United States Patent 6,747,137 (NUCLEIC ACID SEQUENCES RELATING TO CANDIDA ALBICANS FOR DIAGNOSTICS AND THERAPEUTICS) - sequence listing, part 4

SEQ ID NO: 6756 - DNA, 1119 bp, Candida albicans
atgatcccaccacagatatttgggtttatggcttatgggagtttcagtattttgaaatgggctagtttaaagataatcagacagtttgtgtatgatttctttttggtgcaacactgtattttggcatttatgatgttattctcaacatttatccacaatcaaggaaacagggctgtgatgttgatttcggtgcacgggttggttatcgacagggttgttagtaaagtgtttgcatacttgcacgccaaaaagtcgcccaccaaaggtagatgtacattccggatcatcgatgacagcatgatttcggtggtgatacctgtctctgaagttggatacacgtcaaagtattggtacacgagattcctccccaaatacaaaacgtggaaagctggtcagcacatttacttgaatgtggggaaaatcaaattcttccaataccatccattcacgatttctagtcttgctgaaagtggggagatgaaactactcatcagggttgagcgtgggtttaccagaaaactcatgagacatcttgagcaagttgatcatgatgaggtgacaatcaaagctatgttccatggtccatatggtgctaggtatcagccgttgataacttttgatacgtgtctatttttcgctgctggttcgggtggtgcatttacattcccagtttgtcttgatttgttgaaccaaatagatagacgtgatcaggagggtgatgttttgttccgtccaaaaaaccagtttatcaaatttgtgtgggcaatcagaaagcaagataatattgagtggtttgaggattcgttgaaacagtttgctggacggtgttctgttgatatctatattacccaggaaacaaaggaagaattgccactacaaagaaagaatctgatcattgaaataacaaaatcgttaaccaacgattataatattttgtatgggagaccacaaattcaagatataatacaacagcactctcagctgctaggagctaaccagtcgatggcagttacttcatgtggctcgccatcattcacaaactccatcaaacatcattgtcaaagtgctagaagggtgaaaggtgcaccggaagtgtattgttatacagagtcgttttag

SEQ ID NO: 6757 - DNA, 1221 bp, Candida albicans
gaaccttggtgtaagtattttttttttcgatttttttttcctcgctcacacaatatccgccacgaattcaaattctcctgtatcattcaaaacgaaaacacttttgggttgctcttaaattttcagctggggtccaacttcgtcaaccaacacatacccatactcacggagaaaccaatgtcacaatacatcgggaagacaatttctcttatttctaataaggggcttcgttatgttggtcttttagagaacatcaatgcagatgatgcaaccgttgctttgaagtcagtgagattattcggtactgaaggtcgtatggcagcaatgggtcaacctaatttggaagttcctcctggtgttgatgtatatgactatgttgtgtttagaggttcagacgttaaagacttgtctgttttggatactcctattgatgaagttaaaccaaacatttatcgccctccacaacaacagcaacaacagggagcaaccactggtcaatactattctggtcctacatctacatcttctcagaatggtactcctcaaacccaaactcaagctcctgccacaacatcaacaacaactgcctctcaatcttatgggcaaactagttcaagtgctccaactcaagcttctccagctcaagcagtaccagctcaaccagtccaaacttctgccccagaagcttccacttcatatcaacagcctactaaaactgtaaaagaagaacaggcaaccaagactgtcgctgatgatcaaccggctgatgctcaaccaggatcagctccacaaccaacagctactaacccatcttccaatcagctgcaacagcaacaacagcaaccaagaaagggatcaaaggtggagattccaaccgaggaatttgattttgaacaagcgaatgccaaattttccaaggaattagaacaagaacgtgaactagaacacgctggatataacaaaagctcatcattttttgataatatctcctcatcaactgatgaaagaacaaatatgagatggcatgaagaaagaaatttgaatatggatacttttggtgaagcttcattgcaaagaggtagaggtagaggaagaggcagaggcggaagaggcaattggagaggcagaggtaattatcgtggtagaggtggtaactggagaggtggtaatagcaaccgaggaagaaacagtgattacaatactaaaccagaatgggcgtaa

SEQ ID NO: 6758 - DNA, 558 bp, Candida albicans
tattacaatactattacttctactaatatgactgacggtaaattcccaactaacattgaaccaaaatacattccttattctaaagatcatgcaagtttaactgcttgtgctaatccaataccattggatttaaaatctttatttccaaataatactgttgttgtcactgctgtgcctggtgcttttaccccaacttgtactgaacaacatatccctgattatttgaaacatttgaaagatttcaaagacaagggcgtcaaaaaaatcattgttttatctgccaatgatccatttgtaatggcagcttgggctaaagctttgggttatactgatgaagaaaattatgttatttttgctactgatcctaatgcttctatttctaaagaattgggtgatggatttgttgctgatttgactctggcaggtatgggattaagattacaaagatatgctagtattgttgttaatggagaaatcacttatttggaaactgaatatagtttgggattcctggaaatttctagtgctgaaaccattttaaagagaatccacaattaa

SEQ ID NO: 6759 - DNA, 633 bp, Candida albicans
gacgaacagccaaaaaaacaaaaaaataccgatgctatttaccaaccctctttcttcaattatctatactcctcgatgtcatttaaagaaggttccaagttcccagcaggtgttgaattctcctatattccaattcaattggatgatttagaattaattaaccctttgaaatgtgatgttgccagtcaattaaaactcgacaatttattaaccaaattatccactactgatactcctaatttattaattgtttctgttcctggtgcatttactccaacatgtactgaatctcatcttcccccttatttagaaaacttggccaaattacatgacaaaaaaatcggtgctattgttgttcttgccacaaatgatcaatttgttgttaatgcctggggtaaagttttaattaaagcctatgtgaaaacttctggtaaattccctgaagttatatttgctagtgatggtggatttagtgagaaatatggcttagctggtgatagaggtggaattattagaaataaaagatatgctgctgttatcgattctaaaactaaagatgtggtatatttgggagtggaaactgaaaaaggtgtacaaagttctggaattgatgctgttttagccaagttataa

SEQ ID NO: 6760 - DNA, 738 bp, Candida albicans
atcatgccaactttattccatcgatacaatgagattttacgaaaatatccatttcgaagtaatatgatcactactgggattttcttcgggttaggagatttctttgctcagaaattattccctcataaaaccatccataaagaagtcaacgataagggagaaatcgttgaaactgaacaagtaacgggctatgtgtttgatcgtactgctagagcattgatttatggaactttcttttttgctccaataagtgttctttggcatggtaaaacattacccaagattaaaaacccattgattaacattttcaaacgtaagaaaatggaacaaatccctcatgaaaagaaaaaattacatttttatgatagtgttttccgattaggagttgatcagttgattttccctgggttgatatggatccccctctataatactgtgatggtattattggcacaacatgaaaacccgttcgatgtgatttccaataaactacataataattggtggacagtattgcaagcaagttggacagtatggcctggattccaattgttcaacttatattttatcccagtgcatttgcgtattgtggcactgaacatttgggctactggttggaatggatttttaagttttgtccataatacaaaaggtcatgggaaaggaagtggaagaaagatcgaagaattgcttgatattgaagacgatgctcaagaaatcaccatggtttatgattaa

SEQ ID NO: 6761 - DNA, 675 bp, Candida albicans
catttatacaatcacaattacaattacaatcttttagacactttaataaaccagatacaccccttttttttttacttagacttacaaatgaaatacatatttaatagatacaatgcattattacttagaagaccattgatcaccaatatgatcaccacgggattattagttggtggtggcgatgcattagcccaattcttctttcccaacaatgataacaacaatctagaacaacaaccatttgattatttgagaaaccttcgagccatcatatatggatcattaatatttgctcctataggcgacaaatggtataaattcttaaacaccaaagttgtatggacaagaaatgctcaaaaacctcaatatcaacgatcaatgtcgactctattacgagtaatggttgatcaattggtgtttgccccatttattggtatcccattatactatagttcaatgacaattttagaaaatagacaaccattcttagataatataattgataaatttaatactagttggtggatcactttgaaaagcaattggttagtgtggccattattccaattcttcaatttttatttattaccagttcaatttagattattggcagttaatattattagtattggatggaacacatatttgagttatgtcatgcatagccagaaatag

SEQ ID NO: 6762 - DNA, 483 bp, Candida albicans
tttgataataaattaatggatccaattttacaatttactactattattagaaatttgggttatgctggttatttaactattgatgctattgtatttttcaaattattaggaattattgataaaaagaaatatcctaatttaggtaaatatgcttcaagattttggttacttggtttaattgctggattaataaattctttaagaataatttatagtttgaattcttatgaaaatgatcaaaaaaacacccaagatgaaaaggtaaaggtaaaggaaactgaaactgaaactgaaactaaagctgatactgttgctattaatcaaaaattatatcaagctaaaagaaaattgatttgggatttattagatacttttattgcattgaattctttagatatcttgcatttcactgaaggtgatgttggtttagctggggttataacttcattattaggtttacaagatttatggaaagccacttga

SEQ ID NO: 6763 - DNA, 549 bp, Candida albicans
atcaataacattttacttcatatcaaacatactattaatcccataatgtcagacaaagaagctttgaaaatattctcaagacagccagtatcacaagatatggtcaactttctagttgcaaccaccaattctattatacaagtcaaaccactgaagagaaaccagcatcacagaaaactatcatcaacttcttctaccattatatcaccttataaccatagtatttccttgacgaattttattaaaaatttaataaattattccaacgtacaaactcctacattaatggccaccatagtataccttaacaaactacgcaatctattacctgccaatgccatatggatggaaactactagacatcgtatatttttaagtgctttgataattgctgctaaatcattaaacgatagttcaccattaaataaacattggacaaaatacactgatgggttattaactcttgaagaagttaatttagctgaacgtgaattgttaaatattttaaattggaaaaccaatattacaaatggaagaattgaattatag

SEQ ID NO: 6764 - DNA, 1146 bp, Candida albicans
ctactacacatcaacatcttcattatgatttcttcaattgatttacaagctttaaaagtatttcttaatggtccaatcactcatgatatgatccataagattgttgttgctactttacaagttatcccttgtgaagacaccaaaagtaaaacttatacttcatctaataatactattaaacaattaccttcattaatgacatttttaactaaattagtgaaatatactaatgtttatactggtacattaatggcaacattaatttatttacaaaaattgaaatcaagattacctaaaaatgctcatggattaccttgtactagacatagaattttattgagttgtttaattttatcatctaaatttcataatgattcatcacctaaaaataaacattgggctaaatataccgatggattatttaatgtcaaagatattaatttaatggaaagacaattgattttcttgttgaattgggatttaaaagttactaatgaagaaatgtgtcaatctttacaaagctttttggaaccaatcaaaactgatattattaaacaagaaaaattccaaaaatatcttcaacaaaaaaatcaagaaaccaaacaaatggccaatgctgccgttgctgtatccatttctgctacaactactcctgtcactttatcaagatcaagtacaagtaccagtacaagttcacttgtttcttcagcaagcagttgttctggacgttcttcaagatattcatcaatttccccagatcatttatcaccaatgcattatagcaacactaacaataatcattatcgtcaagattcatcaagttatatttcttctattggttcaaataattctccaagtagtgtttattcaataagtccaaaacataatcataaatctattattaccaacaattatagccacaacaacaacaatggtggtggtggtggtggtagtggtgttcgtcaaatcattgatccaataattgaattgacggcacaaaaagaagaattagaattgaaaaatttcttatcaagaaaatttggtaccaccaccaccaccacaacaacaaccactagtactggtaataacaattatggatatggttatcatgcagcttatggttataatgttgccaataacttttaa

SEQ ID NO: 6765 - DNA, 708 bp, Candida albicans
cgctggtcgaagacatatgaagaatatcttgacaatttgggtaaatataacaagtatttgttgaaaccacatttatatagtcaaccattgactaaaccaacaccgccacctccatttaaacctttgattgccattagtgctgggtttgatgcatcgcaatacgaaaatcctcaaatgcaacgacatgggatcaatgtccctacatcgttttattcaacattcactaaagatgtggttaaactagccaaaattcataccaatggcaaagtattatcatttttagaaggtggatattctgatggtgctctttcaacagggatattttcccatttaattggattaaacaatgatgatgaatttttatggaatcattcttgggggtcacaacaagttatgaaagaattggttaaagggtgtaaaaaaaattggtctccgtataaaaaacctcaaagtgacattacaatttgggccaacgaagtaattaaattgggtagagccatgatgcctaatgcgatattaccgacaaattatgtttatgatgatcaaactaaacaattgaatagaccaataaataaaatggtgaaagaattgatggattctagaggagaagctgttgaagtcagtagtccaataagaaaagatcctgaagatgataggaaagttatgagacacacaaggtcatattacaagaaggtatccaatatatag

SEQ ID NO: 6766 - DNA, 528 bp, Candida albicans
tcatggttatctacaagttttgaacgtccacaacgattattggcaagttgtattggggtggcatcagcagtatcaatgtttcccttttattataaagtgataaattcaactaaacgaggttcagtattttcgtcgcatgttcgtaaaatccatggtcgtaattggccgaaaaaattatttgaattgtgtcttgaatcccatgaaaaattaaataatgatgaattggaagtgcctgaagattggaatgttggagatatttatttaacccctaaaactataaatgctatagaaggagtaattggaaccattgaaagtgctgttgattctttatttctgaaaaggaaaaaagaaaatcacaatcttgcatttgttgtcataagaccaccgggacatcatagtcatgcttgtttacctagtgggttttgtttattgaataatgttcaaataggtattgaatatgcttttgaacaatatggtgttactcattgtgccattttagatattgatttgcatcatggtgatggttca

SEQ ID NO: 6767 - DNA, 1326 bp, Candida albicans
agccaaccgtttgctttttctttttcagttacaaatcttaactttatatcaacaatgccaactgaaccaatccgttatgttactaaagtagaccttacaaaaccgggtgatcaacaacctcatctccacaatagatggcatccggatatcccttttgcagagacaatcaagccaggtgaaacagtgaaaattgagtgtttcgactggacgggaaatcaaattaaaaacaacgatactgcagatgacatcttaaatgtcgatttaagcagaatccactacttgtcaggaccattcaatattgaaggagctgaacctggagatgccttggttgtggaaatcaaagacgtgcaaccattagaaagacagccttgggggtactgtggtattttccataaaaagaatggaggaggatttttagacaagttttaccccgaggcagcaaaagctatttttgatttagaaggtatccatgtaacatcgaggcatattcttcatttcaagtttaccggattgattcaccccggaataatgggcacggcaccatctgcagaagttttgaaagaatggaattccagagagataggtttaatcaatgacattcaacatcagcatgaaaccaatgttgcaaatggaccgttagaaaccaattctcatcctggtagtgctacaggaactcttgctctgaaaattgccaaagaaggtgctcggactatacctggaagaccagaaaatggtggaaactgtgatattaaaaacctttctcgtggatccaagtgctatctcccagtttatgttgacggagcaaagctttcagttggagatttgcatttttcacaaggcgatggtgagatttccttttgcggggcaattgagatgccaggagtaataacaatcaaagtatctatcatcaagggtggcattaaaaaattatccttaaaaagtccaatattcatcccaggtgacgttcaaaatcattacggaccttcgagatacttgacatttgaagggttttctgtagatgaagctgggaaacaacagtatttgtgtgcaacaacagcttacagacaagcttgtattagagctattgagtacttgagaaaatttggttacaacgattatcaaatctacttattgctttccagtgcacctattgagggtcatattgctggaatagttgatgttcctaatgcatgcacaaccttgggtatcccaatggatatttttgactttgatattagtccagaaggaaactttgaagaaaaagatatgaaaaattgtgcattcgttgaaggagctaaacatagtgtaacatacgactataaataa

SEQ ID NO: 6768 - DNA, 216 bp, Candida albicans
tttgctaatttggcagcattgccaacgggcaaatttgctctacgagcgttgggtcaatcactggcgcgagaattcgggccgaagggttcccacgtttctcacgtcatcatcgatggggtcatagatattcccagaacgaaggcttggacattcgagcatgaagacgctaaacttgacccagacgctgtaagatgctttttcctcgtttggaattga

SEQ ID NO: 6769 - DNA, 225 bp, Candida albicans
ttactgataatgattttgagttttttcaaagttttcaacattttcctcacatcagtgacattcaagttccaattctcccgagcatttatatttaatttgatatctttattttcactctctaacatagatactaaaaatggcgatatcactcgaaggttacaatttctgacatctaaggattttaatgatagtggtaatttaatcgggtttacattctggagttga

SEQ ID NO: 6770 - DNA, 420 bp, Candida albicans
acgtctcaacacgagcaatatccttttgtaggacatgtgtgtatgtgtttggggattcctccacctctctcaatcgttcacgtaaagacatggttaaaaaaaacaacaacaacaacaacaaaaaaaatttttctcttgccttctttatcaaccatgtcaagtttatctaccacggctattcagagccttgatgaggcttctagaaaagagattatgcagtttgttgagtctgaacagtcaaagtccaaggtccagctgtcgatccataactttacagatatgtgttttaaaaagtgcaacaaagataagccgatcacgagtgctacattagacggacaagaggaggcgtgtcttaagaattgtttgaacaggtttttagatacaaatatcaaggttgttgaagcattacaagggcgttaa

SEQ ID NO: 6771 - DNA, 570 bp, Candida albicans
tgcagcagaaagttggttaatgttgatatgatgatgttgttgttgttttctgatttgttgtggtttttcttttttgcgtgtaggtgtgtgtgcgttaattttcttcaaaagcgtgtgtcttttctcatatgcagtccgccattcaaaaattgtgcaaagtacgggaaaagattccacctccacttaccaccactaaccatttaccaccaaaaacttctggtcgtggtagaaaaaaaaaaagagaccaaaatcaaagcaataccaccagcatcccttaaacacactgttatatacattgatatgggaaatataatgtcagtttcatttgctccagaatgtacaccagctaaaaatgcttatgatgattgttttaataaatggtacacagagaaatttttaaaaggtaaatcaatggaaaatgaatgtacagaattttgggatacctatattacttgtataaatgcaaatttggcaaaacaagggatcaaaccaatgttagataaagctagagaagatcaaccttttgatcatcaagaaattaaagaaagtttgaataatgaaaagaaatga

SEQ ID NO: 6772 - DNA, 2436 bp, Candida albicans
attgcttgcgcggatgtccggtcccccgtggtgaagacgcccccaagactatccgttagaaagaaatacaacgccaccgaaatggaccgccacaaccgcaactatgaaaagaagtttagcaagaaattgaaggaactaaatgtcaaacgacagacagaacacacgcaaccgaccaccagaaaactcgtcaaactttctgaagcagatattgaaaagtcaaccaccaccagaatcatgctgcttcttgaaacccctaccccccaatcattcgaagatatactcgaccttatcgatgtgccccaaaccatactcaacaccgaccaatccagacaggtaatatcagtgtgcaaaaaatacttggcagaaaccgttcccgagttgtccaccaccactccggacattatgggaccaatgtcggcatccctttgcatagccacagtgatgaacaaaaacaggttcgacttgaaattccgcgttgacgatactttctcagaagtggcacagctagtatactggtttgtccataccatgttgactcccgaacacataccacgtatggagggtccgatcctatacatttgtgacttgctcaaaaagctttcatttatgagtacaatcgtgctttgtgacgaagaatcactcaccaaattcgaaatatccgccatccacatcttatttgaagagctggacccagagttcttactcaagcacgctacagcaacattccttgccgatctctaccacctgagctatatccaaagaaagtttttgctaaatgagttgacaacaaacttcctcagattgcccaccaaaaagtccgaagctagaaattatagaacccacagggggtttaacatcctggtgtttactgctgtcgccgtcaaattcgctcgagaagagtcagatgcaaatgtgcttgcccgggaattggttctgcgagtaacctccaacttcgacgctaccgccaagaccttacttgaattgctagttgaagatttgatccacctcctaccatttggcgaatgggcagcttcggcggcattgctttatgggcttgctactaccatgttggcagaaatgaaaaacccggccgtggaagtctttttcttggaacttttgggaaccatatcctcaagcgtgcacgaagttaaacacctgttccatccaaatttcctaaaaccagcctttgaagagtgtttggagtacggatctgacactgaccttaactacgtgacacatgccgtgtatgataaacaccctcgatcccgcaaacgatatatcgagctcttggtgcttgatttggataaattctgcaacgcatacttgactttgctaggcaagtgtttgaactcccccaaaacaaaactcaaaaccaaagcagtaaaagtgttgagtgtgttgtccgacaaacagccaaacttactaaattccaaggtcttgcagctggcattgtcggccagactctgtgacgatgccaccctggtcagggacgcagtatacgagcttattggcaaatacatcaaagcccacccaaacgaagccgacaatttctacaactcactatgcaacgccctatccgatgaaggggtttcggtcagaaaaaaggcaatcagactcaccagagacatctaccccatgttcagcgaaacttcacgcatctccattgccaccaaaatgttgaaacgacttaacgacgaagaagataatataagaaaagaagcagcatcaatgttggtcgactgctggataagaaaacatttggtgctggaaatgattacccttgcaatgtctcaccacaaaactttggagggtttggaaacgttccttgaatcgtatgtgtttcccgaaaaagaattgcagccccacctaaaacagcttgtggaaacacttttggatatgcagactgaaggtgccctattgcttctctcagtgtgcagcagtggcaaacccgacctaataggccaagacctgctcatagccttgcagccattcttgactgacgccaataacgtcacccaaaagtcctaccaatacggactaaaagtattgaggtgtgccttgcctcacatcacttccttacgtcctgactttatcgacccactccaagaattcttatttgccaaactcaccaaaatgactaaaaaagaactacacgaggccgtaccaagtttatggcaactatgcaaaatcaaacaggatttcgccaaactcgtcaatgccgtcatatccaccatgaaaatgatttggaagaataccgagccccaccggctcgccaaattaatccagctcttggcatgtttggaaaaacattgtgatttagaaaggttccgtgaaatgtttgccaaagctaatcttggcctcaaaacgaacgaatcggtcgtgtcattgtctgtcaaggtattgaccagccggctggaaagtcaacgtcccgaaggc

SEQ ID NO: 6773 - DNA, 357 bp, Candida albicans
aaaaatcaatttcattacaaagccatggcaccagctaaaaagaatcaacttagtacagaaaatgccttagcatctgtgcaagtgtatatgcaacaacaataccgtccatactcagttagcgatatcctattaaacatgcacaatgttttgaccaaaccgaaattgataacaatattagacaccttggttgctgatcaacagttagtttgcaaaacaattggaaaggcatcatattatgtatccaaaaaacaagagtgcgtttcggataacacttccaagactgaaacaagtgaatgtttgaaccaacaaattaaagatttgaaacaagagatctgtcacttgaaattgagtatgtaa

SEQ ID NO: 6774 - DNA, 777 bp, Candida albicans
aatataatgacaattgaatcaaatttagaatccaatagatctgaagaattagataatttattaacccaattaaaacctcggttacttgcttatattgatgaagctgatcctaaatcatccaattataaaccagaatccttgggtactttccatgaaccaaaatttttaaagcaacaatttattgatcccgataatgatttagataaaccatgcagtgaagaagaattatttgaaactattgataaagtattgaaattttcagtaaatacttggaaccctggatttttagataaactatatgcctcaaataatcctattggggtgatttctgatatattattgagtattttaaataccaattctcatgtttatactgtttcaccagtgttatcagtgcttgaaaattatattggtaaaaaatatgctcaattatttttccataatgaaacttgtggggggttaacttttagtggtgggtcttggtccaatattaccagtttgcaaattgccagatcgttgaaatatcctgatactaaagtcaagggcaatggtaattacaagtttgccttgtatactagtaaacattgtcattattctgttgaaaaaggggctatcttattgggattgggatcagaaaatgtatttaaagttgatgttgatgaaaatggtgtaatggatgttgattctttgaaacaagtgattgaaaaaaccaagaaagaaggctataccccattatatattaatgccacgtcttccccacggggtagaaatccgcgt

SEQ ID NO: 6775 - DNA, 2859 bp, Candida albicans
gttgattcttgctattcaattattggaaaattattcacttattattacagtggattatttgtgtttgaacaggagttacggaccttggacaaacaatatgatttcaaaaaatttagatccaccaaggatttaactcatcaaattgagaaaacattgactaactttgattattccttgttgcacgatgttgatgccaatcatactttttttaaaatgtttatccaatgcagtcgttattcagaattgaacaagattttgaaaactatttccaatatcaatttgagagatatcaaaaacatacttaaggatcctcaatacaatgattattttgaagcagccgttcaaaactgcattaaaatggaagataaagactttgaaatggtagatcaatggaatgaaggcggcggattgtattattttttgacactgatgaaaatgatccctgctactcatgactactataagttagcacctttattgtttgcattaagtaaagataaagggatctttgctagtgctgctggtgagcttttgcgaattctcacaaacgaagaagtcaggggtcctatcaatgtggcatccatggtggatgacaaacaaaagtttcctatctacgcaataactaagaataattttacaaattatgtttttagtttcttgaagctgattgattttccctgggaatcagcaagagacaccgaaaactgggatactgaaaacttgggaattgaaaataacgtgtttggcaaagggactatgtacgattacttgacaacaaaccaatactttatccggagaatattttcagatcctaacattaccataaaatacatggagttgagagcaaaaccttcattcttttgtttacctaaggatcacgaaatttcgaaagatgttgccgagttgaagaaattaagagagtcgttgcaaacttcatttgcatcattcaaaactatcgacagattacttgaaagtattagtaaattaggaactctgggaactgataagaatctcattttgtctcatttattagatgcatctcgttattttggtaacaatacattcgttttagatgatgttattgatgaggaagttaaaaatggccaacctgttgcaaaacacgatagttattctcaaatgcccgattggcttcatcttgaaagtcatgtcccagaaatcaactttttaaaactgaaagttggcaattttagcgacaagaatgcagtaatgactgtgattgaaaacttaacaaatgaaatcattgctgaagaaaatgctcatccagaaatcaatgccaacagttttttgaagttaagatctaagctaattgagtttagtataaataatgttaatgattgtttggaggtgttggacacagttgttgttaatcaagatgcctttgagaaatttgaacaaaaattaggtgataaaaagatacccgctgtttatattcagattcctgatgattttcctttacacgaatttgtcgaagaattatctgagctaagagaagttttgggtaaaccttttagtgaaactaatgttgacgaaatattgaatcaagtacagaagtttttagaaaaacaagatttgattgcaatagataagactgtaatttggagaaaattgtaccggaatttggcaatgttattcaaacataacaacaataacacttttgttttggataatgtcatatctagtgcacaagagtttaaaaagtttgaaactaatcacctgaaaaatgatcaaaaccaaacagctattggaagtcaaggacagttgttggttggaactgcttatgaagtattaggtgagtttttaagagatagtgggatattgtataaaccagatgttcacaacattagtgccagtgaatttgataaattaattgaccaatatgccgataaattggataaatcgagttctacatatctattccgcaagaatatattggaccagttgaagcaatggaactcacaaattgaattttacccaccctttttggtttgcatttatggtacaaactatactgatgaattaccatttgcatcaactcaattggaaatgttttatgatgatttagtgaaaagcttaaaagatgttgctgaggagcaaaaggctgcagaggctgaaaatatagtagctccagtcgatacaaaacttgccattgatcaattcaaaaaagatgtgaaagacaaagttaaatataatgattctgggaaactttttgctgatttagataaaaagaacagtgcagcagattttgaagctatcaaattggcagtacattctgcatttgaagaacctcatgaacatgttgttataacaaccaatgaagaagttgccaaacacaaaaaagaacttaatcgtgtaagtggagaactgcctttgaaaactgaaccacatactgttgatacgtctaaattggagaaatatttacaagaagctaaaaaattagaagaaagcaaaaagagagaaaaggaagcttttgaatggagtaaacaaactaaagcaccttcgagagcctacagttttgtgagatcaatattggccacatcaggattagtgttgttgagtttaattggaattgatttttacatgaaagaaacagataagtctagtagtaaaactattactgattatcaaaatgaggagaacaacaaattgtcgagaacttcaacaacaactggtccatttactgtgagtacaatatcaggtggtacacctgatgtacctgtgatttttggtaaagaaaagattaaactggtttttaattgggattccactgaaaacgtatcagtcaatgatgatgataataaacaaatgtcctggtggcaaaaattattctggaagaagtaa

SEQ ID NO: 6776 - DNA, 1047 bp, Candida albicans
agaaaaaatcaaaatatacaacaaacaacaacatcaaaaaaaaaaaaaaaaacgtatgtagaaagctattctttacaaccaacaactgtcaaactgtatctgatgtctgaagattcatctcccccacctccattacctgctagaaaatcattggattcaatttcgattgagactgaaatcagtaagaaacttccggatcttccttcagcagcaaatgccaatcaacgaattagttttgatttgaatgattcagtctcacagatatctgccgttagacaatgggagatctacacctctcttcaattgaatgagacatctgacatctttgtgaacaatgcaattggacaaaatacaatcagaaccaagttgaacgagttgaaagatgaccacaccaaattttggatcgatatgaatgattattccagcctgattttacttcccaagaggataaataaattggaagaagagattttgacggggataccactgaatattaggtacttggtatatttgaaaacactacttgttagacaaaaactcaactctagagaaaccttttccagtctattgaccaaatcaaggcaattaagagatgaatatattgagagcttggcagtcgactctagggttagggagattctaattgtttttaattactatgtcaacgagatcaccaattcgaaatttgaaatagagagtgatgaaaacctggagttgatgcagcttccaattagccgatttatcatcaatgtgtgtatattgttgggcacgttccctgaagcttcacaagaggatgtgttgtatttgcttctcaagtttaataaattgtacacgtgtttgaataaggatgagtttttctacaaggtcagcaggtctttagaagagggtttggcagatatcttcaagcacattagcgtgcaaggaatcaatttaaactctttgtttagaagcatcttggttcaactatttagtagtgagttgcttgatgaagaagtccgtttgcgggtttcttcacatcggcactggacggatccaaagctagatgtg

SEQ ID NO: 6777 - DNA, 594 bp, Candida albicans
  unsure (579): Identity of nucleotide sequences at the above locations are unknown.
cgcggttgcttccagccccgtggtgaagataatcaaactgtcccagccttgctcaatgatcctcaatacaatgttggttcgttgactcaaatctccagatccaaacattacattatgagaccacttcctaaattgatttacacgctttaccgtttgttttcattcaattacttcacaatgtattttttcagattgatgtttatttttttctccgaattgaaggttccattgttcaaaggtgaaggaattatttccaattatgtacgtaaattaactactgaagcatctgttctgtacatcaaagaagttgccccagaaaaatatcacgataagcttattccagattacaaaattggttgcaaaagattgatttttgattataactacgttccatctttgaaagatcctagaattgacattaaaaccgaacgcattgataaagttgttgaagatggtattttgttagaaagtggtgaacatattgaagctgacattattgttgcttgtactggttataacttgagcaaaagtcatttcaattttgaaatagttggacgtaaaagtgctgatattactcanctttggaaagaataa

SEQ ID NO: 6778 - DNA, 360 bp, Candida albicans
ggtgaagactggacaattggtggtactaactcaatcactggtcatgcttcagttgttatggggattgaaaatggtgttgattatttcctcaagactgctaaacctgttttccaaggaaaggcaaaatctgttcaagttaaagatgaagcttacgataactggcttactactcttcaaaaagaaatcaacaagtccgtttttggtactccatttggtggttgtgtttcttggtactctggtgcaaaagtcaattctatctcgtacccttggagtcaacttcattactggtggaaaactcaatttcctacctacagagatttgaattatgaaccattagatgaaaacaagaaaagaagataa

SEQ ID NO: 6779 - DNA, 762 bp, Candida albicans
cccacaccgatgtcaactatcactttaacaagagaatctcacaagaacccatcaaaattcagaatcaaccaccaagatgaattggacattttaggtccaaatcgtaaggatcggtatgctatcaacgataaattaccaactataaccacttcttccaaacttgctattattggtgctgggtttggtggtatggccggtgcaatcaaaactatggaaaaatatgacgaacatgatattcaaatttttgaaagacatgacaactttggtggtacttggtacgctaatacttatccaggctgtgctagtgatattcctgctttgtggtattcattttcatttgctttgacatccaattggagtagaattcaaccgccacaatatgaaatggaagagtacattttacgtgttgctgaaaagttcaaattgaaagaaaaaacaagattccaaactgaaatcaacaaagttgaatgggatgatgttaatggtgaatggactttatatgcacacgatgttaaaactggtcaaagaattattcataaaagtaagcttttacttgcatgccaaggtgggttagttcatccattacattttgatgctaaaggattggaaaatttcaagggtccatacatgcattctgctctttgggatcattctgttgattttagagggaaaaaagttgttgttattggtaatgggtgtagtgctaatcaaactgtcccagccttgctcagtcttcacccacgggggctggaaggacccgcg

SEQ ID NO: 6780 - DNA, 1029 bp, Candida albicans
tttggtggtacttggtatgccaacacttacccaggatgtgccagtgatattcctgctttttggtattcattctcatttgcgttgacgtctaactggagtagaattcaaccaccacaatatgaaatggaagaataccttttgagaattgctgaacagtataaattgaaagaaaaaacaagattccaaactgaaatcaataaagttgaatgggatgacgttagtggtgaatggactttatttgcacacgatgttaaaactggtcaaagaatccttcacaaaagtaagcttttacttgcctgtcaaggtggtttagttcaccctattcactttgatgctaaaggattggagaatttcaagggtcactacatgcattcagctctttgggaccattctgttgattttaaaggtaaaaaagttgttgttattggtaatggatgcagtgctaatcaaactgttcttgcgttactcaacaaccctgattacagtgtcggttcgttgactcagatttcaagatccaagcattacattatgagtccacttcctaaaatgatctatacactttaccgtttgttttcactcaactatttcaccatgtattttttccgtttaatgtttattattttttccgaactgagggttcctttgttcaaaggtgaaggtattatttccaactatgtccgtaaagttaccactgaagcatccgttctgtacataaaagaagttgctccagaaaaataccatgacaaacttatcccagattacaagattggttgcaaaagattgatttttgattacagctatgttccttctttgaatgatcctagaattgacatcaaaacagaaggagttgctagagttgttgaagatggtgttatattggaaagtggtgaacacattgaagctgacattattgttgcttgtactggttacaattttactaaaagttatttcaatttcgagattcttggtcgtaacgcaaccagcattacccgtcttcacacacagccggccgaaggtccgctaattagt

SEQ ID NO: 6781 - DNA, 984 bp, Candida albicans
  unsure (84),(152): Identity of nucleotide sequences at the above locations are unknown.
atttccattccatatacacacaagatgtcaacgaaatcagcaaattcaactgctgtcaattcatttaatgcaaaccactccaantatgacgtttttagaccttcattcaccccagttttggtcaatacattcttagtacatcttggattagntacgaaaaacccagatgacactttcacttttgacatatccaaacatattcttgaaattgctgctggtactggtaaattcacccgaaacttggttgataatggttggacagataatttagctgtgttagaacctagtaaaggaatgttagaaacatttaataagaatttccctcaaattaaaaatcaaattcttggatcatcatacaaaatccctcttgaagataattccattgatgcggtgataattgctcaaggtttccattggtttgctgatttggatagtttgaaagaaatctatcgtgttttaaaaccacaagggaaattaggattgatttggaatttcgattatgccagtccaagtcaagattcaagtgttgccgactcggaatacttcaatgcaggtactcaatattataacactttgaattttaatcttgatactaatgaaaaagtgtttgaacaatattttgacaatcaacaatggaacaaagctgcaacaaaatttatatatggtttcgatgttaatgtgcctcagtatcgacacgggaaatggagacaagttttaaaagataatccatatttcagttctgaagaaacaaatttgtttgcattatacgacctaattgttgccaaggatgatgcttggaagtattgggagacaagatcttacattactgagaagtcagacgatgaaaaacaaagaataaaacaaaactttaatgaattggtagagaagaacctcgatgattcaagctattctgataaagataaacaattaataattaaacctatggcaactcatgctgttgtatcacaaaaaaaatcgtcttga

SEQ ID NO: 6782 - DNA, 2475 bp, Candida albicans
atttttagaagactctgtttccttcaagtaacaaataacaatttcattactttttatacccttttcaaaaccacttttaacttgaacatgaatttcattctcacaattatctttctcatatcgaattatttgctagttgttgaatcagttgcaatcaaaaatttgtactcctatttatcacttcacaaaaaagacaatgctggtgatagttccaatgacgtcttcaaaaacgtagacttgttatacggtacagataaaaatggtcacatgttccccggtataacccaaccttttggaatggctaaagtgggagtagacgttaatgatcctggtttcggtgattcttattctggatatgctcctaatggtgtaatcacggggatttctatgatgcacgagattggaactggaggtgctcctcaatatggtgtggtttgtcaactaccttataccgatgaaactttggctggtgatcaagaattatcattacatagaactaagaaagatagtgctaccattggacaatattttgttaatactccaaacattgacatcgagttcacatctggtgaaagaagtggattattcaagtataatttccattctggtgataaagctaatgtattggttaacgcatcacatcatttatcagcacctaaacaaccacaatggacacaacattttgttaaaggttccattaaaacgaaaaacaacaatggatatattggtaaaactaccattaaaggtggttggggtgatcaatctgattggacaatttatttctgtggtgaatttaatgctgatttcaatcaagttaccagttttgctaatggggaaatttcctacaactccaaccaagccaattcaagcaaagttgatgattcaatggggttaagtttccaattcaataaacaagatttgaaaaataatgaacttattagtcgtgttgggatatcatttatctccactgataaagcttgtgcaaatattgaagacgaaaattttgatttcgattcaatggttcaacagaatcaacaacaatggaaaaatgaagttttccagaaatttgaaattcaacatgacaatcaaactgttgttgatcaattttacaccaatttgtatgggattcatttgttaccatctaaccgaactggcgaaaatccaaattgggataatcaggacaatattgtttattatgatgatttctttactatttgggatacattcagaacattaaatccattaatcaatataattaacccaacaagaggtgctgagattgtgcaatcacttgccaatacttacaaaaacgatggatatgctccagatgcccgttcagcaaatcagaatggtcgtgttcaaggtggtaccaattctgatattgtcattgctgatgcttatgtgaagaacgtggcaaacaatgttgattggaaattagcttatgcatcaatggttaaaaatgctgaagttgctccaccatactggtatgacctgtattcaccaactgattcctccaagcaaggtcgtggtgccttaccagactggttgaaatatggatacatcactcgaaactatacccgttctgttagtagaactgttgaatacgcatatgatgattatgcagtttcagttttggctaaagaatttggttcttcagatgatcacgataaatacttgaagcgttcggccaattggcaaaacatttggaatttcgaagcctcaacaaaccattatcattatactggatttctccaaccaaaaaatgctgatggctcatttaattataccagctatgatcctttaaattgttatggatgttattggggtaacgatgaatacgaagctaaaccaattgaatatggttggtcaatgctttatgatatggaaacattgattgaatttattaatcataataataacgacaaagataacgatgcatcattggttattcaacgattagatgatatgtatttattacgtggacatgaaataattgttgatgtggggaatgtaactagttttgctacaccttatttgtttaattttatcaatcaacaatatcgatcagtggaattggtcagatatatcatgaacacatatttcaagacaggagaaagtggattgccaggtaattctgatgctggatcaatgctgtcatgggtaatatttgccatgatgggaatttaccctattcctgctaccactacttacttgatcacatctccatttgtatcaagtttgacaattaatttggaaaatggtgctcaattcaaagtaaaagctaataatctatcagaaaagaatatttatgttcaatcattaaagattaatggcaaaaaatggaataaaaattgggttgatcataatacgttatttgggaaaaatggaggcgccattgaatttgaattgggtgagaatcctgtggtttgggaaactggtgaaagaccacctagtcctggacattataaattataa

SEQ ID NO: 6783 - DNA, 240 bp, Candida albicans
aacttgatgaatttccaaatcactagagtagctagtaccatcagatgcagaagcattgtgttcatcatgagagcctgtttgttcaatgattgggttaacaacttcggcaatttggattttacccaagaattgaccatgtggaatagcaactctcaccaacaatacaacaacagaagcagcaatagcaaagtaaataccagcttcaatggtaacgaaaacagtcaagataacagcaattaa

SEQ ID NO: 6784 - DNA, 1053 bp, Candida albicans
  unsure (1053): Identity of nucleotide sequences at the above locations are unknown.
tttcccattatcgcaatgagttccgcgttacttccaatttcttgtatttcttgtcgaaaaagaaaaataaagtgtaacagaatcaaaccttgtgatcaatgtataaagagacatttaccatgtgaatttccagaaaagtttagaaatatcaaaattcaagaagatgaaataaagcctgaacttgacggtgaacctaaacttgaacctgaggacgatatgaattcgatatatgattacactaggaaaccttctgaaaacctgagcatctcaacaagtggctcggcatcaatactatcttcagcgccaagtaaatcaaccgactcaactgattcaataccaacaagtaccgacagtgccacaaattccgactcccgtgagaaatgtatggttacgaagaatcattcaactgggaaaattagccattcttctccatcagcaatacccataacagttggttcattgaacaattcaattataccttcaagtaaaaatttaatcgacagtgatgcacctaatcaagacagtgacaatttgaccttgttgagagatgattatgacatcatgaaagcggccaatacacagttgttaagtagtaatcgattattaaaacgccaattagaagagttacaacaatcaactcttagtcattttcgtagaagtgatatgagaaattgccacgacaatgcccataagaatggcagctgcagttgcaataaaactaccaaaactattgacaatggtaaccacaataggggagacgctaatgctaatctacttccaaatttgcctagaagtggtgataaacgtgctaatacatctgattcattttctgatgaatcaccaaacaagaaagaaaaagttggagtttttggttactccaaatctagtttccccaaagattcagcaagtcaaaatcaaggaatatattcgaataaccagttcaacgaagacaacagtagtagtccaccaaaggaaacatcaaccacgtccaccgatagtagtagtagtggaggagaaattgggcaaacacccacttttcaaccattattttan

SEQ ID NO: 6785 - DNA, 681 bp, Candida albicans
attaaaggcaatatcaataactaccgtgatagtacacaaaattcagacaatttatttgggcactcgtttattaacactagtcctgttgacaaaaagtcactggaactaattaagaaatatcaagccaatacatctaccactgctgagggaaaaaagaaatccaataaagtacaagaactcattggactgattcgacattttgcctcacagttttttggaaattttcaaaaaacaattggtgacgccaatcaattacaagaaaaatttgcaaaactgtttaacttcaaacactatttgcaaatttatcagaattataaagataaattcttacaaacctatattgggatatttttcagaatcactataaaaagagacaatgaatcaagaataatcaaccccatcaatttctgcaactcaattattgctatatcaaacttgttacaatattcaattgaagaggataagtacgatatcattagtaatgatgacgtttgtaaagttctaaatttacttgagaaaccaattagagccacaacaaactatattgattatttaccagcatcggtttatgtgccgcaaaattctcaacctaaaaagcatagttgcttgatggggaaattacacgatttatctatgcatgagttttatgaaatctgtattcgatttcttcaccacgggtga

SEQ ID NO: 6786 - DNA, 642 bp, Candida albicans
aaattaagtgtggtgtattttgaaattgatgcaactgatgatcaattgattgaatatcaagatcgattagaaattgcaaccacgataacagcaatggcaattcaagaaaacattagtgaaaaaagtccatttgcaattattggctgttctgatgaaacaattcaagtggtctcgttacaggaacacaattgtcttgaaatcaaatctttacaagcattatcggcgaatagttctagtttgaagatgttaaaactgtcgggtaaagagacacatgtacatattggtatggagaatggtgtttatgcaagaatcaaaatagatactataaatgggaatctctcgaatagcagagttaaatatattggttccaaaccggtaagtttaagtgttattaaattttctaatgaaatagaaggaatattagctatttcttcagcaccttggatatcttatttataccgagattctttcaagataacaccattgttggaaattgacattactaatggatcttcattcatatctgaagatattggtggtgaaagaatagttggaataaaagataacaacttgataatattttctgtgggtaaaaaagatagtgtatttgaccccctgcaagatttgaccattgccaccaca

SEQ ID NO: 6787 - DNA, 732 bp, Candida albicans
ctccagaagaaaaagtgtattataaattattatgaattagatcaaggtttgaaccatgttgttaaaaagaaacccaattcgtcaaatctggatccattacccaatgatgttaactatttgatcccgttacctggtcatattggaggtatggttgtttgtgggaccaattggtgtttctatgataaattagatggtcctagaatatatttacctttgccaagacgaaacggacaaacacaagattccattattgttaaccacgttacccatgttttgaagaagaaaaaattttttatattactacaaaacgcattaggtgatttgtttaaattaactgttgattatgattttgataaagaaattattaagaatatatcaattacttattttgatactatcccaccggcactcagtctaaatattttcaagaatggatttttatttgccaatgtattaaataatgataaattgttgtatcaatttgaaaaattgggtgatgatttaacagaaagtgaattggtcatcaattcttcggattatgaaagtgtgaacagtgtccgggaatccgtcacctcatttaagttgaaaggattggataatttggcattgattgacgttttggaaacattgagtcctataactgattctaaaattatagattccaaattagtcactttatcttctcattcatatgtcaaatcgataactcatggtgttccacaactacattag

SEQ ID NO: 6788 - DNA, 594 bp, Candida albicans
caatttgttccatttgctgatgatgtaatgaaacgacaaatcacttcgattatgaatttggatattgatacattaattggtggtgataaatttgggaatatatttgttactcgaatagatgaagatatttcaaaacaagccgatgatgattggacaatattgaaaactcaagatgggattttgaatagttgtccatataaactacaaaatttgattgaatttcatattggagatatcataacttcattcaatttgggttgtttgaatttggctggtactgaaagtgtcatatatactggattacaagggacaattggattattgatcccgttggtttcgaaaagtgaagttgaattgttatttaatttgcaactctatatgcaacaatcacaaaataatcttgttggtaaagatcatttgaaattaagaagttattacaatccaattaaaaatgtgattgatggggatttattagaacgatttttggaatttgatatatcattgaaaattgaaatttctagaaaattgaacaaaagtgttaatgatactgagacaaaattgattcttaaccagccgtggccgatccatcttgat

SEQ ID NO: 6789 - DNA, 210 bp, Candida albicans
ggtagtagaaggtcccaatcaaaacactattcatgcttgccaaaaaacatgacagttgataaaaacaaactagacgagctagtcaagtcttggttatctattgatatgaatccagaatcaagacatgaaatcgagcagttacacattagtgggaactatgaacaattggatagaaagttgtcaaagagaattgcgttcggaactgcttgg

SEQ ID NO: 6790 - DNA, 909 bp, Candida albicans
caaatggtcggtcttacaaaagaacagttaagtacatttgaaagggaaggaatgttgtgcatccctgattttcttacacccgagcaaacagccaaattattggcagaatcgaaaacactcttatctaattgtgacttatcgacacatccgaaaacaacattcaaaactgccgatgacgaccacattggtgataaatatttttttgagtcgtctgataaagtttcatttttctttgatactgacgcatttgataaagatgggaatttgcaagttgatttatccaaagcaataaacaaaatagggcatggattacacattcataatcaattatttcaagaaactacttttgataagaaagtacaagacattgctagaagcttggaatttaaagatcccagagttttacagagtatgtgtattttcaagcaaccaacaacaaagacatccaacaattccagagataatgctgtcccacctcacactgacgctacgtttttatacactgatccacaaactgccattggcttttggtacgcgctagaggattgtactttggacaatggatgtttagcatatattgcgggttcacataagaaataccctgtgacgaaaagatttgttagagttgaaggtggtgccaaaggttgtaatttcaaatacttgaatgataaggagcaggaacctgttattgaagaggaggagtataaatacgttccttgtaaagctggttctttgatcctaattcataattctgttttgcacaagtctgaaaagaatgcttctgacaagtcacgttacgcttatgcatttcatgtaattgatggtaccgcccaatacgatcaattgaattggttacaagttccttatactggtggtactaatttttcgaaattatacaataaagagtaa

SEQ ID NO: 6791 - DNA, 285 bp, Candida albicans
caagtaactataatcataatggcgaattcaaaacaaattttactgttatacaaacaattattagaaaaagcatacaagtttgataactacaacttcaaggaatattccaagagaaaaatcgttgaaacatttaaggctaacaaatccctaacgaacgaaaatgaaataaaccagttttataacgaaggtataaatcaattggcattattgtatagacaaacgaccatttcccagttgtacacttttgacaaattggtggttgaaccattaaagaaacatcaataa

SEQ ID NO: 6792 - DNA, 2088 bp, Candida albicans
aaacaaagaaccaaaaacaaccaggtagcgaagatggcggtgaatgggaatttcaatgactgcatcaactcattttctgatgaagttcaaactacagtcgaagacattttacaaaatagcgatagagactatttaatggaaattccagatgactctttgttcaacaacgggaacatacaattcaaaaatttattggatgatatagatttagattataaattatcaccagacgataatgcaacagaccaagttaagtcccaaattgagaaccacaataccaacattgctaataagtgtaaagaatttgttgttacatccacctttttaaatgtgatcaattcaagagttcaagtatttgtagaatctgatatggccgaagaggcaaagttttttaatgcaattgcattgattttggactttgaagtgtcattgtttcttaatgttgatccaatttttaagcaagtttattatgatagtattctgaaaattacaaaacaattgtttcttatctcaacggcggttatcgagaaattttggtcctatttggagacaagggttcccattattttgaaaaagttatatcaaaatacaccttccgagagaatgtcattgttggagatgtgcaaccatttgactgataatttgattgtgaaaaataaagaaggacagagagactcatataaaaaggatagtttcaacgaccagtttcaggctagagtgaggttttttataacaagcattttaaactttgaagacaatacaggattaaacaagtattttcatgtttccgatagagcttcatctagtatccaaactaaggatccttatttggaagatcttcttgagatacagaaacttttcaacaatccattgcaatatttgaaaagagaaaaccaaaaaaaattaagagtacttgttgggaaagttgagaaggtaagtaaagaattattaatacaagaaaatattttcagatcttcacatccatcatgggaccagtttcttattttaccaccgaaatcggaagctgagaaagattatttgacagagaagttttctaaatcgtcatacgttcctgagaactactttatttcgttgtttcaagaaaatgatagaaaacaacaagcggaagatgctcagatgttgaatgaaataatgagaaagcctgtggcgagaatgcaatgcattcagctgatttatgttgttgcacattttttttcagagttatcagttaaaaataaaaaccagtttttgagttcaatacatgcacctcctaatatcaaacatttcgtggatggtgttttgcccgatgatattgtatcatcttttggtaatgtgaaaaaagatataatgcatactcttagggcgactgatccacattggttgtttctacttcaacatttaacaatatcggaaaagaattggtggagttggcttacttatggaaaaaactctaaaactaacaagtcgttttttttcgataagaacttaacgtcggacgatattcataacacggaggacacgttcaagagcatttacccatataaagataaaaagtatttcaatacctttgtgactcctcaggttactagaaagatgaaaattcaacgggggttatctcaaatagaacgcgctgatgtgttttcaatcaatgattccaaatttgaaattgacactatagacaacgaactttcacagacaactgacgtcaacaatagaaatgagcttttggaaaagaaatcattacttacatggagagtattaagagagcaaagatcatctgactggttgaaagccacccaagctttacgagctaaagcagtttcagatcaagaaagaaatgctgataatgaaacaaaggaagacgattcaggaggtattgctaaatctcaaaaaagaactttgactgagtctgtggatgatgattcacctgaagaaaagaaaataaggttagatgaacaaattaatagtgaaaattctgatgatgtatccgaaaaggatcctcaaaatcatgtgattagtgaagccaatgatgccagcgcggacagtgatggtgaaaatcatgatgcagttgatgtggacatcaagtag

SEQ ID NO: 6793 - DNA, 2217 bp, Candida albicans
  unsure (796): Identity of nucleotide sequences at the above locations are unknown.
caattttacattaggatgggtgattcagaacaatttccttcaccattcaatattaacccaatatatcccaacaaacgacatgcaaagctatcatcaacagacacaaagaccacaccatcacctacccctcaatctcatctgacaccgctaccagcgttaccgaataacaccaatggaaaatccattagcaactctaatggcaacataactaccaacagctttactaccagtatcaacaacacagaaatacatctgaataacaaatttaaagcaaaagatgccgaggatgttattgattggattgatagtttaaaatctcgatatgaacaattgataattcatcaaaaaaatgaattgaatgaaataaccaatgatgagttaatgagaaaacaaaaacaagcaacagttgataaatatctgtcgatgcattttgatcaggactatgaaaaattgggtcatcttcttgaggttcaagatagtcatcatccacaaaaagattcacaaaaagaggaaataatagatagtaatgacgaagatgagcaagaagatgaacaagaggatgaacaagagcaatacgatgaggacaatgaaattattgagattttgtcactggaacctgaagaggaagtatcggaacaaccaacaacacaagaacattacggtcaattccatgaagagttacaatatcctcaaatgacgcatagttataacaataatttccaaatgagtggaatagattatggtactaattataatcaaaacatcgaatatgacgaagaagaagaagaagacgttnatgaggatgagggagacgaatttgacggatttattgatgaacaagctcatgaagttcaaggtagttccaattatgaagatgaggaagatgaagacgaaattatagatgaaggagatcagttcgaagaagaagaagaagaagacgatgagcaatatagttatggaaccggcgcacaataccagcaacgtggatatggtataaccaatgtacctggttacacgatagttaatggtagacctcgattgtcagataatctaggatatggccatgttgaaacttttgataataacgatagcgaagaagaagaagaagaggacacaaatcaagaagaactcagtgaagatgaaattgacgacgaagccaattattttgcacaaaatacccatcagggaaagccagttgagacaattgatttaggcaacaccgaagacgaaagtagagatagtaatgaaagtggttcagccgacgaagatttggaaagtgacctgtccaatgaaaatgaaaatcacctggagagtgagaatctcgatgattcagtcgttgaagggtatgaagcgggacacgaagaagaggagggagaaagggaaggggcaggtattgggcttgaattttattcaaataatgaattgctagattttgctgcaacagcacttttgcagggtaaaattcatgaacacaaatcaaaacactcacaatctggatatatagccgattcagaatttactgacaccaatgttcctgttttgcactcgccaaatactgaaacagaagagggcaaacaatctcagttgaataaccataataacaacattagtaccgttcacagctctaagaaaagtaatgattcttccacaagaatatcatatcgatctgagggactcgccccagttcctgatccattttatgctcatgaattaagcaatgaaaaaatggttgcagttgtcaatgatttcgatgaaaaccgatcagaaggctcactagctgatgaaagtcaatttgaatcaatgaaaccaaaagtgactttaccaaatcaagatgatcctattaatgataatggccaacatcataaagaaaatcaacataaagataatgaatcagtttattcctcatcagatgaaataaatccaccaattccaatattcaaaactattgaagaagaagaaccagaaattgttttacagaaattgaaagaaacagaaaaaaaatataatatcaaaattaatgcagtagaagaattagaacgagagttgcatttgccaattgagcatgcaaatgatgattcgttggtgccggctgtggaatctcatgaagataaaatagtacaatccaatcccgccttagatgaacacgtcgaagacgaggaagaagatcgggaacagaaatatgagcccactatacaatatgaatactctgaaatctaa

SEQ ID NO: 6794 - DNA, 930 bp, Candida albicans
cccagcagcaaaattaatagaaaagttgcatttgaagatggtgatattgatactgagtcacaacaacaagaaaatccctcatcagaagaagatacgcaaggggatcgaaacgttcaatcatccacttcatcgtcaccaccaaattcttcatccactgattcagcattacctgcttcagactcgtctgatattggaggtaccaataaatctaaaacaacaagtcatggcaacaataaaaatatcaatgcaaagaaacgaatcataacaaattcttctgcatcttcaactaagggtaccaagagacacaccaataatgatggtggtggtggtgttaatggtaatcatagtgatgataataaagaccttacccttacaattgataaaccactgttatttactcgaggatcaactggtactgccaattccggtaccacttcatctcattccgataaaaaaatactttatccaacacctacaactactacaacaacaacaacaacaacagaccatactactgtattggatgatatatcacatttgagagttttagtagctgaagataatctggtgaatcaagaagttatttcacggatgttaaaacaagaaggaataactaatcttactatggcatgtaatggagctaaagccattgattttgttaaagaatcaattgaaaataatgaaaattttgatttaatatttatggatgttcaaatgcctgaagttgatggattaaaagctacaaaaatgattagaaaaaatttacaatataataaaccaattattgccttaacagcatttgctgatgaaagtaatgttaaagaatgtttgaattctggtatgagtggatttattacaaaaccaattagtaaaactaatataaagaaagttcttgttgaatttttatcaaatgaagtcgttacttcataa

SEQ ID NO: 6795 - DNA, 1851 bp, Candida albicans
actatgaggagattaaagattgggattcgaccccaattaatcataattgtttgttttgcatcgttgttttcattattgattttgggtattgtaacaggaatatattttagtgccaatttaaaaaacctacgattagaaagactactagttatatcccaattaaaaagaactcaagtacaacaagcaatacaatatattgcctatcaagtgatgacagtatcggaagtagattcattaacggttccattatcaaattatcgagctggtaataattccaaagcagttttcctggaagcacaaaattatttacaacaatatgtccttaccactgattcatttactgcagctagattatatgatttggatttacaagttgtagcatctagttttgataatatgactttaatttctgaaagtgctcaagatgtggtttatcctttacaaccaaatagatcaatgcctccggtattaggtactccactgggattatattttactggtcccattgccaataattcggataattttaattcaaggtattttatggggatcaccgtaccggtgctatcgaatagttcgattattttactgcagccatcaatttcagggtatctcaccattgtagcagcagcagaatccattcgttcagcattaaattctactagtgaagatgattatcaagctatggcagtacaaccagtatatggagatcctcaaaaggggatagataatctactgcaaaatgcttataatggagacaatgaagttattggattcaaattagttttcccagtggaaaatagtttattagaagctggtaccatatataatatcaattcatcttcatcgatgaaaactgcattagcatcaaattccggtacagcaactggcgtcaaatcattttttggtaaaaaagttgccattggattttcaagaataagtgttcaagataatttaaattggtcaattgttattgttcaatctaattctgttttcaatgggcccgctaataaactacgaaaaataactataggcgttgtcattggaattggagcattcatgtgttttgttacattcccgttggcagtttggtttatacggccgattacaaaattaaaagaggccacagaagccattaccaaatacaaaaaggaaaaattaaatagtgtcaacagtaatagccccacttctggttctggttctggttctggatctggttctggatcaagagctaattcagattcttcagcagaccaatcactactgttagatacggggaaacgaaatagtataaattcgtcatcattttcatcaagttattctacggggataagactaccggcaagaataccaagatcgaaaaaaatatttaaagatgaattgactgaattatcagaagcatttaatattatgacagaagaattagataaacaatatactcatttagaggatcgagtgaaattacgtacaaaagaattggaagcatctaaaattcaagccgaagcagctaatgaagctaaaactgttttcattgctaatatatctcatgaattacgtacacccttaaatggtatattaggtatgacctcaattgccatggaagaagaagatcctaatgtaattcatgattcattaaagttaattcatcgatctggagaattattattacatattttaactgaattattaacatattctaaaaatactttaaatcgatcaaaattagaaaaatctaatttccaaattttagaaattgtttatcaagttcgatcaatttttaataaattagctcatgatcaaagagttaattttaaaattttagtgaaacccaaatatgttcccaaaaattaa

SEQ ID NO: 6796 - DNA, 186 bp, Candida albicans
ttatctaattcattaaaatttactcctgtggatggatcaatatcggtttcatttaaattgttaggtgaatatgatcatgaaaggtctaaaaaatgggataataaaaaagtctgtattttgaatgattctattagtaataccgtaacagtggcccctccaaaacctccatccgaatacttaacctaa

SEQ ID NO: 6797 - DNA, 1020 bp, Candida albicans
ctcggccggagcgcggatcaagcgcgggtccttccagccccgtggcgaagacccatatttgaatcacaatttaaatcaaaaccattacctgctttgcccgtagatgcaaaaccacaagtatcgggaaaaatagatgagaatgacgttaatgacgaagaccctagtggtggcagtattaaggatgatgatagcgaggataccataaatgaaaagcaaggtattctgtcatcgccttcttcttcttcttcctccaatgaaaagcaagagaatctgcctcggtcaaatgattctacaacggtgactgttacacgaccacgtcataatatgatgcctctggctcaagatttcaaaagttatccaacatttgataaaaaaccagaatatgattctaatatgtctaataatgaaattgttaaaaataatcgagtatatagaattcgaaatatgtatcaaccaaaagtttgggtaattcagattgaagttacagatacagggccaggtattgaacccgcattacaagaaaaagtatttgaaccatttgttcaaggtgatcaaacattatcaagaagttatggtggtacgggattaggattaagtatatgtcgacaattagccacaatgatgcatggaactttaactttaaaatcaaccattggtaaaggttcaactttcacattaactttaccattaccacaaactggagaaattatggtacctcctgaagatatggcagaattttgtgaagatgaatttaacccagcagcaaaattaatagaaaagttgcatttgaagatggtgatattgatactgagtcacaacaacaagaaaatccctcatcagaagaagatacgcaaggggatcgaaacgttcaatcatccacttcatcgtcaccaccaaattcttcatccactgattcagcattacctgcttcagactcgtctgatattggaggtaccaataaatctaaaacaacaagtcatggcaacaataaaaatatcaatgcaaagaaacgaatcataa

SEQ ID NO: 6798 - DNA, 729 bp, Candida albicans
acccgtggtgaagacccatgttcgatcacggacttggccagtgcgattataccagcgttggagtcgagatctatatcacagaactcagacgagtcggtgaggtacaaaatattactagcagaggacaacctcgtcaatcagaaacttgcagttaggatattagaaaagcaagggcatctggtggaagtagttgagaacggactcgaggcgtacgaagcgattaagaggaataaatatgatgtggtgttgatggatgtgcaaatgcctgtaatgggtgggtttgaagctacggagaatattcgacaatgggagaaaaagtctaacccaattgactcgttgacgtttaggactccaattattgccctcactgcacacgccatgttaggtgatagagaaaagtcattggccaaggggatggacgattatgtgagtaagccattgaagccgaaattgttaatgcagacgataaacaagtgtattcataatattaaccagttgaaagaattgtcgagaaatagtaggggtagcgattttgcaaagaagatgacccgaaacacacccggaagcacgacccgtcaggggagtgatgaggggagtgtagaggacatgattggggacactccccgtcaagggactgttgagggagggggtacaagtagtagaccagtacagagaaggtctgccacagaggggtcgatcactacaattagtgaacaaatcgaccgttag

SEQ ID NO: 6799 - DNA, 282 bp, Candida albicans
acgcggttcttccagccccttggcgaatacgtggcggatgttgaaggtgcttggaaacaggttacagaaaatgtcaacctaatggctactaatttaactaaccaagtgagatctattgctacagttactactgcagttgcgcatggtgatttgtcgcaaaagattgatgttcatgcccaggggagagattttacaattgaaaaatacaatcaacaagatggtggactctttgcagttgtttgcatcagaagtgtcgaaagtggcacaagatgttggtattaa

SEQ ID NO: 6800 - DNA, 1197 bp, Candida albicans
  unsure (938),(1042),(1050): Identity of nucleotide sequences at the above locations are unknown.
gatctattgctacagttactactgcagttgcgcatggtgatttgtcgcaaaagattgatgttcatgcccaggggagagattttacaattgaaaaatacaatcaacaagatggtggactctttgcagttgtttgcatcagaagtgtcgaaagtggcacaagatgttggtattaatggaaaattaggtattcaagcacaagttagtgatgttgatggattatggaaggaaattacgtctaatgtaaataccatggcttcaaatttgacttcgcaagtgagagcttttgcacagattactgctgctgctactgatggggatttcactagatttattactgttgaagcactgggagagatggatgcgttgaaaacaaagattaatcaaatggtgtttaacttaagggaatcgcttcaaaggaatactgcggctagagaagctgctgagttggccaatagtgcgaaatccgagtttttagcaaacatgtcgcatgagattagaacaccattgaatgggattattggaatgacccagttgtcacttgatacagagttgacacagtaccaacgagagatgttgtcgattgtgcataacttggcaaattccttgttgaccattatagacgatatattggatatttctaagattgaggcgaatagaatgacggtggaacagattgatttttcattaagagggacagtgtttggtgcattgaaaacgttagccgtcaaagctattgaaaaaaacctagacttgacctatcaatgtgattcatcgtttccagataatcttattggagatagttttagattacgacaagttattcttaacttggctggtaatgctattaagtttactaaagaggggaaagttagtgttagtgtgaaaaagtctgataaaatggtgttagatagtaagttgttgttaaaggtttgtgttancgacacgggaataggtatagagaaagacaaattgggattgattttcgataccttctgtcaagctgatggttctactacaagaaagtgtggtggtacaggtttanggttgtcnatttccaaacagttgatacatttaatgggtggagagatatgggttacttcggagtatggatccggatcaaacttttattttacggtgtgcgtgtcgccatctaataataaatatactcgaacaaacgaacaattgttaccaatttaa

SEQ ID NO: 6801 - DNA, 696 bp, Candida albicans
  unsure (62),(78),(683): Identity of nucleotide sequences at the above locations are unknown.
gacttcctttgttggtcgtgtgtggtggcaatatacaaagcccccccttacatcaacaaaanatttctcttctctgtngtttatctcgagtttctccttctctctccaatgaaccccactaaaaaaccacggttatcaccaatgcagccctctgtttttgaaatactcaacgaccctgagctttatagtcagcactgtcatagccttagggaaacacttcttgatcatttcaaccatcaagctacacttatcgacacttatgaacatgaactagaaaaatccaaaaatgccaacaaagcgttccaacaagcacttagtgaaataggtacagttgttatatctgttgccatgggagacttgtccaaaaaagttgagattcacacagtagaaaatgaccctgagattttaaaagtcaaaatcaccatcaacaccatgatggatcaattacagacatttgctaatgaggttacaaaagtcgccaccgaagtcgcaaatggtgaactaggtggacaagcgaaaaatgatggatctgttggtatttggagatcacttacagacaatgttaatattatggctcttaatttaactaaccaagtgcgagaaattgctgatgtcacacgtgctgttgccaagggggacttgtcacgtaacatttatgtacacggctcacacagccggaaggngggtcatcgctcc

SEQ ID NO: 6802 - DNA, 195 bp, Candida albicans
cggttgaatgaagatggtggtcttcaacaatatttgttagtcaaaaatttacgtactttattaactatccctgaaagtgtcagttttgaacaatccgcaatcactaccgattcagtattgactccattcaatgccatagcaaaaattagacatctgttaacaccaacatcaaaaattttattacaaggatgttga

SEQ ID NO: 6803 - DNA, 1146 bp, Candida albicans
aattttcaacaattctttcaaataaagcataaattcctcgaaagccgattatttattgttcttgtaatgtcacttcttttgaaacgattaagtccaatcaaacaatcttattcaaaagtactcgcaatacgtacaatgtcaattccatctactcagtacggatttttttataataaagctagtggtcttaacttgaaaaaagacttgccggttaacaagccaggtgctggtcaattgcttttaaaggttgatgcagttggcctttgtcattcagatttacatgttctctatgaaggtttggattgtggtgataattatgtgatgggccacgaaattgctgggactgttgctgaactaggtgaagaggtgagtgagtttgcagttggagatcgtgtcgcttgtgtcggccccaatggatgtggtctttgtaaacactgtcttactggtaacgataatgtttgtaccaagtcgtttttggattggtttggattgggttacaatggaggttacgagcaattcttgttagtcaagagaccaagaaacttggtcaagatccctgacaatgttacttccgaggaagctgcagctattacggatgccgtattgactccttaccatgctatcaagtctgcaggtgttggtccagcaagtaatatattaattatcggagctggtggattaggaggtaacgctattcaagttgcaaaagcatttggtgcgaaggttactgttttggataaaaaggataaggcaagagaccaagctaaggcctttggagctgaccaggtttacagtgaattaccagacagcgttttacctgggtcattcagtgcttgttttgattttgtttcggttcaggcaacatacgatttgtgtcaaaagtattgtgagccaaagggtactattgttcccgtaggtctaggtgcaacttcgcttaacataaatcttgctgatttagatcttcgtgaaattaccgtcaagggctcattctggggtaccctgatggatttaagagaagcatttgaattggctgcacagggaaaggtcaaaccaaatgttgctcatgctccattgtcagaattgcctaagtatatggagaagttgagagccggtggttatgaaggaagagtcgtgtttaatccataa

SEQ ID NO: 6804 - DNA, 1095 bp, Candida albicans
agtgattatttatatgatcagacattgagtccccaaggttttgacaatatccgtgaaaatttcaccatccacaaaacaatcgccagtttatacgaagataactcatctgttgtatcacaagaatctactgatgacaccaagacaacattatcactggaaacatgtgagagcttttcattgaataacgcatcatatttgaccaacattaactttgtgcaaaatcatgtacaataccttagtcaaaatgttttgggaaatcgcacttccaacagcttaccgccatcatcatcatcacagatagactttgatgcctccaatttgacacccgattcgataccagggtacattctcaacaagaaactaggatctgttcatcaactgacagacctggtatacaacgctatcaagattcatcaaaaccaagaatacaactgttgcactaaagcttctgctagtcaaaatccaacaaatttgaattctaaagtgatagtgaggctatcacctaatatttttcaaaacttgtcactttcgcgttttcttaatgagtggtacatattatctgggaagcacagttcaaaagagcaccaaatatggtccaatgagtctctcacaaatgaatacgtacaagacaaaacaattccgacatttgataaagaaagtgcacgttttagaccaacgttgcccataaatataccaggtatcttgtacccgcaagagataataaacttttgtgtgaacagccatgattatccacttgaacacccatcacagtccactgatcaaaaaagatttgccatggtgtaccaagacaacgattacaagacattcaaagaactcagcatgttcactttgcacgagctacaaactagacaggggtcgtattcgtccaacgagtcacgacgaaaatccagcagtggctttaatataggtgtcaatgcaaccaccactgaagctgggtctttggaatcttttagtaatctaatgcagaatcaccatcttggtgcaacttcaaccaacggagacccatttcactcaaaactagcaaactttgagtatcgagttttcaccaggcggaggaagcacaacgtcggcaat

SEQ ID NO: 6805 - DNA, 3003 bp, Candida albicans
  unsure (2931),(2974),(2981): Identity of nucleotide sequences at the above locations are unknown.
tttcatttgatagttaatgtttccaagattttcttttcatgtatgaatggagaaagtttcaaaatgttctcaacattcaagtgtaaatcctatttaacaggggatccccaaatgcctgaaatggacaattttttatacgatagtgaaatgttacttgctggacattcagaattgaatgaatttatgagaaaatatcagtcattcaaccaaacttccgttggtaaattttgctactatttaattgtactacttgtaatgtcacgtgaacacagatttgacgaggctgccgatttggttttgaaagttttggaagacttactggaaaaattgcctgtatcttttttgcatcatcaatattacttaatatgtggtaaagtgtttgcttatcaccagaccaaaaccccagaaagtgaggaacaagtggaacgtattttggctcgtcaatttgaaagatatgaattgtgggcactgacgaataagccgacccttctaccacggtacttgttgttgagtacctacaaacagattagagaaaaccatgttgacaagttagaaatactagattcatttgaggaggcgttacagacggcccataaatttcataatgtatatgatatgtgctggatcaatttggaatgtgcaagatggttaattagcataaaccaaaaaaggcacagaatctcaagaatggttaaacaaggtcttaaaattttgagaagcttggaattaaataatcatttaagattagctgaaattgaatttgatgaatacattgaggacgaagatcacagaaataaatgggcagggttaactaataatccaacattggatactgttactacctggcaacaacagaacatgcccgataaggtatctccatgcaatgacaagcagttggtccacggaaaacaatttggcaaaaaagagtttgatagccatttgcttagattgcactttgatggccaatatacaggcctagatttgaattcagctattcgtgaatgtctagcaatatccgaagctttagacgaaaattccattctcacaaagttgatggcatctgccatcaagtattcaggtgccacatatggggtaattgtcacgaagaaaaaccaggagacaccttttcttagaacaattggctcgcagcacaatattcacacattaaacaacatgccaatttccgacgacatttgtcctgctcagttgattcgtcatgtattgcatacaggagaaacggtgaacaaagctcatgatcacataggatttgctaacaagtttgagaatgaatactttcaaacaacagataaaaagtattcagttgtgtgtttgccattaaagagtctgcttggattatttggtgcactttatctagaaggtagtgatggtgattttggacatgaagatttgttcaatgaaaggaaatgtgatttgttacaacttttttgcacacaagcagctgtggctttgggtaaagagcgtttgcttttgcaaatggaactagcaaaaatggcagcagaagacgccactgatgaaaaagccagttttttggcaaacatgtcacatgaaatacgaaccccattcaattcgttattgtcatttgctatttttttgttagataccaaattggattctactcaaagagaatatgtcgaggcaattcagagctccgcaatgataacgttgaatattattgatgggatacttgcgttttccaaaattgagcatggatcctttacattagaaaatgcccccttttctttgaatgattgtatcgagactggtattcaagtaagtggggaaacaattttgaatgaccagattgagttggtattttgtaacaattgtccagagattgaatttgtggttggtgatctaacgaggttcagacaaattgtgatcaatttggtgggtaatgctattaagtttacaaccaaaggtcatgttttgatttcttgtgatagccgaaaaattacggacgacagatttgagatcaatgtgtcagttgaggattcaggaattggaatttccaaaaaatctcaaaataaagtgtttggagcattttctcaagtagatggttccgcaagacgagaatatggtgggtctggattaggtttagctatatcaaagaaattgactgaactaatgggtggcacaattagatttgaaagtgaggaagggattggcacaacgttttatgttagcgtcattatggacgcaaaagaatactcatccccgccatttagtttaaataaaaaatgtttgatttacagccagcattgtcttactgccaagtcaatttcaaatatgcttaattattttggatcaacagttaaagtcactaatcagaagtctgagttttcaacttccgtgcaagccaacgacatcatttttgttgatcgcggaatggaacctgatgttagttgcaaaaccaaagtcattcccatcgacccaaaacctttcaaaagaaacaaactcattagtattctcaaagaacaaccaagtttgcccaccaaagtgtttggaaacaacaaatctaatttatcaaaacaataccctctaagaatattattagcagaagacaatcttttgaactataaagtatgtttgaagcatttggataaattggggtacaaggcagatcatgccaaagatggagtagtagttttggataaatgtaaagaactactagaaaaagacgaaaaatatgatgtcatattgatggatattcaaatgcctcgtaaggacggtattacagctacaagggatttgaaaacattgtttcacacacaaaaaaaggaaagtcggttacccgtaatcgtagcattgacagctaatgttggtggagaacacccccagaagtgtctacaaaaaggaatgtttgaatttataaccaaaacccatttttacccagatgaacttagacgtatnttaacaaaagttagggaaacagtgaatatgttaaatgtgtatntaataantagaatctatccatatatttaa

SEQ ID NO: 6806 - DNA, 3009 bp, Candida albicans
gacggagtttccaaatcccctatgaagcttttagagattttgactgttataatgagagttgtcgagacaataagtgttattcatgaactacgatttgttcacaatggcctaactagcagcaatttattgaagtcagagaaaaatgtcagagatataaaaataacaggatgggggtttgcattcagttttactgaaaattgcagccagggttacagaaataaacacttggcacaagtccaagatttaataccttacatggcaccagaggtgttggctattacaaattcggttgtggattatcggtcggacttttactcgttaggggtaataatgtatgagttagttttgggtattttgccattcaaaaatagcaacccccagaaattgatcagaatgcatacttttgaaaacccaatagctcccagtgctctagcaccaggttggatttcagagaaattgagtggcgttattatgaaattgttagagaagcacccacataacagatacaccgactgccactcattgctccacgatttaattgaagttaaaaatatgtacattagcaaattattggattcaggggaaacaatccccaatagtaacctaaatttaagtgatcgccagtactatttgactaaagaaaatttacttcatcccgagaaaatgggaattactcctgtacttgggttgaaagaaagtgttattggaagaagagaattcttgcaaaatgttactgaagtttacaataacagcaaaaatgggattgatttactttttatatccggtgaaagcggaagaggtaaaacgataatattacaagatcttcgagcagcagcagttttgaaacaagacttttattactcatggaagtttagtttttttggagcagatacacatgtgtaccggtttcttgttgaaggtgttcaaaagattattacccagattctaaattcttcagaagaaattcaaaatacatggagagatgtgattttgacacacattcctatagatctaagcatattattttatttgattcctgagctaaaagtactattggggaaaaaatacacttccatttacaaacataaaattggaatggggatgctaaagagaagtttcaaagaagaccaaacactgagactagagattaaattgagacaaatactaaaagaatttttcaaacttgtagcgaaacaaggcttgtctatttttttagatgatgtacagtggtgttcagaagagtcctggaggttattatgtgatgtattagattttgattcatctggagaggtgcgagagagctataacatcaaaatagttgtgtgctatgctttgaatgcagaccatttagagaatgttaatatcgagcataaaaagatttctttttgccgatatgccaaacaaagccacttaaatttgcgtgagtttagtatacctcatatcccacttgaagacgctattgaatttttgtgtgaaccttacacgagactgcacgatcatgaatgtaacagtaaaaagtctgatgtaattgccaatttaaactgcacaaatgaatatcctcagaacacttgcaaagtcatccccagtataatccaagagttgtatcaatcatcagaagggaatgttttgcttttgatattcctaacaagaatgacaaagctatctggcaaagttccctttcaacgattttcggtcaaaaattcatatctatatgatcacctactgaatagtaactatggaactacaagaaaagagattcttacaaattatttgaatatgggaactaactcagacacaagagccttgcttaaagttgcagcgttaatctccaatggatcgggattctttttttcagatttaattgtagccaccgacttgcccatggctgaagcgtttcagttgttacaaatatgtattcattccagaataattgttcctactagcacatattataaaatacctatggatttaatagcctctgaccagactccatttgatttaacagatgataatatttggaaactagccactttatgcagctacaagttctatcatgattctatttgtactcatataatcaaagaattaaacgccagtggcgaattcaaagaactttctcggttatgtgggttgagattttacaatacaattacaaaagaacgtttattaaatattggtggctatcttcaaatggctactcactttagaaactcatacgaggtggcaggtcccgaagaaaatgaaaagtatgttgaagttttggtccaggcaggacgatatgccatatcgacttataatatgaagttgtctcaatggtttttcaatgttgttggcgaattggtatataatcttgattcgaaaactcagttaaaatccgtgttaacaatagccgagaatcattttaattctcgtgaatttgaacaatgcctaagtgtggttgaaaatgcacagaggaaatttggttttgacaggttgatattttccattcaaatagtccgttgcaaaattgaattaggtgattatgacgaagcacatcgaattgcaattgaatgtcttaaggaattaggtgttccattagatgacgatgacgaatatacaagtgaaaacctgcttgagacgtgtttgggaaaaattccgctctctgttgctgacattagaggtattttgaagattaaaagatgcaagaattcaagaacattgctaatgtatcagttaatttcagagctaattgtactattcaagcttcaaggtaaagacaaagtgagaaggtttctcacagcttatgcgatgagtcaaattcatactcaagggtcttctccttattgtgcagtaattcttatagactttgcacaatcatttgtcaacgaaaccacaacttcaggaatgcttaaagcaaaagaactcagtattgtcatgttgtcattgattaatagagcaccagaaatatctttatcatatgttcagtctatttatgaatattatttcagttgtcatgctgtattttattga

SEQ ID NO: 6807 - DNA, 672 bp, Candida albicans
tgtgttgaaaattatagttggaatcaaatgatggaacaagcaaaattatatgctgatatgtttggatttcataaatattggtcagttgatgaagatgatatatctactgggttcacagcattaagatccattgttatgtcttcgagtaatggacaaatcaaaatgccaattaatgaaccagttaaatcaattatgaaaggccaaattgaagagtttaatgattttaatggtggtcccggaattcaacatattgcattccgaacaaacaatataatagaaacagtaatggcattaatgcaacgaggagtcgaattcaatcatacttcggagaactattataacaatttaaagcaaagattgaacaacgatgggattaagttatatgaagattttgataccttgagatcattaaatatattgattgattatgatccatcaacaaaaccaaaacctaaaccaaaacctaaatcaaaaaggaaaaggaataataaatgtaattatctattacaaatattttctaaaccattacatgatcgtcctacattatttattgaaataattcaaagacatcatcataatgggtttggtaaaggtacattcaaaggattatttgaaagcattgaagaacaacagaaattaagagggacatttgttaaatcacagaataattaa

SEQ ID NO: 6808 - DNA, 834 bp, Candida albicans
ataccagtattactcatcaaaaaaagaacaaaaattataatgccagcctcccgtgaagattccgtttaccttgctaaattagccgaacaagcagaacgttatgaagaaatggttgaaaacatgaaagccgttgcttcctctggccaagaattgtctgttgaagaacgtaatttattatctgttgcttacaagaatgtcattggtgctcgtcgtgcttcttggagaattgtttcatcaattgaacaaaaagaagaagccaaaggaaatgagagccaagttgctttgatcagagattaccgtgccaagattgaagctgaattgtctaaaatttgtgaagatattctctctgtgttgagcgaccatttaattacatctgcccaaactggtgaatcaaaagtattttactacaagatgaaaggtgattaccacagatacttggctgaatttgctatcgctgaaaaacgtaaggaagctgctgatttatcattagaggcttataaagctgcttctgacgttgctgtgaccgagttgccaccaacccatccaatcagattaggtttagcattgaacttctctgttttctactatgaaattttgaactccccagatagagcttgtcatttagctaaacaagctttcgatgatgctgttgctgatttagaaaccttatctgaagattcatacaaggattcaactttgattatgcaattattgagagataacttgactttatggaccgatttatctgaagccccagctgccactgaagaacaacaacaatccagtcaagctccagctgctcaaccaacagaaggtaaggctgatcaagaatag

SEQ ID NO: 6809 - DNA, 471 bp, Candida albicans
ttgactcaaagcaattacaatctttttgcactaatcattacaaaacaaatcaaatctaatcaacataagcaaactgttaatcaaatcatgacttgtttagatgaattagctcattcattggaatcaaaatcaggcacgacaaactccaaaacaaggaatagcaaaataaagacaattgatttatatcaacaaaatgaattactgggacaacattctcaagatcaagataaattttatcgattaccagcaatggatcctattgcgagagataaaaaaccttggaaacaagatgttaactatttcaataaatgctatatatcatcattagcattaatgaagatgtgtacacatgcccaaactgggggatcaattgaaattatggggatgttagtaggaaaaatccctggcccattccattattgttatggatacatatcgattacctgtagaaagtaccagaaactcgagtga

SEQ ID NO: 6810 - DNA, 918 bp, Candida albicans
aaagtaccagaaactcgagtgaatgctcaaaatgaagcgtatacatatatggttgaatatttaactgaacgacaacaattactgaatgggaaaaatgaagaaaatatagttggatggtatcatagtcatccaggatatggatgttggttgagtgggattgatgttagtactcaaagtttgaatcaaggtttccaagatccatatttggccattgttgttgatccggtgaaaactttaaagcaaggtaaagtagaaattggggcttttagaacgtatcctgaaggatcccagcaacaaccatcaatgacaaataagaccagaaaggatcaaaataaacctcataactccggtgctaatgctaatcggaagattttacctaaatcaaaacaaaaagattttggtagtcatgctgataaatattatagtttagatattgaaattttcactagttcatgggatgataaagtaattgagatgttaaaagatgaagattcattaacttggatgaagaatttattagttgatagtaataataatgataagatattagggattagaaaagatgaaattagatctattgaattgattaaaaattatgaattgattctgcaaggaaatcataatgctgatgaaggtgaaacaatatttgatcttattgaacaattgaaaatacaagctaatacccctaaatttatgcttgacaagttaactaccatgaaatttgattcaaatttcgaaagtgttttatacaagagattattgaaaaaaacccaaaagtcaaccacaactaaaaaaaataggaaagaattgagtacagatatagatgatgagaccatgttagatgaaagtgatttggaaaaaaatgtgggtactggtggcattgaaactagtattagttctgatgacgatgacgaataa

SEQ ID NO: 6811 - DNA, 522 bp, Candida albicans
caacatcttgatggttctgacggatctcttgtcattggtggttacgatgctgctaaagttaatggtgaaatcaactggaccagtatcaagaattcaaatattcatgcattactttctgaagttaaaatcaatggtcagactatccctgtcaacaaacagtatactttagacacgggtggtggtactggatttttaccagaggctgcatataatcaagttattggtaatttgcccgaagatccaaaattcggaactgaccgtagccaaattacctgttcattacttgaaggtaaaactttcacttataatttaaatggagttgagtacgagattccattaagagacttttacactcccaaggagaccaacggtgtttgtaaacttggcttacaaaaagggaatgctgcccaattgggagcttggatattcagaaatttgttgcttgccgtcgatttggagggtgatttgtttggacttgctagtttaaaaaacaccaccgaaaccaacatcaaactgttttaa

SEQ ID NO: 6812 - DNA, 666 bp, Candida albicans
ccaaatacaatggtctccattattacttttaccaaaaacgttcttgttacacttgcttttgctttattggctcaaggtcttgctatccctgaagacattgataaaagagctgaaaaagttgtctcattagattttaccgttaccagaaaaccttttaatgctactgctcatggacaacatcatcaatcccaacaacaacaacaacaacaacaaccagctcaaaaaagaggaactgttcaaacaagtttgattaatgaaggtccatcatatgctgctaccatcactgttggttcaaacaaacaacaacaaactgttattgttgacacaggttcttctgatttatgggtggttgattctgctgccgtttgtcaagtcacttatcctggtcaatcaccaactttttgtaaacaagatggtacttataaaccttcttcttccacaacatctcaaaatttaggtaaagctttctccattagatatgaagatggaagttcttctcaaggtactgtttataaggatactgttggtttaggtggtgcttcaattaccaatctacaatttgctgatgtcactacgacttcagttgatcaaggtattttacgtattggattcactggtgatgaaagtagtccaacctatgataatgttcctgtcactttgaaaaaa

SEQ ID NO: 6813 - DNA, 1713 bp, Candida albicans
tttttttcttcacaaacaattgctatagatatattctttccatctgatttcttttcttttttttttttttccacatatatgagactcaattctgttgcgttattatcgctagtagcaacagcacttgctgctaaggcacctttcaaaatcgactttgaagtgcgtcgtggggagtccaaagatgatttatcccctgaagatgattccaatcctcgatttgttaaaagggatggttcattggacatgactttaaccaacaaacagactttttatatggccacgttgaaaattggatctaatgaagacgaaaatagagtgttggtagataccgggtcttcagatttgtgggttatgtcccacgatttaaaatgtgttagtgccccaaattctaaacgtaacgaacgatctttcggtcatggaactggtgttaaactaaatgaaagagaattaatgcagaagagaaagaatttatatcaaccatcaagaaccatagaaaccgacgaggaaaaagaagcactggagaagattcacaacaaactatttggctttggcagtatttactccacagtttatatcactgaaggtccaggtgcatactcaacgttctccccattcgtaggaactgagggtggttctggtggcagtggtggttccaatacctgtacatcctatggttcattcaataccgaaaactcagacacatttaaaaaaaacaacactaatgattttgaaattcaatatgctgatgataccagtgccattggtatttgggggtacgatgatgttaccataagcaacgtgactgtcaaagacctttcttttgcaattgcaaacgaaacatcctctgatgttggtgttttgggtattggtttgcctggattagaggtcactacacaatacggttacacctaccagaacttgcctcttaaattgaaagcagatggaattattgcaaagtccctttattccttatatctcaatactgccgatgctaaagccggatctattttatttggtgctattgatcatgctaaatatcaaggtgacttggtgactgttaaaatgatgagaacgtattcacaaattagctacccagtgagaatacaagtcccagtatctaaaattgacgttgaaagcagcagcggcagtactaccaacattttgtcaagtaccacgggtgttgttttggataccggttcaactttatcgtatgttttcagcgacactttgcaactgttgggaaaagctttaaatggtcaatactcgaattcagttggcgcttacgtagtcaactgtaacttggccgactccagcagaacagtcgacatagaatttggtggtaacaaaaccattaaagtcccaatttctgatttggttttgcaagctagtaaatcaacatgtattttgggtgttatgcaacaatcgtcaaactcgtcgtacatgttgtttggagacaatatcttgagaagtgcttacattgtttatgatcttgacgactatgaagtaagtttagctcaagtgtcttataccaacaaggaatcgattgaagtcattggtgctagtggtatcactaacagttcgggttcaggaacaacatcttcatctggcacctctaccagtaccagcacacgtcattcagctggaagtataatttcaaagcctgtgtatgggttgttgctttcgcttttgatatcctgttatgttttggtttaa

SEQ ID NO: 6814 - DNA, 366 bp, Candida albicans
tacatacgcggatcggctctctgtgagagaagattaggcgatgcacatttttcggtccccattcaagatctcaagactgaaaaggacggtcaatgctatttggcaattatgagcaattccgttataggtggtggtggcattctttttggtgacgatatattgagacagatctacctcgtttatgatttgcaggacatgaccatttcggttgcaccagtggtttatacagaagacgaagatattgaagagattttaaaccccaatgaagatcaaaacgaggttccaacaagtacttcatttacacaatctgcatctagttctgggtcccaacccagttcaaccattagtggtgagaacatggactag

SEQ ID NO: 6815 - DNA, 942 bp, Candida albicans
agacaagacatgtctactactactttaaaacgaacaataaacatgacaccatttaaatataaactaccggatcttatttctgatttatctaaagctaaaaaaatcatggtagttactggtgcaggtatttctacatcattaggtatacccgatttccgatcatttaaagggttatataatcaattatctaaattgaatcttagtgatccacaaaaagttttcgatttacaaacatttatgagagaacccggattattttataccattgctcatttagtcttaccaccagatgggaaatttagtttattacatgcatttttgaaattattacaagataaacataaattattacgaaattatactcaaaatattgataatttagaacaacgagcaggattgaaactggaaaaattagttcaatgtcatggatcatttgctaaagctaaatgtgtttcatgtcaaggtatatttgctggtgaaaaaatttataatcatattagaagaaaacaagttcctcgatgtgctatttgctggaaaaatactaaacaagcaccaatccattttggtgccataaaaccaacaattacatttttcggtgaagatcttccggaaagatttcatactttgatggataaagatttacaacaaattgatttatttttggttattggaacttcattaaaagtggaaccagtagcaagtataattgaaagagttccttataaagtaccgaaaatattaattaataaagatcctattcctaatagaggtttcaatttacaattgcttggactttgtgatgatgtcgtatcttatttatgtaaatgtttaaaatgggatattcctcatgctgatttcaataataatgatgaatttaaattatcaaaacttaaaaatggtgattgggaaattgtcaagaaatcaacttcgacaaaaaaatga

SEQ ID NO: 6816 - DNA, 504 bp, Candida albicans
gcgcttgtccttccagccggtcgtggtgaagacgcgggtactaccacatcaactaaaggaatgattacacccacaccttttaatattgatatcaataatgatttaaatgattttgatgggaaatttatagaaacttttaaacctgatttagaattacaaaagaaatatcgactgtttattcaacgagaaggagctttatcatttcttcgaaccgaaataactcaatcaatgtctaaacgagatatatgcgttttaattttaaatttaggataccctaaaaaagccgtggaagattatccaatattaacattaaaagagttggcgtatatcttgttgaagttgatgttaactgattcagcacaattagaaccaaaagtggaaattgatgaaaatgataataaaaatgatggtactaataatagtgatattgatagtaatagtgatatggacctgcaactggaactgggagaattagacgatgctatggatgtggatgattcttta

SEQ ID NO: 6817 - DNA, 585 bp, Candida albicans
aaaaaattgtcacaaatagatcatgcattacagacggcagaagctatacggcgagatgggaaaccacgatggtttcaattagttgggttgattcatgatttagggaaattactatatttttttgattctcgtggtcaatgggatgtattgggtgatactttccctgttggttgtaaattcctgaaacggattattttccctgatagttttaaaaataatccagatttcctaaatccattgtataataccaaatatggcatatattcaaaacattgtggattagataaagtcatgttgagttggggtcatgatgagtatatgtatcatgttgcgaaaaagaattcgactttaccaccggaagcattggcaatgataaggtatcattcattttacccttggcatcaagaattggcatatagttatttaatggatgagcatgataaagagatgttgaaagcagtcaaagctttcaattcctatgatttatattccaagatagatcaacagtatgatgttgaagagttgaaaccatattacctagagttgattgatgagtttttcccaaataaagtaattgatttttaa

SEQ ID NO: 6818 - DNA, 1497 bp, Candida albicans
ttcaattataggtgtaatcgatgtcgatctaagaaaacaaaatgtgatggtgggtttccgtgtctaaaatgtgtcaaatcgaatcaagaatgtaacatttctgctccagaaaggccttccaatcctactgatttcaaagaaaaatatgcacagaatcgagcctatacttgcaaattagaaagaataatacaatatttgtttcccgatatcgatttgaagtatttacgagaaaacactgacacatttgaacgagaagtatgtataaataaactgaaattacctcgtgttggagttcctataacgtcgactaagccccctgaatcagaagacaacgaatcaaaattgaactcactcaagaatttcaatcatacctatgtatctccaacagaccaaagttttattagattcatcgacaatagcaaaaaccaaaggtttatggaaagaaatacattggcagctagtgtttttgccaatagtaacatatatgccaaacacaatttacaagtcttagttcaaaatgcattagaagttttctctgatgataataaaatacgtaaattggtaggaattttcttaaacatttgtgaaacaaattatttttatgttcatcatggacgattttataaacaagtggatcaattacttttaaaaagacaagaaaatgatatagaatatttagtcaataattggacaactgtaagtattgtgctggtcatgcttgctcttgctagtggatttgaatttattgctgacaattcaccaatgcccaaagtcactcctgatacaacaccagggttaatgtgttactatgccgcattaccatttgctgggtttttaattgatttgaaatcagtggaaagtattcaatgtttacttatatttggagtgtttatgacaacgaacaaattagaaaatttccaatcaatagatggtggttatacatttatgaatttagcattagaaattgccattgccaataaattgcatttaaaagaaccgtttgagaattatcctgaagaagatcgtgaagttttcaagcgtctttggtggacttgttatactatggaaagaagacacggtgtaaatattggacgagtcgaaacaattgcacctgaggatataactgttgaattacccgttgatatgcgtggtctttatagtaatcttggactttcaaatcatttaagtcagatatcaattattcaaatgaattatattttcagagatattatggatttattctgttcaaaatcaaaatcacacaaagatcaaagcatatcgatagatcctaaaattattaggaaatttgttgaggatttagaagtatgtaaattgaattttcccaattataccaagattgataatttagatcctagctcaacaagatatcgtgcttgtattcatttgaatttgacttattatttggcaaaaatttatattggtaagccattcccactatataaagttgaaaatcaccaaacgattacacgagaataa

SEQ ID NO: 6819 - DNA, 771 bp, Candida albicans
tgtccccattttcattacttggtgcttgatgttacttcatcacaacagggagaaatttattctgaatcagtttctattgcttctattgttggtagtgaagatggaattttcaataaattccctggatcagttcgtattcaaactggtggacaagaagttattgctgatgttaaaagtatggttttggaacgattagaaaatttccataaaaaaattgggaaattacctagtaaagtattattttatcgtgatggagtctctgaaggacaatataccaccatattaaaagaagaattaacaaaaattaaagccgcttttaatgaatatggtaaattgaaaaacatccctaaatattctccaaccattacatttatgattgttgttaaaagacatcatacaagatttattcctattcatgataatgccgatgatcccaaaaccaaaaaacaaatagctgtcaccagtaatgaaaatgtcattgctggtacaaccgttgatcgagaaatcacttctccagcatattttgatttttacgttcaatctcaacaatcattacaaggtactggaataccagctcattattatgttttacatgatgaaaataattatacttcagatactatacaaaaaatcacttatgatttatgtcatacttttagtagagctactaaatcagtcaaagttgtccccgcagcttattatgccgatttattatgtactagaggtagagattatatttatggttttgctaaagatccaaatttaaaagga

SEQ ID NO: 6820 - DNA, 855 bp, Candida albicans
ttagcgcgtgatccttcgcagcccgtctggtgtaagaatagttatttaattgatgataaacaaactcatattaaacatacaccttataatatcaccaaatattctgataaatctcatgatgtaaccactttacaaaaatattttaccaccaataaattaactcctataccttcaacgacacaaataattgctatattaaaatcaccttttactcaaggagatttaaataaatcatattatttaatacgaatgtttcaattatctagtcaaggattatttttaactaattcccccatggataaattaaatcatccaatacaatttttgggtgcagaaaattgggataatgtcatgtgttatttggatgcattattatttgccatgtttgctaatttagaaagttttgaaccaatactatttatacctaatcattctgaatatttattaaatcaattatcagcattattaagagtttatgtcaatttattacgttcaggaaatttaatcactacggatttaacggcgaaaatttgtgaagcattgatgaaattaggattcactgaagcattaagtcataaacaacaagattcagctacattatttgaatttttgactcaaactttaaatatgccattattaacatttaaaatagatattaaacatggtggtaaatttagtaaacatgatgatgaaaaaatatctaaagaaagaatattatttgttagtattcctaatgaagaaattgaagatgaattattacctgttgaaaaaagtagtattagtcatactgaaaaagtcgacaagaaattcaacacccataccactaccaacacaatccacaccgccaccatcata

SEQ ID NO: 6821 - DNA, 849 bp, Candida albicans
ttcttattcgccaatttcacatttgttgctcgtaatccattaactcataaatcatttgcaattaatagattattaccagttaatgaaaatgattggattgattatagaagagcagaatctcataatgctaaaaaaaaattaatggcaaaaaatttaagtttaattgaaccaacccctgaagaatcaaaattaatttatgatatgtggaaatcatcaaaatcattacaaaatgatgttgaaaaaaaacttaatgatggaattgcctttatgaaagataccgtgatgaaatcaactttattcatgcaaccacaatatagaaatagacattcttatatgatttttggtggttatttattaagacaaacttttgaattggcttattgtacagcagctacattttccctggccggaccaagatttgttagtttggattctactacttttaaaaacccagtacctgttggttcagtattaaccatgaattcatcaatttcttatactgaacatttacatgatctggatcaaattaaagaagaaattgataatgattcaccatttaatttttcattaccaccaactaataaaatttcaaaatctccaaatgcatttttatcagaacctggtactttaattcaagttaaagttgatacttatattcaacaattggaacaaaatgataaaaaacctgcagggacatttatttattcatttttcgttccaaaagaaggaaattcaagtttttgttcagtaattcctcaaacttattcagaaatgatgacttatattggtggtagaagaagagctcaagatactgctcaatatgttgaaactttaccaacttcgaaataa

SEQ ID NO: 6822 - DNA, 1002 bp, Candida albicans
tttcaacaagggaacaatttattgaagaagaggatcgaaggagataccatcagtccattgaataaaatcgttattgcttctcattacaacagtacttttgaaacagtatccaacttgagcaagctcagcaataaaagtaaattgaaagatattttccatgcgttgacaaatgcaactgaatttagtgacttacctgtacgtgaaggtgaagacgccttgttgattaaacttcaaactaaactaccaataaaatatagtcaagatgattatgaatcaccatttttcaaagcttttatactattgcaggcacatatatcacgaatcagtatcccctttgatttacgacaagatcagaaatctgttttgactagagttttacaaattttgaatgcagctatagacattttgtcaagtgatggctcgttgaatgttttattagccatggatttatcacagatgatagtgcaggctgtgtggagttctgacaacccattaagacaagttccgcgcttcaccaacgagattttaggtagatgtactcagcacaatgtcgaaacagtatatgatataatgtcattggaagacgaagaacggaatgaaatcttgcaattgccagaccaagaattgaacgaagttgcatcgtttgtgaatctgtatcctaatattgaattactgtatgaaatgaagggcggggttacttctaacgaatcaaaatttgttaccgttacaatcgatagagacgaagagatcgagtcattagaagttgttaaaaatgaaaattttcctgttaccaagcaagagaattggtggattgttgttggcgatagtaagactcgtcatttatatggtataaagaaagtcaatattcaaaaaataagccagtctttcgaaatcgagtttactatcccaaacaaaggtaagcatgaattaacaatttatttgatctgtgattcatatctagacgctgataaaaaaatggaattcgttatagatgtagtataa

SEQ ID NO: 6823 - DNA, 1017 bp, Candida albicans
agctcagtgcattttatatcagaagagatggttaatttggaatacttaacaattcagttgccaaatattcgaacttttaatgaaacaggaataattgctccaaatttaaaagaactaaatgtcagatgtgatcaattgtcaaatctcgaggagttgcgacaattccaacatttgaaagaattagaatttggattttgtaattatccctttgggttgtttgatgaagattcttttcccgagttagaaagttttatgtgctgggggtgtcatattctggattcagaagattgtcataactcatcattaatttttcctcgaaatttgaagcaattagcaattgaatgtcccggttttgaaaatgttgatttcaccacggcaatgctcccacttacattaactattttgcatgtttctggtctatcttttaatgatggatatttgggtgaaaacttacggtatgttaatgttcaaggttcaagccttgtatttaaaaagagattcataatattccccatggtcgaaaaattcatattgaaagctgatcatctaacatttgaaagtctggattttatgtatcatttacctgccagcctaatgcacttgaacttgttcgcctgtgagcagggaaagatgaacccccttgcacaaaaagtaaaatggccgtcgatgttgagtggtttcgtctttcagaacttcaaaatcaattatgagacattaaaattgttgaatatgaaagagtctagaattgaagaaattgatatttgcgggggtgatatcaagacattagatgctgacctatttcctgtcagtgtcaaagatctatctttagtgcaaatgggaatcgaggaagtgttgggctcgtttgaagatttggaaaatctacaaaagctttctctacaagggaatcaattaaagaaaatatcacccgttagaatgccagtatcatcattgagttttttagatctaaaacaatgcaccttttcgtttgatatcaccattcgtggtttcaatgtttga

SEQ ID NO: 6824 - DNA, 873 bp, Candida albicans
ctcctgatattgatgaattcattataccagatgacctggaaaccccaaatgctccacagaaacaatcaaggtggcgcatcaccattttcaccgttcaattttcttcctaaagttgatttgtcatcaacatttggaaattcaagtggccaattacctgtgaatgtgaaaataaaggaacgtcagtattctggtggtgatacattagatgagccagtgtgggtaactttgaaaagagatttattgcaaattggtaaaagattggctatagttatatggcccatgcaattagcacaattggccaagaaacagcaatcccggttcgttagttttgccaattccaacggaatacacattcccgagcgtttaggaaatatacttcctggtggtggagtagatgacaatactgaacaaaccactgggatatctagtaatgatttgataagtcaagataatttagattgggatttatggggaccacttattttttcacttgtttttgctattgttttggcatttaccaatgaatcccaatcaaccgaagtgtttagtgggtcgtttgcatttatttggatattttatttcgttataggattgaatgtgcaattattgggtggcacaatttcgtttttatcagcaatcagtgcaataggttattcgatgtttcctatagttattggcgaagttatatgtactttgttaattcattggagatggatacgacttctaataatgttggtattgaatgcttggagtatctacgcaggtgttatgagcgttaaatgttccggtgtgttcccaggcagagtggctttggctatgtatcctgtggggctcttttattccgtacttagttggctagtcattattacttaa

SEQ ID NO: 6825 - DNA, 1632 bp, Candida albicans
  unsure (1306): Identity of nucleotide sequences at the above locations are unknown.
gtggcagcctttttcgtcttcggccccgtggtgaagactactgcattggattcctatacaatttatggtatgaaaaagttggacataaaaataatccctgatgatgatgatgatgatgaagggacccagatatttacttttcctgcaagtttggaggatttacaaattaaaactagacttttaactggggtgattttacctccaactttgcggagactatgtcttgtcacacacctgaaacaaattgaaatttcatctgaaggaatgcctattttagagtatttgctgcttgagttgccttgcattgacgtccttaataacaaccaaataattgcaccaaatttaaaaactttacatttaaaaaagtgccttagtatgagaggctataatggtttgaaaaagttccaacatttaaaacatttaacaatcgactctagtgtatatccattttatttatttgatcagaattctttactagaattagaaagttttgaatatattggaaatgacttgcagaattcacaatattttctcaaatcattattaatcttccctccaaatttgaaacatctatcaatcaaatctgctggtctcggggatcttgattcaagtactttagtacttactcgcccattaacgcctgtggtgcttttaaatgtctcatttaaaaccggttattgtcatttggacgaaaatttggaatacatcgacatcatcacatcggatcttacatttcatagtagtttcaggatacctcctcgggctgaagtattagatttagctgctaaaaatatagtttttaccagcctggactttatgtatcgtttacccaatagtcttacacgcttgcagttgcttgctaggtcacagggtgagatgagtcctcttacccaaaaaatcaaatggccgctggtattaggtactttttctttaaagggtttttccattgattccagtacattagaattattgaacttgaaagaatctagacttcgaaaaatcgaaatttgcaaaggcaatattcaaaaattggataatgatttattcccaattagtgttgaggaactaattttaaataagatgggaattaaagagttacctgaatcctttgaaaacttagaaaacttgcgcaggctattgttaaacagaaatcaattgaaaaaagtaaatcgagtcaaattgcctgtatcttcattggagcatctagaattatgcctgtgtaaccttcgtttagtgtcaccatttttggtttcaatgtatgaagaagagaacaaagacgctaaattaaaaatacatgctccagganagtggaatatgagtgttattgatgtgagaaggaccttaaaagcaatcaaagggctttcattactgctcagcagatatgatgaaactttggaagaaatatccagacggtattatagtttgtttgatgcttttctgacacctgatccttatgctccagcatatgaatattctggaccagaggaggtaatttcagaatatgattcagatgatctttacaatggaagtctggataacgagtacagtgatgaggatgatgaattttattatggttctagcatggaggaagattcatcaattgtaacaagtgacaatgataaagactcttga

SEQ ID NO: 6826 - DNA, 972 bp, Candida albicans
tcacatttcttacttgatttatttatggatgcaattttagctaatttaccacctataaccaaaggttggtgtatagcaattttgtcaacggcaaccttactttcagcaaatcgactcaaattggttaatttattatttgtccccgataaagcattgactaccgaaccatggcgattaataacgtcattttgtacattcagatcattatcaattgaattatttctagaagtgttttatgttgctagttcttgtggacaattagaatcgagattcacaaccgaattatcccttttcccaacccgtataattgatcaattcaatcaacaagacagaaacgctcaaaatcaacatcaagaacaaggtgacaatcaaagacaaggacaaagacaaggacaaggccaaatcctgcaattggaattattgaggagttttattgatcgtaacaagtcgattgattttttatattatgtgggtcaaatttgtttatcaataatatttgttgccagtttaatccattataaattacaatttgttatacttaatttaggacaaatcttatctcatttgattatttatattgatactcaaaagacacctaatgaattaatcaatgtcatggggttgtttaccatgaagaaatcctattatccatggttagtagcaattgtcactatcatattaaaccatagtggtggtggtggtcttttagatgctaataatattttcaattcaccgttagtatggacttatattgtggctactggattaggacatttttggtggatggtaagggatgttttattatcatcaattcattatgattcaaatgatcgaagaagattattgaaacagaaattattaaatcgtcatggaattataaaattcgatattatcagagaaagattaatttggttattattgccaccttggtattgggtgattctctcaaagataaaacaaagaagggcataa

SEQ ID NO: 6827 - DNA, 222 bp, Candida albicans
  unsure (41): Identity of nucleotide sequences at the above locations are unknown.
ggggtgttggagaattggaatcgcaaaaggggtcctggacnaagaccaggactagaactacagaacccacagggtcgacaacaacaagaacaacagcagcaacaacaacaccaaatgtctggttacaaggtctctcctatatcaaatattgagtcaccaattgctaatggtggtttgaccaaccctaatgtacaatttggtaatggtgcaagatcgtttgac

SEQ ID NO: 6828 - DNA, 1980 bp, Candida albicans
caaataatggggtacaatataaagcaaaagattggaatctgtctaaaagcagaagcaaaccctgaaatgactcaatctgatttggcactttgggccatgaaagaatataattctgaaaggccaccatcacaaactactatatcacggatattgaactcgaaaaacgacataatttcgagaaaagagtctgaatttgagctcataagaagacgtaaacgggcaaacccattgttacgacgaattttaacggaatggattacccaagcaaattgggaaggaatacccatcacgacgccaattatacaactgacggctaatgccatatggactcgattacctaaagagggacaagaaggtaatggtatattcaatcaaaaatggtgttctcattttgtgaaaaaattgaacattaatataacgggatcgcctcgggatgttttagacaaccgaggatacaacttaaataaagtttggaaattggatgaaatactagaattgaaacgatatttgcgagatatcattgatcaagaagattatgctcctcaagatgtgtttgttattgatgattttcaattgttttattctttgcctttggatcaaatatttgatgtttcgtctatagataagggcattaaacaatcaaactcatatgctgaacattcattaacaattatgctcggctgcaacattgacgggtcagaaaaactaacaccaataattgttgggaaatacgataaatttgatgtttctaaaagtacgcatgtaagtttaaactcaatgcaatttgattcggtatcgtatcaaactttgatgaataaacttaccgaagtttacaatattttttacaaatcaaataccaataaatggatcacttcgtcaatgtttcaaaattatttaactagattggatcataaattatccaattcaagaccaaatggacggaaaattctaattattttagatgattgttcatctcatcgtattataaatttgaaatttaataatataagactatgctatttgaaaaatgaggctaatcataaaaacccttataatacaacttattctggaatcaaatttgattatttacccatgaattttggaattgtggaagaatttaaaatattgtaccgattgcaacaatatttagaaatgattaatttacaaagaagcaaatcacaaattgattcggacccaatgattgaagaaaatttgacttcaacttcagtggcaacaacagctactgcgttggaggttttatcagaatccgattaccacatatccttgattcgagcaattgaatggataacaagatcatggcattctgtgtcatcggaacggattttttcctcatggaaaaagacacatttgttcaatttactagattggcctagtggtaattctggacaactagtttatttaaaccagaaattgaacacttttgatgaaaataagagtttgaagaaattaaaagaggttatgagttatttaaatgtggttattccttgggaaattgatgaattggtagggttggttaacgagagaggtaaagttactttaagttatgcatctatcgaagaaatcattgatagttgtttgctggaacccgttgacgactatgatgaaatgggggatgatgatggtagatttgacaataggaaaaatgaacttggtgatgtttcttctgttccagttgataatagcaatgacccttggtttactgtaagtgaaataaatgaatttcataatgatccattttataataatgacaaatctattgatgcagcagcagaacctttagagctgatttcacctgataatgatagttcggctattccaggtttggaaaccaaagctctttctgctatttcaggtttggggacgacttcaacaagtgttgtaagtgattctccactgggaactacccaaaagtacaacaacattagcatttatccaaatggttcattaaagcacaagtag

SEQ ID NO: 6829 - DNA, 477 bp, Candida albicans
gaaactatggttttagcagatttaggatcaagattgaggggtgctttgtcatctgtggaatctggttctgatgacgagatccagcaaatgataaaagatatctgttcagcacttttagaatcagacgtcaatgttaaattagttgccaagttgagaggcaatatcaaaaataaaatcgacgaatccaatgtatctaaagaaacttcagctatgaataaacgtaaaaaattacaaaagatcattttcgacgaattgtgtgcgttagttgactccaatgtcgaacctccaaaaccaaagaaactttctacatcaaccaaaactatcaatgggaaaaaagtgagattgtcaaaagaatcaagtcacgttattatgtttgttggtttgcagggtgcgggtaaaaccacgtcatgtaccaaattggctgtctattatcagaagagagggtcttcaacagacgattgtcgaacatcccccccc

SEQ ID NO: 6830 - DNA, 936 bp, Candida albicans
gaagaagttgattatttgttagatataaaaaactacctgcttaaattgtcaaatattatcaagatcactcctatgtcatttagaaacatcaatacggaacttttctatgaagtagcaagacttccactgggtattattggtattattgttgattacttgtccaaatgtatgttaccagagcttctatattttctacctattagaagggttgtcgcttctgctattttatcagacgtgaatattactgaagctcaacaaagacacaagaaagatattgcgcgaggtttgggatactccagatgtaagtgtactagcataagtattaaaccaaagagtttaaaacggggttcgaagcgttggaatatactcccggaggttatccacctcggggacatttttgcttttgaattgacgtataaaacttttccagaagtattgtacatggttcccaaaattgatgcttacttctacggttatgatacttttgatccaaaaatagatgcaaattatctcaaaaattccggagtcaactttgattcgttatttttgtatgagtttatgcatgtaaaagaattgcccaccgttattacgagtcttaaattaatcggaaccacgttggatagctacgtgattgatggccttaaaaaattgtcattggaactgtctggtgatgaaaacacgacaaaagaatattctttcccttcttctttagaagatttaactatcaaaggctacaaattgacgagaataactttgcctccaaatttacgcagattgtatatcagtacattcctgaaatcagtagattttgtgtctgaagaaatgcctcacttagagtatttgctgctttcgttgccggatgtcaaaaaccttgaagatactggaatatgtgctcctaacttaaaaacacaagaaatacacaatcgttcgaggtga

SEQ ID NO: 6831 - DNA, 837 bp, Candida albicans
caaaaatttataaacattttgtctcctcgaataatcttattttccttaacaccgataacaccaagagctttaaatcaatcgactgatgcttggcttttaatcaattccatgaccaccgcaaccattaagatcgacactgctctatttattaggttagcaaaacttccgtcagaaatcgttgcttatatcattggtttcttaccgaaatgtatgttgccagaattattgtacttcccaccaattaaggagattgttgtatcaacaattttttcagatgtgaatattgctgaagagtacctaagggataaggccagtgatgtaccaggtgttggatatggaatttgctattgcgattatttcaaagtcacactcgacgatttaaaaaggggtattgatcaatggagtatttacccaagatgcatatatattgataatgtggaagattttcaaaatgtatgtgatgacttccctgaactattattcaaagcccagagtatcaatggttcatttgcaggggatgagggcccaaatccagaacctttctttaaattctttttggatttgaatatcaagtttgattcattaagtttatcaaatttctctgatccactcacagtacctcctattgctacaagcattgaactactaaatgcttcattgaccaactatgtgataccgggggtaaagaagttggatgttgatgctggatctgatgagatggaaacccaaacatacgctttttcttctgatttggaaaatttattactctatactaaaaggtcgattgaagtgaccttacctcaaactttgcggaaactagaggtatacgcattttag

SEQ ID NO: 6832 - DNA, 1185 bp, Candida albicans
ccctttcataaactttccatttacatattttgggtcacttctatgacaataataaacattgatccagactttttttatgagattgcaaaacttccctctgaagttattgctttaattcttgggcttctaccaaaatgcatgttaccaaaattattgtatttcccaccaattaaagagatcgttgtatcaacaatttttacagatgtaaatattattgaggaaaccaaaagacataaaggcagtgatgggccagaagctggctactcagaatgtcattgcgacaggtttgatattagacttgataatttgataaagggtgttaataaatgtaacatttacccaagatccattcatatacaccaaataggtggatttcaaaacgaaccagatactttccttgaacttttaaagaacgctctgtgtattgaaggtaagttttctcaaacttggggtctggatccagaaatcctgttagatttgtttgtcaattctaatgtcaagtttgatcatttagaattgtttgatttccccaatccagttacattaccacatatcgccgcaagtatcacgctatataatactgagttgaataattatgcaattccaggtatcaagaagttgatcttcgacgttgaatctgatgatgacagaaatcaaacgtatactttttcctcagatttagaggaattatatgttactactgataactcgattgaagtgactttacctccaaatttgcggaaactacggttatataaaacccggggcccagtagatcttgtatctgaagaattggttaatttagagtatttactgcttatgttgccgaatattcaatcatttagcgaaactggaataaatgctccaaatttaaaaaagctaattttagagtgtggcaatttgtctaattttgatggtttaaaacagttccaacatttaaaggatttagaatttagacaccttagattccccattactttatttgatgatggttccttacctgagctagaaagctttgcatgctggggatgctctatttacaatacaggagacgtcaacaactcattatcaattttccctccaaatttgatggtattgcagctagaaatttgcagttttgagaataccgaatttagcaattggtacttcctttttcaccacgcggctggaaggacccgagcttgc

SEQ ID NO: 6833 - DNA, 1734 bp, Candida albicans
ctacgagtttctaaaaccagttttcgtacaatgtcatctacagatattggagcaactctctttgctaggctagtagacaatcagtcggacactattccgataattcttaactacttgccaaaatgtatgcttccagaattattagatatatcttctgtcagaaatgcagcagcttctactattctatcaaacgtgaatattacagattcagtttctagacacgaaaacatttatggagatgataacagttacagcaaatgcaaatgtgttcaatttgacattgaaccagctagcctaaaacggggtgtagatcaatggggtatttacccaacaaagatacactttgatggtatggaacaatttcaaagtattttcgaaaatttcccagaagttttgcagaatgccaggagcataaacggttcattttattgtttagaaggggaaaattcaaaaagaattttacgtgaggtggtttcttctaatgttaaatttgaggttttgaaactattcgaattcggggatatgggttctgtgcccctttttgtcaaagatcttgatcttgtcaacaccaaattggacacaacctgtatttctgggttgcagagattctattccaatactaaaaaaataaatacaccgctcttgaattattcctttatatctcgtttggagcaattgagtatcacaactaacacacctactgaagtaagcttacctcaaagtttacggaaattgactgttgattcatgtaatggaacaatatctcttagttgtgaagaatcaaacaatttaaaagaattgttgtttcgttcaatgaatacaaaatcttttgttgaaaccgggataatggcacccaatttaaaagtgttgcgcttagcgaactgttatgatttaactgactttgatagcttgaaaggattcacacaattagaaaaactaagcatcaaggatacgatctatccaattgggttatttgatgcgatatccttccccaaattgaaaagttttacctatggaggggtcgaagatcttttcgagagttcacatgtttggctctcttcagaaaacttacctgaggagtttaataatccaatattaaaattccctccaaacttgacactgttgcacattgaagatactgattattttaaaattaatttagacactttggtttttcctgtctcattgaccgatttacgtctttcacaagtattgttaagtgaaggagaaatacccttaaatgagaacttggaatctatattcatagatacgccaaaactcacttttagtggcgagttcacattgcccaaactggctaagaaattcactataaatgctgatcatttaacttttcaggggtcaaggtttttgaaagagttaccaacaaatcttctgtcattgagtttaaaggcatacgaaagcggtgagatgaaaactcctgttggtaaaataaaatggccatcttcattgaaatcgttggcattaaaacgttttgatcttaatcacaagacttttaaaatgttgaacttgagagattctaaacttgaagacattgatatttataagtgcaagctcgaaaaattagatgtacatgcactcccaacaagtgtggtcgatttgaaattggtaaatgttggaattgaaaacttacctccgtcgttggaaagacttgaaaaattgaaacacttgactttgagaaattttcaccacgccgctgggcggaccacgctcgaa

SEQ ID NO: 6834 - DNA, 585 bp, Candida albicans
acaacaatgctgaaaccaaatgttgcaatcattgtcgcggcattaaagcctgctttgggaattggatacaaaggtaaaatgccttggagactccgtaaggaaataagatatttcaaagacgtcaccaccagaacaacgaaaccaaatactcgtaatgctgttattatgggaagaaagacgtgggaatccataccacagaagtttagacctcttccagatagattaaacataatattatctagatcatacgaaaatgaaattattgatgacaatatcattcatgccagctcaattgagtcgtcacttaatcttgtatctgatgtcgaaagagttttcataattggaggggcagaaatttacaatgaattgataaataattctttagtgagtcatctattaattacagaaatcgaacatccaagcccagaatctattgaaatggatacctttttgaaattcccattggaaagttggaccaaacaaccaaaatcagagttgcagaaatttgttggagatactgtattagaagacgatatcaaggaaggtgattttacctataattatacactatggacaagaaaataa

SEQ ID NO: 6835 - DNA, 1068 bp, Candida albicans
gttcctagtgctactttcaaaaaaggtaataatatcaatggaatatcattaatgaataagactaaaaaagatgtttcttcaattaatggctcctcaacgtcattttcatcgtcatcagcctcatcatcaatattttccagtgttgctccatcaacatcatcttcttcatcttcatctaatggtacaacaattaataatccagcacctaaattacctactttaggttccaaaatttcatcaccttcatctcaaccatttaccagatctactactccattacaaacattacctccattacataaaatagcgtcacatgaatcttcattacctccattacataatatctcgacctacaacaataacaacagtggtggtggtgctgatggtggccaacaatctatggctaattattcccaaactaatcgttcaccaatcaatggtaaccaagacaacaacaacaacaataacaacaacaataacgggaacaataatggtaacaacaacagcaataataatggaaataattttactgcttctgctcatgaagtaacattattgaaaacaagaatttccgaattagaattagttaatgatttatatcgtaccagaattatggaattagaagcaatggaacaagcagctagattaagagaaaattctatgaagaaaagattagatgaagtaatgaatttacaaattaattatcaaaatttacttaataataatggtgggatgccatcgcaaactcaaccccaaccatcacaacaaccacaacaagctggtcaatattatagtaacaacaacaacaacaataataatgatcaaggatcacaatcgattagtccaaatgtaagtattactggatcaacaacaattacatcacctaattcaagaagtaaaataatatcagaaactactccaacccatcatcagcaacaacaaggaggagttggtgcaggagataatgaatcaattatattaccacctttaaaaagaaatcgaactgatgaattaacagatgccaatggtaatggtaatggtaatgataataaaaaagtgaaaatataa

SEQ ID NO: 6836 - DNA, 2448 bp, Candida albicans
tactggaaagcttatgaccatgatatggtagccacagacatagatatatcaaccgatggatccgttgtattgtgtactagaagtggtacagtatttattaaatcgacactctcatccaatcaaagaaaaaactccatgagtggtgcaacattaccgataccccttacagaaaacaaattcaagaaaatagaaaatgtaaacaatgttgttagagtaacgtgtgatcccaagtttttatcatttgggtttatgcgggatgatattgatttattgccattggaacttcctcaaaatgattttttcactgacattgagacattatcgccagcagttgcatataattttaacagaaagcaaaataaattgtttgacacacaagaccatttgtacattgctaattttttcactgcgtcacgaaacaatactcatgaagatgatgcagatgatgcagaatacgataaattatattcaaatcaagatgcactggttattaacaaaattgaggagatctataacagcaaatttgatcctagagcaagtaagcgagtgaaggcattgagcacatacgaaaatattgtctcagaagaagtttattcaactatcaaaagatgtagtggttatggagaagattacgttgatggtttgaaggatatactatccaacaatgaaaacctttttgacgcaaatttcgagtttgcttttgcccaagatgcaaaatttgggttccacagtcgtgttctcgaattcagatcaagcgttttccaaaaattgttacaattgaatgacaagaacgaaactttgattggtgacaatatcaagatagtttggattccagaacaatcaaccctaagagttttgacaaccatttcgcctgttgccgctttaatgttcatgcattctgtctacagtggaagaaaaatggacaatttggaacaaaatgtattttcctactcgtctccagaactagtcaggcttaggatcaaccaatatcaatcactctgtagtttgtttggaattggttgtgacagattgtcagtcacagatgcttttcaagatttactcaatagcaacactggtgatgttgttattaaggccagtgatggtgacgtgtttgcacatgcatttgttttgaaggcaagatcagctttttttgaaactttgctatcagaaagatgggatacagaggaaaaaggtaatgttcaatacgtcgattttactgggttaacaaagttccaggttactttaattctccggcacttgtacggtgttagtaatgaaagtctcttggattgcttccagtatgattttggggagaaagattatttcataaacgacttacttgaattgatcgaagttgctgatgaattattattgtttcagctcaagtctgttttgcagttggctatatgtgatatgatttcgttagacaatgtattggttttacttgttcatgggttcacattaaatgctcgacaattatttctcaattgctgttggtacattttcaataatttagaagttttgatgtttgcacctggttttaaagaaataccaaatgaaacaatgcagttgttagaggtatttattgacaaactatgtaacgtgcaaaatggaaccaaaaactggattgaccaaaatcctaatatattgctagaacacattgaaaatattgaagagttcaatgagtatttcatgagtgatagaaaaggtttttcctcattcaaacctttgattgataatggatatattgatgctataaagacgaaagagaccgtgaaaaaaagaaaatccagaaagagttccacttctgcattcaataaagatattagtgattttagacaaggcttgcgcagagaaaataatggagagagtttcccgccaacaatcattgatgaaaatgatggatttatattggttgaaaataaaaccaaacaaagaaatgcatcaagttcttcgccaaatattttaaatatgaatggtatcgttgaacctacaaacaaaattggaaatttgtcagtaattggcaagttaacttcaattcatcccaatcctgagtcatttgttcaatcaagtggactaccatcaacgtcaaattgggcgactaaaccacaatcgtcgctgatagaatccaatactttgttaccagctgctattagtacaacattgacaactgccaaatccaagccgactaaagtaaagatcggacctgtaacaaaactttcgcaaaagcaaagaaagcgtttagcagcagcagcagcaaatgatgccaatctagaacaaattgatcaaaaaactaccaaagaatcatcaactattgcgccatggtctacttgtgttgctgatacacctatatccaacctgcaaaacatcaacaatcttccagctttaggatcctcgaagcctaagaagaaatttacttccattagccggttctcaccgacgggccgg

SEQ ID NO: 6837 - DNA, 354 bp, Candida albicans
agattatccatgtcgagacgtgtattacctgcattgcatgaaattgctattcgtcaaggtttagaaaacattaatcaattaggatacccccattggtcgtttgttaagttggatgaacccccagcacatgtattaacggttcattatcagttgaaaaactttaaaaccacttgggagtttttgaattctgttgctgagcttgccgctagtaagagacaccatccaactataatcacaacatataacaaagttgacattcaattaactacacatgacagtgacaatagtgtaactcaagatgatcttgatatggcagaagctattcaaaagcaatatcatgaattaactaaatag

SEQ ID NO: 6838 - DNA, 873 bp, Candida albicans
gaggacaacaacaacaggaatcaaatcaatagttgtagacaattattaaatgaacgatcacaagaaatttataaacagttatgtacattaccttatttacaaccaacaaattggataaaactgaatattcgtcataatttacttataaaattaggtataccgataaatcttgatgaattgaatgatacaaataccatctcagccaatcctaacaacaaaaacattgtaactagtgaaactcaaaatgatcttaaaataccaggatataactttggtagtggtggtggtggtggtagtggtggtggttttgtttctgtttctggaagacaaagaaaatcatcaatttctataaatgatataaattggaatgaattgaatttaatttctgaaatacctaaatttgaatcattaaatattgatgataatttgaaaaattcattgattaattcaactttagataaattaaatcaatttgaattagataatttatatcataatctgaccaccaccacaacaacaacaatatctgtcaccaccgccgccgaaggtgatggcagcagcaacaacaacaacaacaacaacaaaagcaatagtagtagtaatgatagtggtagtactattggtggtggtcatgccaatagtcaatggattgatgaaaaattaaataaattgacatcgaattataatgaattattaacattaagtagtatttggattaatcaaattgatcaattacatgaagaatttgaaatttatgaaaatgttatacaaagttttattggttataatcaaaaattacgtcgtgaagaaatatttgaaaatttaaaaaaattaaagaaaaagaaaaagaaaggcaaggcaactaagaaatga

SEQ ID NO: 6839 - DNA, 735 bp, Candida albicans
cataatttctacaactatatcaccaccttcccagagaccaccttttctcaggtcaggggcaaaccccatgaagttttaaagttaattgatgagtacccccaaaatttcatgaacattggcccacacaagggtacacaaattgtcaccagaatcaaagagaaagcccctaaaaccatgattgagttgggtgggtatttagggtactcggcagtcttatttgccaacgaaattgctgacgacccagacgcaaagtactacagtttcgagcttaacccagagtttgccaaaattgccacctacgttatcgacttggcagggttgctggataaagttgagataatcgtgggcagggcctcatacactttgccagctttcagacagagattgttttcggaaaataaacactacactggattggactttatttttattgaccattggaaggatttgtatgtcccggacttaagagttttagagtcactcaaccttattgccccaggaacattgattgttgctgataatattattacgcccggcgctcccgagtacgtggtctacgtaaacttttcacccgatgagaaaaagctctacaatgaaaccaccaagaaccccgaaggaaaggagtttattggtaggtggaacattctatacgatacaaaaaccattgaagtcgcaaccgccaaccacaaagacgcaatcgaggtaactaaatgtgttgattatttctctggataa

SEQ ID NO: 6840 - DNA, 729 bp, Candida albicans
acatttgaagaacctttgaaattaacaatcactactatcgattggcatccaaatggtgtgttgttagcttgtggttcaactgatggtcatgtcagagtgttttctggctatattaaaggtattgatgctaaaccagacccatcagtttggggaacaaaattaccatttcaaactttgtgtggtgattataccaatgaaaccaatgcttggatccatggagttaaatttagtccagacggtaatgcgttggcttatgtttctcatgattcttcagtagggtttgtttatcctcaaggtgaaggattaccaccaagagccattttcaatgtgaaaacagataatttaccattcaaaagtgtagtttggttgaatgatcaacaagtttgtgctggtggtttcacttgtaacttggttgttttccaaggggatgaaaatggttggcaacaagcttatcaggtagaagaacaaaaggatttaacaaaagaagtccctcattctaaacttggtgaaggtgatgacgacgatgaagagatttcatctcatcaagcattgaatatgttcaaacaaatggatttgaaaggaagagtcagtaaacctagtgccggtggtaaacctgccaaggctttaaatactattcaccaaaataccatcaacagtattagaaactttgatcaaggtagagtatccacttcaggaattgatggtaaagttgttatcttcaatgtatag

SEQ ID NO: 6841 - DNA, 1191 bp, Candida albicans
cggaaacacactagaaaactaacccttatagaccatatggcagtcctgagagatcattattttaaattgggttctgaattacccaaagaacgtttgaatgcagccactctgttaatttcagaattagttgctgcagataatgaagaagaatggtcatatgcgttgaatagattacttaaagggattttaactactagacaatcagcaaaatttggttttagtatggcattaactgaagttgtcaatgaattaaataatcggggaactttaactgttgggaaatatttagatttacttgttgaaactacaaaattaaccagttcaatgaaaggtaaagaacaacgagcagttttatttggtaggctatttggtttacaagtattaattaattctcaaattattattttgaaaagtgaaccggaagatatgttacaatttgttgaaattttaatggaattgagtaattttaaaaattggattagagaaactggaattttcaccttgatacaatttataaaattattagataatagtaatgttgaatatagtaagaaaatttatatcaagatattaaatatggttaataatctgggattgaatttgtcaactgaaggtttagcaatttatttatcagttcctcaaagtgcccaattatcacaaaatgtaactaatatgaaagcaaattggaaaaatggtgatccattctataagggaaatttaccagtgttggctaaagttttaaaagatgtcgaagtaatcagtgatgaagaaacaggggatgaccaaaagaagaaaaatcaacaaaagagtagttggaattctcggttaccatttgtgtgggatttaatcgttgccaaattcaatcaagttgctgatgattcaaatgttgaagatgaaatgcaagatcagttggtcacttcaaagaagagaaagaaaaccacatcaccaaagcataataataaacgtgctaaaatagaaccagaatatatttcattaaaagaattctggaaagttgttgttgatgaaactttattttcagaaaaatcatctaatgaacgtaaatattgggggtttgaaatttctactaaatttgtcacatctttagagacaacctcactggttcaatatttatttacaccaaattttatgagatgtgtaatcaatcaacatgcatcatcaacgagaatgtga

SEQ ID NO: 6842 - DNA, 663 bp, Candida albicans
gcgcgggattttccagccccttgggtgaagaactggagctccacaaaagaaacagttaaatcggggaagaaaaattttggcgaattaggagttgtccgaaccaaaccaggaaggtcagacagtttgattagttactccaaatcatgttcagataaattgtgcttaaaacagttggttggcatatgcaatgctacaacttcaactttgttcaaggatagcatttttcttgattatctagtgaccaaaaaccttcctgccaaagatttccatcgatgctttagaacaagattcgatctaccgagcgtggtacaccccttgcagttgctaacttatgactgcgatggctatgaatttgtcaaaagtgaagagaaattgccgtcgcaattgagtcttcttcatattgtgccgttaaacgtaactcaggttttgaacaatggggtgaaaaatgggtcctttataaaaaataagcccccaaagaaaggtggtgagagtattatatgcaaccagaacttcataaacagacttaaacaaatacgtgaggtagactatccagactacgtatcgttcaaacactccaacacggcacgtcaggcactaaagatggcaggccggaaaaaactaaaagactgggtttcgtctactgctgacaattttgtattatag

SEQ ID NO: 6843 - DNA, 759 bp, Candida albicans
atcattaataaagtaaatgtgccaccacacataaattcaatcagttttattcgggaaaatttcagcgatgcttcaataaaagagaaattgggaggggaacttggattaaaggtctataatattgtccggggtataaacgctattgaactacaatcaacgattgaagtcaaatcaatgacatcaactaaaaattttactagctttgtgataagcaacttatttgacgcttatgattggttgaaggtatttgcaggagatttacacaatcgactaattgacttggacagtgaaaatatggaattatcgtccacggaattgtctaacaagtctaagggaataatgaaaagaccaaaaaccttaactttgggtgtactttcgaaaaacggaaccagacaaaccagacaaatgcaaatacctattcacaaagatcttgacaaaatgaaagatatattttttgagaatggctgtgtcttattaagagagtttttggaattcaacacacatataagtttattgaataatcgtactcctgcgaaagatatattcatatgggacccaaaaaaagtcaaaattatggaattaataaacatgtctttgacaatttcaaaatgcgttctggtggaagacagatctacccttttgaaaaccacagatactagctttaataaagaagagcatattgccaaattatttcgggactacaatcaagcaccggggaacaatcatatactcatctcctccaccaccaccaacaactag

SEQ ID NO: 6844 - DNA, 1224 bp, Candida albicans
atacgaatcaagtacgacctaaaaatgttctactgcggcctaatttttggttttttctcctgtgcacgccaccaaacctatcccatttactacctccatcttgaccgtttaacattcccaaacgaaaaaaaaaaaaataatcagcgtaattacaagaatagtaataatgatgataatacaacgactaaaataattaacgtgagaaaatatttaaaagacgaattacggagtacaatcattttaataaaacaacaaacatttacaaaaccaaaacattaccctgggacaatgcttcaatcaattaacggattgagaatattaacattatctgatattcaagggaatttcgacatttttaccaaattatacaaccagcaccaaccaatagacttgatcatacatacaggtaactttggattttgggacataaataccattcaagaatataatgagttgaattatcttaaacaaatagttgcgtttctggaagtattgaaacctgatttggtagaagaattaaacaattcaagtaagattttgtcaacaaatggtagtggcagtggcagtggcaatggcgggaatggaaattctacaaatcctgatgaattagcattgttcaaatctgaacttttgtcatcaaaagaaagtatcagtcaatttcaacagtatgttgatggagaaaaagttttaccttgtccagtatatactattttcggtccattagatgaccccaagatcattgataagatacaaacaaaacaagtgactattcctaatttatttttactcgatcacaaaaacaattatgaaatcaaaacagcaaatggaactccaaatatcaagttatatggtttaggtggtactttaaaaatacatagtctatttgataatgggaacttgaattatctgggagtttgtgggaaaattggagaactttggatttcattgttacaaatagctgaattatatatcaatgttacaaactcaaaggcattaacaaccagtaccacaaagaatgcaacaattaacattttcatcagtcatgtaccagttgttaaagcaccacttttggagcatttggcaatcatcacacatgcagatttcaccatcagtcaaggcttacatttccgatatccggtgatgggcaatggtatgagttttgttgatagtctgggcggatcatcggggttttcaccagctgcaggcatatcattgtccggatgg

SEQ ID NO: 6845 - DNA, 462 bp, Candida albicans
acattagaatcaactctcattaacaaaattgaaacaactacgggctataatatgaatagctcaagactggccaacaatagtcattctgtgtcaaagtcaagtagttctaactcagtatatattagtggaacaacactagcggcattacagcctgccaaatccttcaattaccatcaaggtgcttctatcacatctttagactttgatgatgctgggcaattcctggtatcttcaggaatagacaaatccatacaattatacgactgtcataaggggacacactctaaagatatacaatcacagaaatatggggcacattctgctagattcactcacgaagaattgaattgtctttatgcatcgacaccagaaccaagtgataacaatgaaaatgccattagatatctttctttatccaacaaccgctacttacgatacctcaaaggtcccaaagcccaatga

SEQ ID NO: 6846 - DNA, 801 bp, Candida albicans
aaccatcgaataaaagaagaagaaaggccgatggaagatgaccttgaaagaatgcaagatgataaaattgattatttaaaggatcaaatgattaaagctgccaattctgatgttgaaaagaattctcaaggtcaaattgctactgaaaaattgaaattattgaaagaagtgagcgatattttggcaagagcagatttagccatacctattttagataataatttattggaagcagtaagattgtggttggaaccattaccggatgcttcgatgccagcataccaaatacaaaaagaattgatccatgcattggaaacgttgccaataaagaccgatcacttggttgcctcgggtattggaaaagtattagtgttttaccaacgttctaaaagaactgaacctctgttgaagaaaattgtcgatagattaattggtgattggacaagacccattttgaacaaatctgactcatacaaagacagaactgttcaatttcatgaatataatagaaacaagtttactaataaattgtcaagaggtgttaaaaaaagagaagctaaaaccttatatgaagaaaatgctgaaagaaggaagagggcggctattccaagtacaagaactacggcttataaaattgctcctcaagttgacaagagtttgttgatgagacaacaatctagacatgcaagcaatgatgaaagatttaagagaattaatctgaaattgacgtcaatgtctgtgaaaagaaaggcagccaaaaagggtggtccatcgattgaaggtagagatttggcaatgtaa

SEQ ID NO: 6847 - DNA, 1344 bp, Candida albicans
ccaactaaccaactatcatctatacaacaaaaaatgaatacatcaggatactgggatcaatcgagtaataataacacttctttttctcaacatgaagtacgatcccaacgagaattatcacaagaagaaatccgtgaatcattattattatcatcatccataacagatctgagtttccaccatcaccatcaccataatcatcctcataatcataatcatttaatacatgcaattgatgaagagagtagtaattatagtggaagtcaaaaccatgttggaaataatttatttggtgtaggggatgatgaacaagatgaagaagaagatgacgatgatgcatatattgaaggtgatgttcgaatgagacattcaggaatcagtcttgatgaagttgtttatgaagaaaatgaaaatgatgctgataatataattgaagatcaaagtaatccatcagcaaatccaagttataatagcaataacaaccactataatattgctgagcagactccaccaagtttagaacaaattcaacgagtttattattctaaaggattacaagaattggaagaattacaattatttgatttatcaccattagctacttggaaattgagttcttggaaacaacgatttggattaaaacaattacgtgatgattctcctgattcatattggcaaagtgatgggagtaatactgggaatagtggtaatgatgataataattccaatcaactgcaaaatcccaataatagtatgttattgaatcaattatcaaatcctcattctattactattcaattttctaaaaaagtggctcttgaaagaatttcaattttcacaaattattccctagatgaaagttataccccatcaagaataaaaatcatggctggtagttctgaaggctgggatttgattgaagtatgtactgtcaattttgatcagccggtgggatggtcacatattatattcaatggtattagagctgatggagtgttgaaatgttttttaataaagattattatattagcaaatcatcaagaaggtaaagattcacatattagggctataagatgttttggtaaaaaatcatcaacttcaaatcaaataagatatgcaaatgttgccaatgataatgactataatatccatgatagtaatgattctttgcatcattcggagatgctcagagatttgagtttggctacaacaggtactagtgctgccggaatgagcaatttatcagggtttctgcttaataatcgaattattctgggcttgtcaaataaagaggaagaagaactacaacacgaagaccagggcttaatcgatcgtaatctataa

SEQ ID NO: 6848 - DNA, 714 bp, Candida albicans
atcaaatcaaaacaacaattattcctccatcaaacagtttccacacaaccctatctatcccttcccccccttatcatgccatcatcattagaaccatcatctaaattagctcttaaaggatcactgaaaattgtatgtgattattttgaatttgctttaaattcaatattatatcaaagaggtatatatcctcaagaagattttgtcaccgttaaaaaatatgatttaccaatggttataaatgatgattatgatgtacaaaaatatattaataatattatgaaacaaattaaaaaatggatttatggttcattaatgtcaaaatttataattgttattgtatctaaaacaaatttagaaaatattgaacgatgggaatttaacattgaaacgaaagatcaagaagaaaccaccgaaaatggtgatggtgatggagttgggaaatcacgtcaagaaatacaaaaggaaataagagcaattatacgacaaattactagtctggtttcatatttaccagttttaaaagatgatgatgaatatacatttaatgtattagtatatactgatcctaatacatcgatccccattgaatggtgtgatactcaaggtgatgggaaggtactagatggtgataatgttgataatgtgaaatttacttcatttagtagttcttcaccacgtggctggccggatccgcgcttaataattgggtga

SEQ ID NO: 6849 - DNA, 1425 bp, Candida albicans
attaggttttcttttttgtttctaagtatacatttaggaaacaacataacaaaatattcagtgtcatcaattatgattacaactacaacaactacagcaacatcacagattggtgatttgaatgaaataccgaacttgaaaccaccaagagaaacatttgttgatcaaccgaaaagtccggaggatgttaatttagaagagttaatttatgatttacaaaatggtaccaaaaacgtcaataacttgcatttataccattcaatatttattttatccaaaacattacaatttattgttaaattacaagaacatcctgatttgtataatgaatttagatggcaacaattgaatagattggggatcaatgaagatgatcttatagataaagacacgggaaacattaatgagaataacgaaaggaatgctaatgctagtagtacgttatttcaaccacaaccactgcatatgaccaaagatactgattttgccaatgaaatgagtaatattcgatcaaatacgccgtcattatctccaccaccattgaaaatggccaaatttcataaaaactcgatcattaatgataacaagtattatgatgaacttgaaacatctatagaggcaaggattgttgatgacgttgaagttgatcgagatagttctataaggtcaccagatgatatctcaactctaaatataccttcacctacaaaagagtttgaatcaataattgatgaaaatatcgatgacattaaatattttagtgataataataataacgagaacaacaacaacaataataatgatgaaccacctccatatatccccattgaacaattaattcaatcaacaaccattacaaatcaaacatataatgatgaacaaatcaatgaaatttatatcaataaattaaaattggaaattaccaatcaacataaaaactcccaaaagaaactggaatcacaattggaatcacttaaaatattcaatttattgaaaactccaaatatatcaattgatcaatttttaaatcgaattaaaacttattcatcaaatatatcgataatttcttatttaaatacaacttttttattatttaaattatcaatttatttaaataaaatcacgttgaatttaaataatagtttccgatttttaattggatctttacgttgttcaatcaaaatttttgaagatatttatcaacatcaatcaaaatttaataatgtcgttggaataaataatttacccgatttattgaaaattgaattaaaatttgtttatttaataaattttaattttaatagtaatttcaattgttttatcattgatcaatttttaaaattggaattcattcaattatgtttattcatgaaatcaaatttacctgatgattataataaaattgtcaataatattaagtcatag

SEQ ID NO: 6850 - DNA, 429 bp, Candida albicans
tctggacttgtcccttcatatataaacactcaaatgacaactcagaaacaacaccaacaacaacaccacctacaactgggacaagagaaaaataaagcattgacattgataatatgtgtttgtggattatatgggacgtttttaacatggtcaattttacaagaacgtataaatacaaaaccatatggtgataataatgaatatttcaaggcaccaataattataaatttaattcaagcattatttgcatcaataattggattcatatataattatgtcaccaccaccaccacttccacaaaaaccacaaccaaaaccaaaaccaaaaccaatagtaatccattttcgatatttttcactaatgggaaacaaaattgtaatgttttacaatttgtcttcaccacccggaggctggcaggaccgcgctaa

SEQ ID NO: 6851 - DNA, 744 bp, Candida albicans
agaatagtaagtacacacctacgaatactgtttatggaactcgtcactaacaagaattgttatagttggaataatttttacaaaaaagaacaagataattttaatgagaatgaggaagacacaggggaatgttggtttgacgactctgatgccgaatccaaaatgattcaatttataattgataagttaaatgaggaagaactccctgaagaaataagttctcaatcagtagtgagatttttagatttgggtacagggaatggccatttactatttcagcttctggaagacataaatgaagaatacgaaggcgacaaaacttttgaatatacggggatcgattattcaccggattctgtgaagtttgcttcaggggttgccaaaagaaagtattctgagttgaaagtaaatttcgaacaggttgacttgttgcaggagagctgttcattcttgcaaaacaaatttgatattttactagataaaggaactctacatgcaattgcccttaatcaagaatcattggccgatttctatgggaaaatacggatggatgtctacgcttctcaagttgaaaaaatgatggtactacgatctattttattgataacgtcgtgtaattttacaaaggatgaccttattaaaattattaccaaagtattcaaatttgggaagtctgggggaagagataaattaatccaagtttcccaatttgggtgggtgtccaaacgctcttacacttggtga

SEQ ID NO: 6852 - DNA, 1851 bp, Candida albicans
aaagtgggaaatagagtaaatacagtacgtacattattttatagcatatataaacaaattgttaatagttttttatttgcagtcgacattgcacgacctcttcaagaatctcatcgcactaacaaattgaaattttttttttttcacataaaaaagtatctcctacatctttccgtactacactcatcagccatgcccacaaacatacaaggagaagaagtgataatacctcctaaagatgaagaggaaatattgttggagaaattagtatttggagatgccgcagggtttgaaaataacttgaaaaaattagacaacttatatgattattcagacgaggaggaagagatagatgaaaaaggtctggagaaagaatcagatattgaagatttacaagatgaagacctattttttattgatgatgggaataatgaagagcatagcagtggtgatgatatggaaatagatcaatccgaagacgaagaagaaggcgaagatcaagattcagataatgcatgggaggatagcgatgatgaaaaggttaacatttccttattaacatcagataaattgaaaaagttgagaaaaacaccacaggattcagttatatctggcaagtcatatattattagattgagatcccaatttgaaaagatatacccaagaccacaatggatagaggatatagaaaacaacagcgatgatgagaaagacttgtcggacgaagacaaggttgacgatgaagaaggacaagtaggatcaacaactgcattattaaacatcttgtcaagtactgaaaaattcataaacacaaagcaattgaaactaattgctgcaaataaaatatctataaccagattgaaagatgcaaactataaaagaatcggtaaatcgggtatccagaccattgacttccatccaaactatcctattttgctaacaggtgggtttgataagactattagaatttaccaaattgacgggaaatcaaacaactttatcacttcatactttttgaaaaactgtccaataatggaagccagcttctatccacaattgtcaggcgatgacaccaaaaccagcaacttaatatatgctagtggtcgaagaagatatatgaataaaatcaacttgtcaactggggaaatagagaaaatcagtcgattatatgggcatgagcagacacaaaagtcgtttgagtacttcaaaataagtcctcaaggtaaatacattggattgactggtaacaacggatggtgtaacttattaaatgctcaaaccgggcattgggttcatgggttcaaaattgaaggaacaatagtcgactttgcatttgccaacgatgaatcatttattatgattgtaaattctgctggtgaagtatgggagtttgctctcgaagggaaaatcacttccaaaaccccaaacaaaatcattcgcagatggtacgatgatggtggtgtcggaatcacaaagctacaaattggtggtaaaaacaatcgttgggtcgccattggtaacaataacgggatagtcaatatctacgatcgatcagtatttgctcctgaaacaacacacccaaaaccaatcaaaacagtggaaaacttaatcacatcaatatcttcgttggttttcaaccccgacggacaattattatgtattgcatcaagagctaaacgtgatgctttgaggttggtgcacttaccaagtggttcagtgtatagtaactggccaaccagtggcacacctttaggtaaggttaccagtattgcattctcgccaaataacgagatgttggccattgggaaccaaaccggtaaggtcactttgtggcgtttgaaccattattaa

SEQ ID NO: 6853 - DNA, 1245 bp, Candida albicans
agagtttacaacttcaacaaaaacaatcaaattatatctatcaaacgtatatatttactattaaatatggaatcactacgaccattgacacaaattaaaaaactgaacaaaaagctaccgtcattagttgatatatcattatcaacaattaaaaaacatattcatctgataactgatattggcactactccatatcatttattagaaccaatattacaacaaatccctgctaaacaattaaatgaattagaattgaattgttctcaattattatcttattctgataaattatggatgaaattaattcttaaagattttcgtgatcgaccaccaccaccaccaccatgtgctgcaacttcacctataaagttgaatcagaaacacggtggtggtagtggtggtatttgtggattagatatgccatataaatcattatattataaatattgtcaagatcgagatgaatttagaaaagattcagcgaaacgattacgtcatgcaaataaatcattagaacgacaaaaatcgaaaaataaaattgttgccatagatgaagtattaagagatcccacaattaaatcaagaagattttatgatttaccagcatataccaataacagaaagagttatgggatgatggggaataaaaattcaattttacaaaaggcgaaacgggatactatagtaaatcgtacattaatatttggtggtaacaatggtagtggtactaatcgacatttaaatcgatatgatccatttgatgcttttaaagtagataagaaatcatcaatatctagtttgtcgacagggagtaaatttataagacctccgaaaacaacaacaaccaataataataatgttcgacctggggttagacgaactacttttttcaattcagctggtagtggccaatcaactgctactactactaagagagctcaaccttttgattcgaataacaacaatgagcctaacaaggtaaatccaagtatagcgtcagatactaaatcaaatttgaattctgcacctgattcgaaacaaaattgtgagaccaataatactactactactgctagacaaccatcgatatttttacaattcaaacgcaaatcatcaataatgactaatgatttaacttcaacaaagaaaaagaaggctaagaaactgaataatcaatctgaattgttggaagttaatgaaactccaagtaaattaaaaccattaaaatcatctattttcagttaa

SEQ ID NO: 6854 - DNA, 285 bp, Candida albicans
tctgcatcctcatcagcaaccaaccaagccccaggtggattaagaagcgcagttaaaagaaagaccactcaagaaaagaaggctcaatcatcaaatgccacaccattatcaaccagatctgctggtgctggtggttcttcctccacaatgatgaaattgtttactgatgaagcccaaggattaagagtcgatcctttagttgtgttgttcttggctgttggttttatcttttccgttattatcttacatgtgtttgctaaaatcactggtaaatttacttcttaa

SEQ ID NO: 6855 - DNA, 924 bp, Candida albicans
attctttttaacacaaaattatctatcctcatcgctgatttgatatacaacaaacaaaaaaaaaaaacaccaacagttcatccaatcacgtctaaattcccattatacatgaatagtctatcaattaaattcagaaatcggcactgcaacaacttgctaatatttgcgcgaaataaatccaaacagaatgtacggaaatatattgatctggtcagcaacgatacgtactctaacaagagacgacagagtttattcaaatctcgagcggcattcaaacttcaagaaatagatagtaaatacagaatcttcactaagagaacaaaaaacatcgttgatttggggtttgcaccaggagcttggacccaatttgcagttcaccgcctagaagaacagaatctatcacacaacatacttggtattgatatcaacttggcaactccagttaaaggatgtcactacatgcaaggtgatattatgaataaatctactcatgccaaaattagaaatttttttgaaaagcaaaggttacgagagactcaagactatcaaacagataccagcagcgatgaagaaaaacaacttgatttgattatgagtgatatgatggtagactgtacaggaactggactggcagatcatataggtaacatggaactttgtacggcagcgctatatttggcatacctggagttaaagccagagaaagatatgattttaaaagtttggctgggtctggaattgaaattatttgaaacaagaatgaatataatgtttaaaaaagtcattcacataaagcctgacgcaagtaaagatagactgagcgagttgtatatggtaggaaggcgtaaggtggacttggaaagcaagggtattacatttaatgatatcctcaatgccacaaactcaacagaaaaggtatcataa

SEQ ID NO: 6856 - DNA, 276 bp, Candida albicans
gcgttgtggacacagtatgatgatgaatttgatggattaatggagatagaagaagcagatcaagaagatcaagaagcaggtggggaagaagaggaagaagttattgatttagaaggattagaaccagcaagaaaattgaataaaggaacaatattagctaaatctattgaatatattaaatttttagaaatgaaaaatgaaagaatgaaacaagaacatgatgaattggtattaaaggcaagaatgttaggtttagttattgatgaagatatgtag

SEQ ID NO: 6857 - DNA, 1023 bp, Candida albicans
ttgctcggaggtctgtcttccagcccgctggtgaagacatcggacaagacgtgcaagtttgtcactcccccagcagactcgtctattgaagtgttgaatgatttttactggacagatactgatgagccacatgtggccaggagaaagatgattcttcaaaagtatcctgaggttacgaaattgacgggccacgagcccaagaccaagtggtatgttatgggggtggtgttgttacagcttgggattgcatattacattagacacacgccggttttttcatggaagtttttgacgttggcgtatgttattggagccacagccaaccaggcgattttccttgccattcacgagttgtcccacaacttgttgtttagaaagccgttgcacaataaattgtttgctgtgtttgccaatattcctattggggtgccatactcggcctcgttccagccataccaccagttgcaccacaagtttcttggtgacatgtacttggatactgatttgcctactgaatatgaagggaggtttttgtcgagcatgcctggcaagttgttttttgcgatattccagattttcttttatgcgttgagaccgatgtttattactcagatcaagtttacgtatgtgcatttagtgaatgttgtgttccagcttatttttgatcatgttatggtgacatgctgggggtggaaggcgttggggtactttattgtgagcacgtttttggcggggtcgttgcacccatgtgctggccactttattgctgagcattatgtgttgaatgagaataatgtgccacgccaccaaaagattggcgggacaaacatttcgaaagaattgttgccggccgagacctactcgtactatgggacgttgaacatgcttacatggaatgttgggtaccacaatgagcaccatgattttccatacattgcgtggacgaagttgccagagttgaagcgaattgctgcagagttttacgatccgttgccacaggttacttcctgggtgtggagttat

SEQ ID NO: 6858 - DNA, 201 bp, Candida albicans
caaacggttagggggttaaaattcattatgatcacagcaccaaatgtggccaattcagagacagtcaccgacgagttattccgtcatttaaacctactttattcggataacgttatgaaggatccattttattcattagatatgcctataaaaagtagtttattcgatgggagagtcaagcagttgtttgcaccactgtaa

SEQ ID NO: 6859 - DNA, 540 bp, Candida albicans
caaatcgaaatggaagacagagcaatacatacttctccaacacgatggttgcaccactattcatcaactacagacactgcaaactcaggattgcaaaaagttgatacaagatggctgaacaaaacttatttcccaaaacaagctatccaacttgagtcctttgaaggtgacaatttgataacacaaagcaagccatcgatgttctcacgactattatcgaaatttagaagtataggtaaaaaagaaatcgtacctccaaactataggtcactgtctattttgtctgaaaagatccataagaatcattctgtaagtgctttcttcccatcaacaacttctaaggaaacgccctatgaaaacatattttctccactggttgataaacccatggataccatcgatacaattcaagaaaataattgtacaatggcatttattaaacacgattgtcgcacggagtcaaatttctttagcagcgatttttttagagatagcgttagaccagttattgattacgatgaaagtgaaattacagattag

SEQ ID NO: 6860 - DNA, 876 bp, Candida albicans
cgctttaaattgaccggggatccggcagtccgtggtgaagatgatggattagaaatggaaattaaggatggatttatggttcctattaatgaaactggggattctattgccattgaagatcaagttcataaatcattatatcaattatataaaaaagctcatcctaaagaaactgttttaggatggtttggaagttctaatcaaatcgatgatattactagtttaatccatgatttttattcaaagggggttgatagagcattcccattccctgccatatatttaaatgttgaatttttaaatgaaaaaaatcaagttattgaacctaaaattacaacttatattggtgctgctgttggtaaaccagttagtaatactcaacaaattggttggaaaacaactaatgtcaataattcatacattttcactcctattcctaatgaagttataaatgccaccattactgaaaagattgcctttaaaactttgattgatcaaaaaattaaccaacaaaatgataataccaataccaataccaacaccaataacaataataacaatggcaacaataataataccgatgatttatcatatttgagtcaacaattgaataaagccaccgataatgttggccaattgttatcatacattgaaaacaatggtaataaagatcaagatattgatttattaagattattgagtaatcaattattgaataaaccagctattttgaccaacttacctgaattggaaaaattatttaaagatcacaaccaagatgttatcatgattgagtacttgactaaagccgttaaagatcaaattgaattaagtgctagattgactgcttctgctgaagccgataaagctcgttaa

SEQ ID NO: 6861 - DNA, 246 bp, Candida albicans
  unsure (35): Identity of nucleotide sequences at the above locations are unknown.
ttaagtatacatttgtggggggggggggggggganaacgcacgcggcgcattcaaccctatatgaaactcatctaactggtgaacaaaggcccgtgaagaacaccgtagaaccagcccactcttctgatccagcagttacagatacaaccgacattgcgttcatgggtacattggtccggagacggacatggtactgcgtatgttgttgcaacaacaggtcgaaccgtgtgtgggtccctgtttga

SEQ ID NO: 6862 - DNA, 504 bp, Candida albicans
tttgagatttacaatcttagaatcaaaatggtagatagactagaaaccaccggacctgtaaccacgacaatgacgacgacgacaatcgcctcaccacaaccacaaccactacaaaattcaaccattatcaatgcttcacccaaatcagatgtaaacaaaattcatagtcgaacaagcacaattgatacctcggccactagcacatttgataataacaagttactaatatcaacagtattgtataaacgatcacgccatactcgtcaatggaagaaaaagtgggtagtgttaagaaaatgtcaattgagttattataaagactccaaggaatacaaaccattgaaagtttatcatggagaggatttattgtcatttagtattattcctgatcatactaagaatcattttgcattatacactagtaataaagtattacattttagagcacctgatgagacaactttccatcagtgggtagatacattaaatgagtattttaatagt

SEQ ID NO: 6863 - DNA, 810 bp, Candida albicans
ttggagttagttatgcagattgccgttttatatctactattgacatcttgcatgatccatatttatgcaatcacctcatcatcaacatcatcttccactggcgatcatattatagaatttgacgataattccattcaatctacattagaactagctgatttttcctttatatatttttattctgacgtttgtaaatattgtcgaaaatttgatcctacatttgaaaatctaagtgtattatacaatcaacctaaacagaaagacaccatcaagaagacaggtagcaataatgagagattatattttcaaattttgaaaactaatgctagacaaaataatcaattgagtcaattgttcaaagtttcacaatatcccacattaaaattattgaattataaaactaaagaaataataacttatgataataagaataatcgagatttacaatctattattaattatttacaacaaaatttaaacattgaacctcaatttgaaaattttaagagtaaagtcaaatattatcaatcaccccccagtgattcttttaaacaggatctagatttttttggaaatgaaaatgaacttgaaaagaatgacaaattaatattcttcattgctagttatttacctgaatggtctgattatcaatatccagcacatttcatccatcaattagcattagattatccggacttaaccattataattgttgattatgaaaaattgaatgattatggtgtattatccaaatatgaaatcaacagtttctcccagtgtcatgtattcgaaaaacaatggggattataa

SEQ ID NO: 6864 - DNA, 1857 bp, Candida albicans
tcaaaggaatgtgccgcaaaaaacatatatttgtatgggtttcatgatatagttttagatcatcattgttttggttccaaaaaactaaataacctccgtatacaactaagactccgagaggaaaaaaaaagaaaaaaaaaaattttgcatatttttcagctgggtaggttcattgcaactttattggcagacttcgtcatgacagaaccaaagagacgcaagtacaacaaatcccgccgagcaatatctaccaatagctttttagttaagcatcctttaaatgtcaagccaggtggaaactcattcattgcctcgactcccatcctacaaaaacaaagaaaggactctttgggtgatttctgcatattaccagatgagataataatgaacattattagttacattactgacattccatcattattgaatctatctcacacatcaagaatactctatgcatttttgtatgacgaagaaatctggaaaagagtatatttgcagaacaatgaacactatgataccaaaccatggctaggatcgtggagaagtactgtgttgaatattatagaaaacaaggagttgttacagttacctgataatttgttgtgttcagatttgctatatcgacctattcagtgctctcaaattgattacaccaaattatttcatgaaattatcagggaagaagaagtatatcatcgagatgcgatgttaggccaacttgatgacttaccaagaggtagaatacaaagaatccaagaatccagtttaagtttggatgaatttaatgcaaattatcattcctcgccatttatcttagtgaattcggattctaaccgttggccaaattggaattttgacttgttattccatcggtttcctaatgtgaaattcagacaagaggcagttagttgggatttgcaaaaatattcacaatatttacacaacaataaagatgaaaatccattatacttgtttgattgcaaaagcgatgccatgaaagttttgaagcaagaatacaaagttccagaaatatttcaagacgatttatttactgtgtttaacagtaaacaatttaattgcagacctgaccacgcctggataattatggggtctgctagatctggttccactttccacaaagatcccaattctacttctgcctggaatgcagctatacaaggccggaaattatgggttatgttgcctcctcatatgacaccaccgggtgtgggaactgatgaagaagaaagcgaagtaacgtctccagttagtgtagcagaatgggtgatttcaggttttttcaatgattcaaccaaaattgatgaatgtttgattggaataactttccctggtgaatgtatgtatgtgcctagtggatggtggcatacagtgataaacattgacgactcaattgccattactcaaaactttgtgcctaaatcaaagctagctgaagttttaaattttttgaaaaataaaccgaaacaaataagtggtttcaggttaaaagaaatcaaacaatgtttagatttcattgctaaagatagcagtgatgaagttttgactcgatatttagaagcttttaatctgttgacaattgatctagaggaggattgtggtgaattacaagatttgcccgatatgccaatttttgagattttcaagcaattactaaataataatggcaaaggtgaaattttaaatgatgctttggaaaagttacaaaagattgaattaaagaattatgagcgtgaaactggtaaaagcaaggcatgggagaaattgacggaaccaactaattcagggactgctactttttcattcaactttgatgaagaaagtgatagcgaatag

SEQ ID NO: 6865 - DNA, 525 bp, Candida albicans
attacgccccacccctactccccatcaatcatgtcacaattatttgaatgggcatttggtaagaagttaacaccacaagaaagacttcggaaaaaccaacgtgctcttgaaaagactcaacgagaattatcacgagaaataactaagcttcaacaacaagaaaagaaattgatatcagatattaagaaatcagccaaactgggacaaatatcaagtgccaaaatccaagctaaagatttaattagaacaaaatcatatgtatcaaaattcacatcgatgaaaactcaattacaagccatttcattgcgaattcaaagtgttcgatcgaatcaacaaatggccatgtcgatgagagatgccactagagtattaggagggatgaatcgatcaatgaatttaccacaattatcaagaatagctcaagaatttgctaaagaaagtgacatgatggatcagaagcaagaatttatggatgatgccattgatgattcttcaccacgggctggaagatccgcaattgcgtta

SEQ ID NO: 6866 - DNA, 939 bp, Candida albicans
gacaatttcaatgaaaaagctaaaataagtagccagacaataactttccattgtagagagatgtattgtagcgcaaggctttatctttttatcagtggtgtttgggccattgacgtctgttgctaccaaagaaaaaaatcgtctccacgggacatagaatggattcttaggcgcaggttcttgataagcaacaactttctcttcatacaaaacgaatggcaaaacagaaaattcggcacaaggaaaaaaatattgagagatttcagtcattcatccacttcacatagaaacatatcaacacctatctaccaacttaacctattacctcccaccatggccggattagaacaatcattatttcaattaaaattcactgccaaacaattgaatcgacaagcaacaaaagcttcaaaagaagaacttcaagaaaaagccaaaatcaaaaaggcattaagtcaaggtaataatgatattgctcaactatatgctcaaaacgccattcgtaaatcaaatgaacgaataaatttattacgattagcatcaagaatagatgctgttgcatcaagagttcaaactgcagtaactatgagatcagtaacggggaatatgactcaagttatccgggggatggataaagcattacaaacaatgaatttagaaaggatatcattggtgatggataaatttgaaactcaatttgaagatttagatgcatcgactaattactatgaaacgacaacaaataatgtcaatgctttaacaacaccacaggatcaagtggatgaattgttgaatcaagttgctgatgaagcaggaattgaaatgaaacaaggtttaaatgctacaaaagtagaaattacaagtcctgttgctccaaattcaatatctgaagaaaaagaagataaattagcagaaagattaagagcattaaggaactaa

SEQ ID NO: 6867 - DNA, 621 bp, Candida albicans
  unsure (617): Identity of nucleotide sequences at the above locations are unknown.
agtcattattgtagtctccataagcaattataccaatttttacagatgagtttaacacttgatgaattaactcaattgaaaaaacaagtaaaagaaagagatgaagaaattgatttattaaatgcatttataaacaagaatccaagattactgtccccctgtgttatagttcacggttatatatctattggtaaaacatttaccgtcacaaaattcttaaaggcattaggaacaaatttctctactattaattgtgatgaatgtgtttctaaaaaaatcttattacgtcgatgttttgataaaattagaattgatagtggttgtccaaaaggatcattaaatactagaaatgatttagcaaaatatgggaataatggtgatagtttttcaacatttgtatcagcattagaattgtttgttgaagaatttgattataaattggaacatcatgttttactactagatagatttgatcaatgttttgaatatgtcaatgatttattagccgggtttactcgattaagagaatcatctactttattacaaaattttaccgtagttgttattatatctggtgaagacccaaaagaaatcctcaccttatcaaacccacaatnttag

SEQ ID NO: 6868 - DNA, 591 bp, Candida albicans
caaccaacacttacattctggaccgataattatcacacaaacatggcgtatagattaaatccagtcgatgaggactacgtacaggcaaaggtaaataaagataaacagaatacaaccaccaaactcctgaaaattttcaataaaaaccccacaaattattctaatgttaaactagaggaatttaaaccttggataaccgaagaaatcaataaacaattacctgacgatgacatagtgattgactacatttacgaattgttgcaagactatggaaatgaaccaggcagggagtttcccgatattttgaatctaaatttacaattggcaaatttcttgggagaaaaggagtcaaaggtgttttgcaaacaactatggtccttgattctagaggcatcgaacgaacctgatggtattcctgcagtctttaaagaaaagaaggaaaaaccaaccattgtccagaagaatgaggaatccgagtccacacaaaagacaagaacaaaaaagacaaactataatagaagtcttctcttgtgtccaacctggataggaaacctcgaacagttgtcaacagggatcttgcccaggaactga

SEQ ID NO: 6869 - DNA, 1761 bp, Candida albicans
caggtatggttgttgatcgaaattggcccaaatattcctgtaactaattacaacattactaatgtcaaattatggtatcctataaatcaggggaaacaactgctttaccagttttctttaattattaatggaatttgcaagactacacagaaagtagggtttaggaaaatagaattagttcaagtgaatgataaatatggtaaatcgttttattttaaaatcaacaatataccaatacaaatttgggggacaaattggataccagctcattccttccaatctcgattaaccaaattagattatcaacaatggatcaatttaataattcatggtgggtataatttaattagaatttggggtggtggtcaatacgaaaaagatattttatattcattatgtgatgaagctggcattttaatctggcaagattttatgtttgcttgtgggatttatcccgaaaccattatagaatccgtaacccaagaagttgaagatcaattaattagattaagacaacattgttcaattataatttatgctggtaataatgaagattatcaaattgccgaactgataaatcttgataccaataattccactcaattcccagcaaaaaatatctatgaatatataatacctgataagatcaataaattgtgtaattttacaccgtaccattatggatctccttattctgacacttcacacaaatcttcagatccaacaataggagatttacatcaatggaatgtttggcatggtactcatgaaccataccaaaattggccagaattatctggtaggtttgtatctgaatttggaatgctttcaattccttctttgcaaacattgacaaaatatatcaatgaatcacaattatcaataaattcaaccttattaaatttccatactaaagctgctggcggcattgaaaatttggataattatttatgggataatttccttaaaccggaatcactagatatttctcattatatttatttgacacaattacttcaatctgaggcaatgtctttagcttatcgctattggagacggaattgggaaaattataaaacaggtggaataattatgtggcaattaaatgattgttggccaagtatatcgtggtccgctattgattttttaaaaattcctaaattggtatattatggtgtaaagagagaaattcaacaagttgggatagcttgtagaaggtatcaaattaaacaacaaacttataaacaacaaaatgtatttgaagttaaaaattgtttagatatttggggatttggtgaatttttggatattggtgttaaaattgagttttatactgaatatggagacttgtattttttcaaatcaatcaagaatttggttttccttaacaatcaagtgaatatggttgctgaaaagctttgttttgataacataaacgataatactattatctatttgaaattaattgaaaatgacaaaattatagctcgatctagtgattggccccaaccgttgaagaaattaccatggaataagttgtcgacaaatttaacaatagaatatcttggacaaggagatttccaaatatccacgaccaaacctgttaagagacttgaattgtattttgattacactcataattacctatttgatgataatggaattgatttattcccagatgatcctcaaattatacatatcaataattttgatgaacttgatgttgaaaaaatacgatatagacatttaggaagtatataa

SEQ ID NO: 6870 - DNA, 726 bp, Candida albicans
tctaactatacgataatgttggttgaagaagtacccaaatcaacaaatgccaagacatctactatttattttagttcatcaatcaatttaactgctcgactgttgggtaagtccaccaacacgggtgaatcaacctcaaattctaacaagggaagagccaaagtcaattataatttaactcaattaatgaatgcacaaacccaatccaatgaaccaacaaacacgggacctttaaaatcatcacaacaaattcaattagaaagattagtttcgaaaagacttgttgaattaaatcaagaaacatcaactaaaggatttgaattaccgaaaaattttgtttatactagtattcattccactggtggtggcgataatactactaaaccatcacataaatcaagattaggtaatactccagcgacgaaaaaaatattggcagcaagaagaaatttaaatctgtattttgaagaagaacgaaatttgatttctgttaatactatccttggaataaattatcaatttgttgattttactgatattgacaataataaatctgccacagcaactgctagtaccaaaagaagaaaattggaaagtgttaaaccaaaaattagactttgttgtatttgtggtgataaatcaaattatctgagatgtctgtcttgtggactttattattgtagtgtgaaatgtaataatttacatcaagaactgagatgtgcataa

SEQ ID NO: 6871 - DNA, 666 bp, Candida albicans
tgtttgacccatcgtggaaggggggtttttaattctgaaggttcaccaaaaacacaaccaaatcactcggtatcattattaaataatgaggttcgtctggaatcatcaacatcatctagctcaacaacagtaacatcgactgcattaccaccaccttcagctattgatcgttcagtgtcattagttggtggtagtccgtttgatttgtcatcaagaatgaacaatcaacaactgtttaatcgaacaccttcaatatcaacaccacctacacagaatggaagactacccaaaatatcttcaccattgataccttctaacacagaatctcaatctccaacaatggtaactggtactgataatgatgttggtgttacttctaaaggttctacaagtattatttcggtatctaaaaaaccatcagtgttttcaaattcgttacaggagcgattacggccatcaatgtttgaatatcatccaattggtaataatttatcaaaagatgtccttacaatacctaaaataagcacaaattcaaattctggatcaagaacaacttctcaatcatcaatgtcatcagcatcagctttatcttccaagaaatcatcattatcatcaatttcttctactcatggtaatttatcaatatggacctcaaccaatatctct

SEQ ID NO: 6872 - DNA, 1056 bp, Candida albicans
ccctttggaaattgttgtttgaagataaacaatgggttcgccagtaaacacgtaaacgagccattggaccatttgattaatacgccagccaaaattggtccccaagtttttattaaatccaattgtttccaatattggtggagcccaaatttaatccaccaggagagacatttgcttataaaaatgattggacgtattatttaccaattagacgagttaattcgaccatatacttctaaagttcttacagtcatatcaccattcttgatagatgaagaccctacagttaggttggagacacgagaaatcatatcaggcttgactaaagcagctggtttagccaatattatatcaacattaaggccagatttagaccatgttgatgagtatgttcgaaacttgacagcacgtatattcgccatagtggccaacacattgggattaaaatcatttttaccattcttaaaagcagttatcaagtcgaaaaagaactggacagcaagacatactggtatcaaagttattcaacaattatgtattatgctaggacgaggaaatggtacggcaatattgccatatcttgcaaatatagttgaaatattgaaacctccaatcaatgatgagtcattacaagtcagaactataacagcgttaactttggctcaactagctgaaaacgtgtcgccatatggtattgattcgtttgaacccatattggaaccaatttggtttggaatcagaaaacataggggcaaaggcttggctagtttcttaaaatgtattggagccatgatccccttgatgtcatatgatccgaattatgaagattacacaaattattatacaacagagctcatgcatatcataacacgtgaattcagatctcctgatgaagatatgagaaagactattttgcgtattataatgggattacctttgtcgagaaagcttattccagactatgaaaaatcaattatcgggccgtttgtcaatgcatttttggaatcgttcaaactgcttcctgattcagtccaaatcacaaaggctagtatttaa

SEQ ID NO: 6873 - DNA, 360 bp, Candida albicans
gatttcttggctggaatagtagtgtttctagaaatcaatctggcgaaaacaccacccatggtttcaatacccaaagacaatggggtaacatctaacaaaacaacatctttaacttcaccagctaaaataccaccttggatggcagcacccatagcaacagcttcatcagggttgatacctttagatggttctttaccaaaaatagatttgacagtttcaacaacctttggcattcttgacataccaccgacaaggataacttcagaaacatcggaggtggataaaccagcatccttcaaagcctttttacatggttcgatggttttcttgatcaatggttcgactaattgttcgaattga

SEQ ID NO: 6874 - DNA, 963 bp, Candida albicans
tcgttgatcaaagtgtgtgttgtgttgttcaagttgtacctttttttttttggacaaaaatacacgcccacacactatcagattgttgttgttgttgttgttgttcattctacaaatgactcttttataatttttttgattgcaaataatcatcaatcatcattaaacactatttatgtttatacttatacttattacactatgagttattcagatcacccacctataatatttttttcaattggtaatcctggtcctataactcgtcattcagttggtcatttcatgttaaaacgattaatggaatcatcatcaaccacttcaattaaacaattgagtaattattcatcatattcattatcagttgattcttttaataatataatttatattaaatccaatacatatatgaatgaatcttctaaagcatggaataaattcaaattatcaaaagaatatagatcatttataaaggaacaagaccaagaccaagaccaccacgatcaaatagttagtgtgattatattatatgatgattttgaaaataatttaggtacgattaaattaaagcaatttaaaaaaaaatctaataataatgaatcccataatggtttaaaaaatttaaaactctccatgatcgatggtaatagtagtaatgctactggtgaggcaatatatttacttggaatcggaattggaccaaaaccaaataataatccaagtggagaaatcatgagacaatggatattaagtccatttaataaacaatctgaaaaatataagttagaaacagaatcatttaaattattacaattatatattgatacaatgatagaacaaattagtaatgataatgatggtattattaaagatgttaataaatttaatgctaaaatgacaaaattatggaaaagaaaacaatcagaacaagaatcattagaatcatcacaatggttagagtaa

SEQ ID NO: 6875 - DNA, 603 bp, Candida albicans
gattctgctgatgatacttctatagacggagtttcaacagataaagattccagactaatagattcaacagcgggaatttcagcggatgatggttcagtagatgaagtttcagtaagtggagtttcagtagaaggggtttcagtagaaggggtttcaacagatgaagtttcgacagatggattttcaacagaaaaggactcgaccctagctgattcaacagttgaaacatcaggggatggagactcagaagatggatcagtagatggagactcgctagatgaaacctcagtagatgaaacatcaacagacatagactcagcagttggtgattcagtggatggagattcgacagatatggattcaacaggcaacgattcaaccgatggagattcaatatatgaagctcgaacagatgaagattctaagacggaagattcagtagatgatgactccacattcgcaggttctgaagaaaatgattcaacagatgatatctcactcagggaagattcaacaacaggtggttccacagattgcgattctatgatcgtagttccttcaagtgacgattcttcctcaacagattcaataacagatgattga

SEQ ID NO: 6876 - DNA, 360 bp, Candida albicans
ttaagcagaatggataactttttaaaagtggtgatttttgaagatatcaaatccaatttggaaaccagcactggcactggcagcagcaccgccatgaccgatactaacacctttaccaatgtacccgttgtaaccaaagtaaccggttgggcaacccaaatcgacagtcttggtaccggtaacacccaaagtaacagtttgagtcaatggacagtaagtagtgacaacagttttgacatcagaagtagtaagtgtgacgacagtaagaccagttggagcagttgttggatgacaagcattgttagaacaagaagtgatagtaacaaccttagtggtttcagcagtaacagtgacgaatga

SEQ ID NO: 6877 - DNA, 2652 bp, Candida albicans
catagagaaacaagtatggcagagacttatcagagcactttatactcggagttattcaacgatagtatcgataacgacgatgatttttacaaatccatatttgttaccccaatagcaaaagacttattaacaactgtattaaacacaaacacagaggctatagtgttgacatctgaagtctctgataaaaacttgttaattttaagcagaatttattttagtggattgaaagttcttgctcaagcaactaattatcatcccctggatgtaactaaattgtccaatgaaaaagtcaaatctatagtaggaatttcaaaacaaaaccggacagtatcatctgaaaaactatttgacgatgaaagtggagatattactgaactaaatgggaacgtactgaagaatacaagtaaacaaacattgaatgaatttgatgatggtgacgatttaacaactctaagcggaggaaggcaaggttggcaggatctgctaagtaacaacccaggttttccattaaaagatgagaatgcgtttagtaatctaagtgaaaaagatagaattgatctaattggaaatgtattaaaaatatttcaagtctggttccagaatttaattgatgtggatttcaaacttgaagtatctcagagatcttctggtattcaattaaaattaagagtatttgaattctgtggagagaatagtaacggatctttcttaattgaattattcactatattaaaatcctttttggctactgctattaaagagatagaggacacggatctggaatcgaaattcatcagcttatctgcaattaaagaaagcatcaatttactaaagaaagttttcacactgatttttttggacctcgatatgcataaaaaaggtgataatgagtttaaatcgcttgtaaaattgttgctggtattctttgaagttgactttgctgatgaattttggaaacttataaaacttacaagtccagatttggaagacaataactacaaaccacctaaaattgtgctatcacttgaaactatgtcaactttctatttgttaatgggggttttagctaatactccatcgtcattgttttctgagggaaaacgcaatgctgatatcaccacattttccgtggaaatgaaaaacccatataaaagttatttttcccaggatttcaagtgggatgttttcaatcagcaagtaaacctgaaattattacccttattttgtgtggagttcaactactgttataactttcgtcccgatttagtgttagaacagattcaaaatagctcacttattaactggataagtgggaatcgtttgagttctgatatatatgttaattgcctaacatctcaaacgatcacaaatttggaagtaaacaaaaagttgagtgtggcaggctctaaaagtgacttgtattgtcaagaattgaacaaaatatataattcaaaaatccaaaatttacaggctaaacaatctaacgaagaaatgaatttggacttgtctaaaattttccccgttttccttcacatgtacacatttgctcaaaattcatcttttaacagtattcttactacccaacagtatcacttttacgataaaattgatgatagaacagatgacgaattgaataacgtggagctttttgaagtatgggtttgtttattgtcgtatgtttttgaataccaatataggtcaactttgatgcaagatttaactcaacttgcattatcgacactattaactttgccattgaataatttggtggattatcaaattaatgagtataaatggaaattgtgtcatcagaaggtgccatttgtacctcttgatttgggtgccaagggacacaaaccaagtattttttacattttagatactgtacaaaacttattaaggtttaatctaactaatagactccatgtcgttaatctttctatgggactaaatttgatgtataatattttggatcacgtaaaagcagattccaatattgaattggataagtattcgtgggataacttatttttgagtttgtttggattgatcaagtttattaaaaagcaaaacctgttgatattgaaatacattaatcaacgtgatctaggttctttaactgaagagtgtttcttggttttgaatttgttgcttgatactaggttttcttctgtgaaacaagtcattgtccaagagaaatcgagtttcatgggcctatttgattctgatgaaactagatctataaactacgcgttaatttacaatattttattgaatttcgaagttattcaaacattgataaacgagtttgggttatctgaaagcgaacacttgacaaatttgtttcattgtatggaacattttgacaaacttttttatttaactgaagattcgaaaaaggaaagactttataaaaagactgaggtgcttgattttgattttgattcccctgtgtttgttgctgcaatcaactcattcactgacgcaaagaatagtaatcagactgagaactcaacagagggtacgcaatcaccaatcacatatcagtataatcaaacattgaaatactccttgaaacagaaacagagagctgtgttggatgaccaagctatgtttagtcttatccaccggactttcttttcagaatga

SEQ ID NO: 6878 - DNA, 1188 bp, Candida albicans
gctggtctattagtttggttgttttctttggggaagaaaatggtgctaaattttgatgaagaattgaatttgcaagagtatacaatttctaaccagggttcaaaaagaactagaagtgttaagcctgacaatattagtaatatacttgaagaagcaccaaatgaaataccgaataaccaactgaatgttgactttacaaattccgaattagagtacctaacctgccacagtttaacagcacatgcgtttgaaaatagcgaaatagatgtatcccctgccatttcaaaccaaacacaccagctgctaaggccatcattttcttccgagtacgatacagacacaactgatcttataggatttgtagagcagaacacccatcacgcagttacaacttctaaccgctacaacaagtcgtcagaagaattggtattccaagagagtattgactactcaactttccttgagaatgtccttgaaagggaaaacaacaacagcataggaaatattgaatcaagtagagagtttgataatgcagcagcaaacttgtttagctcggaaaactgtgaacacgatttgttactactacagcacgaattacaggaaaccggtatacctattgagcaatttcaaccccaatcttatatttacaacgaagagaatgatgactttctaaatcaaagtccagcacaagtcaatacagcagccaccattaccacaactaccacgctgctggttctggttctactgttagttaaatcaccttgtcacgtgacttccaactatgaagattttgttacttcaccaatatacgaatggccaaatgacgaatcgggtgtatcagttgaccttttgaacacaattaatgtgcgagtagcgagtttggaaccgaaaacagtgagtgatgcagtgaggaaaacaatacgcgaagaatttgttatacaagacatgtttctaaatggacaatctccactaccaccagaaatacccagatcaataaggaaaaagtcagatagagacgttgaatggactcccctcagtgtttacaaagcttatacaaacattaaatcgcctactaatggtaaagaagcctataaccatttagtgccgtatacttcttgtattggtacgctaaactaccgaccaaaagatcacgctgcttggaaacgggctcctaatagacgtcgctaa

SEQ ID NO: 6879 - DNA, 213 bp, Candida albicans
gtcaaagtacctgttttatcagaacaaatgtcattaataccacctaaagcttccaaggagtcaaattttctaacaatgacgttttttgtcaccatgacttgtgctccaactgccattgtaattgtcaaaacaagaataagtgcagaggggatcattgaaagtgcaacacagatggcgtatatggctacttccttattaacgtggaatttctga

SEQ ID NO: 6880 - DNA, 1047 bp, Candida albicans
gcagcgtggttccttccagccgcgtggtgcaagacagagttcaaatgtttgaagcctaaaaaattttttttttcgttttgttccaactctattcacaatacagaactaccactaaggtctttttcttttttgaccctacagtacatggatttgatccaacattacacgtcagaaaccgaaagtgaaaccgaaacccaagaggaaggcgacagagattttccaatagaaagtgacgagaaagaaggagaaaacaaattagagagtcaaacaagcatccctccaccgcttccaaatattgagatttatctgcaactttatcagcaaaacatgtctaaaacagtggccaccacctttgggtaccttccatggaaaccaccatttgcagcgatcaggaacatagagagggcctgtttgcgtacaatttctaagatacctttgctctcggaaaactacaagtttgtatctacacacaaggacacctcacgtctagtgaaacagcatctaactgtttttcccggtgtagcactaaacacccctgatacccatttagtggcagacaaaatatttgagagtgtggcgaagttggaagtacccaaatcaatgatagtgactgtgggagggggactggatccgttgtcactgatactaaacaaaccaagaaaggccattcgtttccaaaccgtcaactacttagagttagcaagaggattcacaaatgacagactatttttgttgatatatgtaaaacacactgctgactcgagaaaatatgccgatgagcttacaaagttgtgcagacaaactcttgaggataatgggtatttgcaaaaccctgaaaggtattcgccatcatcgtatcatgtctctatatgcactggctatcttaagaaagcagagttgctgaataaggacattgcaaaggtaaacaaacagcttcgaagcatcaccattcctgagctagtcgacctcctgtttgacgtcgaagaattgtgttgcaccggttcgagtgagaccatttattcacatagattactaccatatacgtaa

SEQ ID NO: 6881 - DNA, 507 bp, Candida albicans
agtgattggatagaaactccacctgagaataggatctctaaagatgcacaaatcgaaagcttggataatatagtcataagtggatatgtcacaatcaatcgcaatgtcaaaatatctttagattcgccaacaccatcgtcatcatcaccaattttatcaatcggcaagtattgttatatataccccgacgtagaaataacaccatctacagagaaaatgtttattggatcctatgtcattattgggaactcgagtaaaattatggctaaagatattggcaatagagttataattgaagataattgtgttgtacatccacattgtgtgatttatgattgttgtttaataaaaagtggtaccattattcccaataaagtagtgattccaccatatagtaaagtgagtggcactccaggagttgatttcacaatacaaccattacacaatagttataagaaaagcatagaattagaagctaaacaattacagatacttaatccttcttag

SEQ ID NO: 6882 - DNA, 519 bp, Candida albicans
ttttggggcgtgtcctttttcaaattgttcattaatttcttaaacccaactaccactattatgaggttgacagatgaaagtaaagcatttcattttggagtatattcaatagtttttcaaataccatatgggaaagtcacaagctatggtatgtcacaagtcgtttcatttatgagattaatgaattgtaaactaaccccaaaatattatcaaggtcacattgcttaccttttgaataaacctcaaaactcacggcaagttggttcatctttaaaacattgttcgtttataatttctcagttaaatgagaaacttgatccaagtaatctggattggctaaatgtcaacgagttgccttggtggagagtggttctgagtagtgggaaaatctcgccacgcgaagccaatggacaatatatacaaagggacaaactactacaagaaaatgttgctgtcctggaagggcatatggttgatatggacgagtacggttggtttccagaggatattaattactga

SEQ ID NO: 6883 - DNA, 1098 bp, Candida albicans
  unsure (469): Identity of nucleotide sequences at the above locations are unknown.
gccacacttttgtggcgaggttcttatttttctttctctctcgcggtttttttttctttcgttctctatttgaatctgtttccacttttgttactctacccatttgttttctttaatacaccattgtcatttgtgttcaacaaagaatactacacaatgtcattgaaattggtaccacaacaaagaaggatagttcatacttacggattcaatttaactgcatttgagttcaccacggatcccagcaacatatcgccaaacattatcttattcgtgggtggtttaggaaatggtctattgaacattccatatttgcccgaattaactgattctgccagcaatgagtttcaaagcacagattgtgggtcctggagtttagttcaggtcttactatcctctgcctaccaacgttggggtacatcatcattggatcgtgacccttccgaattgcaatctgctattgagtatntccgtacagaacgtggtggtaatagacaaaaaattgtgatcatgggacattccacagggtgtcaagatgtgattcattatctaacaaagacgttatacaaagaaaatatacctgaaacttctcaggtgcaaggaggtatattacaagctccagtttcagatctggaagcacttctgtcgggccgcgatcccaccaaacacgaagcattggtccaaagggtttacgatgaatatatttccaaagggaaagagagtgggattttacctcaagagtatcgtaaacttacctggggtgtacctacatctgcttacagattctattcgttggctagtaagagaggcgatgatgattatttttcttcttatttgactcaagaggattacaccaaaagttttggtaaagtaaataaaccacttcttgtgctttacggaagcattgatgaatttgtgcctgaatatgttgacaaggaaaatttggtcagcacttggaaacaatcaacttcatcacagtattggagcgagcacagtcaaataattaaaggtgcgacccataatttgggggatggctccgatgctggtgttatcgaacatttggtgtcagtggtgaaaaagtttattagtgatctatag

SEQ ID NO: 6884 - DNA, 204 bp, Candida albicans
caaatattttggacaatcttaattttttacatgcttgttattgtgatagtatgtttcttgattagacacgacgatcccaaattaatgggtaactcaaattggcctgtgttcaccctttgtaattgcaatttccaaccgtggaatcaaagtcttgccttctattttcaatgctgtcattttgtctgcattattatcagtggctaa

SEQ ID NO: 6885 - DNA, 687 bp, Candida albicans
gctaattactcagaatgttactgcagacagtttgaaatctcactcagcaatttgatgaaaggtattgaacaatgtaagatatatccaagatccatttatataaacaatatgaaagaatttcaaaacgtactagatgaccccattaattttttaaagaaaattccgagtattaatggtaagtttttcaaaatttgggctctggattcagaagcaccgttgaggtttttcatcaattctaatatcaagtttgatcatttagaattatttagttttctgaatacactcacattatcacatgttgccacaagtattaagctacatgacgttagattgaatgattatgcaatacccggtgtcaagaagcttcagctttgtgagattcctgaagatgacagaaatcaaacgtatactttttcttccgatttggaagatttgtatatttctactcgagaatcgattcaagtgactttacctccaaatttacggaaactagagatacatgcaccccagagctcagtagatcttgtatctgaagaaatggtcaatttagagtatttaaatcttgtgttgtcaaatattcgtcttcttgacgaagctgaaataattgctccaaatttaagaacgttaattctagattgtaacaacttgtccgacgtggcccaccaaagggctggaagacccgcgctc

SEQ ID NO: 6886 - DNA, 309 bp, Candida albicans
acaatattaaggacaccagcggggacaccagctttagcagccaattcacaaataatcatggcagctccaggtacacgttcacttggtttaacaactgcagtattacctgtgaccaataccaatggtaatgaccataatggtaccatggcggggaaattaaatggacaaatagatccaataacacctaatggttctctgatcattttagtttccatatcagtggcaacttctaatgattcaccttttaaatcattagtaacattacaagcagcttcagcaacttgtaacccacgtaaaacatcaccttga

SEQ ID NO: 6887 - DNA, 282 bp, Candida albicans
acactcctctcaacaactgcagttcccaatagccagccaattatgtatattccaaaaaaatacttgcaagaagattgggaacaggtggaatacttgattaaaaactatcccttagcaacagttgtcaccaatgacgaaaacggaacaattattgctaatcacatcccctttgttttgaaagaagatcctgaatcgggtaagaaatacttgattgcccatatcgcaaagacaaatcatcaactcccatttattttcaaaacggcgcgacaaggaaccatgtag

SEQ ID NO: 6888 - DNA, 249 bp, Candida albicans
agggaggcgtataaggccattcaagaatttattttcccgggcttaattcttgaatcaatgcatccttcttattttggagtaagaccaaaaatttattcattagaagagaatatgaaaaagtttgctgattttgaaataaaacaagaaccaggatacccagggtttgttaatcttttgggtatggaaagtcctggtttaacagcttcatgggcaatcggagaatacgttaaagatctataccataaataa

SEQ ID NO: 6889 - DNA, 255 bp, Candida albicans
atactagaaattttcttttctgataacaaaatcaatgggttttcaaattcaactttaccagttttagtgttggtaatgaaatatggagagataaatccacgatcaaatttcataccttcagtgacttctaattcatcttctaaagttttaccttctttaacagtgataaccccttctttaccaactttttccatggcattagctaataaatcaccaatatgtttatcaccattagcagaaatggtggcaacttga

SEQ ID NO: 6890 - DNA, 348 bp, Candida albicans
atatttgatgacattcttctaccttcttcaattgcattcaaaatagaagcaaaattatcatcagttaaaacaatatcagaagcatctttagcgacatctgacccattcaatcccatagcaataccaacgtcggctttctttaaagatggagaatcattgaccccatcaccggtcatagcagcaaatttctttcttctatgtaaggcatcaatcatacgaactttggtttttggtgcacaacgggcaatgactaaaggtaaaacgggtaacttgtcaatttcttcatcacttaatgcatcaaattcattagcagtcatggtcattgctttaaccacatcttcactataa

SEQ ID NO: 6891 - DNA, 222 bp, Candida albicans
acaatatcagtgaaatcatcagtcattaaaataatatcagaagcttcacgagcaacttcagtcccagcaatccccatagaaaacccaacatcagccaatttcaatgctggagcatcattagtaccatcaccagtaacagcaactacttcaccagcttttcttaatgtatcaacaagtatacgtttatcttctggtgatgatcttgctaaaactttcaattga

SEQ ID NO: 6892 - DNA, 345 bp, Candida albicans
gcaaaccgaaaaaaagtagataaggcaaccaaagtcaatgcagcaatactggtactcaattggaaagtaatgaaattctgtatgttgttgaaaatacctttaccttcttcaatagcactaaggattgtagaaaagtcgtcatctgtcaaaaccatatctgcagcttctttagcaacatctgtaccatttttacccattgctataccaatgtcagccaatttcaaagctggtgcgtcattcacaccatccccagtcatagcaacgatatcgcctcttctttgcaaagctttcacaatagtgactttgtgctccggagtggttctcgcaaacaccgaaacatcgtga

SEQ ID NO: 6893 - DNA, 216 bp, Candida albicans
ttaatacgtccaccaatcaatacaatatcagcactttcaatagcaatatcggtaccagaactaatagccattccaatatcagctttagctaatgctggggcatcatttataccgtcaccaataaatgcaacattaacactactactttggttgcctccaagacgattatgtaaatcagtaatgacattatctttatgtatgggggaaacttcataa

SEQ ID NO: 6894 - DNA, 384 bp, Candida albicans
cactatcattatttcaccatgccattattatacaaaccagctgctgaaggtaaagacgtcaaaccagctcaaattccatctccaggtaacaactcttttttagaagatacttttaccagtgacgctccaaaagacaaacaaatttcatgtggtttctacagacaagaaaaaggcgaaccattagtttacacttatgattgcgatgaaatgaaaattattgttgaagtatcaggtgaattcacccttactgatgaaactggaaaaaaagttagtgccaaaccaggtgatgttttttactttagcaaaggtacaaccatcacttttgaatccaccgattacgctttagcattcttcacaggtttgagaccaaatggtgctgcatag

SEQ ID NO: 6895 - DNA, 447 bp, Candida albicans
tgccgtgtacaacatccttttgcaaaatttactataaatatggttttaaaagattgcaaattgaatttaaagttaattgaaactattagtagttacgatactcagcaaaataattcaaatatgacagagaaagatttggctggacaaccaactatacaatcagtcggaagtcacttgcaagtccaagatcatgaagttaatttacaagctataatttccaatcctctttccattggtgaagttgctactacattaactgaatcccaaaaatggtttgtcttgaagagattacattttgatgctttggtatctttagaagaattaccacctcaagctagttttatattcgaaaagattgaacagatgactactgaagaagccgtggaaatcttaagaaaggcaattgaagaacatgcaactgatgtcaatattccagaacatgacttg

SEQ ID NO: 6896 - DNA, 570 bp, Candida albicans
actatgaccatgaccatgaccgtggatattactggttgtcataaattacttgaacaattatatcatgacactattaatcaaaatacaaatttaatggaaatattaagtattgttaaatcatctactactatcaccacaaccaccaaatcttcttcacttccaactattgccagaggtttacaaacaaaacattctaaattattatcattaattaatcaaagtttgaaaaatttacaaagtcatcctactaatgaaaaagatattttcaaaagttttattaatgaatttattatttggattgatggtgataatactttaaatttatttgataaatattcttttgaattgaaatctcaaaaactttgtgattcaatcactgaacgtatcattaattcccccattgataatttaattaatcttataacatttattgattcttgtgaatatcatttacataatccatttatacttgataaattgactattatcaccaaaaaattacatgaaattatcactaatcatgataatgatgtttattataaaaaattaaataatattttgttttcctaa

SEQ ID NO: 6897 - DNA, 1497 bp, Candida albicans
gaatttgacatcattgataaattcataggagttaatggaatgtacctgctgaatattaaccgaaatttagttctcaaagtgagtgaaatgaaaccaatgattgtatttaggtttaatgaaaccacatcatcgtcgacagcggcagcagcagttgcagcagcggggaaagtatctagttttgcttctgaagacaagtatggattaaatcacaaccaagaaattggcaacggtggtggtggtggtggtagtccaattatatctattaagaattatttgagttctacaagtatatcatcattcttcgataaatttgccaatatttggttaaaacaagttgattatgattcattgattcatgctgtttattgtaatgtaaattctcaagatcagaaatctagttattgtttaaaaatccaaaatcaattaattcatatattacctgtattcaaaaagaaacttgagtcgtccaaggaagttaaaaacaataatgataatggtgttggttatgattatactttagatatgaattcaatacgacaaaaccattcaacaacaacaaggttttctaaaatggaagaaactcctgatactgatggcaacaacgatcaagaaattcaaactcaggcaattcgacaattacatgataaattaaggtcacaaaaagataaaactaaaggagtaacattaggtttagctcatgaacctaaaaaaaccattgaaaaaattgatgaaaaattggatgataaagtagattctaaattcacgaaaattattgatactaaagattcacttaaaattaaattagatgataaaaaaactacggtattaaaacatgttagttcaaaattagatgaaattgatgataaaactgatttattagctgattcagtaaaacgtaaaaaacatcaatttacaacgtataaattaaaaccacggttatttgagaaaaagaaatcagcaattacaaaatatgaacatattggggttgatgaaacttatgatgacgatgacgaagagaaagagccttctttagaggattgcgatgatattgaagatgaaaatataaggaaatcatccatttatgctgttggtaatgataatggtgatggtggtggtaatactaataaaccatacatacataagagaaatcaagttcttgaatcagattattcatcaatatctttagctaatggtattcctgatgaaggaataataatcccactttcattattaaaatttgaacaacaagaccaaaaacaagatgaaaatttgcggacattaaacttcccaccaagacataaatcatttagtcaaattattaatttacaaactggtcaaaaatatcgtaaaaaacgacaaattcccataatggatgatcatgacaccaaagacaacaacaagaatgacaaagatgaaccatgtcaaccaattacatggtataatatatttcattatagtatatttggagaaccaaaattctgtaatgaagataattga

SEQ ID NO: 6898 - DNA, 357 bp, Candida albicans
aatgaaccaaccgtgtggacacacaggagaaatgattgctatgtcaagtttggatttatgactgtacatcacacctcctatgtgttatacttgagggcagtttccactgccattgaaggtgtagttgctatttttttaatgggtatagctgattattccaattatagaaaactgtttctcatattttcaattcttgtgtatgggtttcttgctttgcctttcattggtctaacaaataactattaccaaactttagtactcgcatccatcttatattcattgttgatgattgatgattccatctaccaaattctcgaaggctcttatattcctttatttatgagagcagacaagtaa

SEQ ID NO: 6899 - DNA, 555 bp, Candida albicans
ccaaaattttccaaatttttatttgaagaattgtctcaaaaacaaaaccaaaagagtttacaatcattatatcaatttatgtggattttgaataatgatcaattacaaaatttattaaccatttgtcaatctaataattttaataaagaagatcaagaattatttttcaatgttgttaaaacatgtattgataaacgattatcaattagtttttttgatttcaaaaaaatatatgaattgaataacagtgataaagaggagaaggtattaactcaaagaaaagaattgttaactaaattgattgaatttgatttaattgaatttgataatgataatagtggggaagacattcaattgaattcaataatagatgaaatcttatcaaataataataatcaagattatttcttaattgagagtatggttaaaaaatcatcaaatttaattgtatcaaaattaatgattaaagattctcaagatcaaaatattaatcatttgaaatgtttagtggtttattcaatggcaaagcaaaagcaaaagcaaaaacaaaaacaa

SEQ ID NO: 6900 - DNA, 183 bp, Candida albicans
gcagcgggagctctaattgaaccaccaatgtcacttccaaccccaattgcagaaccaccataccctacaatagcaccttctccagaggaagaaccaccacttgataacaacaaattgaaagggtttttagtaaggccagtgaaattattagcagaatcaagatgcattaaagtctgtggttga

SEQ ID NO: 6901 - DNA, 528 bp, Candida albicans
cgttcagcaacccatggaccttcatataagcatctagctaattctagcaatggttcaatatccaaagataccaattcacacccgattttttcaaatttagcaactgcttcttggtataatttagggttttctttctcgccgtaccataacaaattggttggtactacaactctaggttttttgccaaatttcaataatggattttttggcattgatcttgaaaattcgtcatgttcatcttcttctgccataatattaaacgtaagctgtgcatcttgcaaattcaatgcaaatatcgaaacacaatcaagtgacttacatgctggaacaacacctgaacatgaaaagacaccttttgttggtttcaatccaataagattattcaatgctgcggggactcttcctgatccagcagtatcggtacctaatgcaattggaacaatacctttagcaaccaccgaggcagatccggctgaagatccaccactgacgtactttggattgaatgtatttggagttattccgtag

SEQ ID NO: 6902 - DNA, 495 bp, Candida albicans
acaaagatgaaaaatctaagaaaccaaatggatgcacaccagagcagaattatggaaggagggatcgaagaagagctccattacagtatgaaaacactaaataccacaattgaccggttggtttatgaaacaagaattgttgccaaaagaattgacgaattagaacaggattttaaactatatgaaatgaaattgaacgacgagtgtaaatctaagctaacggaaatcatagataaagtacttcatctgaaacaattcaaggaagtgtttactagccctgaagagcgaaagcagattgcttacaagttgactggtgatgagaattatattaagtttgacgacgaaaaagaatccattgggcttttgagaatgatagtcatgtttttttatgggattattctgtcaattttccgttttttccactttaatcgtgataacatgaatctcgagagaataagacaagcatgggttatattggatcctaacagatcaatc

SEQ ID NO: 6903 - DNA, 1227 bp, Candida albicans
ggtctttctcagcccgtggtgacgacagtagaaaaacccaacactattccagaaacttcattattggattggatcttgatatcaataggattcaaaactcccgccaagttgtcagtttccaagagagatgccataatatctaacttacaaggtggaaatgattggtcgcaattggtttctgattatttctatttggctggttgtgagataaattttgaaaactgttttttgtcgttggtattgggtacaataatcagacacagatttcctgtggttgcaactattttgaatcactatttgctgatgaaggaggcgttgcttttgaatcttgactacaagggatctaacaaatcgttgataagattgaatcaattgattagcaaagtggatggtgtctcgatatttgaaagcactaatttgactaccaggttgaccaatgtatttaccaataatcggattaatgccaatatagttgacggacaaaatcatgtgaaatacattgaattttaccaacgtaacattaacgattattatgccattgtttttaactggagattattggaatttattcatgaattgaatgtgacgtatttagaacagttgaatgacgaccagtcgcaagtgttaactgatttgaaaattattgaagctttctttggcgaacaagacaacaagttgttcggctattatcaattattcaccagtattttgaatgctaactatgctccatatttatttgaaagtttgaaagacaaagtcgaatcgtcgttggagaaattcagaattgcttacgaaggaattgatttgactgatcacgagatccacaacacttcgtcggaagatgaatatgaacaagaatcccctgttgtgtataaatatgaaccaacattaaagtcacagaaatccttaatctcatcattgaacttggtgaatgaagaagaatttataatactaacatgctcattgactatttactactacaagaataaagaatacgatcgtgctttgaaattattaaactatttgagattggataatgattctaaaactctcagccttttgacatttacttccttgataacattaatcaatgaattgataccaggtaaaatcgaagataatgttaatttggatttagccattagaatttgtcgcgattggcttgagaaccctgattcaacccaatctatggatgaaggtgcccacaacgacacaagcggatcatag

SEQ ID NO: 6904 - DNA, 1236 bp, Candida albicans
actgcggtcttccagcccctgtggtcgaagacaagattgccgagctggacacaacttttccctgaaggtgaagtatcagccaagttaccaccaactttgtttagaaacgaatgtcccgtggtgtgggagcagcatcagaaactttcgtcattggcttataagaaatcaatcacattgatacgtgattttgatggaactttacctatcccaaagcatttaagtgctagaggtagcgaccaaattgactctattttgttgctaacgccattactaaacccgatatacccgtgtaaacaaacagggtcaagtcaacggttgtttactggagaggaggtgtttcagaaattcggcgactttttatctaaccatccaatcaacaaaacaaaatcatacaatgtccttcacacaacatacactgctaacggattgacaccgctacatgaatcgttaattgaacaatctaaaatagttatttttctcactagtgaagcgggaagaaacatgtaccaaattggtattgtaaagtatgtttccatattgtgcggagtcaacccgttgactttgactaaagggttgggtccagttcagccaagaaagccattaattatagttgccacgctgtcgccatacgatttcttttacaacaagagtattggaagcgcatatttgtgttgctacgactacacaaataatgctttagaaaacttggcatctttgttgatgggggattttgaagcccaaggatgtgttcctggagaaaagaagttttcgacaaagcacaagaaactggcggtggaaggtagaaatgaaaataaccacttgagtgcaaaatcagtgcataaacctaaaaggagatggttggttgacgagtttctgatggaaagagactggcaaggtttaaccaagttattgaaaacaaacagtgatcaacttacaaacgatgggttttataaaaggctcgaacggttgttgagctccacagcgaaacatcaaaagcattttgttgttcgtaactcgtctttgaatatcttgtatgggattgttttgacatgggtcaatgaatcaaattgcggacatcttgtgtacatattggttgacaaatcaaaacgtttgcagagtattgggaaaaacttacacctcagagcaatacgatatttgataaaggagaggacatgtaatgaaattgtattaggttactcgttcccgttgatttcacttggtgggtaccaccaataa

SEQ ID NO: 6905 - DNA, 291 bp, Candida albicans
tccaataatgcacttgctaatacaacaaccccagtggtaccatctccaatctcatcgtcttgtgatctggataactcgactaacaacttggcaatttggttttccaaatccatttgcgataaaattgtagcaccgtcatttgtaatagtgatctcaccatctggactaatcaagatcttatcaagacctctggggcccaatgatgtcttaacaatagatgccactgatctggctgcaagaatatgtgatcttgtagcttcaatcccatgttttctttcctttttaccttga

SEQ ID NO: 6906 - DNA, 2046 bp, Candida albicans
  unsure (271),(280),(299): Identity of nucleotide sequences at the above locations are unknown.
gaaaaaaaaaaaggaatcattcgagccacacccacaatggattcaaataaagagagaatcgaggacttggcttctttgttcttgccagatcttttacgcccttcaacagtcaattcgtcaccttcaaatgctactagtccccatgcatctaaatctgaagactacgatatgggttcagtatttttgaaagactccaaacctaccaacgctccgagcaattcaggattaccaagcagttttcaagagtttttaagtaataacaattttatcnatagatcanacgatatggaagatggccnagaagaaagatcacagcaacaaccacaagagtattcacatcattataatgggtatatgccttttgagatgaacccatctgtatcacaacacatgatgagttacaacccaggtatgcaactgatgttccaacaacccaataatccccagcaacaaagttttctttcttcaacacttcctggacaacaacaaatggtgtctaacttcccaagaactggttcttatgcaaaatatcctggtgagtatgatgaatggtttgccagtacgaatagtagcattaccaatttaaatggtctatatcagcaacagttgttgcagctgcaagctttacaacaaccacagccaatgccacaaccacagaatggagccaaggatacacgtatggatacccaaagtggctcatcgactccaaagaggaaaaaagccaagagtagaaaacgagacgtaaaaaatctcgaggttcaaatcgactacaaacctagtaaattgaaacgattacttgatctcaaacaatctggcgcaacgtcttcaaatgattataaaataatagacaaggacaataatgaagtcactattgatttcaacgggtttttaaatggaagatttctcaccaacgatattgataataataattacatcttcactcagaatgaatcacagcgtggcgaagacgagcttcctaaaactgttgtcaacaaaaaagagaatcctaaagttgtgtcatgctatcgacgcaactatattcaaatatcagccaatatgagcattcgtggatttaaaaatgattcaaagttgttgaaactacagaccagcgagtatggctacactacaactagagtgattaaatatttcaaaatagaggtgctggcagcagctaacaattcaaacagcaaaggagttcctataattatcaagaacgagaacaaggatatagagagggaacgggaaaaagaagcaagaaaaatgagtttaccttccaattatgaatacaaagctgacaatgttctgcctacatatatcaacaccaacgaatatgtcataatattgaacgatgaacctatcagcaatggaatgattgacaagtactttgtggtgaaaaaattacaatttaaaaatgcaacaccaaacaacgggagtttgacgtttcaaaactattaccatttaaaagccaagttgagttgtattgttgctgatatttattacgatgattacgatattgatgtggccaatgatggcggtggtggtaacaatgaaatattgttggctgaactagttagtgagcccataattgttcgtggtcgtaacccaagcttctacgctgaaagaaacgatattctaatcaagggtcgatctgctagttccaagtcatcattcaagatagcaggacaatcgtctgagctcaaatttagagctgcagcagatgcagaggaagatgaagacgatggattcgttgtggagcatgaagacgagccagaagatgaagatgaccatcacaaccacagtgaaggtgatgtggctggccaggaagaccaactaccccacacccaaaatggaactggagaatcaccaatctcatctggcgacgacgacgaaaaagacaatacacaaataccgccattatcatattcgaccaaccagttggctttggatgtcaagtctgtcgacaaatacaaatattatcccatcaacagcgtatattacctcccacggacaaacgtggtcttcaccacagggctggaacacccgcgt

SEQ ID NO: 6907 - DNA, 213 bp, Candida albicans
aatatcatacattcaaatggtaagctcgaatatgatttatgggaattcaaaaactatataaagatgcctatggatcctacaattttcttcaaacgttttaattctcttcaccaacaatcaatcaatcattcattcattcaaatagtcattcattcctttattaccgactatcattcattcctttattaccgactatcattcactcctttataa

SEQ ID NO: 6908 - DNA, 186 bp, Candida albicans
tggaccaggatacggttcagggatttcaccaagaaacaaaccacggatttattccattttattttggggagaaatatgacggttaggaaggatcatttttttcacaaatatacaacttttcacacagtgagagtcggagcatgggaatccgataatcttgttgataatggacgcagcaaactataa

SEQ ID NO: 6909 - DNA, 300 bp, Candida albicans
tataaatataaacagaagataccaaaattcagacaaatgttattagatctcaaaatccaaaacccacatatcaaacatagtaattgtattctcattattcttacaactatgccgttacaaaatgaaaatttggcccctaccaaaattgttgaagttcggtcatatactattaaagagggtaaaaaatattacgttgttcgattgaataattatcttcataaggagataagtgaaaaggaattgaagcgattatctccagttttgtattataaagaaatgcaattgcaaaaagaggaatga

SEQ ID NO: 6910 - DNA, 546 bp, Candida albicans
gctgccggagatataaggcgcgtatggccccatccccagtggtggaaaaatagttctattcctcctaataatcaaggatcaaatttacttgataaatataaaatgcttaaattaatattacaattaaaaatttatgtattaactgatcaatttgaattaattattgattcattgaataaatttgctattcatgaaaaacaaatttatttaactccttatttattagatcaaactttattaattgaaaatatgttattcaagaaattacgatcaatacagaagagtagcactactactactactactactactactactactactaataataataactcattagatgatgttgatgatcaagaatcatcatcatcatcattattattattattgggggaaggtaaaaaatctttaatgaaattacgtcattttataggtgatgttaaattaatgttggaaaatgatgaaaatgaaataatggaattaattgataaaacaatttatattttaaatcaatggaaagataataataataataataggtag

SEQ ID NO: 6911 - DNA, 186 bp, Candida albicans
ttaattatagaaaagaattcattctatacatatatatatatatatatatacatatatttatatttatgtacatatatatatatctatatgagaaaaattaaactatttacaaaaaaaaagttcataaaattcaatctcaatggtaagcagtactacctattattattattattatctttccattga

SEQ ID NO: 6912 - DNA, 225 bp, Candida albicans
ttaagctctgtctctaaagaatacttgccaattggcaccatctacacaatctacggatgtcttttgtattttcttggtgttttcaaatcctcaagagtagacgtatattacaatcccgataaggatatggaaatgttcacaactagtggtgattttgtgctttttttaacaattctcagtttatgttgctacattgccttgttagtattgttgctacgaatgtga

SEQ ID NO: 6913 - DNA, 234 bp, Candida albicans
caccaagttcaactaaaaaaattaagcaaagaagaagtacttcgtatgtatttatatgattgttactttttttggattaataggagattactaacattgttggttatagatgtacagtatgtcgaacaattaaaagaaaatgtgacgggaatacaccgtgttcaaattgtcttaaaagaaatcaagaatgtatttatcccgatgttgacaaaagaaagaaacgttattcaatag

SEQ ID NO: 6914 - DNA, 651 bp, Candida albicans
caaagagtgcttcaacaagaacaacaacaacaacaacaggctcaacagcagcagcaacaggctcaacaacaacaggcccaacagcaacaacaacaacaacaattgttgcaacaacaaagactacagcaacaagcaatgatccaacaacaacatcaacaacaattgattaataatttgggtgctcgtcaacaacaagttggtctatctacaactactaatcaaatgggaccacctggtagtaatagtaataatcttcaatcaaatatgtcaccaaataatgaacaattacaatcacaagcaagattacaacaattgaaattacaatttcaacaacaacaacagcaacaacttcaacaacagcagcaacaattgcaattacagcaacagcaacagcaacaacaacagcaacaacaacaacaacagcaacaacaacaacaacagcaacaacaacaacagcaacaacaacagcaacgtcaacagcaacgtcaacgacaaaagaaattccaacgtcaattactgactctgtctcaaagactgccagttattaataatggacaaccgcaacaacaactccaacaagatcaacgtcctgcactggccaccacaaaatcaacctactccaggaaacaacaacaacaacaacaatactaa

SEQ ID NO: 6915 - DNA, 462 bp, Candida albicans
  unsure (114): Identity of nucleotide sequences at the above locations are unknown.
tggacaaccgcaacaacaactccaacaagatcaacgtcctgcactggccaccacaaaatcaacctactccaggaaacaacaacaacaacaacaatactaatgctgtatcaccgngaattacatagacaatctgttgatgattatcaaatgaacttattacaaatggaaaatcaaaataattcaccaagaacaaaatatttgaataatcaacaaacacctaactcacaaaaacaacaaacacaactgcaactgcaactgcaacaactgctgccatttcaaccaccagctcagcaacctaaaaatagtacaacaacatcaactaatactactactaatcgagcacagaaatcttcgagaaaacaacaacccaagaattcaggaactccacctgttcaaccaccaccacaacaacaaccccagcaacaaccccaacaacctcaaaaaaggttaactcctccaaat

SEQ ID NO: 6916 - DNA, 444 bp, Candida albicans
tcccctatatcaaattgtgtacaggttacacgcaccacagtattttgtgattttcgcgctgtatcggcaccaagattgataccgaactcacacgaccgagttacgagaagtatttttactctttggcacttcatctcttttaatacttttcactcaggaatattcaccatagtatcattatttagattgtttggattgaaaccagacatgactaaccaccaacaggaggaccctgcattatcatctacaaatgaatttaattcttcaagtggtgaagattcatcatctgattcttcctcctcgtcctcttctgaagaagaagaagaagacttgatgattactaaacccatttacatgtccaagactactaggaataaaaaaggttctctcaataatcagatcacgaatacaaatgaagacaaaggacaactattttcaacacgc

SEQ ID NO: 6917 - DNA, 243 bp, Candida albicans
cttagcataaaaaatataacgtggtttttaaatgagatcactcacttatttgatgttatacttccattgttgtttccattaaaagcaaaattagtaggtcacgtggacacagtactgattggtagcagcattgaaactcgctctgttttttacacaatacacgactttgttcttcatcatttttttaaaacacaatttgattttgttttggtgggtggtgttgccaaaacttcaatcgtctaa

SEQ ID NO: 6918 - DNA, 519 bp, Candida albicans
agacgtcaccggaagaaattacttgagcatttgaaaactcacaaaataaatataaactcaatcaattttgctcgaccagtaccgatagatgggactgggatgacttattctagttctggccagccgttatcacaacctctgcataatggcattaaaaaagaaccaggaagtaatcaaactcatacttctcagctttctgacctatcattacaattggcaagtagcagggatactgacaataaagaaagcttaaacggaacttctggtcctggtcagccgttcaactcatccaggtttcgtataaatgtggttaaatttcttactgaaaataaattatctatggatgtcttgaaatcaaactcttttcgacaattggtctatgatttgcggccagaatcagttaatgatatactggaagtaacgagtatgtatgatgcatttctagaatgtactcgatacagtcctgctgagccgggaaataccgactctaatttaagagttaacggaagcaatacatga

SEQ ID NO: 6919 - DNA, 183 bp, Candida albicans
atgacaacaagaaatatgaaaacatctaaaaataagaaaatcacggcaagagggtttaccagattgaaatttttggtaaatttggaaaacatgattaaattggttatattgaaaattgttgaatatatcactatggcaatagtactgataaaccattttattctgaatggagggattttttga

SEQ ID NO: 6920 - DNA, 684 bp, Candida albicans
ttcaataatatcatgatgtctcatcagagactcattaatcaacaaggtaacactagtactagtactagtagtagtagtgctggtggttgtggtggtggtggagacgcagaaagcattatactgaataaagaatcatttccttcaataagtcttaaagaaaaattcactcaaatgatatctaataattttcaaaaaatccctccattcagaataaaatggtttatcagtactattgccatagtgatatattcaacaattttcaatataaccaatttaatcatgttttccaaatttaccaaaaatttcaatctggtaaaccctcttgccgtgattttcttatttttagatgttttcatatttcttgttgtcatttatgaaaaattttatcatcatgataatacaaaattcactaataaatggtcaaaatatacttatataatcgtttgtaaaatattgaaaaaattattatggttgattttattaattgcttgtatatttcatgttgtacttatatcaattggtaaattatcaaatccattaaatgttagtgatgcacaaatggatattttaaatatgacaaatcatgaaaaaacggggtattttgtaataaatttaattaatttggtatttaatggggcattattggggatttgtcttgcaccagcgggggctggaaggatccga

SEQ ID NO: 6921 - DNA, 198 bp, Candida albicans
ctgcaattaaatacactatttaatctctatagaactattaaacaacaaacaggaggaactcaagaaataagaaaaagagataacccacagatatcaatagaccaccagttgtttctctattctaacttaatattcgggaaagttctctttgttggctttcatatatctccttgttattttgggttcggttttccttaa

SEQ ID NO: 6922 - DNA, 201 bp, Candida albicans
tttttttttgttacaaaatcgtttgagaaatggaagaataataaagaaataaatttattgttttcagtttttgttaaacatttaatcttttataatacgagtagagttaaattacacaatattggctgttttgatttttttttcccaacaaccacgacattttttttcccaaatgtttatatcacgatggtaaccaggtaa

SEQ ID NO: 6923 - DNA, 204 bp, Candida albicans
tttttttttcccaacaaccacgacattttttttcccaaatgtttatatcacgatggtaaccaggtaaataatttggtggttagcagatttgttgttgttcctgatcttgtaaattcattctatgcttttttctcggttaccaagtctaaagaacaccacaaaagaggtggattgtggatcgatttttctttctattttatttag

SEQ ID NO: 6924 - DNA, 189 bp, Candida albicans
ttaggaaatacatggcgcattggtttaggacctgggcgtgtctgtgctgctcaaggtggccgtgtgagaaagtttaaaaaaataaaaaataccagctcaattcaagtatgtatgtatgtatgtatgtatgtgcgtgtatatttacacaaaatcttcaccacaaggcccggatccgcgtatggttacaga

SEQ ID NO: 6925 - DNA, 249 bp, Candida albicans
tcaattataaatctatgtatgagtgagatttggaatcaattaaagtgcctaattactaatcaagatctcaatactattaaacatttcccacaacctaccactactaccactcaacaaatcgattgcttatcaattttaaattatccatttattccaacttcattactaaattattggaatcggaaaacttatctggaaaagaaatctttacttttacaaatttcattgatactatcaatttctttatat

SEQ ID NO: 6926 - DNA, 240 bp, Candida albicans
tttgttcggtcattgatgtgttattttgtgatgtttttgaaaaacaacaacaacaatagaaatcaccaatctgccatgtatttgattgatggatatgcacccattcatccttttctcgaacactttttcttaaaaaaattttttccagttagttttagtgtcactgttcgattcaacaaaaaagctaattcttttttagttatttgtcatgggttccatttgagagtttcatttgcgtga

SEQ ID NO: 6927 - DNA, 609 bp, Candida albicans
ttagatttgattgtcaattctaatataaagtttgatcatttgaatttgtcacgtttcctgagtccactcacattaccacctatcgccacaagtattaggctaaataagactatattgaacaattatgcaattcctggtgtcaagaagctttcttcttctgtgaaatctgatgatgaaagaaaccaaatgtatgctttttcttccgatttggaagatttgcatgtttttagtgaagaatcgattcaaatgaccctacctccaaatttacggaaactaaatattgaggtaactctgggctcggtaggtttcatatctgaagaaatggtcaatttagagtatttgctgcttaaattgccaaatattcaatcttttgacaagacaggaataaatgctccaaatttgaaaaagctagttctagaatgtgaaagcttgtctaattttgatggtttaaaacagttcccatatttaaaacatttggaatttagtgaggttagtttttccatgagtttatttgacgatggttctttttctgagttagacacttttatatgttggggttgtgatattcaaaatacagtagattttgacagctcattactaatcttcacc

SEQ ID NO: 6928 - DNA, 195 bp, Candida albicans
gctgaaagaagaaataaaccacaaatatcgtggttggagttggttgacacattctatttcaaactggtggtattatcaaaagagattgagtacgttatatctctacgattttgtgttgatgatcagaagacttacattttagagaaattaaaaccagaaacaaagattagactttatcttatctatattatttaa

SEQ ID NO: 6929 - DNA, 303 bp, Candida albicans
  unsure (43),(87): Identity of nucleotide sequences at the above locations are unknown.
ttatttgatgtgagtacgacgaagaagattatgagaaggagcnctccctggatgatcctttggtttttggttcctgctccgtctttnttttttcttgtcttcggttgtcctctctactacttgcttttcctaacagtttttagctcctcggtagaaggcgatcacactttttctctactttctcctcttaattcccttattagtgcatttgccttcggattagaaattcgattgtctttccacggatttttcaatatgtcgtcatatcagttcaatacggaggagtcttgttcacggatgagc

SEQ ID NO: 6930 - DNA, 729 bp, Candida albicans
catgtcccaatattatcgggtaattcgaattatagtaataatactactaatagtttaccttcagtaagtaatttacctcatcctaattggggctcaacaaatggtactactggtagtaatggtactagtggtggtagttatcaacaaaattcttttcatcaacgtcaaaattcagttgttagtgattttctgatattttctaatagtgataatagaaaagatattaaaagtaattggttaaaaggagttttaaatgataataataataataataataataataataatgagcaacaacaacaacaactacaagatccaaaattagcatcacctgctcctactttacccccagtatcaagcataacaggtggtggtacgagtaatggtaatgatttaatgatggttgataatatggagaataaaaatgatgtatcacaatcaaatgtgataaatgattctaataataataatggtgataaaatggtcaataaattaaatttccaaagtatcgaacttcacgataataataataatactccatcaattaaatcaactcattcaactgaaacaatacaaactactatggttgtagtgaataaactggatcctccaccactactgacaccaacaacaacaaatacaaatacaaatacaaatagtacggctactactaatgctactgggtatgtttcgaaaaaacctacgataaataatttaatatcacaataa

SEQ ID NO: 6931 - DNA, 699 bp, Candida albicans
cgggtgatttcttttgtcgaattgatcagattattcaataacacagtaatgaataataaagagaatatacccacaacaccaaagagcaaagaaagcagaattatttccgctgtttcgccgattaacaaccaaatgttgaaaccaatctcacctaacaaagagaagaatcaaattggcaaattaaattttttggaaacagacaatttagatgagcattttgaacttgtttataccactcaagaagaaatccgacaacgattgtacaatattgaattgacatcaaagcagactagtgttgatttaggacaattatttgatagactgaaaaataacaatgaaaatttgaataaactattacggaatgtggtgtcttattctgaagaagtaatgacagaaggaaatgcaaccaaagcagacatggagaaaattttgactcggttggataagcttagcgaggtaagaagcaaatctgaaagtctgaaagtgggaatttctgatagttctattgaagaaattcgtgaagcaataggacaggtattcagtgccaatcagaagaaccacggggatgctgacaaattgactatactcaaagaagaagtatctagaataaaggatatcatcagcaaacataatgaagttgttagttctcaattgaatcttcatgatatcttcaccacggggtcgaaggtcaacgcttta

SEQ ID NO: 6932 - DNA, 390 bp, Candida albicans
agatatattttagaaaatccagctccgagagtatttacatttactactcaattgactgattatgaagatcaatggatattcaataattcaaaaaatattgttcccttgattcaacctccattccccgtattaccatttagtcgacattatatggatttcataggtgaatatttaccagcactggaaggtatgagtgattctaattccaatttagggtgtgggtctgagtctgggtgtgggtctaggtctaggtgtgggttgggattgaaattacctaaatttaaagtatttgatgttcaatataaagtgacacttccaattgtatcagttctgaaagatatcaccagcatacctaagaatactgggaatttatattacaaaccaaaataa

SEQ ID NO: 6933 - DNA, 522 bp, Candida albicans
ataagcgcgatgagttccttatcaatttactgggaaagacaagagctttcgttgatgtatgtgttaaattatcttttagctgttggatcattacgaaagctactcgaatcgtctcagttgtaccaaaaagagttgtcatttcttgttaatagtgtttccttgtcactttctaaggatatagacaaattggcgtcacaaacaacaagtacaagatcaagtatggtgtctataccgcaatataatatggaaatcgaaagaaaattggaaattgaaaaaaaattggcgagtagtaaatacaaatacagttctttaagcagtgttatattcaatggttcatacaaggaaaaactacgattagtagtgaatttcggtgaatctttacttgctcccaatttacttgtgaaaaaattgaaaaacaaaagtatcgataacaatgatagttatgttgagtcgaataaagttgtagaaaggttgatccatgcaatgaacaagattgaagatgatttattagcagttttatag

SEQ ID NO: 6934 - DNA, 771 bp, Candida albicans
ccagccccggcagcaacagcagcagcagcaccacaacaactacaagttcaaccagcacaatcaacacaaccaccatcatcacaacaacagccattattacaatcaacatcagatatttcccctacacaaatatttgatacctatgcaaaacgagattcattttctgatacaacaacaacatctactgctagcagtaacaccatgacaacaatgatttccgataaaaccaccttacaaatggttgatgattattttgaaaatgattgtcatgaacgagttaaagtgacgatgaaattgttgaatgaacgatttttcaatgaagagaaatttttaagtgatgcttatcaattgccaaaattccccatagaaaattcattacggaattatcaattaattttagttggatttaaagctggaagaattgatgttttttatttaccaacaaccaacaacaccaatagtagtagtagtactactcctatttcacaacaatctaataatgatttgatgaatttaaaagttggagatttggttattgtagaagctgatcgtggtcgagatttggggaaagttttcaagatgaatatatctattgatgaagctagattattgaaattgttacaatttcaagaacaacaagcagcattgaaagaacacgttgataatattttagatgatatttccgttaagagtttatctgaccaacaacagcaacaacaacaacaacaacaaagtcgtagtagttttcaccacgcgctgcagatccacgta

SEQ ID NO: 6935 - DNA, 327 bp, Candida albicans
acgcttactgcttgctgcttgctgcttgctcgtgcttggtacttgatgtcttatgcatcacctacacgccacaaactatcatctcttttttttttttgcagccatcgagtaaaatatacttgttcgaatattttagatacaattaatattattattattacacacttgaaaacaaaactaaaaaaaaaagaaaatggaaaagaaaatggaaaagacaatgacttacacacatatatatacatatacatagatagatattatgcaaaaaaagaaaacgtttttgtttatgtttatgtttgtttctatgatagaactgaaagaaaataa

SEQ ID NO: 6936 - DNA, 183 bp, Candida albicans
  unsure (1): Identity of nucleotide sequences at the above locations are unknown.
ncacctccctggggattaactatttatttactgactgggttatactggggattaggaatttttgaatggcactggttaaaatctgttgaaaaaatgagaaatattcaaggtttgaatataaatgttaaagtcaatcctccaaggaattgggtcatctattctaataatttatgggccacctaa

SEQ ID NO: 6937 - DNA, 186 bp, Candida albicans
aggacaataaagaaatcaaacaatcaattaaacaaagttaaaacaggaactttttctattcaagttcaaattgaaagagaaagagaaatagaaagaaaaaaaaaatttagttcaaattggaatcttgtcttatttagtttcatttctatatatcttgtcctcatatactatcaacatttagattga

SEQ ID NO: 6938 - DNA, 183 bp, Candida albicans
tactactccttctccattcattcacaactatacattatggatgacgcagaattaaatgctataagacaagcaagattagcagaattacaaagaaatgctgccggaggtggcagtagtaccaatccatcttgttccttcgtcttcaccacggcgactggacggatcagcgcttatgttagggca

SEQ ID NO: 6939 - DNA, 195 bp, Candida albicans
cttttgacgggattttgcacccctgtgggtgaagataaatatacaatgatacaaagaaaaaaaaaacatcaaatcaaaccaaaaaaaaaaaacataaacctaaacacaaatatattgttaatttattttttattctttaaaaattcaaaaattcaaaaattgataatatttcaagtatctaataatttaacataa

SEQ ID NO: 6940 - DNA, 435 bp, Candida albicans
  unsure (387),(391): Identity of nucleotide sequences at the above locations are unknown.
atcaatcaatatcgtcatcatcatcatcattgtcgtcgtcattgtcgtcgtcattgtcgtcgtcgtcttcattctcttatcctttccattcttctactacaattatttaatacattagaattatttacatttggtaattatcaacaatatttaaaatataaagagaaatatattgatctagatgaatctttattgcgtaaattattggaattgactttaattactatagattttgaaaatattaatcaaattataaattatcaagatattaaaaatcattatggtatagaaattaataataataataataacaacaacaacagctattcagggatgattatttcattaataattaaattaaatttacaaaattttggaaagtccccncaantttactttataaccaacaaatcaatgatgtggaaaagaaattaa

SEQ ID NO: 6941 - DNA, 219 bp, Candida albicans
aacaccaaacttcttggtgataaagggaatcataataatttattgaaaaaattatttctgaatcaacaagggggagaatcatcatcatcatcatcatcatcactgatgaaaattttagataaaattgaaattgaaattgataaacaaaaattacaaacagcaataatagctatgtcagctatgattataggttattatttacaaagattaaccaactaa

SEQ ID NO: 6942 - DNA, 186 bp, Candida albicans
catcacgcgataccttggcgcctcgggcgtgtaagactagatatcgaaaatgagaaaactaaaagcaaaaagcaaaaaaagaaaagatcagcaagtttatcgcccatggtcttactagagataataaaccccttaataaaaaaaattggactgtatggggagtttatagccgtacatgaaacttga

SEQ ID NO: 6943 - DNA, 186 bp, Candida albicans
cacattattattttatatacacactcgataaccaccaccaccacatcactaacaacagcaacaacaagtagcaagacaaattttagttttataacatttgagacaatcaaacaaccaattagattaagaatttcaagtttcatgtacggctataaactccccatacagtccaattttttttattaa

SEQ ID NO: 6944 - DNA, 303 bp, Candida albicans
ggcgtagtcaatgaccacaagtcggaggtttcactttgccattcgctgttaactcgctggatgcaatttgccgttgcaagtatatgcagtacccaacgccaccattgtaacataatccttgggttttttgtttcgttttttaacaacaaaagaatcaaaacaaggttaaaaagaaccgaaagaaccttaaaagaactttttacacatcaccatgggacaacgaatgctatcactgtcaccttcacacataacaaatccatggaaaactcccgaacaaaccgcatcctcatcacatggtcatga

SEQ ID NO: 6945 - DNA, 306 bp, Candida albicans
aagaactttttacacatcaccatgggacaacgaatgctatcactgtcaccttcacacataacaaatccatggaaaactcccgaacaaaccgcatcctcatcacatggtcatgatgaggtaatttcaccagagacaaatacatattccccagatttttcaaactacacacgtaacggtagtagttatagacatgttgataaaaaatcagctagtcccccaacaacaacatttgacaatcaaactttgcaggaaaataattacgacaacacaaataatcaacaatcttcggaggctgatgtttcttaa

SEQ ID NO: 6946 - DNA, 189 bp, Candida albicans
gtaaaagaagaagttgtgtgggaaaaatcttcaccaaaaaaaaataaaaaatttcaatggttgcgtaataatcaaaatgagtcaattctcacaaccgctcgcgacacgtttcaacgaaatggcctcccctaccacagaaaattaagtacacatgttgtgatagattttacatttataaaaaactattaa

SEQ ID NO: 6947 - DNA, 816 bp, Candida albicans
gtcaagcgcggttcctgccagccccgtcgtgaagacgatacaggtaacagatcatcatcgaatactgtgactagtcatcaaagagaatctgtacctccagcatctgaaccaccaacatctccaatttcaaagtctgtctcacaaaagatacctgtacctccttcggcaattccagcaagagttagtgatttggcttcttcagagtttagccacgacagctcatcaattgccgaagatgatgaagaatccgatattgatcgccatcaagtgtcttctaatgttttggaaaatgagataggtaccgataaaactattaatttgctgaaagatattaatgctgaaattgaaggtgcaggttatgaagctgatttatctgaagcagcaaaaaatgaagaaagaaaagagtatggaattccacaagcccctcctgtttcttctgcacctgtaccgccacctccaccaccacatcatcctcatcctcatcatacatcagatgaaacagaagttcctgaagttgattctgaacaggaagagccgcatccaccaattccaagtcgtgctcctccagttcctgtctccgttcctgctcctgctcctgctcctgctcctgctcctgctcctgctcctgctcctgctcctgctcctgctcctgctcctgctcctgctcctgctcctgctcctgctcctgctcctgcacctgcacctgctcctgctcctgctcctggtcctaattcagctccggcagcagcacctcctattccagaatccaatggcactgctccattccaaaccacacacgttgaagaggacgattaa

SEQ ID NO: 6948 - DNA, 279 bp, Candida albicans
ttttttttttttgatagttgttattatctaagggtcactcaacgtcaccaaattaaaaaaaaaaacacggacttcagtagaaaaaaaaaaaaaggaaagaaaaattcttttacagttcgcataaacgatgaggttacgccttataaaaacgccaaattaactgacaaagagagggacaattgtgtaaagtttgtgtatcttaatgtgtggtctagaaaggctacttttcatgatcatgtagataagaataagagtaatctcatacaaagcataaggtaa

SEQ ID NO: 6949 - DNA, 288 bp, Candida albicans
agtacatgcaccaatattttgaaacattctaccaacctaataacaattgaaattgggctcaaccgcacttaccttgaaactaacttatatacaggtggtcatacaatttttttcacagtagacccacaactccaaaaatcaggtacacaaaagcagaaaaacacgcacaaaagtatattactcggtgtgtgttcaatgaaaagtgtgctggtaaacaaacgtacaaaacttacagtcgtgtatataacatcaaaaaaaccgttgaaaagaagtgtaaagtctaaataa

SEQ ID NO: 6950 - DNA, 189 bp, Candida albicans
ccaacccgtcgaccaataaaactttggttttcgaaggattcaattattaaaagtttcgtgttaaatgctcaatttgttgcaacacgaagtaaaagtttaaatagaacaagttttatggaaaagttattaagtctaaataaattgtctattttttttttccagaaaaggaagaatattaattatatacga

SEQ ID NO: 6951 - DNA, 375 bp, Candida albicans
atccttcgaaaaccaaagttttattggtcgacgggttggttaacatggaatatatcactttctaataactatgtcacaccaacaaatatcaatatgagtgtttcagacaaatacccagaacttgttagacaatttttccttcttgatgaagtgaaggaaattttgccgaactatccaaaatacaaaattttactgcaaactcctgaagtcgatcgtgaatactacaaaaacatcaccagtcctgaattcattagacaatggcagccagaagttctcaatcactaccgaaataactggaccgaagtcatacctctttgtgctattgtacatgatagaaccattgatgccggtttgagaatccgaaatttttccatc

SEQ ID NO: 6952 - DNA, 597 bp, Candida albicans
tacaatcaacaacaacaacaacttacacaggcacacacatatatatatatatacccaattaatagcatgtcattgaataatccaagtcaagatttaatttttttcaaagataattcactaatatcagacaaaatcattaatcaagaaaccaccaccaccacgaccaccacagcttcaaataattttcattcttatttatcagtgataacttataatcaatcgacttcacctaattggttaatcaatggattaattgaagatacattatttggtaatgccaccaaaagtttaaataatcatgaatcctaccaccaaatgaagaaaaaagatattattattaagaataaaaaaatcatgattatatcatttttacataataaagaattttatattaaaaattgtaaacgaattggaataaatcttgaagaaaaggaacaacaacaaccatttcaatttattgattattttaatgatttatttataaatttgattaaaaatcctaatgattcagttaaagatattaataaaatgtgtgataatattataaattctttgaataatgaatataaagatgatgtcgatgtgattattattgaa

SEQ ID NO: 6953 - DNA, 615 bp, Candida albicans
cgcaatgcggtccttccacgccgtggtgaatattcagcattattgattattgacgttgcaacccaagcctttgaaacggtctataaaagtttgtcatgtattgaattgtttttcaatcattatgataatctcaaaaagttgttgattccttcacttgttgtaagaaccaaatctattcttgattcatttgccaaaatcgaacagtttttaaaattaaccttcccagtcgacaaaatggcccgaggcgagattgtcacatttgacgaaagtacgtttgaaaatgtgagaagagttgaaaaagttacgagtggtatagaaagagagtccatctttctagaaacttttttcttggcatttgatgcgtcattgacactgtacacaagtatattgttaggcaagggtattttgaaaagagatgtaccaccaagagattgtgagattatatcgagaagaagaatttgctatcaagctgctgagcatgttgtaacaatacctttatcagaggattcacccaataaaagcaaaagtgcaatggagtatcttggcaaatacattgcttatataggagttctgttactaatattgattagtgtagtattttatagattgtgtaaa

SEQ ID NO: 6954 - DNA, 183 bp, Candida albicans
tataaaaaagggaatgttgtggttgttgttgttgttggcgtgtttacacgacattcaccaaaaatgttcaatcttaactgttgttacataaatactagtaatactattactactactctattcctattttctaatactttttacagtaaatatttattctatttatctgatactactatttaa

SEQ ID NO: 6955 - DNA, 231 bp, Candida albicans
tttcgtttttttatatatttgtattttttttttccgtttttaactgtttatttaatgttattgtttatcttaagtagtattatcatttctatatatatatattatatatttgattctttattatcatttcgtttgatgttttacatatatatagaagttttgagtagattattcttcgtcaaattcatagaaatagtgcaatatatcatcactcatttgcaatttcagtaa

SEQ ID NO: 6956 - DNA, 285 bp, Candida albicans
ctgactgacaatcatcgtcatctatttctactcctactttttaatttccctttcccaattgttagacaacacttttatttatcaataatgtcgaaaggtcgatttcttaaaccattacaagaattcttgacttccaaatccgatttttccattatatacaacacttccacaaccggttccacctcatcattcattaatcctacaactcaacgtgtatgtatattagattcttcattccaccttcctcatttgggccattcttgcccacgggtgcagatcccgtgc

SEQ ID NO: 6957 - DNA, 303 bp, Candida albicans
cattttctattggcgaatttaaacttcgaaattttgtccaacaactttatttccttgacagctagtttagagcaatcaacagaagcttttaataatcagttgttcttttcctttgattcaacgaatagtgctagagagaaagagaaatcaaaagatttttttttttgcaccccttgtaaatttccgttgttgctgttgctctgttgctgcttaatcctggtattgctgctactactgctactactagtatttcccaacattacttgctgcacaaactactttcttttggtcacaatatcctag

SEQ ID NO: 6958 - DNA, 255 bp, Candida albicans
cgttgtaacaataagcagaaaaaaaaaaatataaccagtcgagacaaaaaaataaaatactctgcgactttggaacaattggaaattgtaactaaacggtcgaaacacaaaaatagaataaaaaaaagtatgttccaattgttgttattgtggtcgtcttgtagaattagcggaatcctaaaggaactaacaaaactaggatattgtgaccaaaagaaagtagtttgtgcagcaagtaatgttgggaaatactag

SEQ ID NO: 6959 - DNA, 297 bp, Candida albicans
aatgagcatataaaagataacacagtaatactagacaatattattccgtatttgacttttttcaaatctatagagtttcctgaattagcattaacactagctgaagcatttgatgagccagaacttttagaagatgatgcggatgatgctgaagaaagtgtcaaagttttgacatctgaactagctgtgaatgaacctatggcatttgttaattgggaagatacacttgcgtatactaattgggaagtcactgatgcacttattgtttggacggaatcactagcaatagtagcttga

SEQ ID NO: 6960 - DNA, 264 bp, Candida albicans
acaattatttttcttgattacataataacacacagctgcttacataatagactgtttttggaaaagcaaaaattagagagaagaagaagaagaagaagaagaagaagaaaaaatttcaagatatttcaacatttcatccaaaacaattatatcttggatattaagtacttttcattagaaagttcattcaacttaattagacacatctactactactactaccacctttctcctttccctcccaattacacaactatagattaa

SEQ ID NO: 6961 - DNA, 243 bp, Candida albicans
gcaaattttaaaataattcccactactacgattagtttattcttgtttatacagttgtcagtatgggatacttccagtttgacaaatattactatgcagttggctgtttcctatattattctaatggatacaccgggattcataactgtaggtcgtgctttagatcattcctggttagttccacttacctccttcctcgttgttacccacggcccacgccccacgcctctgtcttgttcctaa

SEQ ID NO: 6962 - DNA, 516 bp, Candida albicans
ccgccgctttgggccggtatggtccatcccgtggtgaagactcgttgggttaagggttccaaagagttgattgaacaacaagagttcgaagaagatggtacacccaaaccatattttttcgaaaaatataacgttcagttggaaatccctgaatttgtcgacgaagacacttatgatctttatatgatcgagattaaagaatatgagagtaagatgaaagaggaaagagcaagaagagagaaagaacgcaaagaaagggagaagagagatttagaagagaagaagaaaaagcagcaacagcaacaacagaaatcacaacaaaatccacagaaccagatcaaggacgatgaaaaaaatcaggatacaagaaacaacacagataaaaaggacagtgaacaaaaatctgaggacaaaccaaccgtagaggcaaaaaaggaaactgacgaaaagaaagatgatgtggtattgaaagataatacaaatgagacgaaaccagtcaccgagactacaaaatca

SEQ ID NO: 6963 - DNA, 213 bp, Candida albicans
gaggatgttttgccaacttttaaatcatcatatttatcaagtagtataatggtagttaatcaaaggtgtaataaagaagtactacaaaatcaatacaccaagaagagtaaattaatagtagtcaaagaccaagaaagtaaaacagtggtcaaaaaaattctacaaacccttctaaatgtggttataataatcaaattccaatgccttgagtag

SEQ ID NO: 6964 - DNA, 1017 bp, Candida albicans
cccatattcgcgctaccaagtggtttattagaattattacttcacgtatttgaaaatccagatagaggaactggagtttatgttactgtcgccagggggaaaaatctagttggagacaatttaccaccagttttcattcataatgtcattgggaaacaacttaatttacttgggaaatatcctcttcataatgatgtagcacccctgatattatttgcctgtatatttcttgtcattacagttttacattttgctttgtttctgatcaattacagcagagggcattattttatgttgaatcttatatgggcttttactatgatgataagaatgttatcatttatattacgagctacttgggcagtcaatattgtcaatgtcaaagaaggcattgctggtgaagttttctttgtcataccagacgtgttgttagtatctaccaatttgatattggcacaaagattattcacatggagacacccagtgggaggaacaagaagattattttgggtatttatgatctcactgtatttgctggcagccataatacttgcagtggctatcctatcttcagcaattccctatttatactacttatcaacggaaaggttttttgtttatattaatttgaaccgatgggcatctattatggttatagtttattcgttgactgcaacttcgttgattggattgtcactttggttacccactaagaaagatgaaaatagatacacttatcaaccatggtggattgaaagttttgcaccattctattttattaaaaagggtgcagcacaagaggcagcagagacgtttatgaaaagaaattccaaccatagacatgctactcgtgtgattgctgcaacacatcatcatttcaaggtggttaaaggtttgtctaaccaaagaggggatcttaaacacaatgtttctttggtgatcattataatttcctactgtgtgcttattaattgcttcgactcttgtcttggcccaatgggctggaagatccgcgtg

SEQ ID NO: 6965 - DNA, 318 bp, Candida albicans
tatattttaatttattttattgttacaatgttagtacagtttcaacagttattattacttctaatatcaattattaaactatgtcaagcagatgataacgataattcttttttccaaccagtatcacaaccatctttaaactataaggatactggtaatagaataggacttcttggatcatttgatgctttatctttttattcatttgttaattcttcacaaatcgttaatgatccagataattcagtgtcaatatttcaaaagaaacgggacgtttcaaattcttcatcctcatcaacaagtttttccaataattaa

SEQ ID NO: 6966 - DNA, 594 bp, Candida albicans
tataaacatatactagtcaaaattatgccccgtataaagaaagaacttatagaggtaaaacaaaagcaacaaagatctatattagattttaccacccaacaacggcaacagcaacagcaacggcaacggcaacccaacagatcatcccaagttgtaactatcaaatcagaaactataactaatactactactgaaaactcatcaatagtgtattgtcctatatgtaatgaaggtataactcatttagatttacgtgaacgaactgatcatgtaaatacatgtgtagtacccgtcacatttgttgaaaaggcgacgtccaacagcaccaccaacaccactactactactaccacaacaacaacaacaacaaccactatacctgtgaaaagagaaatatcagaagtaaaatcagaagaaactatgatggaaacagtagtaccaaaacgagaatttaacaattcattatcatcaatattaatatcatcatcgtcgtcgtcgtcttcttcttcatcaagtgcaactgagaaaaccaatagtttaattaccaagacacggaaaatcgatcctgacaataaactgaaatatatcaactag

SEQ ID NO: 6967 - DNA, 879 bp, Candida albicans
gctgtgtgtgtaaaaaacagtctggagatatggcaacttaatacaacattatcaaccaaagtattcgtaaactccaatattaattgcccaaacttggaaaagttgtcaatctgctactgtcattccttaagggagtctccattaacattttcacaatttgctgctattgattttggtaagctaatacagttggaattaaagttgaactgcttccaccgtgactgtgattgtatcaatcaattctataatgatttgacaaaagcacaacacgccaacgagttcaataatttgcaaaaattgtctattatcaattacaaatcgaaaaactccagcaataatttgtgtcagtataactatgtgattaattgccaattacaatcgatattccgcaaattcccgaaattggactatttgtatttcaatttgaacgagttcactaaaaatgatcaattcaagattatctgggccaagtttgctgaatcgcttcaaatcttgaagaatttgaaaacattaataatttacgattttttcaactattggttaccatcgatgaagtcaaatcaagctacatcggaaattctattaaacaattgtaaatgcgtggagtgtaaccaaagaacaagtgctttcaattcaatggcggaatatgatgctgcaaacaattatgttcataatttcaagaactatactgaaccagaattgtcggctgaatctggtaacgaatatcaacctattttactaaataagaaatgtaatgccaaacttttatggttcatttttagtcaacttcaactgcaacaattcaaacaactgccaatatattcaatgaatttaagctactttagagaagataaagagttgttctctcagttccaatag

SEQ ID NO: 6968 - DNA, 312 bp, Candida albicans
ttatcattttgctttttttttcatactacaattaactacaacttcatcattctcgtttggatttcaacatggaaagaagacaatttaacacatccaacattagaaacggaacaggccgtcctcgtaagactcccagatccaagctttatatggtttaccccccactttcaggtgaggactcaacaaatcctgaaccagaagagggtagttcacaggaaaacaatcccacagaacctagttcctcacaatcaaattcagtacaaaatcaagaccaaagtgaagaccagagtcaactaccacaacaagaactga

SEQ ID NO: 6969 - DNA, 942 bp, Candida albicans
ctacaacttcatcattctcgtttggatttcaacatggaaagaagacaatttaacacatccaacattagaaacggaacaggccgtcctcgtaagactcccagatccaagctttatatggtttaccccccactttcaggtgaggactcaacaaatcctgaaccagaagagggtagttcacaggaaaacaatcccacagaacctagttcctcacaatcaaattcagtacaaaatcaagaccaaagtgaagaccagagtcaactaccacaacaagaactgaatacacaacaagagctgaatacacaacaagaactgaatacgccatcacccagggcgtcaaacacatcaactgaaactcctgctcctttaagtcccatacaaccaggaattcgaaatattcctctgggattattattaccacaagaaaaagttggccgtcttatgggatatccattttaccgcgattttaattttaccctaaatccagagagatatcagaaacttatttatgtgtttcagatacttaaaaatgctgctcgtaatcacagaaatggagcttctttacttaagaagtatttcctgttagcgagaaggtctaaaagaacaacagacatgtttgtaaccaccatagaggaaatgcggaagaggctgttggaaaatagtcgtaagagagagctcgaggaagcgcaagaaagggaagagtcaaataaaagacaacatacagaatcaagtgcagaaccaaatgcagaactgagtacagaatcaactacagaatcaaatgctgaatcaggtggtgaaccaaatgctgaaccaagtgcagaatcaactacagaatcaaatgttgaatcaggtgctgaaccaaatgctgaatcaggtgctgaatcaggtgctgaaccaactgctgaatcaaatgctgaactaaagcaaagaatttgggaatcttca

SEQ ID NO: 6970 - DNA, 210 bp, Candida albicans
cttcttcttctcaaatgtattattaggaaaattcaatacgctatggaagttgaaactggtaatattcttatcggtagacaattagtttgggacattcctcttattagtgttagtgaactgacactgggtataagtaatagtgtaaataattgtaagatatgtagagctattaatacctcttgcacgacatgtagacgtttgttctattaa

SEQ ID NO: 6971 - DNA, 231 bp, Candida albicans
caaacaaaaataacaaaaaaaaaatttatggaagtgattatatctattgatcacataaacatcatcaatccgaaaactaccaatgccaagtatttaatattttcaatcagttctttattggatccgttttcatatgaaatggtaactgccgaagaagaagaattagtcggtgtgatgacagaaatttcaatggggacgtctgatggaatagacaaactggaaccattttga

SEQ ID NO: 6972 - DNA, 321 bp, Candida albicans
aacacacaagccatcacaatggcaacttccacagaagtggtactaaccctcacgagtgtttcaggtgctaaaccatcagttgctaacgatgccactaacagtgtgcacaccactgattatactactgccactgctggtgttcaaaatggttccagtttgtctattccatcagacgtccccattgaaatttctgtcatcacaccgactaattcttcttcttcggcagttaccatttcatatgaaaacggatccaataaagaactgattgaaaatattaaatacttggcattggtagttttcggattgatgatgtttatgtga

SEQ ID NO: 6973 - DNA, 183 bp, Candida albicans
  unsure (66): Identity of nucleotide sequences at the above locations are unknown.
tatgccagggattcccccattcagacaccttattcctcacacatcggtgatttcaagattggtaanactgttattcgtgttgacccagaaaaagttgttgccattgttgaaagtattagtgtgataagttcccaccaaacactcgtagtgacgaacaatcaagaggtattgccaaccatttga

SEQ ID NO: 6974 - DNA, 897 bp, Candida albicans
ctccatctctatattctagcggatccaatcttaaaacaagttccattaatcaaaaatcccgcatttcagccaccaagaccaatcactttaagtaataattataataaattaattcctacattatcatcaacggtagtcccacctaaattaaatatatctgatacagaaattgatagttggttgaatgaaatacgatcacttcgtgaacaaatcaaaaataagcaaactaatgataataatcgacaatgtactaaatatgaaaattggattcgagaacaaagtaataaaattgcacctggatttaattatacagttatgcaaccacagaaatcaatgagaaatcaagaaaggaaactaactaccagaaaagaagaagaagaacaagaggaggaggaaagtgatgataataatgataatgataaagataatggatctggttatgatcaggctcaattattcttgcgtagttattggtatcggcgagcttcatttgattgtcccctctacactctttttgcgggttttctcagggtgttgttcattatctatttcttgattcatgtcttcattcgttgtgggttcacttgctgtgctgctcctctcggtgtcgttccttctgtcctcattgtttttggcgtggtttgtttcttgtcggtgcctcttcttatctttcgcttctggtgtattatctattttgtgttccgcttctcacttctttttgtgatgacctttttttctctgtcgttctggtcactcttttctcttgctcatcgtatccgattttactttctcccgctagttttactaatttcttttgttctctcgtttgacttttctaattctctatgcttttggcacccggttaccttgattgttctcttcgcgctctcgctttaa

SEQ ID NO: 6975 - DNA, 222 bp, Candida albicans
gaagcggaacacaaaatagataatacaccagaagcgaaagataagaagaggcaccgacaagaaacaaaccacgccaaaaacaatgaggacagaaggaacgacaccgagaggagcagcacagcaagtgaacccacaacgaatgaagacatgaatcaagaaatagataatgaacaacaccctgagaaaacccgcaaaaagagtgtagaggggacaatcaaatga

SEQ ID NO: 6976 - DNA, 198 bp, Candida albicans
attagggtggaatggtgtttgactcatgatatgtggtatctagacaagttgagttattgtgaaatagaatttgatagggtctgtagaagagatgttttattgatgttgatgataagttttttcaaatttgtactgccttataaatctcaaagccaaaaaaagaaaaaaatagaattatcaacaaaatcaaatctttaa

SEQ ID NO: 6977 - DNA, 243 bp, Candida albicans
aaaaaaaaacaacaccacctccaatccaagatgataagaggaaattggagtttagctgatgaattcaaaaaaaatgaaaagaaacaaatttcaaaaattcagcaacgtcaacgagataatcataaacttgaaaaattgaaagctatagatcccattcatttatattataaaattgatcgtcttgatcaaacccccaataaatcagaaaaagataattcatatttaaataaattgaaagaagat

SEQ ID NO: 6978 - DNA, 375 bp, Candida albicans
ttcttgtttaatgggttgtcttgctgcattatgtgtttgttgtactttagatatgcttttttaagccagatatatctactacccgtcttgttgttttttcttcttctatattcgttgtcttccccccccccccccctttttgttttgttaaattcgtttattatcactattattataattgttatttttaaagttttatttaatattattgctaatattactgctattacgactatatcactttcaagaaatgaaatgaaatttaatttaattacaagatttgttgaaatctttccttttcttttttttctctgctatttaattaatttacatataaaggttttactcctattccttttgagtatgttatcataa

SEQ ID NO: 6979 - DNA, 345 bp, Candida albicans
  unsure (137),(224): Identity of nucleotide sequences at the above locations are unknown.
tctttttttttgcaaccacacgacaatatacaacaacaaactactcaaactgttaacaagcgtgacaagcgtgacaagcgtgacaagacaagcgtgacaaaaagaaataattattcatcatggcctcctctctcatnccagttggtgttacaactaaaattactaactattgctaactactatatatattacgtgttttccttccttccttctttctttctttntcaccaattctttattgactttattcttcttctttattattatttctattactttacttatatcttattgttctacgcgtgtgtaatttcccacttctgttttcaacatgttaactgttga

SEQ ID NO: 6980 - DNA, 210 bp, Candida albicans
attgtgtctatgacgtcatacaaaaaaaaaataacaaaaaattctcaaggctttaaacccgcctcaaatattaataaaaatagaaaccaggaaaaaaggaaaaaaaggaaaaagggaaaaaaggaattatgcaagtatctattaatcttagtgttaaagaatacgatatccagagaaaccagaacgaagaacgaagcaactattaagtag

SEQ ID NO: 6981 - DNA, 231 bp, Candida albicans
aaagtagtagaaaaagaagaaaagaaaagaaaaaagattaaggaaaataatattcaatttcagtttggttttaaggttccttgtttgaaaatcggagacttattgatgaaatcatcaagtgtgcaaaaaagagctgctactactattacacttgtgaatcaatctatatatctgtccagcaagttaaaaaaaggaaaacacatcaaaaaaaagacattgcctagtttgtaa

SEQ ID NO: 6982 - DNA, 282 bp, Candida albicans
ttaaatcaatcaaaagtacacgacagaatatgtcgtacaattaattttaattccagtgaaaactttttttttcttttttttttttgtattgcgtttgagttgattaaacacgcacatcgtacacgtacacaacctcgcactgtcacacacacacactcacacacacacacactcacacactcacacactgactttgaaactatacagcaaagagaaaaaaaaatcaaacttcaacgatttacagaaactagatcagaaccatatataattccaaaaatctga

SEQ ID NO: 6983 - DNA, 297 bp, Candida albicans
  unsure (276): Identity of nucleotide sequences at the above locations are unknown.
tgttgtgttgtgtgtcgtgtaaagatacacaaaattaaaaataaaaacaaaaaaaaaaaaaaaaaacatttggaggaggcggaattaaataatgttagaaatgttaaaaaaatttgtatttcactccaaatcaaattcttatgtcaaacaagtattgtcattcgtgtatattttttttcctgttaccttatatgctatagtcattgtatttattcatatatattaacaaggtcatgctttgctattaagtacttacaatatctttcactattcccntgtattcgttcgttttgttag

SEQ ID NO: 6984 - DNA, 186 bp, Candida albicans
atagtgtatccacattttactgatcaagtcatattcctttaccctatcctttctatattcattgatatattatttataatgattaagaaaccattggcaactatgccaacattgaatagtcgaagaatacggttagtcttaacattgggtctactattgctatgtttacttaaaagcactcattgt

SEQ ID NO: 6985 - DNA, 315 bp, Candida albicans
aatagacgtcaacgaatgaaagatagggtcaaaaaaaaaaagaaacagaaacagaatcaaagtcaagaaaagattggtgggaaatcttgtaaactatttatagttgtttctatagataaattactagggggggtggtagttctattaaatggtaaaaagataagatggatgataatattcaacttaaactacgaagaaaatatggtgaaggctaataaaaaattgaatttggagtggacccagttaaacaatagtgtcattaattcttttcaattcattcgtatttaccttcaagtccaatactattacttttga

SEQ ID NO: 6986 - DNA, 321 bp, Candida albicans
ccctatctttcattcgttgacgtctatttcatatttgctgatcctttaaatatgttattgccagaaagtattaattcccagaatttagttaaaagaattgtgtattatagttcttatgatgattattccggttggtggaaatggagatggttattatggttattgttattgattcctatttttcttaccatctttttaatagcaagaagaggaagacaaaataaagtggtggcttataataatcctcctgatccacaagcaaatgaggcttattaccataataatcaattcttcaccaggcgtggacggaccaagctcgga

SEQ ID NO: 6987 - DNA, 372 bp, Candida albicans
ccgattggtgattcgtatttacctttcatttgctcttcgccccattgtaagacgtctctagcagcttgttgtgttctttccaagttcatatcgactaatgcaacatcggcacctttggctaataaagctcttgataccacggcagccaaaccaccagagccaccggttaatatgactagttttccatccaaacggaagcttgggactatgttatcgtatgaccagtatgcggaatccattatgtgtagtgagaataaagaagtaagttgtatggggaggaaaaatcgaaaaaaaaacggtgatatgagtgtgtctatatattttctgggaggagatgaccgcctcaatgttttcttttcgggaagattataa

SEQ ID NO: 6988 - DNA, 189 bp, Candida albicans
ccgcctcaatgttttcttttcgggaagattataaaaattgttatgtatgaatgcaccgagagaaatgttagttctaccgaagatttatataaaaaaaagtgggctatatacacgtcgccgttttttttttttttaaccaatgtgctttatcccaaaagcttcatagtgttggtgaaatcctttttatag

SEQ ID NO: 6989 - DNA, 186 bp, Candida albicans
tttacattgcttccattgaatttcaacaaatccgatgatattggagtttctattattcccaatattttattaaccaacgatgaatattgtccatttactaaaaaaaatgtaaagttgaccaaattagcaattttcaaagagttctccaatccagaaagaattgatgttctattgatcaacaagtaa

SEQ ID NO: 6990 - DNA, 219 bp, Candida albicans
taccaacagtgtggttttttaccaagctcagggcaaagtcaacaaaccaacaagcatttgctaaactctttcaatatactctcatatcaagttaactttcaacctaacgattatctgccaaattctgtcaatgaaaacgattgtatgttttgtatcactggtgttcgtacattttctgctatactgatagtattctttacaaatctctactgtttctag

SEQ ID NO: 6991 - DNA, 213 bp, Candida albicans
gtagcgcggggatttcttccagccccctgtgggtgcaagaccattgaatacaaagttgaagataaattgacttgtgctaagaacaaattttctacttatgtttacccttacatccatcaattgtatcaattcactgatgttgccgaagttcacgctcacgaacatttgagtcaagtctatgataaagttcaaaaaactttgaaacaggattaa

SEQ ID NO: 6992 - DNA, 306 bp, Candida albicans
gtaatggtagtgtatctcaagttcgctctgaatgtgatgataattcctttactattatgccattatagtaagtgtatcgtggttttccttttccaaaaagattaccaagctgattctatagtttcgagcatgatttttcttttatatatcactttgtatgtgtctaactttacaaaacagaaatgtaaattatttcaacttaaattggttaaaattttcattttaaaaaaaaaaacccccatcaatttcacaataaaacttagggcattcttgctacttcaactgatatttaggataaagtcttga

SEQ ID NO: 6993 - DNA, 717 bp, Candida albicans
attgtacctcaattggagcataatcacaagtcttcaatggcatcttctaatgatactttttcaattgctaaaacaatagcttcaccaattacaactcaaccttcattaattgttaaagcttccaaagattgggttttaccaccaagacctaaaccaggtagaaaacaaaaagaaaataccaccgcaaccaccaataaagaatcaaaacctaaaaaaaaatatgttaaaaaatcacaaagaaagaaggaactactgtcgtcactaaattctcaacaacaacaagcacttcattgccatgaagatttgtcagccaatatcgacgacctaccttcattaatgaaaaacatttccataatagattcagaaaatatggaattgaaatctcatttattgagtctaattcatgaatataaacatttgaaagatattgtgtttaaacaaccaatagatatgttttcacacaacactacaccaatctcaacaacagcaactactacaacaacaactacacctacagcaagcaccgccaccagcaccactactactacttctacatcaacgactaccccagaggtattatcagcaatttctttacaaccttcattatcatcagtatcatcgagtaacaacaacaaccaagatgatccacttcatcaatattcatcaattccatctcctggctcaccaatgtcatcaatatctactccattaccacag

SEQ ID NO: 6994 - DNA, 918 bp, Candida albicans
aataattttatattttctttttctttttcttgtttattcagtcgttttttttttctttaccctataccactcaagacatatttacacatccatacattcgttatgaaattatctacaactactgctttagcagttttggccactgccactgcaattaatgctgctccagaacaacaacaacaacaagaatcacaatttgcttctaaagcattaaccaaaagagaagaacaagatattcaagaattagttcaacacattaacaactataaaactagaagagatgctattgatgaagaaatcatgaaaagagattatgctattgttactgatgtattagcagctattaatcaatcacaattggctcctaaaattttggattatttggttagtaatgaaactttcaaaccaattgttgttaatgttaccattgccacaatgaaatcagggattatttccttacaagctcttttagatgctttagtttcttctaatttggcagttaatcttgttaatgatttgattagtgattgttcattatatgttgaattatttaatgctgctaaaagtgtcattaatgatcttgcttctaaagttaaaggtttgatttctaaaggtgttagtcagttgattactagagatgaaactgatattgatgccttggctccatatgttgtcactatggaaaaaagacttgatttagatggtgttgttgataatttgttggattctttatataaatctggtttagctacttcggttgttaaagatattttgactaattctgattatattccatttgctactgatttattttctcctatgattgccgggaaccccttgatcttggtaatattgttgatgctgtcaaacaatctggtttgtttactcgatgaagcacaaaacttgttaactttgtaa

SEQ ID NO: 6995 - DNA, 228 bp, Candida albicans
acacagaaccatgatgtggtctgtccttttacagccagtagtgctcgccgcagtccagcgacagggcgaagcccccgagtgagcgaggaagcaccatggaacaccacttatatattctgcttacacacgatgcctgaaaaaacttccctgggggttatccacttatcccccggggatatttttatacattattttttttatagttttttaaattcttcttttttatag

SEQ ID NO: 6996 - DNA, 198 bp, Candida albicans
cagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactga

SEQ ID NO: 6997 - DNA, 231 bp, Candida albicans
ttggagtcattagcacctgtcagagatgcatttgtagaggaagttgatgtactggaactgccgttactattattagccaaggatggtacctccaaagaagattgtattggtggggtggcagtggtcttggtagttgctgtttttgtcggagtgctaggcgacgacgttgaggaggacactgtttttgagttgtctgtatctgttgatgccattagaataggtgctacttga

SEQ ID NO: 6998 - DNA, 186 bp, Candida albicans
tcaactcgtcatatgtttgagaggttatatgtaattgtagtacttgctaaattatcagtaagagatataaatgttgatgatttttttagtggtggtggtggtagcacctatacgtccgaagcacacgagtgcgttggcgtggtgcgcggattctcgtctttttattttttgtcgcaagacgactaa

SEQ ID NO: 6999 - DNA, 231 bp, Candida albicans
aaccacccactattaccccagcataaagaatgttccggaccagaaatccgaagaataagttcagatgcctcggtccgatcaaatcccatggttgcttcagaaccgaaatctccgaccccccttgattatgaaaaccataataatgttaccaatttttcccccaccaccaaaacccccaacaaaatcccctccttatttacacccgaccccaccattttccgtatccacttc

SEQ ID NO: 7000 - DNA, 192 bp, Candida albicans
cttcccgtttgtgttgcatatttgagacttttgatccatattctgatgaagctgaatcttctggaacgagtgaggttgtacccgattatgattcagacgatctttacaatggaagtgtgtttactctggatgaagaagacagtggcgaagatgattattctcgccgccctaacgttattgtggaggcactag

SEQ ID NO: 7001 - DNA, 237 bp, Candida albicans
tcttcccgtttgtgttgcatatttgagacttttgatccatattctgatgaagctgaatcttctggaacgagtgaggttgtacccgattatgattcagacgatctttacaatggaagtgtgtttactctggatgaagaagacagtggcgaagatgattattctcgccgccctaacgttattgtggaggcactagggttgttaagcgattatgatgatggtgatgatacagattcttga

SEQ ID NO: 7002 - DNA, 267 bp, Candida albicans
gtgattcccattcttttgcactctatattggtaaccaattgcatctatgagactttaaccacgattgatctcattttatttgttaatcatcttttaaacagatctgaaacaaaaagtgtaaccacttcgatcaaggcatcacttatcaacagtaatgaaatcagaattacaacaagagctttgcattacttcctttcaattggttgtgatgtcagcatagagcattcctacaatctactaccggtaataataacctttataatgtaa

SEQ ID NO: 7003 - DNA, 189 bp, Candida albicans
ttttatgttgaactgcattatccactacgtaattttaagatgaaaaagtggtctagattcagccaaaagtggaacaaaatagtattgggttcattaaggttgatttatgctcttctttctgatttgacctgtgagtttaatgccgatgagagtcacttgtaccttttgataccatgcccaaccacgacg

SEQ ID NO: 7004 - DNA, 372 bp, Candida albicans
atttgtttgtttaatctaaaccttcttttttttgcaaccatgtcaacttctaataaaaggcaatctaatcaatcgttatcatcgtcgtatggttcaattcaagccgaatcggcatctcctagaccaatctttcgaacaggctcaaagactaatacatcaaacatattatctgcaactacaactactcaaaacaacgatacatcaggtccccattcaccatcatccctaacatcagggcacccattgctcaacaataacagcaacaatgataatgacgaaattgacgatatcaccgatattaaacctgaagatgaactcaatgattatcacctacatcttttgaattataaatcgatcacattagaatataaa

SEQ ID NO: 7005 - DNA, 279 bp, Candida albicans
gaggggaagaaggacgggagagagaaggaaagggggagggaacaaagagagagagctgaaaaaggagggaaaagtagaggagaggaaagggagggggaggggggaaaagggggggaactgggaggaagggaagaagaggaggaaagggaggggacggaaaggagagaagaagaaaaagaggcaaaagagagagaagggaatcgaaaaaaaaacccgcagaacccagcgactagaggcgagtcggggaggtcgggaacgaggaaaggaaagttcaggtag

SEQ ID NO: 7006 - DNA, 360 bp, Candida albicans
aggcgagtcggggaggtcgggaacgaggaaaggaaagttcaggtagctcaatttgattatccagctattgttaacttgaaagatcaagatgctgaaattgccaagaagaccatcacttcttcttctagtactaccactaccactactgctaagaaagataaaaagaccacttctactactagtgcctcatctactactactacttctactaaatctaactccacttcatcatcttcatcttcatctaaaaaacataaatccgaaactgcttctattactaaaaccggtggtgctgattctgttgctgctgctgctgctgttggtggtccaatcttggccgctttagctttattattgtaa

SEQ ID NO: 7007 - DNA, 285 bp, Candida albicans
tggaaaatacaactacaagttatcctcgtaggagaacttgaattactaatcaaggtacacttactcctgaaatcttatcattcattatttaaaccacgttttttttttttgaagattttcattcaacttgatttcttattttgtattctattagtaatcagtataattcaatttgattattactatccaaaaatgacattgaagaattatgtttcaagtgtaaatatacaaattgatccaaattcaaccttaaacttgtcgttcttaatttattttcagttataa

SEQ ID NO: 7008 - DNA, 768 bp, Candida albicans
attcattacattcaatttcggaatttgaaccaagatgaggaagacaaggacaataactctaaagacatcactgaggaggaatattttgatccagtacaattcgaatcatttatgaaatcgagtatagcaaagtatcgaaagtcacagaacaaaaaacatcttgatccattcaagaacatcactacgagtgaaaccaattcagagcccaaaaatcaagcatctaacccattaacattgttatattcacagcttatatctaatcccaagtacattgattcacaaagaaatggacaatatccattttccaatattgtaacgattaaatcatcagctactactaaacagactgaactgatttcacatcacaagaagttgcgtattaatggggcacctatcacttcagagagtctacgaaggaataaggagaaatgcaaatgttccatagctgatgaggaaacttcgaacaaaacacttgaggatgcattattggaacagttgaatatcagtgaccatgacttggatggcgatgaggtttggaacagctcagaattaaactctgaggaagacgattacagcgaggaaaataccgtggatgagcttctttcgtccgaatcatctgatctggactcatcgtctatagatgaatattctccaatcaattcaactaaccaatactataataacttcaagtcagatttaaaacagaagaaaagggataaactatccggtcgaaatcttgacctcggacggcactaccacggacagatc

SEQ ID NO: 7009 - DNA, 468 bp, Candida albicans
ctctggtttaatttattacattactctaactttagtaataggatgtatcaatcttcatcttctaaaccaaagctaaacattaataataattccacaacaatcaccattaatccaaataataccctcaatcctttactttttgcaaccccattaaatttcaagccagcatttacatccaccacattaagcactgggtttgataatcatatacctaaatcatacattgttttatcaaataacagcaacaattcaagtatgaaaacttccaagaaacttggtaaatcaaatactaaaaaaactactaatgatccaccaaaacgtaaatctttaaatgaagcaattgctaattatactggcaataaatatttgactcataaggaaaggaaaaggaatagaaaattacaagaaataataaatgaagataatcaagtccccaaagaagatattcagcccgggctggagatacgg

SEQ ID NO: 7010 - DNA, 252 bp, Candida albicans
  unsure (61): Identity of nucleotide sequences at the above locations are unknown.
tggtatttttgggcacagccttttcacggtgatttgtgtgcgtatgtgtcaaataaaccanacgagaaaaataaaaaaagggaaacggtaaataaaattcgccctacaaataaacaacagaacaacaacaagaacaataacaacaaaacaaccataaaaaaaaaattaagagaacgtaacaacaatatacactctttaagtgaacaacatttaccaacacgacaattatcaacgagtccacctgttcgtctt

SEQ ID NO: 7011 - DNA, 684 bp, Candida albicans
ccagccgggacagttttcattgctgtgggtgccattgtgggtgccattttgttagggtttattttataccatttgattgtttcgttaaatgcatctaaattggctaagaaatctaatgccgacgatagaaaattatatgagaaatatcaaagtaacaatacagatgcatatggttattccggtgtgactcctcaaacaagtttgaacaattttactagcgattatggtggttctgtttccaaattacctttgttgaataagtcttttgcaaatgtaaatggttcacagacgggtgacaactccacaatttaccagtctgaagttggagctgcagtaacgtctaaacatgatttgaccaagatgtttgtttctccgactgccgaagttatgcaacataagagggttagatctagtcactacaatccttcattgaccaacttgtcttttggtggttctacaagcaatttgggtaacccttcacttgctactaatagacactcacaagcggtgcctaatttgtatatcaaccaagaggtcaataacagtgattactctttatctcaacatggactggttgctccatcatcacaacaacagcaacaacaacaacaacaacttaatgcaccggtcaatacaaaaactcttccatctatgtatcttgaagatttaatcgataaagaatag

SEQ ID NO: 7012 - DNA, 282 bp, Candida albicans
gaagacgaaattgctaagcaatctactgttaatgatactttacatataacttttaaagaaattgaaggattgaatcaattgtatttacaacataacaatcctaatttgttacaagatccaattgaagatgatgaagaaactgtgattattaatgaagataccattaatcaaattgttgaaaaatttgaattgactaatttaaaagaagatttattgaaagctttgaaacaagaaacaaaacgattaaatagggatattaaagtagaagatcaagttgagtag

SEQ ID NO: 7013 - DNA, 630 bp, Candida albicans
atcggcgatgttggagatattgaattccaatatattaagccaccaaaacaaagtgtatggtttagacgtcctcatgcattaaattattttaaagatggggttttattccgtactaaaggtgaacgaacttcagccaaaacagaattgtttttagatttgttatacgtggggattattgccaatttagccggtgaagcaagtgaagaagctggtggtaaggcattattaaaatatgttttattatttttaccaacatgggtgatttgggctgacattaaagattttaccaattattattataatgaagatttgtcacaaaaaatgtacattttttggattcttgccttgttgactttgtatatcaatagtcattatgcattattgaatagtaccgatggagcagcattaactattgttccatacattctatgtcgattatcattggcagtaagttattttgtttattcatttttcatcccagagcacagagcccactcaagattatactcagctatggtgttggtgacctctttatgttggattgccgttatatctgttccaacaacagtgaaaattggtcttgcctttgcctttttatatttagaacaagtctgcttttctattgcttag

SEQ ID NO: 7014 - DNA, 186 bp, Candida albicans
attacttattcggtttctctttcctcctttcatctatcacttgcttttaagcaattctacttatatatatatcctaccaccacaataaatagacgacactcaataaaatctagaatcattactgatttagaactttcatgtttttttttactcactacctcacacatgaatcaaattcccggataa

SEQ ID NO: 7015 - DNA, 366 bp, Candida albicans
atattcttagtccttaactgcgtattctcttccctcccccccctctctcccacaattagccgacaattaaccaattggcagtgtacttattacataacaatggtagtaaaaaaaaatcggttctgtcccgcccccgccccccgcccccacttctatttttttttactcacatcttccattcaaggtaaaaatctatttcataacatttccatcactacatatcaaatttgtccacgtccacgtccacgtccacgtccacttacttacttaatgtcttgtgattcaccaataatagtttcattaaatgatttgaaaacagatgaaggataccctggattaaaagatgaaattttagaaaaagcttag

SEQ ID NO: 7016 - DNA, 213 bp, Candida albicans
  unsure (186): Identity of nucleotide sequences at the above locations are unknown.
tttaaaaaaaatttcttacaattcctcaatgtgtatgaaatcttattaaggggaatatttaccacttcttatacctatgggattaatcctaaccctagaatggtttatccagtggtaatattaatattcattggttggatagtagttccaaattcagtagttcttctacttgttgttgtatcatantcatcactatcgttatcttcattataa

SEQ ID NO: 7017 - DNA, 201 bp, Candida albicans
  unsure (141): Identity of nucleotide sequences at the above locations are unknown.
aggaggctggaaagaggtggaaaagatggagagtggaaaggaaggaggaggaaaaatgaggtcgaaatgggtgtaaaacccgggaagcgaccaacaaccggtacagaagaagtgaaagaaatttggagaaatctagagaanacccaacgacaaataaattctccaaaaaaaaaacaaaattcacaaacaaaaaaaaattaa

SEQ ID NO: 7018 - DNA, 372 bp, Candida albicans
acaataacaagaaaaatgcaaattaagtcatttcttttaccaatagtcgctgccttattgacatcagtttcagcagcagactcatcaaacaaatgttcattctctaaaacttccatcacagaagctactggtatttcccaattaaatgcatgctctactttagatggtgaaatcactgtttccggtagcggaatcggtagcattgatttgagttccgttaaagtattaaaagccaaattgagtattctcaactccccatcgatggtctcattaaattttcaaccaattaccaatacattaactggtggctttaatcaattaataaaagctaccccatttaaaattcaatttaattttactccaattttacca

SEQ ID NO: 7019 - DNA, 465 bp, Candida albicans
ctgaggatttgctcagctttcattcctatctactactgccccatattaaaaatgtctgacatactcaaagccaatcacagaaaagtatatggtaatgtcagtaatagcagcagcagtagcagcatcagcatgagtccaagtggtagtgctactaacaaaagaagtacaagaagtgctggtgacaacaggtcaaagctttctcatgatatggttgcaggggccgcgtcctttgaagctaccagattatttgaagatagacatcgaagaaacgggaaaccagttagtcatgctttcgccagaaaaactcttattgcacttgccgcatccgaagtggataaattgtttgaagtgaaagaattaacccatttggataaggatcaaataaaaagcgaggcaatcaaggccgttgagaaagaatacgagacccattatggtggttttcacacgggcctggaagatccgcga

SEQ ID NO: 7020 - DNA, 639 bp, Candida albicans
  unsure (630): Identity of nucleotide sequences at the above locations are unknown.
ttggaaaacgggattcaaatgccccaattcctaataacccaccatatccgatacgcgatatcatcgataactagctttgaatcacattgtgaagatgaagaagaggaaggtgataaaatgccttctgggtttgaagaagtaaataggcgatcagtttcacctcaaaacaagcaacagattattggtcttgatgctacacgtaaccaagtacaacaatcgacttataccgcattagatggcagtaacaacactacttctagagattccacaaacatcacaaaacataataataataatagaaattcgactattcagcaagtggggagagtgaattacaatcccaaccggtcatcgttagaatcacagagagttgaagctgtagcgtgtatattggaaagaacggggagtctggccagggatagtagacgtgcaagaagagctagagaattgagacgactggctagtattcgtgaaattgatgacgtacaaccaccatcctcgtcatcaatcaatgagtctagaaacctgtcaaatattaatactcatcgtgccaatagaagaaataatatttcttacactaacgtcgactgccccgtcttcactctacaggaggacgcccagcccccgcgncggatagga

SEQ ID NO: 7021 - DNA, 195 bp, Candida albicans
acaacaactacaacaactacaacaacaattataactactactactactactgctactacaatagctatatctgactctatatgtttagaaaaaaaagggagaacttacaataaaataacgatgaccaaacttgtgaatattattattatatatcttgacacacaacctgtgtcgtatatatatatatatatatga

SEQ ID NO: 7022 - DNA, 294 bp, Candida albicans
acacaacaagtcagtactcacaccttgatgtttagtttgaaacccagaatggctactttactaaaataccaaaacaatgtaccagcaacagccaaacaaccaaccaagacgacaaaattattatactccttgggtgtaccatccttaataattgaagcagcaataggtataccaaacaagtttgctaaggataatactgcattgagaatcccatatttggtaccgatttcattaactggagtaatttgggataagcatgctggtaataaaccaagtatagaaccagaacaataa

SEQ ID NO: 7023 - DNA, 303 bp, Candida albicans
tttacactcacacactcacacacactactattaattgatttgatctattttaattcacgcactttttacacgcctttctttatgttttttttactttactttactttacttagcaagaaaagaattaagtattctttttttttgtgtctgtcatattatcaagacattatctttgattttactattgatgtaaggatcccggattttcacggagacaataactacaacaaccagaagaaaaaaatagatcaatttgattggtggagaatgatacttgtattactattggcaagtaaattttga

SEQ ID NO: 7024 - DNA, 186 bp, Candida albicans
agaatcgacgcagaacgtccggatccaagcgaagaaaagagaaaggagacaaagcaaaaaaaaaaatcaaaatacccaaattccaatcaaacttcttcaacaaatatcacttctctttatccaaatattttaggatctctttctttcaattcaacttcaaatgattacggcaatatttatttatga

SEQ ID NO: 7025 - DNA, 249 bp, Candida albicans
  unsure (187): Identity of nucleotide sequences at the above locations are unknown.
ctgtggtttgcttgttcaaaacaagattttgggaagttctcagtcgcgtgtagaactttaaacaacagaaaagctttacaactttacaaacttgtagagcaaagatcacccgtcaaagaaactcttggcattataaattacaaatatattccagtttttacaaacaaaagagtgcttgaaaagaaanaaaaacaaagagaactgaagactttgaaactcacgaaaccaatacttaggatgaaaaattaa

SEQ ID NO: 7026 - DNA, 516 bp, Candida albicans
ttcatcaaaatagtgttgatactcatccccgtgtctctagatatcataattaatcggcaatccctggcaagcgaggcatttacctttatggttccaaatggtgatcccggtggttggaatcccttgcctgataaaactaagctaagcaaatttaatagtttttcgttgatcaagtttgttaaagttggtatattttctatcaaaacttggagtacatcttgcatgtgctttgataatgaacagtttgcgaacatcatatccaatatatctctttgcaagtgttttgtcaaagcaggccctactgctatggataatttactgatacaatcaaatatagcaggttcagtctcctttctgctcgctgtgtacttaaagccggacgctaaagatgcaatgttagtcgtactgatgtttggagattcattcgatgccgctttggccaaaatcagctgtacccctgcattagaggtatacgataatccctctctaatattatccaatattgcatctaaataa

SEQ ID NO: 7027 - DNA, 219 bp, Candida albicans
agtgtcataccttcaacatatatgttcagtatcatcaaaaaagttacatggaaaattagggaggcagcaagatacagatatcaacttaatcaatcctttcactttaaaaaaaaaatcttcaatcaaaatcaaattaaagtaccagtacaagtgctttatttaatgcacttacaatttactccatatatccccccaactaatctacactcactcctctaa

SEQ ID NO: 7028 - DNA, 189 bp, Candida albicans
aataaagaaagaggatattacaatcaatttatatactttaaaaataaatttttactaattaaaagcggagaagagaagataatgagagagagagaatattttagtttgatatttttaatagtaaataataatactactagtaataattgttgttgttgttgctgtgtcttcagtcgtttctgtatttaa

SEQ ID NO: 7029 - DNA, 636 bp, Candida albicans
tttcccttgatactaaagattcctatgcggaatagagaaacgtcagtggtattagattatttaaagcagtatttacaaagggaaaaagagactgggcgaattttcattgatgggtccactttccaaaaggtcatgcagtatgctgttggcataccttcattaaaaactatagaagcaactaaagcattggtggaagaatacggaaaacaaagcactgaatattatgctggattgatttcagcatactcaaacttagatcaattcgaacgagctgataacatggcgtacgaggcccacagaaagtctaagattccttttggggaaattcaaatatgggcactgcaattgaagaataatatgaggtggaagttacgatcaccggatacaataacatcacaatataacgaaataaagatcaattttataaccaagatgagtttttgttcagctttccaacttttttatgaccaaggaggtatctcgctaattagtgatataatacagagcttgcataatcatggtaagcttaaacaagaattgactattttccgtcgctcaaagatattgcaactccgggatgaaaggatttatactacgagattagacttttggcgaagaaagtttgagtggcatgaa

SEQ ID NO: 7030 - DNA, 780 bp, Candida albicans
agcgttggattttccagcccggtggtgaaaaattggaacagaattcctgaagcatatttggatgcaaccacttccatttccgttgccccttcaacactgcaagaatcaacattattgaaaagcaatattaatagatctaatttgtctgtcaattcaattgattcatcaggttctctgaatgagactccattgagtgaatctaaccctgcttctcgaattcctagttttaataacaaatttttcaaaattgatttgggcaaatatgatgagttgatgaaatcaggtgataaaaaggactcaccaccattagatccatctgtgaacaaacacaattttgttattgacaatgaattgacgtttagaattgatgattttatatctgaattagataatagctctactagttctgttactggtggtggtgctgttggagccggtggtggatatgacgattttgccggaggggatgacgatgatgatgttccaggattgggtattgatgttgatgatattttgaattctgataaattcacaaactttctgatgtcaccaaaagctaataattccaaatctaataaaaggaaattaagcatggatggaagtatgaaaaaaatttacaaattcatccctaaatatgctaccgttgacaggttgattgacttgttgttgcttgattccaaatatttccaccgtgatgtccaccttgatttaactgaatatagatttggtttttttagtagactacaattcatttatgactaccaacgaattattagataa

SEQ ID NO: 7031 - DNA, 354 bp, Candida albicans
  unsure (277),(315): Identity of nucleotide sequences at the above locations are unknown.
actggatcaatttttccagaagattgtaacacaaaccacaacaatagtatgcttctgagcataaggtgggatgaggctttgctaatattgctaaattacttgaatgactatccagtcaccatcacttgtttcttggtactattaattatagcattggggattgccatagattatatcattactcctaaagaaattgctaatatattcccaattcctggtgaactaccatttattggacatttgcatcttatccttgagaatcccgcactaatctatntgacttgggtcaaattatataaccaatcgatttttcanattccgattggaaataaacgagtcgttgttgttaaataa

SEQ ID NO: 7032 - DNA, 189 bp, Candida albicans
  unsure (90),(96),(102),(103): Identity of nucleotide sequences at the above locations are unknown.
ttcgactccccattttcccctcaaatgacgaccgagataattcaaatcaccacatacatcaaagagaaaatgaccactaactcttcattnttcaanacaatnnttcatcaactcattaaccatagatatacgttattgatgtttttcactattttgattatagcagtcatattagtggctgtgatgtaa

SEQ ID NO: 7033 - DNA, 468 bp, Candida albicans
  unsure (1): Identity of nucleotide sequences at the above locations are unknown.
ntattacgttatgcatcgggtttaacaaaaattgaaatcgatagatctcatcaccagtctctgaaaaagtcatcacaggaaagcaaacctccacaacaacagcaacaacaatattacggatatgttccaccggatgagatacaagatttggacgaccaagctaatcaacaacaccagtctttaaaagatagagcacatttattaaaggaaagacttcaagttacggccgatgacataccgcttaaaatcaaactcaacaaacttgacagtggaagtactgctagtggtaatagcagtggattgagacatagaaaaagagagaaattggaccttgataataatccaaacacttatgattatgacattgatgaattgattgcagaggagaatgatttggccagaaaagagcaacaacaagaattctataaagatcaaataatcggtaaagaaagagaagaaatggtttaa

SEQ ID NO: 7034 - DNA, 621 bp, Candida albicans
ggaattttaacaaaggaaaaaggtggtaaaaggtggcaaccggtggcaaacggtggcaacggtggcaaagttggtaagggtggtaaaaataacaagggttccaagtggaaagttatacgtgatgaagacgaaattactgctgctatggacttgggtaaatggaaatctaaattaggaggtatgaaaggaggtatgaacaaaggcggtggtaaaggtggaatgggaaacggtggaatgggtaaaggtggaaaaggaggaatgaataaaggaggtaaagggaaaccacaatatgaagaagaatgcctggaagaggaatactctactgaagaagaagaatgtgacgagtttaacaatggtaaaggaaatgctggcaacggtggtaaaggcggaaaaggtggtaaaggtggtaaaggtggtaaaggcagttggaaagtcaagcgtggtgaaaatcattcagatggaaataaacatgatggacaccataaaggtaataaagaagataatcaccgtgattcagattatgaatgtggttactcttcatccgacgatgaacatgaaaaaccaaaggtaattgccgaacaagatcttcacctagggagcagcacgatccgcgatgatagg

SEQ ID NO: 7035 - DNA, 489 bp, Candida albicans
gtttcagaagtctctggtttaattgttgttgatgtaaaagtaggaacttttgtggttaatgactctttaatagatacttcagaagtcgtgccagtagttgctttgctagttgaaactgacatttctggtgttacagttccagtaatttctcctttgcttagtgatgaggctttgaaagttaatgatctggagctcagttcaccgacaattgatgtttctgtaattgttgtttcagttgtgtccaaaacggtagttgtcaatactaatgatggggatccagcaacaattgattcagtaactatggatctagtggaaattgtttcagcagttgtagacacaaatgatgaagatccagtaattatcgattcattacttgtcgatacagatgatggtgatccaatgacagtagatccagtagctgttgagctagtaggtattactctggtagtttctccttcacttcgtaattttgacaatggcacactataa

SEQ ID NO: 7036 - DNA, 213 bp, Candida albicans
ttaatccgagttcctgaatcacgaaagaggaataaaacaacacaaaaaaaacacaaaatttggaatgatatacacaatgtggaaagctacgaacttggtgaacatcaggtggtattcaataccgcttacggtcgaattcatctttataatgtcttgaaaaaagtgcgagccttaagtttagtcaaattgtcgtcaaacatagcagtgtactaa

SEQ ID NO: 7037 - DNA, 477 bp, Candida albicans
tacgtgttgatcattgatctatacacaacaagtgcttcaagctcaatgacgaatagtttgcacatatcctcaattcaagaaggtcagacaagatttgtggatagtttagtccctagaatagatgaagaatatgttaatttgaatagctttaaacaatttgatgagttgctaacacatttggagagctctttgtcacaattggagaataacaacagtcgcttgttagtgatcccgtcgagtaatatttttagaatcttatttacattactgtctaggagtcctaactgtaactggactatttccaacagtttgggggacagtattccaacaactcacaaacaagtcaaggctaataatggctactacgaagagtcaacgggcaaacccacattatgtgatagaagcagagatgtgcttgaaaagtatataaacttactacccgatgataatcttcaccacgggcgtggaagatccgca

SEQ ID NO: 7038 - DNA, 336 bp, Candida albicans
ttatataacctcaatagatcgatcaaatttcgaaataattatctgcatattcgcaagaattggcaactatttgtcagtactgctgctgactcatctgcttcagaaacatacaagttgacattcccagatttgaaaaaaattaaaaccagcttgaatctagattctgatccatccaccaaagcccctttgaatgacacttttttgattgatatgttagggtgttgttcacatgattcaaatgggaatttactaaatttcgatttcgagaaacaaggcgcgtgtgttaacataaaggactttgctgaaatattaggacaaattggtgagttagactaa

SEQ ID NO: 7039 - DNA, 291 bp, Candida albicans
actgtggaccaagagatgcattcggtaataagctatttcatgagtcgacaatttaacaatgaacctttctcaaccgttaatgatctgactaattcagacaattgtgaatctcatattttcttgttagtatcttatgagcacattggttcattgaaagaaagtgtttctagcaattataccccccctcaatcagaaatcatcaccgtaaaccatactgtgggaaaaaacccaatggaaaatggaacaactgcgctttgtttaactatattaaaacagataatagcccattag

SEQ ID NO: 7040 - DNA, 234 bp, Candida albicans
  unsure (186): Identity of nucleotide sequences at the above locations are unknown.
gtcaatatatattccaataaaatgttatccagagtatccataagatcattgccgctttgtacacgtacatttgcaacaacttctatattaagacaatctgagcttactgccgctacagattcaagtggtaaagaaattgtttctggtgccccaagagaacttgtgacagaaagagttgtcagaatntaccccgggctgttcacctcggatctgaaggggtccgcacaatattat

SEQ ID NO: 7041 - DNA, 189 bp, Candida albicans
gttgatagaacaaatctccgcagccagcacacctgtatcaagtcccaaaaaggtgaaaccaccatcccaaagtccactgacaccaacaaagagtcgaacaagcaaagagaatttgaaatcaggatcccctttaaaacgtcttccgagcaagaaatgttgcagtcttacacgaccgggccctggaaggat

SEQ ID NO: 7042 - DNA, 327 bp, Candida albicans
ttgcccagctttggaacgttaatcactgaaaaagtggttaccatggaaatgagggaattattacatctaacaaaaatgtctcatcaatcaattaatcttttcatagttgctggattatgcaatgtcaataaaccacatatggcacttcagtatttgaacacattatcacatattttccccactatatcaaggaaaaatcttataaagaatcaaaattttattcgtattttacatgctacacaagatgtggaactcgccaaggaagtgatgaactattatcgtgatatccataatgactacattaatgttcaagtgttacaagcgtaa

SEQ ID NO: 7043 - DNA, 222 bp, Candida albicans
aactggcgaatgactgtgagattgctggttggggcgacgttagaatcagaaattcgtcttcgaagtcgattggacacatgttcttctgattcaagtggctataaaaacaaagtatctgatgttgtagctgaaaaccaagtaaaaaaaaatgttgtttataagacaaaggtaaataatgtattcctaaattttaagaaaagactagggtattgtggtggttga

SEQ ID NO: 7044 - DNA, 216 bp, Candida albicans
  unsure (197): Identity of nucleotide sequences at the above locations are unknown.
cgggtgagaatatccacggaacaatttgtaaaataccatagctctgaatatgctatatatgtgtatgatcgaataacaatcatcaacaataaatgtaaattaacgataataagagaaaggaaagaaagtcgcgcttacatcaaattgttaattgcgtgcatcacttattggctggcttatagtttaatcaagtgtgntattataaaaatgaacaac

SEQ ID NO: 7045 - DNA, 213 bp, Candida albicans
attgtttcacatctgtttcaacgaatatgccaaccacaccatctcccaaaccttggttacaaaaataatcaacctatacttggtggaagtgggggtttgcttgaaggatggattgctaaaccaagtccagaccaacgctgcaatcaattccattaccagcaacgaggtcctcaaccagattcgttccgtgtttggcaacgacattccatgtga

SEQ ID NO: 7046 - DNA, 207 bp, Candida albicans
agtcccattgatgaagttaatgatgaccatataattaatatacaaccaaataataatccattatttttcaatccatatggcatggcaagtataccagcaccaattatggtgtttaataaattgattgatccagattttatcgtagcacgtcccataacaccaatagtgtgttttataaacttgagtcttttttttttttttcaataa

SEQ ID NO: 7047 - DNA, 186 bp, Candida albicans
  unsure (16): Identity of nucleotide sequences at the above locations are unknown.
ttattaattggaactntgggggaggtgggggggcgacaatggaataaaaaaattgttatgtggggtgtgagactaggtcgtgtgactggacccaaaagactggcagtgatcacaaagagaattttatttgagagcaacaacaacaaccaaagagtgaacaaatcaattcaattcaatttaatttaa

SEQ ID NO: 7048 - DNA, 192 bp, Candida albicans
cataactgtcaatttgtaggaattaaaaatccaactatccaaccctatcacctccattgtccaatatttaaatgtttgttgggtatgaacccaatgagcaaaccatgtaacccggctaccgaattccatcaacttatagatagaactggtccaacaatgtggacgttaccatgtcttcatatacaaacttaa

SEQ ID NO: 7049 - DNA, 234 bp, Candida albicans
cgtccacattgttggaccagttctatctataagttgatggaattcggtagccgggttacatggtttgctcattgggttcatacccaacaaacatttaaatattggacaatggaggtgatagggttggatagttggatttttaattcctacaaattgacagttatgttattggaagttgaacataatatcattcttgtaaatgtaacatgtaaattatttaagattatttattga

SEQ ID NO: 7050 - DNA, 204 bp, Candida albicans
tccaatattctcatttcaagtttcaccccctttctccaaattttagaaccaatacaacaactgaaaggaaatgagattccaatatttgcagtcaatcaccaactaatactaatttactctcttcccttctcctcatcattttgttcctactgtatttcacatttaaatgaagttattggcggtgccttttgcgaaaggtcttaa

SEQ ID NO: 7051 - DNA, 258 bp, Candida albicans
agattgggtgagagtgaaaaaaaaaaaaaattttgtcgccagaaatttcgcgcgatggagaaccgttttttttttttccgtctacttacaaagcgactaaaattgttttataatccggattctgttacaacctcgaaactgaacaattcatttattatttggagaaataaattgagctcaattgctattcccactaccttactaatgggaaaagaatgttttgaacggtttaaaggttttgatgaaatacttgtttaa

SEQ ID NO: 7052 - DNA, 489 bp, Candida albicans
aaacaatatgaggatgaagctgcagttcatcgaatgattacttataaattaccctcgattctatttgtacattgtaatcatccgaaaattgaccctctcaagaattctaaagaggctgatgcagaatttggagtatattcaagaagaaatatgggattacctgataaagtggaaaagttattagaaggtaaagattgggaattaagatttcataccatatctcaatgggttgcatgtgaagccattagtaaatcttcattatattgggaaaaaattgctgggaaatcacaacaacaagtttgtgaatcagttggtaaatatattgaatttttgaaaaaagatacttttgataatgaagcaacaaaattgacaatattaaatcaactaggggaaaaactgcaaccaaaacaaccagaaatcaacaacaacaacaacaataataataatgatgatgataatggtaagaacaaacaaggtgctgcatcataa

SEQ ID NO: 7053 - DNA, 432 bp, Candida albicans
  unsure (400),(401): Identity of nucleotide sequences at the above locations are unknown.
gaaatacgagaatcaagaggtcgaacaaaaaaactacgagcaagcaagaagggaaaaaaagcagaagaccaagaaaacaaagagaggggagcaagagccaaagaaaaggaaatcagaggaaacacaagcaagcaagaggcagcaaaggaaggtcaaacacaaaaagagaaaaaaatcatcgaaaaaggagcaaaagaaaaagcgaaagcagaagaagcaggagaaaccgagacaccaaagatcgaagcagcagaaaacaaacatcaagaaagagaaaaagagaaacaagaaaaagaagcagatccaacaataatcaaaaaagaaggattcaccgcaaaaactaagataaataaagaacatgaaggagaagaaggatacgatgggatcattgttttcaccnngccggaatggaccggaaacgcggggataggg

SEQ ID NO: 7054 - DNA, 759 bp, Candida albicans
aacttaggcggattggcagtccgtggtgaagacttaatgtaccagagatttatcgaagaaaactattcaagtttgttgcaatctttcatcaatgatcccaatgatttaatttttgatcctattgacgacttgctagctgttaggattactgataagcaagtcaacatttattgtccacgatgtcaaaaaccattaacgtttcaactggtgccactaacgacaacactggaaactggatttgctgatccaggatttgaagcatattcgatagaagacattgacgagcaaatcagaaacaacccacatttccaggtagaatgcatttgcttgcttacgccagtttggaatcatgaccaattgagaaaacttcaattataccatgatgttcatggtgatactgagttgtcacatgcgtataagtatttttcttcaatcatttcaagggtaatttctattagacgtagtccttaccttgccagttccagtgttaaatcttatgtgaaaaatagatggaataacttgcagcttaacttgtataaggaaatgctgttggtaaatttgatcaaactggtttcatcattacccgatgaagaaaagagacttaaaaatcttttgttaagaagttatcttcaattcaatttgatatattttacagttcgtgggggtattgaaattggtgaagatttggggtgccgtgtggtgcaatttcaccttttcgaatcattcatttactcttatacttttcctgaatcccataat

SEQ ID NO: 7055 - DNA, 723 bp, Candida albicans
agactatataaatcaagtcaagattcccattttcccttcttttgtttcgatttgacttttttttttgtctttacttcttttattagctgttcagttgttaccctcctacctaccctccatctcaaagttatatcttccctcctactactacttcccaatatgagtacaacatttagatattctgctgcttctgatttccatcaaccattaggttctaacaagaataatgtctttgaaagaaataattcaactgtttcttctactaattcattgatgtcaaacaattccgatactaatactgctgctactgctgctactagtggatccactactaataatgtcaaacgtatgcattcatctttgattagtaaatataatagtaatcgttccacaatttttacaaatgatactgattcaatatctagttccatgtcgtatgataacaattccacacttgctagctcagtatcacccaattctccagcaaatcatcattcaggcaaacatcaacaccaattaccttcttatatgatgaataaatctcctcaatatattcatcaatcaacatctcgtcatagtaatcttaaccatactaataatcttcttcacaatactcatagtaatcatagtcaacatagtcaacatcaacatattttaaatgaagatttagtcacattgaatagttctattacttacagccgggacgaggatcaaaccttgcgt

SEQ ID NO: 7056 - DNA, 438 bp, Candida albicans
gaaaatgactcagaattattttttttttcctccacaagtgataagtttttttttttttttttttcattttctttcaacgcttcctaccaccaaccagacatgatattccctattttgcctgttatatcttctccagaagataagcaatctattgacgagttttccttagttggtcaagtacttttcccaattgaaagtgttagtcccaagaaacattttattcatcaatttcctcatgacttggatatttttgtaaatgctattgataatgccaccaccgaccaaattgtcgagttgttgaatgtgggaattaagcaggtgtctgtcaatgagaagcaataccatgacgccattgaagctggtttaccaagctctaggtttgttgtaacagtcgatgttccaagtactgaattatggacatctgaagcatcctttgtt

SEQ ID NO: 7057 - DNA, 213 bp, Candida albicans
accaaaccaaaaagaagagaaaaaaaattgttcgtcgacaaaaaaaaggatataaagaaaaaaggaatagagtcaatcttgaaattgtcagagtcgaagtcacttaataattcaatagaatgtcattttttgggtttgatccagcagctcctcctcaaggagccaataaaaaagatgatgcttacgactttgaaaatacttatgatgggttag

SEQ ID NO: 7058 - DNA, 198 bp, Candida albicans
aatatcaactacagaatgctgtctaacaccttcaagtgtttcatttattcgagtacgttatatttgatggtcatctttgagcaggcaaatttagtaattccactgattgtctctatctatcttaaaaacaaacccaaacattgttcaaattcattgacatcattgaccaatcaaaggatttaccaagctaatcaatga

SEQ ID NO: 7059 - DNA, 186 bp, Candida albicans
ttcactcttcgacaaaaggttgtttccaaacttgtcaaaaaaaaaaagttatcttatcaaagagtcaacgtcattcagttgtcaattgactggtctaatttttcaaaccaagttttaccatacattgcatatcaatgcgctttagtcttcacacacgccgctggaaggagccacgctcgcgcccac

SEQ ID NO: 7060 - DNA, 426 bp, Candida albicans
tattgtaagcaagagatggtggtggtttttatttttttttttcacacttacatccactatttttttggagacttgttttcttctctattgagttgtcaagttatggaagttcaacaacaaatcgacgagttgacgacgatttatcatgaatatcgatcattcttcccaaagtgtgatttgattgtgacaccagatgctctgtccagttccaactatattctattaactacacatgaaggtcgaagtatcaaagtttctgttgctctccgaggttggtacgaattaactacaactacccaaagccagaatgttgaaaaaccatttgaaacatttgaagcattgatgcaatccattagtatagattttcaaaatcgttttggaaacgaactttccaataaattaaatcaattactacaacaaaaataa

SEQ ID NO: 7061 - DNA, 258 bp, Candida albicans
tactcaataaactccggagatcatggaagtgccagcgccttaaaaaaaatatgcacacaattcgcatcaaaaattatcaccaccaacacacacacatttaaatgttcaaccatcatttcaatacatcaacaagatccatttattgtgatttttacaaagatgaatttggaagataagaatagaatagaatataaaaaagagaagaaacagcaaattctgaattgttttgtttactgtttttgtgttagtcacggctag

SEQ ID NO: 7062 - DNA, 873 bp, Candida albicans
aaaaaatcgattgaaagattcattgggaaattaatcttcttttatgacgtctacgttgcagctgtgttttgcttacttttaggttgtactattgtgagtggcatttactttaacaatgatagtctgttccccattagcatatttatattatatctttgttccattatcatttccgttgtatcattcatgtgtacaagatatttccgtctgcgtggtggatttactaacaattatcaagtggaagaatacgatttgctttccctaacaacccatcaaaagcaaggatgggggaaacttatatatatcaatcgtaaatacaacggagggatctctggtgactatgtaatttcattaatggaaaattatgcgaatgccaaactatcaggaatgacatgtaaagtgttacgagtctttaaaaaacacgaaataactcctaacccgtcaacgtcactgctaaaaaaatcaaaacagcaacacaaaaagaatatgaatactgcatttgaagatttggatcctgaatctctattattccaagaatcaccaggttcacaaagctatgagtcacccatcaagcatttagaagatgaatatcgaccattatcgaaaaatcaattgaaacgattagccaagaagaatcaaaaggataaaaaactattagaattgaaatctttggaaaataataccgaaattttttatcaagaattaatgaatactgaagcattgatattactcaccattgtggaagaatttgatcttagtgaaagaatccccggttggattggtaaaaaattgaataaatggtttgggaaaaattccaaatttcctattttatgtattcgatttggattattaggattccattggccatttaaa

SEQ ID NO: 7063 - DNA, 246 bp, Candida albicans
tttgcggactttccatggcccgtggtgaagatatttgcttcaattaatttcataaatattttgattgctatcagtcttgtacaaattaatattagttatttcaatgtcactagtggatcagtaaagaaaatacataattggttcattataactggatcattcatgacgggacaatctgccattggattaagtattgtcttgttgattaatgaaaaaaatcgattgaaagattcattgggaaattaa

SEQ ID NO: 7064 - DNA, 333 bp, Candida albicans
aagaaacatacaaaacagaaagaagcaaaaaagaaaagaaaagaagaagagcaagcatcaaagcaacagaaagagaaaagaaaagaaaaggacagggacaaatcacaagaagatctcaggaatctcgaaatcacaaagcaaaaatcaaagacaaaaaaagcagacagtcaggcattctcaaaatctcaaaaccaaacagaacagaaagccaaaagaagaaaaagcgaacgaaggcaaaagaaaaatctctcagcggcaaatctccgacaaagacaagccaagaaaaagtcaaatcagaagataaatcagaaaagattaaaccataacagatag

SEQ ID NO: 7065 - DNA, 183 bp, Candida albicans
tatactaagaatatcacatttgaaatattcttgtattgtttctcctgtgtgaatattttttttttttcaaaacttttctcggagtctcaggtaaatggatcacacggaattacttctcagtcgataagggagaaaggaagaaagaaagatttgtatccttattataattttccagagatttat

SEQ ID NO: 7066 - DNA, 1005 bp, Candida albicans
  unsure (895): Identity of nucleotide sequences at the above locations are unknown.
taccatttacagatgatcgcacaatgttacactttgtttaatgatgacagtattataacccaattggccaactttaatctgtcagtatcggaaaaagattttgatttctcggggctttgcaactcaatccataataatgttgttgatttaaatgattattcaaataagttaattcgatcattcaccaaacatgcgaaaaataccactcgaccgtttaactcattggatactgctctcaacacattgtttgagaccaagaattttactttagttagaattactcgttcgactactgatgatgttcatggcagctctattttaaagttggaaactgcaactccgggtgatttcaatttaatcgacgatgaagaaaatggagatgaaatgttgcatagtctcggcaaagaaagtgaagtacccaataatttgtttttcaagaaaattattgccagaccaaggtataagtccaatatgaaaatctattttatccccgaggtggcaaattattcattatataccgatgaaagaatgcttgaacgggacttgtacaacggaatcattcaattagaatttgaaaataatgatttgaatgatctaaatgttaaacgatctaatgggtattcgagaaatgttttctgttctttttgttatgatcaagtgttaagagattataagagatcgttatttgagagtgatgttgctgaagtgtctccatccaacgttcaatttatagcaccattggccaatccacctctgcagttgcaacctggagctgttctggtaccacctgcattacctgctgcaaatgcccttttctcaacagcgcccaaactacagcaatcaccatttactcaaagagcacaatcgatagacgacacgatgatggtttcttacnatgaacaacaatatccaccttaccgtccaagcattcctttgaatagaaagccaagttttacaatggccagaccaacaccagcatttatcccacaacctcaatccctttaa

SEQ ID NO: 7067 - DNA, 441 bp, Candida albicans
acccaagttatgactggtctatcaaatttattgaattcggaagatttactgaatgctcctttgaaaacaattgagcagtcttcggatcaagatagcactaaaggcacaatcactcctacacgtacattatcatcacaatcgtcaccacaattacctttaatgtcggagtctgaaaaatctatactgtcaaagaatagttatagacctttggtaaggttaagacatcgacttcctaaatcaaaagttaacaaaaagatacttgcctccaaaagatttgtcaaactatcgattagaagaaaatattctaccaagaaaacgaaaactgataccaaacagtctaaactacatataaaatctttaaaagctggcattaaagtgaaaatgactttatcgaaaaacttattttccttgttaccattgcttgataccatttacagatga

SEQ ID NO: 7068 - DNA, 357 bp, Candida albicans
ttcaccatgccgttagctcataatttaaataaagtaacgaaaaatatatccaaatcaactggatcccttcatatcaaaggtcgtaaattcaaacaattaaatcgtgccacattaagagataaaaagcttcaacaaagaaaatcccaaagtttagaacgtaaatcaaatgaattaagtattgtatttttcattcagagtttactacaagaaaaaaataccgctaatgatggcggtgatgaagatgcagaagaaggagaaaactttaaggaattctcgaataagaaacaatttacattagatgaaatgagaccaatcattgaaaagtttattcatcttcagccccggcgctggaaataa

SEQ ID NO: 7069 - DNA, 189 bp, Candida albicans
gatgaggttgagaagttagacagagagagacaaagagagagaagtggtcgtgtactaatggtagtagtagtagtcgtgcagaaaaaccgaaataatataggaaaaaaggggaacgatgatgacacaccctgtcataaatatacaattatacaacagtacaatcaacgtaaatattgccaaacatactaa

SEQ ID NO: 7070 - DNA, 198 bp, Candida albicans
  unsure (162): Identity of nucleotide sequences at the above locations are unknown.
aaagccaattctttagaaattgacaaaccaagattatatagaagaagtgaatttaatataaatttttattatttattatactatacaaccttttttttaataatccaagttttatttagaattgctataattgttgaagtctcgattattgaaatgcatttnttaaaccgccgggatagaaggaccgaagggtgcggt

SEQ ID NO: 7071 - DNA, 198 bp, Candida albicans
aaacaaataagcctatcaaccaaacaaactttatccatcaacaacacccattcacacagtcataaacatacacatgcaacacactctcaacccatacattcaacaaatccccccctctcacaatcacttaaatccaattatcaagttactcaagcagtacattcctttgagatatggccagactttccacagttgtaa

SEQ ID NO: 7072 - DNA, 906 bp, Candida albicans
tgtggtgggggtattcttaaggggaaattgaatttggggaattttggggatttaagatcagttattgaaaaatataattatttccagttccaagttatgcttattttttatcaactattacaagaaggacatttttatgccaaagatgaatttgcaattgtcgggaaaaaatcgaatgcctcgtctcatttggctcatggacatgcgaaattatttagcgccattcaggattcctataagaaagttggcaaatatgaatcagagaaaagaatgaaagttttgagaaacagaattgccattcatggtgctggtaaccgaatgactttaggagggattgacgaagtggcaaagtttatgtccaaacattttaccccactattggaggatgcaaacttgggtattcaaactattattgaatggttagaggctgccaatgagtttcgaatctatgcatggctaccaggaaaatggagtatgcatgtactgaagcaaaaggagatcaatggaaaagtcttcaaagctagaactaccttaaaggatctgttgtgcaagtttgaagatgttgagacaatgaagaagatgatggtggattcaactagaagtgaaaatgaaatgctttttttaattagtcaaggtgttttatttttgcaaatagccaagcatcagtgtgagaatattttgaaaatactagacttgtgtttggacttggatgaaagaagaccagaacccaagtttataacttttttcacgaaaaatcggtactccaagccaaggcatttatcaagcgatatggataaaccaatgcccgattatctatctagtgatatccaagaaagggatgctgacaatttgccaccagcaaatgccatgcatttatctgctcaccaggcggaagagatcaacgtc

SEQ ID NO: 7073 - DNA, 216 bp, Candida albicans
tttgagcgttattggaggtttgttttcaattatactttatacagcagtgtaaaaagaatattaaaatttagagtcatgttaaagtacaaggggcaaaaattacaacaaagcacttcaatagcgcggttgcaagaatggtttagtggtaaaatccaacgttgccatcgttgggccccgggttcgattcccggttcttgcattttttgtttgtcctaa

SEQ ID NO: 7074 - DNA, 183 bp, Candida albicans
aagaagaagttgttggatgagtacaaggaaagaaacaacgacaacaacaagaagattttgttttgtttatactacttcttcctccaacgcgtaaattttatttcaatttttattagtcaaaaaaaaggtagtgtagaattgctaaaatcagtttttgtacaaggtcggcaacatcggttgtaa

SEQ ID NO: 7075 - DNA, 213 bp, Candida albicans
cagtatatatatggaagtcataagaatggtcaattatacccagaagagtcatatacaaatgaacaaacacagttactacgaattgtggactgtgtgcttcatggattgtgctccaattgtcagaaaattttgaagcttttttttacaaccgatgttgccgaccttgtacaaaaactgattttagcaattctacactaccttttttttgactaa

SEQ ID NO: 7076 - DNA, 291 bp, Candida albicans
acacatacgcaacatcttagaatgccaccaaagtcattaaagttgatcaaaaagggtttaaatcctcctgttcaagataacaagacttttaactcattatttaaagaagccttgaactcaccagagcattttctatgcaataatctatccaatttcaaactcccttcagatattgatttctttattggttttattgaaacaaagcaatttgagacatggctcgatattattagtcgtcaaaataattggacgagaaataagtctccaccacgggctggaaggtccgcgatt

SEQ ID NO: 7077 - DNA, 816 bp, Candida albicans
aaaatatgcccccaggcaacaattcatctcatcagaatcccagttctggtcgaagaaaggtcagctgttactagtgctgatggtcctgaataccctcaccaccaacaccaacagagtatcaatgcgtcaacagttcccgtgccacttccaccaccaacaccaccggtaagcatgccacaacatgtatctaggtctccacgtagccatcaactgcaccaaccaccaacattaccaccactgcattcacatcatgttcaacaaccatctagagatcggtcaccattagcgacacgaatctacccttatagcaatagtgttggcggacaaatttctactacgtcagtgggttctattcctagtcaaataccacttggtcgacagactcatgggaaacaaccttctatttcaagtgtaatttctggagatagtattgcagcagttggtttaggagaacaagagaatgttttacccccatccactggacaaacagggaaaacagctacaagtgaagtgaatagaaatgaggaaggttatggatttgggggtcactatcatcatgatcaacctgaaactataactgaatctccagaattaagaggcttacaacaaccacagtccagtgaagcagaaattagtaaagacatttcaaatgatgtagcattggatagtgctaagataccagaagcttcacaggaaccagaagaagaaacggacgaatcaggtaatgtggcagctgctccaccacctccaccagttgctccagttgcacctcctagaaaaacaaaatcttctagatctaatccatatgctccatct

SEQ ID NO: 7078 - DNA, 288 bp, Candida albicans
aatttgatttcatccagtgaagattgtaatgatagaaatagtagatattttaatactaataataataatgatattccagttaataatccaagtaaaatcttggatgattttggtaatttatgtcctcttaaaatactcataatctataatgtctcaaccctcttcccaaaaaacaaaaataaaaaagaaatttgcgaattaattgaaaaattagtagacttggtagatttggtatgttttatagaaattgaattagtatcttctgttattgtagttgttattgtttaa

SEQ ID NO: 7079 - DNA, 234 bp, Candida albicans
  unsure (175): Identity of nucleotide sequences at the above locations are unknown.
acagaacaagttaaatggtatggtctgtctcttttggaattgaacaatacctcaaatccagcagcatcagagtacattctggaaaaattgaaagatgtcgattttgtcatcatttccaagcacgttgcaggtctaacatcattaaaatactctttaaaatcagggttattttccnatagtaacacacgtatttcatgtccaacagctgctacggacatatgtcggcccggataa

SEQ ID NO: 7080 - DNA, 738 bp, Candida albicans
gaaaataaccctgattttaaagagtattttaatgatgttagacctgcaacgtgcttggaaatgatgacaaaatcgacatctttcaatttttccagaatgtactctgatgctgctggatttgaggtattgttcaattccaaaagagacagaccataccatttaacttgttctgttcaacttttgaaagtcttttttgcatcgagagttgaattgcctactggtcaagttgacaacaacaccgacgaaatattaaatgttcctaattttgcattgacgtacaagacaaacatactaaaccaagtagtaagggcaagaggtttcaagaattgtgtggtggaaatatatttttctgccagtactccaatacttgatttagatactcgtcaattaagttctttgctttataatttggtgttattgaaaaaatggaagaccatcaaaaagctcgagaaattgctcgagaaaacacctacgtcatcttctgatttacaagatgatgattttgatggtagtgagacatcaaatttaaagattcatcctggcaccccacatcataaggaaaagattaatgcgagaatatggagatacttaacagattattacccacatttggatatcaagacagtggttgagcaaccacgattagtccttcgacattgtgaacctaagaaaaatacccagatcttaacattttcgtattctttgtcttcaccacgggactggcaggatcggcgctag

SEQ ID NO: 7081 - DNA, 228 bp, Candida albicans
  unsure (36),(37),(78),(86): Identity of nucleotide sequences at the above locations are unknown.
tacttggtgttaccatttgttggacttatcaaagcnnaggagtccaatttttacaaagtagcatcagtcaaattattnacaaactntagactccactctattttatcgttctcctttgttttcattttatttttgcaatatatttttttttttttcaccatttcattcaacactagcataattacaccacatattacttcctttttagttttagctcaacttgattaa

SEQ ID NO: 7082 - DNA, 192 bp, Candida albicans
  unsure (127): Identity of nucleotide sequences at the above locations are unknown.
ggccaaaaatttaaagaggagccaagagagccaaaggaagccaaaaaaggaaccaaaaaattaggacaggacgggaaaaaaacaaaggattccaaaaaaaccaacaaaattattaaacttaaacganaaccaaattcggcaacccaacttgttgaaaagtttgttcttattcaaccaatgacacatttgtga

SEQ ID NO: 7083 - DNA, 348 bp, Candida albicans
ttgataaattttcaatatagccaatcacttagctttcatttatattcatattattttgtacttcccaacctagtccaattatctaaaatgagtccaattgccatacttgataattatggtaatatccaaaatgaattagcaacaataataccaatcccgaagaaaattactatgctatcagatgaaataattggcaagattttagattatgttaatcaaatagatattatcaatttatcttctacaaataaatcatttagtagaatttttcaacggaaattaatggaaaatatttatgtatgtgatactcctaataataattttgaccacagcctgaaaaaccgcatc

SEQ ID NO: 7084 - DNA, 240 bp, Candida albicans
aaccatacaactaaccctaatatagccattcaattaaaaaacatgtcaagaactaataataaaaacccaatagatcaaaattggcaaaataatgattatgaaattaaagaacaagatcgatttctacccattgccaatggtatgtataaattgtacccccgtttttaccattattatatgttttgttttgttttattttattttattttactaacttatcttgttctcctttacatgtga

SEQ ID NO: 7085 - DNA, 186 bp, Candida albicans
attttacaagaaattctaaactttattacagaaaagtttttagattttaattattgcaacattagttccagatattgtttgttctcattgaaaattaacaactccagactagaaatcagctctactcaagctgttgagcacagaacagtatttgtaatccaagaattttgttggtgtttcgtttaa

SEQ ID NO: 7086 - DNA, 303 bp, Candida albicans
  unsure (217): Identity of nucleotide sequences at the above locations are unknown.
ttaattaaagctcgaatgtttaataattgtactagtatactgttacgtcgaatagtaatattggggacaatatcaacgttagttgatgatccaagggaagaattacttaaagataatgcggatattgtagaatgtggagatgaagacagtgaagatgagcttgatgatttggatgtcccagatgatgtttgtcccgctgatgaaaatgatgaaaaanaaattgttgttgttcctgttgctgatctttgccaattgaatttcctaaaatctcttggtgttaaattatatcgttttataaattga

SEQ ID NO: 7087 - DNA, 255 bp, Candida albicans
tacttaagttgcggtccttcgccgcgcctgtgtgtgaagacgtcgttacaagtatttgaaaaggatgttataaacgatgggaaccaaaagagctcgctttcgtttcccaatgttagatcagctggaacaaataccgatttgaaacttgttgattatcgtacaattttggaagagaacgatctcagtgaaattgacgatgatgagattgaatctgttcaaaatcaaaaagagttagagaaatttttgcaagactag

SEQ ID NO: 7088 - DNA, 186 bp, Candida albicans
ataaatgcacgatgtagtttatttacaggacaagtaagaaatatgtgggcatacccgaacaatgacatttctagtcatcatcatcaacaagagaatgattttgtcctcattccatcaccaacacaatatgagtcttcctcatctcaacacacacacacacccagaaatctacctagacaatactaa

SEQ ID NO: 7089 - DNA, 537 bp, Candida albicans
gtaaattgggaaaatctttcttcaatgaatattggagggttacatcatcaaagtagttttagtagtacgaaatcagtgattagaaataagttggcattaggtaatcgtccatcattattgaaatatgattctcacaccagtggtaatactagaaataaaaagcaacgtcaaaaacgaaatgaagtgggaaataattctgatgataatgatgatgatgaatattatcaattgctgagaaaacaaagtggatatattactgattctgaaaatgaaggttatgaattgaattctataaataatgaagacgaagaagaagaagaagacgaagaagaagaagaagaaggctatgatcaagatgatcaagatgatgatgacgaagaacaattttatcaatttagaagaggacaaagaactgtaccggaaattactataaatcaaaaacttaatcaacaacaacaagatgaaagaagatcaagtaatgctgatagcatcaaacatttatctcctacaagcagtatcaaaaggtatttcaattaa

SEQ ID NO: 7090 - DNA, 183 bp, Candida albicans
ttggttcgttttacccgtgattcttttttcaacttcattttaacagaaaagaaaagaagagagaaaaaaaaatttattaaaaaaaacaaaacaaaacaaactcagaaaaaaaaaatagagattaagcatacaactcatttatcattacaatccatcttcaccaggcggtggaaggaaccaaac

SEQ ID NO: 7091 - DNA, 798 bp, Candida albicans
atcatgatcctacgatctactgcaagcgggaagagattacccaaaatatattatcaactgtattttctttctacaaagccccagtctaatacagaatcatttgccaaatatggaatattaccgtactttcagtcaaaattgaatctgtggttgaatcctggctctcaagtcaaaacaccaccgacagaaatacaaacatttattttgcagaatttgttattgaataaaaaaaatgtaattgtcaatcaatctaacaagcctgggaaatcattggggttactattacatgctttgaatctatcgttgaccaaacggccctggtatctggttgagtcgtgtcggattccccagaaaccagcaaggtcgttggattcagtaatacttgttcccacggatgagatggttagcaagtatcacaaatactgtgagaaattaatctcaccaatggagaggaactgtgtcccagttgaggttttcaagaccaatgggtcattacatattacaagagacccattgacagtgaaatttctatcgaggaaaaaactaccggaaattactaccgattccctggattcaaagttagatacagcaaaccactctcaggtgacggtcactaccttatcaggactactcgatactattcagaatgatcctgatcaatttaaatttttgaggttttttgctatagatcaactagattatttcatgaaaagtgttgatctaaacggatttctggtggtgagtcaacatgtcttcaccacggggctggaagcaccgcgattgcgtataaccgcacgg

SEQ ID NO: 7092 - DNA, 228 bp, Candida albicans
ttgagtgaactcttctctgtggacaggacgcggtattttgtatgcgtcttcgagagaatctggttgtatacacatctcatatactttattcccagagagaagaataaccctaacaaacaacaagtggagagtttatcatccaatatttcggaaaatgaagttgaaattgatgacaaaaagttccgaaaagttgaaggagactttaagtttgatatcgcatgtgcgtaa

SEQ ID NO: 7093 - DNA, 231 bp, Candida albicans
agaattcaaaaatatatgggattgaacattcattacagtgctgttagtttaattgtgttgtttcaagaaagtatcaaaaagtatttcataaaattatcatatcttgaacccacaaaactgcaattgagaaatgatagaattgtaataaacatatctaatacccgtttcaatattatcttgcccattgatatttcaggatttaatactaacagaaactctttttttttatag

SEQ ID NO: 7094 - DNA, 210 bp, Candida albicans
tttcacagttgtttacatttcttacccaatccaccagcaaatatgccaccacaacagttaccacctactgatatccaatctattcgtaatgccgcccatgctttgaactcaacattattatcacgtacttatattgatgaaaatcttcaatttaattgtataaactggaagacattgattagtgatcaacttgaagtcaccccaaattag

SEQ ID NO: 7095 - DNA, 201 bp, Candida albicans
ccaagcctaactctctattactacactaaaaaaaagaacaaacgacacgtcattagagatgagcataatacccctagtttatttttattgttcatcactcgtaataacaacaataataatattatagactataaaaaaaatgacatggcaagctttggtgtggtagttcttcttataatagtttgtataataaacacctga

SEQ ID NO: 7096 - DNA, 342 bp, Candida albicans
attctttttttttgtactatctatttacatagtctctttgtaaagtgtataaaaatgtgttctgaattttttttttttaatatctataagaataagttacttctttcattagatatatctaattacgacatgtcatcacttgattatttatggacagaagattatttgaatagttttgaaattgaaaatagattcacagacacgacaataacatttataatagtttcaaaagacccatcaacatgttatgataatttaatccgtttttctcaaccatggttaaaatctattccttggacaattgatcaacctagtataactccacaatcaacccattattaa

SEQ ID NO: 7097 - DNA, 249 bp, Candida albicans
  unsure (181): Identity of nucleotide sequences at the above locations are unknown.
aggcccaagattgattattttttgggtaatttaattatccatgaatattcccccgaaatcattacttttaaatttcaattttattttcaatctcaccaattatcatccaagaatggtgtatttcctttaattgaatccaataaaccaatgaaacaaacccaattttatggctctggatttnttaacctacatgaatttccagaaaatgtattacctccgaataatccgaaactgggattcctcgaattt

SEQ ID NO: 7098 - DNA, 246 bp, Candida albicans
aagggaagggatgtaaaaaataaacagagttcttttaagaatatgacagaactcatgtgtgtgtatgtgtgggttacaacaatggtaaccatagttgtcagtcagttgtcattcattcatgctagtttgggaaatgatgacaactgcaaaaatgttgcacccaaaaaaaaaaaagaagaagaaactatacttgagaaacacgttgatgcccattcccacagtgagaccaaaagaatgacacaatag

SEQ ID NO: 7099 - DNA, 210 bp, Candida albicans
ccaaaaaaaaagagagcaaaattatcatcagatataagagatttcattgactatttatatagacaattaaattatgaaacaagtggaaaaaaagcaaagtggaagggagaaggaggcgggggagagatagatagagagataccatatatgaaaatcattatactagttgtctcggagttaaagatgtcttctgagtggtggtggtggtag

SEQ ID NO: 7100 - DNA, 192 bp, Candida albicans
  unsure (92),(103),(105),(110),(112),(113),(114),(119): Identity of nucleotide sequences at the above locations are unknown.
gagaaaggggctgtgatgcaacacgaatctatcgaaaaaaggagaggcaaagaagtacaggaaggtacaaagaagggagaagaaaaaagggnaaacaaaaaananatcanannntccgncacccccactaccacccccactaccaccaccaccactcagaagacatctttaactccgagacaactagtataa

SEQ ID NO: 7101 - DNA, 381 bp, Candida albicans
  unsure (24),(36),(42),(48): Identity of nucleotide sequences at the above locations are unknown.
agttgggatgcaaagtatacaganacagaaccaganacaganacaganacagaaccactcgcgtgtctctttctaagtcgcccccctccttatccgatttcgcaacaattttcggaaaatgtttattgcttatattgccgcatcaacaacaaaaaaaagcaccccactaaaatggaaatatgtctaaacatacataccaactcttattgtgaaaatcaggaatacattgaaattacgccgagtctatgcatgaaaaccaaacccctctactctactaaacaaaacaaaaccttatattcttggcttggagaaagagaaagtaagtatgcatcaagtacctggagcaacaattacaatttgaaatattataaatacctgtaa

SEQ ID NO: 7102 - DNA, 291 bp, Candida albicans
  unsure (276),(280): Identity of nucleotide sequences at the above locations are unknown.
aatattataaatacctgtaagaatgtccacataataaacactttaaatggatcaattctcaaaaacaaaaactatatctttcaagaatctaaaacgctgggttatacaatcatcatgaccattgaagaatatagacccgaatcagatgaaaaaaatgtgtcgactccatccatcgtgagtttggatgataagacaactaatgcttcacatatttccaatgctgctcaagaaaatgtcgatgactatatcgccaagtttttgggaaccagccaactntctnttaacgactaa

SEQ ID NO: 7103 - DNA, 264 bp, Candida albicans
atatacattacaaaacgaaacaaaaaaataacaataataatcattgataatagaaaacttatacaaaaatacaaatgtaaaaaatccacctttttggtggcatataaaaaaacgaaaagcaaaattcaaaacattatagtacagcttttttataaagaaaaaaacaaaaacaaaaaggaagcaggtaagaaacatattaaatcatttcaatcaatcacgttccattctggtttatttttgacccttcttcttttcaacttttaa

SEQ ID NO: 7104 - DNA, 327 bp, Candida albicans
actataattggcatggccatgccccatggtgaagactggttgggggaaaataaaataaaagtaaaaccattgaatgacaacaaagcaattgaacaaggtgcaactttcatatcggaatttttcatattcagtgttgctggttctctaattttctatgaaagttatagaagtcgaaagaaggcaactagtgagagagatgcattggctgatgatataacactattgcaaagtgaaatggaaaagataaagaacaagttggaggatattaatgttaagttagttgattataaagtttcagaatctccctcggaaaccgccactaaatag

SEQ ID NO: 7105 - DNA, 777 bp, Candida albicans
agaataacttggatccggcacgtccgtggtgaagacgtcatgagtgtgatattatatttatgtgatcaatcagaagcaacaacaacaacaaccaattctgatgtagatgtatttaaattttatttcccaggaatgattaatttagcatcaatttattattataatttcaaaaacacttacaaaagttttgtttcaatgtgtcaattttataatttacgtttacctagtatgatgataacttatttgaattgtcctaatgttgaacttcaatcaattttaaaatcttcattaaacagttatatgatttataaatttgaaaaaattttaaaatttaaattaaatcgtatttctgttcattttaaaattcataatattaattcatttgattatttacctcaattaatattaagtttaggattaaatttatttaattttgaaattagtcaaagaattattgatttaatattatttgatccaaattatgatgaaattataattaatttgattattaattatatgatgaaaattcaacataaattatttggtaataaacaagaaattttatccgccctattaggtggtgggggtataaatagctcaaatggaacaacaacaactactactactactaatgctaattcatcaccttcaagttctggtaatggctcgagttctactgtcaaccctaagtatatcactggtctgaatacttatcgatatgttaatgttggttatgaaattgaattccttaattcattaagagaattatgtaaataa

SEQ ID NO: 7106 - DNA, 375 bp, Candida albicans
cattcgacaaagatgatttatctatatgatattttggataaatgtccacatttgagccatttgtatcttaacgacatggatattgatcaacaagcaatggtacaaataaataaggatttagagaggatatcgtgccatctccaaatgttggatcttagttttaataaaatcgacggtgttagtttaatcagaatgtttgagaaatgtcttattgtaaatcctatagaacagatggttttacacggaatggatatttcaacagatactatacagtatttgattcgcaagaagtatgtgaatagtgtttctatggatacagcaagattaaaatggcaggcatttggggttaatagttgggtgcaagaaaggtcgtag

SEQ ID NO: 7107 - DNA, 771 bp, Candida albicans
aattgtaattttgtatggcgatgcgacatttatagtgaaaaaaaaaaattaaaaaaattacttttgggatgccccaatacccatctctttccaccaacattgaaacgccaaatggtattaactcgaagtcagacacattataagcaacctataaagaaaaaatttactgatgacgacttcagcgatgaagaaaaggtgagcccactgttaccagtacaaccagaggatgactatctgtctgaagaagaagaagaagacgatgacgatgacgatgactctgatgatgccccagaagaggaaagtacaagcaaagctagaagtgacattttatcagagcagaagaggttacaacaggttgaagccgaattaaagaaacaagaaagggagaaaaggaaagcattggatttgcgtaatacacaacaacagcagatgaaaaagagcaaacaaaaaagtaacccatcaacagcgccaattgagcttcctgagtttttacccgatgatattgcatcaataattaatcagccagttgaggaactgaaaccaaggcatataaggttggatgaaatagaggcgtcgccaaaactagataaaaagtcattacttgaagaaaaattgcgactcttgaaggcaaagaagaaagttgctataaagaaagggcctgttcatgttaaaatacaatcgttcaacagtaaagtagtgccacggtctgaatcaaagattgtcaagaatagagataaatggttacataggaaaagcgtcaatagaaagtga

SEQ ID NO: 7108 - DNA, 240 bp, Candida albicans
cttggttcttcagccgcggtgaagaagaaacatatgagtatagaaaccaatgacacttttgataatttgcaaactgattttaaacttagatctcgatctgataccaccaataccacctttaataataatctgaatgattctattgattctggttcaaccattttcagtgctcgtagtcagaacactatattaaataaagataatagtagcagtaccaatggtggtggccctaatgcataa

SEQ ID NO: 7109 - DNA, 921 bp, Candida albicans
aatgtcgctcctaatccaatatcagcttcttcatcgacgggtcatagtttttctgaagcagatatatttgaacgaacttgttctaaacataattatcattatccattaataaataatcctgaaactccatcacattataatttagaaaattatacttcaccgattttagacacggcaacagaaatcttatcgaataatattccattagatcaagtgaaattgaattgttattgtgatgaaaatgaaaatgaaaatgaaatagataaacaaattgaaaatgaaaatgaacaagaagaaaatactgatcaaataagggatcaaaaacaagaaaaggaagatatactacaacctccatcaacaactactacatttattcgtccacgagctagaagtattatatcacaaactttaatatcaacattggatcataatagaaaaatgcattcatcaatgtcaagcactggatttaataataatcataatcataaccacaataacaaccacaaccacaacaatgccactgctactgctactgccatttccaattataatccactgccaccaccattacttgcgaaaagactgatgagttatgctggtcaaaccccttattctcaaagtaaaggtataggtaaagttgataaagaagataatgatcccaatacaattgattttttttcatttgctgatattataaatcatgaagaagttgaagaagaacaagaaaaaggatttattaatactagtccaacaagaagtagtaccagtagtagtagcaatagcggtggtggtagacaatttaatcaaatggtatctccatcaccatcattaacacaaccaccagtgaatgatttccatcctattagaagaggtagttgtgttgctacaattagtgctaaagattatattggaagattttag

SEQ ID NO: 7110 - DNA, 879 bp, Candida albicans
atcaccatcaaactgaaaatgactcaagttatagaagacacttatccttatttgcctgtttatgaagctgtcgcaaaagaatctgacaatgacgagtgccagccttactttgattttatcacaaccctaaaagaagcaaagcaaactgattatcaaaggtacaagtatagaattgacactgattttcccaaaatagacaaactagttttgcggagaccaacgtgtatgccaaatattcccgaagctgttgctcatttaaagttgttgaaagcgtttggtgtattgaaggaaaatgtattagggtgtggaaatgatcctgaaaagtaccaaattaaaaagtggaaggtgtttattacatgtgccgtgaggcggtttattatttttgtatctgccttgagggactgttatagtgatggatcttcgtccagagaacttccattctatgaactacaaaaagatgcaagcttcaatgaaacaatggatctgtttttgcctccgctagatgtggttatggtatggcatgcctttttattaaatccaaagacgttctatgacttgtttactagagaggagtttattgtatatgcaaagtacccatttccgttggatatacttgaatcgtgtattgacaatgaatcttttgagtatcacgtatctgatgagtacaagaccaattatactaatttattgaaaacattcactgaccaatcaaacgatttaaagtatgatgtggggactttttctatgcacgaagagttggttgtagtctattgtccacagtgtgaggtgtcattatcagagcctattccaatgacaacagatcgggaaactgggtttgccgattgccaattcagagcaaaacctctgatcaataatata

SEQ ID NO: 7111 - DNA, 477 bp, Candida albicans
agccatagtgttttagaaaaagtgaattcaacgttggaggaacttcataattatgatggaaattggcgggccaactctattgataataacgaaaatagtgaaccaacagaaactgatcctgtaagtgttgccaaaaagttcactgaaaacattgatttgaaaagacaagaagtcttggataattcaactccaattaaaccattatctagagaaggcatcgcccagtcccaaataaaatcaggtttattgcaatcaacatggtggtcatctgctaagtggagtaaattaagaaaaattgtgaaactgaagctgataagtagagaggaggcaatcaacagcacattgttgatgagcgaactagagtgcacgaataaaatggagcttcgcaaaagatacgactttttggagaaatacataaatagaaatcccaataggaccactacaaggggaaaaggtagagtaaccaaaactcgttaa

SEQ ID NO: 7112 - DNA, 1071 bp, Candida albicans
cccactgcatacttgtttacttgcctaaaaatgtataggaaacatattaggaaacaatcattagtttgtcaaattcaatcattcccatttgatttatatttatatttacatgaacttcatgcttcaattgattgggatcaatataattatatcattgctttacccttggggataatttccattacgattttttccataattcaatcaattttaaattattatcattatattaataaacgatcacaaaatatcttgtttgattctaattatattcaatatgaaaatttgaaaaataatataatttataattcatcaaaacaaccacaagaaagaaccactagctctattggtgataaggaaattgttgatgttccatttacaactactgttttatgggtattaaaatctattaattggttaattatatttattggattattcaatgccgctaaattatttacgaaaagaaaaagttatggattattatattgtaaattaaaaccaaaatcgaaaaatgttttcaaatcttcaattgaaagattatcatttataattgaaattttagcatttttattaaaatttttccaaaatgagcaagaactggaagaagaacaggaactgaatagttttaatgaatcatcaattattatggattcaactaatgaattgattgatgataatgaaatttggcatttaaatgtttgggatccttctaaattttccttgtatttatttattggtcttaatccaataaatctttatatcatctattatttaattggtgagaacaacagcaacactagttttactgatgattctaattataattttatttatccatcatatttttatttaaatatattaattttaatatgtttaatcatgattatattttataaatttattgaattttttttacaattaattaatgataaacaaattttatatcaagaaatgtttcaagaatataataaaaaatttgttaatccaaaaattaatcaattgaaaaaagatgccatgattgatgctacattgggaactcattatctgaataatttaaatgatcaaaaa

SEQ ID NO: 7113 - DNA, 285 bp, Candida albicans
gttcgacgcggatctgcaccccgtgggcaagatatccccgtattaccatttagtcgacattatatggatttcataggtgaatatttaccagcactggaaggtatgagtgattctaattccaatttagggtgtgggtctgagtctgggtgtgggttgggattgaaattacctaaatttaaagtatttgatgttcaatataaagtgacacttccaattgtatcagttctgaaagatatcaccagcatacctaagaatactgggaatttatattacaaaccaaaataa

SEQ ID NO: 7114 - DNA, 183 bp, Candida albicans
ctattccaccaaatttggcttatggtccaagaggtatcccaccaattattggtcctaatgaaactcttgttttcgaagttgaattacttggtgttaatggtcaataattatgtgtgtgaccagaccagacccactattgataaatatatgtgtaattattttatttttctagaaaatgtataa

SEQ ID NO: 7115 - DNA, 240 bp, Candida albicans
ttaccaatacaactactggttgtcgtgtcatctgataacatacacaactaccatgtagaagtcatcaattgtaaactcagctatactttatcaatatcagcgaaattttatttagttttcgttgaaaaatgcagtgaaaaaaaaaaaactacccgtcaacttgaattgtttttctcttcaactacaaattgttattatattgtgattcatttcagaggcttgatttccaactatatgtaa

SEQ ID NO: 7116 - DNA, 336 bp, Candida albicans
gtcgccggcaggtgtacccacccaccgtgcttaattttttttgtttcgtttcacgtcgccacagcttctgtccatgaaaaatataagatcgctggaaatcatgaaaatttcacagatccgttctcaaacggaaaacaaagctcaacaataattaaatatcaaccaatgacaataaaagtagcctttctaggaccagagggaacatatacccatcaagtatgtagccataccataccatacacagacttcatatttctttttcttcttggttatttactaacaatcatcctcaaggcattaatcttcaccagccggatgaaggaatatccttggaag

SEQ ID NO: 7117 - DNA, 276 bp, Candida albicans
attatccaaagtatggttaagatcatacattttcatatgataattttaaccaaattgattgcggtgagtaatgctgcaagaccattaatagttgttgtcatgtcaatatatatatatatatatactgtcgtcttacgacatttgggcatgaagggggagggggggcggggcgttccccattcgaataaacaagattttgtgttcgacgacttattagccccactggcaacccacacttttcaccacggtactgacggatcccgcgcttcacgtaat

SEQ ID NO: 7118 - DNA, 204 bp, Candida albicans
  unsure (74),(107): Identity of nucleotide sequences at the above locations are unknown.
catatgagtcacgttgatctaccgctatcatcatcgtcatccatcaaacaacgttctgaaagtgagcgaagtanaaatgccacattaaattccatagacatagcatntcattctgttgatcgaaatagaactggtcaacagcaccacgagaatgacaacacactactatcaactacttcatcaccacattcaaagctaggatag

SEQ ID NO: 7119 - DNA, 192 bp, Candida albicans
atcaggcattccgccgaaacaaaactagaaacaactaggcgctatcacaatatattgaaactaatggcgttaatgggattgctaatacattttcaaaaggatcttaattcgaataaacaattgttggattatttgggatttgttttgtattatttgtggtgtttgaaatggttgtatcttatagtgtactaa

SEQ ID NO: 7120 - DNA, 279 bp, Candida albicans
tttacacgctggtcggttaatctacctaagggtgatattgcaagtgatattcatgaatctacaatgcatatgtgttttagagtaatgtatttggaagaactagtcatacttggtattggtgtcatagtcgttacttggtttattgtgtcaattgttcgaaaatactgtgtttctgaaaattggtttagttatattaagagtaggagcttgataacattggtgattggacacattaagacttatttgaaatataccaggggattattaaatgactacaga

SEQ ID NO: 7121 - DNA, 183 bp, Candida albicans
atacttatgcgcggatccgtcgacctccgtggtgaagacagcttgttaaaaactaaagtaattttatataatttatacaatcaaacagttaaaaatgagagtagaaaagcaaaacaaaaggttaaggtggttgttgttcagtttccaataatgtttttggacacctttttcataacaaaatag

SEQ ID NO: 7122 - DNA, 258 bp, Candida albicans
  unsure (117): Identity of nucleotide sequences at the above locations are unknown.
ggaggaaggaagaatttgaggagaagaagaaagggggaagaggatggtagaaggaggtggatagagatgagaaggatgaatgaggaaaaggtaggggggtgtgtatggatgggtggnacccccccccccgccaccacgactactactactactactattactgcccactaccaccaccaccaccactaccacttgttatcaattttttgttcgacaaaaacttttttttttcaggtttttttttatcgtcggagataa

SEQ ID NO: 7123 - DNA, 690 bp, Candida albicans
ttcaagaattggaccataacgtcattcaatgaaaacaaatcagactcacaacaacaacaccaagaagaagaagaagaagaagaagataaaaaggaattaccattattgcaagggaataaaaatttacataattcagaatatggtatcatattagccaatttatcaaatttacatgaattcatcaatattcatatgaattatatggatgaaaataatcataaattaaaaactaaaaccattttcattaattgtttattaaatcatattatgatttttttgaatcatagtggaatagtttctttattgaaaaatttacattatttaaaaggttcatcaattattatcactaataattatttagattctatatcttggaaattaatccttaaatcattatctgattcaacttcgaaaaaatgtggtaaaatatattataattatttgaaaacaagacaaaatgatatagaaataactcctatgatgtattcacaattgataatgacttgtatgaatggtgatagtaacggttactttcatgatgttttattttatattatagaatattttaaacaatattctaaattatcaagtgaaattaaaggagttttagattatggtggtcaatatgatataaatgtgaaaactttattagataatataatcaattggcaaaattcaaatgaaaatatg

SEQ ID NO: 7124 - DNA, 267 bp, Candida albicans
  unsure (133),(186): Identity of nucleotide sequences at the above locations are unknown.
tatcaactcagcagcacatacactcaatactttttaatgtcccaagattcttcagatcagcgaccaccacaatctgagtcattacaaacaatatcctcagaacataccactactactactaaacattcagaanaacgtatttctgaaactaaatgggaaaatggtaaccatgtttgtcggaaaatncaacgggttcataacccatcaagcatcaaagggaaatgggtcacaaaaaaactcgttgcaaccggtttaaaggtaaataca

SEQ ID NO: 7125 - DNA, 225 bp, Candida albicans
aagggaaaaagaagaaaaaaaaaagaaagagagcgaaatttatattataatgaaagaaagaaagaaagatcaattgaaaaaaaaaaaaagtattcaatacagagagagagagatagagaaaagtactatagacaagtttataaagaattatctaacaaattaagcttattaatactactactactactactattaatatcaatattaaagttactgataacataa

SEQ ID NO: 7126 - DNA, 822 bp, Candida albicans
atcatcactaacaacaactcaacttgtcattacgatatgaagttttccactgctgctttaacattttcattacttgccattgtcaattcctctgttatcacatatggcacagagtttggagacaattatgaacataaacacgacaaatacgattgtgaaattgatacctttaattggaaatttgctttggtggttaaagaatggaaatatcacaaagacgagaagttctgtaaagacactgatttggatttagtttatgaaggtgaagatggtcaattatatcatggatgtgatggaacctatccttactccaaatgtaaacattgtaccaatgtttttgctggtggtgacgacaataaatggaaagatgacaaatgggacgataaatgcaaagataagaagtgtcacgataaatgggatgacaaatgcaaggacaagtgtgatgacaaacacaaagacgatcactgcaaagataagaaatgcgatgataaatgggataataagtgccatgacaaatgcaaggatgacgataagtgccatgataaatgcaatgacaaaaaatgtgatgacaagcaaaaacatgatcattgcaaggatgacaataaatgccatgacaaatgcaaagacaaaaaatgtgatgacaagtgtaaggatggtgatgataagtgtcacgatgattgcaaagacgatgataaatgtgatacacaccactgcaagtatccatattgtgaaattcataacactgattgcgacttgctcattaccttatgtaatggtgttctgaaagataaaaaatcttcaccaggcgtggaagaccaagtc

SEQ ID NO: 7127 - DNA, 366 bp, Candida albicans
aaactaggcaagacaaagaagtcaattcttgtcttgacaaccactttgtcaaacagtttcaagttcattacacataataaacacattaagttacacatggaaactaagattcaacgaaataatatgtgtcgtgatatatatatatgtgtgggtctatttatgtgttgctatattgttgagtgtataactataaaacactttataataattagggcgggcagaaagaggagacggataaaagggattttatctaagagtgtgcttttagcggcatttgctacaattcaaagtgtgaaaaaatctagaagcgaattcagggttgacgctagttttgaatttgaacttactacttgttatattatatag

SEQ ID NO: 7128 - DNA, 225 bp, Candida albicans
atattaaaagatgaattggttgctagacgtattggtgatttacaaagagctgtcccaacttttttaaccgaacttggtcgattagggattaaaattgggaaaaattttaaaaagtattgtattgatttaaatcatgatagtgttcaatctcaaaccggtttagtatctaatataatttatattgccaaaaaagccagaagtgaagatcaatgtaatttattgtag

SEQ ID NO: 7129 - DNA, 435 bp, Candida albicans
tttattttacatagacaagatactccattatattcagctattaaaagagcttgtgatgttaaagttgggattattaatagttgttccattttgaatacttttagtaagaagagacgtggaacagaaaattttgatgctatgacatatgcacaaatggccatgaaaattaatattaaattgggtggatataatcataaattatcgaaaaaagatagtcaaggattatttgataaaaataatgtccccattttcattacttggtgcttgatgttacttcatcacaacagggagaaatttattctgaatcagtttctattgcttctattgttggtagtgaagatggaattttcaataaattccctggatcagttcgtattcaaactggtggacaagaagttattgctgatgttaaaagtatggttttggaacgattag

SEQ ID NO: 7130 - DNA, 933 bp, Candida albicans
gacgatttgattactttttcgtattcattgtcgatgatcccaactttcaatgctgctatcgataatgctgtttctaaattagatatggaaggtattattgccactgtagattttggtattcaaagcagtgacacctcaatgggtcgtattaatactgttggtgggttggttaacagggacattccttggatattacgtaatttttggagaatttggtttgaagctgataaagtgtttttggattcttcaagaagaaactatttggaatataaatttggtaccgtcaaatctttgaattcatacaacaaggctttgggtaaaatcccctattatatttggattggttgtgataaatcaaaatcacacaccattttagaaagattgaattgtttagccactgaatccccttaccttgctccaactacaactccaatcgctaatcaacttgaagatattccaatttctaaaggtcatgaagctgctttaatcaacttgcaaaaaaatttaccttacccatcaatgtactatcaaaaggaatattggagagtctactatgatgaaatgaatccattgtatgaacaatttaaaaaccaatacatttatgctttcacttgggaagatcctcgtgaagatcataaacttttgaattttaccagtgatgatactgttttggctattacttcagctggtgataatattttgagttatgctagtttaccaacaccaccaaaaaagattcatgctgttgatcttaatccatgtcaaaaccatttattagaattgaaattggctagttttagatgtctttctcaagaacaaatttggtcaatgtttggtgaaggtaaaatcgaaaatttcaatgatcttttgattgatactttggcgccgcacatgtcttctaatgccttccaacaccggatggataatttttag

SEQ ID NO: 7131 - DNA, 591 bp, Candida albicans
  unsure (543),(550),(551),(552),(555): Identity of nucleotide sequences at the above locations are unknown.
gtgaaagaaagaaaaaagggttgtaaaagtgaatcgggaaaaaaaacctacaaatctatctcatctcaatacataattagtgatcaatttccaaattatattcaccccccaaaaactatatctttagtgtgtagttatcctgaaaagaccatgagtattgataatcaagcactgactgctttgaaaaatagtggtcaagaagttaaaaataatactaaccaaacaagtgaattatcgaaagaagaaaagttaagaaagcgtagggaacagttagaattatggaggcaaaaaaagcaacaacagcaacaagaacaagaagaggtacagaataaggccaagaaaacagaagatagtaccaacaatactagtactgaagaagttaaaaagtcccgtcaacaaagaatagaagaatggaaacgagcaagattacaaaaacaacaggcaaccaaagagaaaaccacaactattacaattaagaaaaaagttcatctgcaaacaactagaacaactcttaaacgaaatttagaatttggagatgatgangatgatnnnganaattcccataaacctgtctttaaaaaacaagtttag

SEQ ID NO: 7132 - DNA, 249 bp, Candida albicans
ttaaaaaaaactgcaaaaaaaataatgaagggtgcgagattcgaactcgcgcggtcaactgaccaacagattactctggtaaagaaggatttgaaccttcaccttaagtctgtcaccttagaccaactcggtcaaccctccaaatttgatgtcaattcaaaagtgcataaaaatcaaaagggcaaaactgaattaagaaatgagattgaaaagtgcaaggaaaccaaggctagcaagtacaagagatga

SEQ ID NO: 7133 - DNA, 216 bp, Candida albicans
agaatcattaacctatatttaaaaaacaatattagattaaaactcaaaacagacacatatatactctataatttaatttctgatttctgtatcattttttcaaaccctttaagatcagaccctgtagtacatgaaccgccacatacaacaataacaacaatatcttctggttgcaaatgtttaaaattcttgtacaacaagtcaattttgttataa

SEQ ID NO: 7134 - DNA, 192 bp, Candida albicans
  unsure (35): Identity of nucleotide sequences at the above locations are unknown.
cttaattggaaatggaacattcctttaatattaancattgaatttttaataaattttaccaccttaaatttcctaaatccctttatgggtgcccctttaaattccactggcggggttaaaaaattttccattaatcaatttgcggggggggccaaattttggaagattaataaagggggaaaaataaagggg

SEQ ID NO: 7135 - DNA, 201 bp, Candida albicans
tcgattcttctgacatttttttgtgtgtatatctacaaagacttcctaaataggaaatatctacaacaacatcctttcataagaactacaagcaagcaagaaatatataaacgtaataataatttattaaagaaaacatatacaccccacacaaaagtattaaaaagatatagatatagatatatatctataacattttaa

SEQ ID NO: 7136 - DNA, 291 bp, Candida albicans
ataaaacaaaacccacatttatcaatggattacccttcaggatcagatccatttacatcaagacaacatttattacatcatacattttcaccattaatatcaattgaagcaactcataatgttgatttaatattccaatcaataataaacaataatgataatatatcaacattacaaatcttcaaaccatatgggaataatgcgaaatattcaatcaatactaataatcaacaatttaaaattattaataatcaattgataacaaagaattatcctagggtcccccattag

SEQ ID NO: 7137 - DNA, 210 bp, Candida albicans
ccacagacgctctggcacaacagcacacacgcaatagcccccccactacaaatttggaattcgtgcagaattcctccttacgagacggaggagctggctacagccaggccatttgagtccggtccgccatctgaagaaaggaatttattggaccagtacattggtagtgccgactggagagcccggaaggaatacaacccccggaaaagt

SEQ ID NO: 7138 - DNA, 198 bp, Candida albicans
aattttgcgtgtgcgacaacgcccggaagaacaatcccaagaacgaaaagacaaccggaaactaggacaaccacaactttgaccacagacgctctggcacaacagcacacacgcaatagcccccccactacaaatttggaattcgtgcagaattcctccttacgagacggaggagctggctacagccaggccatttga

SEQ ID NO: 7139 - DNA, 186 bp, Candida albicans
gcgctcttccagcacgtggtgaagacatggtctggtttgatatatagagttatcgatgatatgattgaaaagcgttccaaaattgataagaactaccatgaagatttggcagctatagagctgaagtttatggatggaaagattgatcaaacagaatatattaatacaattctaggcgatttctag

SEQ ID NO: 7140 - DNA, 186 bp, Candida albicans
tgggatcaaattacctacaaaagtctgacttgcaattggtacttcttggaggtggtagatgtatgggtgaatcaaagtctagtgggttataaaaatattgatataaaaataccatcaatatatattaataaaagggtaatttacagagctagatgttttcaacacgccgtggaaggatccaagctc

SEQ ID NO: 7141 - DNA, 243 bp, Candida albicans
tttacattggattttttggcatgcttttgtttggcagttgtcataattattgaatttagaagatcacttgaaacactctttaatagccttcgaaaccaatatatacggataaagagcttaattaagagaataaactatcagttacccatacttaaagtatataacaaaactgtttacctctatagtcagtcctgttatatatggaaatctatacagctcaaattccaagacctagcaatatag

SEQ ID NO: 7142 - DNA, 198 bp, Candida albicans
ttttggtgttttttttttgtaccttctttggtaagacaaattactggagctccagagtttgggttcgagagaaaattttacatacataaaattggtgcaaaaataatgggatcaaattacctacaaaagtctgacttgcaattggtacttcttggaggtggtagatgtatgggtgaatcaaagtctagtgggttataa

SEQ ID NO: 7143 - DNA, 516 bp, Candida albicans
atggagatgatgatgaagttgacggatgatttacatacaattgatttcgatattgaagaattcagaaatattccaagtttacaaatgatgttacaagaattaatcccaccagctgaaagggtaagaattttacttgaagatccgagatatagtgatttgaattttgaagaaagagctcgtgaaattgccaaacggaaatatagtaatattttcaaaatcatatggtggaaaataatggggatttctaaacttgatttatatcattggggtgttcttaaactaattgaaacacatcaccatgatcatcccgaaggaacagaatcaactactgaaaataatcaaccacaagcacaacaacaacagcagcagcaacaagatcaacaacaagatcaagatgccgctgatagtgccagtaactctaggaatacacatgaagcaaggagttcacgagatatggaagaattaggtgacgtttctgaagcaacaaggacggaaacggttatgaatagggtttaa

SEQ ID NO: 7144 - DNA, 216 bp, Candida albicans
gaactctccatgtctaacatacaattcaatttatgtactactttccctggtttacttcaaacttatcatgaatccttatatgatttaataactacttatgatttatatttatcctataaaagaagacaaatgtccttattattcaatctattattttcatcagctgaattaccttcaataaacaaactagatcttccccaagggtggaaaaccgcg

SEQ ID NO: 7145 - DNA, 417 bp, Candida albicans
tttttcaatatttttacacatttgcatatatacattagattagcaccttaccacatgcatttgttcctaaggataccaccccgttttggtttatcgtcttggggtagtatacgaccaatactacttagaaggataccaaattttccacgatttaactcatcaactggatcatcattaactatacgtacattatcaccatcattattacaacgagctcaaactatacaacaagaacataaagaattaagtgaaaaattggatgataaatatattcctgatttacaaatgaaatttgataattataccaatatactatatatgtttggcaaattagaaactttaacacaagaatatattgaattaactgaaatcaccgatgatcctgatttatcttcaccacgggtgaagatccgcgtc

SEQ ID NO: 7146 - DNA, 717 bp, Candida albicans
attatgaagaaatcgaattcaaaacaattactcacaactttggacttaccaccaattatacctgcttcaataactacattagattttgatcatgctgttaatagttatcaaccaggtaattataatccagaagatttaccagataaaatacccattataaatgaatcaactggtagtttccgaagatttattagacgagcaaaatcaacaagaattaaaaagaataatgataaaagaagaatagttagtgcaccacctggaacttatattgggaaagaattacccgatattccttcaaatatgccaacaactcccataacaataatagccccaaaagacagaaccaatagaaaaccattatataccaatcctccaagaacaatttccctcattaatgaaaacataccttatccagtactcacaactccaaattataatccacatcagattaaacttgttgttgacgagcctcatctcaagttggaaccaaaattgactaatgactccgagaccaattcaattgggacagattcaatattatctaccaaaagcattgatatccctgttgcaattcatgatgatgcgaaagtaacagtaacccacaattgtaatagtagtagcagtgataatgatagtcttgtggatagtttattttccaaagaagaagagcaagaaggagttttcaccacgggctggacgaccgcattgcatagtgca

SEQ ID NO: 7147 - DNA, 186 bp, Candida albicans
gacaacttctggctatccatctttaaaactttattacttattgcagcttctaattacattcaaacagtaatttttggtatagtttctaattggagacgttgttttcctgacgagttctatgaaactataaagaactcagcaagggattgttatcgtaaaggtaatttcttttgttccaaatattga

SEQ ID NO: 7148 - DNA, 768 bp, Candida albicans
  unsure (749): Identity of nucleotide sequences at the above locations are unknown.
atcacgttctcaaggtcaacaaaaaccaaagtatatgtcgtcacccaattggttcccagaatcatattcatagaatacattcaaccagaaaaagggtcaccattgggtagagctaatgtgcaataccctatttctccagaacgtttgacagacgttcacaaatcgtcggataatttagctgatgctataaagttgccagtcttacctgctataaataaagttcctccacaagaagaacaacgccaaccacagaagtacccgcaaccacaaccacaaccacaatcgcaaccacatccataccaacaacaacaacaacaaccaaggcagcagcaattatattctccacaacaagtgcagcaacagaaatatcaccagcaacaacaacaacaacttcaacagcaacagcagcaatactatcaacaacagaaatttcagcaactgcaacaaccacaaagacctttacaacaacaacagcagcagccaccacaacaacaacattatcaaaagcagccacaacagcaaccacaacaacaacctcatagagtgccacctcctcaacaacaaccccaacaacaattatcgcaagcttatagggctgctccaccaacacaacaaaaacaaccacctcctcaacaacagctttatggacgttctcagccacaaagtttcccccagggaaccaccaaatggtcatccacaaggatcagggtttatgcaaaatcgtgggttattgtgcctcacgaccgggnctggaaggatcaaacgctg

SEQ ID NO: 7149 - DNA, 264 bp, Candida albicans
  unsure (39): Identity of nucleotide sequences at the above locations are unknown.
cccaaaggtgaatggcgaggcccatacccgaacaatggngatagtggaagggtgatgagtctctccaacgtccaagggcattgtgatgatcaggaatatcagacaggtttacaagggaaattgggtgcttttagtcaaggtgttgctacttcaagaggcgatggtggaatgataaatggatcttccagtgaatcacgttctcaaggtcaacaaaaaccaaagtatatgtcgtcacccaattggttcccagaatcatattcatag

SEQ ID NO: 7150 - DNA, 219 bp, Candida albicans
ataattaaaatagcaatagcaattccaatcggtaccgggaatactattaaaaaaggttggaacccaagggcaaaatcaattctagataaatctgttcctaacattgaagttattttacctaatggatatttatgtcttgcctcggcatttaatttaaatgatttatctaaaagtgctttagttaataccgctttggctggaagcacaagtaatcattga

SEQ ID NO: 7151 - DNA, 186 bp, Candida albicans
tatatatatgttgtatgctggaaaacttttataaaagttgcttttgaaaaaaatcaaattccaaaaaaaagtaaatttagccgtaaattatgcaaaaagatatgttccaaaaaaaaaaaaccaaaaaaaaatatggatcttgaaaagttgacaatatttatacaagttgtaaaaaaaaatctctga

SEQ ID NO: 7152 - DNA, 357 bp, Candida albicans
attgatttaaaacaacagccatatataataacaggttcccatattattacgttcaaaatgatgacatttgacaattataacactactaaagataacagtagctcaaacaacaatactactgatcatggtaataatggtcataactctcatttttatcgtcaatgttctcaagaaggtggtaacaatcaacaatctcaaagacaaccaccaccgccatcatcgcaacaagatatacacttacaacaacaacaacaatctctgcaatatccatttatgcagaatttaaacacacgagtttcacatacacttccatttcaacaatctattggtaatgtcaatcgtgcaccttctgtctaa

SEQ ID NO: 7153 - DNA, 351 bp, Candida albicans
tcgcttagcgcggatgcttcgacccctgtggtgaagacccccctaggcacaacggatgcgatcgttcttgccaaaaacgtaaaaaaagtggaaaaaaaaagttattcctcgtggcaatccttatcaaaggtcaacaattttcaaacaatgtccgaaatagaaaaagaagatagtcaacaatcatctagaaccaatgatctactgcctcaactacccaataaatggagaatatttactaaagtttctaatttcttccaatttcaattggttttaaagaaccaggctgcagttgctcgagatcatgtacgtctaaatttcccaaaaagacccatattcattattttttactaa

SEQ ID NO: 7154 - DNA, 519 bp, Candida albicans
tacacacttaatcttgctgctctgtgtattctgactataaactccccaacagtgctttgtgatgaattctattactcagatactattgacttgtgtcatattcaccaatgcttacatggattttctgttaccaattgggtcttattcaccattagttttatgatgattttgtattgtacttttatcccagaaattaaaagacacggagtcaaacatacattatctccgtcgcagttttatattagctgtataattattgacgacaatccaaaatctatagaagtaattgcaagtgaaagtgcaagtttagatgaagctaatattcacgacgaatcagaaattggtatggctccaacagtatatgctacaaataatactagtagtttagatgctaacaatgcaattgttgattctaatttagagtcttccgaagacgaaaaatcaattcaaaaaattccaattgaagctgtatatgagaaaacagatattagtaaaccatatgcttctaaaaaaaaataa

SEQ ID NO: 7155 - DNA, 183 bp, Candida albicans
ttcacaaaggttataatggaattttatatgatattgaattattatttattggtggaatatcttattttctcaggtatccaaacaatcattcttcatattacgacttattggaattactacagtagtgatttatatacaattatgcatcttttgtgggattattatgtgcagctacatttatag

SEQ ID NO: 7156 - DNA, 201 bp, Candida albicans
caatacaattatgaaatatttatgaaactatcaatgtttttgtgcctggcaatgcttcttatactttgtacctctcgtcagatcaatggcaatattactaacaacctacatatgaaaaagataaataaaacattgtacaaaaagttgatttatttggataatatatactacaaactaccaagcctgattagtacacaataa

SEQ ID NO: 7157 - DNA, 213 bp, Candida albicans
taccgagcttggctgagtatagttccaaagactttgaagagtcttcttacagtgaagaggagtacatggcaagtaacaatgtttcccgcaaacaaaatgcttatcctccaaggcaatgaagggctattggatgaaactcacactacaaagtatggagtgacaaagatctataacttttatgctaaacttattttgcttattatgtacgattga

SEQ ID NO: 7158 - DNA, 186 bp, Candida albicans
agtagtaggcaaagacttgtttataaggaatcgactagggtgaggaaatgctttataaaagcagatttgaattttttttggttttggataaaggaatgtaaaaaggttttaaagaaagtaaaatatcaaaaaggaaaattgattgatattgggaaacctggactaattaggataagagttgaatag

SEQ ID NO: 7159 - DNA, 321 bp, Candida albicans
ttaaaattcaataaaataaccattatgaaattttcatcagttgtattatctgctttattagctaatttggttgcttctgctccaattaaaacggttattgttactgctttcactactgttttggtagatagtaaaggtaacactaagatgcaaactgaagctgctactgctactgctactcttagtggtaatgctgctgctgcaaacacagatgttactcaagaatataataccccatctacaacttttactgctacttcatatagtaacaataataactgggctagtgctccaagttctgttcacacttctattgttgat

SEQ ID NO: 7160 - DNA, 429 bp, Candida albicans
aatagcactagtaattctattataggcaatcctgtaacaaagcctttagattattctatgctaataaagtgctcgtcacaattcattcgctcaagtataagaaatagaaagttaacccagacgcgaaagatctatcctattcatcaacaaatgtccaaacgtgtattcattactgattttttccgtaacaagtctgactccaataaaaaaataaaggtagtgaataaagttaaaaatgaaaatttagtctccaaagctcagactgtagttgaatctgggaaagaagttagtgatcctgtggaatatgaccaacgaaacgagaaagttcaagaaaccaccatatcttcaactcctaatgataggctacttgaatctggagggtatgctgatttctgtaaggagcaccactttgataaagttgcatggatc

SEQ ID NO: 7161 - DNA, 264 bp, Candida albicans
tttactctattagtatttgttgctattactgttgctgttgctattgttgaatgtccttatcgcattgagtttatttgcctgtacaaagaaattctcctcgaagttgattacaaaggaggatcatttttgttacacaaaacccgtccccctaaaactcgaattcttagtacttctttgtctaccttacctcgtggggggagattatcggaattggcattccttcaacatccttctcatttgtttctccaaattatagaaaggtag

SEQ ID NO: 7162 - DNA, 192 bp, Candida albicans
catttattattattattagaattcccgcctgaagagggagttagttttatttgcttagtgaacttggtcggctcaaattcctccatctacgtatctatttttttagccccttttgcactccctctcctttcccgcccctcccccctctttctttctttctttcttctccccaagaaatttagattaaattaa

SEQ ID NO: 7163 - DNA, 192 bp, Candida albicans
gaaataagtaagaactttaatcaacaattcttaaattccgaaaaatatataattcttccttattttctttttccttttcctttttcctttgcaattgatatttatttttcaatcgttatagcttcctatagattagactttttattacattttattttagaacttcacactaaatcatgtcaaaatcattaa

SEQ ID NO: 7164 - DNA, 303 bp, Candida albicans
ctccctcttcaggcgggaattctaataataataataaatgctaaaattctttttactatatctttacttgctttgtttttgtctataaagcaacctatttctgttaaatttattgtaatttttgttgaattgagggaaagaatggaaggaggaaagaagaaggggggtttaagcgagattagaaacaaccaaccaaccaaccaaccagcagtaattatccttctacttctcgttcttatcacccacttcgacactttgtccaactatcactttatcccctcattatcaattttaaccctccct

SEQ ID NO: 7165 - DNA, 222 bp, Candida albicans
gtatctccgatgactaacgctgttttcactttattgtacaatcccgactatcttgctggagcattagtattgggttcagtgttgaagaaattggtgttacgatcggaccaaaaatatccggatttgaaatttggtattctaattgataagtccaagtttacctcctaccaactaaaattgttatctagatattacgatgatttaatggatgtgtccccttaa

SEQ ID NO: 7166 - DNA, 294 bp, Candida albicans
gatggtgcgacagtgcgacatgggtgtttcggagtaagatttatattcatccaagaagaggctaacaaaggtttagcaacaacagaacatcgacttgaaactagtttggctaggaaattattaaatttggcccttcctctgcctccactttgctccatcttcctattttattcctctctctctttcccccctcctttagttgcctcgattaattattgttttcctttgtcctactttggtttttgtaactttattttttttttcttcttcctttccagtttccaattaaattag

SEQ ID NO: 7167 - DNA, 192 bp, Candida albicans
aacagtaatgaactgaataacagtaacaacagtgaaaagaaaaacaaccaccaagagaaagaaaaagtcaaggaaaatgagtcaaaatatgtgtttgaattttcggaaagtgccctgaagaacttgctcgagggatggatattaatggctaatttaattggaaactggaaaggaagaagaaaaaaaaaataa

SEQ ID NO: 7168 - DNA, 249 bp, Candida albicans
gcgttgttccttccagcccgggccgttaataccttgaatgagctatgtgtgagaggtcctaatggaagcacagttactagaatagatgaccttctacttgtttcttttcgaaaagtttttattactgaacagggaattggaagtggggatagagagacgtctcaatttttggggaatgctaaaagtgaagatcttacaggaaatggattgttgacttctactttggctgtgttgtcgagtatatcatag

SEQ ID NO: 7169 - DNA, 279 bp, Candida albicans
agcatgtcaactagtgagtttctacgttcctctccaactagggatgataatgataatgattatgatcttaagaaacctataatttctactcagacacctttacataacaagatttcttctatcccattaactaaatcatcaacatcaacatctttaaagaatcaacaacaacaacaacaacaatttacaatgggtacaccatctataactgcatcagcgtcgaaatatatcaaccaatccttaaacttgagtggatggacaccattaatttccaaaact

SEQ ID NO: 7170 - DNA, 1023 bp, Candida albicans
gatgtggaactggcaattggtgtcttggaagtgttggtagatatatcaacaagtttagagtcgcagataaaagactcaataaataacaaattaaacaaggcggttgtcaactcaatgtgtcaagatttgttaagaatcaaggataagattatacgctggataaactacattgagacgtttcccatcaatgatttgcaggtagcttcaagattcaaatggtgtcagattattaaggaaaaagcagaaaccaagtcgtggactgaaaaccatcccgtaaaacataaattgcaaaagcttttaggggatgcacattttaaaatcaattatccaaactataagaattttattgattttagcaaagacagtattaacagtcagttgacaatcatttcggtgcttgccattttttggagaattttgagtacatcgtccacagaagataataaggaagcaattcgattgttagaagatattctcctagatctgaatacagaacccagtgatgctatattatcaattagaaactttttaaagcaaggttcaattgatatgaaattaagtttatggaatattcttttactgttttaccaactgagcaattcaggtgataaactaacagtaggctttgaggagtgtgttttatttttgaatgattatttggttaatgagtacgttctattagatgaagagagcagacttgttactttgctgagaattttgggattttacggaagtagtattctgtttgttgtcactctgcttgctagtactaactggatattgatgcacccaatcaaggtccagactttgaggctattttttgagttaagtttgttgtttgaaattaatgaagaggctagctatatttcatcgctagcaacttctatcaagtcaaagtctaccaaatcatatcatcacttgactaatacattaattaaaacaatcatattgatcttagcgtcgatacagaaatctaatccacaacctccactcttcactacgagaacccgcaccggattatga

SEQ ID NO: 7171 - DNA, 288 bp, Candida albicans
caaaaaaccgtgattaatataggatataatttacaaggcttaaaagacgtgattgtttttttttttataaaatatcagcagcaacgaaagagagaacaaaaattggaatatgtgttatctagtttctgtaccatcacaccatcctttttgttcgtttcgatatcagttcataattatgtaatagtgaagcttgtccctgaattcacgtgttttagtgttgaaaaaaacaaaccaaaaaaaatggtggtggtggcggcggtgaaaattcaagaacgggaacggatataa

SEQ ID NO: 7172 - DNA, 204 bp, Candida albicans
ataatgaagctctcttcaagcttgcttttaaacagatcccaagtgccaagaactagaatgaatgatagtctttattatggatattgtaagtgctgggattactatcccgactatttggtaaccgcacgtaaatggaaaaccatcaaaaaaatcatcagccagaccacacaagagatattgactcaacaatttgatttgatttga

SEQ ID NO: 7173 - DNA, 225 bp, Candida albicans
aactcctgctgctgctgctgctgctgctactgctgcactgctagaaaaactactcagttaggaaatgaattccaacaaatgaaagtaaagttcgttataagatttactgagacacacttttactgcaattattattatctaattgatcaacgaataacacacttttttactaataatttaaacaaaaaagttatttatttatttattaaatacatctctaattaa

SEQ ID NO: 7174 - DNA, 333 bp, Candida albicans
ttctttgtctcttacataaagcatgttgtagtattatatcttgcaggaaatatcgctcaaacagtgttccaagttttgcgcagatgcgtttcccaagttaaacaatcatacacaaaaataggtagctctatcactttgcagtctaaacccacgttttacggaattataccacaaagagccattatgggattggctaagataccgtataattttaggaatgtgtcggattacggcgcggttctcatttcaagtttgtctcgcatatttgttgaacttttgaagcaagtttacaataacgattcttggtttttacataccaatcaaaagccatag

SEQ ID NO: 7175 - DNA, 258 bp, Candida albicans
ccaattaccagttccattggtatattaggtccggcatggtttcttttcagggcgtgtttggccatttttttcggtccttcaagtggtcaagatgctatttaccaagaagatcatgattttgtccaatacttgagtaacaatggatttgatatcaatatgttgggagaaggtggtgatgttcgtgaagtttgtcgtgaatcagactcacttgaaaaaggaaagagagatgatttccaagttgacaataattctctttaa

SEQ ID NO: 7176 - DNA, 201 bp, Candida albicans
ttttctctctctctgttgctgcactgggtcactaaaaatagatttgtaaacaataacgaagaaaaagcagagcataatttttacaacaacaacaacaagggtttgtcccaatttacaagaaactttggaccaaaaaaagaaaaagaaaaagaaaaagaccaagtgttgttttcccagaatgatattgtttctaaaaaataa

SEQ ID NO: 7177 - DNA, 297 bp, Candida albicans
atatatcctgtttgtcgaacatttttactattagaatttcttggtgtggtggttttctttttcgtggataaatctcttattcctaatgaagcaatattacatgaaggtgttaatgctaaattttttaacgatccagtagcaattaataattgggaggttgttattggaccaactatggcagatacattaggagcaaatttggccaatttatcagatataaatttcgataataattgtaataaatcattcaattgttcgataatatcaatgactattaaaattttatttataatttga

SEQ ID NO: 7178 - DNA, 228 bp, Candida albicans
attttagaaagtttattcatccaatttgttcaagttaaaatagtgttcaatatcgttccaacccaggaagaatacccattaaacaaatcaatttcaactttgttaacttccaacagaaacaaaaaacagtttatttatggaaaacattcattcaatagatattttattccaagtaataaacgtctttattctaaatacatttatcataaacaaaatttatatcaataa

SEQ ID NO: 7179 - DNA, 189 bp, Candida albicans
gataaccggataaatgaattgtctcttcctgtgtatctaaacccctccattattaataagaagatggagatagaaagaacgaaagaaagaaagacatttaccacaagaatcaaaaccaataaaaaagtgatattattaacaataatttgggaggttaagaaagaaagaaaaaaaaaaggtgcttgttga

SEQ ID NO: 7180 - DNA, 324 bp, Candida albicans
tattctgatgttgattcatatctcggggagattacacgtgccacttcactcaaaagacaacaaccgggccctcaggcttccaacaatattgatggtgacaagcagatagacatagctccaggagacagtactgaaaatggtattccattggattacatcaattttgataatggtaaagatgtgggatcaactataaatagtgccactggttcatttttattgaatgtagaattcgatcatagtccattaacgacaccagtgaagacgcattatactgataattctaatgatagaggaagcccttttgctgatcctgacaaataa

SEQ ID NO: 7181 - DNA, 186 bp, Candida albicans
ttgattgttttaggcgcattaacttctacttttgtattttgtattctttttgttgttttttttttcgactacatcacactacatagacacaattcgccagcactaaatagaaaaaacctctgtccagcatttacttacatgattacacttttcacaattatcgttaatgattacaggattgattag

SEQ ID NO: 7182 - DNA, 213 bp, Candida albicans
ttgggagaattcaagtgtgcaatgcagttaaacaaagggagaacagcaaaatcccaaaaaaagattggtaaacgataccaggaaagaaggagattagattccttggaaacaggattacgcaactttaacaacgacaacaacagtagcgaacaaaacaaccatccgaaaaatcgggggggagttagaataaggatctataatttcccaaattga

SEQ ID NO: 7183 - DNA, 849 bp, Candida albicans
acacctaaaattgatttattagcatatgatcaaaatccaatgacttcatatccaccaatggataaaagtatattgaaaaatttgaatcaatcaatttcaccattcaataaaccaaaattgtcaccacctccttctaatttcccttcaatatctattgatttaacaactattgccaccaataaatcaagttcattcctgctgtcaacgactcatcgtaactacaatgaaaatactccatttaattctgccaattcaacttcaggtggattattaccacctatggctacttttactgttcctacggtaatcaaagaagaattacaagtacataatctacaagaagaagaacaagagcaccaagatgaacaaatggagatagattcatttgaatcaaatgaaaaaaacgctaggccaactttgtcaacatcatcattagtgagatcaatgaaaatggcaaatttggaaatatctaatgatcaacaaatgtcttcaaatgaagatgaaaatattgtcactgaggctgttgttaaacaggaaaagaatgggcccgttgttgatgatgtcaatgggactggaaccaatagtaagaaacctagaaagaaacaaaaaagtaaatctaaagaaaattgcaataagaaggggaaagtggcgacaggaaatggaaaggataatgatagaaacaatgaatgtcttgtcaataaaggtaataaaactaacaataatgatactagtaatgataaacttgacaatgacaataaaaataccaatggcaatggcaataatgataatgataatgatagcgaagaaaactcttcaccaccgggatgggacatccgagcttgcgctaag

SEQ ID NO: 7184 - DNA, 186 bp, Candida albicans
  unsure (156): Identity of nucleotide sequences at the above locations are unknown.
gaccaccgtgggatcgggaacggtaagaagtggagaccggggggaaggagtaatacaagcgaatccatagatgaagcatcggtctcgagaaaaattccgagaaaaaaagggaggaggtggggcatgtggttcattagggggaaagaaaaaatacanaataaaaaaaaagagaaaaaaaaagtataa

SEQ ID NO: 7185 - DNA, 324 bp, Candida albicans
atgtgtttaataaaattatgccacattaaagtttatttaagaaataaagtggcagggtacaacataatagataagaaaaattacaatcttactagtatttggggtaaaaatctgaagactctaccgattaactttctaccacatatattttgtcaattcaaattctatgacaatcaaaaactcaaaagcttattacaaaactctgtactccccccatttgtttccctaaattttgcaaagaaacatacaaaaaaatttctggtatttcaatcactcgtaaattcattaagtatcactataagaaaactacttaagctctgttaa

SEQ ID NO: 7186 - DNA, 282 bp, Candida albicans
tttgtaacaatttcttcacaacacgaagattctgggaaagattggatgatgagcaaagctgacccactgcaattttcaaagacagcattgaatgttgttgggcaattaattaaaatttgggtgatattaagtagaaaaatactctggtgcttgttgacatttattccgaatttttgctggatttcaaacaaaaaaaaacatttgtcaaacaaaaacgagaagccacactatgcgtgtacaggacaaaaaaggggtaatcaatcagccaatgttagtagttaa

SEQ ID NO: 7187 - DNA, 195 bp, Candida albicans
ggatcttacacccgtggtgaatatttaataagtcgaaaagatagtactggacatatctattctatatctacttcaacaaccgattctttaacatatattcatctattcatatatttattagcttatttatttatttattcatttgtttgtttgtttttttttgcattcccattggagtttctattgcacatttaa

SEQ ID NO: 7188 - DNA, 432 bp, Candida albicans
atgtttagcttgacaccccgtgacgataaaatcaacagtaaatggaggcgtgataatttgcttttaattctcaagtggatgctggaaccaaaattatacttggggttcattgaggatgaaagttatccgtcgtttgtttatttcaaacaagcatggaataagtataattttgttcttggatggatgttcctgtttgcattgcgcgatgttactgctgtaggatttaggggcattttagacaaggatgcgttattacaagaatgccataaaatggaccacatgagagaaaatattttcttagagtttattaaaaaatgtggtaaaccaactaatttgtcatttaaattaagtacagaagaaatcaagcaattaaaaactaaacgacacaaatgggaaagctttacctcaatagtttcgacaatagtagcttaa

SEQ ID NO: 7189 - DNA, 240 bp, Candida albicans
gtatcagttctagataaattaatcaagtattctattattgattttttcatttccccaacaacctcaacattaccctcaccctcatcatcttcctcctctttttcttcctcattaaaaatatctaaatggaaacatcaatatgggaaatgggaaatgcttacaatttcagaaaaaatttttattaaaatagttattaattatcaattacaaaaatgttggtttattgtatttaaagaataa

SEQ ID NO: 7190 - DNA, 927 bp, Candida albicans
tttgatgaaataattgataaaccaatattattattatatatttcacccaattttacaaaaattcgtaaatcttcatcatcagcacttgatttacaaatatcttcaaaaaattctataactaatgaaaaaatcttgattatgattagatgtaattctggaaatttagctaatgatataatcaataatattgaaaatgccctaggtgtgttattatccaccacttccacttcaacttcttctttaaggacaataatgaaaagcaataatagttatggatctttgaatacatctaaattaatgaattctgataatacattagcatcatcaatgatggatttaaatcaaagtaacaacaacaacaacagtacgagtcattcatctacctatactagtttttcatcatcatttggaactccacaacagccaccaccaccaccaccacgaaaacaatcttattcattatcatcattggatggtaatgaaatttataatgccaatattataaataatccacacactattcatattaataaaattaatcaaatgcaaattcgtctccaaaaattacagcccaacaagggagttgatgacgatgatgacgatgaccacgatgatgatgattatcaacgattgatgatttataatccatcatcttggaaaatattatcaatgtataaattaaatgttgatcaattaattgatgatttaactcaaagaactttctattattttaaattaatcaatgatgaacaacaccaacaacaagaagtggaaaaagtggaagatgagtttagatggttgatttctgatgagatgaaatttcaagtattagaaaaaattggtaaagctggattattagtcaaacataatagtaatggtaatagtaatgggtatggtgagatttatatgattgcatgttctgggtaa

SEQ ID NO: 7191 - DNA, 291 bp, Candida albicans
ctattattgcttttcattattgtccttaaagaagaagttgaagtggaagtggtggataataacacacctagggcattttcaatattattgattatatcattagctaaatttccagaattacatctaatcataatcaagattttttcattagttatagaattttttgaagatatttgtaaatcaagtgctgatgatgaagatttacgaatttttgtaaaattgggtgaaatatataataataatattggtttatcaattatttcatcaaattattattattatttttattaa

SEQ ID NO: 7192 - DNA, 1059 bp, Candida albicans
aaacagttggacataaaaatggattttagtgatgatgaaacccatgagtacactttttcttctgatttggaagatttaacaattgatgcatatttttcgatgcaagtgacgttacctccgaatttgcggaaactatgtgtcagagcagggtgggattcggtagatttcatatcgcaagagatggtttatttagagcatttacaacttaaattgccgagtattgaatcttttgaagacataggaataattgcaccaaatttgaaaacgttagtgttgactgattgtgaagagttatctaattacgacaacttaaagcaatttcaacatttaaagcatttagttttgacacattgtgaatatccttttagtttgttaaggaaaggaacttttctggagttagaaagcttcgaatatacagcaggtgaggatgtacacccagacgatttcaccgacgaactattaacctttcccgcaaatttgaagaaattaacaatacattgctgcgattttgtgaatttagatttggaaaatctaatacttccttctacattgacacaattagaacttcatcatctaatcttcgatgacggttacttttatttaagtgagaatttgcaacatgttcacattaaagcaacaaagcttacattcgacagcagtttcagaattcctcccatggcagaacaaatcaaattactggctacttgtgtaacttttgaaagttgggatttcatgtatcatttgccaaatagtctcactaacttgcacttggctactatcgacaaggaaaatccaatacatataaatcaaaggatcaaatggcccttgatgttaggtagttttacattaaaggggtttgatataaattgtaatgcattagaattattgaatatgaaggaatctagacttgaagtaataaatatttccgagtgcaacatagagacattaaatattgatctatttccaattagtgtgaaaaatctaactttaatgcaaataggaattcgtgaattgcctgcttcgtttgaaaagtcaaataacttgagggagttatcgctc

SEQ ID NO: 7193 - DNA, 186 bp, Candida albicans
accattacgctggcctgttttttgactaaagcttccaattcagccacttttgctttagcctcatttaatttggaaagttcagacatgataattgttggtattatgttgttaaagtataagaaaattagagaaaagaaagtggtgttgttagatttatttttttttttattgttccgccttgcctag

SEQ ID NO: 7194 - DNA, 216 bp, Candida albicans
agacgagaaaaaggacagtctgccgaagtgattgtgctcacatctgatgaagaggatgaagatgaccgaaatccagtggtgctgcaaaccccagtcaagacaaaaaagcgttttaatttttatgaaagagctcaagaattgttgcatcaagaaacggataacgagattcattatggtgatggtgaaagttgggatgatccaatagttctcgattag

SEQ ID NO: 7195 - DNA, 741 bp, Candida albicans
  unsure (42): Identity of nucleotide sequences at the above locations are unknown.
tgcaagtgggatccgccacccgtggtgaagattctcatcgtngagatatttattgggtttgctcgtactcatttagataactgtggttgtggtaaagttatgtatcgtccgaatttggtaatcctcgttaaagatgcagccgacaaaacgtactataagatcagtcacatatcgctgtcgttgtcttttgatgtgccaataatcggatggaatgtgtacaaacctgatgacttgtgttttgattccaatgttttaataccttatagtgtatcgaattggaatatcacatctttggagttagatatagagggtggaagatgggtctccaatgaccaattgacattgacattgtcaattagcgactcgacagtacatagacttgatatcaggggtttgtttcaatcaattttagatttggctgaccggagtttgtttatcccggttgacagggaaactagggtaattgatgaatttcaaaatggtttacaaaacccaggcagtaatcctcttaaccaggatgtgaatctgctaggagtcaataacgataacatagtatgtgctttggatgcatctgttgaattctgttttgagtatggggctaagtttagcatccccaaacaagaggagttctacgaggttgagcaacaagaattcaacgaagagctaattgatcctaagaaacaccagtatttcaaaatcttgggtaagtatttatatgatcatgctctggttaatagttag

SEQ ID NO: 7196 - DNA, 183 bp, Candida albicans
tcactgatcaatgataaatcatcacacttcaaattaaatcatcttattgacattcttgttatgttttcagccaactacataagctggcacaggcacttaactactagatttggttcagttgctaagttagctggtgttcaactttgtagaaatataaaactgaaggttttcacagataattag

SEQ ID NO: 7197 - DNA, 204 bp, Candida albicans
agagccgtctcctttcaaaaactttttgtacaggacctataccttaggataaaaaatcagacgcccccgacatgcttaagtgtattgttttataagtttaaatcagtctatatgatttgtaatagtggtggtggtggaggtggcgttattaattttagttggaaactttctaagggcaaaaatttcctccatattgttgtttga

SEQ ID NO: 7198 - DNA, 198 bp, Candida albicans
ttttcaactttttttgtttttaagattattatcttttctttttcagttttatttgtatttcacaaccaaacgaagaaaaagaaaaatacaacaaacgaacaaacaaacaaagaagaagaaaaaaaaataaacttacatcccccatctcagaatagaagactaaggattaaagtactaaaagaaataaataatttttaa

SEQ ID NO: 7199 - DNA, 198 bp, Candida albicans
gatcaagaatataaacattacaatagttatactttcataaaaagaaaagggagaggtattattattattaaaaacaagtatttacgaacattaacgacaactttacataaaaaaactcaatttcaatttcaatttcaatcctcatactcattatttttaacgttttcaccacgccatgagatccagtatgccttaaaa

SEQ ID NO: 7200 - DNA, 288 bp, Candida albicans
gaattttctttggttggagttttcttcaatagcaatcaaatagtcaatatgttagctataagcttggataacaataacatgtttgtgaatcagaatatgaccccaaccgttgataaagttgcaacaatacaagctgtatcgaaatgtgtttttccaatttatgaacttgctaccaaagactttatcagaatactgaaacggttcaaatataatcacttcactaacaattctgtcaaacttcatacaatgagaaaccgttggtttgatgttgtatcatgttactactga

SEQ ID NO: 7201 - DNA, 279 bp, Candida albicans
aacgtagtaaaacaaaaaataatatcactaaaaatagagcaagaaaattttttttcactacaattctgtaacaacacgccctataaattgaatatttataatgtttgttgcaccttatcaccaacaacatatttaaatttagcatatcctggtgcactcgctactaaccacagcgtaacccaagtgcacatagatatctcttgctcactagtaagttctttgagaataaactatcaagtacaaactaatatcctacgagccaggcttatctatctatag

SEQ ID NO: 7202 - DNA, 1140 bp, Candida albicans
  unsure (58),(73): Identity of nucleotide sequences at the above locations are unknown.
gctagtttggttaatgatgccaaaatgtttgaattgatattatttgaattgtttaaanagaatttaattatanacagtccaatgaaatatcatgaattgtttaataattatattttcattccacaacactattaccattggcaattattaacattgactttaaaagaaattaatcaaaataatgtgatttttaaccaaattcattcaatattaactacaacaacagggtcaaatgtttgttttagttttattgattttgaaaatttgcttaagaattcatttttaaattacaaagctaatccaattgttattaataacaatttgttgataatttcgtatccaataattttcttgagtaattatttaaaccttgataatttaatgacatcaatgggacaaatgaatcaattacaattcatcaatttaaacatttttataatagaatggtatttgattatgatgaaagttttgataattatatgggatgatacattgattgattttgaagataattatatcttgcaaactttgatgtatattttgttggataataaatcatgtttattgaaaagattaaatatcgatacatcaaaacttgaatacgatgtaaattgtgaacgattatcatttaatcaaaaatggttttggattattaaattaaaatttgattctatatttgaaaattggatgaattttttgaaaaataaaaataataatgtaacaaataatagtaatgttacaaataccagtactacaggtatcactaacaccaaccataatcataatgatagttatcttcaccactttaatgttaatgtgtctaatttcaaatttaatttaaacaagtacttgaatgaatattttgtcactggagattttaaatttagagaacaacttgatcaaaatgacccagatcaattccaaggttcaatgagtatggatgaggaaccagatttcactactgccatgcaaacatcacaaacaatcaattcatttatgccaatccataaccacaatagtcgcaatcaagtctatcagcaacataatcaagatacaccaatgactagtcgtagagatagtactaacatcaatgaaaacaatattgcacagacatctagtgtcatttccaactcaaattta

SEQ ID NO: 7203 - DNA, 222 bp, Candida albicans
  unsure (6): Identity of nucleotide sequences at the above locations are unknown.
ttgaanacaaacaagtacgagcagcaacaagagccacaacaagagcagcaacaagagcagcaacaaacagagaaacaacaagcagagcaagagcagccagatcaaccccaggaggaacaacaacaagagaaagaacaaccggatcagcaacaaccagatcaacaacacccagatcgacaacaacaagagcagatccaacaaccagaaagtctggataaatag

SEQ ID NO: 7204 - DNA, 225 bp, Candida albicans
atactcaagcgcggacggccataccatggtgaaaagactgtcttcattcaacaagaaagaaatcatgatagtaaagatgaagttaagataaatcataaacaaagttctgggtctactcatcataattattattgcaataatcattctaaacaatttaaaagatcattaatggatgatggatcagcggcacaaatattttatgcaatttcaaaattttctaaatag

SEQ ID NO: 7205 - DNA, 228 bp, Candida albicans
cgtcatcagtcacgttttacaagagtttttgctttgtgtaacttatatgtatttgcttataattcactcttcttattgttgtcattagtgttcaactatttaggagttaaaattttagttagttatcatttccacttgctcaaatttcaggttagtaatcaatacttttgttgctcatatactaaggcaagctttgtttttttggtgctgcctagttacacaatttga

SEQ ID NO: 7206 - DNA, 1008 bp, Candida albicans
gttgttgtgagtggttgtataatctccgttgcatgctgttatttcatttggccagtgagtgccgttaagaaattacagaaaaccttaaacgactcctatgatatattttcacaagtcatatcaatattagttagaaggtttgttgccggtgagcaatttacaccagtggatatagaaatgattgaaaaattaaaaactaatatcaaatcattatccgaatatctcgaagaagcaaaatacgaattgtatgtggttgggaaagagggggaattgctattccttgaaagattggtaaagtcgactgtttcattagcacgacacttgcaagcgttgagtgcagccatccgaatgcagtggacactattgcacgaagaaaatattattagcgatacacccagtttacggagttttgtaactgaagatattcacctctcaccgtcggtgttaaatatgacacatgcaatgcccctgcctttgcaagatgaagcacacaattcgttgcagctatttgacttgtttgtacaacaccttgcaccttcgattaaatcatttgtattcacaatcaaaggggtgttgggggaagttccctttgagaatttcagtgaagaaaatccaaataggtttgcttctactactaccttacagtattcattagaaagtgccattagattatttgaagaaaagcaagagcagtcgtttgacaagttatatggccagaaaatcttcaagcaaaatctggattttgactttaaagctgatcaagaagaggtcactgcgtgttgtgggaatttttcatctttgttgtctcagtttgggtcggaactattacaatttattaaactttgtgatcgctacgatgatgttgcgtccagctctagaacttggagatggttgaaattttgggaaagaaaaagtgaacccaagaggaccatcgataacagcctacatgcagcagtggatgatctacgcgaacaatatgggtcggggtgtcttcacctacggagctag

SEQ ID NO: 7207 - DNA, 225 bp, Candida albicans
agagacaaccaaaatctaagcctcatatataagacaatacccaaaactatatcaactttctcacctcaaaagaataacaaaagggatggtaatccctgggagcttgcaatagagatttcaaacaataataaacaacaagtctcacacatatcaaatatacctatcaatacgttaaatattctacaattaatttcaaattatctgctagtaggtaacattcaataa

SEQ ID NO: 7208 - DNA, 201 bp, Candida albicans
tttagtttagctgcttttagagctttaagtactagtactgataatggttcagtatcttcaactgatcgtaagaaaaaatggtttcaaatgactgaattacctaaaccggaattgactagtctatcagaattggaaaaaatattgggattaaacacaattaaaaaaaaagagaatgatagcaccaagtgttgtcaattttga

SEQ ID NO: 7209 - DNA, 183 bp, Candida albicans
  unsure (161): Identity of nucleotide sequences at the above locations are unknown.
attaaacataaaatggagatattgtgtgtggataccgaatattttataacagtattggttgaggaccattttaattttatttcttacgggatctctgatatgtttgggaatgggggtattcaaggtaataaatttaaaatttcgttagtaataatggtggntaaggaaaacttaatttgttaa

SEQ ID NO: 7210 - DNA, 201 bp, Candida albicans
aatgtccatggagtagtagtaccaccaagaaaaattaatgatggtgatgatagatttgatagtggttgtcaatgggaatatcaaattaatgatgatgataattttggttcgggatatttacatggtggtacagaattgatcaatgttaatgaattattagataattatttatcaaaatcatctacttcaacctcaaattaa

SEQ ID NO: 7211 - DNA, 657 bp, Candida albicans
ataattatttatcaaaatcatctacttcaacctcaaattaatggtaaacagctaacaaattcaattaaagatcgattaccattaaatcgtcaaatatggattgggtttgctagagcagcaatgagacattgtggttgttcagaaaccatgtatcgaccaaatatggtaatattagtaaaagatgatgtccctactaacaccaatattgcttcgggcaagtcaaactatcgattaacgcatgtgtcatcatttatggatttaggaattgaagtattaccatggtgggaagataaaggattatgtgaggggaaaaatgtggttatacctaatgggatatcaagttggacaattgaaaatgaatcaaacaacctagaatcagagtcatcaactatcacatcaaataatttggtagattatttgacaataacgattactcgacgtgatacaacaattgatcttgtatatataaaagggttattgaatgcattattattaaaccctgacaataacaacagcaataatgatattgatgatactgaggagggatcaagcatttttaaaagctcagtgttatttaatgttgatttagtgaaagattatctgagtactactactactactactactactaatcttcaccacgcgtggaagtccgca

SEQ ID NO: 7212 - DNA, 507 bp, Candida albicans
gggggggaggatgatcttccagcccggcggttaagatctattaatctcaatatcaataaatatccccgaataatcattcaatattgccatcaatgtaaatggcaaaatcgagcaatttggtatttacaagaattcttacaaacttttgcatcatctagcactctggaaattaaaatttatgatattagtattcaaccaatttttgatttcccaggagtctttcaaatcatattacaaaaggaatccacaaataataaaatggagacgaaaatcatttatagaagaaaatttaaaaatgaagagaaatatcataatgaaaatcaaggagatttcgtgtttgatggattccctgatagtaaatttttaaagaaattgattaaaatggaattggggcccgaattatcaattggtcatcatttacaaaaatatagcgatgataataagttatacgatggtaacaataacgataagaatgatgattgtaaagattgtaaactagaatcgtaa

SEQ ID NO: 7213 - DNA, 243 bp, Candida albicans
atagatagatctactactaatagaagcaccacaattagtaagcaaataaagagaaaactaaaaatgaaaggcgatcatttcagtgtaatatatatacacaccgcaatacgccggaaatatgacaaaactaaagtagaaaaaaactttacacataaacacaattattatttttccaggccccagttttgttatactattaacgtgtttgcgccttgcgctctgtatagggaaatactcggttaa

SEQ ID NO: 7214 - DNA, 294 bp, Candida albicans
attaacttactatttttacttccaaataatcagttgataaccatttcagttggaattttagctacaaaccatcatataggagaaatatacattcaggaaggagaatggttaaccgagtatttccctatacagagcgcaaggcgcaaacacgttaatagtataacaaaactggggcctggaaaaataataattgtgtttatgtgtaaagtttttttctactttagttttgtcatatttccggcgtattgcggtgtgtatatatattacactgaaatgatcgcctttcatttttag

SEQ ID NO: 7215 - DNA, 459 bp, Candida albicans
tgcagcgcatctctcctaagcagggtgctaggtgcaaagtgggggtacgagagccaccgctgggacggtttatccgatcctgggatacggttgtgccggttgccaacgcttgtaccattctctagtaccaacttacatactgggactggtctgccactacccttggccagaaagtctaggctggtgggaacaagggctggggctgagatcaagcttgggccagagccagagccagagccagagccaggtcagggccagggtcaatggctgatgtccctaagttcaaaggaaatggccaatcccagagcagggtctaaacccaaagcccatagtatggctatgctggtaacaataccggtagccagggttagtactctggcccactctacaagaggctcaaaggtgttgggtagcagtcaattgtattggctgtacccaggttcaccactggcaacatga

SEQ ID NO: 7216 - DNA, 324 bp, Candida albicans
tttggtggctctctaataatcacagtgtcagtaccacctggaggggcagttacagtagttgtagttgcgtacgactgtgaccaatactcggtggtggttacagttgggtttgggggttctctgataatcactgagtcagtgcctcctggaggagcggtgactgtagtagtagtagcaaaggactgtgaccaatattcagtggtggttacagttgggtttggaggttctctgataatcactgagtcagtaccacccggcggaacaatcacagtatttgtggttggcttagaattgggaccaatactcgggggtggtgacagttgg

SEQ ID NO: 7217 - DNA, 261 bp, Candida albicans
tttaggtttttttacttacttactttctctcctgttgcaattcatgatgatgcgaaagtaacagtaacccacaattgtaatagtagtagcagtgataatgatagtcttgtggatagtttattttccaaagaagaagagcaagaaggagatcaaattgatcctgttacatcacatgaagaacacgaaatagaatcatcaacattagtattaccgaaaatgagaaagaaatcatcatcaccaccatcatcatcgtcagattaa

SEQ ID NO: 7218 - DNA, 216 bp, Candida albicans
attggacattcgcaaactaaatcaagttcccatcaaatctataccaaatcattaagatattgtttagatactccaaatgtttttaaagaaagtcgattcccactggttcctagtcttatccaagttccccaacaagtgaatgaaaatggttgttgtggtggttgttcctccctttatttcattgagaatccctatcctgatttacgtccgacctag

SEQ ID NO: 7219 - DNA, 882 bp, Candida albicans
  unsure (870): Identity of nucleotide sequences at the above locations are unknown.
gtgggtagtttattaaatgggaatttcattgaggcaagtttattaatggaagatgaattattagtgattaatgaaacaattcaattattagctcttaaattaaacgtgaagaatcctaaacttgtcattttgaaaccccctgaatatgaatttaattcaattgtagtggatttccattatgaacaagtttggcttagtacagggaataattatactattaaatcaatatcctttaatgaattggtaccttataacagcactggtggtagttccaataatgtgattatcccattgagttcgaaaaaactgatcacggcattcacagctaaagataataacaatacgatttcaagaccaattattcaaatttatgatttttcgaaaactcatcttgcatttttaactgatcaagaagaaattaaattcatgaagaaagataatagtgatagggatgggatcaatgaaaaggttttggcaacttctttattgaagaattttgctgggataaaatatacttatctgaaagaatttttagcattttcccatcaagggataatcaaaaaatttattgattcaagtgaattacaagatataatcaaatttaatgtgattgatatggatattgtcccagtttctaatagtgtaactgctattgaaaaaaatgatcacaatacattatttattggtgataaatatggtacattaacaatattggaattattagacaacaacaacaacaataataataataatgattataaaattttatatcaagtgaaagctcattcttcgacaattaatgaaattatttatttcacattttcaaatcatcaaatttgttgtagtatatctcgagatcgagtgattccnattttccattgt

SEQ ID NO: 7220 - DNA, 1275 bp, Candida albicans
attatgattataaatttattcacgccttatcattcaattttacgaatatattcacatgattttacttatttattcaccaaatattacattatggggatttcagtattaagttataattcagtgttattcaatatgaatattaatgtggccagtctaataacttttaaatccaaaattggccaaacattgaatatactgaatactgaggatgttgattttagtgtattgattcccgatatagttcatagcactatatcatcaagtaatttatttgatggattaactgattctcaattagtcactatactaaataaatcaaaagaattacttgaaatgttccccatagatgaattgactaataatgaaactacttggaataaatggtttaaacaatataatgttgattcagtattgtgtaatacatcgaaattagttgaggaagatgaagatttgagattacataaattcaatcaatatagatatttaacatcacaaaagcaagaaacagaaacagaaacagaaacagaagatgttaatgaattactgattctaatagcgagacaagatgaacaaatatcaagacaaataaatgatgaactgatagaagaagaaagaatttttcaacaactactagcgaaacaagaagaagaggaagaattatcacaatcaatacaatcaatacaatatgacgatgatgatgaagaattgccttcctcctcctccagtgaaaatctgctatcatcatcattaacattagccaattcaattacatcttcatcaattcatagaattaaatcaactttattattcagaaaattcttccataataatgaagtgagtggtacaactgaagaagctcaaggggttaaccattccaccactactaacacagataataacgacaatgatgagaaagttattagagataagaattgggttttatcattattattaaataataatagtaatatttataaaattagtattaccattggattcattggtgtcattttacattttcttctcatcaaatcgaataacaataataataatactggtagtaattttttaacaacaatgataattaatccattaaaacaatttttacaatatgaaccattatttacattgagtacaattggtacaacattcattaatgatttagaagaaagttttaatggattaatagaatcttccagtattccaaatatggggaattttttgggaaatattggtattggaaatattagaaatacaatttatggatttaattga

SEQ ID NO: 7221 - DNA, 354 bp, Candida albicans
gattctggttatctcttttattttttttttgccaaggatctgcatggaacacgtgcatgtctaatttccaccagcttccatattattctgcgtgcgtgcgtgcgcctttatcaaaaaatatatcttagtcgtgtaatactggataaatctattttcattttttatcataatgcacgcccttacgtaagagtgcagattattagtaaggagttttttgacactatttcgagcagagcaatacatcttcgtcaacatttgcgtttacatcatttgcaacccatattgtattatgtgaaagttgtgatagatatttccgtggttattgcacttatccgctatgattttgacgaatga

SEQ ID NO: 7222 - DNA, 282 bp, Candida albicans
tatggaagctggtggaaattagacatgcacgtgttccatgcagatccttggcaaaaaaaaaataaaagagataaccagaatcctaatcatacagaaactttgaaaaaagaattggaagcaaatgttaccaagaaattagcgataacagaatggccctttttttttctctcttcttcctccttcctccttaaaacagacaacattgaactgatgaatcaccaaaaatgtttacttcctttaaaagttgtcctccaaaagttctattattatatttatccatag

SEQ ID NO: 7223 - DNA, 231 bp, Candida albicans
actggaaagataatatgggtattaatccaagttgggcagaaagttctccctggttggaaaattttgagttattttaagaataatatgaatgaagaagagaaatctgtttctatgaattttgaaacaggtaatgaagagtttgaaaagattgcgaaattaagaaaagtcaagatggtgagatatcgaggaaacccaagaaaaaactggggaccaatggccagaccaaaatag

SEQ ID NO: 7224 - DNA, 210 bp, Candida albicans
  unsure (118): Identity of nucleotide sequences at the above locations are unknown.
aacaaccccattacccattttcgatatttgttacaaaatacaaataatgaaaccattctagatgttcatgcggatgaaaggccgtcttggtttaggaccaatatcaagaataattcangttttttgcaacacaacctgaaatataagaacaaaaaatggaatttaacattgggaataatttcaccccacccaactgttgatgcggaaatt

SEQ ID NO: 7225 - DNA, 228 bp, Candida albicans
ccaattactactacaattattattatatatatactaagatcttgtgattgttgtactacaattatatttaagatgtcaggtaatgattctccaattccaagcaatgccacagttaaaattgagcaactaaaatcgtttactagtcttcaatctcaagtgacctcccccccgaagaccatgaaacaaccccattacccattttcgatatttgttacaaaatacaaataa

SEQ ID NO: 7226 - DNA, 1032 bp, Candida albicans
cgaaatgtttcacattcaacaaactcctcatcatcatcatcctcactactattcacaaatcatccacatagattaaaacccattaaaattcgattaattctcccattacctcacacaactcaaacccaatcaaattcaaattctttaccatatgagaatatttgttgtaatttaattggtgatgaatcatttaattcccttagtttttttcttaagcaacaacaagggcaagagtatggagtcaatttaatcaattcaatatttgtatttagtcaatatatttctaaaattgataaattattattaattgatataactacgaccaataatcaatgtcaaaaatttataaaatcttacaacaaaagaaacaacacagctggtacttataacaattctggttctgattttggttctggtttgaatattgtgataaattatcttattaataatatttggaaatttattaatcaattaataataaatgaaaaaaaaaatcgatcaattttaatcaattgtttaaatgaatattataaaatttttaaattcaatctaatttttcaacaacaacaacaagaaagggaagaatccctgtcaattaataatagagatcaatcaattgatgaaatattaaatttatcagaattgttgatttatgaagatgttccaattgaagatttaccattaggtaataaatatccacaaaaagatagtattaatgttgatgaatttatttatcaaactgaaaaagtattcgatattagtaaattaaatgttataattatgacatttgattccaataacaagaagattaataacaatatcaagaaaagtacctttatatcttcttcaacaattatgactgatccatattattcatttgattataaattagaggaacttgatattggtaaagggttttacaattcaatgaatatgatgaagatgataacgtctgaattcccaaattttgaaatgctccaatcaaacaacaacaaaaacaaaaacatcttcaccacggcgtggaagatcaac

SEQ ID NO: 7227 - DNA, 336 bp, Candida albicans
gttgttacgagagctagcagaaagattcctgaagatgcaagacatgccgccagctatagggactttgagagaccttgcgattactctcaagtaagctttataatgtctcatttagctgaaaaaataactgaatcgagtttaaagtatggattcgatgaagaacaactaaggggaaatgtgaatgatgcagttcatgctatgccgttggtaactggatacagattcaaattggcattgatgtattcgttgaactgtgactattcttcatggaaagcaaatcaaattttagcagaatcaataaagaattattacaagatagatacatataagttatag

SEQ ID NO: 7228 - DNA, 204 bp, Candida albicans
attgatgaagagggacaattgaaacaaggtttcatttataggttattactgtccaatttaaaggaactagtaaataaggtaatattggttttcaaatataaaaaggaaaaaccatccaggatggaaatgaatatacacaacccaaacatgtatatatatattgaccaagctattctcaaaaaagatctaatagatcattgttaa

SEQ ID NO: 7229 - DNA, 225 bp, Candida albicans
cctaatagtttctcagggtgttggatgttgggctttttttggagagggggagagggggggagggggtgtgcttctattattaaaaccatatttggaactaagttgtcaagtcaaattagttttgtgttacaattaatcaatcaatcaatcaatcttcaaaaagagtgtgatgatcttatgaaaagtattgtggtggtggtgttggtggtggtgatgtgtgagtga

SEQ ID NO: 7230 - DNA, 183 bp, Candida albicans
gaaacagatggaatggaatggaacagatggaatggaaggaattttaaatttaaattaatcaaatcttacagtgaaaagaaaaatagaacgtttcacaacaacatatttaaatgtataattgaaaattatcaaaaagaaaaaaaaaaagccaggggcataaaggaattctcttcacttatttaa

SEQ ID NO: 7231 - DNA, 732 bp, Candida albicans
tacaaaaaaatcttacttaatttaatattatttattactcctaaagaaaatctggaaggaatcataatggtgaaacaactggatatttggaaagctattgaaaaattgaattataatcctcgaaaaactttacaatttttcaaaattcttagacgtgatacaatacgtagtaggagagatactaaaaatgaagaaaacacagatcaagaagaagaagaagaacaacaacaacaacaacaaattgaagatgttagtggttatatttcaccatttgataatccaataatacattcgggtaaacataagaaacgacatctaaaaaacaatgattcaatttcaaactcatcaaataaagaaataactattgatgcaataattaagagacaacaaaataatatatcatcaaatgataacaataacaacaacaacaacaacaacaacaacaacaatgcccaacaaaaggaggatgaggaagaacttgaagatataaacaaacaaaataatgatcatgatcacgatcaatatcttgaacaatatttgaatattttagaaacgaaaaatttaaatgaatttgattatattaattctaaaatgtatgaacgaggattagttgaaatgttaatgccggaaaagaaagacgatgatggtaaagaatttatagaacaagatgaaacaattgctgaatattggatatatgaaaatcaaaacatcaaggggaggagaagaagatga

SEQ ID NO: 7232 - DNA, 201 bp, Candida albicans
cacatagtaaattttgagaaaaagaaacaaattactattaatataagagtaaacaataaagtaaggggaacgaaaagtcaaaagtcaaagacaaggaatgacagggtttgtgtgcttgttgttgataatcgaggaggaaaaaaattaagagtcaataattacctaattacaaaaagtatattcctaataataatacaataa

SEQ ID NO: 7233 - DNA, 345 bp, Candida albicans
attatgtctcgtttttttgtttcaggatacacttctgactcttcttctgaagaggaggatttattgagtacttctgaagaagagttattatcttcttctgatgaaggagaagacaacgaatcagatagttcattttttggtgaagatgatgacgaatcagaagaatctagttctgatgatgaagatggtcgaccatctggtccagcatattttttaaagaaatcatttttaaaaggagctggaggagatgattctgacagtgatagtgatgatgaaggtcgtaaagttgttaaatcagctacagataaattattatccttcaccaggcgatggaaggacaacgct

SEQ ID NO: 7234 - DNA, 393 bp, Candida albicans
atctacggacgacataataaggtattaccgagttcaatatctgaattgggcaagccaatatttttacatgatgaaaataaggaaagtcacaagatatatttgggtaaatggacaatttcttcaactggggaaattcatatcattattgaaaatggatcagtgtcatatttaacatttcattactggtttcaaataaaatctttgggtcatatcaataaacatgcaaaacttacatgggttagatacaattcagttagaaaaccaacacaaactataactgctgatggtgaagagacaattgatgatagagtatgtgaaataatggaattttctattagaaatgaaaaagcctttaaatttctgagagttaaaagttatacccacaccaattga

SEQ ID NO: 7235 - DNA, 189 bp, Candida albicans
agtacaaccatgattgattatacaattgatattccttatttcattagtcattatgaacatgaaaatgaccatgataatgaaaatgaaaacctaaataaaagtgtccacagcagcaatgattataataatagtagccacggtttaattttctaccaaagaaatatccattatttggcccctactccatga

SEQ ID NO: 7236 - DNA, 216 bp, Candida albicans
tctattccaatatttgaatatgttgtagccacaattcgttaccttctttgtttatttacatcatccattaatgttatagtccttgttcgtagtattaaaagacatgttcattgtttgggtgcaactaatttatctaccactatccaagatcttcgatttaaaaaattgctattgttattgataattcttcttcaatctaatccatctaagctttaa

SEQ ID NO: 7237 - DNA, 192 bp, Candida albicans
caatcactaggaacttgctatattctcgcaagtcacgaaataaccaccatcaatactactactactactactattaccactactactacatttgattcaaaacgggatcatcgggtacatggaatcaacaatgctaatatccaaaatcacatttttttgcaagacaataaggcaaattcaaccagacattaa

SEQ ID NO: 7238 - DNA, 189 bp, Candida albicans
attttttttatttatttttcaaattttgcaatcgatgattataaacaatattattatggtataatatattatagtccaatatcaattaggctattactaataataacagtattattgttgaatacaataataatagaggatattacgagaaataaagaaataagaataataataagaatcatattataa

SEQ ID NO: 7239 - DNA, 384 bp, Candida albicans
atttcatgggagggagaaaagaataaagatttccatggttccactccagatataactagagcgacatctcctacaattactgctgatgatactgctgctaccaagattgatgacaatggttgggatgacttcaatgatgaatgggtcaatgatgaaccagatgtagtcgatgtaccagataccattatagaaccaaccagaaagatcaatttaggaaagtctactgatataacaactcctaaaaaattgccatcaaaacctgctccaagaaagactacatctttgaaattgggttccaaaacaactaaaccgaaacaaactttgcaattgaatttaaaagttgacgatgatgacaatgatgataactggggagatggttggtaa

SEQ ID NO: 7240 - DNA, 201 bp, Candida albicans
ttaaaacatatggttttatcggtaaataactcattaaagttattaaaaattcattataatttattatatcgggtgatggtaaatatgatgtatcaaatatatatatgggataattggtggttggatcccgaagatccgatttataaaatatcctatccatgtggagggagggagggaggggggatgagtgtgtgggtgtaa

SEQ ID NO: 7241 - DNA, 780 bp, Candida albicans
gacgcggtccttccagccccggggctgatacaagaccttgaagtagcattgccaatactacaaaaaatcaaacaaatgggtgacttcgtcaacattgccaacttgtccaatatggtagacttgttgtcgtctttggtgaaccgagtgttacgaaagtttgatttagcattgattatgtcgcaatggaagcataactttttggagcagctaccacaattcttgcctgctttgacatgcttatatgatttgacgctagtcgtggtatcgtggaagtttgagaaattggttgaaattgaaaaggacgaacagcgccactatgctatagatttggaatttgacggaatcgttgatttagtcaatcaaactatccgattgatttatgagtgtacaaatagtgtgcagtttcttgacttgaaaactttattgatatcaagatatatcgactttatgttgtcgttcaaagtgttttatgttagattccaagctgacaacagttttgacaatttccaagaattcttcaatagtaacatgcagctattgcttattaaacgagacatgcagtttcagctattagaattgttcttgataaaagaagtgagacttggtcatttgttgaatgtggatttggatagagacgatgaagaagatgtttattacgaatattacactgaaaaaatcgatgaatcctatctacaagaaaaaagtatgtttgacgatgacgaccaaaccctgcaacccagtactgaagatagctcgaccacaataaaccaagaggtataa

SEQ ID NO: 7242 - DNA, 192 bp, Candida albicans
aagaatccatgcggatttactaataataatcttcacaaggggagagagagaaatatactccgccgcctcatcgacaacgtttacttccctgaaatttctattgttccggatattcaattaataagtttttttggtaattattacacgcatgacaaagtttttactaatacattacaaatttattttacgtga

SEQ ID NO: 7243 - DNA, 228 bp, Candida albicans
  unsure (94),(118),(120),(121),(126),(135): Identity of nucleotide sequences at the above locations are unknown.
aagagatttgtatttcaaaaaaaaaaattcccagaggaagaggaaaattggaaggttgggggagtgggggggtataaatattatttgccaactnctcccccctccccctcccccccgntnnttgtngttgattangtggagtatttgggttctacttggtggaggtatacttccttgtttccctccccctcccccacactccactcttcaatttgtttcacaactttt

SEQ ID NO: 7244 - DNA, 213 bp, Candida albicans
ttgaaaatttgtattgtgagagaaaaggaagaaaaaaaaaaaactttttggtgtgtgacaattattttttctgtttatttctattggctacagagtgtaaacttcctatttaggaagtatactgtatactctatgcgcattggtctagtttttaattttattctactctactctaaaaaactactttcttttcttaataatcatattcagtag

SEQ ID NO: 7245 - DNA, 699 bp, Candida albicans
  unsure (674),(687): Identity of nucleotide sequences at the above locations are unknown.
tcagtagagagtgccaaagaaatccacgaaattctcgtgtcactaacagcacttgaaaacgaccaagcacttaaattgaatacaattctagatgttgttttaccactagttgccacaatttatcgaaatatggagagctcattggaaattattcaaataccaacgagcttgcaggagtccttagagtttagtgggacagaattgtggaattctactagttcatttgcatcccatttggacgccatttacaaggtgaaattatactccattttgttgctaattgtgtatgaaactttgaatccaaatgtagatagatgtcttaccaatatttcctgtctattgaatttgtattctagtgccattaccaatgccattaatgatgtttccgataaatgcaatatatacttggaaccaatgataggaaaattaatgggaattaacaaggatatgccgttgaaggatcaaaagcggcaactactaaatgagtactaccacaagctgactattctcaatttgaactatgcagctataaataacaattttgtgcttgcaagaaactatgaaagcaaattgagctcctacaaaaacttgtcagaccccttctttcttggagaatgcagcagagtgctttataatcattgtttgcagtcagtgcaacacagtgttttgtattnaacagccaggatngaaaatcaacgc

SEQ ID NO: 7246 - DNA, 621 bp, Candida albicans
gataattcacttactagatttgatgctagatggaaaaaatcacgaactaaattcaaaactaaattgaaaactaaattaatatctaaattgaatgccacaacaaatggatcaaagtcagggttaacagatacgacaaataaagataaacacaaacatgaagagaaagatggagatgaaaaaaaacatagtggtagtcgtggtggtggtggtggtggtggtaattctaaacctactatttcaccaacatttataaaattgacaaattttattaaatatttaaccataattataatcatcatgatattattaatttatttatattcaatatcattagaattaatcggtgtatttgaatcaataacaagaaattattcaggccagggtggtggtagcagtaaatataatggcttttttgcgtcaagtaagaatgatcttaataataataataataataataatttttattctaaaattcatgaatttactcaatcatatacagatagtattcctattattagtagtaatagtaatagtaacggtaatggtaatggtaatggtaatggtaatggtaatggtaatggtaatggtaatggtaatggtaatggtaatggtaatggttaa

SEQ ID NO: 7247 - DNA, 219 bp, Candida albicans
  unsure (30): Identity of nucleotide sequences at the above locations are unknown.
aaaagagagcaaagggggagaaagaaaggnaaacaaggacaaagaaatgaaagaaaaagaagaagaagaagaagaagggataagataaacttattctatttatatatatatatctataaatataaacgttcagaatatatttctttagaggaaaatagtttattattattattattaaggggatctgattcaaaaaaaaaaaaaaatggaatggaatag

SEQ ID NO: 7248 - DNA, 207 bp, Candida albicans
tacttttggataacttcaacaaaaaatacttgctataatcaatattattatttttttatctttcagttacaaaaatccttgactggtttaaccaataggagattaatacgtcgtattgctagagtattactggttaaagttgtagagattttggatttgacaaatgattcttgtaaaaagtctcttctacagaattatacaaaatga

SEQ ID NO: 7249 - DNA, 645 bp, Candida albicans
  unsure (519),(604): Identity of nucleotide sequences at the above locations are unknown.
aaccaatctctagatgaacactcccaaatatctcttgcaatgacaaataaagggaaattatcgaaaactattctgaaatattttgcaaataccattggattttcatgtcgaataacaccacctcccaatacatctttagaattagattatctcctacataatttccataaattggctccattagacaattttcaaaccatttctaattcaaatcatggatttttcataaatgcaatatatagtccctgtcgtgatgaatcttggtttaaattaattaaacctgatgaaaatcatttatttgaagaaatcgattctaaattcaccaatactattaaaaatgattttattaataaattgaccagtttagtggctattcctagatattcatatattgaaaataataaagactttcaaaattataaattacaaatacgatttgatcataatatacagagatctatcgctaattataaagggaaatataatttgacaactagtactgttgacgatccatttatntcaattataaacaatgacaatgccaatggaactaataatgatgatgatgacgaagtactgattgattatgaaaaattgagagtanatctaaggcacaatttccaaaaaattcataaatttgaataa

SEQ ID NO: 7250 - DNA, 855 bp, Candida albicans
ataacaaatcacttgctgttgttaatgcttagccgagtagttttcataattctccactggacccttctagttcttgctgattctagaacgacaagtgccttggacataacaatctatagcaataatgttcgttatgctgcctctaggcgaggaagaggtcgtgatgaattaccatggaaaataagaaaacatggtgtggttgatgcaattaaatcgcaatccggagttgatccaattttgataggactacaagaggttacacatgcacagttaaaagatatattgaaagggttaaataagaaaaattcagaagacgatagacgctggacattttttggtgttggtagagacaatggtcataaaaaaggtgaatattctcccatactatacaatacagcagaatggaacctattaaatggaacttataaatggttgagcttcacccctgataagccttcgaagtatccaggagcaagtaagaaaagaatagtcacaatgggtacttttagccatgtcaaaactgggaaagttgttaattttgtcaatactcatttagaccataggtctgttaagtcaagagaatacagtgccaaactaattattcaatatattaaatcgatacccaattatttccctacattcttgtgtggagatttcaattcccttgacactgataaggcatatgcaactttttctcactatatggtagatgcatcacatgttgctgaaaagaaatatgacaccaatctcaaaactttttcaggatttggcaatggtaccagctacagtatagattttatttggtctccaatggataccagtcttccaccacccggctggaaggatcaacgctgc

SEQ ID NO: 7251 - DNA, 216 bp, Candida albicans
cgacatgggtttcggtttattcgattaaagagtttagccaaacaaataaataaaaataatgcattgtcacatcacctatttggtttgttaatacaagttcaatacgttctaacgaatcatttacattcctacttcattctgtataatttaataaataaaaaaacagttcagagtttaatacttactataccactatggcactgcgacgaattctaa

SEQ ID NO: 7252 - DNA, 399 bp, Candida albicans
ataatggtgtttcaatcatttatacggtttgccaaatattcattatcatcatcatcatgccgaccagaagttagacatcattttttcagaagttcttatccttatttgaatcgacatcatttttttaagaacctgatatccaattacaataaagggtttaataaatcaaaatggtggtttagatctcaaagaaatacttctaatcgatctaagccatttttaacaatatcagatggacattatggattatactattccatgtataatcatgattctgaaagacaacaacgacaaaaggatcatgaaaagtatattaaacatatgattttaaaacaattagagactagtgatagaatattgggtcataaaagtttaaattctgaaacgttttttcgctag

SEQ ID NO: 7253 - DNA, 252 bp, Candida albicans
tcttggacaacattctatataatttatcaccaacctgaccaaaccaaattggacaagaaggaggaactgttaataaattcattctttttgtttgataaacaaaatgacaaaaaaaaaataaacaaacacataccaaatgaattggtttcaattgaaaattcattattattaaaagagttttcagaaaattcactattgcttgtgcctgctatgcttgaatgtgatgtatttggaattggttggttgatttga

SEQ ID NO: 7254 - DNA, 318 bp, Candida albicans
tgtcatgaagacagacgaccatttttttttacaataaaacagcagtttaaaaaaagcgttccaatacaaatggatacccaactgttgtctaatcaacaattacatatctcttgtgcaatggagaaatacatggagctaatacgtaacggaatattactattgttagataattataaatacaaccctctttatccgagtgttatcacaatttccaatgaattatatctaaacacaaaattggcacaaaacttgcaacgaagtggtcataatattacgggaagctctgcccccaatgggaatgggtaccaccttccttga

SEQ ID NO: 7255 - DNA, 522 bp, Candida albicans
gctccaatggattcaaacccgtgtcaagacgtatcgggtgataccagtagcacaccaatggccaacaataatcccactaatgacagcacaatctcctctcagaaccattctaaaactggcttgagaaaacaccaacaacaacactaccaccaacacctgcacctgcaaatgcattctcattcacagcagtcaccttatattaatcaattggaatactttaccaataaccagttttcacgctctttcaatagtttaattttggaggatgccaatgatgccaataccaacaatagttcaacaacaaccttaaataagaaaaccattaacaagtcaccaccattcaatatcaagcaggacttattaaacgatagtatcgacacgtttcttgataactccaacacggaaacgatagaagatggagacgtcacaacaacagacgacgatcacgattttgatgatgaagatattgaagatcctgaagcagtgcgtctcaccaggccggcaagagatcaacgctcgaag

SEQ ID NO: 7256 - DNA, 228 bp, Candida albicans
gagtgcgtgtccttccaggcccgtggtgaagacgtgataagacgaggtggacaatcgagctatcatttcgaatacttgtgtactgttacatatatatgtatatcttgtgactgcatttcatatactaatctaaccatatttgaacaacatgtaaagaagaaaaaaaatacgatggacttgaaaaatgctcctccaatggattttataaatgtcaaaatacattgttga

SEQ ID NO: 7257 - DNA, 216 bp, Candida albicans
aagaagaaaggggaggaagcagagaggaaaaaaacaacaagaaataagaaaagaaataagaaaattggaaagcaaaggaaagggaaatcttttggtttaagcaatgaagatatcattcaattatttataaaatcattggaaaaaaggaataacataaacaacagaatatcatacaatacaatatataatataatatatatatacatatatatataa

SEQ ID NO: 7258 - DNA, 351 bp, Candida albicans
catcgcctccagaagaataccccgaagcctgtgttaattcaaagccaagcccggaaggaaacaggaaatgctcaaggcagcaacaacaatgaaggacaagaagagggattggatgaagaagataagttattggcaagagaggtggctgaagttggcgtagaccaagagacgttgaacagttatgggttgttttataatgtgtatactcgagagggctctacatttccagaattgcaacctcagcaaagttcacaacaacaacagcaacagcagcagcagcaacagcaaaagtactcggcatatgaccaatggggcggtggttttggaatgattccattcaacccatcctag

SEQ ID NO: 7259 - DNA, 693 bp, Candida albicans
caccaacaagagactaacagtcgaactcagccaaaccgattcaacgttgaaccagaagatcaactgtcgcgttttcaacatttcaattatttaccaccactaatagaggttcccaaattgaactcatcacaatcttctccaaacaacagctcttatgaaggtgcgagtggcacaacaccaaccaccacccaattccatcaccaccatcatcaccaccaccatcaccataacaacaatgaaaaggaccagaggaccaagcctgctagtactaacggaagtgttattcgatcaacaacaccagcagaacttgatggtaccagggagtctgatcttataaaattgttgaacaatactgatgaacttaacagaagagaaacaactcccatctccaatccattaacacccttggcacaaactgtggaatatgtagaggcagaagaaaatcaaaagctcaaacggagaaagttgggccctactgttgagtcaaatgcagacatggtgagcaaagcccaacatctcaacaatgataagaaccatgacatccccagtgaggatgaagaagaattagatttttgggaaacaatgagaaatttgaccgagttgcccaataacactttgaataataccactaccaaacctactgttactagcagcaaaaaaaatcctttctcacgacactacttaccacaatag

SEQ ID NO: 7260 - DNA, 198 bp, Candida albicans
tttttgtatgggaaatctgtggcgactttcaatcaacgacccttacacactgaaaaatcaaaattcaatttagcaaaattattgtggcgaggtatcaggaagttagcattgtttacttacagcaacgtggcttcatggtctgttgagttaaaaagatatataggaaaatatgcatgtacaagtgacattcattgttaa

SEQ ID NO: 7261 - DNA, 210 bp, Candida albicans
  unsure (107): Identity of nucleotide sequences at the above locations are unknown.
ccacaagcaatcaattttacaattagcatactagtctctttatacgaaccacaaatgacaaaaagctgtattgcatcaaataaccttgacctaagaaacaattctanacaaataagacccgcatttcagtggtttgcaaattcaaaaagaaggattttgggtagcaaaataaaatctgcattcacattaactattcagtaccaaaactaa

SEQ ID NO: 7262 - DNA, 252 bp, Candida albicans
tatattacacgcaggaaagaaaaagaattccgagatcaaagtcgtgcatacttagcgttgatgcaagttactgctttatctaatcttcaatcaatccaagtcaactcagaaaccaacctaacaacccctgaatccactatttcttccctttcaatcctaattaactatccctcaggtttaattcttgaagcctcctttcctatggacaacccaaatttatttgttccttctgaaaggggggacttaatcccc

SEQ ID NO: 7263 - DNA, 192 bp, Candida albicans
  unsure (4),(104): Identity of nucleotide sequences at the above locations are unknown.
gatnaagaaatttctcgacttcgtaaagaattgaatttattaaaaattgataaacttggtaaatcatatggtaataatcacaataataatagtacatcatcatntttacaatcaacaaatttggataatcatcaacaaaatgcatttacttctgtatcaccaatcaccgggagaatccttaaatttccctga

SEQ ID NO: 7264 - DNA, 195 bp, Candida albicans
tctttattgattataatttctcttatacgtttgaaaaggtgtattgagtcggaagtttttgtacttctggttggtagtggtgccggagtttcctgggggaagcaatcgtcaggaataactacagcgttagttagaaggatcagtaataaaaatgttgttaatactgatactttcattattggtttggtgttatag

SEQ ID NO: 7265 - DNA, 303 bp, Candida albicans
atccactgtaattgtttgatatcaatctataacaccaaaccaataatgaaagtatcagtattaacaacatttttattactgatccttctaactaacgctgtagttattcctgacgattgcttcccccaggaaactccggcaccactaccaaccagaagtacaaaaacttccgactcaatacaccttttcaaacgtataagagaaattataatcaataaagattatgctagaaatcaagcagcccaaactcaatcatcttcctccacggtaaccccaccacctaaaatgggttcgtacttttga

SEQ ID NO: 7266 - DNA, 186 bp, Candida albicans
gaaaaattacgtgatagatttatattcaattatttaaaattgaaacaagattatacattgaaatttattactgagattatgaataagaatcaaataagtaaaaataaatttagaaatccaattggaaacgaaataccgagtttaacaaatgaagttaaatattggattggatcaattgaatattaa

SEQ ID NO: 7267 - DNA, 489 bp, Candida albicans
gacgcggatcttccagccctgtggctgaatacagagattcatctggagaagattgttccattgaatttatactctgatgataactcagaattgaataaaaaattgttgaagcgaatcaatgattactatttccaagcatattataatctatggcatttcaatttatgcgattacaataattccgactctgggaactataatattatgatttttaaattggataatttaggtaattttaatttagattattgttccagccaaggattcaattttaatttcaagacggctcaagagaatactatcaacgatgatgttaacgataccaaagaggaagaatcagtgcggccacctcataaatctactaattatcgcggtagtggtagtaaagaacgaggtggccgtggaggatcaagaggtacaagaggtctgagaggaggtagaggttcctatcgtggtcgacgaggaaatggaaacagatcctcacgttag

SEQ ID NO: 7268 - DNA, 255 bp, Candida albicans
gaaaaaaaaaatgagccaaacaatcatacttttagcactgtcaagcacaaccaattacacaatacatatacaatggctgctggacacattgcaagatatattcgtcatgctccagctataaaaccacacgttccagcttatgtgaaatggagttccaaacttttaggtgctactatgtggttttggattatgttgagaattaaagaagatgggccagttatgtttggtctcaaattaccatttgaacatcattag

SEQ ID NO: 7269 - DNA, 351 bp, Candida albicans
  unsure (18),(60): Identity of nucleotide sequences at the above locations are unknown.
gacacacgtcggggcgcnaaattaaatcgcagatgtcgtcatccggaaggagtgaaaacnaggttccaaagaaagaaactaccaatgctgagctgtaagaagaaattctggattatttttttacatggtcgtgcgagtgaaccaaaacacgtgattttctctagttttaacattttaaccaaccaaattgaagaaaatgtgaattatctccaagacagagagcgaagtgagaaaaaaaaaatgagccaaacaatcatacttttagcactgtcaagcacaaccaattacacaatacatatacaatggctgctggacacattgcaagatatattcgtcatgctccagctataa

SEQ ID NO: 7270 - DNA, 189 bp, Candida albicans
gaattaaagaagatgggccagttatgtttggtctcaaattaccatttgaacatcattagttgtttacatgaactatcaagaaagttaacggtacctaaagagatactttttttaaaaaaaaataatacaaagattgttttatttgtttacgacttatttcctatacatgtatatttattttgtcaataa

SEQ ID NO: 7271 - DNA, 267 bp, Candida albicans
tcaattattgtatgttctacaatcaataatatactaactcacctacattccatccaccttctacttccttcatgtttgacaactaaatatcatataaatctgtccacttttttaactaaatcaccaatggagttttatttttcccttgcttattgttgtcagaaaaaatttagatcattcatcagagcacgtgatcaaatgttgattgaaattgttacaaattcgtataaactgttttttttttcacgctggatttttggattatag

SEQ ID NO: 7272 - DNA, 267 bp, Candida albicans
tcaaataatcctttccgtcaagcatccattagtcaaacccaaccacgcaataattttgatgaatgggtggacaagaataaacagttgttagatttatctagtgatgaagaagtagaagaagaagaacatggggccgcaatagggttccatcaaagtactgaaagttttggtaaaccaagtgcatttccacatactcctgttagtgcagatagtgattcaagtataaactatgcaaggtatgtatttaatcttttatttaaatattaa

SEQ ID NO: 7273 - DNA, 795 bp, Candida albicans
aaacttcaatttatagcaccggcatgtaaccaaattcctgatttatacaattttttcgaggatggtctcaacttgaattctgaactaagtgctaaaattttggcaatttgtgcctcgcaaaacaaactcgaaaacaagattatggagagaagagaagaatttcaaaactattacaactccaacatcaatgattctcgacttgcatttgatatcttgtttcttggttacgtgggtacacacattgaggtgaaggagttagatgttcaaactttgatcggacttttgagcaattcgcaacttaccaatgatgacaatattctggcagcttctactgcattgggattgattgctcaaaaacacattgactcggctgtccctattatattaaatgcctatgaaagtagcgagaagacaattatcagagggtcattagtcgattctttaagtatcgctgctgatgcctgtaacgaggaccaaaaaagagtgatttgggataaagtttttaatttccccgttgagtttgatcacgaagtgattacagaactaaaaaaatcaggagaattattaggtaagattccagttgttgatgagcttacaatcaatacagacaatttgaaaacaacttatcttattcttgtcatcacaaagtctttgctcaataatcttcaagcaacaaaagttaacaataccttattggattcgttgatcaaatcatcaattgaatggcttaacatagtgaatattgatattagacaaattgttgttggcaatttactcacaggtttgcccagttaa

SEQ ID NO: 7274 - DNA, 183 bp, Candida albicans
aaagaaggaactattattagtagcaaaatttttttagttttttatgcgttggtaagatcgacaaccaaaaaaaaaaacaacagtgaaaaaaaaaaaaacttgagtggacgggacgcggtaggtggtgaaaaaaaaagtcgtgttccaaacgatccagaactagaactaaaccaattcaaatga

SEQ ID NO: 7275 - DNA, 216 bp, Candida albicans
ctcatgttgaaaatatgcaaaccaccattgatagaattgatgctcatttggatggattatataaagctatgccatatttataaccaagacatattagatatcaagctacagttgtgtccactgaaatcaagaatttattatttctccattttggaagtctttattgatgtagggaatgggattctaacaaattactattgttcaattattctttag

SEQ ID NO: 7276 - DNA, 579 bp, Candida albicans
tttaatgaaggaaataaatatatgatattccattttaaccaaaaagagaaagcagattcaagtaaatgtaaaacaatacatgtaagaaagagtattgaaaattgggcaattatacttttatacatactatttgtctggtatcgcaagtctgaacttcattatgaccatataattcataccaatttttggggtgttgaaaaaaataaaccgccatttttgttccaaacaaaaaactcaatacctcaattatttcaattctctataccaacccaacctactgccataacacaaacaatgtcatatcatctaaatatactatctgtattatcacgatctccttcaccactgccacaaccacaaccgcaaccactgcaacagcagctactgctgtcatcttctcatccagatccagcacctgaagatgataaacttgccagagaatccgatgtcactgtatcaaatattactctgctgctggaagcagaatatcgaggattttccattcatataataagtaccattggattaattatatggataatttggacattattacccgattctttatcacatacctta

SEQ ID NO: 7277 - DNA, 201 bp, Candida albicans
tcaagtcaatttttcccatacatactttttgatccggaaccgcctcaaagaggacatcaacctacgttttctgtttatatatttccttttataaaccaaataatagaggaaaaagtcgttgcagaagtcaaaaaattgacaacacaaaaagagagagagaaaaagaatttaagaaaaaaaaacacgaccctaattaattag

SEQ ID NO: 7278 - DNA, 189 bp, Candida albicans
ttatcttatcccacttcacaacaacaccaacaattaccaatccaatccaatccaacatttttatttcttaaaaattttttgttatttttttactatagttttattttatttcgttattgtttgaatttcaaaactgtttataaactattcttctttcttttaattttgtttattgttgtttccttgtga

SEQ ID NO: 7279 - DNA, 225 bp, Candida albicans
attactatcaaaatttggcaaccaaaaatatatacactacaatgtaatattccaaaacaactacaacatattattataatagtaacaataattgcagtaccaatgggtcatatggatgttaatcatacttacactttatccatgcagctatatatcgaggttttagttcaacaaattatcaattttattacggtattgttttcgtgctcaccacgggtgaaagag

SEQ ID NO: 7280 - DNA, 246 bp, Candida albicans
  unsure (187): Identity of nucleotide sequences at the above locations are unknown.
aggtaccatgattttttttttttttttttgaaaaaaaaaacaacaaaatttcctatttacattgtttgtttgatatccagtttcaaaaaaaaatccatcccttcacaagatattcaaattttaccctataataataaactaaacctaataaaattatacataaaaaatgaaaacaattttagtggcngggaagaaaaagaaaaactctcattcaacttaaataccgccaaaatgaccacccagtga

SEQ ID NO: 7281 - DNA, 183 bp, Candida albicans
  unsure (50): Identity of nucleotide sequences at the above locations are unknown.
atggtccaatcttcctatgcctttggagattacttgattttcgaaagaanaatttatcttcctaaaatcctgggggatttgaaaaaagaaaaggttggttggtttaacaaggtgggaaataaaaaggagttggaaattgaaacgggggtatttccttttctccgtagctctgtcatcttctcc

SEQ ID NO: 7282 - DNA, 219 bp, Candida albicans
aagtataacaatgcgatttcgaaatcaagattgtacgttaaatttcgagcacaaagtgtggatgtaataaagataatagagtggtggttgtggaggaggtggtggagcccgccgtcgttgtctagtggtgtatcaccaccaactccctttttgcaaaaaaaaaaaagaaatccgactaaaatagattgctttaatttaagtttatatgtatgtctataa

SEQ ID NO: 7283 - DNA, 189 bp, Candida albicans
ctcatttataagaagagtaagaagtttgaaagtaagaaaatgataaaaatttggccaaattcaataaaaaaaaaagtatataagaaaagggataagacaaaacgatttaagacaattcaaacaccaaataaggaagaaattttaattatgggacaagttttgatttttttgaaaggacattttctttaa

SEQ ID NO: 7284 - DNA, 204 bp, Candida albicans
aattcatgtcaaatttttttcaaatttatgaaagattcaaacaagcacccaattttattgcaattggcaagattatcatttaacagcacaaaatttacattgattttagatgttcatcaaaatgtgtacccccagacatcattccaattattcaaggcacaaaattcaactcttgataacacccaattatgttaccacacttaa

SEQ ID NO: 7285 - DNA, 420 bp, Candida albicans
caaatgttgggctctactaccaagagaatactagtcaatagttcaaaaagactgattagattcaattcttctaataacagcaaaaatggtggtgatgccgctaaattaaatttgagtgatctcttcaaaagaatcgatcaagtttcagcaaaagctactgagtttaaaaataaaacctcaagctcgagatcatttgaagctggaaataggagacctggttggcaaagaaacgaaaatgataattttgctaataagagggccgtcagaaataactttaatgaaggtgagcaacagcagcaccaacaaataccaaaacaacatcaacagcaaagagaaggaaactcacaggctaactttcgtggtccaagaagcaacgaatttgctccaaggagtaacacaagaccgtccagatttccaaag

SEQ ID NO: 7286 - DNA, 618 bp, Candida albicans
aatttaaataatagattttatcctgaattaaccattcatattatgtatagcaacaatgaggatgaggatggggatgtcgatatcgacgaggattccaattccaattccaatggggtggcaattataactttcccaagatttatgaatacaaaactttataatttattatcaagaaaaatttccatcacattaaatgaatggattaataatttaaattggattgttttaactcattgtcaactaaataataatagtgaaaccatcaataaattaatcatcaataaaatcaatccaacaaacacccatggtttttccattttagatcaaattcctgatttggctccacctcatagttttagtggaattacggcatcaattacatctcaattagatttatttaataatattaatatcattatattatttttgaattgtgaaggttcaccaggttatgaaatttttgataatgaaacaattattaatatttgttatatattaattcaatttttaaatttgaaaaatcatgatggtgataattatggtgataaatttttaaataatatatctaatgcaattagaaatgttaatcgtccttcaaattcaggaatgtatatttga

SEQ ID NO: 7287 - DNA, 234 bp, Candida albicans
ttaatatttacaaaaagaaagaatgaaacagatggaatggaatggaacagatggaatggaaggaattttaaatttaaattaatcaaatcttacagtgaaaagaaaaatagaacgtttcacaacaacatatttaaatgtataattgaaaattatcaaaaagaaaaaaaaaaaagccaggggcataaaggaattctcttcacttatttaatcaccacaatcctatcaatctattag

SEQ ID NO: 7288 - DNA, 582 bp, Candida albicans
tcgggttggaatttctggaatttgcacctttccccaacatattcggttaatagggccaaaaatatttggtttcaaagaatccaattcttcacaatcaattttactgttgttgttaaacataacaaaggattcaaattgcacatcattgatgctacagtggacgatatctattcttcatctaaggcaaaaacaatccgtgatagtttattatcaattaaatcagcaagtgtagttttaactaattcgaaaagaacttcctctttgttggtttcaccttcaataatcatgcaaagcgtatttgatagtttgttggttttatcggccatttctttgttgtcttcagatgttacgtatccaagaattgatactatgtcaattgccaatgaggcaaattctttaaacaagctgttgaaacaatttttcaaaatagtctcaacaaatccaagaatctcatcgtatagttcttgcttggatctcaaccgatgtctatttcttgatccaagtagtatcgacttaaaaatgattattaatgataatttcaattgtttggaagtggcttttaaccatgcacttgacctatga

SEQ ID NO: 7289 - DNA, 300 bp, Candida albicans
aatttttgcaaaaaaaagcactactgtttctctttatatattccatcaccaactaatatcaccaaaacttttttgttccaagtaaccaaagggggagaaactaaaaaaaaaaaaaatagtaatcaataccaaaagagatttctattacattcatacgtcaaacacacaatctggggtttcttatatttttattattattattgttttcatttttgtatcctattagccattgatattacgaattttagttatttattcctgaattttttcaactattggcataataatagcagatcatga

SEQ ID NO: 7290 - DNA, 276 bp, Candida albicans
gcaagctcggaccttccattcgctggtgaagatgtatctagtgatagtgatagtgcgtgtgcgtgtctgaatgaacaaaaaaaaattcgacaacaacaattgaatttatttttatcaccatacaaataccacccaaaggatatttcatacttggtttattggtttactcattcaattcctatcgattcatcattcccccatatttatttgcattcaagtttttctgtctttttctattacattcattattatataatatttcactttttttattaa

SEQ ID NO: 7291 - DNA, 201 bp, Candida albicans
tatataatgtctggtgaagaagttattaatagtaccaataggccaaatactattcaatcaagtggtagtggcacatcgaatacaaattatgccaatgcatttaatattggatatcaaaaccatttcttccaacaacaacaacaacagtcactgccacccacacaacaatcctttcaaccacctatgctactggaatattaa

SEQ ID NO: 7292 - DNA, 270 bp, Candida albicans
atataccgggaattatcaaccctgcctaatggaggagaagatgaagatgaaaatgctacaataaattctcatacttctcatattagcaataatgggaataaaagaccagtatcgatatcaggatttagcaatggaatattaagaaaagaatttaaaaaaatagtgagtgatatacaagatcaatatgaaatggaattagctgaagaaagattaagaagaagaaaattacaagaacaattagatcaatcaggggtggtggggaaatcatag

SEQ ID NO: 7293 - DNA, 186 bp, Candida albicans
  unsure (110): Identity of nucleotide sequences at the above locations are unknown.
cttcttgtttcttctggttcaataacatctctttcccaatacatacagtcggaatcagttgtaatccaatttctaactacaattgttccccaaaatcaattaactgcccncgagaacatcagtgagaaatttaccaccaataataacttggaaacaatagcccaaaaaaaaaagggggataaatga

SEQ ID NO: 7294 - DNA, 195 bp, Candida albicans
accagaagaaacaagaagctacagaatagacatgtcaattgtacatattcaagtggattgtcgtctaattgttgtttccaattcacgttttatgttgtgattgatatggatattgcaacaattatcagaaaatcagatagtgtgatcttctctagggttagagttggtgagagaatggcattaaaagtactataa

SEQ ID NO: 7295 - DNA, 195 bp, Candida albicans
tttatctttaaatttaagattcttctttttattcttctttttccgattctttcttttccttcttttcttggaagtaccaccaccactacctccactactactacgacaactaattccattacttccactggcactactgctactcccactgctgctactactgctagtatgaccatcattatcaccattagatga

SEQ ID NO: 7296 - DNA, 429 bp, Candida albicans
cggcgacgacgacgacgatcaccactactgatgttaccttcattatttgaattttctgaacctgaaccagagccagagccggaaccagagccagagccggaaccagaaccagcagctgaaacagaagcagaacctgaactaggtgtagatccagaaacaaacccagaacttgatcctgataaaccatcttgtaattctttccctgatgatgttgatgatgatacatcatttgaaacacttgaaaaatatgaatttgatttatctttaaatttaagattcttctttttattcttctttttccgattctttcttttccttcttttcttggaagtaccaccaccactacctccactactactacgacaactaattccattacttccactggcactactgctactcccactgctgctactactgctagtatga

SEQ ID NO: 7297 - DNA, 1329 bp, Candida albicans
catgaatcagaatcatcttcatgtgcaaatatgattaccccaccggtaccaatcacagggataagtgatgaaatagatgatcaaaactcattgagttcatctaatggtgataatgatggtcatactagcagtagtagcagcagtgggagtagcagtagtgccagtggaagtaatggaattagttgtcgtagtagtagtggaggtagtggtggtggtacttccaagaaaagaaggaaaagaaagaatcggaaaaagaagaataaaaagaagaatcttaaatttaaagataaatcaaattcatatttttcaagtgtttcaaatgatgtatcatcatcaacatcatcagggaaagaattacaagatggtttatcaggatcaagttctgggtttgtttctggatctacacctagttcaggttctgcttctgtttcagctgctggttctggttccggctctggctctggttccggctctggctctggttcaggttcagaaaattcaaataatgaaggtaacatcagtagtggtgatcgtcgtcgtcgtcgccgtcataaacgtcgtcaacatcgtggtgcaaaagatatttatcgagaagcatcaaattcaggttctgattccatatattccaaggatagtgcactttcattaaataaaggatctactaattcttccactaattcaagtgttatatgggataaagattccaatggtggtggtagtggtggtggtgtgaaaccatcaactaacagtaccaagaatggtatatccttattgtcgaagaatgataaaaagaaacctattaatattgctactactaactcttctgataagaagaaaaataataaaaagaagaagaataattctagtactcatcgtcatcgtcatgatgatggtcctgatcaacatggaactaataatggatcagaagaaggtggtgatgaagatgaagatatttcaatggatgaaggtgatgaagaagaagattatgttttaatggaagaaaaaaataataataacaatgatgataaattgaaattgaaattgaaattgaaattaaacaacaatgacaataacccgacaattcaagtattacaaaaggagaaggagaatattaagtctgttgttgataaagattcaccatcaccaccaccaccaccacctcctcatcttcctcctaaattacctctgatttcacaattattaggagaaaatttccaatcaaacactagaccatttggtggtgatggtgatggtgataatgatgataatggatcaaataataaattaccaccaattacgaaaaaagttgaaaaatggaaagatcgttaa

SEQ ID NO: 7298 - DNA, 408 bp, Candida albicans
aaccggccctttgtatcatttaaagtgtcactacacaatttgttgtaccaactcaaagagccagaattgattgacgatcatggaattttaagtcatcttggtaatgacgatttccaatgtaaactatctgttaatgaggaagaagtttctaatgttgctgattgtttcaaggaagaaaagggggaagatgttgttttaggggtgcaatatgatgtcaaattgagttacggattgaatgttttgtcttttaattgtaaggttgctcctgctttaagtaagaaaatcaaaaacaccttcattgaagaagaggaagtagcagggagacacacaaggcatcaattgcaacaaatgcaaaaaacatgggatgttgaaacaataactttttatgttgtctgtacctcaggatga

SEQ ID NO: 7299 - DNA, 198 bp, Candida albicans
ttcatcaaccatgttggaagtgtcgcattaaataaacttatcgccatgtgtgtgtgtgtcgttttttgttttttctcgaaacaatttctgttgttgttgtgtgaaccacctccacttccaccaccagaaaaagataaaaaaatttttcagttgttgttgttgttgttgttgttaatttttttctgcttctctgtgtaa

SEQ ID NO: 7300 - DNA, 288 bp, Candida albicans
aaccggttgggtgttgataagaaaatttgggcggggtcaagacttatgggtgatgtttctcttgcttgcccaatttattatcttttgtcacctcttttttacaacagttttaaacaacggcacgcggagatattgatttggggtgatattacacgcatacagaccacacatacatactctccatgtaaaagtttagacagcaaaatcgataactgcgaagatgatgaactcattccaccttgtgaaaaaaaaaaaattattattattattattattataataacgtaa

SEQ ID NO: 7301 - DNA, 249 bp, Candida albicans
ttatttatattccaactaactactactactacaatattattagttaataggtgtcacaagactttttaccccatagtcattctgtttttgaattatcccgctagttatggttattattattttaacttgtatctggttattattatattaaaaagaagaagaaagtggtggagaagaagaagacttggaagtttgtttttagttttaaaattaatctatggaacaaaatgtaaagtaaaggaattttaa

SEQ ID NO: 7302 - DNA, 192 bp, Candida albicans
tgttggccacggccatgcaaagatagagactttctaaggatccaaagtcatataaattcatttgagcaatttaggaaacttgttgtcatagggattcagaacgcaacgttctgtgacttgcttgcaatgtgggatttggtatatagtaacggttttatgatgtcggttgatattacaaacgtcgggtgttag

SEQ ID NO: 7303 - DNA, 192 bp, Candida albicans
ctgattaccatatggtgctcaagcacaggtcaaactattccgatactagctgcaaccgcgatacaaacagccatattacaagacactgtccattttccaatgcaacaagaaatttacgctatcacgaggcattttaccaaactaacactgagaaataccatgcatcaaaacaatgttgcaccaagttgctga

SEQ ID NO: 7304 - DNA, 204 bp, Candida albicans
agtggaaataggtgtatgaaacgtattcgatatcaccgtgatcctactctttgtattgttataatttttaaatacctttcattgaccaccattagtcctaaaacaaaccaaaaactccaaaagcaaacaaaaccaccaaaaaaaaaaaacaggccaacaataattgctgaaaaacacaaaaagacagccaaattaattaactaa

SEQ ID NO: 7305 - DNA, 489 bp, Candida albicans
  unsure (26),(59),(138): Identity of nucleotide sequences at the above locations are unknown.
acaggatacttattcatgagtgaaanagacaaattgaaacagcaatatcaagcagaacnacagggatactttagacctgaagcccttcccccaccatatgaagaaatccaatcgcaacagaatccttatggtggaganacgagaccacagcaaggatatgataataaaccatacccagatcaactgtatcaacaacaacaacaacagcagcagcaacagcaagtgccagacccactcaatgatcctaatgtttataaaatacagcccgaaaaggtgaatataactttagcacctccagaacacttgaatcctcaatatcaagagtatctagctaacgaaccagaccgttttaaaagaggtgattacccaaacaagtattataaacacggcgcaccattgaatgagggtcatgttaattccagcaataagagtaataaaggattccctggtagaagtggagttacctaccatagagctgctaatctgtaa

SEQ ID NO: 7306 - DNA, 273 bp, Candida albicans
accatattggtggttttttacatcgatagagctattaagatcaccagcctcgtttataataaacttagtctaatatttcttttggaccaaaatagaaactgttctcaggtggcaaaaaacagcttaaagtctgtgttaaaaaaagatctcggctatgccaatcaaaaaggagtgacattattatgtaaaagaagaaatgttgtaattccgcgaaacaacaattttaatgcttactgtgccgccaccaatatcctatggccaaggggcctttaa

SEQ ID NO: 7307 - DNA, 204 bp, Candida albicans
aattgcggtaccttccaggcccggggtgaagaccaattggaattgataagcaatgcacaaacgccaaaatccgttgaagatatatggaacctcaaattattatttgaatatgctaatcatattgctcgaaataacaaattgaattacatatctcttgagttcattgagggattaaaacataaactatggagagttcgtaattaa

SEQ ID NO: 7308 - DNA, 369 bp, Candida albicans
attaggaaattgaaaatgccactcaaacctatttcgtttagatggtcgaaaacctctgttcgactggtaccaaacccattcatgtacggtccagataatctcaacaaacccttatcacgggcatcacagatggcagaacgagtgcaccaacaaacaccaagttcaaccaattatcaacaaagacgctattttagttattattattatcaatttcctaaaattccaagaccaaaaagaaacatgttgtactattctacatggtcaagaaacccagttactaatgctagtaatgctaacaaacctagtaaacgtcatatgttaccttttggcagtttcaagactcttcaccacgaggtggaaggaccacgt

SEQ ID NO: 7309 - DNA, 198 bp, Candida albicans
ttggttgaacttggtgtttgttggtgcactcgttctgccatctgtgatgcccgtgataagggtttgttgagattatctggaccgtacatgaatgggtttggtaccagtcgaacagaggttttcgaccatctaaacgaaataggtttgagtggcattttcaatttcctaattcagtcaaacaaaggagtaacgaaataa

SEQ ID NO: 7310 - DNA, 240 bp, Candida albicans
  unsure (7): Identity of nucleotide sequences at the above locations are unknown.
gagaggnggggttttttcctttccccccccccctcgtgtttatttctgaccaatgtatatataatactatttatatttaacatatttaaacacaacgtttcaattatgccaacaaatagttataaaattaatcttaaagctaataaatctattcattacacattatattatggtacatttattcatacccgtgatttaaccaactttagaaatcaatttcaatacattagtgggagttaa

SEQ ID NO: 7311 - DNA, 192 bp, Candida albicans
tttggaggaatattcataataggcaatccggacacacaagaaccccctttggtatcaataaatggttattatgaaagtattaatgtaaaggaaagaagaaaaaaaaaaccaaagattactaaacttcagtgttgtggtaatcacagaaaaagttttcccttaaaattttctctctttgtagtttcacagtag

SEQ ID NO: 7312 - DNA, 297 bp, Candida albicans
atgtatataatactaaaaaagaataaaatttactcagttatacattacatattacatgagaacatactatgcaatataaagagtataatatgtacttttaagactttggggaaaaaattaaatgtagagggggccagacttctgagtacaagtaataagatctcattattggtatactttcaaacattagaagcaaaaaaaaaaataaaaaatgagaaatcactcaaaacttgtactactagaaagaaggtaaagacaggtgggaggggggactccaatagaaagtttgataattaa

SEQ ID NO: 7313 - DNA, 237 bp, Candida albicans
ggtgtttgcgccttgcgttttcattttgtctatttcatctttcttattattagttatttattgatctctatcgtaataataatagtttggttatctatttttagtttacaaaatattaaagaaggaaattacaaaatgaaagaagaatatatagtaaggaaaaactcaagatatttcgaagatttggaaaacaattcatatcaacaacaaaagaataggacaagtggattttattga

SEQ ID NO: 7314 - DNA, 423 bp, Candida albicans
aattgtcagcgcggtcttgccgccctgtggtggaagacagtgaccgtctttctggattttgttaaaaattttgcttccactatatccgttacattggcacaattactttatcaaacaacagggcaaaaatacattaccgacatgatgggaaatttaccagaagattcacaagactataaagatttaaacaaatacactgcagcaaagtttatttccaatccagaaattgtacaagatttacctgatctggccaaaagtttggtattgagtcaacttatgaaggcattgaaaaacgtgttttatttgggtcttgggttggctattctatgttttatcacatcgcttttcaccacaaataaaaagatacccaaaaacgtagaaatcaagaaaaacgacgacgaagaaagtaataagaacgaatag

SEQ ID NO: 7315 - DNA, 192 bp, Candida albicans
aagcagaagtctaaaaagtttatttactcaaggaatcctataaaggctttaaaaacgactgccacaaaaatactcggcgtagagaacacctttacgccttgtgctcattatgtgaaagattcacaaaacatggctcaaagtccaattactatgatgaattgcggtggctttgtttggtttgagttgacttag

SEQ ID NO: 7316 - DNA, 207 bp, Candida albicans
  unsure (181): Identity of nucleotide sequences at the above locations are unknown.
aaattattcgttaggctttgcttcctggtatggaagctgaaagaagaattaagatctcttggattttttgacgtttatacatttttcactgagaagttcaaatcaaatagcatcggtagaagtttcccatggactgaaagcatttttgtttatgtactgaagtcttattttgtcttcaccnacgccgaagaagatccgaattgcgta

SEQ ID NO: 7317 - DNA, 516 bp, Candida albicans
acaaatatgccaaacaaaatcaggaaattgaccccttgtaaaactcattctgatagtatatctattgaggcattaatgtctgcacctaaagatttgatttctcagtttttgagtttgattggatatttattacccattacatattcaacatctgatgctttatatttaagacctaattacgaccaatatcaggatagacaaaatataaaccaaactaggattgaattatgcacccaacttataccgaatgagtattggaagtttgtcaatgatatatggtcattattaattctaagtttccaagcaaccatggattttgagattagacgtaaagggtttgtcaacttgtatcgtataatttgttcaaatgagagcgatttttcactcattaaagatgtggattttattgcagggttacttgctaacgttgtcactcaatatcaatcaattgtaatcaaagaatttgcaagtgtggagagtaatgatgactatatggtgagcaccgatgttgaataa

SEQ ID NO: 7318 - DNA, 198 bp, Candida albicans
gcaccgatgttgaataaaatgatgaacttggtcaagctagtacatcccaagaagactaatactactattatgattaatattaatactatgatgttgtttattaatatgaatatgaagagttttctatcctatatagtcgaggtacatctagtattcaaagcagtacatcatcattaccagaagatgtcaataaattga

SEQ ID NO: 7319 - DNA, 531 bp, Candida albicans
ctctaccgtcctcttatcacttctcttcttcttttctcactcatcctctcctacttttccctcctttacatcttcttatcctccgccacttatattcctccacttcatcccctcctctccctgtattcaccaaaccagtggtgcactatctctttaaagcacattaaatatcaagtggtttatccaggaacttatactggcggccctaattttgtacatcaacaatacccttattacgtatcatcgtcaccagcccaagcttcacagcaatatattataccaccagtagtgggacagccccacctacaacaacaacaactatcaacacaaccacctgctcagccaaaacaacaacaacaaccagtaccatctcatcattttgagtcacctgacaaaacaactggcaaatctgaggacgataccacacctaataaaagacataagaattctaaaggtggtagtataaatttcatgatcactacacccaagaatccaccaaaaaaaaggtacaacaattcatccagtaaatag

SEQ ID NO: 7320 - DNA, 294 bp, Candida albicans
ctcaatatgccaaagagggagctcttggtaagatttcttttggtagtggtaaaaagccaagacaacaattggaaattatcagtaaagctgctgagagacaaaagcaagaaattcaatttgttgccagaaagaggggttaagcattatagcaaaaagaacatttggagtatattagcaaatattattggcgaatttaaggaatgtgaaagggaatcaagaactagagctgatgttgatactagtacattatgggaatcattggagtattggagcattcttcatcatctggggtga

SEQ ID NO: 7321 - DNA, 255 bp, Candida albicans
tataaaaatataatttcgttatcgtctattggtggttatggtggtagtgatcgtttgctaaaccctcgatcgttccccctttttttttttactcttgcccgttatgtatttttcttcattgtttctctgctcacttatcttgtgacttgtagtagtaacagtaataaaatatcacacttacagcaacagttgttgttgttgtcatcaatttcaaatgatgtcttaagcgccgggctggaaggtattgctggagag

SEQ ID NO: 7322 - DNA, 189 bp, Candida albicans
tcggatgtagcaaccagtagtgatgataacttaatatcaatcaatcagataaataacaagactaacgacaacaacaccatagccactgaggttcataatttaacagagatcgacaaaatcagaactaagaaggtaaagaattcagcaaccaatagcacgataaagaaaacaaaaacgtttattttgtaa

SEQ ID NO: 7323 - DNA, 522 bp, Candida albicans
ttacatttcttaattcaatttcatctttcaatagattcacagatacatatatacacccatatctatatccattatccatataatagactatcctccattttggtgtcaacaatccattattatcaattaaccatgtctaggataaataacaacaatgacaaatcatctatactatcaaatatcactaccaccgacactactactggcaccggcaccactaatacaacaactgttccctcaattaaaacaaagagagggttatcatatatattaggagattccaattcaaatgaaaatcatattctacccatcaattctattcagtattcctcatcaaaccgtcaattatacactgccggtagggatgggaatgttaaagtctggcaaccacatagtattcaaccatattccaatcagcatagcggaaacaatagccaggatgatttgttttccgattgtgtagatcttgatgaaaaattgttacgtttagaaacttcaatatcatctaatcccttatcatac

SEQ ID NO: 7324 - DNA, 201 bp, Candida albicans
  unsure (158): Identity of nucleotide sequences at the above locations are unknown.
gatatcatcaagttacattgtatcatctaccgccacaaatggcatcagcatggagagaatgaatatggtcaaagaatactaacccaagtgtcacgtgctgcattatgtgccaaggatcaagcgggggaaaatatcatgaacttaactcgtgctatcantgaaccgatggaacgggaagaattttgctcagaacaagagtga

SEQ ID NO: 7325 - DNA, 210 bp, Candida albicans
cacccgaaccgccacttggacatcgggacgatggagatgacgatggagtgggtgaagaatgagaacaaatccatttggtcatcatctcagcaacaacagcaacaacaatatttgcaaccattgactgagatatcatcaagttacattgtatcatctaccgccacaaatggcatcagcatggagagaatgaatatggtcaaagaatactaa

SEQ ID NO: 7326 - DNA, 189 bp, Candida albicans
tgtcaagagagtcaaagtacgtacgtagagtcattagaaattgcaaactatgtgtatgcaaattcaagtacaaagttgaatgttaatgtgtaccaattgtataatattcacttcaaagaaactaataatttctggacagcaaaaaatggtttgaagatctgttattggcccattaccttggtgaagtaa

SEQ ID NO: 7327 - DNA, 195 bp, Candida albicans
ctctacgtacgtactttgactctcttgacattaaataaacaaatcaaaactcatttcgatgaccggataaacggaactgaaaataccataaaagaactctctgtactgtatgttccgtgttcaaacaatggaaaaatttcaagtgatagcgaggttacaatagatgttaggattgtagtgctgaggactgcatag

SEQ ID NO: 7328 - DNA, 237 bp, Candida albicans
cacttatctcatcagttaattcttcaactgtcatctgttgtgttagagatatctcatagaattatgattagtgttgtacaagatcaggtcacctcgaggaaaaaaaatggatttgaaaaatacaggaaattagtcaacagaagtttgatgagtatatacaccaagaagtttgactcttctcttgaaattacaatcatggcacatccatacaagatggacagtttaaatactggataa

SEQ ID NO: 7329 - DNA, 345 bp, Candida albicans
aatctatgttttagtaagagttggtggtttttccttttttttttgactattctttttcattttgccatgggggaagtggagtggtgctatggggacattcgcatgtatgccgttttagtgagtgacccagaaaaaacacataaaaaaaatctcaacctttttttttcgagcagttttttagaaattgtgcatatttttttccgatctcatcgtttggtatggaaattagaatttttacaattgttaccgaataacaaaaaaagcaagaagacgacaagtattcgatatttgtatttacataccgattacatagctagagttttttgtccactactaacgatataa

SEQ ID NO: 7330 - DNA, 231 bp, Candida albicans
ttttccatcaatgctccgagtttagtttcatttatcctttttttctttttctacatcatcctcacaacaatttcaaatatgtctcaagacaacgtctcatcaacatctacagctgaggctgtaaataatgaaatcaaagtcaaagatgaatttccacaagaagaacaagctcatactagtttagaagataaaccagtgagtgcatacattggtatcatcattatgtgtttc

SEQ ID NO: 7331 - DNA, 276 bp, Candida albicans
ctaaacatttattatgttgttgttgttgctattagcaaagattggatgtttttattaaagtcattatttaaaaatttactcaatatttctaagcctaggaaaggaatgcaaaaaagaatatggaagaatgaattcccgggtattgaaataacagtaacaattgtttctccacgggtgacaaatttttcgttttttaagaaatggtccgctgtatactccgcatgtcaggaattaaatgttgtatgttccgaatcgggatctcacgtgaccacttaa

SEQ ID NO: 7332 - DNA, 270 bp, Candida albicans
actgtccggaagtattgcgtaacgggcctagtttcgataagagtaaaccaattgttggctgttgttaaaattattttagggtttggcgaatgcaacattgcttgctggaggcaacggaagcaggattgtgaggggattagatatgtgggctacttcttccagctagcgtattggaagtttaagaacagaatagtttgtcatatacctgcaaatgaatgttgcacacattacgtgatattaagaatacttgctataagagcctgtgcatga

SEQ ID NO: 7333 - DNA, 537 bp, Candida albicans
  unsure (501),(515),(530),(532): Identity of nucleotide sequences at the above locations are unknown.
aaaaatttcaagactgaaaaaaaaatttttcactttgactttctttcatcaatcatagtatcattcaagatggagttgagttatagatcgtatcaaaaggtgttgaatatttcattgaaaccaaaaacaactcacgcctgttccaaaaaggctaccgctgccgcaaccacaaaaaaaatcgccaaaccaaagcgtgacgaaactcaaatcaaacgcagaactaaaactggttgtttgacttgtcgaaagagaaagaagaaatgtgatgaagataaagtgaatggcaaatgtcaagcctgtaccagaaacttcttggattgttgttggccagacccaaacactattaagaccaaaaataccaaaccacaacaacaagcacaacaatctacagaagtgaaaccacaaataagtccagtagtaaggcccaaaaaatgtgatatcaactatttagtacactctaaacctgaacttttaactccagtgacacagttgtgttactcnactattgagcaacnaggcgcaaaagtacngngtgaa

SEQ ID NO: 7334 - DNA, 204 bp, Candida albicans
ttaaccgctcgttttcaattgcaatttgtggaaaaacatttgcgaaaatggcaactcacacagaaccaagttattttttcggaaggtgacaccacacaactaagcgaaaatggcaaaaacccatcaaaaaaaaaaaaaagaaaagaaattgagtgccacttgacgcgctaccacgcgcacccaagattatgtcaaattttttga

SEQ ID NO: 7335 - DNA, 267 bp, Candida albicans
atttaccaaaagtattctgatttgaaaacgccaagtgataactacactgacagaaaccttttgttgaatgggtctcatgaacatttgatggaagatgaattggctgctggtatacaacaaatgaaattgcatgacaatatttatcctcaacaccaccaaggcttgtttagtgatgaccaccacaatgatgatttggctcaagttgatttcccaaaatttggtattaataatgatggttcccgttccatctttgggatcccacgttag

SEQ ID NO: 7336 - DNA, 189 bp, Candida albicans
tgtgatatgatatggtattgtttgttttattttgttcaaagggtacaaattgaaagactacaaaccatgatatataatggtgacgatgaaaatacaataggagaaaataaaaaagaaaaaacccgaaacttaaaactcaaaaccccaaaaccccaaaacaatactaatagtaacaaaacaaaaaaatga

SEQ ID NO: 7337 - DNA, 348 bp, Candida albicans
tgtacaacgggagatccactaattcgatctttggtggtgttggtggtggtggtggtgcactgccattcacttttggtggtttattacttttgggacgttttggcggtggatgatacatatactgcggctgcattacaaattgttgttgctgttgttgttgccgtcgttggtgttgttgttgttggaaaaagggatctggcggatagggaaacaccggatacatctgattcatcatcatgggatatgtctgaggaaactgatagtaaaactgttgttgcgcaggaatctgctgtgccatatattgttgcgggtgaaactgttgctggtggtagtttgggtattggctag

SEQ ID NO: 7338 - DNA, 249 bp, Candida albicans
aatacaactcacacatgttcgagattgatctatgtcgtgtgtgagtggacaaacatgaacgaaaaaaaaaaaagggcaaaaattttttttttctctggtgctgatcaccactttccaccaactcttatttcaacagcaccaccaacaccaagaacggatacgtggtatagtactttatttattgttcatctaaacgcatctgcattatcacagaaccaacaacacccaccctctttttataacgcctga

SEQ ID NO: 7339 - DNA, 231 bp, Candida albicans
tgtcataaatttgaatttgaatttgaactgaaatttgtaccaaatttgatagtgaaaattattgtctctttgtcaattgacatttattgccgttcatccacaatatacaaacctaaaacaaagtcgatcaccaagaagagtagtacaccccaaaagaagaagagagcaacaaacaattcaaatttgaaatcatcatcaaagggagaagaggggtggggagtggggggttaa

SEQ ID NO: 7340 - DNA, 186 bp, Candida albicans
tgcttacaaatattttgtttcgtaatgggaaatttaaaagatccgcccgtgattagatctttatatcaacaattcaaatacagaccaagaggcaaaagtgttgttgggaaatttttatatttgaaacttgttcaacgatatttggacgacataatagcatattggcatctactgaaatctttctga

SEQ ID NO: 7341 - DNA, 363 bp, Candida albicans
aacgaacgtccgcaccaacttgaacgtgaacaagagaacaaacacgaacaaaaacaaaaacaagagtatgactttggtattaagcatcagcatgaacatgttgatgtaaaggtggatctgaaattgggagaaagacaatatcaacaacaacaacagctgggacttggacaagataacaataacaccccacgcaagaacaatgttatccaaagtggtgttgacccaaatgatgatggtgttcatcatcttacgaaagtagtttccgatgacactacaagaaccgataagacagttacaaaacccaatcaaaatttcattggtcaaggttttggtaaagaagaggagcttaaagttcaattttga

SEQ ID NO: 7342 - DNA, 225 bp, Candida albicans
tataatttatacatacatatatatatatatatatacgaatattttttagaaatgttttacaataaagaatatagtagaaatgtaagacaacgtgaaaaagttgatttaaccttttgtggggaagagaacatggagggggtattaattaagcagtatcaaatgattctttaccgaaatctggtttaccacccaaagtggcaaagatatcaccaacataatttttag

SEQ ID NO: 7343 - DNA, 552 bp, Candida albicans
cttctaaagttccatttaaataatggtactgaaggtaatgctaaatttagaaatttatataatgaaactgctgctcaaggattacctaaagttgttaaatgtgattctttaactagtgataattatttcacgggtaatgtattaaatgattattttgctaatttcacattattgatgactaatggttctgctacttattgttctacagctcaagaagataatgctactttagaagtcatgacaagattggctaaacatggcttggttgattatgatagaatcatgatcatgagaactatttctgatttttcaagaccacctccatcaatgtcagcttatgaatatttctttaatagaagtgatggtgggatttctgcaagtttagaaaatttggttattgctggtactccaattattcatgatatcgttcaaaattgggataaaatttatgaaagtggtgaaaaatattcttctaaaaattatgttggtgatatctttgccactttgggtggtaaaccagatttcggtaaagaatcatttgatactgcttaa

SEQ ID NO: 7344 - DNA, 198 bp, Candida albicans
ccatcctcttatcaagaatgtatagtatttaaacggcatcaaacagaatgtcttctgggacataagctaagagaagattcggcagcggggggtgatgaaatcaaacaaatagctattattctacactactatcttagaagtatcttccaattcagatcatcaaaggtatcacgagttaagagatatcaaatatcataa

SEQ ID NO: 7345 - DNA, 285 bp, Candida albicans
ttcggtgatatcgcttggacgtattcccaaatgtacacaaaaatgtatagtcatcctacttacttactactaccaatagaatcaattgtaaaagtcatcaccaccaaccaactaaaacaaaccacattgtgcataattcttctttcttcgtcacgtcacgtcacatcacaattaattgtaattcttcttcttgccgttacatggaacaatccggaacaactttttatagttaatgaacaagaaccaccatatagaaatactttgttgtttattacaattgactaa

SEQ ID NO: 7346 - DNA, 231 bp, Candida albicans
cttggttatatgcaggatactaattatgtaagtcactcactagatttttttttgttcaatcggccaataaggaactgttgttggttgagaagaagaagaagaagaagaagaagaagaggtcacttaattcttctatttaccagaacctcatctttatattttaaacaggtaaacagattaattaagattttaagtaaagaaaatttgagagtattgtatagtgttgtttga

SEQ ID NO: 7347 - DNA, 417 bp, Candida albicans
ccaatcactgacgccatacatatcattagtatagttatatacggagcactagagatagcaatggtttcactttctaatttattagtgtgtttgggattagtagtagttccaactacccttgcattttctgatactgcaccaattatcattcattccaacaaccaggatgcgcttgaaagcaaccataaatatatcacaaaatttgttgatgttaaatcaaaagtagatgaaattattaaggaaagctgtagtgacaaaaacagcaagttatttatttatcaaatcgaggatttaagtattgaatctgaaaattcttggttgtggaccaaagggagctatgctaatgtattatatcatgaaaaaaaagatgcccactacgattttaatgggaaaggtgaaaaaacaggaatctggtaa

SEQ ID NO: 7348 - DNA, 789 bp, Candida albicans
cagaatcaaattaaaactatggagaaacaatatcaggtacaacaacgacaacaactgaaattattgaaaaatgacaataataccagaacaccaacgccgaatccaaatctgaccatatcttcaaattcatcagttatattaccaccatccaaaaaatcaacacctaaaacttcaccccttcgaaaacctcctaaaccaacagttacaccagttaggaaaatggcttctaaacgtccaccttcagttacaaataccccggaaatcaaacctaaagaaagttcttcagaacctataattagtgaatctgattttgaagatttggaaatggatgataaactgacagaagaagttcccattattgaattcaattttgataattatgataatgatgaggataaaaaggaggaagtagtaaataaatcaaagaatgaaaatcaaaatatcacaaaagggatggaactgaaaccaaaaccaaaaccaaaaccaagtgaggaaacttccaagacaaaagtgaaaccacaacctcgaaaacagaaaaaacagaaaaaaccacttagtgaagaaactgttgatttgacagatgatttagatgatgatttcaaagatttagaagatcaattagaagaacttttagaagaagaggaacaacctaaacaacaacaaatcaaggagaccaaatcaaatcaatctatacagaagaaaccatcacctactatagaagttgatccaatagcatttaatgaatccgatgaaaatgattttgaaaaatttcatttcccagggtattaa

SEQ ID NO: 7349 - DNA, 189 bp, Candida albicans
tcatcaactcgtcatatgtttgagaggttatatgtaattgtagtagttgctaacttatcagtaagagatatgaatgcagatgatttttttagtggtggtggtggtagcacctatacgtccgaagcacacgaatgctttggcgtggtgcgcggattctcgtctttttattttttgtcgcaagacgactaa

SEQ ID NO: 7350 - DNA, 402 bp, Candida albicans
attttgctgaccatggatagtgcagaagagaatgaagaagatgcgaacgaagaaaaagaggatgtggaaggtgaatttagtgatgctacacttgaagcagaacttgatggtgacgatgatgaagaattagatcaagatgattttgatgatgatgaaaaggccatgtttgcaattaacgatgaagatgagtttgaagatgacgaaatagagttgaagatgttgggagatgacgacgatgatgaagaagaagaatctgaagaagaagaagaggaaacgaaaaaacgtgcaagagaaaatgattcacattcaaagaaaaagtcaaagaaacagagagtgaaagatttaccaatatttgcttctgctgaagattatgcagaatatttggactctgacaatgaataa

SEQ ID NO: 7351 - DNA, 186 bp, Candida albicans
attttttttttttccaattgttttcttactaaaaataaaacagggaataattattatttgtataccgcgcgctgggattctactttgcctcgtcctcgccttgtctttgcatcgccttgtttgtttgtgttacaactgtctcattcttttcttgatactaacattactatctttcttatcaattga

SEQ ID NO: 7352 - DNA, 186 bp, Candida albicans
aatatggaaactttcccaccaacaattggatggaagggattaaaaccattaaaaccccaggaaattgaagacaacctattaattgaaaaattttcgacctattcattgtattcagttgtcccgtacgattgttatcattcattaataggaaaaacaactaaatccagtcttggcaaaggttattga

SEQ ID NO: 7353 - DNA, 309 bp, Candida albicans
  unsure (46),(190): Identity of nucleotide sequences at the above locations are unknown.
ttatttgaaccattgaccaaagttgcaattgctcctgttaaagttntcccttgtccacctactcgtttattggaacccgtaatttcttggattaaaaacttggatgaattgaacatccacttcgtgttcacctttacggaaaacaataaagttcacctaagttggggtgacacttcaaggggggtgatcnatttaacttatcccttatttggatccgaaacaatcgggactcaattgaataagggtttgggggaatctttgggaattccaaccaccttgggggtgtggaaggaagcgctttcgggataa

SEQ ID NO: 7354 - DNA, 612 bp, Candida albicans
actataatcatggattcagcaagttgcgggccatcaactgctttacaaaatttaaacaagcatgcccaaagagataattctttacaacatcagaggcatcaacaccctcaacaccctcaacagcaaggagcttccattcaccagtttcgtcaaggtcaacaagtggattctagattaaatgccgactttaaacaattcaataatggtaatgattttgctaactcgtttatgaaccaaatgaatataaaaccatcgatgcaacagcaccaacaccagcaacaccagcatcaacaaccagcatgggtgaatgatttttcaaatttgtctattcaacaacagcaccagcaccagaaccagcaacaaaatcaagggactaaatcagattggcatcaacagtttatgcagcaacaacaacaacaacccaataccttacaacaccaatccaacttccaacaaatgacaccaaattatgccatggggagttatcagatgagaaacactgctactacaatgacaccaatgtttcacaatcaaactgaacatcaacaacaacacaagttggaggaggaacagcgtatcttgacccacccggctggatttcctagctggggc

SEQ ID NO: 7355 - DNA, 186 bp, Candida albicans
agtgatggtgtaggtggtattatacggtacacatttttggtttgtatcctttttgagtataatgattgtttacttaatagagggatagctttggtaagtagatattgggtgatattaccacagccgttttatacactaaataatggtataaatgaccctattaacactgggccaaatagtaactag

SEQ ID NO: 7356 - DNA, 480 bp, Candida albicans
ctgaggatttgctcagctttcattcctatctactactgccccatattaaaaatgtctgaaatactcaaagccaatcacagaaaagtatatggtaatgtcagtaatagcagcagcagtagcagcatcagcatgagtccaagtggtagtgctactaacaaaagaagtacaagaagtgctggtgacaacaggtcaaagctttctcatgatatggttgcaggggccgcgtcctttgaagccaccagattatttgaagatagacatcgaagaaacgggaaaccagttagtcatgctttcgccagaaaaactcttattgcacttgccgcatccgaagtggataaattgtttgaagtgaaagaattaacccatttggataaggatcaaataaaaagcgaggcaatcaaggccattgagaaagaatacgagacccattatggtggtcagaggcattggtcgccaaacttcaaaccaataagttggtaa

SEQ ID NO: 7357 - DNA, 273 bp, Candida albicans
aaccaccaaaaaaatcccatccatcgtcaatctgttaatattacccaccaggcaatgctacaatctacgcctaagagctggaaagactttttaaaatctccaaagaagcccactagccctaccaccccaccaggcagtgtgacgatcacaccaaatacaacacctccaagtgtgccatgtgccagtccacgaccagcgaaaatcccttccagagacccatttcaaaccatcaatcgttttcacctaagggagctgcggatccgcataagttag

SEQ ID NO: 7358 - DNA, 333 bp, Candida albicans
tacgattctgtttacaaaggcaaccacgaagccaagttctctcacgaagcagttgctggtgctgcttcatttgctgctgtcaagttgtttgaagatagacaaagaagagaagggaaaccagttagtcacgcctttgctaaagaagctttagctgctattgctggtggagaagtcgacaaattatttgaaaccaaagggttggactatttggatagagagagacttagagatcaagttatcaacaacgctcaaagaggttacgacgaccattacggtcaacacgaagaatggtctccagaacacagaccaccttttgactaccaaagatattaa

SEQ ID NO: 7359 - DNA, 273 bp, Candida albicans
ctattcccaaataatccaccaccattggcaataccagaattaccaaaaagtccaccagaagaagaacccaatgttgtattgttgttattattattactgaacaacccaccggcattacccaatgctcccccagttgtattggtatttgaattagatgcaccgaaaagatttgaagttgtggatgcagcattatttccaaataaacttgtggttgctgctgccggttttgcagttgatccaaataaattagtggttccactggtatttgtttga

SEQ ID NO: 7360 - DNA, 432 bp, Candida albicans
ttgttgttagtgttggaattaccaaataaattcagagtaccaccgccagatgtagaagacgaattaccaaataagttggtactagctgcattcgaggcattatttgttgaattgccaaaaagtgtccctgaagaatttgctgcgttatttgacgagtttccaaacaatcctgaacctgctgctgttgtcgttgtattagtgttcagattaccaaataatccaccaccaccaccaccaccagttgtatttccgaaagtatttgttgatgttgatgtcgatgtagtcgttgctgttggaccagaaaccgaagctcgtcgtccaaaacctgaggatgacccccaattgtttccattggtattgcctgtattgattgatccagatccaaaattaaaggacattatacagaacttagggatcgaattattgttgtag

SEQ ID NO: 7361 - DNA, 183 bp, Candida albicans
tgtaagatatttctttttttagtttatgtacggttgttgttgttattttttaagtgttgttgcttggttatgaagatctttttgttgttgttgatgtggttatttgcccatccggcccctcacagtaacaaaaatgcgattactaacgtcgatgtaataagaaagaaagaaagaacaaactaa

SEQ ID NO: 7362 - DNA, 429 bp, Candida albicans
ataaaggaaagtcaaatatcatcaatgggtaacaaggccaaaggagtgaagcgttctgcagacaaatacaacaataagtcttctaagaaggcaaaggtagctgaaaaacttccttcactttcttccgagagcgaacattcagaagatcaaattgaagaaagtgacgcagaatccagttctggagacgatttggatatcagtgaggacgaagatgaattagatgacttggatgatgaagatgcgaaagaagataacgacaaagaggaggaagatgaagaagaggaagaggaccaagaaaatggaaatagtgacaacatcgatccaaacaaaaaatcatcaaaagagcaacattctgaacagaaaaaggtattgaatgaacgtaaattacagagatcttcaccacggccctggaaagatccgcaattgcta

SEQ ID NO: 7363 - DNA, 288 bp, Candida albicans
aggataatagtgttagttaagtcactagcaacagctaaatatgatatttcttatactattgaatgtctcccaacttccttattgcagggattggttggaaatcctacatattcgtttcaatgggataatattaactggatagcaaccacaataacagtaagaaaaaaaactagaccaaactttgatttcccgcatcatgtgagtcgtatcaaatcatggtacccctctaagaaactatttcatatgaatctaggtttaattggatacacagagttttactatgtctag

SEQ ID NO: 7364 - DNA, 234 bp, Candida albicans
caaatattacatttagacctagatccagatcccaaatcatcctcctcaaaaataaacaagagaaaatttgaatctgaggcggagagatgtagaataattgaggcgacctatttacatgcatacattgatgagattttgatcacaatacaaatcaaacatgcaatcaaagtaatattacaatcaccaccaccacctaaaacgtattgtagattggctggctcattcatcagttga

SEQ ID NO: 7365 - DNA, 366 bp, Candida albicans
cactttctaattttcaaaaacttgtcactttatttgtttctttctaccccaggtctttcacaatcaatattttactcactaacaatgtataccaccaacactttattggatgaaaagctgttcctgttgctgcagaaatatctgatttatcatcaaccattcacaaatacttatcaatcaaatcgatatatttatatcattgataaatatttttgtaaattcattcataatccaattatatcatcaataatattaatattatcatatacttattattattattattactactacaacaacgataattatgattatgatgattattacttaccacaatatctgtgttcttccacaaggagctgttag

SEQ ID NO: 7366 - DNA, 195 bp, Candida albicans
  unsure (72): Identity of nucleotide sequences at the above locations are unknown.
tggagagagatcagttctttgttttggacaacttgttattccgtttttcaagacaacgggtttttagccaanttgttgtttacaccgttacataaccgttctgtggccaatgtgcatatatcgcaatttgcagcacgtgtaacacaaatcacttgtccaaaaccaacaaccaatggatttatatctgtccaataa

SEQ ID NO: 7367 - DNA, 297 bp, Candida albicans
ataacctattttcaccgtgatgtagtatcaggggacaatattatgaggtataaccgaataccaaaaacgagaaaaaaaaccccgaaaaacgtgtcgcttttatataatttattctatgaaaaagtaaatccatatcttcttgttatttatcttgtttgcatttataagataatgttcatgtggtctgctaattgtatagcttaccacgtgcatgctaaaatattatattcaccagattgcaaattgtgtgcattattaaaggatttcaaacaccaagaaaagtggtttatgcagtaa

SEQ ID NO: 7368 - DNA, 195 bp, Candida albicans
  unsure (157),(184),(185),(187),(188),(190): Identity of nucleotide sequences at the above locations are unknown.
tcacggcttggtaatagaaaatcaagacaactgcctcgttgtaaagaaccaggatttgtggcttatactttacattctccaaactcggatgatttgtattcagccacgggggctggaaggaaccgcgctccaccggccgttagcgcgccagaggcanaagaccaccccgcacgtcagcccgccnngnngnaatga

SEQ ID NO: 7369 - DNA, 192 bp, Candida albicans
aggaattataagcaaaaaaaaaatatttctcccgagggtgagtcgaacacccgatccttagatatcaatatccagaatgaacagttacagtctaatgctttaccaactaagctatcgagagtgattttgatgtgctaccatgtgcctggtttgacagatgaaaacaactttataacaatgttgattaattag

SEQ ID NO: 7370 - DNA, 507 bp, Candida albicans
actactactgattcttcaagtactgggtttttccaagtaccaaatagagattatactccttctccagataataatactttgactcgtacattatctaatacatccaagaaatcttcaccattaccaccacaaacaacttcagagaatgcattcagaggtgatggacaacaatcacaatcacaatcacagttgccactgcaacaacagctgcaaccacgacggggattattatttgatgaagaagattctgaagattctgaagatgaaggaatggttattggtggtaaaagagaagaaaagaaattacatggacaaggatataatgcattaagtcaagttgcaggtagaaatggtatccatagtccaagtccacaatttggtaatgctagtgcacatcttcaagatcaagatcaaggtcatgaaaatgaacatgaacatgaacatgaagaaaatcataagaatcttgttggtcaagccagaggtttagctaaacacttctttggataa

SEQ ID NO: 7371 - DNA, 387 bp, Candida albicans
ggcgcgtacgcgggttttcttagcccgtgggtgaggactgaattaattaaaattaatcaattttacaattcaaaagaatcggaaattttcaaaatttataataatttaattcatgatttacaaaatcaaaatattaatattgatgatgtatttaaattcactcaagcttataattattccgatccaaatataataaatactgatgatcatcatcaatatcatttaaaatcaactttatcaagaacagttactaatgctagtgtatttgataccattaatcatattgataatgattatgataataataataacaaccaaaagaataattatgatttggagaaacaaaataatactacagttgcaattcatgatgatgatgattcataa

SEQ ID NO: 7372 - DNA, 219 bp, Candida albicans
cacgacgctgatccggccatcccgtggggaagattaagttcgttgacaacaatctggtttgtggtagatgcaagacgctggtacgttggtccacgtactaatatctctgaagaagatattgtgtatggtgaaaaaactgaagatgagggagatgaaatacctgatgttattgacggtcaaaaagttagtatctcaggcactgaaaagagataccagtaa

SEQ ID NO: 7373 - DNA, 210 bp, Candida albicans
gttttctattcctgtaaatatggctctgtcttgttatcggagaaatattttaaaaagatgtcgcattatgtcgccactcttgaaaaatgcgaagacctcgagacaatagaaatgaaacagccaaaacgaaaaaaaaaaagaagcccacaccacttcaaaaagatattatatctgcaaccaaataatcaaacaacctacgaagaactataa

SEQ ID NO: 7374 - DNA, 1191 bp, Candida albicans
ttcgttcattgcatgacgtgcacaacttcaacagcaagaacatcaaaacaatttgtgaaaaaacgaattccgaaaaaacgtcaaaaacaatattttcaaagttggaaagaagaggcagctttattaaaacaaaaattagctaatgatccaacatttcgtttttcaaaagataaatctcaacaacaacaaaataaagataaagataaagacaataatggtgatactaatggtggtgataatgataacgataatgatataataattgagaaaataattcaattacgtggatcttcaatttttcctcaaaaacaagaaccaaaaattaaaaaaccatttgaacatattgattatagtaaaactaaaaataaaatccctccaacttcaaaacattatactatggatgatttttttaaacctaaatctgagaataaatctgataataatcaatcaagaaaaagaaaaagacaacgacgggataatcaatgtactttgaatttgacaaataatggaagattaactcgacaggttgaatcggaaccacagccgccacagccagaacctgaacctgaaccccaagtagaattagtatcacaactagtgccaaaaccacaagcagaagcagggtcagaactacaaccagaattagaatcagaaccacagacagaagcagggccaaaattgcaagcagaatctgaacttgaactggaactggaattggaaccagaacaacaaccacaaccagaacaacaaccacaaccagaacaacaaccagactcagtttcacaatcagaatccgtgtcagaaccacaaccagactcagtttcacaatcagaatccgtgtcagaactacaaccagaatctgaacctgaaatacgaactgattctgaaccggaaccacaatcccaaccacaatcacaatcacaggaaagctcagtacacaagaaactgactgatgaaactgaacaaaaagaatcaaatcaattacttacacgaaaatcagatatactaaacgatttagttctgaatagctcggaagaagcaattgattcagtttctccaaatcattctcaaaggaaacgcagattgtcatcattgtttccctcttcttcaccttcaccttcaccttcattgccacaattcgatgatggtgataatttccaatgtgatacaattgatgtcactgaatcgcca

SEQ ID NO: 7375 - DNA, 192 bp, Candida albicans
tctaaaatttcaattcttagttgctatattagagcaaacaaaaggaaacaacaacaagaacgagagaaaaagattttagacgtgaaatggaatatatttgaatgcaatagcgtatatttgattccaatagaaaagagaaaaagaattgagagttgcaaaaaactatatttaaacagttttgacaaaccttag

SEQ ID NO: 7376 - DNA, 444 bp, Candida albicans
tgggggccggtgagtagtagccaagttcaaccacattattatttaccaccacacccacaaccacaacaaccaatggtgttattgccatcacaagaatttactttttctcaaccaatgcaatatcaatatccaccattaccattaccattaccacaaccacagcaacaacatttagatccaatgccagttcaagcaccagtatcaatgcaatctatttcatctatttcttcatttacacagaatagtggtagtagtaattctaataatagtcttattaatggtatgtctattggaatgaattctactagtgttgtcactactgcagcttctactgttgctactgctgatgttcaacaacaacaacaacaacatcaactaccaatgatgatgccatattatccattgcaaccacaagctaactcacaacaatttaatttattttaa

SEQ ID NO: 7377 - DNA, 207 bp, Candida albicans
tctcatctcgtcttatgtattaacttaaacccacattatacacatttacacacacacattcctatatattcattcattttattattatcgttaatttggaacaaatcagtattgttgtttgagtattatatagattttgttgttttaattttgtacccattgaaaaaaaataaaaaactcatcgtcatgtttattcccataatttga

SEQ ID NO: 7378 - DNA, 216 bp, Candida albicans
atatatgtttctagagttacaacctacttgaaactcgattccaagactacaagtgtatctaaaatatcattattcatatcttcattaataaaaaaaaagtattctctatatatccatactatactaaatagtactattattataatatccaaatttcaatttgtaaatgttcatgttactctatatatatatatatatgtccttttttggttttaa

SEQ ID NO: 7379 - DNA, 198 bp, Candida albicans
aattcaaacacaaagaaaaatttttttgtcttctttctttacttaattaacaaaaaaatttctcactacgtcatatctttcctattttcaattattatattggtttggttgttttgttgtatacaggatacatatacggtcgctctctttaatttcactcaagtttggaaattactaaccatcttcttctcttcctaa

SEQ ID NO: 7380 - DNA, 261 bp, Candida albicans
tgtaaacaaaaacaaacatttttaaaagtacaagaagggaaagaggcaatagaagaagaagagaaagatactgttccgaataataataattatcccttagagtggtgtttaaaaatattcactggagaaatctatatatatttaaagtattccaccatcaccaagtatagatttgtaaaattttcttttccctttttctttctttctttctttcttttcttcttcttcatcttccaacttcacatttctttctttctataa

SEQ ID NO: 7381 - DNA, 765 bp, Candida albicans
tctgccggccgttgtgaaaacctttcaaagtcggtagttgattttaccgttttggaagcgatgattcaaatggtaggcacagaaaaggcaagattttttttgacaaggtacattcaattgatgaacttgtacgatggtagactttcccaaatagagttgccatgggacaggaaatttgataaatcgagtgcttataaaggattttcaagtatagcagattacactcgttatctatgcacattactacctacaacatccattcatcaaatcagtctacttttggaaaacgaggcaaagagaaacccacaaaatacattccaaatttataaaaaagagcttttggataaggcattatctccgaataaaaaatgtttgggggttttgttagcagtggcatatgattatggtgattttgaagcgtgggatagatatagagcaccacaggtggcaattcgtgaatttcagcggcatgtcaagactacaaaaaccggaatagagccaaacgaatggttatggaacaagtacatcaaattgctcctgaagtatgattacatttcagaattatcaaaaataatgaaatggtgggacgatttgaaattcgagccgagtaagggactactcctactattattgtcggcgttgccacgtgaattttctgaaagacacataaagcatcacgaaaagttgcaactgaaaagagattggccatggccaagtatagaagagtttaatgcatttactgtaaatagagacaccatgaaataa

SEQ ID NO: 7382 - DNA, 888 bp, Candida albicans
aatgtccagcggcgtgtcgaatacatcataggtgagaatgatagtgagtccataaacttcaacaccgatcgaagtggttatgataaatttacaaaagtgaggacagaatcgacacaagaggaagacaatgccaatgctagtttaccttcaattcctgagaccattgatgcagttatgcccagtattcaagaagatggtgccagtgacgaagaagagcaggatgatggtgaagagaaaaatgatattcaagattatcatggcgattctcattcagtcttgccaacaatgaccatgtcgtcaaaatctgattcggtgttgaacgaacatttttatcctaaaccgttattcaaagaagaaagattaactcctgctgcttcaaaagaagatttattaccccaaaagtatagcagcttgttgccttcagaaaatagaagagcttctgatagttcagatgtcactgcaagacaaaggtctgaatcaacatctactgtcactactaattctacggttcaagtgacacccaaagagttggtccctgataaataccctgtttcagattggaaaagtattgttaccatatcacaacctgttgacagaatcgctgcttttaaggatgcattacataaggaacaacaatatgatagtaagttgacgagttggttacattatgcattgaaacgactgcccaatacaagcacaaacttactgattggtagggttgcgtctcaagcgtatcaaaatgctgagcacaacgatcttcggagacatgcttcatttagaagcagagtcaatatcgtcaaagacaaggttgaaggtacgggatcttttggtaaaaagttgttcagtcgtagtaagaagtttattaaatctaccacaggtgataaatag

SEQ ID NO: 7383 - DNA, 285 bp, Candida albicans
aattatgaatctctcggggactgccaaaaggtttataaggggttagtgtctagtggagtttcagttattaagggtaagttggtgggttgtgttcatttttttttggtcccaattggaacggtttttttttattctaaattttggatgcgtccaacaaccacgaacccacccatggcagaaaaaggattttatggtgattacttctatagttttttgacgcgtttaattcttaaacatcgaatattacattatgttgtctacaaaattcactctacggtcacataa

SEQ ID NO: 7384 - DNA, 198 bp, Candida albicans
ggaaccattacttttatcaaagcaatacatgtgtacacaaacaatatgtgcagaactcaatccagatatttggtgagatctattttggctaatcattgtgtattggcaagcacacgtatggcagtttctccaatacttaaccaatcgatcaagttctattcatccaaaaaacatgccaccgacaagagtcaggaataa

SEQ ID NO: 7385 - DNA, 285 bp, Candida albicans
tccacaggacgttcagctaactttgtgaacctttcatctatttcatttgctctcttcacagcactaaatatactgggtagcttgaatgatctaactggtgacaaaacatttaattgtgataaaatccttaaacaaggtagtgctgctcgagatgtgactctaaacatttttcatggagttatatggttctgtagtagtcgtataaaatactttaaaattatggtactagttgagaaaaaaaaaagcatcactaagaatattgaaagttgcacatacgctaagtaa

SEQ ID NO: 7386 - DNA, 567 bp, Candida albicans
aaaatgtttagagtcacatctcgagcagcactaccttgtttaaggattttatcacaattaaatgttttgtcaccagttagatcattcaagctacccagtatatttagtgctgtgaagagagcaaatgaaatagatgaaaggttcacaaagttagctgaacgtcctgtggactataaagttatggaaattataaaacaaatcgatacagaaccagaattattgtttcaattgggatttttcttttatgagtgtaaacgaattggaatcactcaagatcttgtaaataataggaaacgtggggttttgtattggccgatattcttgggtaatttaataccgttgaatcgagcattttgggaaacaatgcatctaatgaataaggcccaacattctcatagacttaatccatttaaaataaacgagattggtttgttggatcctaaaaattttccacctgatttttacaagcaattgttgactgggaaatataatggaatagattttcgtgatactaagggcttttcagtgtccaaaccccaatgggaggaatccaaagatccggtttaa

SEQ ID NO: 7387 - DNA, 210 bp, Candida albicans
aatatacccaacaatactttaaattgttatgttgagtatactttcaatagctttgtttataatttgttatatgtatatttgttcttttcgaggaggtttatctataaacttagttcttttctttactctcttacttccaatttaggtctctttatggatctgtttcttttggaagtgccggatgatgattcttcaaaagcagtagcttga

SEQ ID NO: 7388 - DNA, 465 bp, Candida albicans
gtgggatcctcgccccctggtgaagatgctgctgctgctgaagtaaaagcttccactgaaggtgaagctaccaaagatgctactgccactgccactgccactgaaggtgaagttgcaccaactgccactgaaactaaagctgaagccgaagctgaagctgaagctgaaccagtagtggtagctgcagctgcagaagccactcctaaagaagttgcaactgaagaacaaccaagtccatcagctgatattactgaagaagttgccgaaccaactgctgataaaaaagaaggtgaaactgaaactgaaggtgctgctactgctactgctgctgctactgaagctaaagatgctaaatctgaaatcaaagattctgctgaaaagactgaaaaggctgttaaaaagaatgaattctttaagaagtttatttctaaattcaaaaagaattctcatgctgctaagaattga

SEQ ID NO: 7389 - DNA, 192 bp, Candida albicans
tcacaccatcattttactacttatattagtttatatctatctatctatctatttttaattgttaattttttatcttattttattttattttattctaaattttactttcttttttttaatatatataaattggggacttttttatttagtttatcccatttttcttcttcaggtgcttaccattctaagtag

SEQ ID NO: 7390 - DNA, 228 bp, Candida albicans
  unsure (209): Identity of nucleotide sequences at the above locations are unknown.
caatttttgttttggttggttggatttttttttctctgttggccaattaaattttttctcttttttttctcttcctctttgccttatttagccgttgatgttgttgttgtttccgctgagtatgggaatgagaactacgaaaaaaaaaaagcccgcactctaaatgcacgactaacaagttgtatggcatatagttgtgggtattccanaaacttaatcctaaactaa

SEQ ID NO: 7391 - DNA, 300 bp, Candida albicans
ttggccaacagagaaaaaaaaatccaaccaaccaaaacaaaaattgtcaaaaattacactaacagacacaaaactaataaattatttccctcaaattattcaaaatcaaaacaaaataaaaaaacgatgcaagaaaatgtcgtccagatagattttcatctttgcacaaaacaggttttattcttgccggtgggatactctgccactactaaccattacagttacgtcgacccagtaataataatcgaaatatatatcctctttataaataatagagttctttcaaaccaatgttggtaa

SEQ ID NO: 7392 - DNA, 264 bp, Candida albicans
tgtctcccacattctattacacctcatctttcatcttcatctttcatctttcaatcactaaatataaccttgcgaccttcacaaaattttttttttttgacaaacaatccaaaattacaattttcatttcttcttcttttatatataaaaaagtttttcatcattaatttcaccacacatctcattagcaattgggcaaaaatagaaagtaattttataacttataaccaaaaaacaattcaagaacaatatcattattactaa

SEQ ID NO: 7393 - DNA, 195 bp, Candida albicans
tcactatcaccacgatcagcatcgccatcgccatcacctcattatccacaaattgatttaagccatctttctggtgtttgtcacacgaacttaggacattttggttatgatttaataagatcttttataaatctgagttatgatgtgggtataacaaccaaccaactattatctaataaactatatagtcattag

SEQ ID NO: 7394 - DNA, 189 bp, Candida albicans
agcgaaaaaaagaaaagaaagaaagcattgggcttaataggttgttgtactaatactatgtataactattttaattttattatgcatgaagtttttattttagtatttattatttgttcctgttttaggctaaatcaagggaatctttctaatctaataaccctgtatttttcagcttacgtgtttgtt

SEQ ID NO: 7395 - DNA, 288 bp, Candida albicans
gtaagcaagcaatgtttagtagaacgactaaaccatacatgcaaagtagtaaaaatggaggttgctgtaaacttagcacaagagcaagggcaattgagagctgaaatgaggctatggtctacatttgatgttgcaggtacagtcatggacatggctagagtatcaatagccgacaatggaattattgtagttgccaacgttgctgttgtttgtagtttgagagactatgttgctgatgaaaatattgtcctaactcgtcttattgttgtgtctatgcaaatcaagtaa

SEQ ID NO: 7396 - DNA, 198 bp, Candida albicans
aggagaatgttttcaacaccaatattgtattataatagaaaaattactaaacggagtttgaaaattgttcaaactgtggaaaaatgttcatatttcgtaaaaggtgatgaagaatatatattttggaacaatgacgacatcaccaatccacaatatatgctaatgacccacaaacataaccatattcctatcagctaa

SEQ ID NO: 7397 - DNA, 186 bp, Candida albicans
gggatgatgtatgttgaatacaatcaaattttcgagtatgtcttggatattctgatatatttagattctgataaaacaacatattttactgaaaaattgatctatcagacttgcaatattttcaatttaactttctctcgttatttttgcatccaccttgatgtattttctgtgctcttgtgttga

SEQ ID NO: 7398 - DNA, 228 bp, Candida albicans
gttggaaaccatcacttgtacttatgttcagataagcgtacattagagtatttgactttgtgtaataatgtactctttagaatctacctacacaaacgaatatgcagtatggaaataatgaaaactgtattaagcactcatagaatgttcttgaaagactttgcaaatataataatcaagcaagctttttccttatcttcaacatgcagctactcatgtagaaaataa

SEQ ID NO: 7399 - DNA, 219 bp, Candida albicans
gactcgcaccgccaccaatacgacgaccacaatgcgagtttcgtacttttattttttttttttgacacattaaattatggaattaatgaaattaccaaaaccaaagccgtagagccaaacgaaaaagaaatttcagtactcccccaaaacaacaagaaaaactatgaaacatcccacaaacacccaactaaaactagtatgatactcaacaaatactaa

SEQ ID NO: 7400 - DNA, 291 bp, Candida albicans
gagacaaaaaaagaaatgaaatcagtgattgatatattatcgaattttcctgaaaatgggaaaataatcttacaacaatcttcaaaagagaatcaagagttgagacaaaatcaacaacagatacaaattcaaagacaatataatgctgataaaagtataattcgaattccattggctgatgaagaagaagaagaagaagaaacaaatagccatcccaaattacgagctctaaaagagggagaagaagaagaagaacaagaaacaacaaaacgcaagaaaactcaacaataa

SEQ ID NO: 7401 - DNA, 909 bp, Candida albicans
accacgaacagcaacatgaataatactacctcatcagcgcaagaaaagactgttaaaaaaagaaacagagcaaccttggtttgtttatcatgtcggaaaaagaaagtcaaatgtgataaaggaaaaccttgttcaaattgtaataaatcccaacctgataagtgtatttacgatgaacgaatactggaatcaaagaaacgaaagaaaccgtccatgacaaaaccagaaccaaatggtacaaataatagcgacgccacttcttctattcctaatgtgacatctcaagacaaggaacaacagcagcaacaacaactagcaaaagaacgagatgtttgtgtattgattcagaaatcggaattacaagagctactagcaaaactaaaacaatatgaaagtttagaaaatcatactactacaagtaatcaccaacagtttgacataccagctgaatcatcaaatagtagccatcaccaccacttccacggtatcaagaataaaaatgataatattgtattcaacaattcttcagaaactagaagtagtttagttttcaccaaacatgacgagactagaccaggtttcataccattagtaaatgtcacttcagaaaaaccccatttccctgagaaacgtattactacaactaaggcacttgaattatccaaacttcctacagaagaaaccaacctaatagggataaacccttatgatcatccagatgacgtgatagacttccataaacaactccccaatacgtttggtaaaaatgaaaatagtacaatgtctcccttatcttggtcgtatgcaattagaagcagttcgatagtgagaactttaagatattttgattctttacaatatcaaaaggatgtagaaaaacaagttacctccgaaataacccataacaac

SEQ ID NO: 7402 - DNA, 216 bp, Candida albicans
aaaccaagaaaggaaaggttaaataaatttgaatattggaaattgttgtttcatagtaaaaaactaaaagttagattagttagaggatttttaattaatgccattaatttgtttaaaataagctttaatttaatcttcacaatattggtaaaacagaggcgcaaatttttaaacatatatacatacacacaccaattttgttacaaaagaacttaa

SEQ ID NO: 7403 - DNA, 183 bp, Candida albicans
ttaatctacaaatttcaattgggtgagttggtgagtacttcctcttcctccttctcttgccgtgcccttaaattgattttagttcatgtggtcaacatacctccgtttgccgttattatcctcgtcttaattactcacaacatttcactaacgcattctgcttcttctttaatttttttttga

SEQ ID NO: 7404 - DNA, 645 bp, Candida albicans
tttattttattttgcataatgtcacaacaacaacaacatatacgtaagtctaaacgtactagaatgttaactgaaaaggctaaagctgaaactaacactatttctttagtcaatcacaaactaccaacaaccacaacaactaccactcgaaagaagagttttagtttaccaaaaactaaaaaaagaaagatttctagtatagaagaagaagaagaagcagctaaattatcggataagattgaccccgttgaaaaattattgagtttaaccaatgtcaatcaagatttcttactggattgggaagacaattctcaccgtaatcatcatacttccatatcatcatcgtctactagcaataacggtataacttctggtagtctaatatcttcaaatacatcaaattgtgggtttagtccgagatctggttatcatagtagttcaagcagtatatcatcattattttctcaaaatgaagaatcagaaattgatgaatatgattatgattatgaatcagaagattatgaagaacccaatgaaattgaatcagtgaatttcactaaaattattcaagataacattcgtcaatattatgttaaaagaagattagagaatctatatagacgtgtccaccacgggatggaagac

SEQ ID NO: 7405 - DNA, 960 bp, Candida albicans
  unsure (799): Identity of nucleotide sequences at the above locations are unknown.
acgcgggttttcatactccgtggtgcaagaccaataacaatactttgtcaaccgattattatgtgtaatgataattcaattcaaatgttatttttagaaaaattttatcatgataatcaaggtaattttaaatatcaaaatttaattaaagttgaatcaatacttttacaaaaattcgtcaataaaaacacaaatcttgatttgtcgtcgtcgtcgtcgtcaatgaaaagaaatgatttaattgaacaatttttaagaattgttttgacacgattatatcctcgatattttggtcatattcttcctagtattggtggtggttttggtggttttggtggtgttaatgcaaatcatattggaattagtaataaagataatgttggagaaatgacaagttctttaaatgttgatcgaattgttaaaaaagttagaaattccatgatgccaatcacagtaggtaaaattggtttattaataaattcaataattttattcttattatatgttcttcttcattgttgtcctaaaatattgatttggcattatgttaatttaggttcattatatctaattaatcttcttaatgtggcatttattttaatgattttaatttcaaaaagtcaattgaaaacttattcaactaaagattttggttatattttgattgtgtttgaatttttatcaattttatcaataatggtattattcttccatgatcataaatcaattatgaaacgtcaattgtttgttgcatattcttgttcatcatcagtatattctgatcatatggataaaccangtactgcaaacagtagtggtcacaaagaaattaatgggaataatttgttcaacacattaacccccaccccaacaacaacaacaacagtccaggtctcgtcctcccctccctctttaattccctcatctaattccccaacattgtcatattatccacaacca

SEQ ID NO: 7406 - DNA, 519 bp, Candida albicans
agtgaaaacctttatcaaatgtattcagggttggtgttatcgttatttgtttcccaaattttgcatctaataagcgctcatcccatcaacgacgacaattcgatattcatagataaccgtgaccccaccacaccaatagactccgagatctattccaatttatatacgtatgcacatttaattgacatatcgtattgcatttcagaagtcaacagaatagaagagccatttaaatgtaacttgaattgtgaaaagagattccctaacatttctttagtttatcagttttattttgacgactcggttacagggtacattgccaaaacaacatcaaatatttttaggtataatgaaacacttgcagaagataaaaaaacaataattgttgctcttagagggacaagatcaatattcgatactttaactgaattgaaaattgatatgataccatatccgaatatggggactaaactaccgctttggtggattcgattgttaagttcacagaggatttcatga

SEQ ID NO: 7407 - DNA, 291 bp, Candida albicans
aaattttataagttggggggggggggcaaaggtataaaagtgttagggagtgtgaatgaagctaaacataacgagtttaaaaggaaatttttaagggttattcataagaatgatgtgatcacgacattgcctagggatcaaaatatatttaaccgatatagtcagtttgataaccaaatatatttgaattgttctgagactgatacgagaccaactattaatgaagttattgattgttatgatggatccactaatcgtcttctctcacaggagcggccgatccgcaagaaa

SEQ ID NO: 7408 - DNA, 222 bp, Candida albicans
aatagtatcatgacaaagtctatagttaactcttatgcgatgagaccaaagacattccactccaatacaggatttatgatctactcttatgacctgtgtaaacttcctaggttatgtgtacaatactttaatccattcaaagaaatctttgcatttggttacaattttattgtctctgatatgaatcaacttgtttcttcaagcaactcttctaattcttga

SEQ ID NO: 7409 - DNA, 213 bp, Candida albicans
accaaaaacaatcacataaaaggattgaacaatcacattgattttatttcgaacgaatatcaattgttgtataatgattacgaagaattgaaacattcaagtttgcttaataggaaacaagaattgttgaaagaatgtgaatcaaataaaggacatatggatatggagttgagggagtttgaacaatttttggtagatgctgtaggtaactaa

SEQ ID NO: 7410 - DNA, 558 bp, Candida albicans
agaccaaatggtaagaggcgcccaatattgagtactagcgttgaagaaattgcaaattttgtaaaggagaatttttgtttacaccagcccaatcacgaaagaagttttagactgaaaacaagatccagtgtatccagcttgggtcgtaataaggcagaggattttgattaccgtcagttatcgaatttgtttgaagaattgatgactttattgagtcataacttgcaaactgccgaaccatcggaagtatctttacaagctttgatattgagcgcatggaaacattataatgcttatgttaggttttatttgctaagtatatttcaaccattacaacttcacttgaacgagctatctatgagaaatcataatggaagcaaaattatcagaatagacgaccttctacttgtttcttttcgaaaagtttttattactgaacagggaattggaagtggggatagagagacatctcaatttttaggaaatactgaaagtgaagatcttacaggaaatgggttgttgacttctactttggccgtgttgtcgagtatatcatag

SEQ ID NO: 7411 - DNA, 297 bp, Candida albicans
ttaaccacaacaataattaacatcatcatcatcatcatgtcacaaacaaattcatttatgcatttagtgagaccaaatgttatagcaccagctgctggatctgccaatggaccagctagtataaagattcatgcaccagcaatgttgacaattttagaaatcatttcacaacaagttttaaataaacgaatcattgggacattattaggatatcgatccgatgaagacttagaaatggaaattaaggatggatttatgattcatattaatgcaactggggattcttatcgccattga

SEQ ID NO: 7412 - DNA, 264 bp, Candida albicans
tccatgatttttattcaaaggggattgatagagcattccacattccatgccatatatttaaatgttgaatttttaaatgaaaaaaatcaagttattgaacttaaaattacaacttatattgttgctgctgttggtaaaccagttagtaatactcaacaaattggttggaagacaaccaatgtcaataattcatacattttcactcctattcataatgaagttataaatgccaccattactgaaaagattgcctttaaaacttag

SEQ ID NO: 7413 - DNA, 351 bp, Candida albicans
attgatcaaaaaattaatcaacaaaatgataataccaacaccaataccaataataacaatggcaacaataataataccgatgatttatcatatttgagtcaacaattgaataaagccaccgataatgttggccaattgttatcatacattgaaaacaatggtaataaagatcaagatattgatttattaagattattgagtaatcaattattgaataaaccagatattttgaccaacttacctgaattggaaaaattatttaaagatcacaaccaagatgttatcatgattgagtacttgactaaagccgttaaagatcaaattgaattaagtgatagattgactgattaa

SEQ ID NO: 7414 - DNA, 216 bp, Candida albicans
tttcgcaatcatatcaaagagaagaaagaattcaatccatatactacatcagttggtgaacaagtagaaacctacggaaaggaaaaaaagcggataaatggattgccaagtacacacaaagctctgtcttgggccacttctaaaaacttgtacgagcagaaagacgtaaaaattacaaataaaaaaaattacacaattagccataatgcacgataa

SEQ ID NO: 7415 - DNA, 225 bp, Candida albicans
agaatcaacttgagtgaattgagtaaatcatatttgaattttttatttacgcctccagcaaatggatatttaagtaagacggccaataacttaatagggatactgagaagaaccttccaacctttaaatgaaagcattataaacagaatgccagtagtttttaaaactttaattaggaactcatggaataaaactaattctaaaacgttaaataaaaagatgtga

SEQ ID NO: 7416 - DNA, 183 bp, Candida albicans
cctttaactctgtgtcttactatttcaatcaacttatggttttcttatcttatgacaacaaaagttgttaattacagcagttcagaatcactttgtataggatcaatttacatcctcaaacgtaccccttttgttaacgaacaatccagaactactacttattctatagcatctacattttag

SEQ ID NO: 7417 - DNA, 303 bp, Candida albicans
tgttgttcagttaattctaatatttgtttctctaatggtgtaagtcgtttttcttttggccttttcggtttagattcagaagaaaaggatgaacctgatgatgttgttgatttgcgtttttcaacatcttttgatttggttgtggtggtgcgggtagaggtactgtctttggttccatcaaatccaaactctaatagtttttcagaaggaagagaaggagaggcagtaggtggtggtggtggtggtggtagtggtggtgattttgatgatactttttccgttaaagtagattctgtagattga

SEQ ID NO: 7418 - DNA, 324 bp, Candida albicans
ttctccgttttaatcgccagattttttatttttccctcccttcccccacacactcattcatacactaaattaactccacccaatgaaaaccgatttataagtaatctgtcaaatcgccttgatatattcttcttgattatttttcatttcattaactacaatctaatacaattatatatacatattccaattgagtcttataaaactaaattaacacttttcaacaatgtcaactgcaagtattccttcaaacccaattcttatcgttggtggtggattagctggtctttctgctgctcatcaggcatatttacgtggtgctaa

SEQ ID NO: 7419 - DNA, 186 bp, Candida albicans
aagccatacttacactttataaaacttagttgttctgtagtaacctgtcaaaaattgacttattttagcaccggatcaatcacagttataaactatattatagaaccttcaattgtcttttctgagtccaattatctattaataatacaagaatacaatatacatatacagtatataaatgtatga

SEQ ID NO: 7420 - DNA, 267 bp, Candida albicans
aatagtttcttattattagaagatactaaaatggggttggcactttttgataaactgaaaaaaactaaaaagaaagcaactcgcatgatatcctcgtttgagactttttaccaagcggcagtgtcaccatcaccaccaattccaatgagtcaaaactatgcacacttgcctaacctctataattgtttgtccaaattttcattttgtacatttccactaaactcacccttctgtaaagcgtgcagtttcaaaaccaaattgtactaa

SEQ ID NO: 7421 - DNA, 261 bp, Candida albicans
ataagcctactttataaaatgcatattattaattcactttcacttgccagctataataggtcaccaaaaatcgtcaagtataagagaaatattagtggttatttggaacaacaagacagaaaaacagtgaaaaacaaaaaaaaattgagtgataactaccagggtacccggacggcatcaggctatgctgtgcccaaatgtaaaattacacaatatcggagttcacaaaaacacgtgacaggtaatttacaaagtatatga

SEQ ID NO: 7422 - DNA, 234 bp, Candida albicans
aattattttgtagaaaaatttatgcgaaaaacacactatatttctaactccaaattgatgcagcatgcattagaaaaaattctagatataaaatacatttatactgtagattgcagcaaacactcgataacctatttagaatttgcaccatttccaaccaacagcactgaaccttgcccatatccaaacaaccatactacttcacctcggagtcgccgtccgccatattgccgc

SEQ ID NO: 7423 - DNA, 201 bp, Candida albicans
caattaaattttgaaaaactcttcaattactactactactactactttctttattatttccaactattcatttataaatcaactatgcctcgtcgtgttagtaatgcaccatgtattcctgttgtagctacaattgatattggtactacttcagcaagagctattatattttcttcacccaccggggctggaaggatccgc

SEQ ID NO: 7424 - DNA, 348 bp, Candida albicans
caagattattctattattatcccggggtatatttcacatattcctttttttcctaattttaaaaaaatggagatacacttttcccaattgtgtaatacgggtactgattcgatagtacatcatatttttgaatgtggtgagaatatggaattatggctgaaacattttaatagtcagggaactccacaatttattattggaaacacacatttacataagaaagatttatatgccttaaacgagtacatcaaggaagtggttcaaaaggtgaaacgacgaagaggttcaccaattttgaatcagggagaaagggaaaatgtggacgctggaacaaatgtactcgtttag

SEQ ID NO: 7425 - DNA, 222 bp, Candida albicans
caactcaaagttgacagtttgtctattaaattgattgtttcaactattggttataaaatcaaacgtttggaaaacatttattactttaaatcttgctcactaaactcattggctattaaagtatcttccaagtatcctcccctggataaaactcaactacctttttatcaaatgattagagaatctttaactagtagaattctatactatacatcgatctga

SEQ ID NO: 7426 - DNA, 195 bp, Candida albicans
aaatggtttatgaaactgtttaacaaacaatttattcgagagttttacctcacacaaaattgcactgatgagcctttttctacgtatacttcttatagtttgctgtttgggcttacattgacatcaatctttcatatattttttagcaaggatttaaaagaacaaacattcttgcactgtggctggtgcttctaa

SEQ ID NO: 7427 - DNA, 183 bp, Candida albicans
atatccaattgtgcaaaatatgccaattctcagttaagttttcctgcttggggtttctctagaatcatctatgtttgtgcgggggggccgcctggtctgttttctttggaatcggaaatataccctctcacagccgactcaaaactagttagtagattttatgcttgtattgggcctggctaa

SEQ ID NO: 7428 - DNA, 207 bp, Candida albicans
agttgctaccgggtggaaaaaaaatcttatggtaagttgtggcataccgttgtgccgtccttgaaggctaaacatttacccgaatacattatcagggacgggaaaggaggaggaagaggcgaaaaaaaaagcttagatatcatcctgccctttattttttttcgctcttctggttgtagtagtagtagtgtctattgtttagtttag

SEQ ID NO: 7429 - DNA, 198 bp, Candida albicans
ttatatactctctcgttctctcccctatatattactaaaaccactagagacaaacggagtgaattcaatgtacatgttttagttgtattgttaatcaacaatatagttaataaattattattactgggtgaaaaaaaaaatcaaacaaaacaagtaaaaaagacaaaaagacaaaaaaaaatgactaaattacactaa

SEQ ID NO: 7430 - DNA, 198 bp, Candida albicans
aataaagaggaaaaaaaaaagaaagaaacactcatccatacacacaaagcatacattaaatatttattaacatacactcaacataagagaacagagaacaagaagagaaaaaaaaagcagaaccaaactaaaaatttcaacacacgcaaattatattttttctttcttttctttctttttttttgttttaaactatag

SEQ ID NO: 7431 - DNA, 243 bp, Candida albicans
aatacggtccctacgttcgtcaaaaacaggatgcttagcataattatactatgctcagttggaacgaagagcaattatttccgtgcttatatagtgtactcatttaaaaagagctcacataagatgttaatagaaatttattttcatacactagcctgtactcctaagggcagcagcaacacaccacatgttccaactctctcatgcgatcatttaaaaattaaagtctataaagatatctag

SEQ ID NO: 7432 - DNA, 297 bp, Candida albicans
atcaacaccaaatggaatagacatattttaagaattatattaagtatatttctccaattgaacaataaaagtatagggaatacaatatttgaaagcaaaaaaaaaaaaagaagagaacaaggaaaattgggaagaggatttataaattttttttttttttcaaccaacgatacaaccaaagaagaaaaagaagaagaagaagaattgttccgcactgttcctataagggagagagaagacagtgtggcaagctgcgtcctcctacaaatgcagagtgttaaggctaaatttgattga

SEQ ID NO: 7433 - DNA, 267 bp, Candida albicans
cagaaaaatggtaagaaaattcaaagggagccaaaatattgtcattttactcctttcttctttttttttttccgttttgtgaggcagttatattttgttgttatttcggactctggaacaaatgcagacggcaaagaagagaagagagcagacgcagacgcagatgcagactcgagtttcacagtctccagacctcagacttttcctcctatacaactccttccttccttagctccttcctcctcctcctcagattcctccgcttaa

SEQ ID NO: 7434 - DNA, 201 bp, Candida albicans
aaacggaaacatgcgcagccgctgtggaacccggtggcccagtctattaatgatggtaatcataacccgaatcctgattatgcgagtcgtttcgtgaacttaccatccagtccagggcatcgaataagtcgctacggggatccgtccatgaacggcgaaaacattcatcccaacggcgaggtaccgggcaacatccgatga

SEQ ID NO: 7435 - DNA, 216 bp, Candida albicans
agtccaactccagtcggctatttaccacggcctactggggttcaggatgagagatctaatgctaaattcggtaatggaaatttgaacaaagtctgtcttctagagagccgacacgtcagctacagagagtcgaagtcggccaatcgtcccgattatgtatctatggcaacgaaggcaccaagcccaactcaagcaacatgttccccagaagcataa

SEQ ID NO: 7436 - DNA, 189 bp, Candida albicans
cgtaaagtaataatagttgtaccaccaagtgttaagggtttaaatgattttaatgttaagattcgtttggatatagcaaaatattttgttcctaacatgataactgttcaactctgtttgtttctatgtattagtaatgatcattgtaaagttaatgttttttgcgggatctctttctcattcttttga

SEQ ID NO: 7437 - DNA, 660 bp, Candida albicans
ttgcaaataatcatcaatcatcaatcatcattaaacactatttatgtttatacttatacttattacactatgagttattcagatcacccacctataatatttttttcaattggtaatcctggtcctataactcgtcattcagttggtcatttcatgttaaaacgattaatggaatcatcatcaaccacttcaattaaacaattgagtaattattcatcatattcattatcagttgattcttttaataatataatttatattaaatccaatacatatatgaatgaatcttctaaagcatggaataaattcaaattatcaaaagaatatagatcatttataaaggaacaagaccaagaccaagaccaagaccaccacgatcaaatagttagtgtgattatattatatgatgattttgaaaataatttaggtacgattaaattaaagcaatttaaaaaaaaatctaataataatgaatcccataatggtttaaaaaatttaaaactctccatgatcgatggtaatagtagtaatgctactggtgaggcaatatatttacttggaatcggaattggaccaaaaccaaataataatccaagtggagaaatcatgagacaatggatcttaagtccatttattcttacctgccgactggacggataa

SEQ ID NO: 7438 - DNA, 498 bp, Candida albicans
agtaaactaccactttataagtcaaatatgactagtaacaatgatgataatgttaatttagaaaaacttaatatatctgatgaaattattaatgattatgataacggatcacaagaacaattggatgtattagaagcatatcaaacggatgaagacaaacaagaacaagaacaaaaagaaaaagaaaaagatgtcgaactagataatccagaccttgaagaggaggttggtatcactatgaatgatgataaaggtgatcataaattaaacaatcaaaaaatcgatgatgaaatcaataaagaagacgaaaaggatgtaaaagctagtgacgatgatcatgatgacgatgacgatgacgattttgatgatttcaatgaagctagttttcaacaagcaccaacaattggttccacaaaccaagagaatggtcacgacgacaatgatgatgatgatgatgaatttggtgattcttcaccaggcgctgaaatcaatctcccc

SEQ ID NO: 7439 - DNA, 1053 bp, Candida albicans
attgaccagaataacctatcaccaccaccacccccttcctctattcataagtacagttttgaaaaacaaaccaatcaattattatccaacaacaaggggagggccaataaaatgaataatttagctattcaagaatattttgaacttgcattagtatttattcaatgcgtttatcattacattcaacagcaacaacaacaacaacaactagaactagaactagaacaacaaaaaaagaaagatgaagatgaacaagactctgaacgaaccattgccataaattcaatattggattctatttcaaataggttattttcaatgcattttcaatcaactatttatcaaagaataccattgtttgtcatatatactgttgaaaataatgaaggtttaccttatgatggaactagattatcaccgataatatcagcaaattcactaacttcaacagtaacatcaacactgtcaacagcatcgttaccttcaagaataacatctgatgagccacctcctgttccaaccctaccacggttactattaccatcttcaccttcaacctcagacttggctttatcagatcctttgcctttacctttacctttagcttctgcttctgcttcagtttcaccaatgttaacctcatcaccaacatcatccccatcaccaacatcatcaccatcaccatcatcacctccactgccacccccacttccaatgcagtttccattacccctaccatcaccaacaccagttcaactacaattgcctgttataacttcaccaccaccccttctttcacccccaccacctttggtaatggcaacaggatcatcactaccactaagatatgaaattatccctcttcacaatattgatccaagttcaagttcagacactgaaagtgtaactggtgttaaagaattgacagaattaattaaaagtagagaattattaacatttggtcctgatggttatggtcaatctataaatgatgacatccttcctccaatgaatctgtttacaccactggtaaaattcattcccctggattga

SEQ ID NO: 7440 - DNA, 357 bp, Candida albicans
actggtgttggtgatggtaggggtaatggaaactgcattggaagtgggggtggcagtggaggtgatgatggtgatggtgatgatgttggtgatggggatgatgttggtgatgaggttaacattggtgaaactgaagcagaagcagaagctaaaggtaaaggtaaaggcaaaggatctgataaagccaagtctgaggttgaaggtgaagatggtaatagtaaccgtggtagggttggaacaggaggtggctcatcagatgttattcttgaaggtaacgatgctgttgacagtgttgatgttactgttgaagttagtgaatttgctgatattatcggtgataatctagttccatcataa

SEQ ID NO: 7441 - DNA, 198 bp, Candida albicans
ttgttctggttgctggggtataaattccaacaaaaaaggaaggaaaggaaaataccacgagatgacatatacacctcatacatatgcattagtatatatatatatactactactaatttaatgttacaaaatgatcaaaaaaattgtggttcaagaaatcttgaacttgaaattaataaaaatttgtatgtattgtaa

SEQ ID NO: 7442 - DNA, 354 bp, Candida albicans
tttttttttacaacacgatcaaaaccgagactacatttgatttctcattttttgcaacgcgtcttatatcatcatcataacccatattacaattcttgtagtttgattaatcagttacttctagtcatgactactagtccacctattcaagatgatgaacaagatgaagaattcaaattaaaacaaattatcaaagaacaaaatttgattcctcaaattaacagccacaatcatgatgatgttgcttctgaacaacagcaacaacaatttaatcaattatccaaagataaaaagatgaatcgattaaataagttgattgaaaaaagtcaaatatattcttcaaattattgctga

SEQ ID NO: 7443 - DNA, 183 bp, Candida albicans
acactggcctccaaccccgtttctgccagcaagtacgctttgaaatcttctaagcaaagtgagtcaggtacgtcaacagatataatatcaccagagtggtctaaagaaatggtaagttgcattgttgaagaaaaaaaaaaagaaaaaagaatgtttcagtggcaaaaaaatcgacatttatag

SEQ ID NO: 7444 - DNA, 279 bp, Candida albicans
aacattcttttttctttttttttttcttcaacaatgcaacttaccatttctttagaccactctggtgatattatatctgttgacgtacctgactcactttgcttagaagatttcaaagcgtacttgctggcagaaacggggttggaggccagtgttcaagtgttgaagtttaatggcagggagttagtgggcaacgccacgttgagtgaattacaaatccacgacaatgatcttgttttcacacacgggccctggaaggtgccgcgaattgcggctgaa

SEQ ID NO: 7445 - DNA, 195 bp, Candida albicans
atatatatatataattggaatttgaagttggttgtaattgaatataaaaaagaaaaagcagaatcaaaagcagaagaaagagaagaaaagaaaaattgcttgataaaaaaaaaattaattgattattgtgattatagaattgaagaacaagaaaaaaaaaaaacaaggaggtctgttctgtgtgtatgtgagtga

SEQ ID NO: 7446 - DNA, 249 bp, Candida albicans
  unsure (228): Identity of nucleotide sequences at the above locations are unknown.
tatctactacatgtgatgccaaaagtaggcactgtattgggtataggtgttgatatcgtcaattctgtcagatttgaaagattgttgacagccaaaagcacgtctgtcggaacaatgctatccaagcgaattcttcacccagaaaacgaattacctttgtgtcagcagatgcactcacaacgacaagctcaatatcttactggaatctggggcagcaaaagaagcatnattcaagaacatggaacttaa

SEQ ID NO: 7447 - DNA, 195 bp, Candida albicans
aaatttaatacattacacgtaatacacgtaacaacaacaacaacacacgagattagaacccacacacacaataataattataaacaattgtcctatttactttctttttttttcttttttattctttctttctttctttctttagtatttattcattcaaaccaatccaacttcttcacattcattaatatctaa

SEQ ID NO: 7448 - DNA, 189 bp, Candida albicans
atattcggtgggatatttgttgaaccgttcccggacttgaatgccattccgtacgggatggtgattgttggtggtaacaacgagattatcagtgagctagctggtgaggttgaagtagataatgagcattataaacaagagtacgaggattattgtataggtaaaattagagcgactatagatatgtaa

SEQ ID NO: 7449 - DNA, 801 bp, Candida albicans
  unsure (28),(789): Identity of nucleotide sequences at the above locations are unknown.
ataataagcaaaagttgtattaattctntttttcaaaatctaatttatcaatatctaacaattatgacgtcaaaagtggtaatcattggaggttcatacgctggattggctgctttaaacacattaaaactgttaattaccaaaaattcaggggccattgccaagtctatatctatcacattaattgaaccaaaatcggggttcttgaatatattaggattaccaaaatcgattgttaataaggaatttgcaagtcaacaatatgttccattttgtaattttttaaagtttgataatgtggttagcaattccaatgatttaaaggttcaattgaaagagaatacaaactccgacaataacaacttgatgttgaattatattcaagggaaagttactaaattaactagtagcagagtcacttacaccaccaatgataccgatgaatcgagcattgattatgactatgcaattttggcaacaggaagaaacagaaattggccagtcaacccaaaaggcattacatttgaatcatacttgaatgaaatggagatcacaaacaaaaagatccaaaaaagttcaattatcagtattattggcggtggtgctgttgggatagaattagcagccgaaattaaattacattacccaaataaagttgttaatttgattcatcctcatggtactttaccaccagagccgatcctggatgctttcaagaataaaactttgcaatcattaaaacaggctaatattaacgtgtgtttgaatacgagattagatacttccaanacttcaactaaa

SEQ ID NO: 7450 - DNA, 705 bp, Candida albicans
  unsure (700): Identity of nucleotide sequences at the above locations are unknown.
acatcaggaatgaagctggaagaggaatttgctagaattgcacgtaaggcagaaacatcaatgaaaaccatagattcgcatgattctgaaatgaatgagaaattccagaattcgcaattcctaaaattaatgagttcaataggtaatagacaagtggagctagagggtgataaattagtgacatcagattcaaaagaagatatcagagagaagggaatacccgaaacaatcacagccacaaatccaacaataacaactgcacctagagacacccaagaaggccaatttacactgcaagggccatcgaaccctgatttcgccagagaaatgtatgaccaaatcccacgaccaaagccagctaacactgcctttccccatcccttatcaggagacagtgaacatgagcaacaacaagagccaaatgacccacaccagaatactttacctgatccattagctcatatacaagatggtcaattgagtgatataaatgatccgttaactgcagccagaattataagtggtggtcaagtgcaaatgagtgactgggtggaagattacgatactatatcagatactccttctaaactagaaacagattcaaacaacaatccaaacgtacgtccctttagaaaaggtcaaattgtcgaccatcactgggatgaaatgtatcgtgattacagacatgatgatgattatntttag

SEQ ID NO: 7451 - DNA, 675 bp, Candida albicans
acacatacgcaacatcttagaatgccaccaaagtcattgaagttgatcaaaaagggtttaaatcctcctgttcaagataacaagacttttaactcattatttaaagaagccttgaactcaccagagcattttttatgcgataatctatccaatttcaaactcccttcagatattgatttctttattggttttattgaaacaaagcaatttgagacatggctcgacattattagtcgtcaaaataattggacgagaaataagagggttgtgtcatctattgccaacaacaataatgaacaaataccttgcaactcaaaaaagctggcttatttggaagaattatattacaactgctgtctgctgggaaaatatgaatcaaaaatgcagaaaggtcctggggctcgttacaaaaatgcagtaccaactactatcagaacaggttgtcccgcaaagtggtatgcaaagaagcctaaaagtatgccaaatcattggttagtaggtgtaataccaaaacacaaccacaaaaatcttttgaaaggcggattaaacagatcagccagattgtggcttaaacaaaaggttgaagatggtcataatcataattatataaaaaagttgctaattgatcttcatgctgttttctaccacaggagcggaaggatccgcgtattgcgt

SEQ ID NO: 7452 - DNA, 240 bp, Candida albicans
cagtatatatatggaagtcataagaatggtcaattatacccagaagagtcatatacaaatgaacaaacacagttactacgaattgtggactgggtgtttcatggattgtgctccaattgtcagaaaattttgaagcttttttttacaaccgatgttgccgaccttgtacaaaaactgattttagcaattctacactacctttttttgactaaaaaaattccaagtaaaatttacgcgtag

SEQ ID NO: 7453 - DNA, 210 bp, Candida albicans
aaaaaaaaagtgaataaacaacaaaaaagacctaatgagaatgacgatgaggatgaaggggaggggcaaaggaccagtggaatacttatattctgggatatatatatatatgaacaaatttcaaatatatataaaagagaagttgtaattgaaattgaaattgagatttgtgtagaaaatatattaaagagagaaggaaatcaattttag

SEQ ID NO: 7454 - DNA, 213 bp, Candida albicans
  unsure (140): Identity of nucleotide sequences at the above locations are unknown.
aaacaccttgtttctcatagccaacctttacccttctcctccttcttgaaacatattaccaaaaaagttagtatcaaatgtggaaattttcaatacattaggaagttaattctccaaatgttatgctcaattattagacnccgtttccatttgattccaattgggaaaatttaccttattttcgttatggttgatcttaataaaaggattggt

SEQ ID NO: 7455 - DNA, 240 bp, Candida albicans
tcacataaattgcaaaaaattactgctctctctggttatttttttatggtggactttaaaactatctctttttgggtgatgacaattatactcagcgttgtttttaatgccatagctatctacgggtatcgaaataacgtgtttaataagacattacaatcgggtatatataatcaaaaattatttcttgtatggtttttatccgatgtgcgtaaatataaagagtattacgagatataa

SEQ ID NO: 7456 - DNA, 189 bp, Candida albicans
tttgaaatgatgagtttgttcaagaaggcacaagtacgagttaaggatatatactgtgacttgaatgtggtgtttcacagtccaacccacagttcaaaaatccaaccagaaaaaaaattttaccatgaaattccaagtgtgttagatagtaggcttcttcaccacgggctcgaaggtcccgcgctgatc

SEQ ID NO: 7457 - DNA, 186 bp, Candida albicans
actgtgggttggactgtgaaacaccacattcaagtcacagtatatatccttaactcgtacttgtgccttcttgaacaaactcatcatttcaaatcaaaatcagttgtctactatatttcactattaccatctatttttggttttcaagagaatgttgtatcatttgaattcttttgcaaatgctga

SEQ ID NO: 7458 - DNA, 216 bp, Candida albicans
caaaattttagtattaaatactttataaagattatcgaaaataaaaaatatgaaataatcagctccgaattaatgttaagggacgttaatgtaataacagaaaaccccttgtattatagctggataaccccccctctctcccccgcccaaacaccacaacatactattattgctattacgtataaattatgcttatattccatattatcacgttag

SEQ ID NO: 7459 - DNA, 186 bp, Candida albicans
cggcttggtgaagactttgaaagacaaccattcagatttggatgcatagtttttaatgattcaaatcttgacaatgagtccaaaaatgaaaacgtcgattgtttggagcaaactcagaattacccaattaacaactttgaggaaaaacaaagtgaaattgtaaataaagatccacttgttttttaa

SEQ ID NO: 7460 - DNA, 204 bp, Candida albicans
gttaactccaagcaatatgagaccaataaactcgccaaaatggaatcaatgaaacagaaattgataaatgaaaaagaggagttggatctcgatgatatttttagcaagttgaatcttgctcgagaccatgcacagtcattaactcaagatgaaagggacaaatatgctaacaaagttattgaagaaattatagactttttgtaa

SEQ ID NO: 7461 - DNA, 411 bp, Candida albicans
ttgattactattaagtttatcttttcttatttgttcaaggtaatcatgtcatcaacaattcccagtgaagacaagaaacctttattggattctgaaatggaaccagaagtttctgttaataataacgaagaattgccaccttattccgacaatgagaaacatctgttattgtcagataatgagaaatgtgacttggaagaagttccaacaagctatagagtaactcgtcattccaataaattcaaaagattttgtcaaatcttatcattatttggagtgctttatttggtaaactttttgtacatcaatcgtgatgattttgctcgtggaatgtcaactcatttcagatttaactgtggttccttggtttggcacccactcttcacctcgggacagaccatccgcgctata

SEQ ID NO: 7462 - DNA, 219 bp, Candida albicans
acggtgtcgtggttcagaatagttaaagtctccagtgaagctgaagacgcaactgtcgatggcgttgactctccacttgtttttgaattcttagcaacaccaatgcttaaggagtcaaatttcaagtcaatttgcttcaattcatggtcatcatcaaaatcaaaatcaaaatcaggggatctcacccggggctggccggatccgcgcttgagtgaggag

SEQ ID NO: 7463 - DNA, 645 bp, Candida albicans
tcctcactcaagcgcggatccggccagccccgggtgagatcccctgattttgattttgattttgatgatgaccatgaattgaagcaaattgacttgaaatttgactccttaagcattggtgttgctaagaattcaaaaacaagtggagagtcaacgccatcgacagttgcgtcttcagcttcactggagactttaactattctgaaccacgacaccgtttattgggcggtcaatgccactcttgaaaagttgaagttgtcagcacttacagatttggatgggaaatttggtcgtctattggagatcccaacaatcaagaccaatgtcagcgccatttgtgactactatggaaacaataagctcattactgatgtgaaagtagaaaagatcttggttgattataataggtataaactatacactctaattggatccatttatcttataagagagtttgttttagctcctatcaaggttattaaatccaaagtgaataaagatctgaccaaatttgatagcaacttgtcccctgatcccaacgcagcacacaagaccacctcaatattggattttttgcatttagatgttaaattagattatctggatatgattttatgtctaagcaaagatttcaaagtcaggtga

SEQ ID NO: 7464 - DNA, 231 bp, Candida albicans
  unsure (1),(3),(58),(59),(61),(94),(134),(135),(139),(156): Identity of nucleotide sequences at the above locations are unknown.
ntnaaacggccaaaatattttcggaaaaccaaaggatttaacttaattattattatanntngctttcttcgatcaaaggatgatgcaagtgagntattcagattggattgtttaggtatattatttgccactanncccnagaacattacacccagngtatttcacggaggcacaaaaataaatgcttcttttgttagacataaaaaaatatttatgctggctggttgttaa

SEQ ID NO: 7465 - DNA, 252 bp, Candida albicans
aatctccattttgtgaaacaaacaaaaaaaaactacgaagaacaattgaacagtcaacgccaatttgttttgtttttgtctgtctgcaaactagtcacatttttctacaaccagtggttccaatttttttcttacaattatacacgacccaaattatttgacgagaatagaaacccactcatggaatatgttagcattcaagtagaaattatacaaataatcgtatgtttaaatataattactcaagtctga

SEQ ID NO: 7466 - DNA, 204 bp, Candida albicans
gttaataatttgtctttatttagtatccactacattgtacttagacagatactattagaactggatcccttacattcttgttgttgttgttgttgttgttgttgtttgacgggttattttatatttagtgcaccttggttagtcagtataattgacgagttgttgagacaatccacaacaattcatgtaaatcttgttagataa

SEQ ID NO: 7467 - DNA, 192 bp, Candida albicans
aggaaaattcaaattacacaaacacaaagcacaaaacacgaaataaacggaatttcatgtcatgtcatttcgtttcggttgaacttgaaaattaatatgcggatatgtgatatatcaccttattatgattatgatcctttcaaatatgaccatagtatccaagaggttactaatctacagtcgtttatgtaa

SEQ ID NO: 7468 - DNA, 186 bp, Candida albicans
ataccaagtcaacaacttgaaaattggttaaccatgttaataaaacactcagtaaggtttagagttaatggtcgtggtcttatcatttcaaataaatctaaagggggagacgatgatgagggtggagaagaaggaggagaaggcggagaagacgaaaaacaaaaacaaataaagaggggaaactag

SEQ ID NO: 7469 - DNA, 204 bp, Candida albicans
aaggaaattcttcttgatcgatttattgatttgaattgtagtggatttgtcgatggattatcaaaaaaaataaatacaaaatatttatatatgaatatgagaatccttgataagaaagttagatgttactttatatccaactatagattgataagactcgaacgtaatgttttgaaaacaaaaaaacaaaaaaaaagggggtga

SEQ ID NO: 7470 - DNA, 276 bp, Candida albicans
tatcttaagatgtcatctacaaaatatactactcatgaacctattcctgatgaaactgaaacccaatacattccatatatacatgattctacaacagcgaattttgatttccccacttcattcaattttctatatactaatgatagtcctgatattcgttattacctatacaagttcaccaccgatcatttgaactgtcctatttgttcacaaccatttttatccctcttaacactatttgtggccatacctttcgttaagaaagcatttttttaa

SEQ ID NO: 7471 - DNA, 192 bp, Candida albicans
aatgtagagattcccattagattatccacagaccactttcaagaacatcgtttcgttggtgggcaaccaataactatgagaataaatgtatcaaagttgggtaataagatatgggaggtgggaaataaatacaatgaaattggttacaatcttaagagaattttaatcccaagggacaataaaccaagttaa

SEQ ID NO: 7472 - DNA, 708 bp, Candida albicans
  unsure (536),(579),(642): Identity of nucleotide sequences at the above locations are unknown.
cattcttatatatatgaatcactaattatggtagccactagaagatcgtctggaaaattcatagatgtggaattaagtgataacgggaaagaattacaagaagttatccctattgaagaacaacgagcggcaattgcacgggcatcacaagaaagtgaagaggatgagatccaagaaacatctccagtgttggtagaaccacctccaccaacaaagaagaaagagactagaggtcgaaagagaaaaaatcccaatgcaaattcaacatcttcagactcttcggcatcatcatcatcggcatcgtcgtcgtcatcgtcttcctcgtcgtttgatcctgttaaaaaaatcgagagaaggggtcggaaaagaaagaatccggatgtttcagttccaacaaccataaaaagaacgtcagtacaaaataatttagtccgttcaactgataaacaaaccccaactgacactagtattgcaaccaatgtcgttccaaacaaacataagataaatcatttattgacagacgatgctccactacnaccaccacctcaagtccagaactcaatttccagtgcgacattnacttcaaactcgttaaagtacagcacagcaaatccacaatcaattccaaatgtgatgcaattnactgtaaccaccccacaacgaccagttctcccaacttcgggccttttccaacaaaaacagcaacag

SEQ ID NO: 7473 - DNA, 183 bp, Candida albicans
  unsure (73): Identity of nucleotide sequences at the above locations are unknown.
tattctccatggatttttggaggtgatggcggtggtaatggtggtagtgatttccccatagtgggtttattantggtcgaatacaatgggtttttattatcacaggttaatgtgtctggaattatgtctatatttgtgtttgtctctttatctcttctgggtgtaatatatgtgtcgatgtag

SEQ ID NO: 7474 - DNA, 234 bp, Candida albicans
tggtgggacgattcactttgctcttgtttcatctcgagtatacccagatctcacttgttagtcgactgtatttctgtaataggagagacgtatctccctagggttttcctcttggtgtttggattgaaattaggactcaatatttgggcccttaaagctacgcccaagggtatcccttggataactacccgcacctattcctcattgtggttttcgaatccatctctccaatag

SEQ ID NO: 7475 - DNA, 348 bp, Candida albicans
  unsure (233): Identity of nucleotide sequences at the above locations are unknown.
gatctgggtatactcgagatgaaacaagagcaaagtgaatcgtcccaccattaccaccgggaacacgatatattctaccacgactactatacccagctgagaaatgtagttgaacgtcgttactacatcgacacatatattacacccagaagagataaagagacaaacacaaatatagacataattccagacacattaacctgtgataataaaaacccattgtattcgaccantaataaacccactatggggaaatcactaccaccattaccaccgccatcacctccaaaaatccatggagaatattatcggacaaatagatttggtgaacgatcccattatgtataa

SEQ ID NO: 7476 - DNA, 552 bp, Candida albicans
agttatgaaaagaaatttggcaataccaaaactgaaaatatttggcatgcatcacaattgaatctcaaaagtgaagtatcagagtcgagtcaagttgaaaagaaggccagcggggatattcgtgttccaaatgctccaaatgaaagcaggggaagtggtgcaagttcaagaaataatagcagtactagtttcccaccaccaccacttaccattaccacacatgggttcccattattttattatgttcctgctgataatgttaattttgataattcttattgggcaaatccacatccattttataatgtttatccacagtattatcctgcaactgctgctgctgctgccgccgctgctgcatctgcaacaggtggtgataatggaaatttgcaatatgatacaccaggttgtccaccttatggtgtagcgaacgtagttgatgggagtcctgaattttctatgattgcttcacacccttcatatggaggaattgctaattatatgtattatccaaatgaaccagaaatgaatataaatgataaaaaagtttaa

SEQ ID NO: 7477 - DNA, 282 bp, Candida albicans
  unsure (13): Identity of nucleotide sequences at the above locations are unknown.
ctcttccgtcccnaaactatgccggtccggctccttcgagtgaacataccggcactatctgaccaacatgtgtcaaccgagtctgaaaaagagtatgaaacaacggtatggggtactcgtataccaaagaatgaagcggtttcttctcaatcagcaatcgaagacgatgactgggaggcagaagagatgattcgtaaagcaaaggaggagatgtcaagacaagagcaagctgggggtggtaaaaagaaaaagaaaaagaagttagttttgttgtcgtcataa

SEQ ID NO: 7478 - DNA, 405 bp, Candida albicans
ataacagaaaggcatactagcgggatgtttaagaaattagaaagctttacaaatcctcaacacagtgatattagaaataccccaaaacaagatcctcaaccatcatctcccgcatcttttgtaacaggcaatgggaccgatgtgaaacaagcaacagatcaacatgaatacaagaatccttttcccacaatatcagcggtaaattccgcttctgcaaatactttaccattacgaccatcttttagtcatcaaccaccaatcaagaaaccgcggttagagtctttacatctgcgaaacaccagccctttttctttaaatcataatatcaataataataacatgaatcctcaacttttagctcgtccaattaccaaaccacgcgaacccctcgaagtaattttttaa

SEQ ID NO: 7479 - DNA, 291 bp, Candida albicans
ccacccacacaacaaatgtcttttaaacctgtcgaaatatcgggaaagtttggatttgggacaatgtccatgacttggacaccaacgccaccaccagcacaacaatccattgataccttgaaatttgtgacatcacatccaaaatttggaactaaattgatcaatggtggtgaattttatggtccagattttgctaatttgaaattattaaaacaatttttagaagaaaatgatcctgaagaaaatatacaattgtgcctcaccggccggatagaaggacaacgctcagac

SEQ ID NO: 7480 - DNA, 396 bp, Candida albicans
gcaatcatgtttaaaggacttcatttacttactccaattgtcacaactggtgcgatcatagccatacccacatccaatcaaatgatattcaatgaatctaccagaaaacgtagtttctacgaggacgatgaaaatgttgttccaattccaggaacagttactccagcacctgctactgaattagaaactttgggatctaatagaatcatagatggcatttccgtgcgttctacacaaagcacagaaaacttgttcaaatcagttagaaaattcactgaatcaaccgtcgatagtttaaattcttgggctgatcaaaaatatcatcagtataataaaaccgaaagatgggtaacagaatacgtgagctcattacatagcaaatcagaagatctttga

SEQ ID NO: 7481 - DNA, 345 bp, Candida albicans
ctttttttttttgtcgttgtttctcatttggttggttggtctgggtggtctttgtcttgtctttttttctttctctttttactttctcactatttcttatttgctgtaaaagttaagttcttggttttaagacacaaaagtggaaacaggaaggaagtgaaaaaaaaaagattattgatttctaaacttttcctcatctcatactattttaacaaccataatacctatactatgtacagacgtagcctaatactaaggcattcaaatttaccatctcgatgtataaacattattagaaactatagtaattcacaaccatcagataataagtacaaggattatgat

SEQ ID NO: 7482 - DNA, 186 bp, Candida albicans
gatctcttttgtgtatgtatggaaatctacatactctttgttaatcagtattgttttcaaactgcaatagaaaagaacaagaaggaatcaattactttgtttagaaagtatattattggttatggtcacttgtcaaaaaaaaaaaaaaagaaacaacaacaacaaactatatacttctttaactaa

SEQ ID NO: 7483 - DNA, 684 bp, Candida albicans
aaacatggcagcaaatcattcactctagaggatattttattgatttatacaactaataaaatgaattatttaattggaggagaaggtatatcaataatatctcaaaaaagatatcttcaatattggtatgattatattcataataaacaattacgtgaatcatatataaattggttaaatattatgaaatttataaatttaaaaatcattcgaataggtggattgaaattatctaatattgattatttaaatatatcaattctgacatatattacaaaaatagaaactgacactagtggtaatagtaataatagatcaaatacaattgttaaagaattaatacaattaacaaatgagaattgtgatattgataaccatgatgatggccacgatgattattggataacttataatattcatgatttgaagattttccaattggaagatataatgattggaattcaatcatggagttatatttggtttaatattttctttgaatcatttaaatcaaatggtcatggtcatggtcatcacaataataataaggttttattcaattgggatgatgatatagatggatttaaaggatttaaacaaaagggaataaaattatttaatgaaatagaattacaatgggatgttatcatcaccaccaaaagtacagatatatatgctaattag

SEQ ID NO: 7484 - DNA, 447 bp, Candida albicans
ataaatggtaataatgaatgggattcatcttcttcttcttcttcatcatctgcatctacattattggaatttataaatattgatgatttagataaaagactaaatcatgaaatcaataattataaaccacaaccaatacaaccaatacaacaacaacaacaagcatcacatacccaaccatccaatatttcaactcttttattcaatagacttgtcaaattatatggagataaaaatgttaaatttggtaatggcaataattcaactacatctactaaacaatcagaaatcattatatttaatgaaatcaaaatcattaaaccattcactaatattaaatcaaatatacaaatcattaaagaaaatggtaaaaaacatttagattctatacaaagagcattgaatcaattttggttagaaattgataatgaaaaacgtggaggttaa

SEQ ID NO: 7485 - DNA, 201 bp, Candida albicans
atgccagatttaaaggcaattaaaattttgaaccataaacagacccctacaggttcatttcttcaaatgttgtttgaagaaggtcattcagcatggttagcattacatattgccatggaagttgctcctgatttgacgcttcattatttatatttatatcctgatctacaaaaataccatgcagaacataatcctgactaa

SEQ ID NO: 7486 - DNA, 189 bp, Candida albicans
tttaaattttatagtgagcagatttttaaaacagaaggagaagaagaagaaaaaaaaagaggcggccgtaagataaggcgagacacgactgacaaaacattctctgagacaagcttctaccaccgctaccaccacgaagacgagaataaacctttttttatggttcatgcgatatgttacaagctataa

SEQ ID NO: 7487 - DNA, 240 bp, Candida albicans
gaacacataatatcaacacaatcaataccactggtcacaccctatgattatcatgatgatgatgttgataagaaatatcgatcgaaaggttattttgaaatgttttattcactaagaacgttgattataagtattgttattggtataataactttatttacaatttatacccaaatatctaattcaaaatcaggatatgctcctaatttatcaacatttgatacttctcaagtccaattt

SEQ ID NO: 7488 - DNA, 198 bp, Candida albicans
ggaaattctgtaagaaaacaaattgtttccagagtcggttatggactagattcgacactatttatggaaaatgtatgtgtcagccttattttactgtcgttgttgctgcttttagatatggccagatcgatcatagacgaagtcatacctcacatcccctttgaccctggaagtcaggggtcgaatcacttcaattaa

SEQ ID NO: 7489 - DNA, 186 bp, Candida albicans
tttcttaacaaagacaaagacaaagacaaaataaaatacttaatgttatatgttacacgaaacaaattaacaaacgccccccccctcccagaaaagtattacaaaaagattaataaaacccataatgtaagaaaagaaagtttgataaaatcaaacaaaaggacaaagtatcaaataatacaatga

SEQ ID NO: 7490 - DNA, 240 bp, Candida albicans
ttcccatcactaccttcattgaaaatgtctactacaaaaccaacaacgtcacatgttgagtctgataccaaaccagatgctgatcatcttgaaataagaaaatctaacttatctgaatcagatcttggagtcgaagaaataagtgatttaaaatatatcaacctcccaccgctgttgcaacacatgacacaagaagagttaagaacattagataaaaaaacaccagaaagttcgatttaa

SEQ ID NO: 7491 - DNA, 264 bp, Candida albicans
gagagtgaagacaataagttgatcaatgataattttatgataagagaggatatgaatgtacaacgaatgatgattaatagtttaaggaaacaattgcaatttttgttgttttccaagaatagaaataccactctaactggtggtgttggtggtgccaataatatgtttccatctatgtttcctactgaagaactgggattaggtgagatatatgaaacagtttctcgaagtaattctgaagaaagattgaatttgaaattataa

SEQ ID NO: 7492 - DNA, 372 bp, Candida albicans
attagagagcttataggaatggtggttatatcatctatatatacaggatatttaactcccgtgacgtgcataattgaaataggagagaataataatgaggtggggtattccacaaaaactgaaaatagaataattgtcgaatttaaaattatgaacaaatatagggaagatgccgaagatgatgacgggtgtgaaaattattcaataaactttaataaaaggctcgaaaggttacatatattctcagcattcggtttatttgtttgttgccaattatgtatgtttgtcttctcacatgcaagatctcgacatttggtccaacatttgattacggtgcctcacttgaagctcctaaaacctattcagcattaa

SEQ ID NO: 7493 - DNA, 543 bp, Candida albicans
ccctttttaatccttaatttaaccaatctcataaaccaaatacttttacttttaattttacttacaatgaatagtaatattgaagatgatccatggtcaagtggatggaatgatgacaatgacaataataataataataatacctccatcaatgatccattaacaggagcaactgcaacaacaaccccttatcaatcttcatatttaacatcatcacaattatttacttcaacaggtggtggtggtagtggtagtggaggtggctataatagtggagttaatacatataatacaacaattccaccaaatttaattaatgtaccatcatcttatgaaacaatatattctcatttcataaccaaatataacaataacaacaacaacaacaactcaaattcaacttttacattgaatgattttgcaattaatataactgatacattaatttcattaaattatttaactaattatcaaaaacaacacattctagatatcatttatgcacataatcttcaccacggggctggcaggatccgcactccc

SEQ ID NO: 7494 - DNA, 648 bp, Candida albicans
attttgaggcccaattttttttgtagtgtttccataaaaagtgaaggagccacatgtccattttctcacataacaacactgatgaatgaaaatgaggaatctacaaaattacaagaagtcgggtcaaatgttatacttccaccaattgtttcctatggtaacggtgaaaacggtgctagttctaatggacctagtctgtcaaatcagaagagacgtaaatgtccctttgatcatactgccatgatgaaacggaaatcagtttacaataacccaatagaatctaacatgagagaatatcgatcatatacacctagtcccttgggaagtagtatgccaataactaccccaatgatgagacatcaacaagaagatgaagagatgttaaaaccagtgcctctgtgttctccaccatctaatcatcaacaaatcgatagtgcagcaagtacaacttcaagtccttcaatgtttgttcttgatgatttagatgtgtttaatgagtttaacgattttgatttggatttcttacataatgaacatttattgaatcatattgaaaataataacaataataacaataacagtgttgctgtgaagaatagtgctgacaataatgagagtagaaatatagaaaactactttcaaggataa

SEQ ID NO: 7495 - DNA, 264 bp, Candida albicans
  unsure (71),(150): Identity of nucleotide sequences at the above locations are unknown.
cttcattcattaaacttgatttttagttcattaaggatgataagattagttagactagggccagggtctantatattgagaagacaaataggttatataccaaataggggttttcccatattcagaaatgttaagccacctctagaatcncgaattccgactgtttcctataaatcgaacaaactttactccacatcaacagtaagcagcacaataaactcgtcaccgaaaaagaaaaaatcatcatcatcatcatcatctcga

SEQ ID NO: 7496 - DNA, 1194 bp, Candida albicans
aaacaccgagaattctgcttcattttgcctcattttgcattaattcaccttcttacattttcaaatttaatcattccatctttcccttcaattcaccactccaattcccaaattttcgatttttactttattttatttcattttcattttcattttcagtttaacttttattattttagtcgtttttttttttacataatgtcagaaaacattacttctactacttctgctactgctgcaaatacaaatacaaatacaaatacaaatacaaacaccccaacatccaccactaccactactacaaccacagcgactcacagcaaaagcaattattataatcctagtttgatccatcatagcatttataataataataataataacggtactgctggatcgacaggaccaataaaaacaatagcggcagcgacatcaacatcagctgcacctacaacaaatacagattcaggtaaatcttcagtttcaagtatatccgccagtaattcaatattttcagaagcaccagaagtaaattcacatcattactactcacatcccccccatcaacactttccattcatgacaaacaataatcatcaccaccatagtaatgttaatgttggtggtattcccacttcaggataccctttcccacaacttaatgcttcacctacaacaacaatagcaggtaccataacttcacatagcaatggtacacccgaatcacagcagcaacaacctcttgtggcacctccaccacaatcacaaccaactgtgtcagcttcactaccacaatttcaaaatcaaatagtctcgggaacaggagcttctacaaaccctcctcttaatcctcgaattagtgccaaattcactaataatgatattcagatattacgtcagttattgttagctggtgaaaagcataaatggaaacaaatcaccaaagaattgaattcatcaactaatcacaatgcgcacatagttgcagcaataagtgctgctgctattaaatcaagaagtcttgttaataactatgacagtaacaataacattaatgataatacacctacaactaatttacatcatagttttggataccaccaccttcagcaacaacagcatagtttggaacagaaatcattaggtcatagagtaggcaatgggtcttcaccacggcctgcaaggaccgcactt

SEQ ID NO: 7497 - DNA, 219 bp, Candida albicans
cgtgataatgattttatttcaattaagggagtattaccaattaatgattcgatgcctcgagttcgtggtggtaataatgttagtttagaatttgatttatctttgttggtagtggtaacatataagttatataattctttggcaataagaaataatgatatcactgatgccgaggtttgtaatgttgatttccaattaattgccatattaattaattag

SEQ ID NO: 7498 - DNA, 315 bp, Candida albicans
atacacgtaacccaagatatgactcttcacgaacaagttgaagaactacaaaacttatttgatgaaaacgaatcattgattgaaaacaactgtgctagacttaatcaattacagcaagagttgtcacaggaagaggtttcgtttcttgaggtcaaagacaaacttatcaagctactccaacaactcaaagtatcgtacgggtcgacccaaccatacaccacttatctacaagaaatcgccgatgccgctagcgctcttaatgttacaaacgattttaatctgcagcttgcaaatgtattgaaatcatttcaatag

SEQ ID NO: 7499 - DNA, 186 bp, Candida albicans
ctcgctatccaagtcggaccgtccaccgctgatgaagacatagaagaacgaactaaatatggaaatcacacccctaaacaaatgtacaacaagttaaaaaatagtaagagaaagaattcaagtttgtacaacagcaacaacagcaacacccactttctacaacaatttggttatcagatgttgtag

SEQ ID NO: 7500 - DNA, 288 bp, Candida albicans
  unsure (246),(261),(264),(273): Identity of nucleotide sequences at the above locations are unknown.
aagatgatagtttcccattgccatgggtggaagtttccagttaccaccccctcgtctgtaaagcttaatgtaaaagtcaacggtaaagaattccgaatgatgaatttgaacataggacaagaaacagatcataaagtatcgagaactgattttagctggctcaaaacagtaagaatagtacgaaattcgttacaagaaaaaattttagattcaaagagcactttcaactggggtgataccaacatnttggaaattccagtngtngcaggtcanagaatctttcggtaa

SEQ ID NO: 7501 - DNA, 264 bp, Candida albicans
cctttaaaatgtgaatccatatctatcacttggcttctatcaattgattcaccaattatgttcaattcctttttttgcaacaagaatctccaaattggtaaaaatacattggatagtaacggtaatgccatagcactcaccaagaaaattgagaatccgtatagtgttattgtaagtaataatgtttttaaaggcgaaaatgacaagtactggatattcaaaactggtaagagccataaaatcttcaccacggagctggcagga

SEQ ID NO: 7502 - DNA, 507 bp, Candida albicans
ctgctattccaacattggcaagaaagtgtaagctcattagaatatggatggaccaatttggactatattattgctcatcgcgagtcatttaaaaagtccagaaacataatgaaatatgaacccgtcgtcaagggggtatatttgtccaactatattgttaatagtgaagaaaccaatcatttgggtatgatgagacaatttgttaaaacttcaaactattataaccaattgaagaaattgtataacgaattcactgaaatgaggcagaagtttttgatcaatttacctaaatgtcatttcaattgttcaaatcatagcaaaatcttgtctaattatgacaccaagatcaatgactataatttggaaatgaaaaaatataagaattatttgattattcttgggtttgggttacaattgagatttgatttagaagagcaagatagacaacaacaatatgatacatctttagaaaatgaagatgttgatgatgatgatgaatgtgaataa

SEQ ID NO: 7503 - DNA, 237 bp, Candida albicans
gattatgaaactattggtgaaactttatcaaccactgatatagcaagcagtgctggagctaaaagtaatgatacatcttaccaagatgatgagttgacgaaattggttaaatttgagatcaaaaaattatttttcaatatgaaagatatctcaaaagtgattccaactttccgatcactgaaatcaattaaaaacttggctgatttggctcaagatattgacaacaattttggttaa

SEQ ID NO: 7504 - DNA, 261 bp, Candida albicans
  unsure (31): Identity of nucleotide sequences at the above locations are unknown.
gccaattataatgataatgagagtccaatcnaccaattacttgctaccactaacgccaatcctaccgtgaaatccagttcattgataatggaactgtcaatcgctgaagaaccagaagatgctgaagatagtgacaccactagaagaagcagtaaggttaataactcaaaagatcattcacctgctacaagtataagtagtagtattaaaaaaccaaatttaaagattgctaattcagaagtatcagcattggtaatttaa

SEQ ID NO: 7505 - DNA, 207 bp, Candida albicans
atatcgacccgccatttcgaatatcgactccttatcttgctgtctcactcaaatactggtgcgtgtgtgtcagactcaggtgcttctcgccaacccccaggttgggcccaacatcctcctaaccctggtgttggttcatcatctcacattttctctcgaccacttcccacgattgggtttacacctttcctccgccctctacatcac

SEQ ID NO: 7506 - DNA, 321 bp, Candida albicans
ttcttgattatgacatccccagaagccgaatcaacagatccttccaaaagcaacaatgataacaatagagaaatagtgctacgatcgcattctgatagcacaattaacccaaatcctacactccatacaccaacagaaacacaacaacaaagtcgtctttatggaacattctttttttggaatagtctgactacacatatagaagaacgaactgaattgtcaattgaacaagcatcagctgagacaccacagctacagccaccagaatctacaaccagagcaagtatcaaacgagtcgccacaagaattggaaattactaa

SEQ ID NO: 7507 - DNA, 633 bp, Candida albicans
aagaacgaactgaattgtcaattgaacaagcatcagctgagacaccacagctacagccaccagaatctacaaccagagcaagtatcaaacgagtcgccacaagaattggaaattactaataatcaacagcaactggatggcacgacgacatggtggaatttctcttcatatagcatgatatcatatttcaagacaacacaaaatacacttgatgaagaaacaccgttgttgatgccaccttccacatcccaaaccacaagtaccaaagaagattctgatcaaacggttactcaaacttcatcgtggtggaattgggtattcggatcgaccacacctgcagataatagtgaagacgatgaagatgaatcacatacttctaatctagaattatacaaacgtgctaaacaagccatagaaacatcgaaagaagaaatacattatgtgtttaagaaatcaatcagtctggatactgatattagcaataaagttggattgagtgtatatggcacattaacggaagaaacaccagttgaatataattgctccaaacggaaaaatccattatcacctaatgaaatattggaaaatttaacaaccactcttcaccacggcgctagaaggtcccgcacttgc

SEQ ID NO: 7508 - DNA, 252 bp, Candida albicans
caaaatgaaattataatgtggttagccagtgtatattactgctatatttattcaaggtattctccaatatacgtatatatttgttacaacgtaagtaattttgattcgctatcaaatcaaatacacaaaactagtatagctttcagtgatccgggtaagtcaccaatgatattttgttatacagagaccgaaaatttttcagggaaaaaaaaaacagatataggaaacgagttggggaaatcaatcaactag

SEQ ID NO: 7509 - DNA, 186 bp, Candida albicans
attgtgtttggtgtttgtattagtaaaaaaatcttgtacgtgattttcacaattattgagttcacttccccacaagtcagtgtgcaagaaataagttctgttaataagacctatagtctcatctctctctctagctgtaaggatttaaaacttttgaaaacaacctttatctacaaaaaaaattag

SEQ ID NO: 7510 - DNA, 873 bp, Candida albicans
ccccgaacgtatatattccagccgccgggtcgaatattgaattcattatcggcaccaccagctatttatatgaataaagctgcttcagtttctagttttggttgtcttcctaccacaaacacaactaaaacttctggtgtatcttcttctaaatgttcaccaaagcttaatggtactaatggatcaactccatatgattcagcatatgatttattaaatacatttgatgtaccaccaccattaccaattaaagatggtattcaaaacaaactgtctagaaattctagtattagttcaaaaggatcttctagaaagaagggtggattaagaagcagattatcatcaatctttagttctaaatcatcatcatcatcagtatcatcaaaattagctgactcaactccagcaacatcagttcattcatcaagaaaaccatcaattggttcatcatcaaacactttagtcaattcaaaaacagaatctcaaggtagtaattatgctactactactactactactacttctgatgctcattcacattctactcgtcaatcagtaccattattcagtgcacaaccatcaacaccatcgattcatcatattccaccaatcatcaagaaagttgaatcaagtggtgttgcttcatcagcagcaacaagtacaacaagaaaaccagcttcggtttatggccatagatatggttcagttaatgatttaacttcggtttattctaccgatactacaacttcgggattttcaatgtttaaaagaagagataaaaatgatgtcaagtttgttcctccattgactagaaatactagaaaaggtaataaatataatgtcaaaaaagttccttatgatatttgggcctga

SEQ ID NO: 7511 - DNA, 195 bp, Candida albicans
ataccatctttaattggtaatggtggtggtacatcaaatgtatttaataaatcatatgctgaatcatatggagttgatccattagtaccattaagctttggtgaacatttagaagaagatacaccagaagttttagttgtgtttgtggtaggaagacaaccaaaactagaaactgaagcagctttattcatataa

SEQ ID NO: 7512 - DNA, 672 bp, Candida albicans
gtttgtttaattaaatccttcctgctcgtttttataatttatttatttcatttattcactcactcactcattcattcacatcttaataatatatatatatactattcaaatatggctattaaagacagagttaagagagtttctaaaatttttacttccgactccaaagaatctttgaaaaaagaagaacaacaagctaaagatactaaagaaattgaaccatccactacaactgaagatgctgctgctgctgctgctgaagtaaaagcttccactgaaggtgaagctaccaaagatgctactgctactgccactgccactgaaggtgaagttgcaccaactgccactgaaactaaagctgaagccgaagctgaagctgaagctgaaccagtagtggtagctgcagctgcagaagccactcctaaagaagttgcaactgaagaacaaccaagtccatcagctgatattactgaagaagttgccgaaccaactgctgataaaaaaggaggtgaaactgaaactgaaggtgctgctactgctactgaagctaaagatgctaaagctgaaatcaaagattctgctgaaaagactgaaaaggctgttaaaaagaatgaattctttaagaagtttatttctaaattcaaaaagaattctcatgctgctaagaattga

SEQ ID NO: 7513 - DNA, 276 bp, Candida albicans
actcttttaatcctccattcttcaaaaaagagatataaaatgaatttaccattgaaattcaccattgtattcacaataataattcaattcataactgctgcgttattaagtttcttattacttggatgtatagatacttcatcaaattattcaaatgtttatttattaagttataaatttaatcaatcatctccattatatgattatttatcaaccagttcaaactcatcaatcaccaccaccactaacaacaattctactgctatagatgcatga

SEQ ID NO: 7514 - DNA, 210 bp, Candida albicans
ataataaaccattcaaccggaagccaccgtgatataaaaaccttaaaagtcaattaccacttctggaaaaaggtgaatgaccatatcataaaagattatctcaaacatgaactgattcttcttctaatgacattatattcattgctgcttaggctcaaaatggttacagtggagaatggtctggaattgatacttggtaggacttgttga

SEQ ID NO: 7515 - DNA, 186 bp, Candida albicans
gcgtctattgtcttaatttatttttatagttttttgaaatgcattaaacgggaatacctacaagaagtgggaggaaaatcaatgatgggcaaatccacagaaaaaaataacatattcagagaaagagatccaccaaacacagttgatcaaatagaacaattattttggcgaattgctaaaaattga

SEQ ID NO: 7516 - DNA, 207 bp, Candida albicans
tatcaaatgttgagaaaaaaaaaagaaaccatttcacctttttgtaaaaatatagtgcttgttggggagtattctttcaaacaaatgagatttcaacaagtcctaccaagtatcaattccagaccattctccactgtaaccattttgagcctaagcagcaatgaatataatgtcattagaagaagaatcagttcatgtttgagataa

SEQ ID NO: 7517 - DNA, 207 bp, Candida albicans
ttgttgattgagagagaactagaaaaaaaggaagaggaatacaccagtctatttatacttttttgtccatatctattggtttgctttaatttcggagatctccacagaaagccgcacacacgtctacttcaagtattctctgataacaaaaaaaaaaatccgggtgcctatgcggaagaaacgcaaactttttttaacactatttaa

SEQ ID NO: 7518 - DNA, 255 bp, Candida albicans
aaactttgcatcccagaaacgcatcataaaaaaatcagaaaataccaagcaatgaagatttcatccagtctcatcttactgattaataaacccaccaggaatattccgttgaagttcgttagccagaacaatcaattagacaatattgctaaaaattgttctcattcaggttcattctatgccgatgatttccttggtgtttatttaattacattattaccttatatattctccagtcgaattattctgttctag

SEQ ID NO: 7519 - DNA, 261 bp, Candida albicans
tctctagtgcaggcagcaaacaaacaaaagaaccactcaatcttgcatatacctaatcttaaccaatcacaattcattatcacatcttatctatatttatttatactgcaaaatgtatctttactgccacttttttttttttcttctacttgttccaccgcatcaccgcacactacgcagtacacatcatcatcatcatcatcatctggtgttgttgttgctgctcctgctgctgccaccaccaccaccactatatcttga

SEQ ID NO: 7520 - DNA, 213 bp, Candida albicans
ctaataagtacccttcaacaacatacaattacgagaaaggaaaaggaaaaggaagaaaaaaaaaatcatagcaaaaaaataatacacagtttaaaccattcaacttgcattcacaatatacttttagatacattcattaaaaggaataagcagttttatatcctaatagatagcttattcaattttttcctttttaattcaagaaagaactaa

SEQ ID NO: 7521 - DNA, 1227 bp, Candida albicans
tctcggaaaatggatcattcaaaagtaccagtgtttaaaagacgtactaaattaccaacaagggaggaattagcagctatatttaatcctccaaaacaacgaaagttgtcatctgattcaactcccagaataattgaacaaagtcgagtatcattagatttaccgctgttgacgcaaacacaccaaacacagcatagtactacaagttcaacaaaatttatttccccaccacatttacttcctcctaatgctgctattaataatccaattttaaattctgtgcctcaaaacatcattcctatagtacacctgccagctattgtatcggattttttcagtgatataactactgatttaaccaatgaaaaattgtcaaatcaaattaatggaattcttgggaaattcccaccgccaataccacctgagaatccaacaacaacaacaataacaacaacaacaacgtcaaatccaccacagacaaacacttttgaagatttcactctagaacgaggaggaatgatgtttccatttatatatccaccaccaccaattataaatcctaatgaattaccttattcattagcttcatttaaagaaaaacttgataacttatattatgaacaacaacaacaattacaacaatcacaaatcaaaccatttagaggaagacttcaggcgaagaaaaaattgaaaactcctgactcttcaatgacaattaaatctccattatcagatataacttataacaatacaaatgataatcaagtatatgttgaggcaccacctttaccattcccaccaccaaattatatgccctatccattatcatcagaaaaatccacattaacaccatctgaagtatttggagtgtttttagaagcaaattctcaattacctagagttgatatggtagttgccagtgctgccgggtcattatttgatatgaaatcactggcttataaagaaggattcaatatattagattatgaattgggtaaattaaatggaaacaataataataataataataataatatgagtggtggtaatagaggaaaattaagacaaagaacgggattgaaaggaatggatgaagaagggacaataaatgataatgaaactgatgatggacaaaatagagaagaacaaataatagaagaagaggaagagagggagggagaagatgaggattttcacaacggggctggaaggatacgcgattgctat

SEQ ID NO: 7522 - DNA, 306 bp, Candida albicans
agatcagagccagcaaaaaggaaactaaaaaaacgaaaatcacatccaagagcaaaaagggaagacgacgacgaagtacaaaaacaacaacaccaaaagctaaaagaagagaaaagaaagaagaaaggagaaaaaaccacaaaaaaggaaaaaacacagccacctacatcgaaaaaaaagactcgctcaaactcggaatcagccacaaaaggagaaccagataatcagtcgtcgtcttcttccactaccattgctgcacaatctccattagaagtatattccaacacgccggaatggaaggtacgc

SEQ ID NO: 7523 - DNA, 759 bp, Candida albicans
  unsure (11): Identity of nucleotide sequences at the above locations are unknown.
aacataaaatntacggccgttcgagtaaatttaaccctgaaaaataatttaataaaattatttgattatttgaatacctggcatattaataatactttaaaagatcatcaacacagcaatccaaaatatcaagttgataaagtatctaccattggtgattcccatggagtttatttccattgggatgattgggttgatttatcccttggtaacaaaaaattagataaagtacgacaacgaaatagtaaagggcaggatcacctggatgatgatgaagatgaagatcaactagaggtagatgataatgaatgtgatgctagtttattacattatgctaatgttaatgctcatagattagaatcattagaaacaaaacatattcgaggtcgatgccaactatattgtctgttcccaatacctcaaagaattattgctactactgacaatttatttattgaaatacccgtgattggcaaaaaacgacttggcatacaagttagtactactaacaatgataaaaagtttactacaactacgaaattggtttccacaatggaaaatttacaaaataatttccgccaacactaccacaaccacaaccaacaaaaccttcatacctctgaagaacctcaattgctaattagaaacataacacgattacaaccaaaaattgataatttatctgtcaaagattttgttttcaatatagattcagaaattgaaaaattacaaattgctattcttacaccacgccgctag

SEQ ID NO: 7524 - DNA, 1143 bp, Candida albicans
  unsure (1127): Identity of nucleotide sequences at the above locations are unknown.
acgcggaccttcttacccgtggtgaagactaaaaacaagaccgtcagcagtgataaacccccattgcaaaccttaaaatcttcaaaattattatatgacaaatcaaaagaatatcaaccattaaaacccatacctgtgacagatttccaatgggatcaaatagaaccaataaaatcatatcctttcaaaaatgctgaatataaattaaccatggggattcgtactttagatcctcaagattggttattaattgaaccaacttataaatcacgaattgaaactaaatctaaaatacttaataataatcaccctgattatccatctacaaaagatcttcgatcatcgacattattttctactccagaagctattcttgcaattaaagaattttatggaattgtcatgaattatatgtgtgataaatatcccacttgtttcaaaatacaagaagatgaaaatttgatttataatttgatcaccaataaaaaataccctataccaaattcaattgatgatgttgaatttgattcttatcaattacaagaatttttagctgaaaatattgaagaagatttcatcattttattaaaagatccaactagagaatcagaagaaaatggtggtaatgaatattttttcaaagctggagtgtttgcgtttgctgctggatttaatcctattgatagatttaatactccattatcatttattcatcatcctattcctggttatgaatcaaaattgaaaatatccatgaatagatttttcaatagattatcaccaggtcaatttgtcaccagactgaatttttcaattcaaactcataataaattctatgttgatgattctaataaaggttatcataatcctaaaggtggtgatgttcttgaactgttgaaatttgaagatttggattttgaaaatcaagtacattatagaagtgaaagacaagtattaacaaaattacctaaatcaggtgcaattgtgtttacaattagaacttatcttttaccgttggctcaaattaaaagtgagggtaaagaagtttgtgatagattaattggtgctataaaaggatttcctaaagatatagctcattataaacgttctgatgaatccggcgcttnttcactacggaggtga

SEQ ID NO: 7525 - DNA, 216 bp, Candida albicans
acaacagcttcacgttcaaggtatgctatattgaatggacttgaagaaagtttaatcactggattagaaactgtgggttcaaagggaagactgaaattcttatattttcgttttattttagccaattcttcgtgccaattttcaggtgttctattcttgaatagttgggaagatgcatgtaaatttctcaacaataccgagttgattcataggtaa

SEQ ID NO: 7526 - DNA, 852 bp, Candida albicans
atcaactcggtattgttgagaaatttacatgcatcttcccaactattcaagaatagaacacctgaaaattggcacgaagaattggctaaaataaaacgaaaatataagaatttcagtcttccctttgaacccacagtttctaatccagtgattaaactttcttcaagtccattcaatatagcataccttgaacgtgaagctgttgtctacaaatttatgttgaaagaatttgacgaaaaatgtaaggagttcgaagaaattaaaggagtcaacaccctttatcctgacttggttgatattattatcaaagatataaaagaaacgtttgctaaagatcacaaggaattggcagaattgacaaccgacgagatcttacaaacggttcgtatctactatgaattactgaatcaacatctatatttagatgaattggaatttaataagcctgaagttcaaaaattgtttgaaacctataataagttagataacacagaagaaccagattacaataaaattgccaatgacttgggtttaaacccacaagctgttaagctttggatcgaaatttttcaaacccttgaatcagttgattttgctgttgatggaaggaaatcattccccctttgtcctccagaatacaatcttctcattaatttgaaacaagtgagagaaaacattgaaaaaattacccccaaggcacgtcaagatccctttggaatgttcttcaacaaagccaatcccaagcaagatgataaagacagttctaaaaataaatccaatgaagataccaaggacaaaaagaaaattgttgatattctgattgaattgactccgaaaaacattttcatgtag

SEQ ID NO: 7527 - DNA, 477 bp, Candida albicans
agagcatcatcaaagcaatatttaatttatcaattagatagatttgaaaaatatttaacaaaagatagagttgctaatgatgatatagcgaaaattgctattaaattgactaatgggaatagagtaactggatattttccatctaataattcaattgaagatatatttatatttgttgaattgattaatcgaggatatttaaatgttgctaataattcaacgacaacaacaacaacaacaacaacaactaaattaacatcaacattaactgaatcacaagcattaacaaaatttaaagattttaaattaatttacaattttaaattattatcaccattacctcctaaaatttgtttaaatgatgtattattatcatctaaagataccacacccaccgccaccaccatcaagattaatcaatttgatataatttatccaaatggtttattaatagttgaagatatacaaaaggattaa

SEQ ID NO: 7528 - DNA, 480 bp, Candida albicans
tccctaccgacgcggatttctacccgtgggcaaggcaatatatctaactcaaaaaagatatcaccatcattatcatcaataacaacaaccacaactgcagaagatgaaagtataaatgatttaccaacaaatgtaatcaccccaactccgaaaactaccaccaccaccaccactacaaccaccactacaattaataatgattcgaaatatcctttattgattagattatcaatgaattcaagtgataataaaatcaagaccaaaaccaaaaccaaaactgataataaagtccaaaagaagaaggaaagagttaaaatatcaacggtggtagaattagatcaattgaatgaattttgggatcaatatattcaaatattaaaatctggatttattggattgaaaaagaagaaagattacaagaaaagtcatacaaacaataacagtaatagtaatgttaataataagattaaaaagaaatag

SEQ ID NO: 7529 - DNA, 474 bp, Candida albicans
gaaaaaaaaagagcaggagtactttaccaatcaaaaacgaaaaatacagaaaaggaagaaaaaacaaaagtagatcgtcataaaattcataagactaaaccatcaagaaagcggagacaatcgaaaaaaacagaaaaggaatcggaaaaaaaaaaatcagaagaaaaggaaaatcaagaaaatcaagagctcaagaatcaaagaatccccaaaaaaaacgaaaaagggaaagaagctcccaaaaagaaaacaaaagacaaagaagaaagtcgaaacacaatcaatcaaaacggcaagagagaaaaacagaagaaaaagcaaaaatcaaagaagcaaagagcaaacccaaaaggaaaaaaagaagaaaaaatcaaaccagagaaagaaagaaaagaattctcaggaaaaaattcaaaagaaagagaaaaagcaaaccggggatcaaagaagaatccagcaaatttaatacgttaa

SEQ ID NO: 7530 - DNA, 201 bp, Candida albicans
tatctggtcatactggccgtatttgtacatatgtgtgaatgtgtgtacatgtgtgtgaactcgggtcatatcttagtgcctgaaaaaatttttaaacagatacgaaatttcgcctcgccgcactactttttagatgttccagaaaccgtctattcattcgacacagcattgagtatgtgctcaccagccgaagcgatcaag

SEQ ID NO: 7531 - DNA, 195 bp, Candida albicans
ttttcttgttactccgtttcgttcattcttttattctacaaaagtccatcactttctagtataacatttactttgcaactgggatacaactatcgttcgcttaatatatcattcctaatccttttgatcccagccagcttaaaaaatgtatcagcaccaagatcaaactcagcatcagtattaccaacagtataa

SEQ ID NO: 7532 - DNA, 408 bp, Candida albicans
aaaatgtatcagcaccaagatcaaactcagcatcagtattaccaacagtataattcatacaacccgtccatagaggatttgattgcctcatcagatgataaacggtatcaaaatggtggtatcggtaacctgttacaaagacctccagtagcaggtttaccttatatttcgtcacaagttaacccaaacacttcatcagccaacttatccaagctaacaagcaatattaacaattatgggtacaacaacaacaacaacagccacattcaattacacacaccaccattatcttcaaacccatctttcacttcgttccagaatttgaactacccattatcaccactcagcaagccaacgtcacccgaacctatattatctgccgcatcagtaaccacaagcaatttttag

SEQ ID NO: 7533 - DNA, 348 bp, Candida albicans
atgttaagttttaatcgtaatattcaatgtcactgctttcaaataccaccacctcctcctccgccgccacaaccacctcctccaccgccacaaccaccaccacctcctccactgctactaccacaaccaccaccacctcctccactactactgccaccacaactaacacaacctccagtactaccacaaccattaccacaaccgctaccgcctatgcatttcccaccacatttgccgcatgaacttgtagagttagcaatagaacagcacaacgtattagaatacaattcagaatttgctgaatctactggagcaccaggtgccataacaaacatcgaagaattatga

SEQ ID NO: 7534 - DNA, 189 bp, Candida albicans
aatacaaacaaccacaaagaaacgactttgaacggcctaaccagccaaccaactttacctagtccaaaattctattccacaaatgagcatcaataccaagttattttagggttaaccttgttgataataaagatcctaaagtgtactataatagttgaatatttgttctcttcaccaacgattatgtaa

SEQ ID NO: 7535 - DNA, 198 bp, Candida albicans
ttattttttcttaaagaaagttttattatatatttttcaagttatataatccatcatcttgatctccataggaccagaaaaatatttgtgtcagaaaaactgagatcgtgtacgaggcttaatgacaatactacaatagagcaaaatgatctacggctaactaaatctgtatgcgggcaggggaacgaaagaatttga

SEQ ID NO: 7536 - DNA, 240 bp, Candida albicans
cacaaaataaaaaaaagttctacagccgttaaacatattttcaaccacatggcaaagtatataacccattgtacctttttccattgttcatccttttttttctcaaaatcaattacatcatcgtcgtcatgggatttaataaacttgttccatacacaacaacaacaacaagcccaggggctagcaggggctttaaagggaagcgcagtacaaaataggctttggcttattaaactttga

SEQ ID NO: 7537 - DNA, 183 bp, Candida albicans
gaaaacaggcgaattgcatattttttagtacttaatgtagttcatgtgcaaatggtgatccgattattaatcatagattggagtcttagaatcgcaacaacaacaccactagagaataacccatatttaagcttgtacgtcttaaatgtattttgctatgaatacattcaatcaattgcttga

SEQ ID NO: 7538 - DNA, 192 bp, Candida albicans
tgccattatatgtgtccacaacatattgttagtaaatttccaaattggggttggggattacttttgatgcatatggagagagctcgtgaaatgaccgctggggataatattaaaacttttaaacttggattgacgaacaacaacaacaacagcagcagcaacaacaaggtttttcacatgcacagtcactag

SEQ ID NO: 7539 - DNA, 282 bp, Candida albicans
attccagtaatatggaatgatggttcaacaagaaacggtacaagaaggcaggcaaaaaaaaatagaagctgggaccctggagggatttctttgttaaaggtggagactgcgaatgctcacacacaaatagaaattgcaaaagtggttctaaatgtcgcgacaacaaaagttgaacaaaatgacgggaaaaaaatagcacttaaaccaatctacatacatacaaaactggttgaaaacaataacaaaaccaacttaatacttcattattctattttgggataa

SEQ ID NO: 7540 - DNA, 612 bp, Candida albicans
acgcgggttcttcatcccgtggtgaagaactctttggcacagttaaatttacaagatagtaatggtgcacttggtagacatatttcagattacacaaagtatttatttgatgatgatgaagaagaagaagatgatagtggttcagaagagggtaataatcgaaccgttcatttactggcttatggtgataatgatagaactttaataagtgcgaaaggtagggaagcagatggttatagacatgataccaatcctcaattgcctactccaaacacagatgatgggttgagtagacaaggtacttcagcatcggaggcatcgattcaaagtggtggatcattaaaatttactgtcgccgatagtaagagaagactgaatcttccattgaaaccggttaccaacaataaaccaaaaaagaagaccaagaatgccaaaaaatcgaaaaatactctcgaaattcaaccacctgtgtgtcaggaatataatccaaatatgccattacctgaattatctatgggtatgatgccctttgcatcttcgatggcaggacttgctccacctccacctcctgtatttgatggatctccttccgtaaaaccaatgatgatgaac

SEQ ID NO: 7541 - DNA, 735 bp, Candida albicans
atttctactaacactttgaatagattcttaccatatacagttcattttgagattgatactgcggaagtacaatccattccgcaggatacagcaacatctgctcaatctacttcaacaccaagtacaactgcatcatcgactcaattgtctattcttccttcgttatcaaagcaacctagacccgcagctgctattccagataacaagcaatttgaacgttccgataccccagaagggttcttttacaataaaagaaactctgccaaatccgaacaccagtttatccagccaatatcaaaaatcagcaaaatggaaagttctgttgttgattccaaaaagccaaacgaaggtatgggtcttcctggatttagcagatcacaagttaacttggcaaactcgactcccaacttggcacgtgttgcgaaaccactagcaccacctcctttgaaccggggccgcagctcatttagtaaagcgttattcacttttcatggaaacagcagtgccacctctttgttgtctgaggatggtactgctgatagcagccctgttattttgccttcgagtttggaagatgattttgatcaaaatttccacgatatggtgcatgggaaatccagattggccccgtttggtgggttctctagaccgggtgttgaatcacaatttctttctgaaaaaaacatttttgatgttgccccgtggtcttcaccagccggccggaaggacagcgat

SEQ ID NO: 7542 - DNA, 315 bp, Candida albicans
ataattgtggtaaaaatgaattcagtgaagaaaattagagatggacttgaagattatgatgaagaaatatatcgacaattacatacagataaattattggataaatataatgggaataaatatgaagatgaagaagaagaattaatgatggcattagcattgagtgaaagtatgaataatagtcgagatgccagtgaaatatcaattaatgaatcgttattaacaccagacgataaaagtcaactagaagaagatgaacaagaaatggatgaagaacttagaagagcattagaactttcattaattgaacattaa

SEQ ID NO: 7543 - DNA, 540 bp, Candida albicans
agacctattggaagttttaaaggtgatcctaaaattataaatgattcgtttacccaattattaaatcatggacccaaaaccaatgatttcaatatatggttgaaattattagataaacccaaactgggaaacaaagaatcatcaagagatttgaaattgaaattaatgattttacaaacctttttaaaattattccaagccaattataatttcaataattatattgattataatgaattctatgaaaaatgttatcaattatatctgaatggtggtaatattaatcaaattagtataattcttcaaattttttattatattgccaagaaatcaaaatcagcatcaccaacaagtttaacaacgaaaatcaatcaacaatttacgagatttttaaaagccaaatatttatgtaaattaagattagatgaaatttttttacaaattatattagataaaaatggagatttacaaagatatgaacaaatagaatggaataatttgaatgctagtgatataacatttatccgagaatccctataa

SEQ ID NO: 7544 - DNA, 207 bp, Candida albicans
ccggtttaccatggtaatggttttagggagttagttactcgattcaatgttgtaactggttttcacttttttagttcttctacacttattttttgggggaaatatcaatttgctttgacatttataattacatttgagtgtgctaggtattttctagaaattattatatatttccatatttctatctttatatatgtatatttatag

SEQ ID NO: 7545 - DNA, 255 bp, Candida albicans
ttaattttcttttttactttatctactactactagtactttcctaatgccttcaaatttattttccaattatttttatagacaaagacaacttccacaacatcaacaaaatgatataaatacgtcaatccttgaaccaacaactgctggaactgtcgatgctaatcctaatccagtgatttctaatttgatcaatcaagaaagaccgaaacataattatcataaatcttctgataatttagccattggattataa

SEQ ID NO: 7546 - DNA, 999 bp, Candida albicans
agacaatgtgctcagatgccaaatggtcaaaatcagccttcaatggaacaacaacaaagaatggcaatgatgatgaaacaacaagcaatggctgcacaaagacaacaaatcccaatgaatggtttagatccacaacaacaacagcaaatgatgaatgctgtaggtggtggacctggtaatttgaatttgcaacaacaactatttttacaacaacaacagcagcagcagcagcaacccaaaactactttccagcaacaagcacaaaatcaaatgaacaatttgcgtcaacaagctgcaatggttgctcagcagcagcaacagcaacaacaacagcaacaacaacagggtcagttgcaaggcaatttggcatcagcaatgggtgattcatctctgaagaataactctcctgttggtgcaagatcaaatcaacagctgactccacaacaaaatgctgcaccagctccactgccacatccttctcaacaaggtcaagcacaagctcaacataatttccagagccaacaacaacaacaacaacagcaaatgactaagatggctgggtctcaaggaatgaaaaagaatggtcagatgtcaaacggcactagtaataacagtagtggcagaaacaataatgctctacgagattatcaaaatcaattaatgttattagaaagacagaataaagagagattagaatttgctagaaacactggtaattccgactccaacccattgagtaatggaatgatgtttgccggtcaaaatcaatattcaaattcaaatcaaaatcaaaatcaacttcctcctaatcaacaacaaccaactccagcaactttccacccaccacctccgccaacaactgcaaatggtcctcagggacaatttaatcaaaaaccatcacctgcaacgtcaaacaattcacctgcattaggcaataaatcatcaccagcaatgggcaataagaaatcgaagaaagaatccaatagtaaaaaaggttaa

SEQ ID NO: 7547 - DNA, 798 bp, Candida albicans
  unsure (11),(13): Identity of nucleotide sequences at the above locations are unknown.
aatttaaaaananaaatgggatatccaccaaatttcaaaattgttactaaatcattaacagaaaacattttattagcatcaacggctttttcaagagttgataaattcaattttggtgctcgtatggcggtatttaaatttcctcaatcaaataaaatcattttatggtcaccattaccttatacaccacaagtaattgatgttttaacaaaatttaccaataataccaatgaatcaaatttaaatattgcttatgtgataattcctgatcgtgaacataatttagctgctaaatcatataaagaaaaatttcctgggtgtaaattaattggaatggaaggattagatgaaaattcattgaaattggattataaatttataaaactgatgggtaataaagttttgaaaaatgatgacttgagacaaatctttaatgacaatgacagtggcttgattgttgataattttgaatttgtttatttaccaaatcatgcaaatcaagaattggttgtatttgataaatcatcatcaacattatttgaagccgatttattattcaatttaggtgtaccggggtcaactctgggtgaaaccattttagaacaatattcaccagagttggggttccctaaagggtttaatcctcattctggttggtcatttataactagatatttacaaccatattctaaagttggccgtttcttatttagaaaaattgttgatataaatcatagtaaacgtgcattagaagctatttttttcacacacaggcctgggccatccgcattggggagg

SEQ ID NO: 7548 - DNA, 426 bp, Candida albicans
cttgatattgaatgtcataaacaatctttagtaacttcatatggaaaacccattattccagcattattaaataaaaacatcctaaatattctctgtgtcaagaaaattcattctaatacttttggtcacattaacatagaatttacaaattcaatattgaataatattccaattcacccaattggaagtttatatggtctccttaaacctggtctggtcttcaactttcaacttttgaatttatccaaatgcgttccaatacttttgaattcactctctctaagcacctttaaagatatttccctggttatattctatctaagaaaagtttatccacccaattctctgaattctctcccagtaaataataaatcacttctcctgtgttcctattgggtcaacacaaaggggctgtatatagtaatt

SEQ ID NO: 7549 - DNA, 921 bp, Candida albicans
ttcgtggatcttcgcgctcgggtgaagacccttctagtcccagtgaaaaaaatacccaaattaacgaaacaaattgatgatagatcattgactcccacacaatattcatccggttcaattgttagtttgtcgcaacaacaaaagaaaccaatttcaatattatcaccaaggtcaaccaatattccagattgttcctgtatgaaccgacagcaatgtgaacgttgtcaaaatgagaaatccaccgataaagaaatagtggaagattcccaggaaaatccagaagaaataatatctattaataatttattcccatcatcaacatcactaacttcctcctcttcatcaacattactgccacccttccatattgaaattcctgaaggttataatacaattattttacaacggaagtatcgattacaattttatataaacaaatattataatgatcctaatttcaaaataaatttacgtctacatccaacaaaattgattgattgggatgaagttgatttcatcattaatgaaaattataaaccagataaattcacacaatttttaaatagaaataatattaaaaatggtagacaatttgaaaaattcaaaaagttatatcacatcgataacaataacaataaccaacagcaactgtcacatttggaccaatttgagttcgaagataaattaagtcaaatatttgataaatttcaatcaccaccaggatttatgcaaagtgattttcctgatactcaagaatataaacaacgacgagaaattattaaacaacgacaattgaaacgaatagaacgaagaattaaagattgtacaacaatacaagatggtaaacaaattggtgaatttgttttcgggatagaaattttcaatctttatgtcattagtaatcgttggtacatcaaatga

SEQ ID NO: 7550 - DNA, 210 bp, Candida albicans
agccaaggctgtttccaattacaggcacatgattgttaccaaggctctgtcctgtatatcacctcctactgtgtaacatcattgactcctacacaccaaattacttcttataggtgtaaatatattaattctacattctctatcctacacgtatatgtatgtctaactttattgttgtcaaaactgtcccaaccctcccttaatcattag

SEQ ID NO: 7551 - DNA, 276 bp, Candida albicans
ctttattgttgtcaaaactgtcccaaccctcccttaatcattagcctttcttttcagggaatgctttcatttgatgtaccaacgattactaatgacataaagattgaaaatttctatcccgaaaacaaattcaccaatttgtttaccatcttgtattgttgtacaatctttaattcttcgttctattcgtttcaattgtcgttgtttaataatttctcgtcgttgtttatattcttgagtatcaggaaaatcactttgcataaatcctggtggtga

SEQ ID NO: 7552 - DNA, 186 bp, Candida albicans
tttcttaattacattcaattaaacgagagaacaggaacaaagattaaaatgaagaaccatatggatacgctaagggaaaatagcgataaaacgtgggaagaagttgaagaagaagaaagattctcaaaacaacacaaaaaagtatatgcagcaacgccaaaaactataaatgaacacaaaacctaa

SEQ ID NO: 7553 - DNA, 216 bp, Candida albicans
tgtttgttctacacacacaaaaaaattactagtattttttaccatacaaaaaattactatgtattacacgcacacaaaaaattgccatacaaaaaaattactagcattttttcccatacaaaaaattactatgtagtgcacccatacaaaattaccatacaaaaaaattactatgtattctcacacacaaaaaattgccatacaaaaaaatgttag

SEQ ID NO: 7554 - DNA, 417 bp, Candida albicans
atcaatttaaattgtccaaccaaccataatgacaagtataataatcctgaaaatgccattgaagaatgtcctgaaggagttgattttaatccatcagataagtacattggacccaatggtgaagtacaaacttcaattcccaccaatttattctcaggagttcccttttgtggtccacatctttctaaaaaatcaggtcgaggattacttatccaacattttaacacatctgtcaacacggaagtgacacagacacttaaccaaagtcctaaacaagatacttgtaaattatgcaatttttcaaaattggattctccaagatacaatgaaatcaaacttattataagactagggattaacactgaatataggtataattggttatcggttacttgttcttgggttgcaaatggatga

SEQ ID NO: 7555 - DNA, 219 bp, Candida albicans
ttgattttccaaagggaagcactaagtaatcaaatgtactcaattgataaaatggcagccagtggaatctatactctattggcactaatagtattaacaatcattgtcattttgttactaacaacttcaaaaaaaaatagttcatatctcatagatactgaatatgaaagaactattgacattctttcccaatttgtaaaccctgcttcattgaaataa

SEQ ID NO: 7556 - DNA, 792 bp, Candida albicans
  unsure (460): Identity of nucleotide sequences at the above locations are unknown.
gatggaagtaaaaaaaaagagatcccatttagtattttatgttctatccaagtcaacatacaaactagaaactcccattacaatatggctaaaacaagatctaaatctgctgctactgctgctgcaacttctcctaaggcttctccaactgcagctaaagtaactaaaaataaagttaccaaaccatcaacagcatcaccatcaaaaaccaccaagactaaagcagtaaaaaaaactaccaccaaaaaggccacacctaagaaagaagaggaggaaaaaaaagaagtacatgtggaaactgttacaaaggattcaagtttgattcctgaagaaatcaccgaaaaggcaattagtgaattgaaaaaatatatatctagacaatcccaacaacaacaagaaacagaaaatgatgaatctaaaaaatcgaaattgtttgatgaagatgaagatgatgaagacnataaacgaaatgaatccttctacttgaccatagattctaaaaaattctggtcttctaaacctcaattcaaaccaaaatcattcaaattgaccaaaccattatatgataataaccagaccaccacaactactagcaacagtaataatgatataaatgttgataacaatatatgtgtaattattcgtgataaattagttaaatcaattgatgaattaaatgaattagaaaataatcaatcattatcacaaattactcaaataattccattgaattcaattaaaactgaatataaatcatttgaaaaaaaacgagaattatatcaccaattttaa

SEQ ID NO: 7557 - DNA, 216 bp, Candida albicans
gttttttttatcaatcttttggtggggtttataataccacatggattgatttttgtttttattagcatgatcaatttttattcatttttcaattatatttcatttgttagtacgttgtttgtaactaagtatattttaataaagattcgttattcaaaaatcaaaatagtaataactgtttataaattcaacgaaggactttatgctttaggataa

SEQ ID NO: 7558 - DNA, 219 bp, Candida albicans
tttgtggggttcaatattttaacaaacagggccggggaggaaaaatgggttccagagatcacaaacgtgggtgaaaaacagcatttcattgaatgggccaagaattttgcaattacccatattcatgaaacaggtgttataccggattcgggaggctcaactaatatgttaattcaacctttttttgcaaatgcgacagtggttattccaagaacttaa

SEQ ID NO: 7559 - DNA, 351 bp, Candida albicans
aaatttagcaacaattgttcaagagaaagatttgctacaatattctttactaacttgacttctgctgtgaccagaaatatcactattggggaagctaagcacagaaacataaatctgatatatacaagcaaactccagaattttgtcgatacatctcatacaccaaaatccgagacttctgataacaaaaaatgtggagaatgtaaacaaaaccttatctcctccatctttattttctggccacaaatgatcaatcggcatttagctaaacgaacagtactggggttatactgtttcaactatctgaataatcagactgtgcttttgcacccacaattggtcaaaacataa

SEQ ID NO: 7560 - DNA, 204 bp, Candida albicans
  unsure (3): Identity of nucleotide sequences at the above locations are unknown.
aanagttcccaaccaacagtgaagacacaacatacatccaacaacttcgttttgacagatattctcttttttacggatgaaggattatttggcaaaaatgataagctaaataatattacaaaaacaagtcaattcaattctgtagtaagtttggcatatgcacttaaactgttgactattcatgctggatgtagcaattgttag

SEQ ID NO: 7561 - DNA, 189 bp, Candida albicans
aaaatttcttgttcgtggagaaacaaaaaggaaagaaaaaaagaaaaatccaattctctttctcagataactgttaattattcctacaccatatacttcaacatgagtaaagatgataaagatttagaagagatttggaaattgtttcaagattcaaatgaagatgttccgaaagaagaaaagaaataa

SEQ ID NO: 7562 - DNA, 288 bp, Candida albicans
tatgtccttggtcccctggtgacaattggttattggaggtctcctttcaaaagatcatttttattaattacatacattgtgttttttttattattaattatatttttgtttcaaatccaatcctccataaactatatatattttttttttacaaattatatagagtataattttaattttaattttttcttattaaagataatggatagttactttttatattgtagaatcaaattcttcttttgggttgaaaatatcttgaagttttttacctgtttcattaaatga

SEQ ID NO: 7563 - DNA, 519 bp, Candida albicans
tatccctatcctatcctatcctatctcaccctatcctatcattcaatgaatgataattttaatagttcaaatttttcaagtttcaaaaattcaccaaccttgttaacactgactaatgaacaattaaatagattatggaatttgatattgaaatttgatagaatatcaataacatcaaccgatattaatatcgaagatactgataataatagtagtactggtgatgatcaatttatttctattgaaaaattctataaattattaattaattatcataaattaattgaattaatcactattaaaaataatgaattaacaattatgaaattccaatgttttgaaatcattcgtaatattcaacaacaacaacaacaacaaaagccgaacacacacaagatgtttaaccaacacaattctacagcaacttattcttcttcttctttttcttcatttaatgaaacaggtaaaaaacttcaagatattttcaacccaaaagaagaatttgattctacaatataa

SEQ ID NO: 7564 - DNA, 258 bp, Candida albicans
tggtatttccgagttttcattcattattcgagaaatattctttttacacaccaactgtaccccctcctcctcctcctccttcttcttcttctcctcctaacggaattttattttatgccgattattcagtcttatatatatgatgactacaccattttaattcaaacaacaattttcttattgctttcttttaagttattcgattctattaatactaatatgaaaagggagattcctgaattaatagtattttgttga

SEQ ID NO: 7565 - DNA, 261 bp, Candida albicans
aaaataaaaaaaaatgttaataacaaaaatcttcttgtttttaattgtccttgtactttttgtggaatttcaagttttaaatttgtttctttacaacaacaacaacaacaacgacaacaacaactttacatacatacatacatacatacttggttacaactattccatataacaacagattttagtttaaaagatcaacaatatcccactcgtcgttctcaacagtcttcactacgagatagcccgtccgcgattatttag

SEQ ID NO: 7566 - DNA, 1071 bp, Candida albicans
aaacctatccttaaaaagaaacgtacaagaatttcaaaagcctgtgagtattgtcgaaagaaaaaagtgaaatgcaatggttgtcaaccttgtcttaattgtctacaatcaaataatggtaattgtgaatatgctgtggacgatgaaaagaaacccaaaattctgaaaaagaagaaatcaacatctctgaagagcaagctgaacagggaccggcaaaacaaagctcttgatgaaagattgtccaaaattgaaggcattcttgcccaattagcagctggaattggtaccaatgataacacatcgactttaagccctgtgtcgggatcaaatgtcccaaatggaaaagaagcaaagacagataaatctagccctctccaattaccgaaggagattagggaggagagtgccaatggacacgacgagaagcatgatcccaaagtggaatctaattttcatggttcacatagtgtaattaacattttctgcaagaaatccgtcgaatggctattcaggcctgtgcttagcaaatgtaaccaagacatagaggtattcaaagatattgccaaagtaaacgatttatatatccaggcgttccttgacaccatttctcaaccaattaaagccagaattaatcggcgaaatgaccttatggacaacacttttgctaatgcaaagataccattggagattttatcttgttatgacgatatttttctagttagttacgtatgtaagggagacgacatacgcaaattattccaaacttattttgaagaaccagatcaaaatggctcacgcagaagaagctttttatggagtgagttattactaatgactgctgccgttggtatttgtatttcagtgttgattgatgatcgtaacaatactaaagataccgataaacccaagtattcttgctcattatcaaaccagcagttaattgagatcaatttcaaatgcttttattccatgattttttatcaccgcagattatgtgttataggtgaaggattctccactgtaacagcgtttgttttgttgataatgtattttgattttgccgtgcctata

SEQ ID NO: 7567 - DNA, 1257 bp, Candida albicans
cctcctggaatgcaaggtagaggtaataatgctcaaacacctttacaacaacaacgattcaatatgtctcaacgacaaatgatggcagcacaacaacaacaacaacaacaacaattacaacaacaaaatgcaatggctgcagcagctgctgctgctgctgcatctggacgtccagtacctcaaagaaatccaaattataatggaagtcctaatcctggacagacacttcctttaaataataacaacaacaacagcaacaacaacaacaacaaaactgggatgtataatccaaatgcattagcaacagggatgccttcttcaaatttgcaacgtacttcttctgcaggaaactctcgtggtcatacaccaagaatggtaaatcaaccacaaccatttataccgcatcaacagaaccaaccacctttaccaccacaacaacaacagcagcaacaacaacaacagcaacaacctactcctcaactcccacctcaaggtcaaacaccacaacaagtacaaatgggatatcccaagaaagtaaacaatggtaaccttgttgcaaatcagtctcttaaaagtggaccaatggggggaccagtacctatgggaggaccacaacaagcaagaattcttccgaattcatccttccaacaatcaccacaaacacagtttgccatgcctcccaatagtaatggtcatatcaatccccaacaacaacaacaacagcatggaccaaatcaaaatccacaaccaacagtaagtggtcgttctcctattcaaagacaaatgataatagccaccacaacagcaacaggtggaaaaggtgacacaaacaattcagttcaagaacaagtacaacaagaaatcaataccagaatcattaaaagaaatttaggaaatgctgctataattagagtattagatttaattgaatttatttcaaatcaacattatgaaaatttatcaaatatagaattttggacaaaaatcactccagcaaattttttaccaacagcaattttaaaatttaatactaccaatattactggtgctaatggtaataaatctttaaatgatattactggattgaatttaaattttttaaattcaaacaaagctacgagtaataataacaataacaatactaatactaatactaataatagtaataacaataataagccacatcagtttgaattaactactagtactgctccacgattgttgctagttgtatacacggcgtctaaacgacggaat

SEQ ID NO: 7568 - DNA, 195 bp, Candida albicans
tccctgtcgaatgtcatattccttgcaagttgttatttgactagaaatatattggttgaattatcggtggaaaaaacactattaatgaagggtgctaatccccttgactatttacaattaatacatagttgtccttttcaaaaccacttttttttttcacgatttagttcaaattctaacataaaaaataaatag

SEQ ID NO: 7569 - DNA, 432 bp, Candida albicans
agatatcatttagtatttgatattttcaccaaattagaatatttaatattaaatcaatctgagaattctactactagtgttggtaatgggaatagttatagtttttatctgagtttaatatggccaatatttatggcagcatcagaaatttctacaattaatgaaaattgtgaatcattaagatatttaacattacaaatttttgataaattagaatcaaatactttaggaaatactaataaaatcaaacaaataattataaatatttggaaaaaacgagatttaatcaattcaacaattaaagataaacctacaaatggccaaactaaagatgatggattgaaatccaagagaagaaaacgattaatgggatttgtcaatgattgggagaaatatgttgttgaagaagattatgccattgccttgacatag

SEQ ID NO: 7570 - DNA, 204 bp, Candida albicans
aactgttttattggtgttttagttaaaactaaatcaacaaactacgagagtattattgttgacaaaaatcttggttccttgcctagaattatgtccttttttatgcaaaaactatacaccaatgaagagtttgtctctaattcagatttacgagtagtagtagtagtggtagtggtaatagtagttcatatcaattatttgtaa

SEQ ID NO: 7571 - DNA, 243 bp, Candida albicans
aaaaatagagaaggagaaccgaaaggtctagacctggtttgtaagccttcccccctttcaagaaaaataaaattaggttataagcccgtgaaaacgagtttaattattccatactcagagatagagagagagtgtgtgtatgttttatttatgtcatgttacataaccatcgtcttgattattttaccttctggtgaaatggcatcaaaaaaacgcaaacgtttgcaatttttttcaatatga

SEQ ID NO: 7572 - DNA, 246 bp, Candida albicans
aactctcagtccttaagcaatgacagagtaaaagagatgatatttggtggcttgatggcaagaacttcacatgacaagatatatcaagaaatagcaacaaaggggggcacaagggagcaagggacaataaaaattaggaacttgaaagcaataaacaagaaaaaaaaaaggagtaaaaccgatatggttgcacgtaggaacaacagcaacaggagacttaaggagatgatggtaacgataccatga

SEQ ID NO: 7573 - DNA, 315 bp, Candida albicans
  unsure (112): Identity of nucleotide sequences at the above locations are unknown.
gagatttttcattacaaccaggaatttgatggtgatatcctggaaggtgcaaatttagcgattaaaggtggggaatttttagcaaatttaatcaatcaatgtaaagataganacagacaaggagatgatgatgatgatgatgatgatgaacaactggtaagatttaatgaagcgaaaaaggaattgaatatagttaatgttttaaaaaaatcttattttgatgaagatttgaatttgaaaaagagtaatgacaataaagaaactgatgaatcatatcatgaattaattaataaatgggagaatgaaatgaaatga

SEQ ID NO: 7574 - DNA, 222 bp, Candida albicans
agaagaggagataatgagaaagaacatacatcaatagaacggaaaccatggcataatattataaatggcaaaagcaaacatcagaaagcatatatatatcaccctattcattttttactttgcaagcattattatattttaaaaaattcattttcaaggtatataactgatgttaatacccttgttttctatatgtttcaaggtttagaaggattgatatag

SEQ ID NO: 7575 - DNA, 534 bp, Candida albicans
cgaacgatgaaatttttattattattattggccggtgttgccattgctgaatcaagtgttgaagttgccccaagtgaagttgtcccaagtgttgaagttgtccctagtgttgtcccagttgaagctgtttctgacttacaaataaaagccagtgtagccagtcctgctgctagtcctactgctgccacaacttctggctcattatttggagacttggtagatggtctttttggtggtgcccaaaactcaagtgcgatagctactccaaccaccactgctactgctgcacaaagtacaggtgggttcttagatggtttatttggtggaagcaatactgttgccaactctactggctcttctgatggaagtttgtctgatttatttgatgaatggtttggtccatctaactataccaaaactgcaggcgctccatcttcatctacaggttcgattttagatggtttatttgacgatttgtttggcgattcagggtcaaacagtggtcaacaaagtcttcaccacggggctggaagg

SEQ ID NO: 7576 - DNA, 216 bp, Candida albicans
  unsure (79),(81),(82),(87),(94),(100),(101),(114),(115),(121),(155): Identity of nucleotide sequences at the above locations are unknown.
cgaacaaattcctaccaagaattgttcttggtagaagaaaagcattgggaatcatttacctttgtggaacagtttgacnannagatngacgatnctgatnnagttttgtgggannaagctntcattgaaaaaaatgtatttgaccattttactantggatcaataagaaaactgccaatgggaactgaatgctattctctacaaaaatctcattga

SEQ ID NO: 7577 - DNA, 876 bp, Candida albicans
aaaactcctaaggtcttcgcaagtgacgacattgatcttttcgttggattaataaaacttccatctgaaatcatttctactattataagttacaccctcaagtgcagattaccagaattattatatttccctccaattagagaaatagtggctactgaaattttaacaaatgtatacattagaaaaagaatttttagacacagggacgaccttgaagtgtcttatgagggttttgatttctgtgactgcgaccacctcgatattaaagtcaataatttgaaacaaggtattcgtcagtggaatatattcccaaaatccattagtatagacagcgaggtcgaactaagtgatgttgtgaacacttttcctgaaattttaatggatgctctgagtatcaagtgttattttgattggaaatgcaatctggaccaggaaaacctattacggctattttcgaggttcaaaatcaggcttgacaacttccatttttctcattcatcatatccattcaaaatacctcctattgccacacacattagcctacattgctcttcattgactgattatgcaatccccaatgtaaagaagtttaacattcacgcagcctctaatgttgtgagaaaccaaacattcaccttttctcctgatttagaagatttggatatttatactgaccagtcaattcaagtgattgtacctccaaacttacggagactaaacatacgcacaattaatggtctaacaaatttggtattcaaagaaatgcccaatttagagtatttactacttcaattaccaaatattcagtcttttgacgcggcagaaataattgctcccaatttacaaagtcttcaccacgggctggaagatccgcgt

SEQ ID NO: 7578 - DNA, 252 bp, Candida albicans
gtgagggtgaagaagaagaagagaactcaaaggaatgggttgacaaaagatatcaaagctatattatactttaatggctcatttcactttattgttgtcatctcaatccaacagattaatcgtgatatatatccacccattttgaaatctatttttaaatctgagattcaaatagtaaaaaaaaaaacagaaaaaaaaaactttttaaactatgtatcattactattcataatttgtaacaataataagtaa

SEQ ID NO: 7579 - DNA, 207 bp, Candida albicans
tcaaacaatgtaagaaaattggtgttattcatctattccatcaaaagaagaggtacattcctttgttacttctttaagttatacataataggatgcaaatctaaaattgaaatttatagatgtttgagagatgatgagattacaatattatctctaaaaaataaggagaattgcttaatcaatcaaataatgaaatttctaatttaa

SEQ ID NO: 7580 - DNA, 183 bp, Candida albicans
acaaaagttacatataatctaaacaacaatctaaacccaacaaagaaaagagttgtacatattaactttgtagcaattactaatacttactacaatatctttagtactaatattaatacaagtggtataacttattattattacttattattgttacaaattatgaatagtaatgatacatag

SEQ ID NO: 7581 - DNA, 867 bp, Candida albicans
cctaagaataatcaattgattatagatttcaaattattaatacttttattaagattaaaaaatttccctaatatgaatttaattaatgaattatataaattaatttatcaattaagattgaaaagaaatgataatattaataatgatcaaatttcgttattattggttaagaatttacaaaatttgagttatgataatattgttatattgacactcactaagaattatttaactttgattaatttcttatctaatttaattcaagaattgaaagaattaaaagacagcgaagataagaaacaaaatatggccaattcttttgattgtgattattattccaatataaatttgatttatttaataatcaatttaattgttcaccataagaatcataatcaaaatcatatagatgtggttataaatgatacaaatttcaatcatatttggaatactcaaatcaatgaaacaactaaaaactcattaatttatacattacaacatattcctccatctattgcttctaaacatgataataatccacaagaatcatctatacaattcaaatgtgattcaattaaagatttaggtcaattggttcaagaaggaaaaatcacaggaagaataatatgttcaatgttaggaatttgggatttatctaatacttatgggtttactttatctaataattcaaattcagatggtaatagtgcgttacaattcacgaaaattaactcccaagaagatcatcaacaacaacaacatttggatatcaatacattgtccaaagatgagataatcaataaatgttgtgatttactcaatgatcaatggtgtaattatatcaataaagtatatgggcttgaataa

SEQ ID NO: 7582 - DNA, 204 bp, Candida albicans
ataataataactaatgggggaaaatccaagcaaaaagtgaattggaaacaagtactaattaaatcaagaagaaataaactaaatccaataaatcgtcaagaaaaagtaaagaccaagaatgttctaattaagatatcctttacactagtattaatagatgtattgattgtagggggtggatgggttgtaaaaaaaaattgttga

SEQ ID NO: 7583 - DNA, 312 bp, Candida albicans
agaagaataatgaaaaaaaaaaagtgggctgaaattgtagtgctcctcctctttacacacccaaatacttacaataaatggcaacacaaaaattcaactttaaccgcatttagatttcttcacttttcaccttcaacttcaacttcaacttcagctctcatacattacatatatatttactactactactacttactactactattaactaatcatttgaaatttttttatatatatttttatatttctttctttctttctttctttctctttctaatctatttatttttatcttctttaacatcagtttaa

SEQ ID NO: 7584 - DNA, 360 bp, Candida albicans
tcatttgaaatttttttatatatatttttatatttctttctttctttctttctttctctttctaatctatttatttttatcttctttaacatcagtttaattaattcaacttcaacttacttgttgatattctacaaatcatttgattacattcatcaccaccccatcacatcattttattcccaaaaattttttttttccttacttagaaattctttttctttacaagtttggagaccagaagaaatttatcaacaatttttttttacaacccatccaccccctacaatcaatacatctattaatactagtgtaaaggatatcttaattagaacattcttggtctttactttttcttga

SEQ ID NO: 7585 - DNA, 219 bp, Candida albicans
ttagtaacaataaatatacgcacgcagattcgcgtcttcttgtttattaatagaaaattttcaataattacacaaaaacaccaaaaaaaacaacaacaacaacaacatatcatcatgaacaacatcatcatgaacaaattagttagacgatttttatattcggggctatcccaaaaaaaatttcagctcctttttttaacttccaggtttatagaatag

SEQ ID NO: 7586 - DNA, 312 bp, Candida albicans
ctatcactaataactaatactacaatgctcgccttatccttattgtcaatcgtttccattgcttcagctgctggtgtcactgctatcccagaaggtgataatccatacactattttcccaagtgttgctaaaaccgcttccatcaacggtttcgctgacagaatctacgaccaattgccagaatgtgccaaagaatgtgtcaagcaaagtactagtagtaccccatgtccatactgggataccggttgtttgtgtgtcatgccccaatctgttgggttttcgacgagccgggacgaaagacattgtacgcca

SEQ ID NO: 7587 - DNA, 261 bp, Candida albicans
cattgcaagaataaaccaaatccactagtgaaagcagctagtaatatgataaatgtaccaaaaatgatcccatctgtagaatacgccaatggcatagataataaaccggcacctataatggttttaaccaaactaatcgatgaagaaactgttgatgcaccggcatcattatctattgaaggcattagttatatattattaaaatggtggttaaaaagaatattaatgccagtaaatctgattgaaagaccattaaaataa

SEQ ID NO: 7588 - DNA, 183 bp, Candida albicans
ttttggcaatcgtcggtgcttcaggtcttgacttcgatttcctttattttgcctgctttatttggttataaattaattggatcagagctggatgatccaagcacattagaaattgctttccaacaatttgtctttggggttgactttttggggtggtactgtcatgatcttgtgcttatataa

SEQ ID NO: 7589 - DNA, 504 bp, Candida albicans
atgtctacatatcaccctagttttggctcttcaggaggagggattggaagtgttttcaaatccatcactaaatcatttaaacaatcatcttctaccaaacgagtccccgttactatcaatccaacagttgtaggaggtggacaagatttacaaaatcttattgatcaattacaaacatcatcatcatcaagtgttaaattacaagccattaaaaaattaattgaatcaattcaaaattatctgatatcatcggttccggaaatatggtacgttgctcgtaataattgtgatattaaaattataaaacattcacgagatcttcgacgagcaacattagaattattaaatgcatgtatagaaaaagatgatttaacatcggtagggactagaatacgatattttaatgatatttttaaaaattgtatgtgtcaagataataataacaataacaagtgtgatcctgattttgatttatttttgaaagctttattagtgttaactggt

SEQ ID NO: 7590 - DNA, 189 bp, Candida albicans
aatataatcaaaattacaaatccaagatacgtttcaaaaaaacttttagcattagatttttcacccaaggggaaaattgctaaccaaaattcagctactaaaaccaacacattcaataaaatcccaaaccaagaaccaatgaccccagtttgtgatacaaatgttaattcatcagtatttctcccttga

SEQ ID NO: 7591 - DNA, 258 bp, Candida albicans
tctaagccaggaaggccaaacgcccccgaaaaaaaaaaaataaaccaatttgattcccggttttttcttattcacaagagctttaagcaacgacatttttcctctttttttttttacattacatactttgtgaagttaattattatccgaggtgtattaatgccatacgtaaaaaatatatatacatatttcttgtttatttatttaatttacccttgcataaatgggtttagtttactattggtttggttgatttaa

SEQ ID NO: 7592 - DNA, 204 bp, Candida albicans
atatgtgtactgttgaggaaagttcgcctggtgtatttgaagttattaaatgtgaagatcatgaacatactcaagtggatcaatctaaagcccatattgcagcttttgaaaagaataagaagaaatagaataggtggaaatcattacgaagatcatgagcatttgagattaaaaaataaatccaattatagacaaaatatgtag

SEQ ID NO: 7593 - DNA, 195 bp, Candida albicans
atggcagtacgagcattgaattctttacaaaaatcaatggctttgacccctttggaacctaatgctggacccacaggtggagcaggggcagctttcccagcttataccactaatttgactaatgctccttttgcagacatgtttattgaaggggggaaggaagtgactttgaaccgaaggtctagtattgattga

SEQ ID NO: 7594 - DNA, 231 bp, Candida albicans
  unsure (145): Identity of nucleotide sequences at the above locations are unknown.
ttgtatcttcttcaattttatctgtttgaattgatttatcaacttcttcttcttcttcttcctcttctcctacttcccccttgtgattcaattttaaattttaattttttctttaatggtgatgaagatgataatggatttgttngaaaaaccaaaaataatggaactgaatatggtttaacccaagaatttaaagaaaatcctcatattattaattatatgatgaattga

SEQ ID NO: 7595 - DNA, 189 bp, Candida albicans
cacacacacaacatgaataaaaatgggtcagaaaaacgagctctgttagaagaaaaaaaaaatgaaaaaaaaaaacagaaggctcaaaaaaacaatcaacaaatcattgtacaagtaacaggtacatccaaccgtactacctttcaatccgaatattgcacaaatatagacagtacactatggaaatag

SEQ ID NO: 7596 - DNA, 618 bp, Candida albicans
tttgttgattgtttttttgagccttctgtttttttttttcattttttttttcttctaacagagctcgtttttctgacccatttttattcatgttgtgtgtgtgctaagaaaacatctccatttattatactattcgatatcaatcacacacacacaatgtctttaccaattcctgatttaaggtttgaacaatcattcatcagccagttaaataagtatgcgggcaacaaacaaccagaccaaaaaaaactacaaccattgagtagtaagaaatataaccatattgccactttaactgatgatgatttgaagttaatgaatgaagaactagacattgaagaagaggaagaaatagataactacactgataaaccacagcccaaaccacttgctcctataaccccttcgatagtcatttacgctataataaaggatcaaatgcttatgcctttattacaaggattcttatggacaggagtgctactttgtgtacgtccacttttaaaattggtagttagaaacggtcaatacgccggacattgggtgtctaacttgttgggactaaatagattggcgacatctcgctcttcattacattccagaagaagtttcagttag

SEQ ID NO: 7597 - DNA, 729 bp, Candida albicans
aatatggacaaacttgaaactttccaacgtaatgatcctagaaagttatttgaattggctaaccagttgaatgaacgactgttctttgcaatctttctaaatgaaactcaattcaagataattaatcatattttatccttagataatttcgagatttggacaaattttttggaaggtaattgttatatttcctatttgcaacccgaagataagaatgacaaacctgagactccaaacaccaatgagaacaacgagagtgctggtggtgagagaattcagaacaatagtagtgatagagataccccaactctcaataacaatgataaaaagaatgattcaaacaaggaaaccatgcaagcggaattggagaccccagaaacattattcccagagggggcagaaatgattaagaaattggcactacatgtacgatacctcttgtgggagaaagcgattgatttttattataattctaaggtgttggatgagtcaaataacatattagatgaagtttccgatgattaccagttgattgactcgttggacaatattgttgacgagaaagcatctaacgaactggagaaaaaggaagctgttgagaaactaaaagtgagagaaatcgaggatgattatgatgatgatgacgaggacgaagatgaagatgaagacaataatgatgaaccgaccacgactgatttgttatccaccccgacgatgacagatccatgt

SEQ ID NO: 7598 - DNA, 207 bp, Candida albicans
gacactgtgttaaagttgagtttcaattttttgttgcgacaaacaaccacaaccaccaccaccaccaacaaaagagacaaggaacaaaaaagtgagactttgggaaagggaagtgaaggaaaaaaaaatcagacagtgagagaaaagttaattgaaaacttgaaagttggagttcaaattgtcatttcatttcagtatatcatctaa

SEQ ID NO: 7599 - DNA, 585 bp, Candida albicans
gggttatcccaaggattgacttttgccagtagcttgccaggctcaaatgccaaaggcgctcaattacaagcatgtttcaaatctattgaaaactctgggaaattcaatgtcaactggtacgaagtgtttaatcacgtgcatcaatatttatttgactcgtcacaaagagatatccaaccatcagttggcagcattacccagtttttatcgtcattagatttcaaacaagaaccaatagatatattcttgaactacgaatggtggttcaataagacgttgttgtatatattgcactcactggatgcatcccagggtggttatgatatatcgttgctgcctaatttagcttattgttttgaggaagataaaaccactccccaaacaagaagaaacattttgaaatttattaatgtgggtaaactagaaatcaaagtgataaccaaaatacaacagcaacagcaacagcaacagcaacagcaacaacaacaacaccaattgagtgagcaagataagaaactaaacgcgtttttaaatcaattgtttgagcatgattatcgtggttccatcttgcccacgggtggataa

SEQ ID NO: 7600 - DNA, 1017 bp, Candida albicans
tatgttctaatggacaaggaatatcttattgtaattggattagatagttcaataacatcatatcttgttaaagacaattttgaaaagctgagtgtgatccatccaccaacacgattcaaaactttttgttacaaatttgtcaaatccgatgacaaatcttatttaataagtgctttcactgggaaaattgttgtgtcggaaataggaggtgccaactatgaattcaagcttgatacctacgcagcttgtaattcaattgtatcaggaataacaaatggtgttttaactttgcttttatcgttcgatactggtaaattcaaaacaataaaatttgacattacttcaaaagactttactcaagttccattggataaatctattattgcttttgtcaataagtctctttatgcataccaattccaaaacgataatgactcatccaaggggacacctgaaccaataatgaaattatttggcattaattcgttacccaatggaacattagctattttctataaagttacatctgcaaatgtcattgagtaccgttctatggcgttcctggatgtcaacatcaggtttttgaaattgagtgaaccaattggaaacgaatatcaagtccataacagaacttccatagcaaaatttatagaaaattgcattggtgattttcataattttcctacaatcagtaatgatttgagattgttgagaaaagatcgagttaataaattcattgaaaatttcaagacttttaaagaacaatatttgcttagcaattttgattttggtcccgacttacatccactgtcggatttcgaaacaacactcaagaaaaatttcattgaaaactctgttgtgattcaagcacaatatctttatattctagccacttttattgagagtggattgacgccaatttcatttgagaaacctactgaagttgatgtcatggtgaaagaaatccaagattataaaaagtcaattgagaattcgatcatcatatatttaagaaag

SEQ ID NO: 7601 - DNA, 198 bp, Candida albicans
aaaagatgtcaaatcagtgggtggttgagagatggggctaaatctaatgctagaccaagacgtgagagaactgccatgtcgttggaaggaattttagcaaattgtttgaaagcagagaaaattgccagcgaaagtcaaagaaaatattcttgggagagagggccagacagagaaaagggtaatgaagatggagtgtga

SEQ ID NO: 7602 - DNA, 267 bp, Candida albicans
agtctgagtaattggcaatgtgctttgagagaagtcaacagtggggacatgggaattaggtgttggaaattcacggatggcgaaaccgttgctggccaagctagtcagggattcgcgggaaattattgcagctcgggtatgatttttaagggattggaaactactctgagagacatggaagtcgacgtggcaatggaagtggcaagggaattgggaagtactgagagaatgaacagccaagccatctttttctgctcgcgggtttaa

SEQ ID NO: 7603 - DNA, 807 bp, Candida albicans
ctacttcctccctactccaatatggataaatttatacaatcatttagtcatcaatatttggattcttcttcatcacttaaattaacagcacgaaggaaacggaaattgaccattctcggtctttttttattttcattaatttcattaatgataataatatcttattccaataataatatcttacctggattatcgggaattagtattagtagtacattttctgattattattccaaccctaaacaacaaaataaatttgaacaacaaattcaagatcatcaaactactaaaaaaggtaaacgaacaattatattcccaaataatttcaatcatgttcatgatcataaaggttcttatatgatgaaagatagtgaattggttaaatattatgttgaaaccatggaacaagctttggatccagaagatttaatttatcgtaatcgatttacttataaattacccaatatcccatatactgaacaaaaaattgaaatgtttagcgatggtggtggtggtggtggtgacacaagtgattctaatactgatatgtgtccaaaattatcaactactattaaagtagaagcatcaccagcaatgaataaaaatggtgatttgaaaaaaatcttgaaaacttttttacaagaagatagtttttattatcgtgaattatcaccatttttccctgatttaaaaaaacattttgatgaagatactattgataaacattggtatcaattcatcggatcaactgtttggttagaacaatatggtgttccattaatggtttcaagaatccattattacgag

SEQ ID NO: 7604 - DNA, 261 bp, Candida albicans
ttaatggggaaaaaaaaaacgaatgaaaaaggtataacatttaatactaataagaaaggaagaaacagaaaggaaatagaaaggggaaatggaaagaaagaaagtaaatcaaagatttacaaaataaccataccacagttatatatatatatatacatatatatactattatcatcatcttctaaaacaacttacgaattagagagctgcaccaataaattcaagaaaaaaaaaaaaaactttttccttcttttgccgtag

SEQ ID NO: 7605 - DNA, 189 bp, Candida albicans
gaacttcatgatagaaagttcttataccatatgaatctttttgttagaaaagtaaacaaaatcaaagaagaaagaaagaaagaaagaaagaaagaaagaaagaaagaacacacaaatatatgtttaggaaaaggaaaaggaaagagagaaaaaaaaattttgtgtgtgtactatataaagagtgagtga

SEQ ID NO: 7606 - DNA, 303 bp, Candida albicans
atagagggagagagagagaaagagaaagagaaagagaagaatgagattctctttaacagtgaaacaatggaacaaaagaataaactgcgtgaggtatcaaattgttatttgttaatcaccataataacttttactactaaaaagcttgatttcttctattcacacacactctctctcactcactctttatatagtacacacacaaaatttttttttctctctttccttttccttttcctaaacatatatttgtgtgttctttctttctttctttctttctttctttctttctttcttctttga

SEQ ID NO: 7607 - DNA, 216 bp, Candida albicans
caagggttaggggattcctttggaggggaaaccggttacttaatagggcaacaaatggcgcttaaatacaccaccaaattgagtcctatacttgcaattcctcaattagttgttttaacgataagcaaattgttatttaacaaccacacaattgttcaaacaaattatacaccgttatttttaaacgtcattaactgtactaacaatgttgcttaa

SEQ ID NO: 7608 - DNA, 198 bp, Candida albicans
gttaataatttgtctttatttagtatccactacattgtacttagacagatactattagaactggatcccttacattcttgttgttgttgttgttgttgtttgacgggttatttcatatttagtgcaccttggttagtcagtataattgacgagttgttgagacaatccacaacaattcatgtaaatcttgttagataa

SEQ ID NO: 7609 - DNA, 381 bp, Candida albicans
gaacccaataaaaacagaggaagacattgtcatgatccggtggaatccctgaggagtcaaaatttcaatgttcgaaataaacacgataaaatcggtcaagtgaggaatcaacatcgtcatgataaattaatgataaatcgagagaaaataaatgatcaacaatctaaacgagatattaatgatcaatacgaaaaagagtacgaaagtataactgaaggtttggatattgataggctaattgaagatgaacaaaacaatactgaaattcaggggtggttagagcattatgaagaagaggctgaagaacgtgaatgggaggaagatgctgatttgattgatatgatacagagtttagaattagaggataaagaaatgaattga

SEQ ID NO: 7610 - DNA, 276 bp, Candida albicans
gcccacgattttcatccaataataatttgtttgctaacgaaaaccaaacatctgaagagtttaatgtgtcacaaccaaaccaattttttcaacccgtaccagatgtgtcaagcaaactcattctaccaaccaggaccggtccttacagcatcatatgctaatgatgaagataacgccgacgagcaagaaggtaatagctctagcaactatgaaacatcatcatctgaagacctcgaggaaagggaatgtgacttggactatggagaacatgagtag

SEQ ID NO: 7611 - DNA, 234 bp, Candida albicans
agacggaaggagctcagtagagtgtctgttatgttagatggtgaggcaaagattcttgacaagactgtagatgggaaggattttgatttctacaagtctttgcatttaaacaactcaaaaattgattacgcccaagttaaaaattatattgagaatgatgacaacgcgttgattattatacgcatcactaattgtaaggtaacagatacggataataatgtggagctgtactaa

SEQ ID NO: 7612 - DNA, 240 bp, Candida albicans
gaggatgggtcttcaacttcgatgtcaagtagtaagaattcagaatccaaattattggaaacacgtgacgtgattaaaagtattgttgaagaaggtgattcaactacaggtaatgtttcagaagttaaatatgttcatgaatatcttgaaagatctccacaatcaactgccataaaggaagaagacctttactatggttcatctcataatacacctctaactgttcacaaaacattatga

SEQ ID NO: 7613 - DNA, 195 bp, Candida albicans
aaactaaacaaaattgaaaacgtcatatttgtgaaatttgtcaatgcagaaaagcgcaaaatatattttaaagagaaacaatttttgattgtggagtttcggatatatctaaaatatgaattatcaacgaacgaacaaataaacaaaaaaaaactttcaacacaatacacaaaatcgttaatttccattgattga

SEQ ID NO: 7614 - DNA, 234 bp, Candida albicans
  unsure (183): Identity of nucleotide sequences at the above locations are unknown.
acttttcttcattattattttcgaaaaattagagcaagtcaaaaagcaaagcaaagcaaagcaaagctagcttattccgataatcattatttctatcggaaatctattgttgttgtcaccgtattggttgatatcaattttgtgttttgtggtgccgtgcaagtttctatctcctcatcctcntattccttctccttatggcttgttgttgacaggcaacaggagaggttatga

SEQ ID NO: 7615 - DNA, 222 bp, Candida albicans
  unsure (113): Identity of nucleotide sequences at the above locations are unknown.
cttattccgataatcattatttctatcggaaatctattgttgttgtcaccgtattggttgatatcaattttgtgttttgtggtgccgtgcaagtttctatctcctcatcctcntattccttctccttatggcttgttgttgacaggcaacaggagaggttatgatttgaaacttgtgtttgttgacgtttcaagtcaaactaaaactacttttttggattga

SEQ ID NO: 7616 - DNA, 183 bp, Candida albicans
ctaggatggatttatatttttttagttgaagcggttaattcaaatgcatttcatttcattcaaatcaattcaaatcaatttaaatttaactttatcaattatagactaaatttatcaatattacccgtttcactttctgcccccctcccccggtttccccgatttccaggttttgtttactaa

SEQ ID NO: 7617 - DNA, 207 bp, Candida albicans
cgagaagcaattattcacgagattttgaggttgcatgaactagcccaacttcaactaactattgcagatcttccacataaattctgggctctgttttatttaacgggaaagttagagcaaagaaaaagagcaagatcatacaatataggcttaattagagagataaaagtgatctgcaaaatcacaacaacaagttacaagaattga

SEQ ID NO: 7618 - DNA, 249 bp, Candida albicans
aatgcgtatcctccagcccggggtgaagacgaaaacagcaaggtaactccaaaagattttgataaatacttggggagtctaaggttgaaattgagtaatttgaaaaatctaatgctggaggttgaaggtatcaatgagacgttgagttatactttggataaaatcgagagtttaaaacaaaacaatataaagaaggaagcatttctactgaattttaaaaatagtgttaacatgaacgaagagatatga

SEQ ID NO: 7619 - DNA, 1113 bp, Candida albicans
gttacgtcatcgcggatcctgacgctcgtggtgaagattgaagaggacgaaacttatttcctgaaaattgatactaaggaatattatgattcttatgctactattaatgaagatccaacagataccactaccaccacaaataaagttgaaattaatatgattaatccaaattttgagaaaatatcaagtaaattaagtaatgtgaaaaacaaaccaacaacaatagaacaaacagatgataagtctctgaatgaggctattgaagatgtatattcatatcctgaagaagctattgggaatctttatcgacttgatcgaaatgagtttttccctactaataataataataataataataataataataataataataataataataataataaaccgaataaagaaattgcttatatatccggattaaatcatgaaaaacgtcgaaatgaattatcaaaatccattgaagtgattgaagattttgaaactcgtcatctagatgatttatttaaagttaaaaaatatcacttattaacaagattgaaaaatttacaatcatcgaaaatttctttccttaatcacactagttctaatatgattaaagatgatgaattattaaatatagaacaagatttagcattggaaagagatttagaattattacatttgaaattattagaaaattatgaattattgaaaaattcattaaatttttatcaaaattctcataaaatttataatcatttaaattatatcctaattaataaattggaaaaattgaaaacattttttgaaattcaaaaaaatttattccttgaatatataaaaaaagatgataatgatgataatgatgatgatgataatggcaactcgaggaatattttcaatattaatgaaaaagaatcaaataaattatttattggaatatcaaatcatgattattcaaatgaaattaaagatattttgaaaaatttgattgttaatgatattcaacaatcatcaaatgaaaataacaccccaaaaaattcagattcaaattctaattctaattctaattccattgattcattaagaattaccagaactaataaaaacaccatcatcatcaaataa

SEQ ID NO: 7620 - DNA, 246 bp, Candida albicans
acttcctctttttcttcgtctactcaatcatggttatcactcaatttgttgagcaaattttttgatgtttcatcaagggtttgtttattaagggtttgctacaatttctgtattgaaaaaaaagatcaaaccaacttgaaaaaaaaaaaagaggaagtattaatcacaaaacataaaaccaaacttcaaacactaatgagtttttcaaaaaaatatggcgtgagttttttttactatgagtactag

SEQ ID NO: 7621 - DNA, 186 bp, Candida albicans
aaattgatttcctctttagtgctgcaaaggaacaatagaacaatagtaaaaaaaaaagggatatctagatctttagaccaatttccgaaacaaagagtttctttgaacaaattggaaaccattaaaagacaaaatttgatattatacttagtaaacaattatatatggaatctacaaaaaaattaa

SEQ ID NO: 7622 - DNA, 189 bp, Candida albicans
acacagttattggaatattctataattatttggcattgcaacttcttcttcctgtttgaacacattgttgttgtagtagtagtagtgaaaaaaatggtgattagtagaattgccaagaaattgattcatcttgaaagtatcaatattttagtccggcgagatatgtattatgtgtattcatctgaataa

SEQ ID NO: 7623 - DNA, 267 bp, Candida albicans
aagagtggaataaattttataaatgaagatttaaataaaaaatacaaaaaagtattaaaagatttacgatttgataaaatgatgcttattattgaattaattgggaatttcttagatttaacatttaatcttattgaattatatggaattgctttgcctgattggattatgagtttattgaattttgcaagtatggcaatgacaatttatagaatgaataaagatgatgaatatgttgatgatgatataactgatgatttgatttga

SEQ ID NO: 7624 - DNA, 219 bp, Candida albicans
agttgtatgtgttggcaacacttgtgtttgtatgggcgtatattttttgaggagatcaaagcaaaaaatattttgagacttatacacgcaacatacagagtattagtagttgctttgtcatatacaaatagattaattaaactaactaacaacctatatcaaatcaaatcatcagttatatcatcatcaacatattcatcatctttattcattctataa

SEQ ID NO: 7625 - DNA, 201 bp, Candida albicans
ataaagtctgctttttctttttcgacagtaaagcaaacatatacttatagttttgctttggtagatagtagtatgagattatacattataacaatagtaatagactatctactaacgtcacataatcatatacttgagtgcagtgaacgctgtgatcagtatgcgatcattgacaactcaataagttcaggcggaaattaa

SEQ ID NO: 7626 - DNA, 363 bp, Candida albicans
  unsure (322),(331),(355): Identity of nucleotide sequences at the above locations are unknown.
gcaaaaatgggtagaagagcaaagaataagcaaggtgtgccaccaacttttgatgagtttcaggcctcaaaattgaaaaacgacactaaaagaaaaagaaatggtgctaaagaacagaaaaatgatttacccgtttctaaaaaaccaaagtcaagtacaagttccagcaaacaaactgatcgtactgaaagttctaaaccaaagccaaagactaaatcaaaagtgactaaagatgttgaggttgaagaggaagtcgaaaatttaccagaagttgatcttgaagaattagcttctgctaagaaatccctttttgatgattcanaaaaagaanaagtggatgatgaatttgacgtcnaaaggtga

SEQ ID NO: 7627 - DNA, 507 bp, Candida albicans
ttgatacaaatcatagcttctactacaactataactacaaatacaaaaatgaaatttttcactgctgccgccactgctttattattctccgctcaagccttagctggtatcacccaatacactttatccatcgaagccgatgacaaaagactaaatggtaagggtatcacattcaaacatgaaggtgctggtatcaactatgccttcgtcagtgacagttctgccaaattcagctatgatgatgaatccaaacttttctactatccaatcagtccacaacttaactacaaccttggtaccgctggtgacattgtccaattttccgtcactcctccatcttctgttgaaatcggtgatgatggtgctttgaaatttgaaggttctgatgagcttttcgctgcagtcagtattaatgatccacaccattattctgacaaagactttgctgttattgttaaaggtaagaaccatgctattcaaatcaaacttgtggctaaaaaagcttaa

SEQ ID NO: 7628 - DNA, 210 bp, Candida albicans
gttgttgtcattacaattaacctcgatccaattcaacaagcacagtttattaaccgaaactatcctgccctgtcacatcaagtgtatttatccaaaggctataaactaactatcaagataaacgaaacttcagtagtatttcccaaaatcaccatcaaagtataccccagtctatcattcttaatatttcctcccctctattcaatctaa

SEQ ID NO: 7629 - DNA, 597 bp, Candida albicans
tatttcctcccctctattcaatctaataaacaagtagaaggtgttatgacccatataacagatttacccgaggaggtactatttcaaatttataaatatttagaagtatcgacccttaaggcattacaattaattcctgattttgcagaaagtactagatattatttatatcgaaacagtttatatttattacgaatatgtgatgatcaaataaattcattaacattgacaaataaggaaaaaccattaggttatgaattatcattacttgttcaagataataataatcaatcaatgaagaaacatatttcacaattccgacattatcaagtaaatttactgttgattaaatttgaaaatttattggaaaaattagattgttataaagataatataattcaagatatttttaatcgtgacgatattggtaatggtatagtaagtgttaaattattaattcaattaaattattcattgagtacatttaatcaagttaaagattgtttagttaatatggataaagtatcgaaatattttagtaataatggtaagaatagtattactattgatttagaattgaatagtcatgataaatga

SEQ ID NO: 7630 - DNA, 252 bp, Candida albicans
gatagaaaggatggagacagagacagagacggagacggagacgaaaaaattactgaagatactaaacaagaattgatagaatatactaatttcattgaagcattaaaattaattgatgattggaaattatttataattcaaggacatccattcaacggatcatcagtaaatagttcattagagaaaactgaaaaagtattgaagaatattttacaaaattggttacttgaattgaacaatgaccatgaaaac

SEQ ID NO: 7631 - DNA, 354 bp, Candida albicans
  unsure (204): Identity of nucleotide sequences at the above locations are unknown.
gattttaaacaatctgtcatactgcaagtactactactactactactactggtggtggtggtggaggaccccccagaaaagagaacaatagtattaaattataatgactttcttattctatttattttccctatttatgaaggatgtattagtacaaatgttatgaaacgaacactaagaacgcattctaaattgactaatcanaatctatgtgggtttttgcctgttgtgtgtctcaacaaccaatctctgcatttcagattgcgggggttatttttgggcttttttagtttcaacattttcttcaagaatttctctactttccttgcccttttaactttcataacttacatt

SEQ ID NO: 7632 - DNA, 867 bp, Candida albicans
actttaacatatactatggagaattatttattaagttcgccgacacagctatcacagccatatgatgatggtacaaatagtttactatttatggacaattatgaactatcacaaaatttatctcaaccgttagatcaacatttacagtcactacaacaacaactgcaagtacaactgcaagccccacaacaagtgcaactgttgaatcaacatcaacaattgccacaaatacaaccattcccaacattggtaaataaccaacaatatgctcaagagacgtttcaacaattaagtcaacaacaccagcaacagcaacaacaacaacaacagttttcaccatttcaacaatcacagctacaacaacaatttcagtatcagtatagccaacaacagcaacaacaacattttcaacaaccagtgactattgaagaagaaatagtacctgctagtaacaataccaatattcaaatcagcaaattctttgatgacaataagggtgatgatgaggacattgccaattcaggtaattttaatgagtttgatcattcaagaaatatatctcttgatgataccactatcactgatttacatcgacgtgagaattctataaatccacctacaggtttgcctcattcaatttcatcaaatactatttactcctattcatcatttgaatcaccacaatctcatattcaatcacaaccactgtattcacaaggttatcataatcaaaacagtttatcgaccccattgagaagaaataagtcatattccaaatcatcagcaaatattaatcaatcaccagtcaatttggcaactacagcaatgaataagaattataaaactcctcttcgaagtctaaacgat

SEQ ID NO: 7633 - DNA, 204 bp, Candida albicans
aaaatcagttcatgcaacaacaacaacaacaacaacaaacagttcacaataattaaattagtttatgcattttacagttatgtcaattatcatttatcctatttttttttgtgtgatggtgatggtagtggtgttaaatctaattcaattcatacccactatgatggtagagaatttactgtacacctggataaatttagttaa

SEQ ID NO: 7634 - DNA, 237 bp, Candida albicans
attatgacaaagatattcgattacgagaagagagagattttagctaaaaattcacacaaaactgtatcaaaattaatatgcgcctacttaaggactaaactaaacttgaacccagtccagtccagtccagcccagcttattttcataacaacgcttattgttgaatactttatatttataaaaaatcagttcatgcaacaacaacaacaacaacaacaaacagttcacaataattaa

SEQ ID NO: 7635 - DNA, 243 bp, Candida albicans
gtcaaaacagcgataataaaaaggcaaaagtctttttctaatccacaaaattatgcattcattaaatggccagtccttttatcttggaagaatttgattccaaaaaatgggttcttttggacctggcgttattggattccaagcccaaaacctgttttgaagtcttccaataaagatcccaagaaagctcctctccaacgaattgggtcaaatggccttaagggcgttatgtttgaagaataa

SEQ ID NO: 7636 - DNA, 1095 bp, Candida albicans
tccgtattatcatctctgtttgtagttttattattttatttctttcaacacctattacctctcaaaatccaactttatacctttcacttatacttgactgggaacaacatgaccaaatcatatatgccattattcaggtctcctagacaattcaaaaagatttatttcattttaattcctttgattcttgcagtgataatactacatgttttctttgatggatttaataagatatcggaatatctgccaacatttatcagtaatagaatccttaatcatcaagaccaacaacaaaaaagtgaaaaatcatcagatgttatatcatcatatttcccttcattggccatttatccgaaaaatttcgataatagagtagagtttgtcaatgaaccgaaaaattctaaatggattcaatattttggtgattcgaaaactgtattgtcaaattatatcactaatcaaacttataccaatcattcaattggtttgtattcttcatctaccgttagaccccctgctagtctgtgtaaagatatattatatgaacgttcatttgaaatcaccaaatatcgtactttacatgatgatttatataaattggcaaccaccttattatatcaattagaaaatgatccagcatttcaagatttatcaccatttttcaatgatagattacctcatattattatgagaggtgaattacataaacatatttataaatttgctggtacttcagtatggttagaacaacatggagttcatttaatgcttagtcgagtcatatattcacaacaaggtaaaaaaaatgatcctcaactttctttgttgtatgctcaagtttatgatgaaaattggaatgaattaaatgatattgaattgattgtccccgtgattaatccaaacggtgaacgagtttatgattcagttaaatatcctcaatttgttgctataccattttatcataattcagaatatattaaaagtcgatggtatggaccagaagatacaagattgatattaacgaagaataaatttggtgatgatgaaccagtgcttattttcaattcacgtctaaccgccggttggaaaacacgc

SEQ ID NO: 7637 - DNA, 192 bp, Candida albicans
ttgctggcaccaaatgtagaagaagatgtttgtgtttgcccaaatggcgagcttgttgaagattggccaccaaaagggtttgaagtattattgttagatgatccaaatggagaggaagtgttggttggcgcggtggttgcagctgtatttgaaccaaaaggtgaatttcatgtcttttcacttcggatctga

SEQ ID NO: 7638 - DNA, 513 bp, Candida albicans
aattcaccttttggttcaaatacagctgcaaccaccgcgccaaccaacacttcctctccatttggatcatctaacaataatacttcaaacccttttggtggccaatcttcaacaagctcgccatttgggcaaacacaaacatcttcttctacatttggtgccagcaatcaaacccaatctgcatttggaacggcatcaactcaaaatacaaatctgggatttgggtcaaacaattcagcatcgactatcgcgaacaccaatcagaattcgtcaactaccaacaatgccaacccatttggatcaacatctgaggctacacctaccttctcgttcatatcaactcaacctaaatcccagccacaaactcaaactaccaggagtatagatgttgacattcaagagaacacacaaaatgactccttgcctgctctgatactagaggcattcaacgccagcatgtttacattggggaagataccggatgtaccaccaccaccagaattatgtagataa

SEQ ID NO: 7639 - DNA, 321 bp, Candida albicans
tctagaagaattcaactcaacccagcaatgagatcttctggctatttaaattccaacaatggatcatcgtcatctttggaatcgactaatgtaaacaaatcaaccgataaaaatcagttgtatctcaaagttgtttgcaattgtgctacagatttagtaccacaagatactacaggaactggcagtgagtccaaaaaagcttattcttccagcaaatcaataaatccagttttggttgtccaattaaacaataccatcaaatcaacttccaagaaattaactaccaatcaacgttttcacaacggcctggaaggtccgctt

SEQ ID NO: 7640 - DNA, 255 bp, Candida albicans
gaggagcgggggtttgaaataaaattagataattttaagtctaaaaagttaacaatacaaagtagtgtaactgttgttgttttacagtccacaaatcaaatgaccattaagttaacctatttggacttacctcttttagtaaagaggtggttgctatgtacttctgaatgtatctttgctcatgtccgaccaaggaagagtaaacaaagcctctcggctctcgtgatttatacattttgggagaaaggaatgtag

SEQ ID NO: 7641 - DNA, 207 bp, Candida albicans
acaacactaaagcttttagcgcattgtcaaactttgtatactttatgcactactggtgacataatttttaggcataaagagaactgcattagtaaatttaaaaatttaaaagtgtgtttcaacttgttgttactgcaaatgacgcttgcggcacagcaacttaaacatagttttgtttgtggcttgttttgggattgtcttttttag

SEQ ID NO: 7642 - DNA, 240 bp, Candida albicans
tcagtagtacctgtgcacactttttcgtatgttacgttagaaattgacggtttaccattagcatatccgactttaatgtctactagacccttgtttgtaaactgttttctaaatacattttcgaccccccagaaacaacccgctgaaagattgatgagcttggaagttgaagttttaagaatagttggtgaaatagtcgataccattattgaatcaagtggtgaatttgtaaatgtctag

SEQ ID NO: 7643 - DNA, 441 bp, Candida albicans
agcgcgggtccttccagccccgtggtgaagaatttaaccaatgatgattatctacctttgaaacggttatttcaattgattgaatttacagaaaattctgaaagaatttatatcaattgtttaagaaaaattgaaattggatattggcatagatttttcagtgctttagaaacaacccccgagaaatttatgaaacgattaattgccattgataatgttgaattatgttataattacttgatcatatatcttaattataagaatgaaggtgatactgaaactgatgaattaaacgatcatgataaagaggtgatattgaaaatcattaaaatgttagagtcttcttctaaatgggattggtgttttgaattatgtagatttatcaagatattagaaccttcaggtgattttcttagacaaattaagcaggaacttgaataa

SEQ ID NO: 7644 - DNA, 192 bp, Candida albicans
actttgaatacgcagaaccaaatggagacaaaatctagagtgcgtgtaaaatttccaccaaccaaagttcatcatttagtaagaaagaaacaaaccaataacgaaaaaaaaaatataccaagtccaaaaaaaaatcaaactacatatatcatcaaccctttccatatatacatatacacatcttccacataa

SEQ ID NO: 7645 - DNA, 237 bp, Candida albicans
gtcaatttcatctatcaatcaatccatttatcaatcaatcaatcaatcaatcattacatcatttctagaactgtcagtatttatccatttttatccagacatagtatatttgataaatatactcctgacatatctagccacacgtcaattcatttaaatctaacgcattatttttattttttcaatacattattttatcttgtcaaacaaagtaaatcaaatcattatcggtattaa

SEQ ID NO: 7646 - DNA, 249 bp, Candida albicans
gttactatttctttgattatgacatctcaaatcgctgatggatcttctacaactactatcaatcctttgaaaaatggattatctgctcttaaaccaacccatcaagcgcatggcacgtcaactaccactcacctcactaatggtttcacaaagaaaataaaaagctataaacggttagagctagaacgattaataagagaatttcaaaataaactaagtaagattggggacaatatcatgaaactttga

SEQ ID NO: 7647 - DNA, 201 bp, Candida albicans
aatgacttgaagaaaacctgtatgagttttttgtctttcactttatttattccttctttattctttcttatggctcctaatacttcgggtaatatatggagtaatggaccagatggtaaaaactatctctcgttgttatccaatatggtgtctataactttcgcctcttttagaatagaaaatgctgttggttcattatga

SEQ ID NO: 7648 - DNA, 723 bp, Candida albicans
gtttcacatgtgtgtgcgttgttaaaacgaaacattttgggctttcgaatcacgaaagtgaatttgttacatgatccattgctattccctgtgcttaaaaatacgaatgatgctgaaaaagaattgaataagatgagaaaagccttaacaaatgcagttgttacttcagtgggtcgtcatggcaagtatttttggattagactaaacaaccacaatacaactaacgtcttgcttatgcatttcggaatgactggaatgatcaagttacgaaatgttcattcgcatttagcatttatggaaaatggcggtgataaaaaggctttggagaagctagagaggtttagatataaagacagtagaattaaaccagacgtcgaagtcaagcaagagtggcccccaaggtttacaaagtttaatatggaattggaaaacaatgacaaaaaactagagtttgcattttccgatccaagaagattagccagggttcgactactctctggtttggaagtaagcactgacgagagtttgttgaaattgagtcctttgaatgccccaggtcccgattacagtaagcctgaagtaccgccaaaagaaacggaaccctctgtatttggagatcctgattcagataaacatggtcgtgccagattgtctattgatgagtttagtgctcttatcctgtcgaaaaagaaaccaataaagaatctcctttgggatcagact

SEQ ID NO: 7649 - DNA, 531 bp, Candida albicans
tcatgggggtttcatgcttctttagtggcagatagtgatactccagaattaagaaaacatggcattaaacgatttcaacttgctgctcatcagaatttaagtcgtgaccaaaaatatgaaggagatttttatatcaatgatgttgaattgaatggtccatttgcttattggttagtgacagcatcacagaggtttgaacccacatttgaaatatctcccaaaggtgatattttgaaagatgagttatacgtggttacatttaacacacagaatacccaatattatattatggatataatgaaggaggtctatgataagggaagccatataaagaatccaaatgtggtttataagaaacttgatgaaaatgataaaatactattaaaaacgaaaaactccaaacctttgattcaaagaagattttgcgtatatggtagtataattgcattacctgaaactgagagtcatgaaatttatatacatgttaaagataattctcaacattcatggaagttatatataatacattaa

SEQ ID NO: 7650 - DNA, 207 bp, Candida albicans
agattcaatggcagtgttgtacctgcggaaaataatctaatgattgcatctaatggattggtgatatttaatgaaagagataaactattacctgttcctccaggtattgggaaaatcgctatttcacctttttcggagtcgtttaatgaattgatgaactcattgattgaagtatctccactaatgaatattattgtgactttatga

SEQ ID NO: 7651 - DNA, 405 bp, Candida albicans
ctgaaacaacaagatgttccattagaagaattagatcaaagaccacaaataaacgttaatgataaacctattaccgatgaaccaaaggcttcaccagctatgaaacaagagccacaatcaaataatgaaaattcacaaaatctaaaatcaaaagaatcaagtaacccgaataacggatcatctagttctgattctgattccgattcagatagtgatgacgatatcaactcgcattttactgctactagtggttatcaaagagaatcaaatgaatgtactgaattttgtattgaatgttgtacttgttttggtgttcttaattgttgtccaaacaatggtgaaggttgtgtcaccaatatggctacattcattggtaatatgctttttgcttgttgcaaatgttga

SEQ ID NO: 7652 - DNA, 312 bp, Candida albicans
catcaaaaactttctcttcctcataagttgctgtttctgatattaatcatgaatcggaagtcaactttaaatcaaaagcgttcagcgactatttctgaattccgatttattactgaagaaaatacggaagcaaatgcattgctgcaacaagaacagcaacaaccccaattaaaacaagatcagtcactgttgcagcaacacaagcgtactcaaagtcaaaccaaactaacaaaagtacttccctataaagttactagatccaaatcagttcatgcatttcaagaatacggtaaagggtttgttggttccccg

SEQ ID NO: 7653 - DNA, 210 bp, Candida albicans
tctgtttgtatttcattgaaaatggaggataaaagagaattactcaaacaaccaattcatggtatatatattccaatagggttaattttatttggtacctggatttttggttgggaatatatgccatattcaatcggattcattgttgtcatagtgtctatacaatattatggtgctttgaaacgtgcttctttctatgcatcaagttaa

SEQ ID NO: 7654 - DNA, 558 bp, Candida albicans
taccaggataatagaagcatcataataatgagatcaatattaccaatttcagttttagtaactactgctttatcagctagtatgagtactattagatcaactaccatttcctcactatcatcatgttcatcttcatcttcaacagaaccatcctcatcggccttacctgttgcaccgaacttgtcatctgctcgttatcaaaatactactattcaaacaattcaacctaattctgctagtaatgatatcagtagtattattagttctgatagtgaagcaccagaaactcgttatgaatatgaaactgatactgattatacccatgtcaccaaaactgtttgtgatgctaataacaactgttatgttactgttgaatcagaaagtttaactacttatactacaaccattgatggtgtgttgactgttatcactaccgctgtatcagcttctgctgctgctactgctactgctgaatcaactatcgcttctacttctacttcttctggtgctactgttgcttctccaatttcaactaaagctgctatcaaatcttcttct

SEQ ID NO: 7655 - DNA, 306 bp, Candida albicans
cgagcagatgacaagttcggtgcaacaggtaaggccgatgaggatggttctgttgaagatgaagatgaacatgatgatagtgaggaaatggtagttgatctaatagtactcatactagctgataaagcagtagttactaaaactgaaattggtaatattgatctcattattatgatgcttctattatcctggtattataatatatatatatatatatttctcttgtcaattattatttatatgaaacctgttgtaagtatttggctgttgttgttgttgttgttgaatttcttgagaataaattaa

SEQ ID NO: 7656 - DNA, 441 bp, Candida albicans
tcaatattaatcaacaacaacaacaataagtcatctctaataacaatgtcgacagggttatcaaatcgagtcatgaacatgaagttcatgcaaaaagccgaagactcaaaactagggaaacagaaactagaggaacaaaagaaaatacacgatttatcagaatgggtattacccgacctggcaaagctcttgaaattggcagccatgaaaccgaaaatagacagagtagggtttggaactataatgactaatggaaattacaactattcatcaactacaaaacgatcttggggtagtaatgtttcctttgaagaaattaaagatgatgattctaataatgttgaagacaatgacgatgaaccactagatttaaacacaatgtggaggaaaagaaaactagaaagtccatccaattcaaacaaaaagaaacgattactgtaa

SEQ ID NO: 7657 - DNA, 1479 bp, Candida albicans
atttactctttccggattttgggaagggattcggaaaaattttttggtttcgagaattccgatttcaaagtaaattttaaccttcccaaattaaggcggaaaattaatgaaaatatggcaggttccgaggcttggaaagaatctgggtatactgaaggaaatggttttaatttaagaataatttttttgcttacgtttccaaatattcaatcatttagcaaaactggaataattgctccaaatttaaaaaaactagttttaatacattaccacatttctaattatgatggtttaaaacagttccagcatttaaaggatttagaattaaaatgccttagtttttctatgagtttatttgatgatggttgtttacctgagttagaaagttttatatgttggaattgctcgattcacaatacaggagattttgacaactcgcaatctattttgcatccaaatttgaaggcattagatctacataattacaggtttgtaaataccgaatttagcaattgggtactttctgatacattgaagatcttctgtgtttctgatctgctctttaaggatggttttttgggtgagtatctaaaggatgtcgacgttagtgggaacgaactcacacttgatagtaactttagaatctttcatatggtcgaaaaattcatattgcacccccagtatctaacttttgaaagtctggattttatgtatcatttaccaaataacatcttacgattgcacttgatttccaacggagagggaaagatgagccctcttactcaaatggttaaatggccgctgatgttgactgatttcgcatttcgaaattttaatattgataatcagacattggagctattgaatatgaaagaatccaaccttgagataattaaaatttgtggaggcgatgtcaaaaagttatttgcagacttatttcccgttagcgttaaagatctatccttgaatgatatgggcatccagaaattaccagattcatttgaaaatttagaaaacttaagaagtttgtctttatttgaaaaccaactaagaaaagtaaattctttaaaattgccagtgtcaacattgcagacattgaatgtttgtcgatgtaaccttcatttaatatcgccatttttggtttcaatgctcgaggaaaagaacaaaaatgcagaattagaaatttgcgcttgggggaatacaaatattagtgtcattgatataagaacagcattgaaatcaattaaaggactttcattagaggtcgatgattttgataaaacattgacagaaatatcaaaacattcttctcgtttacaatgtaagtattttgtatatgatccttattctaaggagtctaaatcttctgcaacagaagaggttgcccttgactatgatccagatgatctttacgatggaagtgatagtagtttggatgaagaagatgccggtggtgatatcaaaagaagaaaaatgtaa

SEQ ID NO: 7658 - DNA, 285 bp, Candida albicans
gacttgattggcaaaaaagcaaatagaactcctagaattcaccttttagttgtttctggtttctctgtcttgaatggttttattgttcgtagttttataatagtcgaatttattgttacagtaggtagaatagaactacctagagataagcagaaaacagtggggaagcaagtcgttgttatgtcgacctcagatctttcgaatgaattgaaggttagacagaatgcgacttttcaagacaacgatttcaagcatctaggtgcaagttctaatacttcaatataa

SEQ ID NO: 7659 - DNA, 912 bp, Candida albicans
  unsure (889): Identity of nucleotide sequences at the above locations are unknown.
ttcgtccccaagttgaaaagaaaactagaaggtgacgacgatggtgatgactttgagtacgatgaagaagatgatgatgatgatgaagaagaagaagatgtcactgtgattgatccgccaatgaagagacagaaagtagcaacattgggtgaaccttggcagtcaagcacccctgctaagtcaaacagttcaaaccacacaagcggcgctgctaatttggctgcgtccattagtgaaagcaaaattaatgcagtggtcaccacaacaccgaaaacaacgtcaacaccaagatttgtcattgattcacctaataggccgattcttgctggcaaaaatcttacatatacttcttcattcagctgcagttcaaattttgaattatctccagtaagaccacttgaaactggtccacttttggaacccttgacacctgcaaacaacatttaccgaaatttccaaaatcaacaacaacaacaacagctgctgcatatgttgcttcgggtacgtacaccaaagtcgaccatcgcaaaaacaccaattagaaacattcgtaccccgcaaaccagttcgattgtcaaaaaactttggaattctccttcatatttagatgatttttattatagtccattgatcaataatctgatcaatctattaacagtgtcatctaattccaagctatcgactatacagggaagttttctgtcgtatgacgatgacgatatggtttcaagaaactttgaacatcctcatgtccactcatcgccaatattaggcagttcatcagatcacggtgttcttgctgataataaagaaaaaagaaagaatttgttccaggatttaaaaaatgtggagaagaatattacattaaaaggactgagtgtctcttttngttgcccaagggtgtttgtatat

SEQ ID NO: 7660 - DNA, 390 bp, Candida albicans
cgggtttttccaatatttttttcaaccccggaggaaagaattgagagggtgttattaaaaaaaattgcaaaagggaaattcgaggaaaattttcgaaaatattttataaaggaaagaggaggatttttggggtggacaggaatttcttataagggccagaattttttttttttggaaccaaggcattttattccaaggggtgaggaaaattctagaagaccggggaaaaggggcctttttttgggtggttattcaaaaaccagggattttggaagggagcaaattgttttggaaaagagcaaggaagttggggagggaaaagtttccttattcaaggaagttcattggacccaaattcaaacccaagggtttccaaaatttaattgctga

SEQ ID NO: 7661 - DNA, 417 bp, Candida albicans
cagtttatttattatattgccgtcgttttttcaaatgttatgggatttattaatccaggaaaatctttgaggaagagaaagctgaggagcaacactcccttacctgctaaaataccaaaagtatctccattcttatcccaaccacaactgcaatatgctccagccatttcactaattacattaccagtggagattattcacaaaatatttgtttacgttggaccaagtgaaaactatctccccttagttaacaaacacatgtattccattcttcgattcaatggtgatatacaagcggaaagtatctgtaattatcccctcctcaagtccatggtgaacagttacttctattttgacctaaacataagaataaaccaccaatctcttaacgccgggagtgaaagaaatccccccccc

SEQ ID NO: 7662 - DNA, 225 bp, Candida albicans
aatacatataaaaatatattcccttttttagttttaatttattttaattcactttttattacaattatattagtacacatagaaaaagataaaaaaatagacccaacaatttactttactcccttcattctaagttcaataaagtactttgccactttcattttatgtgatattcaattatacactaatttaaataaaaaaaaaatttgtgagaacgaagattag

SEQ ID NO: 7663 - DNA, 192 bp, Candida albicans
  unsure (21),(22),(23): Identity of nucleotide sequences at the above locations are unknown.
attcatatttttatcggtccnnnatccaagggggaaaggcggataatgaggaggagttggcggaggcagttgaaaaacggagaatttgcaattaattctcaattctcggacgataaacaaattaatggagatagaatgagcataacacacaaagataaatcttttgtactgggctttgtatcaattatttaa

SEQ ID NO: 7664 - DNA, 1089 bp, Candida albicans
tggagcaagaggaggaaggaagaattgttgaattatgagaaccttgatgttattagtgacaagattgatgaagttggtgctgaatcttccataagtactagcaatgacagggggattattgcaaatgccactgcaaatggaccaatcatagtcggggatagtactgaaagtgttgatacaagtaacatagaaaatagaaaacttgttgttgtcaacagcacacctgacgaccacgactactatgcaaccaatgacatgaatgacaacttcattacccctaatccttctaatgaaagtgttgaaactcttgctggtgtttataaagattttgaggttactaatgcaactgaggcaaatactgaggcaggcaaaactactgatatcaatgccgagacttcaaatgctattgatgcagtagctgatactgaaaataaagtaaccgctgaggatgatgctactgatacggtcaacactggtgaaagtatgaccgatacaacaacaagtactactgataataagaatgacaaagaagttgacaaagaagttgaaaatgccgttgactcaaatgtgactaccaatgataccattcctgataaagcagcaaatatagataacgaatcttctagtgataacagtattgatgctactacagcaaacacaactaatactaataatttcaatgatgctgaggtaaacacagaagccactaacactatagttgacaatgtcaccaatgataagtttaacagtgttgacgtcagtacaactacccctaccgctacgactgtttctggtattcctactgcggatgaaatgaccaataatgtgaacaccaatcgaatttctactgccaccgtcgatagttttacgggaaagactggtgagaactatgaatccttcattactaatgctggtaaagattcgaacgacaataatgcagatttgaaaacacccacgaacaattctgcaaccaccacaacaaatacacagtctggtgtttcaaataaaaaatccaattccaaaaccggatcttcagaacaaaatccatttcaaaaaaaacttatgaattatttaaacagtttgaactga

SEQ ID NO: 7665 - DNA, 585 bp, Candida albicans
acagatgacgcaccacagacaccaatcaatccgacaattgttgctaaaattcttttttcactagatgagctctcgatagtctcgtcattaccggtttctttgtttgattcattaccgaaaataaacgttggtttggcaattaatacaaccccagccaaggagaatactgaacagattgcttctagtattgaatatttttcgtgcaataacacaaatgccaaaaatgctgtcaccatcggtaccaagaaagtcaatgctacggcatcagaaagactcaaatactgtaatgaaaagtacattccaaaaacaccaaaaaatcctaccaagcctcgtaacaacaataacttcctaattggtttgggaccaaatggcgcatcgggaacagatcttgtgatggccatgtataatagacaacaaatatatgtgatgaacattctaacaaacaatatttgtgccggatggatcggagtgttgaagttcttatcggtgaccaataacttacaagttgtcaccataatcgaattcaaaaattgtgatagtaacaatagagacaatccaatgtttggtttgatatattttgaataa

SEQ ID NO: 7666 - DNA, 219 bp, Candida albicans
  unsure (208): Identity of nucleotide sequences at the above locations are unknown.
ttagtgttacattttccaaatcataataaaagaattatgtattatgggaaatcattgactcatccaattaaatcgagtttatttctttgggaaagaaatcttgaactggtcttgtctttgagggttatgtacatatccgcctctttattaatttatatgtataatcctcgcctgatatgtatgcatggtaaatcaggaacttctcttngaaacaaataa

SEQ ID NO: 7667 - DNA, 183 bp, Candida albicans
aaatccccttatgcggctctaccaaatctaaagtctcgaatccccttttattctagacacatattgaatgtgaacttaataactaaaacatttaaagtggagatttacagacaaaattattataacactaaaactttaaggataacggcatcaactattatccaagaaattacagaaaaatga

SEQ ID NO: 7668 - DNA, 294 bp, Candida albicans
  unsure (148): Identity of nucleotide sequences at the above locations are unknown.
aaaaactggagaaaacactttttgcccaattggttaaaacggggtacggattcgaaaagaaacttcaaatttttgaatggtgggaagaatagggaattatgggtgaaaaatttttatagtcagaggactccacaatttattattgganacaaacatcaacataagagagatttatatgccttaaacgagtacatcaaggaattggttcaaaaggtgaaacgacgaagaggttcaccaattttgaatcagggagaaagggaaaatgtggacgctggaacaaatgtactcgtttag

SEQ ID NO: 7669 - DNA, 204 bp, Candida albicans
tttaacacctgtattggtttcttcgattccacattatcaaaatcaattgatgtgtcatttttgaataattttattgttttgggacaatacaaatccccattggtacgtagaattatcgaatacaatttgacactgccattaagaaatggaatgttgataatcatttgttcatcactgtctgatttgataattggtttgatttga

SEQ ID NO: 7670 - DNA, 189 bp, Candida albicans
gaacagctttttttcatattttcaattgccgatttattggaattcccaattgctggagcaattgttagtggtagtaaacaaagttataacaatttagtttattttttaactgcttgtgcagcaattggtgctatagtaagttttatatctcgatatctatatggtgggtttaatcttaatagagtttaa

SEQ ID NO: 7671 - DNA, 195 bp, Candida albicans
ttgcgtgtgtgggtgcaaaaaaaaggtgaagaaaaaaatacctcaaaaaaaaacaacttcaaatattcccctcattttctttcacagtcatttggtttcaatctctattgggggttgatctcttcttcaatactattgcttctagtttataagttcaattgtttaagtggttggagggggtttgtttatatttaa

SEQ ID NO: 7672 - DNA, 300 bp, Candida albicans
tacaatagtggtcaagggggggaggaggaagaaattgcaatctatagtaacattgatgttcccctctttctgattagtaatccccctttcactattagcaacaataaactatatatatatatgtatatcaaacctaccttccttcctttcttcatttttgttctcttttcgtcgactagaactttcttaacaaacttcaaaactatcttgcccgaattatttgataatatttttaataaaatgggtacaaaatttcactggtgggcaaacccaatcctccttatggggggttgctctcca

SEQ ID NO: 7673 - DNA, 222 bp, Candida albicans
  unsure (26),(30): Identity of nucleotide sequences at the above locations are unknown.
tttggcgatcataaaaatcggggggngggnggggggggcaacaatcaactttactactcgtttttttttttaattaaccgccaacaacaaccaccaccaaaatcatcacaatcaatcatcttaatccatcatgacaacactatcaacaatctggttatttttaataacaataacagcaatattccaattaggtttaagttcaaatgtcaccaccattattga

SEQ ID NO: 7674 - DNA, 972 bp, Candida albicans
actaaatcatcttgtacttgtttcttcaactatcaactagcctacctgtcattttttattattaaatcatttactagtttttttttttgttgtttccattctacattaatatccatactcattactacaatggctgattcaacttttgatgagttctttgagaatgatttctattcagctccaacttcaatcaataattctaagaatcatgttaaaaatgttagaaattcaattcagatcaaacattcaatgtcatcaaggtcgttaaatgaattcacaaaagatataccaccttcggcaactaccggtagtataaccaccaaatctaatacacagacgaactcttcttcttcaaaagtcgggaatacatctggtagtacaaggacatctattattaaagcttcaccttctttaaaagctttggaaagtatacttaacgaaaagaataaactatattatacaaccaatacgaatattattgaagaagttgaagaagaaacagaagaaacagaaaaagtcagaatagcaaagaatcactcccagggacttcattcattatcacctccgattttgtttaattataataacagtaataatagggaatcagtacaaacttttgagaccgctattgaatctttaaacgaggacgatacccttgcagtattatcaactaatactagcaatagtattggcaataatagcaataataataataatagtaatggctatccattgactaccaagacgagtaaatcatcgtcagttaattctcacaaatataataaatcgtcagtttcaacaattagtgagtccgggtatagtactgatgatactccaatcatatcgcaaccacttactttccaaagttttacaccccatagttttgaatctcctcaattaaaaatggttgatataactgaagaatctaattttgagaatgaaaatagtaattctactataacaactaataca

SEQ ID NO: 7675 - DNA, 228 bp, Candida albicans
ttaatagaggaaaagtattggcaacagaataaacgcgtcttgaaaggctggcacgtgatctatcaaagtttatttttttttctttttcctgttcattttaacgacgcgttttttttatgtgttttgggaggggttcaaactttcaactttattgggcgggctaatgctgttcctgaaacatcgattgaagatctcaagtttagttgcaacttaatacagaacttttaa

SEQ ID NO: 7676 - DNA, 408 bp, Candida albicans
ggaatattcccaaggggtaaaattcttaagaaatttgacaattgtttttacattaaacaactcaatctttgggttcaaaaagataatataatacccattttagaagatcaaactggaattcccaacgaagatattttgaaacaagttcaaccgccatcatcattatttaatgatcaaattttgaaattattaaataatgaagaaatattacaagaatattatttgacgagatcgttgacaagattccatgattttgaaaaacaagttttgtttgatgataatgggaatgataaaccattagatctaataaagtacaagacttataaaaaaggtttaaaaatggttaaacctttaagaaaagcattatatgaatatgaaaatatagaaagaataaagcatcatcactaa

SEQ ID NO: 7677 - DNA, 498 bp, Candida albicans
aggatgaggatggtgaagattatgaagatccaagatgaagatgatgttgaagtaattggggacagccatactgataaagaaaatgaatctagttcagaagaatcatcacctgaaccaatgactaaacgaacgagacaaagaacaaggtccacccatgaaaaaacagaacacacgtcacctaatatcaaaaagaggacaagacagagtgtcaaatttgacgacaagcctgcagagccctccgatacaggttctagaaaaagacgagctccgccaggatcagtatctcctccacatcctcctaaaacacggagacgtacaagatcagtaacccatgaaatagaggaagaggatgcttcgacacagagtgctgatgatgctgagccagaaataatcaaggtagaaacgagacatacaacaagaaggtccagtcgtatactgatggaaccctcatcatcaacaccaaacgtcagagtaagacgcagtagtcgtaaaagatga

SEQ ID NO: 7678 - DNA, 627 bp, Candida albicans
caaatgataaccaaatatcaacagtctcaacagaaaacaccattaacgtcaattacaattattgaaactacatcaaaaacaacagaatcattatatacaacaacatcaaatgattctacacatattttcactacaactataattgatgttcaaactaatacgatagtcacttgtccaacaacaacatcaactttaacgctgtcacacacttctgataatgaaaaaccagcttcattgtcatcgtcttcattgattgaatctgatcatattgctgatggtactacaacttcaactactttccaatcaactagtactactacagttgatcatcattgttcttcatgttcagaaatattgttaagcacatcttcttcaattataggaaacaaatcaacttcaactagcattagttcaattgagacatctgctagcagcagctatcattcaagtgaacctgaagtcatgtcatcatcaagttctaccctgattaagcagtctagtgattctattccgtcaaccagtcaaacacatgtatcgactacttcttcttctgttagttctttggaaacaacaacaacaacaactgaaaattcaccaacaagtaacggcttttcaagttcgtcatag

SEQ ID NO: 7679 - DNA, 186 bp, Candida albicans
gaattggatcaattaatggttgagttcaacaacttgaatttgaataataaggcaaccaaaaacagacttatgaaatttcccgtggaaacagcaaccattgacagcttgaagtattacaccatgtttcttaaaataaatgagaatatcctaatcgacttgattgaagtattattcacctatttggga

SEQ ID NO: 7680 - DNA, 231 bp, Candida albicans
caacttatcatgacattgaacaaaacctataatgataatgatagatcccattctacaattaatataaaggacacttttgaatctgatttacacaagaacaataacaatattagcaccgatagtattagaccaacgatatttgaattaacctccaatgaattaaaaaccaaaaatgacaataccggggtgaaaatggtggtactgggtgatgggaaatttcacacggtataa

SEQ ID NO: 7681 - DNA, 564 bp, Candida albicans
atagactcaccaatcacaccaagtaatgctgtaaatatgaataatgggtcttctttgttcaatacattggatgttcctaacgaagaagatgaaagaaggagaattgagccttctgtgtcttctcatccaccacaaccaccaccaccaattgaatcaactaaaaataaaacaccaaacactgatttagttgaatcagttatagaacaaggatatatgaccgtattaaagaagaaatataatcgtaaccttactaaacgagtttacttagtgttaactaatgtgaatttgaaagtttacaaaacacaagaagattatcgtactgattctcaacaacaacagaaacaaccatttgaattgatttataaaaattaccctattaatgatattttggatattatagaattagaccccatgacttcaaaatatcaatggtgtttattaattatcactccattgaaaagaatacgattctgttgtcatgatgaagaagatatgatgaaatggttttcagcacttaaagcagtggttgttactcaaaaaaagaaacaaaaagaaattacctaa

SEQ ID NO: 7682 - DNA, 246 bp, Candida albicans
tacgacaaattatatggtgcatacttcaagaatccaccaataacaatagaaggttcaaagtatttaacatatttcctaggtgcatacttcttaatggcaatacaagggaaagccaataaaaatccaatcaagaaacaccatgctaatactggatataatccattgaaaacttttttggggccaataactccccataataccgatgctgagaagaatgttctaccgccagggcatgtaaacttttga

SEQ ID NO: 7683 - DNA, 372 bp, Candida albicans
attagagagcttataggagtggtggttatatcatctatatatacaggatatttaactcccgtgacgtgcataattgatataggagagaataataatgaggtggggtattccacaaaaactgaaaatagaataattgtcggatttaaaattatgaacaaatatagggaagatgccgaagacgatgacgggtgtgaaaattattcaataaactttaataaaagacatgagaggttacatatattctcagcattcggtttatttgtttgttgccaattacgtatgtttgtcttctcacatgcaagatctcgacatttggtccaacagttgactaccgtacctcacctaaagttcctaaaacttattcagcattaa

SEQ ID NO: 7684 - DNA, 273 bp, Candida albicans
ccatcttcattacagaaaaataatgcatgtgtacgtgaaacaactttacttttgaagacaatcggtgctgaagatccctggggtgcgtgtgctgccgctttgttcttttcagtgtatctcccgatgttgatggatgtttttggtgaaagccgacgaattattggcgagaaatatagtcctgacgatgtggatgaatggtctattaatggcgtcaatcttactgaaaagaacccatccttgtctaacccgccctttgcgtcttcgtcgacgtag

SEQ ID NO: 7685 - DNA, 195 bp, Candida albicans
  unsure (163),(182): Identity of nucleotide sequences at the above locations are unknown.
tcactattttcagcaattacccactcgcttgtttttctacttagtttactgatttcattttgccacttgccccagtttaacagctttttaatcatgaaatccgatgatatgactcctacattcaagtcatttatatctgcgtccatactctccttgtatgatnttcaccagctaggggcccnaatcattcccatc

SEQ ID NO: 7686 - DNA, 204 bp, Candida albicans
aggaagataataattaatagtaatagtaaggaacagttgaatgaagtgtggcaagtattgaacttctggggggtggagaaatcaataataataataataataatatttgtaaatataggaaattcaaggaaaagtaaaaaagaagaaaagaaagaaggaaataggaagaaagaaagaaaaataagaattaaaagtgaaaattga

SEQ ID NO: 7687 - DNA, 339 bp, Candida albicans
tttctccaccccccagaagttcaatacttgccacacttcattcaactgttccttactattactattaattattatcttcctttaacccaacttgatcatactttatctgacttgatcagacgtatttattttactgaatccatcaagagtgtttcaacaaccatgtcagtagcaataacatccaataacaataaacaaccacaaccacaaccacaaccacatctaaaagtggtgaataataattcaacttttaatctatatacttggttaagatcagtgtttcaatattgtatatcattaatcatttcatatacttccaactggttatttattgaataa

SEQ ID NO: 7688 - DNA, 279 bp, Candida albicans
aaatattttttaatttttttgtgtcatgcacacactacacactacactaaccaatacaattttcaattcttcttcttcattcttttattcattcattcttcattattattattaatatccccacctcttcccacccatcaaccaaccattatttcactcctttcaaatcttaaactacccactcactcacttcttctatctttcttaattatttatatatataatactattctagttacaactactactactactacttactactactttaaacaataa

SEQ ID NO: 7689 - DNA, 303 bp, Candida albicans
attaggaaaacagggaaactgaaattaaaaaaaaacccccagttatttttgaaggaacaattattaagacgtgattggagtattaaaagtattgttctttttatggaaaaaaaaaaaaaaattgattttataacaaaatcaataatgaatcaaataaacttgttgattcaagaaaataatattgtggttgttgttactttctatcaatttatgaaacaaatgataggattaatatggggggaggggggggatggaatggaatggaatgaaaggggatataatataaattattgtttaaagtag

SEQ ID NO: 7690 - DNA, 294 bp, Candida albicans
  unsure (47): Identity of nucleotide sequences at the above locations are unknown.
agcatttttgttggagcaaagaaaggtcaagttagtatgttgtatcntatactgagggaagacgagaacatagttggtattgttgatcaaaaaaagaatatcagttcattgtttaaggtaacaaaccagagctattttgctgaattaattggaaactatcaggatattttcgaaagtgagttagatcagaagccacccctgcgtgggagctgggatccaaaaattgaggtggtaccccatattagtcctccagctactgcacagtacccgctttcagttccagaacaagaataa

SEQ ID NO: 7691 - DNA, 249 bp, Candida albicans
tatatactatattatgttgtatattataaatttaataatttttctttatttttttatatgtttgttatctataaactttcctcctcacaatgtttaaacattcataatatcaagaatgattttttgatcatcttcattcatttgtccaaaagtggaattaaatttttgattattattcatttgcaattcttgaataaattgtttaacaacggcaaatatattaactgcatccaatggagtggtacttaa

SEQ ID NO: 7692 - DNA, 567 bp, Candida albicans
ttattatcaagacacttaatcatttttagaatgtctgataatactacttcaaaccagtcctcgactggtgattccaaatcaacacctggtgctgtcccatcatccaccgatggatcgtcatctgctccaattggcaattctgtcaattctgttgatcaaacttcagtctccactgataaacaacatggaaatcaaaatgtcccacaatctagcggtgcttattctggccaaaattataatgccaattatcaaggatacggtaataatcctaattataataataactataacaacaacaacaacaacaaccccaattattatcacaaaaaccagtataataaaaactacactggaggcaatagtggtggtagtggtggaagacagaataactacaacaacaatgccaatcaaaacaacaatcaaagatataacaacaacaagaaacagtacaataaccagaaaatgaatcatcaccatcataaccaacagcaaccacaacatcaatatgtgaactacccttacaaaactgctgccgctgcaaccttcacaaaatgtatgggttactaa

SEQ ID NO: 7693 - DNA, 321 bp, Candida albicans
tatttatcttgtggagcttgttgtttggatatttcatcttgttcttgttgtttacgtaatttctcttttaatttaattctttctagtaatgataatccattaaatttattactttctattgattccaatttttctttaaatttgaatcttgatgaatcatttttcaaatcagagaaatttaatgatcgattttttattttggttggtgatgaattggctgatcgtggtttaatgattttattaggtgaagttttcaaaaacgataccggtgaagatggcaatgaggatgagcacaattcaaatgttgcttctgtagtatag

SEQ ID NO: 7694 - DNA, 276 bp, Candida albicans
aggaaacagagaaagaaaatattatctattacttatatctatgcatcaacttcatcttcttctcttaatgcaatatcagcagctttagaattcataaagaaatatttcaaaacgtattcaattgcaaaagtaaccaccaaatctaatattatgcatccagttaatttagtcttgaaatcaattgtcattggaacaaattgcataacttcattcaattcaggaataaattccgttgaacaagaaaatgttaacccagcaacacccaataatccataa

SEQ ID NO: 7695 - DNA, 216 bp, Candida albicans
tccacgcaaaaaaatgttagtatttttcccatacaaaaaattactatgtattacacgcaaaaaaaatcacatacaaaaaaaatgttagtgtttttcccatacaaaaaattactatgtagtgcacacacaaaaaaatcacatacaaaaaaattaccatacaaaaaatttactatgtattctcacatacaaaaaattaccatacaaaaaaaatgttag

SEQ ID NO: 7696 - DNA, 210 bp, Candida albicans
tgttttttctacacacacaaaaaaatattatgtaatccacgcaaaaaaattactagtattttttaccatacaaaaaattactatgtattacacgcacacaaaaaattgccatacaaaaaaatgttagtgtttttcccatacaaaaattactatgtagtgcactcatacaaaaaattactatgtagtgcactcatacaaaaaatttactag

SEQ ID NO: 7697 - DNA, 186 bp, Candida albicans
tattttttaccatacaaaaaattactagtatttttcccatacaaaaaaattactatacaaaaaattgctatacaaaaaaatcaccttacaaaattattactatacaaaattactttatatttcgttcactgtactgataaaggagtatattctatggctgctggagaagaactacgtataatataa

SEQ ID NO: 7698 - DNA, 255 bp, Candida albicans
tgtttttcccatacaaaaaattactatgtagtgcacacacaaaaaaatcacatacaaaaaaattaccatacaaaaaatttactatgtattctcacatacaaaaaattaccatacaaaaaaaatgttagtgttttttctacacacacaaaaaaatattatgtaatccacgcaaaaaaattactagtattttttaccatacaaaaaattactatgtattacacgcacacaaaaaattgccatacaaaaaaatgttag

SEQ ID NO: 7699 - DNA, 1161 bp, Candida albicans
  unsure (137): Identity of nucleotide sequences at the above locations are unknown.
aatgaatcccaattatacccattacacttgtctatcattcaattaaatttcaatttattgaaaagtcattatcttatgcttattaataataatatattgggacaaattactaaacttgaaaatgattatcaatcatntattaatttcccttcatcaattgaagattttaaaactagtgataataaattattaattgatatgaaaggatcagaatcaaaagttaaacattgtgctaaacaattgaagaaaattttaccaaataattatgaatttaaagtgacttttaatccaaataaatttaatgatacatttgtgattaataaacaagattttgaaaatcaaattgttattccatttaaaattttatcggggattgaaattatagctaatgaaaccccaattgaatcaaacagcaatactactacaactactactactaatgagcaatatcatcaatttattttatcttattttaatgaaaatgaacaacaggacaacattaatttagataaggcaattgtttcattaacattatttttaagagaacgaggatttttaattaatgaaaaaagagaaatggaattcaatccattaattgaaccagtggtatcatcatcaccagttaaattacaacaatcattatttaatccaatttctccattacctttacaatcaattactaatttcattgatatgagaacagcaacaccacaaaaaggatcagtatctcctaaaaagaattcaggtcaattacaactgccagttaaattacaatttctgccaaataaatcaaacaaccataacaatagaggtggtcgtcaacatcaaagaaatcaatcactttgtctgccagttaaacaacaacaagtctactatgttctgccagttaaacaacaacaagcctactatgttctgccaactaaacaacaacaacaacaacagcaaggatactatctgccaacaaaacaacaacaatttctgccatcgaaaatgcaacaatatcaatatcaacaacaatatcaatatagtcctataaaacaaccaaatttccaacaattttatattccatcaccaacagaaactcttgttccaactactcctactactacaagaactagaagtacagccaatacaatgactccttatatttatagtatttag

SEQ ID NO: 7700 - DNA, 183 bp, Candida albicans
aaaacattcggacggaaaaaagacacggaaaccgaaaaatccaatttatccaaaattgaaaaaaaaaaacaaactccgattccaccaaataaaatcatccccttccctttacttccccttcccaaatatttttggttgaaccaaaaccaacactactatctccattacttggccaaactttga

SEQ ID NO: 7701 - DNA, 306 bp, Candida albicans
gctgataaactagccgaagaaggaggtggatgtgactctatttttagggatattgttttgcaacctcgtgttcttgatatatactgtcaattattaatgcaatttaataatacactccgtaaatcctgtatattagctatagaagctggttatgtaatcatggtctctagtttattcttgaaagatttggaagattctttcataaaatctaattctgtgaagagtcggattttcattgataattctgcttcggtgttacaatctgaattatcttcttcatttcaaccttgtagaagtaaaatataa

SEQ ID NO: 7702 - DNA, 243 bp, Candida albicans
agcctatcgacgtgtttggcgcgtagttgctactacagcaaatatggaaccgaagttgtgcaaaatacttccacagacacacatatatatacccagatttatatatttggatacaattgctttgctacaaaaataaatcataaattaaaacgacctaaagaaacagataacacaatgtctttaaacacttgtaaacaaagtccaaacacctttggcatattgaacaatttcatcaccacctaa

SEQ ID NO: 7703 - DNA, 270 bp, Candida albicans
aaagtattaagttcttccaatcctttagttggaatcactaaagacaaaactagacgcccatattttgcaaagaaatttagagttactacgattgctccaattcatttgaaacaaaaaaatatatattttaaccgatctgcaagtttagaaagagttgataaatttttgaagtccattctttactgtctattattatttccacatcacttgacgcaaatagcagacacacacacgcacacatatatattggagtcatcccccactgaatag

SEQ ID NO: 7704 - DNA, 831 bp, Candida albicans
gaaacccacattaatattccaatggacgggtttcttattgatgcttgttttatagagccaaatgccacagtacaaacagacatgttatttactttgatattcacggagactagacggttgactataaatttgtttttatggtctaatgttgaaggcgtatggcaaggtttttctcgagaagtgctaccgttggaaaacgacaccgaaataccggtgtttgttgcacctcttaccaacaactgttcatttttatttgtatcaccaacaaaactaactattgttactattcatgacattatttctgcaagttatgattttaaaacgatcgaggcaccttggcaaaagtcattcccaaccacctatcatatcccaaaagaaaacacctcaccaatagagattgctaaatttgatgaagttctaatatctacagatacaggagccatatactcaattcaggtaattgagaattcatttggtaaatgtgatccaataatacgtgttgcagatagtatttcccattttgttttagaaaaaagaaaagaaaactatagaatgatatatgcaagtactggtggctcaagcaaagatattttaataccagggttgttttcaagtgaagttttagctgacattagcaatatgtcaaaaataccatatactaatgccaaactactaaatgatttcaaaccttgggctcctctagtggatgtctcaataattgattcaaaacatataaaagattcaaaactaccattaagaaacgaaatttggggtgtgggtggtattggaaggaaaagggacctgagccaattttgtttcgacagcagccct

SEQ ID NO: 7705 - DNA, 510 bp, Candida albicans
  unsure (34): Identity of nucleotide sequences at the above locations are unknown.
ggggggccccttttcccacatttgaggcccctancggcctcgtgtgaaaacaagaaaggtggtgtgggtaacggtggcaagggtggaatgaataaaggtggaaaaggtggaaaacagattgaagaacaatgtctggaagaagaatactccactgaagaggaagaatgtgatgaattcaataacggtaaaggtaatgctggcaaaggtggcaagggtggtaaaggaggaaaaggtggcaaaggaggtaaaggttccatttggaaagcaaagcgtgacgaagatgaatttactgctgccatcgatataggtaaatggaaagccaaacttggtggaatgaaaggaggcatgaacaaaggtggtggtaaaggtggtatgggcaaaggaggtcaaggtggtatgaataaaagtggaaaaggtggaaaagttaaacaaccagttgaagaggaatgcctggaagaagagtattctactgaagaggaagagtgtgatgaatttaacaaaggaaaaggt

SEQ ID NO: 7706 - DNA, 402 bp, Candida albicans
ccattcacattaggactaacagtcaaaaatatggatttcaatttactgcatcgaaagtaccttgacaagattaaagccagtgtgtttaaaaaacagcaagagctcctgctgccagacgtgcatcagcggcgtcaaccagacaatgatttatcccttgtaccaatcacttccccgcccgatgacccacaccaatatccatccacattttttttgagtcctgtcacttcaaacgaatcatataattactattctgaccagtctctgtcgaagcgacagtattatgctgagcctcagtcaccagcatcgtcggtggatgatggggaaacggaaaaagaagacaatgaggatgtcatttcagatgcaccggaagatcaggatgtagtgatgacgactgaaagtgac

SEQ ID NO: 7707 - DNA, 285 bp, Candida albicans
atacttaggtataccagaacaattaaacctacacttatccgttattcattggtaagattacgttgtgaacctggtaaaaataaagataacaataatctctggaaaccagtagtagatcaagaatgtacaactctagaagtaggacatcgtatagtgtataaacactcaataagtaatgaagaaacacgttttgttgtgcaatttagctggcgagctcaatattgggtctctccgccgtctgtctgccttgcattctactttttttctccttatggaaaacattag

SEQ ID NO: 7708 - DNA, 228 bp, Candida albicans
gggccaccattaaacaaggaacaacaattaatgacgataacggttattgaaatttcacaattatcattgaaagaaatattcccacttttttggggtgaagaggagaggctttcatttttaatggttttccaattaaaactggtagtagttgttgaattgtttatttattataaaagaagaattacacaagatctacctcagattataattccgataaacaatagataa

SEQ ID NO: 7709 - DNA, 201 bp, Candida albicans
caacccggaggcgcagccaatgaacacaagtcggaggcttcacctgatcattcgttgttaactcgctggaggccatttgccgttgcaactacatgcagtaccaacgtcaccatcgtaacaaaattacaaaaaatattagtttgtactacaaagggcactacaattatgaattggcagaatatacataaacaaccaacttag

SEQ ID NO: 7710 - DNA, 198 bp, Candida albicans
tcaaattttgtcatatcatcaaatgataatacccgacctaaaaaccctaaaaattctaatgcagtaccacaagtccaagatacattaaaccaccaatatcgagatttaatccacattaaacaagtcatgacaaaggttatagcgaaaatcactaagaataggatattagccacacgatttaattttggaatagcataa

SEQ ID NO: 7711 - DNA, 183 bp, Candida albicans
gttattggttgtgcagctggttgtgcagctggagctgccgctggagctgctgccttactccctgttaatcctgaaaaaagatcaccaaaaaaacttctcttgtcaatttcatttgcattggtcaatgcagcaactgttagtaacaccgaactgacagctgttactttcatgattgaactatag

SEQ ID NO: 7712 - DNA, 276 bp, Candida albicans
cgaatgattgaaagtttgcttcaaaagaaacaaaagagatctccagaaaatttttttactttacagcagattggtagatatatatttgctaacctccaacaatacagtacaactcaattgggaaattattttgcacctaaaaaaaaagaaaacaaattttttttttctattcccaatacagtaataaacctaattgcaagtccaaatacagtaatacacacaaagacaacaagaggggcgaccacccctaatctgtcagtgctcttgacttactaa

SEQ ID NO: 7713 - DNA, 891 bp, Candida albicans
aaaaattttctggagatctcttttgtttcttttgaagcaaactttcaatcattcgttacaaactatagttcaatcatgaaagtaacagctgtcagttcggtgttactaacagttgctgcattgaccaatgcaaatgaaattgacaagagaagtttttttggtgatcttttttcaggattaacagggagtaaggcagcagctccagcggcagctccagctgcacaaccagctgcacaaccaataactcaatcaccagctgaccaaccaactgtacaatcaccagtttcatctgaccaaccatccactgcacaaccagttgctcaaaataatttattattagattcttcaaatagtactttagttgtgccaagttcatccaaatcttcaacaaccacacgttccacagctggtttattagataatttgttaggaggaagtggtgccacatctagtgaagcatcatccagtgaagcaccatccagtgaagcaccatccagtgaagcaccatccagtgaagcaccatccagctcatcaagtgaagctttgtttagcagctcaacaaccaaacgaccaactgctgctgataaaggttttttcggcgatttgtttggtactcagtcaagtgcatctgaaactgatgatgaagattgtgttgaagagactgaaagtccaacaagtgctccagcaagtgctccaactacgtccaaggttgctactactaccggtggtggactcccaaatatattgtcagatctctttcctggaaaatcaagtgctcccatttccagtgctgaatctagcccaactgttgcttctagtactactggattcccaaatatattgtcggatcttttcccctggcaaatcgagtgttccaagttccagtcctga

SEQ ID NO: 7714 - DNA, 477 bp, Candida albicans
atgattcggatgaggaatttgatgatgaaaaagataaagcctttttttgaaagagaagacaaaatgaggaatttattgaatgacatgggtggtattgtaatttcggaacaatttggaagggaaatttcaaaaaagtttggaagaatttggaaactggaggaaacaataaagttgtttattactgtggcaaaagctgtgaaagaagtcgggttatttgttgaagaaagtgacaacgatgatgaggtggaagaggaaagtagaaactctgctccagtaaatgaagaagctgatcgtacaatttttgaatcaggtgaagttgatacccaacaagatttatcagataacacttcaaatacttctgatatggaatcagaaactgaaactacgaaaagatcatttgttgaagacccagaagaaatactgcatgtccaacccaagagaaaacgattagtcatcagtgatgacgaagaagaatag

SEQ ID NO: 7715 - DNA, 603 bp, Candida albicans
ctcctagtctattcacctttctcattaaaaatgattcattatttgattttccccatattattaatttttttccaaattattaaatccagcgggtattatgtaccagcaaatggtgatgattggacaatattaaaacctccttcatgtaaaaataaattaccaggacaatatattgatagtttaccattcacatttggtattgttgttaacccttatattcttaatgaagatggtgattatgaaaaacccattgtatctaaaattaaaccaagtttaacgacgactacttttgttacttcaataattactacttctactgctacggctcctggttctaaaccaactaaaactaaagatattattgttcaaattcatgatggtcaagttcaaaaaatgaaacataaacatgactacagtagtggtggtggtgatgatgatgatgatgacgaagattgttttgatgaaaaaaatattgatatggccgctaaaagagattatcaagatatgaatactcaagaacaagcaaatgaagattctggtcaagtattagcagaatctgattctcatcaacaagtggttgatcaaaatgaacagatcaatgaa

SEQ ID NO: 7716 - DNA, 573 bp, Candida albicans
attgttcctttcctttgcaatctcaaccccactatgaatgttactattgaagaatccggtattcttagatctttaggggtcaataatttgatactattatcaattccaattgctgctatacttgtatatctctcatatcttcaaaagccaaaaccaaaggtaaactcaaacaaaaatacaaatacaaatacaaacacatctaaagattataaaatagctgatagaccattaggatattggaaacctgattattcattcaagacacctactccaccaccatttcctaattgggattttgaaaaaactagaccaatcccatatcgtgcatttagacataaatacaatgttactatggggataagaagtatgaattgggattcatggattgaattacataatgaatggaaattttatcatgatttaaaattgaaacgattacaagaaaaagaatcagaactttccgggatgtctgatttggctcaagatgcaagttgggaattattacaagaattatgtcaatatttacctgctagatatccgacaatgtttaaatttgaaaatggaatcatgaac

SEQ ID NO: 7717 - DNA, 252 bp, Candida albicans
agaacaattcaacaaaacttacatctttacacgtatataggtgcatatatatatatatatatagttctattagttacaattcatagagaaagtttatctcaaatcaaattatacgaattaggattatctatacgtttagtcttgctctattctctatcagtgattattattattaaaattattcttgccttttatttctctccacttccgtcgtatcatttttctgtttcaggaaaaaatttgcaaccgtaa

SEQ ID NO: 7718 - DNA, 186 bp, Candida albicans
tatcattgtaaagaagcgtttacgagggggggcaacacgttaattagtcatttcatagttaatatgacaggagaaaaaaaatcaaaattggatgagaaattgatcgatgattgttgtaatataatttttcatactttttctatcattcttttcttcaataagtcaattcaatttctaacaaattag

SEQ ID NO: 7719 - DNA, 333 bp, Candida albicans
cgacgtgatttacttcgccgcctggtgaagatttttaagcttgtttattggttgcatttaaaacaagaacgaattctcactttctcttttcattcttcctttttcaaaatagtacctcatcccttgaaattaagtacaagtagatcatcgaaatacaagagaaacatgcccttgaaaaaaaaaaggggaaacataaattttgtgtttacttcaatgtcattatcgtcgtctaattcaatagtgaaagaaaaggacgtgtactatcaaacaaaatattgtttttctgcttacataatatcacgtgttcatatttttttattttttcaaatttga

SEQ ID NO: 7720 - DNA, 243 bp, Candida albicans
tttcacaacacctggctgttagaacatgtagtgtttctttggatgaccttgacttatcccaatacggcttatcttatgaaaaaaaatcaaaatatggggggaaggagtgaaagggctcattactggctttttcaaatcaaagatctagatctacttgttcttattgccccaatacaccgtgaaataggttttatggttggtgatgaagaaatctcggaaataatattattcccgctaccataa

SEQ ID NO: 7721 - DNA, 228 bp, Candida albicans
aaaatgataaaaaaaataaacagaaaacgtaaagctacacattgtaatgtgttttattccaagataaggagtattattaaacgctgtttgtgtatggggctagaacaatccaattcttatcaaagaggagaggctcctttaacacttcagccacacggaaagcttaagtggctggttttgatagaggggttctatttatcaatcaaacaaaaaaaaaatagccactga

SEQ ID NO: 7722 - DNA, 213 bp, Candida albicans
attgcacaacacgtaacttcggccaacagtatttcgaccattttctgtagagcactaaaaaaaatgcatgcgaaatttgaacacgacaaaaaaaaaccacagcaactgatacccaccaaccaatgctggaagaagatacgtcatcagatagagtacccccaccaaatccaaatgcatttgtttgtggtgttaggtctaggaagacattgctaa

SEQ ID NO: 7723 - DNA, 690 bp, Candida albicans
catttcgttgaattttcatattttccttccaactcaatttccctttgcattatgtcaaacactgttgttcttaacttagattatacttttgtcattgatccaaaatataataataatgaaatcattacttgttatgaaactcataatggtatttggagacagtacactagtaaatccttatcctcctccttctcatcctcctcatctaatactggttataagatgattgataatttatatcctttacaacaacttgctcaaactattaatgataatgcccagggtagtaacaacagagttaaagttttagatccatcaattaagaatccattaattatggtatctattcaaggtgatgaaacatttattaatgatgctagacatcaaattttaattaattataatcgtgttggttataaaactttaacattaaatgaaattgaatttatgaatattaatgaaacattcactgatgaaatgatgaaattatgtcaacgttatgaagttgaaattattattaataatgatattaattcttttggtggtggtgatggtggtaaacagaaaagtgctactactagaaaacttgaagaggaacaaatttattcaattcatattgttggtaaattagataatattacattttgtgcagcttgtcttccaccacgggagctggcctatcacgagcaa

SEQ ID NO: 7724 - DNA, 213 bp, Candida albicans
gaggtcgtggcagtagtagtcgtgggctgtgggtcgacacaattgttgagtttcatgaataaatacgagaaagtaactgctcgtttaggaaaggaaccaaacaagacgaaaggtaagaaggggaggagaagaacgaaggctctggacgcgagaatagaccacaaaaaaaaagataaccaaagtggggtgtgttgttgttgttgttgtgtgtga

SEQ ID NO: 7725 - DNA, 237 bp, Candida albicans
gtctatttttctacagtacaatttatttttaatttgcagtacccattatattactcgaacctactcactatagctgcaacttcaaaaaacatagtctatgattctctaatagaaaagaaaagaaaatcactcaatagtgaaacttgttttgcaatgtatgtatgtatagttcacaattataattgctcaggagtaatttgtctgtttcttcaccgacccggggctggaaggtcaaac

SEQ ID NO: 7726 - DNA, 201 bp, Candida albicans
ttcgaatcatattatatgatatttgatttcttcaaacccaagcccaatcattataccatgggatttatcaatgaattgataaaagcactaaaattattcccacaaactagcaagcaacttcttgacaagttcattacaacatacttttttttgcaaattccgggatatatggtaccgactgagagctggatcacatattaa

SEQ ID NO: 7727 - DNA, 306 bp, Candida albicans
tattccattctatccattctaaatcgctcaaacagactttgtgtacacaaaaatgaaatgtataccaagaaagaacaattgaaaaataaaataaaatttgaaaatagaaacaataagagaagaattttaatacatatcaaacaagaaggacaatacagttctcaagtaattgatacatatatacatggaacaatagtattgggaataaaagtttccacaaaacaacaaatatcaataattcattttgcgtgggccgagttttccaaatcatcattgtttttttatgtaacttttcttggaatttaa

SEQ ID NO: 7728 - DNA, 198 bp, Candida albicans
tgggcgggaagggaggagaggtggtgggacaataagataattttttttttgaagttagacgggacggggggcataaatttgaaagcacgatttaacaaagaaatttcatctacttacttgaaacaattagcccaaagaatgaagagctgtggcttgaatgtcaatcgttgtctatgtaaagatacatgtattttttag

SEQ ID NO: 7729 - DNA, 789 bp, Candida albicans
acgtggatcttccagccggtggcgaatacgtcaagtttcagtgagaatttttttaataattctgttcctatttttgattcattaagattaaaaattattcatgatttattaattgatcataatttaacattatcaaatatcaatggattatttgaaaaatttgaatttgtcaaccaaaagacttctaccatagataccacgtccaataatactacaacaaaagatcttgttaatgacttgaataattcatttctgtcaaaactgcatttagatgaattaattaataaattatcaaatttaacgattaatttaaaatattttcaaaaatataataattcaattaaaaatttccataatattgatgaacatcaagataaattattaatttttaatcaatttaaacaagatttaaataatattaaatcattatataaatcatctttaattgatttaaatcatgagattgataataatcctcaaaattttatcctaccaggaccaggatcaccaacaaataccaccactacaactacaacaacgacaatttcaagtccaacaaatagtaatgggaatcgatttagtttaaaagaattttctataaagaaacgatcatcaataactacacccacaccaccattaacaacaacacatagtagtaatggtaatggtaatggcaatgttaatgttaatgttaattcaaaaagattttctggagcatttacggtgattcaaccaaatagattttctctgattactaatatttccgaaattgaagattttaatatataa

SEQ ID NO: 7730 - DNA, 276 bp, Candida albicans
acgcggacttccacccgtggtgaacactcattgacagaagttatgattcatgaatcactcaagttagaacaagcaaagttacaggaaactgaaaggaaaacgcttgtagaaatccaacaggaacaagaatttgcaaaatggtgggaggaagagtccaagagagtacaagaagaaatgcaacgtttagaagtagctgatactaaaaagaagaaaaagaagaaaaatacatcgccaaaaccgcaaaaatatagaaaaccaataaagtctgattcatga

SEQ ID NO: 7731 - DNA, 180 bp, Candida albicans
aaatttattatcgtgtcttcatcaccagtaaacgctagcccactgggccaacaccaacaaataatagaacagcaagtcgaaaaagagccatcttatagaatagagaatcccgaattaaccaaagctattatcaatcaattatcgatattattaacaactgctgatcacgagtcttcacca

SEQ ID NO: 7732 - DNA, 207 bp, Candida albicans
gtttcgagtggccaaaaaaaaagaaatggaaaatcaaagaagaagaaaaaattttactgtgaagtgaaaggagtagtgtatatgttaacaattaaatacctacacatgaatagatgtgtatatgcaacacaaagctcattagcaactagtagtctaatagtttccactttgcaatgtagattgatgaaatatagaaagagaaagtga

SEQ ID NO: 7733 - DNA, 1155 bp, Candida albicans
ctttcggggcggctgttgagcgactatgcctcctgcccgactggtgaagacgaggaacaaggctgggatgaagaagatttgatgaagaagactttgatgaagatatttactatgacagcgaagagcaaccacttgaatactacgaaggaagatttcagtgatggcactgatgataccatacaagatttgccaattgatttctataatgaagatggtgctgatgctgatgatgttgagattgcttatgttgactctgacggtaatgaatttatcattgataatgaagatttggaagaagctattttagatgaagctattttagaagaattagaagctaatggaagagttcatgatttaaacaatgaaattgttgaatattatgatgaaaatgatggattaagttcgagtgattctgaaagtagcagtgaaagtgatttggaaattgattcattgaatgactccagtgattctagtgactctagtgatgacagcgactccagtgaatctgactctagtgacgacggcgactccagcgactcgagtgacgatagtggtgttgaatcgttagattccgatgtggaacaagaaattaaagacgacttattattagaactcatcaaaagagaatttgaagaagaattggttagttccgatgaacttacttctgaagatgaaagttccgacttaggttctgaaccagaatattttgaagttgacaccgaagatgaagaaaattctgaagatgaaggaatcactatatataaaagtctagtattaccagaagatatcgatgacgaagatgttgtattttacgatgatcttggagaagaatcagacaatgaaactactgataatacaaaattgcttgcaaatgatagtgatgatgaatttcaagtagttgatttgactgaagatttagaaaatagtctggactataaattggaagagattgatgctaacacttacaagttgaatgttagatttccttcattagttaaagatgagttgaagattgatttcttgaaaaatgaaaacgaattggtcattagagggaaattgaatttgaacgacgcagatattgatgaagaagttgatgaagtgaccgcaaatgtcttcaccacagggaccgccgatccgcgagatgggggggcggcg

SEQ ID NO: 7734 - DNA, 330 bp, Candida albicans
gtctgcagaagtacctcagcggcggctgtagatgagaattttgtgggaacatatcactttgaattaccgtttcaattgccagattccagcaggtttttattcaagtaccatcctattttcatttgtcctgtttcgagagagcagttgatacctatcacagagaatggttacacaacacaggctgtagtgttaaactattgtcaacatttggttttgagagatagcatttggcatttatcgaaaaagggaatagatatcttcaagtgtcattactgttataagaaacataagtatagtgatgtcacagatgcatattttatcgacttataa

SEQ ID NO: 7735 - DNA, 357 bp, Candida albicans
cacgaacttcttgatcaaagaagaagaagaagaagaaattttttttctgtcatcacgtgcacgacctttaaatcaattgacaattcaaaaattttgaacaacaacacaacacaactcattctctttctctctctctctctctctgtgaaaaaaaaaaagaaagaaaaggacaataaagaaatcaaacaatcaattaaacaattaaacaaagttaaaacaggaacttttactattcaagttcaaattgaaagagaaagagaaatagaaagaaaaaaaaaaaatttagttcaaattggaatcttgtcttatttaatttcaattctatatatcttgtcctcatatactaacaacatttag

SEQ ID NO: 7736 - DNA, 228 bp, Candida albicans
actcaaagagataatagtttgaagacagttcaacaaaatactgctgttggtgctgataaacttaagcctttggatgtttatgatggaatgtataaggaacaagtacaaccacaaagacttgtttcagaaaaattcaaacgtgaagctgaaaagaatatcaaattatataataaagttgttcaatctagactggatagaaaactgcttgaaaattacttgggattataa

SEQ ID NO: 7737 - DNA, 207 bp, Candida albicans
tttaacaaactttttccaaactcaaaccaaatgaaattttgctttgccgagggttgttgtttttttttttttttatataattttaataattatcattcattcattggttatttgtatatttgcttaaatttttttcatactactactactactacctctactcctactacttctttttctttatacaacaatgccttcatcaactaa

SEQ ID NO: 7738 - DNA, 183 bp, Candida albicans
  unsure (122): Identity of nucleotide sequences at the above locations are unknown.
atagcaaacaaacaaagaatagaaagaaaagggtatacactattattattaggtaacttgaattttagtattgttaacaaaggtgctttacagtgtccattacggaatggacgtccgcgtcngaagtgtacaggtagagaaggaggtgttgaagtggtaagagaggtgtatgtgagagtatag

SEQ ID NO: 7739 - DNA, 297 bp, Candida albicans
caataccctattcttgaactcatgttgaatacgtttgccaaaattaaaccagatattcttaaattcaaaacatcaataagcaagtacagaaatattaacaccaagatggtaattaatgtcataaattttgaaaagttcttcaagtctgaattagttgccatgctcgaaaataaagcttccaaaattccattaaaggcaagaaacggaagatacacaacatatcgcgggaaaagcttaaatatgtctgtactttcccagtttgaagctctcccgcccattaaaagttttagcaaataa

SEQ ID NO: 7740 - DNA, 276 bp, Candida albicans
ctgtatttaacaagaaaactgaaaactataacccaatcacaagtgggaaattataatataaaaagaactttccaatctcggtgttacaagcgatttgccaccaatatttatgtaagattgacaagtcaagacacatacagaggagttaagaactggagattaaattccaatcaaacaatcagtaatataataaaactgaaaaaaaaagctgtattacatataacatacatacatgacatttataataaaaacatacatattttaccaaagacatga

SEQ ID NO: 7741 - DNA, 390 bp, Candida albicans
caattctcaagggaaatacgcagaccatgtccgatgcaagatactagagaagaagaagaaggacaagaaaaacatgggcttagttttcatcagacacaaaataattctgtacaaataatagattcatggcttagaaatgacataaagaagaaggataaaaaaaaaagaaaaaaaaaaaaaccagatatacaatcttgcttgagaatgttaacaaatgatcagaaattgaatctcgaattaattcgactaggtgctgtcattccttcattcctatgcaatcaaagtgagatcatcatgtctttggtaaaatatgtatgtttttattataaatgtcatgtatgtatgttatatgtaatacagctttttttttcagttttattatattactga

SEQ ID NO: 7742 - DNA, 1488 bp, Candida albicans
  unsure (72): Identity of nucleotide sequences at the above locations are unknown.
gattcaaatcaactaacaatcaattatttatcagaattggtttatcgcaaaataagtcaattggttgaattntcaattgtcttctgcgaagtgtggcaagactttttgatattgatagttgaagacaccgacaaacaagtcaagattaaaatttatcggatagttttctcggaagtgtcaccaactctagaaggagacacggataccgacatttttaagtattttgagctcacctgtgaacaagtattggatttccaaccatccatgcttaaagcttgtacagttaaagatgaagaattaacaatcgccataggtggatttgacggtaacttgcattttatattatttaaagacggagaattaaccattttgaagacacatgatttaatccaattttccaactatagtcatgatgaaattactgaactcagcttcatcattccacacgacatgattgtcactgagagtgaaatcatcattggcacacaagaaggttattatcttaaatttgatattgtaaacggtgtcaaaaataatttacaatgcaaacaatttctcagaattggttccactagtgtcagattatgtcctacttcggatgtaaaactactacttgtttacagtgaccagttatggttactcaacaaatacgaatcagaatatccaaaacgagtatatttcgacgataattttgaacgttcaatactacaatcagtggagattaaaaatacaaagaataacagcaaatggaagagtttagcattgataagagacaatggattagtgttagttgatgtgtcatcgttttgtcaacctagtatcagacaattatccatgccagataatgccaaaaaacttatttatataccacatgtttctacttttttggttttatatcattccaattatgccaatagtcgaatcaagtgtgttgataaaaagtcaatcaaagttgtaccacacagagaaacaaatattaaatatcgtttgacaagtaatatgaatggaggtgataatgaaacatacatattccaagatgatgaaatacctatttcagtgtgtatttgggaagtgcaaagaaatggatctaaaaaatcaatgaccaccaaaaaaatcttgattggatgtgaaaagagatcattcgataatagttgtaaaacaactggggtggtgaaagtattggatttgaaaaagattcgaagtaatagtgaacacaataataataatagtcctgatgacaatttccctggggttttaataactgaattgacttcacttgatcatgattcgcctgttacaaacattttacaatgcaatcaaaacatcatatttacaagtgagggaaacttatatcctacaagttattacgaattggagaaacgatttactccagtaaaatcatgtcaaactttacctagtcggattatctctctttatgtgtcgccatcgtcaccacaagagaaattcatgagcgtttaccagccatga

SEQ ID NO: 7743 - DNA, 282 bp, Candida albicans
agattagaccttaccactcttattcctatcattgttgcagcaattacttctgctttacctggtgttctcaacactattctgggacttttgggagatttgccttcaccaattgatcctactgaaatactcaatgtatcatcttctaccaacaccaccagcaatttagatttagttaatgaaattgtcaaccaagtgaaagttaaacttccacaagctatttccgagtttgaacaaaactcgcaaaactccaaaaggataggccttgattctattgctcaatag

SEQ ID NO: 7744 - DNA, 198 bp, Candida albicans
aaatatttagaaagagcaagatgggcctcttggattcatctactctacactaaagtatctgaagcttttcatcaaccgaaaatatactattctgaagaaagttgtattgtaagtatagaatcatcatctcctactttttttttctccttgatttcgcaaatttttttagcagaagctttgattcttcagcaaaagtaa

SEQ ID NO: 7745 - DNA, 210 bp, Candida albicans
agagagaggaagaaagaaaagagaagaggagtggaagaaaaagaaaggaaagaagaggaaaaagagaagggagagagggggaaaaggaggaaaaaagaggaggataaagaaaaagagaaaatggagaaaaaagagagaaaaaggataaagagaagaaagatagaaaaaagggaaaaaaaaagagaaagaaaagggagaaagaaggggtag

SEQ ID NO: 7746 - DNA, 261 bp, Candida albicans
agaaaaagagaaaatggagaaaaaagagagaaaaaggataaagagaagaaagatagaaaaaagggaaaaaaaaagagaaagaaaagggagaaagaaggggtaggtagaaaaaaaaagacaaagagcgtcacaccaccgagacaacccattcaacttttacttctactatggatgataaaaatgtataatcatgtgcatcatatggagcatagacatcatcatcaaatcctgaagacatggaatcaccaactccgggtgtaa

SEQ ID NO: 7747 - DNA, 186 bp, Candida albicans
cattgttcccatccattaattgtttttttgccttgtgaaagtaagtggtatacaataaaccccaataagataaagagaagagaagataaccaagaaagaagtgtgagaaggttgttgaaaattgaaaacccacaccaaaaaaaaaatatacaactgaataccaactccatcaacaaatacaattag

SEQ ID NO: 7748 - DNA, 303 bp, Candida albicans
gtgtgctggcaccgggaagatatacgtccatcaacgtcgaatggcgatcaatcaaatagagataccaatacaccaactacctctacttcagcatccactactgcaccaccaccaccaccaccaccaccacaacaacaacaacaacaacaaccatcatcctccattacaacaaccgacaataacaacaataatcaaacatctcaacaatcacaagaaaagaaggaaaaaatcattccaagagatgttagacttctccatttaatatatgctacacatgctgtgcataattatcaagatcatgta

SEQ ID NO: 7749 - DNA, 189 bp, Candida albicans
ataacaactatatggtcgattgttcggttgcagaaaattcttatatctcatttaaataagccaccatttctttcttctttcttgtccccaccactaagaaaagcttcgatcatttataacgataccagcaattctgaatacgtgcaaaaaaaagaagtagcctccttaattccgtttttggctttttag

SEQ ID NO: 7750 - DNA, 195 bp, Candida albicans
ccagtatacatgatggtgtttgtactctatttcaattgtttacaacggttaaacttgctagaaattcaaagaatgattaattattcttttgttcttactttattttttttattctattctattatgttcttttcttttttgatttttttttttttattcattcaatcaagggcatacatatgccccaaagcataa

SEQ ID NO: 7751 - DNA, 228 bp, Candida albicans
gctttggcatttcttcaacttcaaaagttgtttttatttttttatttgtttaatattctttttatttcttccttgtcaattaattcagggttgttcgttaacttcttgggactgcttttgtattcggattttcaagttttagaaatttttgttgataacctaaaagatattttcaaaggcccgtgtccctttcctcccaatcaccactttactccatttttgatttaa

SEQ ID NO: 7752 - DNA, 564 bp, Candida albicans
tctgatggtccctcattggtgacttctgttgaatcaaatactgaacttatttcatctgccactcaatccagtgatatacaaactgagttcacttccacttggactactaccaattctgatggttctgttgttactgaatcaggtatcataagccaatcaggtacttcattaaccaccttgacaaccttccagccagccacttcattagttgttccaccatatagtgtcattgaaactgagtttacatcaacttggaccaccacaaactcatacagctccgtggctactgaatctggtgtggttagtcaatcagacactttattaacaaccgtgactactttccctcctgcaccatctgctattgtacctgaattcacatcaccttggaaaatcaacacttcaattgagtctactgaaacattaactgttagtgccagctcctatgagacattgggtgaatcattggctgctgctacctcatcatacttgtcttctgctactgttgttgttgctccctcagaatctgaaatcaatactatcagctcaatattgaataatgaatag

SEQ ID NO: 7753 - DNA, 438 bp, Candida albicans
cagttttgttacctatgtctcaagcgtttcctggtgcactattactgtgggagatccgagaaaaatatttccactgttggtaataatgtcagtagtatcgtgggtgacgatgtttccaacacacaagccatcacaatggcaacttccacagaaggtgctactaccctcacgagtgtttcaggtgctaaaccatcagttgctaacgatgccactaacagtgtacacaccactgattatactactgccactgctggtgttcaaaatggttccagtttgtcaattccatcagacgtccccattgaaatttctgtcatcacaccgactaattcttcttcttcggcaattaccattccatatgaaaacggatccaataaagaactgattgaaaatatcaaatacttggcattggtagttttcggattgatgatgtttatgtga

SEQ ID NO: 7754 - DNA, 258 bp, Candida albicans
ttaatctatagtgctatacaacaacaacaaacaaaaataacaaacaaaaaatttgtggaagtgattatatatattgatcacataaacatcatcaatccgaaaactaccaatgccaagtatttgatattttcaatcagttctttattggatccgttttcatatggaatggtaattgccgaagaagaagaattagtcggtgtgatgacagaaatttcaatggggacgtctgatggaattgacaaactggaaccattttga

SEQ ID NO: 7755 - DNA, 414 bp, Candida albicans
aatttttgcaacaaacttattcatcttttagtaaccctcaaacattcaaacataatagccagaaataagaatatcattccccactcaccttcacggtcgttatcttataatttgaatactcatcctccattatcgacaacaaccaaatgctatgataagaattattatttaacattgaagaactcacaatcaatgtatattcataatattgtattccttagaaatgatcattatttttctttttcccttggttgtggtttatttgttagtgtgtatgaccctttgaaagtattacaatcttgtggaaaacagtattatgttagatatcatcataagaataatttgtcccaaattgttgaattttggatagctaaaccatttgttgatacattagaagaaagattggagaaggca

SEQ ID NO: 7756 - DNA, 330 bp, Candida albicans
tatactgccaatataatcattgttggtaaaaccccttgtaatactgccccaagtacattaaatacatcaccagctaaccataatacaataaatgttaatgataaaccttccagtgattttcttttaaaattttcatatatttggggtgcaaaaactataatccaacaagcaatagatatggaaccagttattccactgacggattgggagtctagtactattggtgctggaggtggtgctatcattgtaaaggctatgagtaaaatgatctataagaaaagaaaagaaaatggaaaaaaaaatgaaagaaagaagatagaaatgaaataa

SEQ ID NO: 7757 - DNA, 1251 bp, Candida albicans
agaccacctgccattatgcagtcttccccagatcccctagtagtcaccagtggagcaaccgcattatctgagtcattatcgatgaatagaaaacacaatgataatttatctgatacggggaaaacctgtcgattttgtaagaaacaatttagtcaacgaggatctttaattcgacatcttgatttgaaaaaaggtgatttattacatccaagtaatgaagtgacaattattagaaaccaaaatcgacgaagaaatagtagtgttgatgtcaattttagttctattgaaaaatctgaatctcaatccggtggtaatacccctttaatgactagtgaatcattcaatggtacaaataccaattctaaactgggtaaaaagagaagagtacttaaaaaatcattggcgatatcacaaatatcatgtgattcagcaagtggacaacgagagaaaagtaaattaagaagaaaattacgtgatcgaagaattaaggcaaagttattgacaaatgattggttccaagatttatttgcgcaaaagccattaccaaaatttgataacttggatggtaatggcaacaataatagtctgataacagctgaaatattttgtcaattggttgctttatacctacccatcaatgattggcccgtgaaaataccagatgaaacttgtcttaccccaacaattgaaagaatgagggttagagaaacccataatttgatcaatttgttaaacaagagttttttggtgtatcaaaaattgacaaccgtgcaaaagaaacaactatggattaatgaatcgcagagaatattacaggcaagcatcggaagcttttcactttgtgatttacataatattaaaggggttattgccaaaagagagcaagccaattttgaagaaatttgtcgtaatgataaattatctgcatttgttgaagtggaaaatagtccgaatcatcatggaggggttctgggagtagatgatgaacgagaagcagatatagaggaagaagtagatgaggatgacgacgatgaagtaaatagcactcaagtcgagaaagtgaaactgataacaccacaaaaacggaaaacgcaatcgattctgggtcaagtacaattaaacactcaacagaatcctgctaatcttcacaattcgtcgcgcattcatggtgaaccatacattcaaaagattccagaagttcaacataataattttgaagattttggaacatattttgataaattctattag

SEQ ID NO: 7758 - DNA, 189 bp, Candida albicans
gtttatgtggattttaacggcccgatgaaaccaaaaaaattcattccagggtgttttggccccacccaattaatttatttagttttgtttgccatatttttccaaattgtaaacaattacaccaaacagtttttccaacaattgaaccaagttaacaggtcacttcgagggaaattattgggcaagtaa

SEQ ID NO: 7759 - DNA, 1158 bp, Candida albicans
  unsure (1126),(1139),(1145): Identity of nucleotide sequences at the above locations are unknown.
agacaagagattgaagaatcgatatcatcacaaaaattgctacaattgaaccaatcatcactactaaccacatttatttctatccattcaaacattcacaacaaacttttatatatcagtgagattatacccaatgatatgaatcctcaatttgaaatcaatttaccatatgtaccaccaaacatttataaatgtgttatcaaactttggtgtcaaactaatagtgattggaaattattatgtctttacaagttaaacttgcggaaaatgatttcagttgataatgatttggaaattttagatttatataaaaccaatacgttaagtttacaacttaatgaccaatggtttactttccaagatatgttgaataaaagtatagttgacaaaaaccccaatgttttacctcaaccaatacagtcatacacatttgattcgattcgttgtttgaataatttatccaattcattacaagaattagctatatcgaaacataatttaatgcaacaaataaaactctacattggaaatttacaagactataagaacataaataatataaatgtggttttgaataaactacaatttcaagttcataaactaaaacatgatgtgaataaattaactttacaaaatgaacaattgaataataaaatttacaatatcaaacagaaaatcaatgatttgcataatataattgaaagtttcaataccaataccaaagagattatagaaaacaaattagaattatatgataccgaaatacaaaatatgcaagtattacaattatcattacaacaacaattgaataaatatttaaagacaaatatgaaatcaattgagtttgtattccccattgacaatatagattcgacaaaattttccattttaggatttcaattccctcaagatcatcaagaattattagcaatttgttattataataaatcgtcgattgaattgaaaaacctgtattatcaaccagaatttgatagtgaaacacaatggcataattttaaaattcaacaaataaatgctgcattatcaattattgttcaattgatggtactaattgccgacatcactaatacagattacaagtataaaatggttttatcagagaatnagacaccgacggngctggntaatccaacgctc

SEQ ID NO: 7760 - DNA, 738 bp, Candida albicans
attaacatatatatacatatattcatggcaatgtcagaattattaaagagataccaacagtcacgaaaagaggctacagatacaagtaaaagtagattaccctcgattaaaactgacccaatatacccttcatattccaatttagatggaatcagaaatcaatcacgataccaatcacgaacttatggcggtataagcaaaccaacaaaaaaaacttctttattaaacacttctccaatatataagaaatacgaatcattaaatttaccatcatcgtctcaaatttataaaagagaaattgagaaaaaacctagattcaccattaatgataaaaacgaagaaagtatattttccaaaatcaccaaatatttccaacacggagaagaaaatgaagaaaaacctgaaagagtggatattgctgataaatatctaaatgatgatagagatgaagttgatgaattgattttacgagttaaagaactggaaaaaaaatatgaaagagaacgattaaaaaaattggaagaggataataaacggattcaaaatgaattagatgatattaaattggaaaataggaaattgaaagatcaaattgaaagaatggaaattagaaatagaaaagaattgaatcaattggataaaaaattgtttgaattggaaaataaactaattatggaaactcaaacaaccagaagatcaaataattatagacggagcacttattcaaaagacgattaa

SEQ ID NO: 7761 - DNA, 192 bp, Candida albicans
gggaaggctgtcatcgcttttgacaggagaatttcatatgaaatacaaatactgttcgaattagggtatgtaacatggctaattatgaacagcccgcattgcataatggtagataatgttactgaggagaataatacactaatctatttccttgttaggaagtatgtggacttatcagttcgtccactgtag

SEQ ID NO: 7762 - DNA, 357 bp, Candida albicans
ctgctttataactgcatagaattaattagatgtttgaaaaaaaataccgttaaacccacaacaacattttctgattctgttctataccacttaaaaaaatcaaatcttcatggctattcagcacctcgttgtgcgctcaatgcctgggagaacaatattaataataatgtgaaactaagacatcaccatagaacatataaatcaaaattaaagtgcacacctatacgaagaaaaagtcattttaacctgttaatagcaaagcagccaactcaggtgacaccttggtatttttctcttttcttcttctattggatatcctatcaatatgttagtagggttacaaagaatgaaaattaa

SEQ ID NO: 7763 - DNA, 312 bp, Candida albicans
tctccaacctttgaattagatttctatttgatattcatacatatactcaaactaacacacatattcatcatggcaggtacattattcccagataagcaatttgaaaaattcaatgttgctagagaaaagatgggtcattattttagattcaaacctcgttcagtattcttcaatataatatggatgggtataataccagtaggattattttatgttgcctatggaaatgaaggtaaagttagtattactgatagatttagaaaaaaaccaattttggctaaagattatgttccaagaagtaaacaagaataa

SEQ ID NO: 7764 - DNA, 213 bp, Candida albicans
gagctgataacaaaaaataaagctgaaaaaattgacaatctgtttgtatcaatggctgggaatagtgtgttgattatgccagcacagttagtaaaacaccagaatactgttgacatgagtgagcgttttggtttaaacgatacaagacaagaaaaaagtagtagaactaagactgggtgttgggatcttccaggaaaaaaaagacagtattga

SEQ ID NO: 7765 - DNA, 210 bp, Candida albicans
atgtcgcgcgatcggaccaccatcaaattatcaccagcaacaccccctcaatctattatcacctgtgcattctttcgaaaattagctcatgtttgtgtaataaagaatcttacgctaattttacaaattaaccaactcaagacaagattatactttttagtaaaagctcaacaaaaaaaaataaacaaaaaagctaatataataatataa

SEQ ID NO: 7766 - DNA, 195 bp, Candida albicans
atcgctctttgcaacactgatttgacttttgttaaatcagagattgtagatcatcttctaccatgtataaaccccattgattacctctatcaaagtgataataagacttttagttcaattccggatacattcaatttccatgatgacaacgcctggaaaattcaaaaattgttgaaaaataataataaaagctaa

SEQ ID NO: 7767 - DNA, 237 bp, Candida albicans
tcatctgactgtaactccggttctctccattatcagcttgtaatatcgatagcatacaaaaaacctggcactattcggtatagcaatatatacagattaaaattctttaatatggtgcaagcatacaatatgtatgcaagttttaataataataatttagcttttattattatttttcaacaatttttgaattttccaggcgttgtcatcatggaaattgaatgtatccggaattga

SEQ ID NO: 7768 - DNA, 189 bp, Candida albicans
gtgggtagatatatagatttgcatagtatatctacaatagatagaatgatatatagaagaagaaaagcaaaagaagaaaaaagaaggatttgggttgtaaacttttttggggaatctatagatttggaattactattgatagagaaagagaaagggggggggggtgtgcaaaaaagaataaaaaagtaa

SEQ ID NO: 7769 - DNA, 222 bp, Candida albicans
tctaacattaactttgttatttcattaattaaaaaaagtgtaatcataatttcagttgcaaaaaaaaacaaaatgaaagatgaatataggcaagacgacgatgacgatgacggaaacgcaaatctatcaaaacattatacaatagcaatatcatttccaaaattggttaaatgtttcataatcagttccttttgtgtgtacgatatcgaacaaaagaattag

SEQ ID NO: 7770 - DNA, 192 bp, Candida albicans
tgttgtttttcaaacactgtaaaaacaatatttttttcaaaaaagaaacaaaaaaaactagaacagagaattaattggtttacaaaaaaattttcaataccgcagatatctaaagaaaaaatgggacattttacacgaattaaattttcaattcataatagaacaaatatgatatggttgtggggattgtaa

SEQ ID NO: 7771 - DNA, 303 bp, Candida albicans
ttaggatccaattcatcactcgaaccaatatcatcaacaaatgtatcaccactatcaactatgaaagaaattaataaatttataattaatcaagatcttgagaatattttacgagggatttatgttcgtaatgaagatatatatttgaataatattaatcaaacaacaatactttgtcaaccgattattatgtgtaatgataattcaattcatatgttatttttagaaaaattttataatgataatcaaggtaatgttagatatcaaaatttaattaaagttgaatcaatacttttacaataa

SEQ ID NO: 7772 - DNA, 252 bp, Candida albicans
ttcgtcaataaaaacacaaatcttgatttgtcgtcgtcgttgtcgtcgtcgtcgtcgtcgatgaaaagaaatgatttaattgaacaatttttaagaattgttttgacacgattatatcctcgatattttggtcatattctccctattattggcggtggtggtggttttggtggtttaggtggtgtcgatacaattgttaatgcaaatcatattggaattagtaataaagataatgtggaagacatgacgagt

SEQ ID NO: 7773 - DNA, 198 bp, Candida albicans
agagagctagccttgattgtggttacaataaaatataagcagaatggatattgtgaactggagaagatgtttctaaaactagctttagaaggcccaatcaatacaaattttacagaatacggccacttgttcaaatttgtgatattattgcaaatgagtacttccggttctattgagggccataaaattctttgttag

SEQ ID NO: 7774 - DNA, 210 bp, Candida albicans
tggagattatttaataattggagctatatgatcatctgcgttagaattgagttaattaaaaatacgtatttcaacacatttgttacaacttcaaatagtgttcagtcaccaagaagcttacaggttgtaccgtatacggtattgaaaagtcgaggtttgagtttttatttcatctctatcttctttgctaagggatgtaataaagattga

SEQ ID NO: 7775 - DNA, 201 bp, Candida albicans
aatgaacatcgcacaaagctcttgatgttaaaattctattcacatacacccataattagtctaatattgtgcttattgattttcttgtttttgccaatggatccaaagtcttgggtgtttttagttgaaaacaaacaaaagaaggttttgcttggtattctaaaggatacaagatcagagtatattcaaagactattataa

SEQ ID NO: 7776 - DNA, 276 bp, Candida albicans
gatcaaactttttttattttttctttctttctctttttggacgacaacagtgagaaatctttctacccacattcaatcatatctctcaaagagccacatcatacacatatatactatttattactattattcttgcttattgaaagtataaaacagcattcaatattttttcctatttacaagaatctagctaaatcaaaatacctactaaattgctatcatggacgcactgaaaaagagatcatcaaccagccctggcagatccatctcccccac

SEQ ID NO: 7777 - DNA, 186 bp, Candida albicans
cacatacaccaatacattataataaaagaagatccactacaacacaacacaataagtaaaggaagcaaaagcaagagagagccaaagagagaaaaagtaaaaaatcaaaacattcaaaacattcaaaaattgagatcaaactttttttattttttctttctttctctttttggacgacaacagtga

SEQ ID NO: 7778 - DNA, 195 bp, Candida albicans
  unsure (24),(48): Identity of nucleotide sequences at the above locations are unknown.
gacatagggttttttatatgggantgggggaagttacaaaagagcatntgggttgttcaatttcatcaaattagaggattatcaaatatatctaatgaagagaacttcgaaaaggaggaaaggaaaccacaaccacaacaacaacgacaaccaaaagcaaagacaacttcaagaacattattgaattcgacttaa

SEQ ID NO: 7779 - DNA, 252 bp, Candida albicans
attaataatgtgttgatttcactgataccactgccacaactactgaaacagggatatcgactgtcactgacagttgtaacagagtatcatcaacaacacactgtaaatgatactttaattgatgattctattgataataatgatatatcgaattctaattcaagaaatttccctccttcttcacctacaaaacaagctatggttcaacataaagcacaaacgcgtgatcacaacattaatacccataaatag

SEQ ID NO: 7780 - DNA, 1176 bp, Candida albicans
caaccaattgatccactacaacaacaacaacaacaacaacaactgaatgataaaatagtagtaccaccagtcccatcgtcgtcaccattaccaccatcgtcaccaataggcaataaaaaacgacctcatgatcaaaagcatagtccaaatacttggaaattccatggtggtaatatcccaaaacgaagaaaattgacacgagctgcattagcaactacaggaaatattcatacgaatagtggcaataactttaatgatcaattaacttcatcaaaatcatcaatgaatctgccattgaaaaaatacaacaatatcgacaccaccacaatcaccaccaacaacaacaacaataacggtgtcaaacaaagtaaaggagtaaatcaattaccattaccaaaaaataattatcaattgaatccttccaaatcaacccctattattattactactactactactactcataatcatcataatttaagtgaagatattgatcattatggtcattctcgattgaaaaatcttagaaaaccatcaattccatcaatggcaactccattgatcccatcgtcgtcatccggatcgggatctgggtcaggaataacaactcatcaagtatcaaaaccccaacaacagaaacaaattaacgaaattcaagatcaagctaatgatcatgataccagtgttgatattgttcctgaaactattgataataataataataataataatgatgatgattttataaatgatgaatttgattatgatccaattgattcagtagaaccagaaataaattcgtcaaaagaagaggaagtcaaagaacaagatgtcgataatgaagttgtaaagaaaaaagtattgtcaaaaaaggttgttgattctgatgcagaaaataacgatgatgatcatgatgatactactgtaatcatacaagctaatgaagatttgaaatctaagaaacatcgacaagtaaaaaaaacacctagaaagaaggaagtattgatgattctatcaccaagagataaacggatgcaacaacgacaacaacggcaagaacaacagaaacaaaaactacaacagaaacagaaactacttcaggaaagtgtatcaccacaaattcagtctgttgatgatcaacttttggaagagccaagcgaacttagggtgaacaga

SEQ ID NO: 7781 - DNA, 372 bp, Candida albicans
ccccgtaagagagaatccgatatcacttctgaaaataatataaaaaggcgtctgtttgatgcagacaacaaaaataaaagagaaggggcccacgttttctatatgacacaaagttaccaatgtgacacaaaatgccattattgtcttaggcacactactcttttaagccgaatgaaagtggcgggattaaagaaggacattcatttaacaggaaaagccggctcaatcgagataagcattgtaagtatccttattgttgtatttgatctgttgatttattcaacatttggtataataaaatgttccaacttagcttttagatttatttctcttttgacgagcctgatgatagtttttatggaaactaattaa

SEQ ID NO: 7782 - DNA, 486 bp, Candida albicans
agaaaagtcacaagttcaagtgaagttagttcatcaagtgaagttagttcatcaagtgaagttagttcatcaagtgaagttagttcatcaagccaagttacaagctcaagtgaagttgttagtagctcaagtgaagtcaacagttcatcaagtgaggttgtcagctcatcaagtgaggttgtcagttcatctagcgcttctagtgaagttgttagctcttcaaccgaatgtattagttcatcaagtgaagctatcagttcttcaagccaagttaccagctcttcaactgaatgcatcagctcatcaagcgaagttatatcatctagtgaagttaccagttgttccagtgaagtggtatcgtctagcgaaacttgcatctcaagtaaagaaatgtcttccagtgaacaaatatcatcaagtgaatctactagttcatgtagtgaatttgttagcaaaagttcagaacattcatcattatcaagtgag

SEQ ID NO: 7783 - DNA, 213 bp, Candida albicans
tcttataatagtgctggaaaatcttctggtttgataatgaaacagcctgaaaacttacggaagaaccaaacattaagttttctgatggaaccaatgcaaacattgtggggaaaagatttcacacacgttcaacaattcaatgataaagtacaattccttgaggcaatcggtataatgcgccacgttcatgttagagtgttcttattatggtag

SEQ ID NO: 7784 - DNA, 249 bp, Candida albicans
aaagacggagacagatacagagatggagatatactcacatatatactaatttcctttcgttgtagagaactgttaacagttaatcataatgggcttttactgctactactactactactactactgctcctcctcttcctctccatagaccacttgcgcccctccctcacatttcaccaaataaaaaataaaaataaaaataaaaataaaaataaaaataaaaataaaaataaaaataaaaataaataa

SEQ ID NO: 7785 - DNA, 222 bp, Candida albicans
gtttctttttcttttaggattttctgttttgtttcaaaagtatatgaaccgaatagaatgggcagatctagacaactaatttttaaggtacaagtcataaaagaaaatattataacggaagattgccaggaatataccgggccacttattaacttaaaaagacggagacagatacagagatggagatatactcacatatatactaatttcctttcgttgtag

SEQ ID NO: 7786 - DNA, 198 bp, Candida albicans
ctgcatacatacataacatttacaaaccatcacttgattattttttactactatatgtgtgtgcacacattaatcttaccaatttattatagctgggacaatactttattgttaatgctaaagaagaataaggaaaagaatttttttttaaatatttctaacataatgcgtctaggctgtaacacatccagtctctaa

SEQ ID NO: 7787 - DNA, 528 bp, Candida albicans
aaaatttttaagcataattttaatgatgtgtcaaagaagagatttgaagctacatggaaagaattgactgctgccactgatttggctatcactatccctataagtgatatcgaagatatagacgaagcagaggaggaagaagatgaacaatctgaagaagacgcttctgaaagtactccacaggcttctgacgaagctcctaaaatttcaggacaagctgctttgttcaataatgataaggagattaatccaaatgaacttataacccttcgaaaacggaacgttcgaccaaacaaaaagaataataacaacaacaaaaaagttccacaagaagatcaaaaggagattgactatgctaatgctgacaagatattattgaaagatacaaaaaagaaaaatgatagaaagagacgtggattcgatccatatagtagagatagtgaaggtccaaaacctgctaaaagggccaaggccatgacatctggaagaacttccacgtataagaagaaaatgaataaatataaataa

SEQ ID NO: 7788 - DNA, 246 bp, Candida albicans
  unsure (202): Identity of nucleotide sequences at the above locations are unknown.
aaaaaaaagaatgcaaatgcaacttttaacatacaagtaattgagagagaaagaagaagacttgaattgcttgatattcttggtttaattgatgatgatgttgaccatagcggtgattctattattattattattattaccacgtctttctggtataataaacttggagaacaaattatgaaggaggagagtgatcataatnatatgacaaatttgcctctttttttttttatcaacttttgttag

SEQ ID NO: 7789 - DNA, 375 bp, Candida albicans
caaatttgcctctttttttttttatcaacttttgttagcaaaaagaacattcttctttgttaccatttttgtacttgcttctcttgctttaaattgttatttcttaataataataataataataataataataataataataataataataataataataataataataataataataataataataataataataataataataataataataataataataataataataataataataataataataataataatattgttattattttctatttttatttttgtttcacttgtatctcaagatttggcagtagtaatgaaagtggtggtggtttgcggtggtggtggtggcgcgcatctgaaattttgtag

SEQ ID NO: 7790 - DNA, 183 bp, Candida albicans
  unsure (66): Identity of nucleotide sequences at the above locations are unknown.
caaagaagaatgttctttttgctaacaaaagttgataaaaaaaaaaagaggcaaatttgtcatatnattatgatcactctcctccttcataatttgttctccaagtttattataccagaaagacgtggtaataataataataataatagaatcaccgctatggtcaacatcatcatcaattaa

SEQ ID NO: 7791 - DNA, 531 bp, Candida albicans
gtatcgccatttcagggacagattgatacattttggtgcattacaaccacttggatgtttatttcccatttgcagaaattctttttccaaaaaatgattggtggagtatatgatgcccaagtgttgaccgatgaaactataaaggaaaccattgaaataaataatcttctttcaactcgagcggttccacaaattcctgtatttttgtttcattcaaaattcaatgaaatgtcaccgtttttagaaattttgaaattggaaaagctttggtgctcacagttaggggttaatctagagatagcagaagatatgagttataatcatatggttgaagccttttctggtatgccagcagcaatcacttggattgaaaagaggtggaataattcaaccttgggaggatgtaaacatgttcaccggttgtcaaattttgaatatcctggcatagcaccatttctcagtcagtacttccgttcgtctttacaaatggtgttaaataataatcgttatttcaacaatactacaagatag

SEQ ID NO: 7792 - DNA, 462 bp, Candida albicans
actatttttcttcccgtatatgttactttgtcaggcgactggaagttaatggggttcgaattgcttaccaatttaacatctgacccagatcaaccgatctacagattatcaagatacatgcctatttcttggaaagaatattccaatgatttggattcggagactattcgcaaagatcctaagaaatttgattcatacagatttggtaatttcattatgactgtgtttaataatggtgttattgacacaaattatagcaagctccctcctaagatgtcagcgtccgtcaagagacttttactgcaaaaaccaaatttaagaagtaccattaccatgtatttgaaagatttagaatcatggcacaaacaaaattcagttattaaatttacagaacaagtcaatgaattaaagtttttacaggagtctgaaaaaatagctttcttcaaacacgagttgccataa

SEQ ID NO: 7793 - DNA, 285 bp, Candida albicans
  unsure (32),(46),(80),(88),(154),(167),(180),(203),(228): Identity of nucleotide sequences at the above locations are unknown.
acgagtgttcgttatgaagatatatgtgccanaattctaggtcatntggcaatctcactgatggataggaaactgagtanagttaganaagaaagcaaaagaatatccgaattggtattggactctgtggaatcccatgcaaaactggtgcccnaaagggagatgangatgaagacgatnaaggacgtgagtttctcaaaaantttccttccggctatgttccctccnataaacaccagcccagacaatgttgcttcaaccgggaaatccagtttacaatccggt

SEQ ID NO: 7794 - DNA, 504 bp, Candida albicans
  unsure (72): Identity of nucleotide sequences at the above locations are unknown.
cgcggatttcagcccgttgtgaagataaatagccagacggctcagggagtgacgaggagtcttatttactangagaataccctgcagcaaggagttaatgatgtggtttcagatcatccaagcaattaccaaaaagacagtcccaaaactcagcacctacaccctagtaataatgtcatgctcaaccctccagaaagtgtttcctcaggtggttccaacttaacattttatacagccaatagtcagcccatcgaaagtagctcagctgaaaacggccaatcaggtcaaccgaaaagaccttacctaatatccaagccactgcaaatactaagtcgattatcttcttcaaaactatcaggggttgaattaagtgccagtattgattcaggtagcgaccataatcaacaagaacaaaattcttttgaatcatcgactacaagcatagttgaactggatcatggcgatgaactgacaataaatctttcagagtcctacaataattaa

SEQ ID NO: 7795 - DNA, 468 bp, Candida albicans
gaggatagaaatcagatcccttcttcatcaccaataaccatcaactcatcaccaactaaagagtccacgattcaacagccatcattggcctcaaagttaataagcaatgaaaaggagcgagaattggaatttaaaagacaaaagatcagacagcataaagatttcccgttgattcggaagaagtttaattacttatctgaaagtgatatattgaaggcatttgtgaaatgtaagggaaatgccagagacatcaacaagtatttggaaacaaattttgatagaaatgaatacttgaggaaagaaaatgaacaacgacaaaagattatccaacaacaagaagaaatgagagaaaagaatcgacaattgagattccaacaactcgttgaacaaacaagtaaaagcagtaccccagaagttgaacgtggcattatcactgatgatgtcaatgggtaccgacgaggaagatga

SEQ ID NO: 7796 - DNA, 663 bp, Candida albicans
gattccaacaactcgttgaacaaacaagtaaaagcagtaccccagaagttgaacgtggcattatcactgatgatgtcaatgggtaccgacgaggaagatgaatctcctgtcaaaatcaaaaaaggtagagcaacagttaaaatagacgacatgtcaccaacaaaaccaaatgcccgtgaatctaccaaagtcagtgtcaaaagtaaaaaatcaattagcgacaaatataatagacaatctacattagataaatatgcgagacaatttaaaccagatcaaactagcagattggaatcattaccgaaaaagagaagattagtgagattgtcaagcttagaggattcatcgactccaagctcaaggtcgatatcaccaatccctgcccctgttggattggcagctagattcagttatagagaatccaataccccaaatccacctctggaccaacctgacgtgataaaaattggtgataccgaagaggaggcagaacctgaggatgaattagaaatgttggaacgtaaaatcttagaaaatcgtaaaaagaggagacaaaatcaagttcaacaaccgaaacaagataaacagaatcaaaggaaaccatctagtaccaaagcgattattaacctcagtgatgatgagaatgaggatattgacgagtga

SEQ ID NO: 7797 - DNA, 267 bp, Candida albicans
ttatctatctcatttagttatatatacatatttcctctttcaaaaagatcaactaacttaataaaagaaagtcacacacacagaaaccaagtgaggaaaaaaaaattcacaaaaaaaaagaaaagaaaaaatttagagacatattttatttttacaaacaaaaacattcttatagatatctttttacatgaatcaagtataactcaaccactccaagttacaaattatagatatatatatacaagtatttccaaactaaattgttaa

SEQ ID NO: 7798 - DNA, 219 bp, Candida albicans
ttaatctttccttcaatagtattattacctgaacggctttactccttttgtctttctaccaaccaattttcaattaatcatctcaccaacgttcttcttttgatcatttgtttatgccaaacactaaatccaagcttttcattagctatacaacaggcagattctgaatcacagcatcctctgcaacaaacgccaacatcagcatcattcaaaacttaa

SEQ ID NO: 7799 - DNA, 648 bp, Candida albicans
  unsure (326),(643): Identity of nucleotide sequences at the above locations are unknown.
ctatacaacaggcagattctgaatcacagcatcctctgcaacaaacgccaacatcagcatcattcaaaacttaacagttacaatcatctccatcaagatcttccacaacaacaacaacaacaacagcaaaaatttaaaaaaacacaaacaaaatctaacaataattttaatcaatctacccctataacacctataaagaatgcatccactgtatcgtcgcatgatataaatcaatatccttcatctaaaagttttaatgaaaattttaaaccatcaccactgttattaccaaatttaatacagcatagtactccatatgtatcaantacaccatcatcagcaaaacattttaaaccggaattaactgttttaacaactcccataactgaaaagaatttagaagatatttatcacaattatgataacgatgattatgaacaagactttgaattgaaggtaaatcataaacataattttaaaaatataaacaaatcccaaacaggaaatggagaaccatcaactttgttaggtaaagaacaagaacatttggtagaggatatcaaaaatagaatgaatcccagcaataacagcgatgaagaagatcaagccgattatgacgacaaggaagacgatgacatctccngatga

SEQ ID NO: 7800 - DNA, 795 bp, Candida albicans
actacttcaaaacatttaactttgaagtcatcgacaccagccagtacattagaatattctacttccatacctccagctctagctaccacttcgagttctttatctactgaatccaccactttgactactatttctaagtcatcgacttctggatcatctgtaccaaacactactagagaatcatcaacatcaactaccacaccaaactcatcatcttctgaatctaaagtttcaagtgctaccccaaaatactcatcttctgaagtctccagttcagctactactttgaagtcatattcgaccacacattccattccaaccactttggtatattcttcttctacttctttagggttttcagttactgaatttcgtaatttaactactacttcaaaatcatctttgtcaactagtaccactgagttattaacatcaggaactactgtgagatcatcaacttcagaatcatctgttacaagtgccacctcaatttatacttcatcagaatcaacaacttcatcagaatcaacgacttcaattgaaacaccaaaatcaattgcttctaaatcatcaagttcagttactttgccaaaatcgtcaacgtttgcatggtctacatcaacaacaactccagaatcatctccgatcactttgaaactttcaactagcaaaccaccaaaaccaagtgctacaatggagtcatctgctagtaccacaaagaattcatctattcaatcaacatcagaagctactacttcgggatcatctggagttgagtcttcagttttaacaggt

SEQ ID NO: 7801 - DNA, 210 bp, Candida albicans
tttacgaaaaaaatattaagattattttcaattatcaacaccaaattgaaaataatactaactaacttacatcacatcaacaaaaattcatttctatgtaattatatgtacggcattgaacagtttaaacaaatattattaagcatgattgttttctcatctaccatattcattaatcctcattggtcgaacggaagaaaggaagtatga

SEQ ID NO: 7802 - DNA, 225 bp, Candida albicans
aaagtgttagccatttcagtttgtttagaagtagaagaagctctattatataccacaccactaccaccgtcaacctttacacctggtgatactatcaacacccataacgcaaaatcaaaacaaagaggcttgaactttgtggtaaaaaaaaagattacgcacgatccattttcaaatgcatatggcagcagtttggaaagtaaaaaaaaaagagtatatatatag

SEQ ID NO: 7803 - DNA, 411 bp, Candida albicans
agttgtgctagtgaaaagatagctttgtgcgtgaagagactaataaacttttggtgcgtggaatctttagtattcgtcttctatatatatactcttttttttttactttccaaactgctgccatatgcatttgaaaatggatcgtgcgtaatctttttttttaccacaaagttcaagcctctttgttttgattttgcgttatgggtgttgatagtatcaccaggtgtaaaggttgacggtggtagtggtgtggtatataatagagcttcttctacttctaaacaaactgaaatggctaacactttttatatccaaagaaagaaaggtgtatttaaagttcgatttaaattagaaagagattcgtcaagtttctttgaaatctcaatttgtggttgtaaaaaagttttttga

SEQ ID NO: 7804 - DNA, 396 bp, Candida albicans
caaaacattatttcaataatgaagatatttacaatgttcaatccattatcaacaacaacaacaataattccactacggaaaaagactgcactattaaaaaataattctcaaaatgatagaaatattcatttccatttaataacatttcctaatggaatttctgttgaagaatatggattacccataattaaaactttacaagatattgaaaatttacctaaatttgaagtcattagatatttacaaggatttgatattgaatataataataataatgttttactggagattcatttacgaaatttattgaaagatcgattaattattgaaatgaattatttgaatggtggtgttaaaaagacaaagtggtccaaagcaaaaaaattaaagcattaa

SEQ ID NO: 7805 - DNA, 195 bp, Candida albicans
aattcatttagttgtttgatgatatataatcatacacctgtaaacggggcaggaagtttaaggagagagagagagagagagataaatttttctcctaaatcaatcaatcaatcaaatcgcagtaagcagcagacgacaataattaaacacaccaagaagaagaagaagaacaaaaaattttatcaatccttttga

SEQ ID NO: 7806 - DNA, 1029 bp, Candida albicans
  unsure (5): Identity of nucleotide sequences at the above locations are unknown.
attcngattaatgcttattcaaaattattagattcagcaattgctcatgcagcaagagaatcaactccagaagttaatgaatttgaatttgatcaacaaaaaactaatatcaacaatcttaataatgatgatgatgatgacgacgacgacgatgacaaagtatttattaattcaatcccaccttcaaaacaaggaaataataaaatttatactattaaatatttattatctacacgtaatgaaattcaaccaattgatgttaatgataaattacccgataaatcattttggagattaggaaaatctcgatctaatgatggtggtggtggcggtggtagtggtggtaataccaatagtggcacatataagaagaaaggtagacgaggtgctaattataatgaaacttgggaaagaaaaaacagtactagtagtggatcaggacgtgatcgtcatggtagcgacagacatttaggatttaatagatcttttgaattggatcaattatcaaatgataaaatatctcaattattaggtgagcaagaaaatgaattagaaactcctgaatgggatgatgttgggaatttttctgaatcatcaaataaatacaataataaagagactaataatggcggattaatgaatatgggtcaaaccgttgaagattttgaaaaatggaaatatcaaatgaaattacaagaacgaagaaaaaatggtgaagtgattgatgaagaaaatgaagaattaaatactgatactaatgctgctgctgttcatgctggtaatgaagttgataattttttctcatttgtaactcaagatcaagttaatgataatattgataatggaggaatcaaagataatgaaactaatttcaaacaaagtaatgaacaatcacataatgataatgataaacctcatcgatcatcaagattttcatcatttttccaccaaccaaaagaaattccaagtccagcaactagtacaatcaccacatcttcaaacagacatagccgaccatttcagcccccc

SEQ ID NO: 7807 - DNA, 237 bp, Candida albicans
ctgtcacttctttgctgttgtatcctgcaagtgccaatttcgagtggaaacggatttggcgtaatggttgtcttaacatggttggaaaagaaaggtggtacaatttttttttttctgggggaaatgagtgcctttttattggtgaatccagaacaatgcaggtctatgcagccaaaaacagtatataaagcagggtttgccattggtcaaaaaaccgagctggcttgtcgtcaatga

SEQ ID NO: 7808 - DNA, 219 bp, Candida albicans
atgtacttattcttgtggttgttcttgttcttgttgttgttgttgatcatggctaaaaaatttcaactaaaaaaaatttctactgagtggaaaagtttctttttattgctagtactattcaatctgtggtgtctattccataattatcgtacatatatcaacttatctcttctaactaaactagtaaaatttcttctaatcaaccacaacaacgactag

SEQ ID NO: 7809 - DNA, 252 bp, Candida albicans
tttttttttcttggtattcgttccgtctcatcattcattaactatttaatcttgttatttattattattgttgttatttatgtatgtgactataattgtttttttatttttacaaaagatacatcatcatcatgtatatataaaaggagagtattcccatcaattgtcatttacaaacaccgaaactttttttttctcactctcttctttttcttttataacaattcgttaaatcttactttatttaattag

SEQ ID NO: 7810 - DNA, 213 bp, Candida albicans
aatgttgatatatcgaataatatacggccaatgtttggggttttgtgcgttttttctatcgctgttactattcgaagacataatcacatttcattggatagtcattctactcacaaaatttcaatatctccgagtgtggataatagcaactctcgacatttttttagttcaaattcatcaattaagactttgaatatcttagtcacttattaa

SEQ ID NO: 7811 - DNA, 282 bp, Candida albicans
tacagcaattattttcacattaacgacctaaccaatttcaaaaaaatgtcgtgtactcacacagcaaaaaaagaatttttcagtttttccatttttcaaagggacacagaaatgaattttgctttgcaagttcatttttcagttatatgtatacatagtttatctaaattaggtagaagtgagcaatatttcatgttccaattttgtgtgttaagcctattcaatagtttatctaaaaaattttcaactaagccaaattgcagttttcaaaggagtttttga

SEQ ID NO: 7812 - DNA, 1257 bp, Candida albicans
accatgtcaaatacgattccacaatattttattagaattttcaatctaatatttctggccagaaggaaaaatttccaattagcattaatatcagggttattattttttggttcatttgtcatactatcaactacatcatatagtaaaaaattcaattattttgatgatttaatcttgaaaatatatgattataattatctaactaataattataacattgactatttagctaaaaatgatccagaagcttatttcaatgttaaagttcaacaaattgttgatgaaaaaaagcaacatgatttagaaagtaaattttggtcacttgatactaaaattaatgatgatcaagcaactttacaaattccagcatatttcacatataataaacctagagataataagaacctagaggattctgagcaatcgtcaaaaccagtggaaaaaccattgattcaaccatttgatccaagattcactttagcaatgtattattattatattgatcaacaaatgacaaccgcccatcacgattcttcttcttcatcttctgagaattcaattacagtaccttttaattggtatgattgggttgatatgtcagtattgaacaaatacttattagcccccaacaaagataaaccagattgttcaatcttagatgctcatgaagatgctagaaaaattgaaactgaaaagaagaaaatggataaattagctaaacaatgggatgaaaataaacgtaaagctgaagaagaaaagaaaaaagccgaagaagataaaaagaaggaagaagaagaaaagaagaaggctgaagaagaggaaaaacaacgtcatgaacaagaaaaacaagcattagaagaagacaagaagaaattagaggaagaaaagaaaaaaattgaggaagaaaagaataagttacaagagcaacaacaacaacaacaacaagaagagaaagccaatgatggaaaccaaaagcattctaaatttgtcaaacgagatgatgaaatcaaaatgctgactagccaagacaaatcagattcagactctgatagagcaaaaatcgatatgacgacatttttcaatgaagcatttgaaaaactttctgatgaagataaagctagtgttgctaaagatgttgaagatgccgtgaaaaaaattactcaaccttctagttggtgtgttcctaatgctaaactttctatagatcatagtgataaacaaattgttcatcctggatttaacgttttcaaaagtcct

SEQ ID NO: 7813 - DNA, 183 bp, Candida albicans
ttcatttcttgcaggtttcggtcgggttgggtaggttttgattggtctatacgaccacagaaaattgggcttttagtagttgatcgtatagagaagaaaattagtaaatttcatattggtttggaacaaacaaacacacaaacgagtaaaatagaaatcgacagttctgtaaatttagcataa

SEQ ID NO: 7814 - DNA, 426 bp, Candida albicans
gtgtttattttaatgacaaataaagaccaagaacaattacttcaagacgcctccactttgttgatgtttgcaagcctggtagccaaacatgaactgctgaatcagcattcaccaacatcaaatatgtcatccccaccaacagttcaacaactaccacaacaaccgcagcagccccttccccaacagtatattaattctggatcatccacacgaaaatcatccgagcataaggagaccagtgtagtatcttcacccccatctgtcaaatttgtcgatatcattaacaacccccagtctgcatcagtcacacatgagaagaataaacctacaactcaatcgaaaagaacttcaatcagtatgcttgttaacgatactccatctgacattgccggtcttcaccacggggatggacggatccgcgcttga

SEQ ID NO: 7815 - DNA, 183 bp, Candida albicans
caattaaattacaaggggtacttagtaacacatttttatactcaacaaagggctattattttttttttgaaattaccacacagtgttcaatacacatcattgcaggtgaatgcattttatagagaactggaggtatatgtaaataatgaatttatcggaaaattacatttcagcgtcgcgtaa

SEQ ID NO: 7816 - DNA, 972 bp, Candida albicans
ataatgaatttatcggaaaattacatttcagcgtcgcgtaattcgtcgtcttcaacagctacaacttcaatgtcaaacaagtatagcagtttaccaaagtttaacaaccatacccattccaaccaatcaagaattgtgtctaataatgatatgagtacatcaagcattttcccttataatagaactgtcagttcctcgtcgtcgataatgagcaccccaagcaataatatcagaaagttccaacgacagcgacaacaagagagacaacaccacgaacacctaccaccaccatcacaacaccaacgacaaactggaagtagcaagaatgagcatatcaacaacagttcaaggacgtctaaaaatgggagattaatcaaaaacaaattattaaacctacaacagtcactgaaacaacaattaatcaatcgaatatcagacaaagatccaagacattctcattctaacagttcccaatctaatgcaaaaaaagtgacgcctccagtgtttggtctacaaaaagttgcatccagcccttatgacttttcagtatttacaactgtagccacaaatgaaaaacagcatgatgaggtgctatttcctgctataaaacaatcacaaatcagagcctgggaatctgccgagaaaatatgtagaggcattatttttgatgatgatgatgatgatgatgaagaagaatccaccgacgacgaaagtgaaatcactaagaaccccataatttcaataccgggatacactgaaggtgaattgaaagaattgtccaaatatccgaatttatcaagtcaagaaaagaaaaaactattagctgaatataaacggaaagtgttatcacaacgggaacagaatttatctaataacaatttaatatcgttcagaagacaattgctaatagaccagaagatagaaatactttcgaaattgttcaacaatcaaaacaaactcaatctcgattat

SEQ ID NO: 7817 - DNA, 186 bp, Candida albicans
aacttcccatttaagatcgtggtggctaaaccatatttaaccaatttaaacactttgaaccgttttgctaatatgaaacccgaaggggaaaaaaagtctagaagtttaccaaattgggtggcgtttaatatcccttttttttttcttattttagggcattaccccaaagaattgttttggaagtgc

SEQ ID NO: 7818 - DNA, 192 bp, Candida albicans
gtaattattgaacaagttgaacaaggagaaattaaatctttagcatcatcaatagtaccaaatggaggaatatcagtatctgaacctaaacaaagactacaaattttgctagatgaggaggaggaggagaaggaagaagtgaatgattcagtatctgtatcaatatcggtatctatatttgacatgatctaa

SEQ ID NO: 7819 - DNA, 825 bp, Candida albicans
atcatgtcaaatatagataccgatattgatacagatactgaatcattcacttcttccttctcctcctcctcctcatctagcaaaatttgtagtctttgtttaggttcagatactgatattcctccatttggtactattgatgatgctaaagatttaatttctccttgttcaacttgttcaataattactcatagaaaatgtttattagattggtttaattctgttcctgctgataaattacatataattcgtgctcatcgtcaatcgacatcaagaagaaccatttcaataaataataataacaacaacaacaacaacaacaacaacaacggttctctaaatgaatctaatattaatcatgaagaaaattttgatgatttaggtgtaggaataacaccaacaacagggatggaccaaaatactactgctactactgctactactgctactactgctactactactactcgtattgaaataaatttatctactcaagcattactgaattggttaagtactatgacagctgcaggggccaatactaatgaaatagaaattaacaaccaccaccaccacaacaacaacaccaacaatagtgataataatactgatgttactatacctggtggattcccaattagtcgtcgtgcatcatcatcgtcgttgtcaaatgtttcttctcctcctcatcatggctcttctcctaatcatgattttaaaccaagtaatgaatatcttgtttatatattagcaccatgtccacaatgtaaacgagatataatattttccatgagtcgatcaccactattagcctcacattcatag

SEQ ID NO: 7820 - DNA, 198 bp, Candida albicans
ttgatccctgtcgaatgtcatattccttgcaagttgttatttgctagaaatatgttggttaaattattggtggaaacgtcattattaatgaagggtgctaatccccttagctgtttacaattaatacatagttgtccttttcaaaaccacttttttttttcacgatttagttcaaattttaacataaaaaataaatag

SEQ ID NO: 7821 - DNA, 237 bp, Candida albicans
actagccaatccccacaatataaactacaaactgtgtgtacaaatcctagtgagtattttataccacaattatataggccaactatggtaaattatagaaaaagaaagatatattgtgacgctcttggcagttccaaaacaccccacataagcttaaaggtactaaaatcatattctttatgttccttacatagagataagaaaaccgagcatcttttcgagattcgcgctgtgtga

SEQ ID NO: 7822 - DNA, 192 bp, Candida albicans
gccaaggcagtggcccacacgaatagcacgtcagcaataaacatgatcagattaatctttacgagtggtgcatacaaagaacgacaaatttattatactaaagcctcacataaaatcaagccaaacgggagcggtcgtaacagaggtagtcagcttcaggatgagatagcaatttggctattggagttgtag

SEQ ID NO: 7823 - DNA, 213 bp, Candida albicans
atagaattgatatctattttgttggtgaaaaaacaagggaatatggaaaaaaaaagaaaaagtggtgaagaagaaaaaaaaaatatttcttgtgaactcgaaagtacaatattgtctttatatataattttcaagtggtggtggctggcagtggtggtttgttggttagtaatggatcgtggtggtggtaggtggacgggggtgaattactaa

SEQ ID NO: 7824 - DNA, 1023 bp, Candida albicans
  unsure (992): Identity of nucleotide sequences at the above locations are unknown.
tcaatgttcagacatcatcgagatgttagcagtcatcttaatcgtcaacatgatttcagagatgattattacaaaattcaaagattgataaatgataaagttcacttgagtttgaaatttgaacaattgaaatctccagaaattcattctactttaatgaaaccaataactgacgagatattacgaatatctgagctatcatcgtctccactagcagcatatttgcaacatgacactcaaccagaaataataggatcgtcatcattagcagtaacagaaagaagagactcacgattagggagatctacatatacaactttagatgcagtttcaagagaaacaatcgaagggccaagacagaaagtctcaaataatgtcattttcatattgttattactacgatatgaatacttgattcaactggaaaacaacctagtctgttttgatttacttattactaaagctaccgtttgtgagctattgtccatcagaatgctaagagaatacaaatctttgaatcgagttaacatgttatttatcaaaccattatatgaagtagaccagcagtataatttcaacacccttgaacttagtgtattatgcaacgctcagaaatttctttcacaaccaatcatagttagaatattagaaaggttttataatggtgagcttataaataacgagagtagtcatatgacaggttctggaatgagttatactgacgatgaaaaagggttacttgaagctgactgtgttacagattaccaatttagaagaatatcatataaacaaataattaaacgggcaaacaccgtgccaaaatatcaatccatagtgataaatttcaaattgataatgctactgatcttttactttctgttgatctttggcaaccctatgggaattgggactttattttggattattggtttaagttttaatattgaattaattacaaaattgtacaatatagaatggcaatttgtgagaantataatttggaatcaggaccgatttctgttt

SEQ ID NO: 7825 - DNA, 216 bp, Candida albicans
tgtattaatattcaattgtactgttatctatctagtaggttaagaaacagttttgtttggtctatattagttttaaagagtgatgaaatggaacaagtaaaaaaaaaaaatctacaaacaaaacgagaaagtgagaagagtgttataacttttgttcaaggtacactactatataatctattcaattttgggattctggctcaatggagcagttaa

SEQ ID NO: 7826 - DNA, 510 bp, Candida albicans
accatcatgacaagattagataattcacaatttctaaaacaagttgaaactttaacacaatcaaataatggtaaatcatcaatatatctaactcaaaaaagattatcaccatcattatcatcaataacaacaaccacaactgcagaagatgaaagtataaatgatttaccaacaaatgtaatcaccccaactccgaaaactaccaccaccaccactacaattaataatgattcgaaatatcctttattgattagattatcaatgaattcaagtgataataaaatcaagaccaagaccaaaaccaaaactgacagtaaagtccaaaagaagaaggaaagagttaaaatatcaacggtggtagaattagatcaattgaatgaattttgggatcaatatattcaaatattaaaatctggatttattggattgaaaaagaagaaagataaaaagaaaagtcatacaaacaataacagtaatagtaatgttaataataagattaaaaagaaatag

SEQ ID NO: 7827 - DNA, 588 bp, Candida albicans
  unsure (23),(36),(47): Identity of nucleotide sequences at the above locations are unknown.
tttcgtcaagaattacaagatanatatatgagtcanatattattaanacaacaagaattaaattaccaaaaatcattacaagctgataaattgaaaaaacaaaagaaacaatatgatacattatcaacacaatatttaatttatcaattagatagatttgaaaaatatttaacaaaagatagagttgctaatgataatatagcgaaaattgctattaaattgactaatgcgaatagagtaactggatattttccatctaataattcaattgacgatatatttatatttgttgaattgattaatcgaggatatttaaatgttgctaataattcaacaacaacaacaacaacaacaacaactaaattaacatcaacattaactgaatcacaagcattaacaaaatttaaagattttaaattaatttacaattttaaattattatcaccattacctcctaaaatttgtttaaatgatgtattatcatcatctaaagataccacacccaccgccaccaccatcaagattaatcaatttgatataatttatccaaatggtttattaatagttgaagatatacaaaaggattaa

SEQ ID NO: 7828 - DNA, 471 bp, Candida albicans
gcgcattctaaatcaaccgatattacatttggtgctatccatggtggtattcatacaactacttctcaaaatggtacttcaagatttttcttatcttcaaaaggtaaccatggatttggatccacttttagcaagtacaagtcaaaaatcaagtttggcccacatcaaagaaagtataaaagagttgtgaatgcagttaatggaactattgttttggacaagtccaaatcaggaaaagatgacgaacatgggaaaactcacttgtcttcaatgatgaaagctatggaaaaaacatcagtttacaagaatgcttcagaaatgttacaaagtattgtaaatgcttcaaaagcttctttcaaagaatttcttggtgctaaacctggatgccacggtatgaaacatcatgaaaatgaagatgggcataagaaaatgaagcataaaatgagaaaacatctatccgatgctcattag

SEQ ID NO: 7829 - DNA, 348 bp, Candida albicans
ttctatttcaaacattcaagtaatcgtttcgcctcatcttttataatgaatgataatgatgataaacctatagctactaccattgataataaatctcacaatccaataattttaccagttgttaattccatcccgcggacccaggagtttggggtattaaaattcggtggtattaaggattctaacgcaatagagaaccatataacttggtgtgttgatggggacattacggcgttttccaccacgaaagatatttctttgtgttcccctcaagctaataatatgggaagtgatttggctacttcagtacaacaaagcaattttggtagatcatttaacttatcgtga

SEQ ID NO: 7830 - DNA, 519 bp, Candida albicans
  unsure (31): Identity of nucleotide sequences at the above locations are unknown.
cactccgtggatccagccatgcggagagaanactatggacttgatagtaaaatcagtttccatattaatgctaataataataataataataataatcatggtaatgtttatgataatgaaagtaatgaaaataataacactgatgatgatgatgatgaagaggaggaatatggagatgatgaagatggaaataatcatttaggtcatactgaatcatttggtaataatagtgctattcatgatgattggcatggatttgaaagtgctacatcaagtgtaattgatcgagcgttttctgacgatgatgaggaggaggtggtggacgaggaggaggaagatgtttctattcaacgtctgatgaatagtccttataataatgatagtatagaattatcaagttctgaacatgaaaatataatacaattgagtggagatgatgaagatgattcatattatgattcagaagatatacgagatgctatggaagaaatggataattttaatattgacaacactgat

SEQ ID NO: 7831 - DNA, 1125 bp, Candida albicans
tatagacaaaaacagctttgtggattgttgtttgacaatacttcacaatttatcatggaagataaaacaaagcggcaacactcaattctccatcctctagcaaacaacaaccagttacctgtgaaaacagtagacaccagtaacacagcagacaataattacaataacaacaatagcggtatattgtccagctcatataaccctcaacaacaacaccaactacaacaacaaaagagaccaattccaaaaaatgtagcttacccgccaatgtacagctttaatatctcaaccgccaacacattaaagaatagcgtttcaacaacaaaagctacttcagggcttccagtagcacctgatggatatatttatgtaaaaggttatggtagtggctcagctgcagatcatattcctagaaacatccccaattattacccaagacgaggcacgtcaataaccaataattacacagaatcatcagtggtgaccccgacaccgctacacattcctcgacctttggtaccaccacatttgcttcaaccgccaaatttgcaccaactgctacaacaaccacaaccacaacagcatgataatggagaaacggtagcagcagcagcatcatcaccaacgttggagattttcaacactttaaaccccagaaaggctccgaacatgacttataaagaaaaaataatgaactggatgtcatcaatccctcagtttaacgatagtgaaaataatgaaatatatatagattgttatcctggtgttatatcaacaagtgtcacaccaagcacttctgacgaagaaattgatttggcagatattgaggacatattggaattacaagctagaaaagttaccagatacgttactaggctatatattcgtgagtcagaaaattgggaagaaattgctggagatgatgaagccggtgatgttgatggcggggtagaatatgaagtggaagaaggcgatgatgacgacgacgacgtcgatgatgatgattacgatgaagatagagtgcagccacacaactacgtctacagaaatgctaatttgaacattgcttatgaaactgactattcttcaccacggggctggacggatccgcgcttaagtaaccac

SEQ ID NO: 7832 - DNA, 369 bp, Candida albicans
tttaatagaaagacgcgtaaccaaacacaaaacaagaaaagaaaaaatatttttgttagcgtttcgttcatctctcaatatcccccattgaaaccattccagaacaatattccaattatgagtctgttgaaacgaaaaattccacttgatgaaatagaagattttattgctgaagaggaagaagaaggagaacaaaatgatgatggttcatacgaggaagataatgaatttgttggaccaagtggaacggccacacctcttgatgagagtgaaattcagcatgttgtaaaccaagtggttagattgtttctttcgagagaattaaatggccgaaccacaatcttcaccacgcggctggaagatccacgt

SEQ ID NO: 7833 - DNA, 240 bp, Candida albicans
tattgtgttttagtaagaaaaaaaatgactaataataccgctaatactaacaatattaatcgtgtaacggatgtgtcagtgtgtggatggtgtcggatacgtgggctgtgtgttatgtgcattttgaacttggaagaaaaaaagaatgaaatcaatttcaatttcatcaatgtggaaaaatgcgagaagataataattaattatgtacagatacttagacaatacaattctattatttaa

SEQ ID NO: 7834 - DNA, 288 bp, Candida albicans
gtccgtcgaaaccactgtgttgcaggtcgtatgtttaaagtatggataaaaacacaggaaagcagtttacgtgtatccaaccttgaagtttttcgtcgttttgctgcaaattgcacaaattggagaatagaaagggatgaaaaggcaatttataatatccgactacttccagccacctttatggcaatgtcatatataattcagttttacactacacaactgtttatgtatatcataatcaaaatcttgacttcaatacatattagtcaattctgtatttacagatag

SEQ ID NO: 7835 - DNA, 348 bp, Candida albicans
agaatatctaatattgattgttttagaaaattaatggccaaagttaaagtgccattagcaaatgatggagttggttcaaacatcaatacttttagattagaacattattttaaaaacaatggtgaaagtttaaaagaaacattgttagataaaagcaataatccaaatgttttaattaatgaaagaagtagaaaattgtctgattctttactggctcctgatttgcaacaagttggatttgcaagtgatcattatgattattctgaagatagttattctacaaccattagaggtaatgctagagacgattatggtgataataacgaaccatatagctttttgatttag

SEQ ID NO: 7836 - DNA, 309 bp, Candida albicans
tacaaccaagcagcttttaaaatggacaacctgtttatatttgacttacctacacatttacctaatgagacaccaaaagaaccagagcttgcttctgagtcccaaaatagagtaccagtgaatattgaaactggcaaacagaaccaaatagaccatcgtgatgaggatgaggaagacaataatgatcatgaggaaacactccccaaaacaaacggaacaatatacattcaaggcacaaatatcagtttacaaactgaagaagacatagagaaatggattgaagaaagaatactcttcaccacgcgatga

SEQ ID NO: 7837 - DNA, 330 bp, Candida albicans
acacccaaccctcttttgaaccatttgccagaccaccatgcctggttgacattttctgtgcgttctcttgatataactaaaatcaaaatgaaattcgaaatgattctatggcaattgaatataaccaacaaagccgacaagagcttaaccatgttccagtcttctaaaaatagcaatagttcgatgttgaaaatatgtaatatcaaacaagcaaaatgtacaaaagcagcaaaaaatgccggtgttttcttaaaccatattccaaccaatggcgcaagagttaaggacattacccatacgaagaaaagaaccgccgaattctcgagataa

SEQ ID NO: 7838 - DNA, 222 bp, Candida albicans
attatcaaaggcaaaaatgaaatgaagaagcaaacaaatactgaaagcacaaaacggtcaatccagtttagaacggggactaaattatggcagccaggtgttgggttatcttccgtgcacgcggctgtgccgttgtttaatgcaccaaggctcatcaacaaagacataaaggcttttacagacaacattatagacaagttgttgatatggaatccagcgtga

SEQ ID NO: 7839 - DNA, 231 bp, Candida albicans
aaacttcttcttattaagtggatagttgattcctgtgtgtatccctttccttccttattgcaaaataaaatttcaataaaactcgtaaaaaaaaaaaaaaaaaaaaaaaaaaaaagtgctgcacgtgataaaaaatgggtcgtgcatagaataacaaacaaatcacgtgacacaccaagtaatataatagaaaattttttcttctacaaaattccaaccaatggaaattga

SEQ ID NO: 7840 - DNA, 333 bp, Candida albicans
gttaaagatgaaaaagataaaaaaaaaaaatttttattattatttaacgcaagaaaagctcatctaattcttccatgtatattcgttttcattggttcatactctttttcttcttttattattactattactaaattgtattgtcaacctgagaattacgaattatttaatttattagtttatagtatatatataacctctactttcttcactcttccttcatttttatatttatccgatctcttcccatccccccccctgaatttttttttttttttcacaagaaattttatatcatttcccatcgccaccctacctacccttgatacataa

SEQ ID NO: 7841 - DNA, 201 bp, Candida albicans
aagaccctttttgttttcccaattaataagaatctgagcaaggcttattatgtatcaagggtaggtagggtggcgatgggaaatgatataaaatttcttgtgaaaaaaaaaaaaaaattcagggggggggatgggaagagatcggataaatataaaaatgaaggaagagtgaagaaagtagaggttatatatatactataa

SEQ ID NO: 7842 - DNA, 360 bp, Candida albicans
gtacgcggactttccagccccgtggtgaagaccaatactcaaacagatattagtgtcactgacactaatgtgatttcaccgtcactggtagatttggaagagcaaagtggacttcaagattacttggcaacaccccctacaacacaagaaaccgatccattattagcagcaaataacaagtcctccaatgcaagacctgagaacagtaatactgacaatggtaatgaaaatgaaaatgatgaagtctacaaagatgacgataacatgagcagagtgttacgattagccagaagaacaagtttcatttgggtttgttgtttgggtgtagtggcattaattatttttcaattaacattttag

SEQ ID NO: 7843 - DNA, 192 bp, Candida albicans
ggggggagggaggcctccgacaacctacccgggagagaagagcccttcctcacctctgatagagctaatccccaatcggttgtcttaaacgaaactttttatgagagaggaaattgcaattcttggaccccccaaaggcaaaaattcccattaaagagggttcgagatcaacattcggagtggtcgggataa

SEQ ID NO: 7844 - DNA, 201 bp, Candida albicans
  unsure (67),(69),(73),(76),(78),(81),(82): Identity of nucleotide sequences at the above locations are unknown.
ataattcagattatccaattatttcttccacaccacagtccacttaactcttttttttcctttccantntccnttnanttnnaccctacacaccacacaccacacaccaccaccaccaccaactacttatactggttagaattgaaaattgaaaaagaaaagagggaaaaaaatgaagtacgtaagactagacgcatatga

SEQ ID NO: 7845 - DNA, 1362 bp, Candida albicans
attattcaaggcaagtaccaaaaagaaccatttatcgatgttgaaaagaaagtagcttcttctgcttctgcttcagtttccgtgtatggatcaaatgaaccattaccggatccaactccattaatgatcacccctgaagaagtttcaaattatgatgatagaccatggagaccatttagatggccatatcatcaaaccatggctattttcaaattagatatcaatcattggttggatatggataaatattacatgcattacatcaaagaaaaggaaagaattagacacaagtatggtaaacaaaattttgatatgctacctgaaggttatgatggttgttttgaattaatggagacggtgacaaatcatttaattgccagatatcctttattatttacagttttaaaagatggcaattatgaaaaaggtaaaactggtgatggtaaaatcattcgtaatgaaatcacgaaagaaatattagatatgactttaccattgaaagaatcaccattagtttatgtttctaaattggctaaagaagacttttacgttgtgaaaaaaaacccaactgatagattacattatcttgttggtgctgctgttcccttccctggtggatcttttggtattgatcaaaaaattggtcatcatatcgatactatacatgctgatgtaccatattataaagaaaaattgaaaaaatcaatggagagatggtttgatagaatgaaacctaatgatccagtagaaagagcaagttggtatattacttgggatgtcaaattaaaggtgaataatatttatcaacgtccagaatttaaaccaaatttagaagcagaaatgaaatcaactgatcctaaagaatttaatgttcgtgttgaaagacaaactttaagaagattgcctaaatcaaatgttattattttcaccaatcatccagtgttttattctattgaagaaatgaaggatgaaccaatgattccttcacttttgaagaaaatcttgtatgaaggccctgaagatattttgaaatataagaatttcccattgattagagatcatcttgctgaatatcttgacaaactagttgctagacaatatgaacttggaattattaatgacgaaacccccttgaaaactcaacctacttatccatttgcttattggagtaaaactaatttcgattacgttaacggttggagttatccaagtcctccttatgacaagaaaaatatgaagactgattcttcgaaaaatgtgaaactagctgacaacgaatacgcttttaatttaataagggaattcccttatccattatctcaaataaattacaagataaattattcatttctctcaaattaa

SEQ ID NO: 7846 - DNA, 207 bp, Candida albicans
aagtggcaaaccatcaaggaccttcaaaaaggaatggcaatggaaggaagatttttagaaattgataactttttgaggaccgttattgagcaaaattataggaataggacggattgtgaaagggatttaaaaagggggagaggcgtgggagctaaaggtagattgaaagtactacttcaaattgtgctaaaaagtgatactttgtaa

SEQ ID NO: 7847 - DNA, 189 bp, Candida albicans
aaaattagaaaatttaatgaatatcaatttttatttcctttgattatttgttcaaaaagtgttaatgttaatttttatcctaatgaatctttcataatttttttttcaattttcaattttcaatatcaatttgaatcacatccacacattgaaatatccatttatggaaagcttgaattgattgattga

SEQ ID NO: 7848 - DNA, 216 bp, Candida albicans
ccagggtttcattgggaggggaaaagggaaattcaaaaatttttggacacaaagcccgttagagcaacactgggggggtgggtaaaagggttttcatcccaaccaaaaaaaagagatgagacggtggtaaatttcaccatttttggaggaaggggaaagatacgccaggtggtgaaaggggtccaaactcttatttttcttcttggtcttcagtag

SEQ ID NO: 7849 - DNA, 483 bp, Candida albicans
caaaccggtgatttattaagaattattaaatttattgttcgtgacagtgatgattcagatgaggcaacgggctctatcaaatgtatgcgaatggcacctaaatcccccaccagacccagacccagattcaggaatcaaaaacaaaaacaaaaacaagattaccaacccacttcagcgatcacccttgagagttccaatgaatcattctcgagtgagattataattaacaagtctaatcccatccacaaaaacatatattgtgtagggttgttactcaattcttatctagatttcaataatgatcaattgaacttgaaattaaaggttcaagaaacttccagcgaagaagaagaagaagcaactgaggatttgattaaagagtttcccttgagtatagtttctttggagacaactgttgtcaaatcagtattggcaggggaagtaggggaagaagaagaagaagaacaagctcagatgaactag

SEQ ID NO: 7850 - DNA, 198 bp, Candida albicans; identical to SEQ ID NO: 7535

SEQ ID NO: 7851 - DNA, 198 bp, Candida albicans
aatacaaacaaccacaaagaaacgactttgaacgacctaaccagccaaccaactttacctagtccaaaattctattccaggaatgagcatcaataccaagttattttagggttaaacttgttgataataaagatcctaaagtgtactataatagttgaatatttgttctctcttccccaacgattatgtaatttttag

SEQ ID NO: 7852 - DNA, 258 bp, Candida albicans
acgcgatctctttccgtgggcaagagaccattgcaacttcacttgaatgagttatctactagaggtcataatggaagcaaaatcaccagaatagatgaccttctacttgtttcttttcggaaagttttcattactgaacagggaattggaggtggggatagagagacatctcaatttttggggaatgctgaaagcgaagatcttacagggaatgggttgttgacttctactttgaccgtgttgtcgagtatatcataa

SEQ ID NO: 7853 - DNA, 207 bp, Candida albicans
gttaactatcctattttttttaattttattttattttttattaccattttttttttaaatcttacaaaatctacttttttttttaaagaaatattattgtctattattgttttatattatggggactatatttttaatcttgtcaaggagggacaggaatcattgaatttacgatttggttttttcattaaccgtttttgtttttaa

SEQ ID NO: 7854 - DNA, 225 bp, Candida albicans
  unsure (95): Identity of nucleotide sequences at the above locations are unknown.
atttctaactggctgacaaaccaatatactatcaatcttattctattttttttgatatttaatatatccgttgtgtttattttcaatttattgtntttttttgtttatttctctaataaattatgttttttttttttaaccttattgtttttaataaatttatttaattttcaaaaaaaaaaaagatctcctcgccaaaaaaatgttaaatttaatatttgttaa

SEQ ID NO: 7855 - DNA, 300 bp, Candida albicans
aatatttcaattgaaagaagaaaaggaaaagaaagaagaaaagaaagaagggaagaagaaagaaagaaagaaagaaaggaagaattttttgaaggtggtgaatttattccccttaaatattgttttttcaattgtgtgtgttttcccgttgcttactttcaaacttcttctaaaagtaattttgcatttcattccggagcgaacaaattgaaagcaaaaccaaaatacaaaaagcaaaaaagcaaaaacaaaaaaaatttttttctaatcgagtcgtgcacatgtgaactaaaaaaataa

SEQ ID NO: 7856 - DNA, 879 bp, Candida albicans
aaacccaccagatcggacatatcgaatttcaatgcaacagcccagaatccaaatcgcctgccagtacaaagagttggtatggcaagggctttggttggacaccaacgtcagcaacaattccaatcagaaaaatcctcaatgtataaaaatggcaatccgtcgttgtattctcaagcttcagctgtaccacaattgaagaatcgtccttcatacgatcaaatgaagagtttaaataaacgctcttcacgtcagtctgttatatcaaaggattctagccacaatgatgatgatatgatttcggtgttgtcatttgatactatgaatttgccaatgcatgatgaatcggactcccaacgtttcaaccaacaaatggaggatttcaatgttgatgattatcaggataaatatgatttaaccttagaattgcaaggatcaccgtatttgaaagaagggttgttgaaattgaaaattttaaacaatgattcagttgatgaaatagatggcaactctaatccctcggcatcatctacaccagctaatcacggcaagttcttgtcatttttcagtagaccagctaattccagttcttctacttctaacatgaacaatcacaaatttactgaaaattttgtggttataagtaaaggagaattgtcattgtactcatttgatccaaaagttatcaaaaagttcaagaagagaaatggccaccaacaacaacaaactgaacccgatgacgatgacattgttggcgatggtaattggttgaaaaacgctgccaagattggtacctacaatttatgctctacttatgctgatttagaaaagacaacttctcaaggtaatcttcaccacgggcctggccggatccgaacttaa

SEQ ID NO: 7857 - DNA, 240 bp, Candida albicans
  unsure (10): Identity of nucleotide sequences at the above locations are unknown.
gcgggtcttncagctgtggtgaagacaggagatattaagttgattagaaatgtaaataaacaaaacaaaaaaaaaaaaaggaggaaaaggaaggagatggttatgattatatataatagatttcgaatattatgtcaaagtgttagcttcacaattcacacgatgaacaaattaaagaaagaaaatttttgtttattaatcacgaaaaataagcaaaagtattattattctattgggtag

SEQ ID NO: 7858 - DNA, 1119 bp, Candida albicans
acttccaacaaaataaggggtgctccatattattcaacaattggatatgtagacttcaacactgtgaggaaactaaccacaaattcgtcgtttttgttcagacgtaaattaactcaaccacccaaaacaagcaacgctttatcccgggtattcactagaaataagtcatcatctaatatttcaattcatccttcttcaagcgatgatgatagctcaccaaagacactccgagaatctacatctccatctgaatcaagcaagagtgttagtggcaataagttgagaattgccaaaaagttgaagtttcccaggaatcaaagcagtcggaaaccagatttgtttttggatactagtagcacaataagcgaagacagttcttcgtttcgaaaaataataactggtaatctgttaaatgagataaataaatcaagaaagagctcaatgagctcacccatgagtaccacatttcatagtttgtttcatcgatcccatcatagtggcagcaaccttcaacaagataacaacctagctgccactggcacgacacttttgtccggtaagtttgatgatttgtcaaaatcatccaagacaactttatgtctatcctcaaatagttcgaattcaataatcagcaatcctgaactagctcagatatataatttcaccaacccaaatatttcaattgaggatggagaaaccaatttggatcatataaacagttcatttttggatattcataagaaaatgcttgtgccagccgatctgtttattcagaataagctaaacaagtaccaccaaaccgaagtagggttgggcatatacgaaagtgatttagatcatgacaaagatagtaagatatattccaacctttatcattacttgagatcactatttaccccatctttttcaatatccgactctggtcaaaagagtaaaatgcatccaatattgggtgctagtgttgaagaaattgcaaatttcgtaaaggagagtttttgtttacaccagcacaaccccaaaaaagttttagaaggaaaacagatccagtggtttccactgggatttgaaaaaggtaaaggattggaataccggccgttatcaatttggttgaaaaattga

SEQ ID NO: 7859 - DNA, 408 bp, Candida albicans
gtgcaaagtgggggtacgagagccaccgctgggacggtttatccgatcctgggatacggttgtgccggttgccaacgcttgtaccattctctagtaccaacttacatcctggggactggtctactgccacccttggccagaaaatctgggctggcgggaacaagggctggggctgagatcaagcttgggccagagccagagccagaaccagagccagagccagagccagagccagagccagagccagagccagagccagagccagagccagagccagagccagagccagagccagagccagagccagagccagagccagagccagagccagggccagggccagggccagggtcaatggctgacgtccctaagctcaagggaaatggccaatcccagagcagggtctaa

SEQ ID NO: 7860 - DNA, 216 bp, Candida albicans
  unsure (41): Identity of nucleotide sequences at the above locations are unknown.
gcgggatttgcttgcccgtggggaagactgttctatataanaatcatcaggtctgctcaagattctactgcaaattccacttctggattatctcaaactgctgatcagaatgcgtcatttcaacacatacacacacacagaaaaaaatataaacaaatcagccaaattttttttagacaaaacaaaacaatacaattaaaaacgaaacgaaaataa

SEQ ID NO: 7861 - DNA, 396 bp, Candida albicans
ttaagcttattatttcagttaattctccaaatttacataaaacccataataatagtaataaaccagacacaaaaagtagtatacacacatttatataaaccactttcaacaattaataattaccaaatgacttcacaagcacctttacaagaggatacaggccaagatatacaatcgcaagaaccatatagctcaagatataatgtagaattagtcgacacattcagagaattcaaggaattcatagactatcgatttgaaggtttggttaaatcgatgaattcattagaagaaaggttacaccagttagatgttaaactaaaagcatttatgcaaaaacaggaggaatactttgaaaaaattaccgttgagtctgtaagtaacggaaagaagtaa

SEQ ID NO: 7862 - DNA, 243 bp, Candida albicans
aacgataaagtcatagaaaacacaacaagaaaaaaagcaatgtgctgtccatggtttccaccctattccaatcgtgatatgtttactattgtagcttgtcatgttgtaaatggggtagtttattataccgtccgttataaaaatggtcaatatcagatattcccagagtacactgtgctaatatatgccccagacgaagttatgagatatcattttaataatggtctggtggattatcaatag

SEQ ID NO: 7863 - DNA, 192 bp, Candida albicans
cgaattacattacatatgccaatgtggcatggtaggtttatatctcgtaagattgttaatttgaaattccaaaatcatatgagaaaatgcaattataatttagaatatggcagttttaggagacaatatccctcaagatgcttgaggcggtccaatgtcatctttgttgttctagatacttcttcactctaa

SEQ ID NO: 7864 - DNA, 192 bp, Candida albicans
tttagctttgctaatcgtttatctttattaggtctagatatgaattacaaaatacatgtgtatcttgccattttatatacaaataagatttatcttggcttaagaactatattgagctcgaggtttaatgaccaaaaaaaccaagcgattcataaggaaaggaacaccagaaatttacaaataattatgtag

SEQ ID NO: 7865 - DNA, 261 bp, Candida albicans
ctcagcagattaacaagcagaacatattgtcattatataatcaaccgactggcccaagcattcacccaacaacagcaaccacagcagcaacagcaacagcagccacaatataccaatacagtatatgtacaacaacaacaacaacagcaaccacaacaaccacagcaacagccgcagtttactggatttggccaaacacaacaaacaggatatatgtttggacagtacccacagcagcaaaatggttattggagacagtag

SEQ ID NO: 7866 - DNA, 198 bp, Candida albicans
gtaatacacccacaaatgttgagaagttttcattatttggatttgctaaatggtattaagtccggtgatatacaaacgagaaaatactataccaagaagtatgggtttggtaattttcccatggcagggtttatttgggtgggaaatgaaaaatataaagtctttctgaataacccaatcatattaaagttcaagtga

SEQ ID NO: 7867 - DNA, 186 bp, Candida albicans
aaaaaatttttcattcttcttcgcatactaattactcatttactcatttacccttttgtccccgaaattgactcacacaaatttcatcatactattactactgttaactactcactactacttactaaccaacgcctaactaagaaaaaaaaaatttatttctccatattaacatatttgaattaa

SEQ ID NO: 7868 - DNA, 216 bp, Candida albicans
  unsure (208): Identity of nucleotide sequences at the above locations are unknown.
attatttcaaattccttatttttctttttgttttacttcttcttcttcttctttcttctttacagattcaaactattaattcaaacaaatatgatttctcgtaatttgagaacttcatcaacgaaaaccttttatggttccattttaagatcactaattagatcggtctcgacaaataattcctcaacaagcgtgattcaccacgggnctgaatga

SEQ ID NO: 7869 - DNA, 183 bp, Candida albicans
  unsure (47),(128): Identity of nucleotide sequences at the above locations are unknown.
cacccaacaatttcttttttggttaaaccaaaaacattggattcttntagtaaaataccatacctagtttctcacaagatttggtttgcattattcctggaatccattaatggacaaaatttaacttntaatagatggtgtagagatgagcacaacagaatcaggattatcctcactttgtaa

SEQ ID NO: 7870 - DNA, 210 bp, Candida albicans
gacaataaacaacattcacatctagtagtattaagattatctttatgggttgtaacaagaccatttctgttgtcaaatactgtgtataattctcaccaaagttgtttgaacgatgaacaagaaaaaaaaaccaaaaaaggttcaaaaaaaaaaacacacacgtacttcccatcattaccaggtatagacaaacaattctttcatttataa

SEQ ID NO: 7871 - DNA, 408 bp, Candida albicans
acaaacaattctttcatttataatttgaccaattcctcaaaaatgtcaatattcaagccacgtacaattgttaaacaatcaagtactttacctacagcggctgttcatgaacttacaaagaaccaacattattgtgtatcaaagttaccagcattaccttcagtgttcaaatctcaagctgattcattcactaatgcttattcagattcagaatcaaactattcattagtgattaatgaagattcaatatttgtttggtgttacaaatctactgacgcaactccattatctattgaattcccaattgataaatctatatttcaattaccaatggcgattttgacaagaccatcaagcggtactggccaagacccaggattagttatattagattctgtttcaggatta

SEQ ID NO: 7872 - DNA, 201 bp, Candida albicans
gagtgcgtgttggacaatcaaatgaagaaaatcaagacgatgaagaagcagatgaagaagaaggtgttagagatagtgaagaagttgaagaatccacggaataataaagtatattgctacatgtttatattaaaaaaaatgtgtacatataataactctaaattctggcttgttctttcactgcttcaacccaggacttga

SEQ ID NO: 7873 - DNA, 183 bp, Candida albicans
cttttccccacgcgaaattacacaaaaagaggaattgtattatcaacacaggcgataaagcaaattgaaccactaaaaaaactaagaaacaaaacattccagggggtaaaggaaaaacacgcacagttatccaatcaattaactaccattgaaccatggcgatctctatcccaagtggattga

SEQ ID NO: 7874 - DNA, 1251 bp, Candida albicans
cctatggcggatccttgccgcctcgtggtgaagatctcgtataataataacaatcataattcagatgtatcaattgatgaaaaaattgcaaagattattctgaacagtaagactagtattcgagaaaatggtagtgatattatagataatcttcctaatggggaatataatcaagaaaaacaacaacaagaagacgaagagtttgacgatgatgatgaagaggaattggatgaatttgatactaataaatcgtatttgaaatttttgaatggagaattacaagaaagtataaattctaatgaagatgataatattaatgggggtggaggtctaggtggaggtagaggtggtgatgaagattatgaagatgatgaatatatacttagtgatggagacacttttaatgaagaactgttagaaagtaatcttaatgcaagtggttatgaagatgaatatttgagtgatggagatcttgaatttgatagtgatcgatttaaagagaaaaatatattcaatgatgaggatatcaacgaccacgtcaccaaaggacatcttcatagatatcctcgaacgagactgaataagcttaagtttggatcactatcaccatcgccatcgcttctggaatcagatgaaattgatcttgtcaattcgcaattaagtaatcccccgcataataatgatatgaattggaaacaatatattataatttcattggtatcatttcttatgactatattggggtatttattgataacgggacaaatttccactatactaccgaatttattacctatatcaggatcttttgatccaattaaaatggcgaaattagatggcaaactacatcgattagatcaagaattgaaaaattctcatcaaaaacaacaagaaacattatttcagttacaatcacaaattgatcaattaaataataaaattattagtattattgataatcagcaacaacaacaacaacaacaatcatcaaggaataatgaagataaatcaaccaccaccactaataaaaaacatgaagatataataacgttagaaaataatcaaattcaaataagtccagaatttcatcaatttttatataaatttattgataagtatcaaaattcttatcttgatgaaaaattacaacaattggaaaaatttaatgatttacaacaattacagaattatgttgaaaaattaatttcaatgtcaatggaatcaattaaacaatatatactaatatatatt

SEQ ID NO: 7875 - DNA, 228 bp, Candida albicans
aatattgcagatcttgttttacaacagggtattacttccaaaaaaaaacaaaaatttgtaaaccctaagaaaaccaaaaactaccaatttaattcattctacataaactcatttgaaactatagcaagccaacaatttacgaacaatttcatcctcactattctctttttgttttgtatcacgagtttctccacaaggaaatgtattttgagcatctcatggaagtaa

SEQ ID NO: 7876 - DNA, 246 bp, Candida albicans
aagggaagggatgtaaaaaataaacagagttcttttaagaatatgacagaactcatgtgtgtgtatgtgtgggttacaaaaatggtaaccatagttgtcagtcagttgtcattcattcatgctagtttgggaaatgatgacaactgcaaaaatgttgcacccaaaaaaaaaaaaaaagaagaaaccatacttgagaaacacgttgatggccattcccacagtgagaccaaaagaatgacacaatag

SEQ ID NO: 7877 - DNA, 198 bp, Candida albicans
acaaaaataggcttacatgtattggttattcttgctcctgcatcattcttttgtaacaaaataattctacagtggctgttaataatgtttcaaacaaggcttaaacagttgttagaattttttaaaaaaaaaacagccacaaatgggttaaggtttaaaaatttccaaaacccccttattttcccatatcaggaatta

SEQ ID NO: 7878 - DNA, 1095 bp, Candida albicans
cccctcttctcttacaacaaaatgcaaaaccaacctccaaaccaactggtatatctgcaagatggactgttgggagcagaaaatagtggccattctcaaaagaaaatattgccaaacacaagttctaagaatgagcagtgtgctattggtcctcctgcaaccacacaaggattcattcaaaatacaacgcagttaccccttgttcttcaatatcctaccattttaaaacatcaattcggaatttcttcatctaatctgccacaggtgcagcaacgacacattattaattcacttccagtttattcacccaactttaattttttctattcaaaacaagcaccaccgcctccaccaccaccaccgccaaccctaggttatgttgttttaccaaacacaatagctgaacgccaaactattgcaacctttcaaaaagatagaaacaatcctaaaccaaacaaaacagaatattcagaaactttcatcccggttcaaccaaaaggtaatcccaaaccaaagatccatagaatgaaagagaaatatacaatagagaaaagtcttgagtcatattcatttggtgaaattagaaatctattcaagagcaaaactggtctctctgatatgcattttgcaacaaacaggattgaggatgttcgagaaaaccagttaatcaactactttagttattccataggaaaagccttagatgtatttgcctcacatgaaatctattctcaaatatttattgaacttgctttattagatgacacaaatgtcattttgaatggtatattttgtttggcagaatatgaattatcaaaagaagatttcacaaaatgcatgcattattatgaaacaacgattgcaattattcacagtcagatacaagacaaaagcgaaaacagaccattgaaatatagatgtttaatggcaatgatgttgctttgtatatttgagaataaattccctcaaatcgagttgtctcatttgcaacattacaaaaacatgacagttgaattattcaaaaaccaaccaattgacgaaatcagattggaccctttttcacccgccgtagaaggacattgtcggtcagggggg

SEQ ID NO: 7879 - DNA, 582 bp, Candida albicans
acaactcaaatacttttggtgatggagaagtcactccaggaaactctgataccaaagttaacatttaagaatgatgaagatgtagaaaatgaaaacagaactgactcatcaagttttgacgatgatatggaaacaatttcacaagataacgaggatggtgaacaagatcgccgtaaccgtcaagaaacagcaacagaagagaatgcacaagaaagtgaggcaccacaatttgaaaccactattattgaatctggtgaaactgaagaaagagacggcgacgatacagattcgggtgagttatactcagaacagcaacaaaacaaggaaaaagaagaaactgttccgggtactagtaccccaaaaatacctcaacgtccaccaaagaaactgtctttatcaagagcaacaaccaatgattcgttaacatcattgaatagcacttcaaaaccaccaaaaccagttatctcgaaaagaccaactactgaggaatctttgtctaacatagagccaacaataccaagcagaccagcaattaatcaaattccatcagttggcgacatcccaacacgagccacaagttgc

SEQ ID NO: 7880 - DNA, 276 bp, Candida albicans
atgccaggaataaagaaaaacaggaaaacttacaatcagtctagttttagacgagtactacgatcgaaacttaattcaaatgagggatcaaacacagttggaataaaatccgataactgtgatattttgatttacttgatatatatgaactatgttaatgagctaataaatgaaggtgcaaagtctcaaaacggtggtgctggtgaagaaggagaggttactgaagaacgtctaaacaatgcaaatgacaaactaatcaagaaatacagaggatga

SEQ ID NO: 7881 - DNA, 615 bp, Candida albicans
atctacccatgtactacaagtactgaaagtactcctgctactgagtctactcctgcctacgagtctactcctgctactgagtccactccagctaccgagtccaccccagctactgaatctactccagctactgaatctactcctgctactgagtctactcctgctactgagtctactcctgctactgagtctactcctgctaccgagtctactccagctactgaatctactccagctaccgagtccacaccagctactgaatctaccccatgtactacaagtactgaaaccactccagctactgaaagtactccagctactgagtccactccagctactgagtctactcctgctactgaatctacaccagctaccgagtccactccagctactgaatctactccagctaccgagtctacaccagctactgaatctaccccatgtactacaagtactgaaaccactccagctactgaaagtactgcatccactgagacagcttcaagtacaccagttgagtctacagtaattgttccaagtacaactgttataacagtaagttcgtgttatgaggataagttcttcactcacagcggctggaaggacccacgctcc

SEQ ID NO: 7882 - DNA, 1434 bp, Candida albicans
agaaatacacgaccatctatcacattcgcttgctttttttacacactaaccactgagagacactcacaacgttatcgattattgacaaagagatttttccggtatagaaaaagagagtgcgaaaaaaaaatgaaagtttctcaaattttaccattagctggtgctatatccgttgcatcaggtttttggattcctgattttctgaacaaacaaaattcaaattcctacccaggccaatacaaaggcaaaggtggctatcaagatgactgtggggatgattacaagaaaggttataaaagcaaaacctactccaaggtcaagcccattactagcactgattgtaccactccaattcaaccaacagggaccaccaccgggtatacaaaagacgttgttgaatctacctcctacacgactgacactgcttatactaccacagttataactgtcaccaaatgtgatggcggttcttgttctcatacagcagtaactacgggtgtcactatcatcaccgtcactaccaatgatgttattactgaatacactacttattgtccattgacatcaactccagctactgagtctacaccggctactgaatctacaccagctattgagtctaccccatgtactacaagtactgaaaccactccagctactgaaagtactccagctactgaatctacaccagctactgaatctaccccatgtactacaagtactgaaagtactcctgctactgaatctactccagctaccgagtctactccagctaccgagtctactccagctactgaatctactccagctactgaatctacaccagctaccgagtccacaccagctactaaatctactccagcttacgagtctactccagctaccgagtctactcctgctactgaatctacccatgtactacaagtactgaaagtactcctgctactgagtctactcctgcctacgagtctactcctgctactgagtccactccagctaccgagtccaccccagctactgaatctactccagctactgaatctactcctgctactgagtctactcctgctactgagtctactcctgctactgagtctactcctgctaccgagtctactccagctactgaatctactccagctaccgagtccacaccagctactgaatctaccccatgtactacaagtactgaaaccactccagctactgaaagtactccagctactgagtccactccagctactgagtctactcctgctactgaatctacaccagctaccgagtccactccagctactgaatctactccagctaccgagtctacaccagctactgaatctaccccatgtactacaagtactgaaaccactccagctactgaaagtactgcatccactgagacagcttcaagtacaccagttgagtctacagtaa

SEQ ID NO: 7883 - DNA, 228 bp, Candida albicans
gccgttaatagtgaaaatcattccagtaagttctatttgataaggaaggtgttcagttcatttattcaaaacttttctcctaaccaattgaatcaattttggggtttctcaaaacaatgtaatatcaaaagattgtgttcatttcggaacaatgacccaattctctggaaacaaaatcaagctattccaccttatatatatgagtccaattcggagctattcttctag

SEQ ID NO: 7884 - DNA, 189 bp, Candida albicans
aaagctattctttgtaatagagatggagataaagatacaagtgagtcagaaacagtacaccggtaccggcatcttattactcacagtttgcattgccaatcaaccgataaagcaacatgttctaacaatttttatgccgatggggagcaaattccggctatagacgcaccacctgattgttcttactaa

SEQ ID NO: 7885 - DNA, 237 bp, Candida albicans
ggattacaagatactacccatataatactctctaattataaacactctaagaaatttctattgttgtgttttagttatatactaagatataatttatcatcaccaccaccaccaccaccaccactgtggttactttttcattgttacttttatatttatatttacatgcaagttatgaagatatataccaaaaagaagtctagaaaattgatttcctcgtcaaacaataacaattaa

SEQ ID NO: 7886 - DNA, 330 bp, Candida albicans
tgcaactcaatcttttggattccccagtgcagttttatccgttggataaatttaatttctgatgatttccgacaattattatatgatcaagatgaatttgctcttagattattatttgtgttttctagtttgtgtttatatgctggatttagtttgaatgatgaattcaatatttggaaagattttatagattggtataaacatgatcaagaagggaaatataatggacaattcaagtatttgatggatgggaaattatatcaattgataatagtggagaaaaaacgatgtaataaatttaaagaatttcctgaactagatgttaattaa

SEQ ID NO: 7887 - DNA, 276 bp, Candida albicans
gttgtgtcaattctagtaaacatgtcacagactttaaaaaagagatgcggtaatagcagcggtaggaaatcgccaacaacttctaacattgaatttgatgataagaaaactgagttcgatttgaatgctattgttcctccaaaagaaccagagtataaatacttggcagctctaactttggtaacccttctaccaatttaccctagattcacaaaactaggcactccaaataaagttgtttttgatgaaatccattttggtatgtctgcgtcctaa

SEQ ID NO: 7888 - DNA, 321 bp, Candida albicans
aagttgttggcgatttcctaccgctgctattaccgcatctcttttttaaagtctgtgacatgtttactagaattgacacaactcaatcgtgaaggaattggacagttgaagaaaacgaaaaacgaaaaacaaattaaaaaagaaagaagtaacaagaatggtggagatctatattatattatttggagagagagtttttcagaaaaaaaaatttcagtgtgtgttttatcagacaatgcgaaaacacaacacgtaaaccaaaatagacaaaaaaaaaattattcaataataataccaactaaaagttgcgtgtcggcttag

SEQ ID NO: 7889 - DNA, 192 bp, Candida albicans
attgacgatggaatggcccgtaattctttgtcacgtgcatattgtgtacaccaagaaatttcacaatctttgttagtactaataaaaaatgaccaagggagagaggacaactccaatcaagtatcaccattcacctacaaaacggttaaattaactacatgtcatttgtcttgggaatgtaaatttagatga

SEQ ID NO: 7890 - DNA, 234 bp, Candida albicans
caatacgttggttcattattacctgaggaagatgaagaagatcctttagctccgctagcaccagtagcagtagcggtactagctccagttgacccactatttttcgtggttgtggttgaactcgttgttgttgtggttgctgaagaagaagttgttgacgatgatgacactgttgctgtagttgaactaccaccaacaagatttcctgtagttgttgtctttagtttaccatga

SEQ ID NO: 7891 - DNA, 651 bp, Candida albicans
aaaagtaacatcagtaacagaatgaattttaacaaaatgtattttaacaacatagattttaacaaattctatgaatatttaaacgataattacaatgcaagattattttatggagatttaaccgtattaaaagataagttaaatgcaaataatggtcaattaactgaagaagaaaaggaattattaaagaaaggcatattgtattctgttgacactgcaaaatgggtacttgataatatggatgaattccaagaatattgcagtgcatcattattaatacataatgaattaaatattgaattattaaaagagtatgaaccagaaacattgtggtatccaaaaatacctactgaaaatacattaagagaagcattagaaataagaaacaatgaaacttttatttataaagttgcaaaagcatgtataattggaagatacctatactgttttaacagtttaaatgtatgctgtgacaaaagtttgctaaatatgtgtagagaaagatcaactcgagtgtttcttgatgtatacatggataaattctatgatagtaaatatatgggtgatgtgttacgaattggacatatagatgctcctgataatgaatctgaatttttgaaagtgtatgagaacgagatggaaaactataat

SEQ ID NO: 7892 - DNA, 1134 bp, Candida albicans
ttgatttcaccagcaaaaattggcagggcaaataatcatgggatgacgaaatttttattgatgccattatttgattcattaactaacatgggtaaattaaatgaatttgtcattgcattttggtatgctatgattaaatggggtggattacgtataaatttatcaatttttaataataataataataataataataataataataataataccaccaccaccacccgcaatgttttaaatggtgtaatcaaagactcggaaactttgtcagtatcaaatatggcagcaggtaacaagttagatcgttcagtgattgatgaagtgattcttggaatatttattaataaaataactgaatatggacgtgaaaaaggattaactaaaactcatttaatcatggaattatttcaaactttaatatcaaaagatttaaatcctcctcctccttctcttgttggtaaagataaagataaagatagaatacaaattcaattcaaatatttaatgagaatttggtgggcgattcatgatgatttagaatattatcatgcctataatcaaaataataacaataacaataatagcaataacaataacaataaagttgatgataaagatttacgatttattcaattggaacaatttttaaaaaatttaattatatttaatgatataaattatcaatggtcaagaaatttattaatgaaaaaacttatacctgatgaatttattgatcaaataaatcgaattttaataagattaaatcatttaaattggtttaatattggaaatgaaaatgaaaatgaaaacaaaaaaatttatttatataaattaatgttaaaatcatcaattaaattattaatcccacaaagatttattactgcaaagaaaaatggaaacggaaacacaaacacaaacacaaacacaaacacactggtagttgtgtccacttatcctaaattaatggaacaagaaatatttcgatatatatttgttaaattatctaaaactgataatttaactgataataatatcaaattattaatggctcttaaaaaatatagaaaggcaaaaccttataatgatgaagaagctgttcttgcacctacggggctggacggatccgagcaggct

SEQ ID NO: 7893 - DNA, 237 bp, Candida albicans
  unsure (60),(70),(114),(117): Identity of nucleotide sequences at the above locations are unknown.
acctgtattggaaagtccattttgcaaatacaaatagaaagaatgggaaatcgtgtacantttgaaaacnaccacttgactatggaaagaggaagaacattgaggaagagatcntcncttggtcgttccctttttttaaatgttaatggcattgaaccacttactaacttattatacgctcaccttttacaatgtttgaacgagtttcttctttttccttaccacaaaaaaaattaa

SEQ ID NO: 7894 - DNA, 192 bp, Candida albicans
ttttcaaataatttgaaactaaaactaagtagcaacaatgcgaagggcaaaaagttccaaaaaaaaaagggccaacagaaaaatagtagtttgttcattactaacaaatatttaagtatttttttttttttaagattatacgttaaaggaaaaataaaaaatacaaagtttcaaaggattcaaaatttttaa

SEQ ID NO: 7895 - DNA, 183 bp, Candida albicans
gtgatttgcgacaactgtatggctggaggactaaccgtcaatatgaacgcaacaattaagaaaattgggtcatccaatattgatgccttgatgtacttgacacacaaggctattattggcaataacaccgcactgggcaagatcattcgggataacaacgacccaaatagtattctgttgtag

SEQ ID NO: 7896 - DNA, 306 bp, Candida albicans
tggcagagttgttcgtacatttcaagcaagacattttattcatgcagtacataccttacctgtattaatcaacgatatccagttgattataatcaatgttattatggaggttcattacaatatatacaaatggcattatttattaattcttcagctaaacatattgccccgtttgccacgaaatcagtagtgaaattagtgactaaagcaataaataatggttattataaacatgaatggtttttgaatatgaaatatttagaagatcgattagaacaaaatggaactgggttttttcgttggtga

SEQ ID NO: 7897 - DNA, 255 bp, Candida albicans
  unsure (211): Identity of nucleotide sequences at the above locations are unknown.
aacccaggaaaaaaaaaaagaaagaaaatgaatccagctactattatcactaactttaacaattctcaattgcaaaccccacccacttcaccagttagttttgataaatactacgcctattataacattcagttagaacaatctaaattaatgcctcagccatcgaaaataaaaaatggtgatccattcacttggtcagatatacaatttnttgtcttcacgcagacgggatgggcggacagcgttccagggggc

SEQ ID NO: 7898 - DNA, 225 bp, Candida albicans
  unsure (6),(42),(114): Identity of nucleotide sequences at the above locations are unknown.
tcattnataatccttggtggtggtgaaggtggtgccatgatngtcgtaagtatattgctaagaaaaaagggtggttgttgtttgttaggtggtttgtttgttagtttgtttgtngtattcaaattgaattatcggataaccaaaagaaaaattcaaccatctaaaaaaaaaaccatggctcacactgttaaagcttattgtaatcactactactactactactaa

SEQ ID NO: 7899 - DNA, 756 bp, Candida albicans
accttattttctctctctctctctctaatgtcagtgcctatcctaactatccctgaatcatcatttgatccagcatcttataataatcttaatactgcaaatattacaaaatcacaatcacaaattttactttacattataaaattaactagaagatcatcaattggattaatattattctatatattgggattatttattattaaaccattaatggaacttaatgtcactagaagaaaagattatttggattatataagaggtaaattacgagatttttatcttaaatcaattactaaagttcaatatattcctattgttgccattaaaaataaacaaactgggaaattatattctgatgccattattcaaactgataataataataataataaattatcaacaaatagtactggtggtgatgatagtgatgatagattgggtcaaaatcaattatataaaaaattgacaaaattatcacttttattaactgaaggaattcgaaattattcaacaatagaattatctaattataaaagtataaattattctattaaagatttacaaaataaatctgatttagtttattttaatcaaaatgatttatttgtaatggataatggtggtagtggtggtggtggtgttagtagtattatgacaacttcagggaatacaatgaaaaagaaagatcttgctgttgaaattaaaaatgaaattagaagtattaaaggattatatatgagtggacaagtataa

SEQ ID NO: 7900 - DNA, 225 bp, Candida albicans
ccagaagattgtaccggagcagtcaacggagcactttcttgtaagtttaatggaggaagcactaatgttgtcgtagttatggaggaatttgttgaaggattgcgtattggggttggtccattgctagctgcttgtcctccgctagtgggtaaggaacgtgcatgtgcatctactggtgtaaacaagtttgatacactagggactgagatcaattgtggttgttga

SEQ ID NO: 7901 - DNA, 189 bp, Candida albicans
cttttgccaacccagtcagtgctcaatactagaatgtggccaatgaggttaggtgttaattggattacttacattgatgtggttgatattttcaaaatagtcgtgttattatgcacaaaacgttttgaagccttacaagcatttggagacaatgaagacatgagtgtcaaatatagtgtcctcaattga

SEQ ID NO: 7902 - DNA, 228 bp, Candida albicans
gaagatcaaaaaagaaatgatggtttattaaacgacgtcaatgttgaaaaaaaaatgaaggacaaaaactcgtacaggaagttagagagtcattcatgcaaacatggtagtaaagggaagacaaaaaccaaaatccgggggtggcgcgagtttgtccgtgacaaagaaataataaatacattgaatcacacacacacccacatacccacacacccacacacgaactaa

SEQ ID NO: 7903 - DNA, 312 bp, Candida albicans
  unsure (15): Identity of nucleotide sequences at the above locations are unknown.
tgccagtttagtttntgggccggtcggaaactacactttttagattccgatgtaagacaacaactagtttatgacagtttagctataaggttgtcttgtagaaatgattttcatgtgggtccatctcggcccccccccaaaatttcaacccgaggaggaaaaaaaaagaagtgcgtgcgtgtgctagagaataccgcttggcataggacaggacatgcgcgttttattttccaatgtgttggttgctggaagggatggagggagcagcaacaactcaattcctattcctattcctaccgaaaaactaactaa

SEQ ID NO: 7904 - DNA, 261 bp, Candida albicans
tatgtattattattgatgtatgtggaggttagtgtacgaatgatcaaaaaaggaaaaaaaaattttcgttttttagttcatggtcaaatttttggactaaatatattgatgtgtctattaacgcatatgttgttaatacttttgtatatatatttaaatatatataatgtaatgtttgttaatatatatatatatattatagaattccctcaatacatatataatctcatcctttctctaatttttttacaatttctttaa

SEQ ID NO: 7905 - DNA, 183 bp, Candida albicans
cactgcacgacacatattatctcttctgagcatcgaaaaagtgacaaaaaaaaaattattcacttaactatctttacagtgaagttagtttgtattcaatattcgaaactagttgaaagtccaattaactacgatgacaagcctggaaataactcaggaggctatatttattggtgccaataa

SEQ ID NO: 7906 - DNA, 264 bp, Candida albicans
ttattgtattattcgtattattacaatcacaataggaactggttagatacaaaaatctttggtgatgatgtcaatagttatgtgataatctacatgatttttttggagggaacagcaccaacgatagaaaaagaagaaaaaaaaagtaacgacaagtttgtgtttggtttgatccttacctgtagggcggagcggggtaaatttccttcaacactaaaccaacatcaagcaaaaaaaaaattaaggcttgccccaccatcataa

SEQ ID NO: 7907 - DNA, 231 bp, Candida albicans
cggttattcacgctattaaatcaatcacctagggtagggttgtggagcgttcttttctttgatagtatcattttaaagtttcacccactaacgataaacaaaaacagtagattcattgtttttgacaataatataatgatagtaataatctatgaaacagcaccctatcagaaccagaaggaaaaagaaagaggaccaagaaattgtgctctcatagtaaagaaattctga

SEQ ID NO: 7908 - DNA, 351 bp, Candida albicans
ttattccaaaaacataacaatatgaaatcaattgcaattatcaccattttacaagttttatttactcaaatcaaagcaattgcaattgatgaaagaggtgttggtattgctaatgatgatgatcaacaacctaaaggtgctccaataggtgctacatctcaatttgatccttattccaatatttcaccattatcagtaaacaatacaacaacagcaacaacattgtcaaccaccaagatgtcaatggcaagttctaatactattactggtgctactggtagtactaatattcaatggaaattattattaggttgttttttatttgcaattgtaagtttacttgcaatgtaa

SEQ ID NO: 7909 - DNA, 717 bp, Candida albicans
attcacatacacatgttcaatacaactgattcatcaagaaactatctagtaattgaaaatccatctgctaattatatttcagacaaagaggaagaaaggtatagcaatgataatgatatcgtccacaacagtagcaactattatattccatcgttagatgatatctcttcaatatcaacatcagcatcttctcatggtactacttttttcagcaacaaccaactgaattcaaatagatatgggacgccaagatcgctctcaaaattgaggtcaattgaatctgagatcgataatttgccattagttttcaaaacaaatatttggtcaaatgattatctggttacccacaacaaaactgctaatatgtttgctaattttacattggaaactggaaacgttgcatgtagcttaaatactgcaaattgtgataaatctcagttacaatacaatgatgctagttatgctgtcaccacgccccaagtttctcccatcggtaataacccaattgctgctgcaggcaatagttcttgcacttttgatagcaccacacctggtataaatgctaatgctgcctgttttcaagctctgcttattcaccacctccccagttgtcttaattttagaaggtatactggtgctatattcacagttccaaagacatctaaattctttgtaattaaatcttacaatattcttgatgtcaatgcttctttttaa

SEQ ID NO: 7910 - DNA, 186 bp, Candida albicans
aatttttgtcagatcatgacatcagaaaacatatggcaaatgagtaagtcaatcagcataatccaaaaggctcatagtcttagcattagaagagtagcaaacaagtcaaacggatatatgcctgtttattggggtatgacaacaacaacaacaacaacatcaaagtacgtacgaactgattgttag

SEQ ID NO: 7911 - DNA, 234 bp, Candida albicans
catttttttttgtctacttgtagtaacaaacttaaaggggagagagagagaaatttggggcccccactgaactttgaccaacaaaaaaaaaaattaaagcacaaatttcacaaatgtcattttcgttccttgtcatttcatttcaaagcaatcaaactaattcttcgtttaaaggttttcaatacctattgtaattttgccttaagggagaaaattatagcaattttccaataa

SEQ ID NO: 7912 - DNA, 201 bp, Candida albicans
ttcaccaactaccatattggaatacaaagaatatatcactccttcaaaacaaagttggttgaattagtgatccttagatgggggatgtttgtgttggtatcgtttgtttgtaaaaaaacgaaaaaacaaaaatacaaaaaaaaaaaatttagttacaagaatactaaacaaactcaaaaaataacaaaaaatcgtttctga

SEQ ID NO: 7913 - DNA, 273 bp, Candida albicans
tatgtgcagtacacagccttattttttgtattttttttggcggccatgccattacgaatgtccatcactggggcgcagcctcaattccaactcatattctcgtggaacgatcatgttgtagggggagaccctacaaaaaataatatctgtcatccatcttatgcatgtccatgttccaaactaattttttataacgtattcagtttgttttatttgttatttttaaattcctactctgatcccctcctttcaggtcatttaagatctgagtaa

SEQ ID NO: 7914 - DNA, 315 bp, Candida albicans
gaatacgctcggtaccgaccagctccgaggtggaccacaaacgaaaaaagcagatcttttattggcggtttatcaattgtaattcacgccaacaatggtaccacattgaactgtgctaatatcactttgcttgacgagggacacggcaatgctaacacaactatgtcaaactcatcttcatcatcatctcaaagtgcagtcaacacttcttctagtatggcttctactgctcctcaaggtaatggcgctgagagagcagtagtaaatggtctcttggcagcaggtgtagttggtgtcattgctgccttgatttaa

SEQ ID NO: 7915 - DNA, 186 bp, Candida albicans
cagatgacaaaattccgcacacaaagacagtgtcaattgatagatgcctacactagatacaacaagaatttggtttacttgggtaatataatgatatttgaaaatagaatacctcacgtttgcttctcgcatgctttttcatgtctgtataggataatgaaagtgttgattgtaagatgtagataa

SEQ ID NO: 7916 - DNA, 189 bp, Candida albicans
atctcgtatttgatttgcacatacatgagcctctggattcatttactaaacttgcttattgtattcagtagttcaaatttgagctcgagtaatgtgctactgtttggcagcattatgctaacagcaaaagctgatgaagaaacaagtatcggttgtgccattttaattatatatctctacataaagtag

SEQ ID NO: 7917 - DNA, 207 bp, Candida albicans
  unsure (167),(182),(189): Identity of nucleotide sequences at the above locations are unknown.
cccatattaatgtcaacgtattctataccctattacaatcaaatgaacggaaattacaataacggtatgccccagcaaacaactgcagccaatcaacaggcttttcctcagcaacaacaaccaacaacaacaggcaatgctagccaacagcaacagcaagcagctgntacggcagctgcacntgcatcnatgtgcccaacggcctag

SEQ ID NO: 7918 - DNA, 186 bp, Candida albicans
  unsure (24),(25),(28): Identity of nucleotide sequences at the above locations are unknown.
ttcgctaggcgtgttgaagatttnngtnttggtcggtgctcaaaaaattttaattgtatcttgtgtgtttgtcgtccttgttttagttcatctgattggttgatttatgatcttgctttgcaaaaaagaataactggaggaagtgtgaaaaatcttggacttacatttgtcataaagaagagctaa

SEQ ID NO: 7919 - DNA, 276 bp, Candida albicans
ggcaacgtaataactcacaccattaacaaaaaggagcctcgcatgatccatctacatgtgttgatacagatgcacaaaatcaaaataattgatcaacatgaagctcatcattatggtctagcatcaataaaaagtcacactagattagcactcgttttttgtgattggttttactatacacacagaaaaatacaacaacaccgaaacaaatataacaacaacacgtgtggtgataacgtcaaatgtgcacaatttaaatttagcactgaccgataa

SEQ ID NO: 7920 - DNA, 186 bp, Candida albicans
acatttattcaagttttttttttgtcagcttctttcacaccgttgttactcgggcgacaaaaaaaaaaaatgagtcaattttcgcaacacagtaaaaatacagttgatttatttttttcttatactacatctataacgaattccatttttttatcagcgtctagatatgaatcacagatcaaataa

SEQ ID NO: 7921 - DNA, 204 bp, Candida albicans
tttaaatcaagtgttcaaaatggtgggaaatttttatggacattgacttcaagttctttattattaggagttcctttagctttagcaattttatccgaaactcaattacaagaaatggaaagaggtatgtcattagaaaaatctgctcaagatgttttagctcctggatctgaagctgcatttggaaatgaaaataagaaataa

SEQ ID NO: 7922 - DNA, 279 bp, Candida albicans
tcattatataataacaacattcggttaagcaaaaataatcaacataaaagaaaaattatgagtacaccggtgaaaaatgattccataactgccacttcatctacttcctctagtactcccagccaacctccaatgcagaataattctccgtatcctatgcaaccaatacctcaaccgccatcatctcaacaacagcagcaacaacatttgcaacagccaataccaccaattcctgtccaaattatgccacaacctgttcaaccacagctacagcaatag

SEQ ID NO: 7923 - DNA, 252 bp, Candida albicans
  unsure (69),(173): Identity of nucleotide sequences at the above locations are unknown.
aatttttccactttgggaacacaacttgggaataatggtcctgtttccaactactccagggtattcctnttacaaattctacaacatgctcctgagtataacaacattatactctctcacaatcacctcacgttctatttattggcacaacaagttggagatatcctacccgngactcctccccaatctatattatatacatgctctcattatacagcttacacctctcctctgtgtaacatacctgtgtga

SEQ ID NO: 7924 - DNA, 237 bp, Candida albicans
actgattattatcattatcattattatataaactattggagaattccaatttttttttatataatttttaatttccaaagaatcaaattattgattgttacagccaagcttcaacaacatcaacagattcaaacaacaaaaaaaaaggaaatcattcactatatttcccgtcctcccgaatcatcttctacaattataataataattaatcattatataataacaacattcggttaa

SEQ ID NO: 7925 - DNA, 315 bp, Candida albicans
aaattatataaaaaaaaattggaattctccaatagtttatataataatgataatgataataatcagttcatcaatgaaaataatattaaaaaaaatacaacacaaatgaaagtagataatataaagtatgtagttagtagtagtaatgactttattggaaagatagtaaatgatactaaatttgggatatttagaaaaacgagtctaaaaatttttcactatcaccaacaaacaataacaccaagaagaaagaaaagaaaagaaagaaaactaaaattattcttttggttgcatagaacaataataataaaatag

SEQ ID NO: 7926 - DNA, 216 bp, Candida albicans
aatagagttaattcatattcgcttcgcttcgacttgttcaatattgtttttttcagttcattactattggttacgaaactatgcattaaatctcctgtcaattcaagttacaatagccagcaacaacaacaacaacaacaaacaagcaagcaagcaggcaacacccactattcttatttaactccttttaccggattttttcccttccccccttag

SEQ ID NO: 7927 - DNA, 333 bp, Candida albicans
  unsure (319): Identity of nucleotide sequences at the above locations are unknown.
agagacagagagagtaattttttgcgttttaaggactataagggcaagttttcttattttttacacacgacttttagtcctttagttctttttaagcatttccctttatttccgagacttcaaccgtttttttttttttatttattcatttattcattcattttttctttatttagattactaattattgttgttgtatttttcctctttgtgaaaagattaagtgattacttccaacaacaacactttctcaactatattcaatttagacgagaagtatataccaaaaatagcaaaccaacattatcatctctttctntcttcttggtgtaa

SEQ ID NO: 7928 - DNA, 609 bp, Candida albicans
  unsure (84): Identity of nucleotide sequences at the above locations are unknown.
ttaataataatgatacgaactcgtggtaccaattcaccatcaaatattaaggaaaaattcccggctttagttaaaccaacgaanaagaattttgtgaatcataatagtcaacccattagatataccattattttaaaaccacaaccgaaaaagaaagcaattttgatgaatatatctcaaacatcaaatagtgattataccccaaattatataaacaatatcaataatagaacctggtcatcatcatcatcatcaccatcaatgccaatattaggcaatggcagtagtagtggtgcaggaggaggaggaggaggaggatttaatagtagtggcagttcctcatttgcatcatctagagacagttcaagtacagcattagatgataagaaatttccaacattacagaaaaaaaaacaaattaaaaaagtgataataccaagagttaatgaagtgaaagttgctgatccaaattcatggggtaaaaaacaatctcaaccaagtatcaccccaaatattaataatgatttggatggtattgaaataattgataaaagaaaacaaaaaatgaaacggaaacaagagaaattgttattcagtaatgcaatctaa

SEQ ID NO: 7929 - DNA, 213 bp, Candida albicans
gtttatttgttttcatttccttatcagcatttaaaaaaattactgatatgtaagacaaggcaacagttaaagtataacagttttaaaaaacacatttcttggttctgtagcgtcaagtataagaagattccatcaaaggcagcagccacgtcttactccaaaaataataataacaataataataatacaatatttattcaattagtgccataa

SEQ ID NO: 7930 - DNA, 372 bp, Candida albicans
ttatttaaatctagtttcacttattatttaacttgccgtgtacctatacacaacttagaactcttagccttatcaatgtcattcccaccgttagaaaatccaaatttagaaggttatgaaattgctcgacaattatggatagagtattataatcaacgtgaaggaacttttgttgcccgtaaaaaatgtaatggatgttataatgaaaataaatttgttgtttgggccgttgcggtagctgcacaagcaattgttgatggtgcaaggatttatcctgaacttaaaccattagttggtccagcaattcaaattttccaaaaatataaaaaatatcatattaaaggatatccagcagcagaaaaatcctggtaa

SEQ ID NO: 7931 - DNA, 219 bp, Candida albicans
ttaatttcagttgggaatattttaatatttcaacaaaaaatttcctttcaacacaaattacaatacgaccagggaaaaaatttagcatttgatttttttttcatcatcaccaacaacttacaaacattcttctttcttctttcttctacttctacttcttcttttaatctttattcaattccattcgttgaaaaacaaaaagagaacaagaaatcttaa

SEQ ID NO: 7932 - DNA, 291 bp, Candida albicans
tcaaatggggtttgtggagaagcacttgtatcttttgattcacatttcatggtggtggcagcgccactcaagacccagccaagagacccagcagcagagtttgaattgagattggacgatgaattgttggccgaagttgatgccgattctgggagtttaaagttgttcattgccaaaatgttgatggggtactcgctaaccaaccctgaagagttgacggtactaccacaagtctccgtcaacctcgaaagcaacaccttatcgtttgggtcatatgagaaaatcttttga

SEQ ID NO: 7933 - DNA, 1263 bp, Candida albicans
aaacaactttctgctacttacttacatataagttgcctactattatatctaatcaaaaccgcttttatacgtgcacactttttttttacagccaaaaaaaaccaaaaccaaaaccaaaaccaaacactcaataatatggaacaattttatattagtagctatatcaaattcatatgggtcataatatcccataactcaacctccacttccacttctacccaacaatcatttaaatctttccaacaatttaatactaaatatggggaatttcttcaaaaattgattcttgattctcaattatctgcaactaatttaatgattagtttatattatttatataaacattatcacacaaataatgtgttattgcacgactactgctttgatgttttagatgaagaagatgaagaagaagaagataatgaattattcaactccatgctaatatataatgtcataatatcattggtattatctaataaatcctttgatgatcagtcgtttacattaaaaacttggttaattattattgacagcacattaaacactaccactatcactaacaacaaaccattgattaatattgatttgaaattattgaattatttagaaaattatttcttatcatcattgaatttcaaattatcatttcttgatattgccattaatcctaaattttggaaaattttatcaaattctaaaatttttagtattaatcaaacaatattgaataaattcaaacaattggtaatgattaccaatcccacaaacatcaccactacaactaataccacaactaaccaagtaaccaacgttattaataatattaatcttgtgttttcaccattaccatcaacaccaatttcatcatctatgacaatgttagctacaacttataatggaattaacaacaattataaagttgttgccaattctaacaatactactatcactccattcactaattattcattaacaccagcagtagtacatgttagagatcatatacaaggttatagtcatagtcatacacattctcatgcaaggagtattagtagcaataacaacaacaacaataatttctcatcaccattgaataatatttctactttttcatcacctttaaatcatccatcaactccgtcaactccttattatgatgacaattatcatgtatgtttgaaaagaagaagaatcatgggagctggtagtagtggtcaagttccaacccattattatttaacaccacaccctaaaacacaa

SEQ ID NO: 7934 - DNA, 654 bp, Candida albicans
gttattgtgaaattgataaatattgaactcacacccgaaataaaccctgtttatgccggtgggtcatggcatgttgaaggtggaatcaacgaagatattattgcaaccgtattgtattattatgatgttgagaatattactgaatcaaaactttctttcagaaccggatttgatgatcctaattatgaacaaggcgacgatttttatacagaaacaattttcggaataaaagatgaagaggttatggttagagaaattggcggaattgaagctaaagaggatagagttgttgtgttcccaaatatgtttcaacatcatgttgatccatttgaattgaaggataaaactaagcctggtcatagaaaaatcctttgttttttcattgttgatccatacaatcataatgtcgttagtactgataatgttccacctcaacaaaaagagtggtgggatgattctagtttagattatttgttccctggaaatttgaaacaacaaatgttggacttaaaagggggtggaactgcttggccaatgacgtttgaacaagcaaaagaagctagagatgatttaatagatgagagaattgctcaaagtgaaggtgatgattatgaaggtgcattttcaagatattttgcattacaagaaacctaa

SEQ ID NO: 7935 - DNA, 264 bp, Candida albicans
caaacacccagaacaataccaaaactaatgtcagaagaattagatagaattttgtctattgaagaatcagcgatcaatagaaacaaagaaatagatcgaattctacagtgttctccttatgattattattcaatattagaaatcaatccgttgctttccaccacaactgcacaagaacttctgacaaccattaagaaattatatcggaaaaaatcattattaattcatcctgataaatctcaccacgcgggcgaagatccacga

SEQ ID NO: 7936 - DNA, 267 bp, Candida albicans
caattattgtacatagatctgttcaaactcattacaattgaatctaaagcacatgatggatatcaaagaagtataaataaacaacttaatagacaaactagctcaatttctagacatgtaaattctatgagcaccacctttaattcccatacaaaaacgggcttttttgttgtagcatctccaatcattcgcctacctcaatcaccatctgtgcgtataataaacatttgtcttggcttcaaaacggtattagtttggtctttgtaa

SEQ ID NO: 7937 - DNA, 231 bp, Candida albicans
  unsure (127),(172): Identity of nucleotide sequences at the above locations are unknown.
aggaacggggataacgtggacccggcggcacagtccaaccaagaagttaggtgggagaaaaccgactataactccctgaatcggagatcttcattcccgaaaacaattttttctttgtcatcgttgntaattcttgttggttgcttcccaatccacaatttacacactacantacattacactagagtatttaaattctttaacttgtccccatttttaatttttttttaa

SEQ ID NO: 7938 - DNA, 297 bp, Candida albicans
  unsure (259): Identity of nucleotide sequences at the above locations are unknown.
taccaatcaatttactattatacttatatacatacattcataatggcaaggaaacaagttaaatcgaaggttgctgaaaaggttgaaaagaaacaaaacataactactccaagtgaaaagtcagtagaagatattgaacatgatttacaattaccaccctcatctgatgaggaagaagatattgaccaagacgaattatctgaagaaaacagcatggtgatgaagacgatgatgaagtcgaaccccgaagatccttttnttggattttctgaccaagaaccggaagaaattcccccg

SEQ ID NO: 7939 - DNA, 867 bp, Candida albicans
agaaagatggcaatcctggtttctggaacaaagcctttacaaagcctttacaaagcctttaaccccctcttcttctacgcaaacttgctaattttcttgctagttgtcatctatagttttaattgcttagagagagaaaagaagtatccaagaagtttgataaaaatggggtcagatgtttacaaattagacaaactggctgattatttaattccagatacgtcaataattgccatcaattcacatctaatcaaacatatataccgaaaagaaatcaaaaatctaaaacagttaaaacttataacttatacattgcctgtgttgtcacgttacaaacaaacagcctttaataatcaaagtttgtttagtgatgagatgaaaagttgttatgaaatcatggagctttgtgcggtacaaatagtcacccaaataggtgcaattatcaatcatacttggaaatacggagagaatgcatctcatgttgctgaacaatttgtgtttttatttgattcaatatttcgtggtgatttgcctttagtttcaaaattgacaaatcaacaaattcgatattttttacttgaaagctttaatgatttatatttacatcgacaaatccaactaattgtttatagtatatttcttggcctagataaaattgaattaagaaatagcattattgaaatgcttgaacttaaatatggatatgagattcctgggcatttgtttgttgttgcagtttccagtctaggattacaactttatcgaaatgaattagaaagaaatcatgaacataagatacaaaagttgaataaagttttccgatggaaaaaaatagctaaggcacaaagcaaggagacccgaaggtag

SEQ ID NO: 7940 - DNA, 186 bp, Candida albicans
ttggtagtccccatttttactggtccctccatcaaaggtttttttttttctcttgaattatgttctctatcttattatttgttatttttttttatttgtattctgattgatactgatactaatgataacaatgataatactagacaatctactggatcaaattcactccacacagggtttagataa

SEQ ID NO: 7941 - DNA, 204 bp, Candida albicans
gatcaatttttacctcaattgctttggtttacaatcattttacaagtttatttcggaagattggtcatatttgctcaaacatttcagcaaattctgaataaaaaaatttccactcatacctttattctttctttaattgaaaaacgtgttttagaaaatagaactaattttaatttcagtaaggcggatccttatcaagtttaa

SEQ ID NO: 7942 - DNA, 234 bp, Candida albicans
ttggattggcttagattgtctacagcatatggcttatgggggggtattgactcacccttttttttttttttaccacaactggaaatggagttcagtggttatttgtttgggttggttatttcttattcaaggagtataactggtttgctttatctgttgatcactttacctacagcaattaatttgactttgattcaaatacccaaagagaaaagtcaactgctgactaggtga

SEQ ID NO: 7943 - DNA, 213 bp, Candida albicans
agaggtcagttagttaaccttctaccaaatgattgtagaatgttcaaaaccaatagcttatccaatgatacattctattggcagttagtaacaacatacataaatacataccgactaaatttagctcaaatttttattctacattttaatcaaagaaacaatttactgaataatgctagtccatatatagtttatcacctagtcagcagttga

SEQ ID NO: 7944 - DNA, 336 bp, Candida albicans
cttattaccgtgatgtcattttataacacaaataccaattattctccatcttttaatcaattgtcaccaccactaccaccaccaccacaacaacaacaacaacaattttcaggacatctgtcatctcctatgaaaagaaataacacattcaaatcaaaactaaaatcattgaaaaatgaattacacgaagcaatgacactgactactattactactactactaaaccaccattactgccatggtcaagaccaccaactagatcaaattcaacatcttcatatcgttcacctttttcatctataaagttatcaaatggtatcttccccacgggctga

SEQ ID NO: 7945 - DNA, 186 bp, Candida albicans
agatctggaattcgttcattttcattggtggtaaaactaattactttcaggagggaattcagaaaacacaatttaagttggattcttaatgtgattcattatattcaagtttcaaaaatagattcattggagtttcacggtttgacgggtttattaattagaatagacgtcaagtgtaagaattaa

SEQ ID NO: 7946 - DNA, 252 bp, Candida albicans
gtgaacgacattttagaaatcctcttgtcccacactcgctctacttatctttcgaaaaaaagctcaactattatagcaacttacattaccacaccttttccagtcatacttagacttactacagaatcaacaaaagtatacttcagatatgaggattacggttatattaggttttactgtatgtttgaccaatgcttttcctttggatttccccgaatggacaacaaatgcagtttcattttttaccaatga

SEQ ID NO: 7947 - DNA, 201 bp, Candida albicans
gaaaaaaaaacatcaagaaaaatattcgatgaatttttgaatgagatccagaaaaagattctcatctgcacacgaccatcttttctagagtatattgatatcagcatcgttaatgtcagactcatgataggactattcagaaaatatattcttttttttgagaaaccggcatcaaagattaaagtgaatagtttgtattaa

SEQ ID NO: 7948 - DNA, 624 bp, Candida albicans
caacttacattaccacaccttttccagtcatacttagacttactacagaatcaacaaaagtatacttcagatatgaggattacggttatattaggttttactgtatgtttgaccaatgcttttcctttggatttccccgaatggacaacaaatgcagtttcattttttaccaatgatgggtatcggaacagcgatagattaatcaaattaggtccagaaaactatagaattgtttcggagaacgagaaattaaagttgaaaagaaacaagattaattttatcgatgccactaatcaaatacctattgaaagcgcaattgaacaaggtttaactttgaaaccagctcctccttcactttggcggaaattccaattaatgagatctaaacaaattacaactttaaagaagaaaatcccagtatacaactacccgaaacaccctcaatatgaaaaaaaggtattgagtattttccaatccataaacgttgagtttatgcaagaaaaattgagcaagtttacctccttttacaccagatattataaatcagattatggtgctgaaagtgctgaatgggttattcaccaaatctcatatacattggcgccgttaaagattctgtactaa

SEQ ID NO: 7949 - DNA, 222 bp, Candida albicans
tcaaaggggaacggaataaaacaagaagacaagaaagtaggaaccgaaaaaaaaaggggcacagagaatttagggaatttaatcgagtttatatataataatgataatgataattgttctataaacaacaactacaacaacgacaaccctcttacatcaaaaaacaatctatgtctctttgtatcctcaacatgtatgaatgttgtttttgtatctctttaa

SEQ ID NO: 7950 - DNA, 333 bp, Candida albicans
ttaatttttgcagtttattcccaaattacatatacacataaattgactaacatcagcatgacacaattaccttctgtttcagaattgatcaaccgtactggatcaataggttcaagctcaaacattactagagtcccaccaatgacaacaacatcagcaaccaacactactactgctgctactgctactactgttacttctaccacaccaagaagtgaaaattcttattcacctaactcaccatattcattgcctactagaccctccaatacttcattaactaattattcagctggttctggtattacagttgcatcctctcctttgtcttct

SEQ ID NO: 7951 - DNA, 636 bp, Candida albicans
cttctggacttgactactattaccagaattattcctatggaaacctcaaacaccagcattgagcttttttctgaaacggcaaaacttccttctgaagtcattgctataattgttggttatttacctaaatgcatattgccaaatttattgtatttcccaccaattagagaaattgttgcctctacaattttgtcagatgtacatattggtacgtacatctttagacacgagggtagtgatgaaccagacgttggttactcgaaatgttattgcgaccgattcgatatcaaattcagtaatttgaagaagggtattgaacaatggaatatatacccaaaagcgattcatatggaaatagaagtacactttaagaatgtattggatactttccctagacttttaaaagaagccctgagcattaatggtagtctttcctcaaggaaaggttcagaagcagaaacggtcctaaatttaattttgaattccaatattagatttgattctttggaattgtcaaactttcggggtccaattgtaccaccagttgccacaaacattaaattatcgagcactattttgaatagctataatatttctggcatgaaaaagttggacataaaaatggattttaagtaa

SEQ ID NO: 7952 - DNA, 207 bp, Candida albicans
aacaactttcaaagaagaaaaagaagaaaagggaaaaaacaaaaaaaattttcaaaaaaaaaatgtggcagcgatggcaaagtttatatagtgattgacagtcgtgtgtcattgtacaattattttactatagaagtcaaaaaattactttgcttaggtggaaatagtaacaaaaacagacacttgaaaagttacaatttcaattag

SEQ ID NO: 7953 - DNA, 420 bp, Candida albicans
aacacgattttagacatagtattattcaaactcgttacatcaatcatggaagtcaaagatatttttgttcaaattggaactataattgtgtttttactagagtttttctttagaaactccataactttgattgttcatgcccataagaattatccagacattactaatgttatatttttcatacttggagtgtatatcatatataaaatactagtcagaacccttagatcctggtttaattttatgatattcacaatcaagttgatatttgttttgtttttcgtttttcttgtatttgtcatatatttacgtggttgggaaacattcatttatcaagatgtcccatttttgaaaaaatcttttggtcacttgaaggcatttaatgatagtacaaccaaagaatggggggtttggctttaa

SEQ ID NO: 7954 - DNA, 249 bp, Candida albicans
tcttgtttatcaatgacacaatatttatcgaaagattctttatttttgaaattacctactgatttatctaaagatgaaatttctgtactagatttatatcatgatatcacttccttaacaacgacaccaacaccgaaagttacattcgattcaataatcgatgagacatattatttattgaaatcaactgatgatatttctaaatgcgatcttcacctcgggactgcgatcaccgcctactctggggaa

SEQ ID NO: 7955 - DNA, 501 bp, Candida albicans
  unsure (339),(366),(448),(487): Identity of nucleotide sequences at the above locations are unknown.
caagagctacgtgcatatcatcaagttaaatattccaaattagccgaaatgataagacgaaatatattagttatacagggaagatcattttgtcaatcttcatatttagcagaaagtttaaaaccaaaacctgacatcgagaataaagtaacaactaatggcgattcaaacgacatcactaagatagcacttaatacaaacaagcctggagatgatggctcattaaagagagatgatagggtaaaaaatttaattaatcggcttacggcaactggacgacacgaagctaaacgaaatccgactacgacgaatgcaagcgaatgctataaattgtgtcanaatccagataaattgaaagccttgaanagaatgtttgcacaaccaaaggtatccaaaagggcggtcaaaaaacatgtcaaggaaaagtttcaaaaaaagcatactgaanagaaataccagaacatcactgaaacattctccaaagacnagtcaaccgaatag

SEQ ID NO: 7956 - DNA, 207 bp, Candida albicans
  unsure (206): Identity of nucleotide sequences at the above locations are unknown.
ttcttaatccaaaacacctttgtcgtatggacattggatgttcatgttcatgttaattttgttaataaacaacatgctatgaaagtctacttttacagtattgctaccagtatacaattcactagtaaaaatggtttgggtagaaagtactgttatactgagatattgtcgtcttcacacacgccgctggaaggatccaccctctng

SEQ ID NO: 7957 - DNA, 195 bp, Candida albicans
tgcagtttgatgtcttttgcttttactgtgttgggtaatataaaagattttggtttcctagtcaaaaacagttggcagagaataaaatgggttggactgtcaaagtttttcactgtttttagaaaaaaattgttgttgagttggctaccatggaagattgacaattcaatccacataaaacattattttctttaa

SEQ ID NO: 7958 - DNA, 198 bp, Candida albicans
catctatcaccaatattagttgagaatgtagtatcactgccactaataaaattgcaaatcaagttgtcgttgctatgtagagataaaatctttatgcacgcaattagaccaaaaaaaaataagacttactcgttatgggttaggtcatatgtaaccaatataagagatttgctaaaccaaactaacaaaccactttag

SEQ ID NO: 7959 - DNA, 264 bp, Candida albicans
  unsure (235): Identity of nucleotide sequences at the above locations are unknown.
atgggacaaacgttgccagaaaagaaaaagaagaaaaaggaaagaaagggaaagaaattcttaggattgaaaaatttttctttgtacgagagagagatgccttcgacagaagtcagatttattttgaagtgtgacacggaaaaagtgaaaaaaagaaattgcataatctattcgagattttgtgttgattatgtgcaggatatccgacatatttatacacacagagatttgactnggaagtgcaagtcaatgcttatttccccc

SEQ ID NO: 7960 - DNA, 189 bp, Candida albicans
atttccttttttcctttctcccctctttctggtaccttcttactctatccatttactacccccttaattaccgtttccatatttcttgccccttttcatttcttagttcgatattttttcataaccccaatctttctatttcaatttctaatccgtcttttaccctatatattacattttctctttttt

SEQ ID NO: 7961 - DNA, 402 bp, Candida albicans
gcaggtatcaaaaagaaaagttcattaagagataaatcttctaaaagatcacaatcagatagagtatctcaattcaaacaagaattagccaatgacaataataaaaatgttacccctaattcagaaataactttctcctcctcctcctcctcatcatcatatcatgaaaatccgtttttaagattagctaaaagtactaaaaaagaaaaacaacaagtgaaatctgataaatttgttaatagattaattggcgattccaccaaaataagtaaatcatcattaagaagaaggaaaagaaaagctagagaacaattaaaaccaaaattagatgatttattatcaaatctacccctgacaaataatgaacaggcgtcttcactacgaggagcagcaccgcgctaa

SEQ ID NO: 7962 - DNA, 375 bp, Candida albicans
cgatcctgcatatttcgtcataattcacacattcttaaaattatgcacacatccttgaaatgtgttaatattcccaacattatcaattatatgtgttcagaattggttgcaaagttatcaactcaattcacgctatataaaccttacaaattctctacatttttatatttttttatattggcttttcttttagaatcaatcaatacttttttatcatttagatacatctttcatctattaatagattatctttctatatatcaaaacacgacacagtcacgtgccaaaaaggatataagaaggaacttcatcttgattgcgccgcaagcaacaaacaataagccaaggaaagtatatactccagatctactatga

SEQ ID NO: 7963 - DNA, 837 bp, Candida albicans
aaatttcaacatcaaaacttttccatttgttttccatttcttcttcttcttcttcttattattattctgttaattcaaattttcaatctctttactttttacttcaaaaaatttttttacccaatgaaagctactaccttcactttattattatctattgctactgccattaacgctgctgcttttgaagattcaagactcaaagctttatttgctagagatgctgaaattagttttggtgctacccttagtgccgaaatctctcatggatttggtcatcatcatggtcatactgctgatttaagttccgaaattggcggtggatcttcatcttcaagtgtttctgaaagtactgttgaagaattgagtactaccactactactgaatctgtttctgcttctgtatctgcttctgtttctgcttctgtttctgcttccgtttcagtttcttcttccgctgaagaaacttctactgaagctactgaaagtgctgaaactactgatagttttgaaaccaccgatagtgctgagactactgatattgttgaaactactgacagtgttgataccaatactaccgatatttccactactgatgagaccactgaagaaactactgacgccactgatagtgttgaaactacttttgaatctgtttctaacacagaagatttatcatcatcatcatcatccattattaccgattcatcagaatcaactattgaagaaactcctttgattactgatactagtgttccttcttctttgtcagaagaatttctactactggtagtagttctgaagggattcatctactactgctgccacttcccataa

SEQ ID NO: 7964 - DNA, 276 bp, Candida albicans
gaagaagaagaagaagaaatggaaaacaaatggaaaagttttgatgttgaaatttttagaaacaaattggttggtatttataaatcacaacagctcagagtactaattaagctttctttggcaattattttttgcttgtttacttttacaccaagaagtagtagaagtaaaagaaatagaacaagcttttttttaagcctattgagtatatattgtttttgcatccatatttatttttcaaccacaattttttttttttttttttccacacaataa

SEQ ID NO: 7965 - DNA, 195 bp, Candida albicans
gaacaaatagaccacatagtaaacccacaaatttctacaggtattgtatggaaaaatactgaagtgattgtgtacagtattaaccacatgatcaatatgaaaactgctatgacttcgataattgttcgaaattattcgattccaggtccattttcacatcctttgactggtgatgccatttgggtgcagcaataa

SEQ ID NO: 7966 - DNA, 618 bp, Candida albicans
aaacgatatggtttcattgctaaacttcgattatgggttaaagaagaagatttatattatttcattaaacatcgtgatcaatggaccaaatatcatagttttaacactaaattatctcaagatccaagtaatactttattacaagattattcttatttaatgagtgaacaagaatatgaaaatttacaatattctacagatttagaacatgataatccatttaaaaaaaccaaaaaaccattagaattgaaaaattctgaacttgaaaaattaaaacatatgaatgaatcagaattattacaatttttaaataatgatgatattttaattcaattttttaatgctaaagaatttactagtttccatgaactggaaattatgcaattgacttttggtaaatcaacggcaaaattaatgtcactggcaattgatttcccaccaataaaatatgaaccttatttatacaaattgaatcatgatcttgatacttttgaaaataaagttgatcgttatttagcattacaagatgcttatcaacaagaacataataatagtccttctggtggttctgataatgggtttatggaaattgaagaagatttagattttgcattttaa

SEQ ID NO: 7967 - DNA, 216 bp, Candida albicans
atactatttgacccaaagaatattaataaagagggagtaaccattgaatcaaataaactatatacacaattaaccaaaattttaattcaaacaacaataaattactattctttcgttttgtactgcagcgttggtgtggtagtatattcatgtatgtgtggaatgaaaaacttgcaacaaaaaaaaactaacatcaaacaacaagaattgaaatga

SEQ ID NO: 7968 - DNA, 186 bp, Candida albicans
atgcatgtcttatatcgtccattatttcttttatatcaaaaacaaaaaaaagagttcttagggataatcaataaatcaagtcacatcattatcatccatatacatatattcaaattgtatgaagaatattgtcacaatatttttggttcttcaaatttcaaagctgttgagtttcttcgtttatga

SEQ ID NO: 7969 - DNA, 861 bp, Candida albicans
tacaagcaagtcatcaaaatgtcgagacattcatcacgcaagtgttcattggccatcgaatcaccaatagacgattcctgtaacaatccattaaatgcatttttaatctacagtgggaaaacagacacccacagtaataataataatggtgctgacgatgaaatggctaccaccgatgaatcaatgtcaccactagcatcatcaacattcttatctcccatgacaccaccaggctcaagaaatacaactcaattaagtaatcaacaattgactaaacttcttcgttgtcatcgtcgtccttctatgatcaagtgcacttcattacctgaattaacagccatgtccactcacacagttactacttctcctccactcagtagtcttatcactaattccaccactcatgcaatattaggcaatcgacgaatttcaatttgcgatttagataattttacgggggagattgattatgtcaaacaacaacaacacgaacaacatcaacaacaattacaaagtcctgatattgcaaatttcatgtattgtaatttatcaactagtgatattgataagacccctcgtaagttttcattccatcatcgtcccaaaactgccccaggaatgatgattgggggtagtgatgagacaccccagaaccacgatcatgaggacaatgaacatgaatatggacctaaacaacaagaacaggagtccatggaaatagacaaggaaaaagaagaggtggcaactcaaaacactcaattaccacatcattatattgaaaatttggctagtttccaattccgaaatcataaacgaagaaactcaacagctttgaaatttgaagaaccaaaaatattgtga

SEQ ID NO: 7970 - DNA, 204 bp, Candida albicans
cggaaggagaaacagaagcaggcaaagcaagtcagggaaaagaggaaaaaggagaaaaaggacaaggaaacaagtcagggagacaaggaagtcgacgaggcaaaggaagaagagaaggatcagagaaagaaagaagatcagccaagaaaggatcaggaggaacatgaaagaagatcgaagcaaaagtataagagattagaatag

SEQ ID NO: 7971 - DNA, 195 bp, Candida albicans
accgttttaagaagtttttgttccgtttttgtgaagaaagaaagaactaaaaaaaaaaagtcgcttcaaattttcaaaagaacaaactacttaatccagttacaatataaaatcccacccacaaaagaaaataatctcccaagaaacaaaaagtataaaaaaaaaattaaaaaaaaaaaaaataaaactaactga

SEQ ID NO: 7972 - DNA, 279 bp, Candida albicans
cctacaaatttcataatcacaactaggtttcaattatctactcatatccacctcaacttcttttttttttggtttttggtttttgttctttctttcatttacaagtcttttttttgtgagtcagaaaaatttatcaaatacttccaaaattcttttacactacaagctaatcatactattaacttgttgattgattatatcccttctttcactacaggattatcaatctttaatcccttaagttgttctgttggaatctttttggttcggtggcaatag

SEQ ID NO: 7973 - DNA, 189 bp, Candida albicans
ttaccacctggatggttagtaataccattgaaaaaacctgaacaagaaaatagtgatattgattataaagtcaatatttcttcttatcatcaagcagatttgaaaattaataataaaaaaccaagtactcgtgatattataacttatgctattccaaaagaagaatctataggagaatatgagatgtga

SEQ ID NO: 7974 - DNA, 354 bp, Candida albicans
ttcccttgctgtcaatttatcatctgcactatgctcgttattggcatcatacatcgatggggttcaataaatacgttaaatgggcaggttgtaaatgtttctaaaaccgttgaagaagaacgacaactgggttccaaacactactgttttctcattctcgttcgagaagaggttgaaaaaaaaaaaatatgtcagaatcttgcaagaactaaaacacaattttataatacaattataatagaagaaaagatatataaatcaaactataacatacacataaaaacacaaactacaaagtcatcatctttgttttaccttgttcggttaaatcttccaaatcttatcactttctag

SEQ ID NO: 7975 - DNA, 393 bp, Candida albicans
cactcaaactatgatagtaaagatcctacaaatggttctgatggcgaaatcagtagtattaatggtgaattcataggggtgaatacttcttttgaactgttcggtgatgatgatgatgattataacgactacagaaatcgatttaataatagttcccggttacacaaacaacaaggagtgctaccgggacaatttttcaatgtttttgaagcatctaaagaaaatgatgaagatactttgcaaggtaaaagtgttaatggtattaattttgatgatgaattgtcaacgtctgatgatactagtggtagtggtggtaataataataagggggacttctttgccgctttcttccaagaacgacctaaacgtcaacaagttgagtatttcttgtaa

SEQ ID NO: 7976 - DNA, 321 bp, Candida albicans
cacttatttttcatcatgtcaattacaaaaactgcttccaagactgtttacccaacaaaactaattaaatgggcattactagctaaattgttttcaagtagtttcaaaagagtgaaacataaagggaaatcaactcataaaaaaactatcaaatcatcatcatcatcatcatcttcgaagtcttcttcttcttctaaaaaacatcgattactgaaacctcatatgattaataaaaccattacatcaattatatttgcattaattttacttctttatatggtttttgtatcattagaatttacttcaattataaaaatataa

SEQ ID NO: 7977 - DNA, 438 bp, Candida albicans
tcccccatgcgcggtccttctgccactgtggtgaagatgatcatggagagtcatgactctactgaaaatcatattaaccagaccaattttaataatggtgaacaacaaccgatacaatatgtcaataattcaccaccaccgtcgccgccactgccgccaccactaatgacaagaaattggaacccacatttacttcaaagtacttgttttgggaaaaatttatatgaattaaccaaagaacaaaaagttggtgaatgtttacatcttttaaataccacttttaattggtttgatatgattgttaaatcatcaccagaaaagattgatgaatccattggttatataaaaggattagaacggtatatgctgtcattggccacaggtgttcaatatccttggcatgttgatgaatatgggagaccaatgtatcagctttag

SEQ ID NO: 7978 - DNA, 273 bp, Candida albicans
  unsure (68): Identity of nucleotide sequences at the above locations are unknown.
gagaatgggaggcagaggataaagatttggaaggaatcaaaaggaccaaggaccattgatatgaaggnagtggagaagaaagtggaacttgaatacgattcggaagttgttgccaatgctgaaagtttggaacaccgacaaaaagtggaaagttcagaaactatgaatacactggaagtggaaaccagagaggaatctaaaaaagacaccaaagaaaaatctgatgatgaaacaaaagaagtaactgacggtttgaaagaagtagaattataa

SEQ ID NO: 7979 - DNA, 231 bp, Candida albicans
tgccgatttactttaggcgcgggtccgttcagcttcgaggtgaagaatactggtgctcaccaatctcagctgaattttattcctacaacgccaacaccaacgcaaccacataactatcctcataataatgctagtaataatattgtggccgtttcaaatgataatgggaatagtagaaacgatcaattggtaggcagtgttcctgccaattggacgtggagttcgttttag

SEQ ID NO: 7980 - DNA, 663 bp, Candida albicans
ttggaagcaatgaatggaatcaaaaatttacagaataattatcctattcaagatcaaattaatgatacttcaaaattaacaaaacaatcaatttctattatcaatacaatattcaaaaacgacgatgacaggaaattctcatccaaattattacatgacatattgatattgaatttacctagttctttaaatatcaaggttatcaaacattattataaatccaatcccactgatgttatcagtaaagaagtggcgttgatcccattaagaaatgcaattttcaatgctgaattcatgaaagcaatcaaattgactgacttaactgtcggtcatgaaaattatattaatcatatgaaccaaattttaaaatctggagttatcaaactcatttcaaccgcgattatagttactttatttacaaaattgggggtttctagtttgattgatgccggagtgatatcacaaagttggcaaagcataggagctatcaattcgattattttgacatatttgattaattcaagtttttttatctctatagtcaaattgggtcgtactttaataaatgctgggggtgattatttgacctggcaaaaggggactttttatactcattggtttaaacatgctgatgaaatgttatttaatttcgaaaattattga

SEQ ID NO: 7981 - DNA, 237 bp, Candida albicans
  unsure (10): Identity of nucleotide sequences at the above locations are unknown.
agattactcntactcgacagactctgtatttgggctagcttagtgtttgctgaatcacatggtttacaaatcacaacaagtattactgtatacttacacatcttttataaaccatatgataaatataaattcagactttctaaaaaaaaactagaaaaaaggctatatactaaatccaaacttgaacttgttcatagaaatcgactctcttcttttcggagttatcgacatttttag

SEQ ID NO: 7982 - DNA, 357 bp, Candida albicans
attatttattgggaagaagatggtaattttaaaattttacaagaagaagtaaagcaaaatattttccataagaaaatcgtgactgataatcaacaaaccgatgaaaacggacatggtcagtttgattatgaacgtttccaaagcttgacagctaaaaaattggacaagatttatgatgtgcatactactcgatatgttggtgttaatgctgatgatgatgaatacaaggaacctagtttctatagtgatgatgtttctaatttggaactagaggaggaattgttgcaatttactactggccacttgcgccaatgcattcatgatagcatagacgaagaggaaatgacagaaaagtaa

SEQ ID NO: 7983 - DNA, 270 bp, Candida albicans
tttagcagcagattggaaaaaaaatttttttctttttttttccaacacccaaaaagaaaaaaaaagtttaacctaatgtgcatatatttattacatattgtaatgatgttacagaattttattattaccgtgaataaattttttgtttttgcaccccctgtaaatttgttattttgtcaaactggtattcttgtgttccaccaccaccaccagacccgtgctaataatactaccattttagggcgagacagaattataacaagacgataa

SEQ ID NO: 7984 - DNA, 456 bp, Candida albicans
gtcatttatcactcgttatggttattttactacattgaaaaactgatagtggacctgagtttttacaatcaagtcatagccaccttggttgaaacatatggcataaaacacatcctcggtacgccccattatcctcaatctcatggatttatcaagcgtcaacaccaaggtattatcattttttttttaagaaattaccaagcactaatccttggtatcactacctatccaccacccttgcccttttgggtagatcgcacacaagtgagatccactacaattcctgtaccacaactgcagttatcacaagacgagttatttgctttcctttccggtttgatcaacttcgtcaacgtctgtataatcatcttttttgccaaacatatgacagcatatcaaagtcaacaacaaaagatcatctttgataagaaaaccggcagaatagatccattataa

SEQ ID NO: 7985 - DNA, 432 bp, Candida albicans
ggcaccaggttcaatgggaaaaagttagtgattgttgattgggtaatgaatcaaaaaaaaatgccagccaacacttctgcagactcatcacctaacgactgttcttttcattcaccagcttcaccactccaagctattaatcccccgccagtcaactcaattttggcaccagcagcagtagcagcagcagatccaatgaatgctccacctgcaggtcaaaccccgacttccccactggccactccgaagcccaatccaattccgactgcaactattcaattattggacactggtctgaatttggagttccaaattcaacgaattattgaacgtgaaattcaaaaaagctgttgcaaaagcaatgagtgcaatgttacctactattgcaccacattttactgtttcgtctccatcgagtgttgcttcagctaa

SEQ ID NO: 7986 - DNA, 255 bp, Candida albicans
actgattttgccaaatccaaattaactcttaaagaaactggtataattgaagaaaatagaattaagaatctcattatatcaagataccatgcggttttcaaggggaacccatgtgctaagaccaataccaacgataatataaagacaacagcacacaatattttggaaagaccatttatctctagttccaataacccagttttaaccccggtcttggttgtgttcatcagttgtctcgtttcaataccagtataa

SEQ ID NO: 7987 - DNA, 570 bp, Candida albicans
  unsure (544): Identity of nucleotide sequences at the above locations are unknown.
aattttagcattatgtcaaccgatattgaaaatacactgcagcaaagtcaactgccacaacaaccacagcagcaacagcaacaacaacagcaacaacaacaaccacaacagccaatgtcgtccttgacaaagttgctacatgaatcgacctcaaccctagcttctccagtgttatcgagaaatacttctgaagtgactttcaaggatcagggtcgccgtacacccgaaattttgaacataagtgatactgttgatgctaaatcacctggaatcactattgacgtttcaaaaccaaaaccttctccaatagatactgatggtatgaatgttgagccacaggctgtgcatggttttgatccatctccaaacaccaaagtttcgtttctgtctccattttcgccaacttcgccatttaccagacaatcatcaaattcattttcaagtaaccaagcatttcaaaatacaagaggggcagttgctagtccaagatatataaagaacaattcagttagtcactcctcagtatttatgggtggagaaagtntatcatcgtcgataccttattctgct

SEQ ID NO: 7988 - DNA, 288 bp, Candida albicans
atgaaccaacagacagaaggaaaagaagaaattacacaggggggaagaagaaaattggtggacattaaattagatttctttacttgctgttgttgttgttgtagttgtggttgtgtttcaataattaagagtatagggggattatgtaatccggaaattgtacaattgcgggatagagagagagagagaaaaagaaaggagggcaaatcaaatttaaggttgctatttggtttaaaacaggaagaaatttatttaattgctatatctatattatacaattgctgttaa

SEQ ID NO: 7989 - DNA, 597 bp, Candida albicans
tttatcctcatgagtcaacaagaaaaatcgacattccgtagttataccaaggaagaattacacgatttattaactaaacttgaacttccagttaaatcgaaaaccactaaaaaggcaatggtagaaattcttgatgattttgttgagaaacatcctgaagaattagataatattgaaaaaatcttacaaactgaagaagatgaagatgatgatgatgatgaagaagatgaagatattgtagaagttgttaagattgatggtgaagaagatgaggatgaggatgatgaagaggaagaagaagaagaagctgaggacgatgaagaagaagaagaagacgataaagactatgaagctccaccaccattgaatttaaaagaatgggttgttgatccaataattgctcaatcagaaacttttattgaaaaattttatgaatttactgataatgttggtattacttatttaaatcaaagtgaaaaattaagagatcaattaagttctaccgttacattaaattatttacaaattggtgttgaattattaattttcatcctatattcttcacctcggatagcacgtcccagcagtttaaagaaa

SEQ ID NO: 7990 - DNA, 276 bp, Candida albicans
  unsure (9): Identity of nucleotide sequences at the above locations are unknown.
cttgttggngaacgagattccgaggatgaacgaaatacaatgttacaaaccgtcttgattgcatcagttgcaatagttacaaaaactaaattgaatccctacaaccaatattttgatcttttggtattagtcatgttgttcttagatgataaatttttggaggggatatttaatttatattgttacctaatattgcataaatgtcgatttgcaggacacaagtccggacgattgcacggaataacgtcccgaaaatgggaagcaagaaaaaagtag

SEQ ID NO: 7991 - DNA, 318 bp, Candida albicans
tatggtaaggtggatgtgcgagcacgtcatcgcaatagtagtgtgttaaccgagaatggtataactagtaacattcctatgacattatgtctaataataaccttcaaatatcatacaccaaaaatgaacaaaaaaaaacataatcataataactatagtactaatacaaaatcaatcagaaacaataccagaaacaataaatataataataataataataataataataataataataataataataataataataataataataataataataatacaaaatcaatcaaaagtaaaaacccatcagagaacacatga

SEQ ID NO: 7992 - DNA, 606 bp, Candida albicans
tcaactctatatttcttcttgtttaacattatgtatactaaagtatcaccagcaagtactactactactaccactatattcacaatgcatgactccaataatacttggaaacaagaatacgacccaatattacaacaatattattatgtcaatttactggataattccatatcatttgattctccttgtgaagtgattaatcataaaaagagtactactagtactaatactagtattagcaaatcattctttatgccatttaaaagatcttcaagttataccagtgaaaaagattccaaaaaacaatgtaaatttaccataaacaaatctactgccaccacagctacatctacatctacatctacaactgacaataaaaaaggatcaaattattctctttatcgttgtctcagttctgcattatcattaaagaaaactaaatcaaatgaatccactaattcttcaactacaaataccaattctcaatcaatgagtagtgatacattaaatgaatctacaacaataataacacccacggcaacaccaagtgctagtatgactaccgatatctcagcattttcaaccgccgggccagactatgtaagg

SEQ ID NO: 7993 - DNA, 216 bp, Candida albicans
gagaagaaagatttgatagatttgataagaccaattgagaatatttacttgcaactgagtgggtttttttttaggtttctaaatgtcaaaaaacaaaagggtgagaaatgtaaacatccacaattgagagagagaaaggaaaaaaatatctcctggttgccatacttatttatttcaagtaatacacttctagaacaaagtaagaactcttactga

SEQ ID NO: 7994 - DNA, 495 bp, Candida albicans
atggaagaagacaatactggcagccatattaggcgatcaaccagacaacagcttaaacagcaacaacgtcaacaactagagctacaacaacaacaattagcagaagaggaagaggaagaagaagaggaacaacaaatacagttgcaacaacagaaacagaagcaattggatcaaaatcaacgtaccacaaaaaatcaagaaacaccggaataccataacttgaaagaggaagattttgagcgactcatggaagagatgcaaatcgataagaatgatgatggtgatgatgggtcctctgatgagtatattttttcagacgaatcggatgattatgacgattacgataatattaataacaacaataatggaaataataaaattgataggccaatattgagtgatgaaccagaagaagatgatgatgatgaagattatgattttaaagatgcattgaaaggtgctagtaactttagagttagacatcgaagagaatag

SEQ ID NO: 7995 - DNA, 189 bp, Candida albicans
actgcctccaaaatattatttaataatacaattactatacacacatcatctggagaaataagatctcactacaaacgccatttagttaaccttcttggttttcttttgtttcaaatgagattctggaatccagttagtatcgtatccagtggcagaagtagtagaggggccactagcaacaggacttga

SEQ ID NO: 7996 - DNA, 306 bp, Candida albicans
aaaaactgtgtatggggtggttttaaaccccgcccaccaccaacagccacgaactccgccaaattttcccctccctgccactacttctcctcttcttcctcttctccatttgctttacgtttgcttatctatctatctatctatttgtccttctcctcccccgctcaaaaggaacaaaataataataatacttcaaataaacattataatcattatcatattttcttacaaaatttctataatattgaacttatatattttcttcaaatttttatgttattcttattgttgctatatatattataa

SEQ ID NO: 7997 - DNA, 849 bp, Candida albicans
tccttgccgcccgctggtgaagacatgaagaataaagttgaatcagaaaatcaaactcaaacccaaaaccaaaaccaaaaccaaaaccaaaaccaaaaccaaaaccaaaaccaaaaccaaaaccaaaaccaagtcaatagttataatccggatgaaagtatgatgtctatagataatgatattatcccaattaaaaaacaacggattctttcaccaccacgacaattgaaaaaaccgaaaaaatcaactcaaataccaccaataaccagaataaataatattaatagtggcggtagtggtggtaatggtaattctaaactcaaaaaaccaagtcattggggtgatcgtgacaagagtgatttgatgtatgatacaagtatggaagaaaattcattaatcacatcagaaatcaattttgatgaaccagatggaggaggaactcccgtagcaagatcatctccaccaccaccactaccacctttagtatcttcaaacaaaccacctaatgttcataatattttggccgatgtcaatgaattagatctaccttttaatccaacaatagaatctctgcccactcaagttccaacttcgaaattaattccgccaacaggaacagcaactataacagacagagatgatattgataatagtaatatcaatatcaatggcaatggcaatggcaatggcaatgcaaataattttacaaataaaagattattgactgatcttaaacgaagtcgatcactgctgttaatgctgaataaaaaaataatgatgaattttactgattcaaaattaccattacttaataaacaagctgcatcaaaaataagtaatgataattaa

SEQ ID NO: 7998 - DNA, 204 bp, Candida albicans
tttttgaattttgtttatttttttttggattgtgtttcaagaatgatgaaattgccatttttttatattcgattagtctttaagacaaacttacatggttataatttaagccctgaatttgaaacaccaacaaatgaaaaatctagcatttttaatatgttttttctgttttatttggtttttaataagaactcattttactaa

SEQ ID NO: 7999 - DNA, 273 bp, Candida albicans
gtgaagacgagttccctcaagaaggtagcatatatggtgatgatatccagatacaagtggactagatttttcaaatttataatggatctaaaaactgcattatttagacaatatttgaatatctcggggtgtgtgattaaaagttgtttgtcagattccaaaagattggaatctaaagttattcttctatctcctattgtgtatggcatgcaattaatacaacaaataaataataaaaaaaaaataaagattggtgaaaatgctaaaacttaa

SEQ ID NO: 8000 - DNA, 498 bp, Candida albicans
ataatgggagttttcagtatctttggctccaaagagtctttcgacccgaatgtgttcgaaaaggaattgacttcaattacagagaaaatcaataccaacaaacaacaaattagcaagttacaacagcgtcaaaaatacgtaagaagatccttgtcaagatattttatcatcatctatctctgtatttttgggtattgttatgccaccattccttcaagtactatcggtaagaatcgagttcagtggtttataagaggtcaaactagacaacacttgttggtgttaataggatacccgttgttttcagtgttgactttaagggcagtctcgtacattttccaatttttcatcaataataagcagagctatttaaagagtctacagaacaagcacaaggaaaagatcgaagaattgaaaaagattaccaactttaacaaaacgaatgagttgatcaataaattcttcaccacggcgctgaaaggatccgcacttggcgta

SEQ ID NO: 8001 - DNA, 393 bp, Candida albicans
aagtatacatcagatatgaggattacggttatattaggttttactgtatgtttgaccaatgcttttcctttggatttccccgaatggacaacaaatgcagtttcattttttaccaatgatgggtatcggaacagcgatagattaatcaaattaggtccagaaaactatagaattgtttcggagaacgagaaattaaagttgaaaagaaacaagattaattttatcgatgtcactaatcaaatacctattgaaagcgcaattgaacaaggtttaactttgaaaccagctcctccttcactttggcggaaattccaattaatgggatctaaacaaattacaactttaaagaagaaaatcccagtataccacttacccaaaacaacctcaatatga

SEQ ID NO: 8002 - DNA, 243 bp, Candida albicans
  unsure (58): Identity of nucleotide sequences at the above locations are unknown.
gcaatttcttcatttgttagacatggaacatataacaaaaaactccatttccctaatnttgctaattatattgaaatgcctaatgtgttaacaatgggatttagtttgttactccacatttcgttattaatacaattgaagtccccttttaagaatatgccaacttgtaatcaaaatgaacgaatcaccaagaagttgatggaaaaaaccattactaatagagaaagctctgcatataaatag

SEQ ID NO: 8003 - DNA, 198 bp, Candida albicans
  unsure (165): Identity of nucleotide sequences at the above locations are unknown.
gataaatttctgttcctttttgaatattggtttgggcttggtacaactttttactttaaattaatatataaaagtagaaatctatttgatattgtaaagggagttaagcaatttcttcatttgttagacatggaacatataacaaaaaactccatttccctaatnttgctaattatattgaaatgcctaatgtgttaa

SEQ ID NO: 8004 - DNA, 198 bp, Candida albicans
agtaaaaagttgtaccaagcccaaaccaatattcaaaaaggaacagaaatttatcctataaatataaagtgtactacggctggtaataatttgattttcctgggtcgtatagtcatatataccatggaagtaaatcggtatatagataaagtcaaatcccaggttaaacaaaaaaaggagttcatatcttacaattag

SEQ ID NO: 8005 - DNA, 231 bp, Candida albicans
agctgcattttcaggattttttggctgcttgttgtgatcaaagaacaaaaagttcatattccatcctttgtaaaccgcacccgaatggaggaatctaattccagtaattatgctgattttgaaccccgaaaaaagggggcgaaattattctttaaagggcacaatttaaaaaatttggggaatagaatacccggcttaggttcctccagtataataagttaccatggataa

SEQ ID NO: 8006 - DNA, 369 bp, Candida albicans
attaatacccaatttgagatggaggtaagtccagttaatctacataaagaggaaacagaagaaaacaaagccattgtgcaacaagattctgaaaccgctgctgaaaccgtaaccactgcttcggatgaaaagcatgcagttgaagccggcgatgaagttaaccaagaaccagcagttgacaatgatggaaacgacaaggataatcagtcagatgatgaacagaatcaagacgaggccgctattgatcctgcacctcaagccgatactactgatgacactgaaaaagacagtgaaaccaagacagaaccgggaagaagtaaaagaaccagtagaaagcaaagaaccagaacaagttgctgctaccgatga

SEQ ID NO: 8007 - DNA, 189 bp, Candida albicans
agggttttagttttaaatttttggttagtggttttgattcaagacgccacactttcatttacggttgcattaaattgtcacctaagaacgctcagaaaaacgtctcaaacaatcaaactcacggaagcagttgccaattttgtcgatgcgcgcgcattttatgttacttgtaatcaattatttccataa

SEQ ID NO: 8008 - DNA, 234 bp, Candida albicans
ccatgcattttattcagaatccaaattaatgttgcaatgccaaatcaattaaatgagctagagggttttagttttaaatttttggttagtggttttgattcaagacgccacactttcatttacggttgcattaaattgtcacctaagaacgctcagaaaaacgtctcaaacaatcaaactcacggaagcagttgccaattttgtcgatgcgcgcgcattttatgttacttgtaa

SEQ ID NO: 8009 - DNA, 234 bp, Candida albicans
tcactggaagaagatttaaataaattgactcaagaaagagaaagagttaaacgatgtaaaagatgctggaatggcatgaataagaggagcaggaggaagagaaagaggagtagcattatagtcttggttgttgtagttattagatacaattcaatacatacatttcatacattaattatatactgtaagtggtttacatataatgatcatcgttatcttttaatgcttgcttga

SEQ ID NO: 8010 - DNA, 492 bp, Candida albicans
  unsure (346),(379): Identity of nucleotide sequences at the above locations are unknown.
caaaaaatgaatacatcaggatactgggatcaatcgagtaataataacacttctttttctcaacatgaagtacgatcccaacgagaattatcacaagaagaaatccgtgaatcattactattatcatcatccataacagatctgagtttccaccatcaccatcaccataatcatcctcataatcataatcatttaatacatgcaattgatgaagaaagtagcaattatagtgggagtcaaaaccatgttggaaataatttatttggtgtaggggatgatgaagaagatgaagaagaagatgacgatgatgcatatattgaaggtgatgttcgaatgagacattcangaatcagtcttgatgaaattgtttatgaagaanatgaaaatgatgctgataatataattgaagatcaaataatcaatcaacaaatccaagttataatagcaataacaacaataataataatgctgagcagaaccacacaagtttag

SEQ ID NO: 8011 - DNA, 234 bp, Candida albicans
  unsure (30),(38),(40),(43),(54),(60),(90): Identity of nucleotide sequences at the above locations are unknown.
aacaaattcaacgagtgtataattctaaanggattacnanaanttggaagaatnaccatnattttgatttatcaccataacctacctggnaatttgattcctggaaaacaaggatttggaataaacaattaccttgaagaatcttccgaatccattgggcaaaagaagggaattaatccgggaaaatatggtaaggagaaaaataattcacaccacttgcaaattccaattaat

SEQ ID NO: 8012 - DNA, 825 bp, Candida albicans
gacatgccatcaattcgacttaaactaatacaaaagggatccaatatagttaacgatgatgaaaaaactcttatatctatattcaaagaagccatggaatcaccagaattatttcaattcaaagattataccgaagcaacaccttcaaaagatgttgatttaataattggatttataaagaaaaaacattataaaaaatggcttaaaagtattaatcttgaatatcgttggttaaaaaaaacaagaatttatctgacttcaaataatgacaaagacacccctcaaaaacgcccaaaggaactgagttatttaaaagaatattattttcattgtagtctgctggggacatatactttaaaattacaacaaggtcctgaaagtcgttataaaaccccaagatcattatcatcaattaaaactgcatgtactgctaaagtatacatcaagaaaccaaaatcaatgcccaaatcatatttaattggtataatgccaagacataatcatccaccaattaaatataaaggtcctttgaatactatagcgaagaattggcttgatgagaaagtgaaaatggggtatactaaagcacaaattaaagaagctttgaaaaaagctgaagaacaatataaagattcaccaaattttaaaccattgttacagatccagaattatcatattgaatatcgtattagacatcatggcaacaattccaatgaatccaatgaagatcattcgacaaatataaatgatagtgatattgattattcttttattgatgatatatgtgatagttcagattattcaccacgggtggaagaccgcgct

SEQ ID NO: 8013 - DNA, 195 bp, Candida albicans
aaaattacattgaaacgatccttcctgtacaccactaaaagccaaaaacatgagccaccacaatggtactctatattattaactcatatatcatctctatcatcatgccagcctatgtcagctgtcgaagaacgaaactatttgtacccaatgtcagaacaattgctgaacccactgatcgctatcaagcgataa

SEQ ID NO: 8014 - DNA, 498 bp, Candida albicans
tcccggggcattaatcccatttgtcaattgaattgcttccccttatttaattttttttttgttactactcgctccctagtctaccccatctcggacctagcccagctcccactcactcgctcccacccacgatacggcacacatacacacaaacaaaaaatgatcaacgataacttgaaattgttgaattatctctttgcagagtttaaacaatcatttctttttctaatccacatattcatttataagtctgccataaaatttatacatgtcaacacgcagcagacaactcctaccaccaagcttgagttttgtacgtcatgtttcacaaacagttacattcacagcaatggatatatcatccagtggtgttttttcccatacacaaccatcaaaagtggggaagttgattattcgtattctaaaaaagcctttctcacttgggtcattctagtagtagaatcattcgtttgtataaggaagacaagtatagtgtaa

SEQ ID NO: 8015 - DNA, 249 bp, Candida albicans
  unsure (189): Identity of nucleotide sequences at the above locations are unknown.
aagtataagttgctggacatcagagtcatcatcctcatccatcatctgaagaacggtcctttctacttctgctgccgctgcctcttttttaatattacttgcattttagtttgttacaaccccattgaaataagaaagatagaaggaaaagaaattgtccaagaagtagaatttggttttggtaactanccccaagagaaaaatactgatagggtaacccctttcttatttctaaaaaagtataccccc

SEQ ID NO: 8016 - DNA, 243 bp, Candida albicans
ccctcccccaattttggggatgagaagaagaagaagaaggagaagagaagagcttttgctgggcaacacaattgtagcaaattgaaaaattcaaatataaatataacccttatccccccctactcttcaaatgtatttatttcttctattgttgctttaatttttcttttgtttcatttcccaacaatacttttaatcctaccaatttcatatacatcacgcaatggttgccgaaagttctag

SEQ ID NO: 8017 - DNA, 189 bp, Candida albicans
  unsure (151),(180): Identity of nucleotide sequences at the above locations are unknown.
tcctaccaatttcatatacatcacgcaatggttgccgaaagttctagcattgataatactcctaacgacgttgaggctcaaagaccagtctatgaaccaaaatatgacgattctgtcaatgtttcgccatggaacagtcttcactttggancgccccaaacggcgaaatatgttaaattnaaaaccccc

SEQ ID NO: 8018 - DNA, 207 bp, Candida albicans
tgttgtttctatcatatatgctattgcagtactggcagtgataatctggtttttaacaatttttgtgttaacaaactatacgatcaaaccttcgtggttattgaaaacaagtacaatacttctcacagtgtacatcctcgttgtggtgataaaatcaattctcatactacacggacaacaacgagatggttatttacatggagctaa

SEQ ID NO: 8019 - DNA, 249 bp, Candida albicans
aattgtttcgccatctcatgtttggactattgtaccaatttctttgtgactgttaagtatttttttaatgaatgtactaaaaagaaacaaaacaccatggagcttgatgccgataatagttatataattttaggactttatgcatgcatattattcaaacgtacatataatacatgtttattatatagaaatctcaaactttcaacttgtttcctattgtttttgcgatatctctctcgcctcacatag

SEQ ID NO: 8020 - DNA, 198 bp, Candida albicans
  unsure (15),(69): Identity of nucleotide sequences at the above locations are unknown.
aggaccacaactaangggaacaagattgataaattaattttcaccgaattacaagagaacacccccctnaaaaaaaaaactaatacgggggattcgggagcaatccataacaaacgtgcacgacaagtcccacaatttaagtgttcatttgtaaccaattattatgttttactttttccatgtgtttaccatccataa

SEQ ID NO: 8021 - DNA, 216 bp, Candida albicans
ttccaactgggcaattttggtttcgcattattgaaaaaacaatcgtggccgttcccttgtggtaaagcacacatatctttaacctcccccttgttacctttgtttttttctattacccatcaatccgaatgggaaccccaaaacccaaaaggttttaaacgtagcttgtaccctaattttggggctctttcttatattttttcccccaatttcacc

SEQ ID NO: 8022 - DNA, 276 bp, Candida albicans
ttgattgatgttcaggggataagtaagttagatgttgtgattttaaggtggatgttaatcgatgaaatagattttcttatttataaggaaagggtaaagcaatatttggaaaaaaaaaagagtaaaaaaattttttcaattaaaagaattcacgatggggggggaggggggaaaaaaaggagtgagagagaaagagacaaaatgtgtgagcaaaaaaagaaagccaattatactaatatacatcttcaccacagggctggcagatccgcgttcaac

SEQ ID NO: 8023 - DNA, 711 bp, Candida albicans
caatcaacaaccacatgttccaatgacaactgttgtttacaggtggacaggttatttacccacgactgtgaatgttattacaaaaaaaatttatatccagatgaatgggaagatgatggttatgaaggggaagacaatgccggtgtttatgccaatgggtcttttgatgatggtgaatgggaatggtatgaagaagatgatggcgaatgtgtgccaacaggtggatcaagttctggatatggcacaggctattggtggggttctggtgctggatcaagtggtggtactacttctggatccagttatggtgttagttcaggtgattccggttcttattcagttactggtggatcgtatggaagctggtggggtggatatggtaacgattatgtttgccctggtgaagatggctacgatgatgaagatgatcaaactcctgaaccagagtgtgacgatgaggatgatagctgggatgatgatgaagagtgtgatacacaagctgctaaggaagttgtcaactcggttactgttgatgctgaaagtgtttatccatctaccactgctgccagtttgaccacatcatggatatcgacacaaactgcccaatcagtgacacaaattgagaatattggtggtaaggtttatgccagtggactttttgttgttcttcgggttgttgttgatataaggggattgttacaggatatataa

SEQ ID NO: 8024 - DNA, 192 bp, Candida albicans
agccagagccagggtcagggccagggtcaatggctgacgtccctaagctcaagggaaatggccaatcccagagcagggtctaaagccaaagcccacagtatggctatccaggtaacaaaaccggtagctggggctagtactctggcccactctacaagaggctcaagggtgttgagtagcagtcaattgtaa

SEQ ID NO: 8025 - DNA, 492 bp, Candida albicans
  unsure (42),(86),(89),(102): Identity of nucleotide sequences at the above locations are unknown.
gaatttattataacttatccatatactacaattacaagtagntataccattacagtgaaacctacaaatactgacacaagcataantantgattgtagtganactccaaacacatcagattcaattgaaccttcagaaacaaccgagtcaattgaatcagtcgaaccaactgatccaactgatccaacagattcaacagggtcaacagaaccaacagagtctcccgaaccaacagactttactgaacctactgaatccaccaaacctactgatactactgattcaacagggtcaacagaaccaacagagactacagagactcttgatccaacagaacctacagagtttacagagccagttgaatcaactgaacctattgtctcaatagatccaacagatccaaccgaacccacagatcgtacagagacccctgatccaactcaacctacagtaacaattttacctgctaaatctacaacattaagcaactga

SEQ ID NO: 8026 - DNA, 228 bp, Candida albicans
ataagagagagagagagagagaaagagagaaagaattactattgggagaaagaatactgttcagccgtttctaaacgttatactactctagagataacagaattgaaagaagaagtaaattttaacacatatattcatttaaacaaactatataagaaacaatatcatttgatccttattttttttttttatttagttttatttcaatttttctatttttttttatga

SEQ ID NO: 8027 - DNA, 228 bp, Candida albicans
cgataccatcaagctacagtaataagcagctattcaaacgttagtcaatgcaaagaccagaagttatggccggtggctattctattgttgatttgctatacttataatggttgcaatccatacagtaattactggcgttacatccctgcagaatcgaaagaaatacactcatgttttactattatttttgaagttcaatcaaatagctacatcgtaacaattatataa

SEQ ID NO: 8028 - DNA, 381 bp, Candida albicans
acgaacgaatcaaaggctcgaaaaaattatcaaagtttacctgatcactcattattgatttgttactctcaactgggggacccacgagaaatgtttaaattgcaaggtgttcgacgtaatttccaaaaatgtgagaaagaagggattgttgatgtaacaaaattgcctgaggaagagtcttggacttttacaaaatccgaaaagttgcttgagcaaacatctttggctagagaatcattgatgtttataaaaataaaaccgtcaagtgatactgggagttatagcattaacaatctatctactgaaactattacttctgtcacaccagaaattagtggtggtggtggtggaagcagtagtagtaacaaagatatagaataa

SEQ ID NO: 8029 - DNA, 189 bp, Candida albicans
aaggcaaaaagaagaaaaagaagacaaataaaaaaaaataaaaagagcaagaacaaagttgttggattgtttcatcattataaacgtaccgtattaatagatgattctcctacaagtgtaactacaataaatacctctgccactaataacatcttcaccacggagctgcaaggacccgcgcttaggtta

SEQ ID NO: 8030 - DNA, 210 bp, Candida albicans
  unsure (185): Identity of nucleotide sequences at the above locations are unknown.
tttttaaacaatatcagtcagtctgaaccacttgctttgtttctctgttgtggcgcattgaattatccctcctccttcctgctacgacaaaacagttataatgagctgaattcttcactactatctctttctcttcccatgttatttaagttagtacgttttctagatgatccaaaggttcatantagtaacgagtgtgtaatgggagtg

SEQ ID NO: 8031 - DNA, 189 bp, Candida albicans
tcattaatggacttcctccctaccaagaagagtattttgtatttttcaacaacagatactcccaaatggaatagttttggaactttaactccgagtaagatcaaccctaacgaaatagccttacactcacgactgaatataataagaattccaattcttgatcacataatcctcgttacaaatagttag

SEQ ID NO: 8032 - DNA, 312 bp, Candida albicans
aacagccaacttgcagcttatttcactccaggagcaatcatcacggaattccgtttcccatctcagttgcatactctgtgtattatgtatagaggctatttacaatatcaccaagcagtaaaacattctctcctcaaaataacaataagattagtcaagatgaacgactcgaatctattcatatgcattacacatttagtttctcttacaaatagtgatgcaatggtgcaagattacgtcttgtctgcactaactatttgtaacgaggattatgtgatcaagaattggaattcttattatattcagtcgtga

SEQ ID NO: 8033 - DNA, 258 bp, Candida albicans
aggcacaaaataaaaatcaccttcaacctcctcgttttttccaaagcaatgaactcagaaatagaaagtagcttaacacttttaaaaagtgtagagaaactagttcaagcaacatcagtatataagaatgaagacaacgaggaaatattcttacaattgaagcgtgagaggcaggagaacagcaacctgcatgaagaaacagaaaccctttttcacgagtctttggatagattaatgaaggtatgtcaccgtgtttag

SEQ ID NO: 8034 - DNA, 273 bp, Candida albicans
caatggcacgataaaaaaagctcaaacctcaatccaatatcttctactaggactactagtgagctcaactatatcgaactttgttcaagtatttacaatcaatcaagaaaacatccaagatctgtacagggtaacaaagcaaaattcagattatacaaaaacgtttcaaaaaagctgaataggaaaccacggagattaaaaaatggttttaaggtaagtcgaagcactataaactgcagttatggcatctatactgaggacgtttttcaatag

SEQ ID NO: 8035 - DNA, 246 bp, Candida albicans
aacagtttcaataataagcttacaatgaatgcaagtgttaaattaataaatgaaattattaaatctagcaaaggtaataaaatcaagaatacacatgacaatactactaataatataaattcactaaataccgcaactaggatcaacaataaaagtcaattatcaaatttgattcaatcaaatcccaaaatgaaacaagcaattaaattaattgttcaacatcataaaaataaatcccatacatag

SEQ ID NO: 8036 - DNA, 204 bp, Candida albicans
acatttatgccttttgtaacattcacgatgtcagttgggggatcaaaagggttgaacaagccaaagatttggggtcagcaaaatctttcggtaaagaattctgatgaattggtgatgaatggcacagagaatttgaacccagaattgaatgacaaatttgtgcccaatttggaaaatttaactactatgaatacccgtgaaata

SEQ ID NO: 8037 - DNA, 963 bp, Candida albicans
  unsure (666): Identity of nucleotide sequences at the above locations are unknown.
cattccgcacagtggatggctcctgcggtcgtgtgtgaagacaaaggacaaaaggattattccaattattccaattattccaattattccaattcttcaacgtcattagggttgactaataataataataacaatactacaatatcaccagttgattcaacaactataaattcccatactaaaaattcttcacaattaaattatcaatatcataatggtggtagtaataataataaccaccaccatcaccataaaccatcattatcggtatcgataccaccaccacaaatgcattctcatcatcatagttctaccgtttatcaaatggtaacaccaccaaatctggccaataaaaattcaaacaaatcaaactccgctaacaataacaacactactactattgctactactactactactactaataataataataataatagtcagcttcctgcacctcatcaattatcttataataattatttcaattctccaaatatgcaaccaccaccaccaatgaaatatacaccaggtcgcaagcaacaacaacaacaaaaccaaggccaaaatcaacaacaaccattacaattatatcaaggtgataacaataataatggtactaataccaattcaaagtttaatagtatcgctggttctcgtgctgtntcttcttcttcttcttcagcagttagtattgcttcatcaatctcaacaaataattatgataaatatgatgatgacgatgatgatgataatagtaatgatttattttcaagtagtagaagatttatgaattattcaaattattcatcaagtacaatcaatggtagtgttatgagtggagtcattaataataacagtggtaatggtaaaggtaatggtaatggtggtagtggtacacctattagtgaaaatgattctcctatttatactaaaactcgattatgtaatatgattcattaa

SEQ ID NO: 8038 - DNA, 186 bp, Candida albicans
aaaaaaaaaaactcagaactaaaaatagtatatactgtcacacttaatgataataataataaacaagataaacaagataaaaggcaaaacgataagcaactcacatataacaaagatggaattaataaaattgaaaaaaaaaaaaaaacacttttccttttcctcttttttcttaattttttataa

SEQ ID NO: 8039 - DNA, 189 bp, Candida albicans
ataaggcgagttttaatggaaatggaaatgagtgagggagtgagtgagtgtgaaagattagtaatcgaattggtcagaaatttatttaagcaagaaaattttttctttttttcttatcctggtggtaaagttacacgaccactaattttcctacctcctcctcctcctcctcctccgatgatcggatga

SEQ ID NO: 8040 - DNA, 285 bp, Candida albicans
gctgtgagtgaattgaggttgataaaaatgaatgaatatgttaatcaattaatcggattggattggattgaatcggattggtatgaattggtcagaaaaagagagaaagaaagaaaaaaagaattttttttttccttggtgggtgggtggtgtcttgttttggatcaacaacaacaagcaatttcattatatacaacacgtattcaaaataacacgtattcattatatatatatatatatatatatagtcaactactaaagataagaaagatattaacaagataa

SEQ ID NO: 8041 - DNA, 243 bp, Candida albicans
tcttatttaaagtataaatgtaaagacaattcaaaccaattgattgttgttgataatgattggttaaaagtagaaaaaggggataaagcgagctgtaaaaaaaaaccaacaaatgaaaacgtaggaagaaggacaaggagaagggagggaggctctgttttttttgttgtgctggccactaccttttttgttgggggagacaatgaaggaattcgcttcattattactaatttgccaaactaa

SEQ ID NO: 8042 - DNA, 207 bp, Candida albicans
cttctttacaacaaccttgttgtttttttttggttcaagttaaacgatgacaacggctccgagaacagttcagtgaatacaacttgcaaccatatgaagtttaaaattgaatatgaattgcgaaatttctttcaacagggaatgatgattttggttgaatctataaaagtttataataccttgatttaccaattcggaggagggtga

SEQ ID NO: 8043 - DNA, 483 bp, Candida albicans
caggttatgggggggtactactgcagcaagtttcaaatcacagccagcaattttatgaaaggtattgaacaattgaacatgtatccaaaatcaatttatatatacgatatggaacaatttcaatacgagcaggatactctcattgaagttttaaagaaatctctgggaactcatgcttgtttttctcagagtaacgatctggactccgaaacaatgctgaaattttatattaattctaatgtcaagtttgatcatttagaattgtcatacttcctgaatccactcacattaccacttattgccacaagtattaagctacatggcactagattgaataattatgcaattcccggtgtcaaaaagctttcactttttcaaaactctagtggcgacagggatcaaacttatactttctcttccgatttggaggatttgtatatttctgctcgagaatcgattcaagtaactttacctccaaattag

SEQ ID NO: 8044 - DNA, 327 bp, Candida albicans
cagacagtatttaatattagttttcttcacactgaacctactcccatgacaatcataaacattgatccagattttttttttgaatttgcaaagctcccctctgaagttattgctttaattcttgggtttctacaaaaatgtatgttgccgtacctattgtatttccgaccaattaaagagatcgttgcatcggttattctatcagatgtagatattactaagcaaatcgaaaggcataagggtagtcaaatatcattaacaggttatgggggggtactactgcagcaagtttcaaatcacagccagcaattttatgaaaggtattga

SEQ ID NO: 8045 - DNA, 201 bp, Candida albicans
  unsure (1): Identity of nucleotide sequences at the above locations are unknown.
ntgataattctaaaatcattaattaaatttcaccatggaatttcacggttcctttctgaaaatgaaaagattagagattttcaaaattttaattcaataaggaaaaaaataaaactttcaccaaagatatcaattcttatcctttcacaatcagaaaagatattaattttaaaaaccttgcgttacaatctgctggtttaa

SEQ ID NO: 8046 - DNA, 228 bp, Candida albicans
attaattttcaggcgattaataatgggagaattttgaaaaaatgggctatggaaagagtatttggaaatgatggagatgtttttaataaccaaaattttgatttggatggggattcaataaataagagattcattttattgtacgggaataacggggagattattgactataagatattcaataaatcttcgatttattacacatttggaattagatacaaggtataa

SEQ ID NO: 8047 - DNA, 264 bp, Candida albicans
ataagagattcattttattgtacgggaataacggggagattattgactataagatattcaataaatcttcgatttattacacatttggaattagatacaaggtataagattaaaagctacactgagaaagaagatgacgaggaggaagaagaagaagaagaagaagaagaagaagaaatggaatcaaatgatatgacaccaggattatatgttaccccaatcacgggcaaattattgttcttggagcagcgattttttttttga

SEQ ID NO: 8048 - DNA, 480 bp, Candida albicans
atattatcacaattcccccctttcctttaccctttattttatttccttttagtttattcctttttttatttcattatgatatctactttatcttcttcatcttcttcaccactaacaacttcaactcataagttggaaaatccaatagaatcacaaagaaaacgatataaacataatatgcaatccatgtcatccaatactcatcatccacattttcaattgtctaaagacaatgaaaacaacaacaaccaccaccatcaacatcaacaacaacatgaaccagaatatataagtactggaacatctttacataacactaacaatggaaccttcaccccaatcactcaaacccattctcatgaatatcttatgacgatgggtgaagaaaccatcatcaataacaataataataaacttgatatagaaatgattactgaagataaatttttccaacctcaacaacatattgaaaagcctaaa

SEQ ID NO: 8049 - DNA, 192 bp, Candida albicans
caacgatccaaaaaatcaggacgtaatctaccaaaccaatttttcacaatatttgtaacaaatgaagtaattaatacacttaataataatccaatgcttgaaacccaagtattatataatttatatttaggaggacaagtggaaattagggcaacaatgataattacagataaagggataacagtactataa

SEQ ID NO: 8050 - DNA, 201 bp, Candida albicans
ttgtatattggtgagtcgttcatgttcgcacaaggaagtgaaaagtcctatcctttaaataaaatgtttataaaatggtccgcctggaagttacaaaaaatattcccttcatcccggaataatttaaatcctggaacccccttaaaaaggttggggaataaaccccccttttttcttgaaattgaaattaaacctataata

SEQ ID NO: 8051 - DNA, 315 bp, Candida albicans
gaatttgtattcgttacagatgatggttctcccttggatgaagtgctagtccctttgtcttcagttttgtgttcatcacgatttggtgttattggcaaaggtttatcatctttaggagggtggtgttttattttatttgaggtactaattggaggtggtttagtcatatttattgaagactccggagtggtggagttgacaacagatgattctgttatattgcttaccgcagaaaccattgaatcaaccgaatcggtacttgtgcgacataattgtgattatttaacagacgccgctagaaatcagtttgtcaga

SEQ ID NO: 8052 - DNA, 183 bp, Candida albicans
agacaagttagaactctaaaactttttgccggttatagcaacaaaattatacaactaccttcattagtaatgtttcatgtaccctttacattgaaatgctatttacgaataaataacaccagtagaaaaaccattgaaataggtttttatgttgtaaagctctgttcgaaaatggcatggtag

SEQ ID NO: 8053 - DNA, 195 bp, Candida albicans
tactattatttctccaccatttactgtgcctctttatatagagttttagttacacttgtattaattattgttcttgatatattaccacttcttgttattcatttgcccttaatgacaagtccgtattgtatacttgttcacgtgatattacgctacaggtttactcaatgctgtgtattatcaacctctttgtaa

SEQ ID NO: 8054 - DNA, 198 bp, Candida albicans
acagtttcttttaaaacaagaattgtttatgaacaatcatctatttgtttcaacaatttttcttgttttagtatttttaacgatatatttagtccatgttacattttacctaaaagaaaaaaaaaagctgtcactcatttaagactattatacgttatgatttggttttggatgccttttactttattgaatgagtag

SEQ ID NO: 8055 - DNA, 285 bp, Candida albicans
tttatcccacaatcccgtagtagtcattttcgtttttgcttcttcatcatcactatggaaactcaactcattagtgataatatcatcaacagccaatccatgattagcaagacattgtttgatgaaaatacttgtccaattagcactaactataattattgggatattcaaattttgacaacgtttgacaaactgactaaacccaggtcggagttttattttattatggtttatgttaacataatcctggaaatcttttttggtcaaaccttcgaatatctttga

SEQ ID NO: 8056 - DNA, 750 bp, Candida albicans
tcaagaatccaagatataacattatcgatattaagaatattggcagatttaaaagatagttatggtccttcaagaatattggttttgcatggattatatgatggattaaatcatcaagccaataggaaacaagtattacaatatggaattcatgatattccattattagtattatttgaaaaaaaatgtgaaggagaaatatatgaaagatatcatcaaactcttaatttaaggttattacttaatttcaaattagatataaaatcatttttatcaacattaaataaattcattaaacataatggatttgaattattaaaagaaaatcatcaattatttaccaattatattcaagatgtgccaatagagaaatttatgtcccatcaagaattaggtgattgtggaccagaatacaaggcattgtttttaggtattaccgataaagatattggcgctgttcttgaagaagaatctcaagagaaagatttgttattggccaaattatttgcatctggtcttaaaacaaccgaattaaagaaattcaattcaagattacaaaaacttgttttactggatgatatggaaatcatacaaacattaagtcaagctgaatttgaattgataggaatccctgacaatgaagacatttccaaattatgggaaaccataaaaaatgaaatccaatcaaacgaatatagaattcttgaagagtgtctttataaatttagacttttcaatcaaatttattaa

SEQ ID NO: 8057 - DNA, 702 bp, Candida albicans
aattcaactttccaatttgaaaatataaccacgattattgatttccatagaatcatgttaaacaattcttatgaaacatcgaaaacttcaagatttttttataaattaaaagatgaaatcttaggtgaatactatactactttaaaccttacttttgagaaaaccaccacaaacacaaatgccagcattaacatctcagctattctagatgtattaaatcctggtattgttcaaaataaagccaattacaatatggtaaatttactttatcattatcttgaaataactgaaacacctgaatcaatttatcaaattgtaaagtttttaagtgaattatggtttaatttatctgccacaagattgaaattacaagcattaccattacatctttccattataaaaacatttttccaccccaaagtggttttctcaaaggtagataaagatgaagaagaagaagaagatattatcattagtgatatgtcacatcaatttggtatttcaattatagaaaattctaaagttagaagaagttttttaccaactttaactttatgtttatcaaattgtcaaattcaaaatcaaaaacaatttgaatcatgtcaatggattcctgaactgttaattaaagcatatttaatatttcaaccagaagctcattttttcattctccccattatattaactgatatttatgattaa

SEQ ID NO: 8058 - DNA, 186 bp, Candida albicans
agagaagagagaagaaaaaatttttttactcagcttgatttacttcttcttttcttttcttccttagtcattcaatcaatcaatcaatcaatcaatcaaacaaccaacgacaattccaaaaggtatatcaacttgactttattttatttagttgggattaactttattctgtggatagctttttaa

SEQ ID NO: 8059 - DNA, 186 bp, Candida albicans
cccaagaaattaaaagagttaatagtaataaaaatacactccaacaagagtttgtttttgatgggtgaaattgaaattgaaattgaaattgaaattgttaaagccgaagaagaagaaagtagaaaaatttttattgtctgtctgtcccaagtgagtactaaaaaaaaagtaaaattgtttgtttag

SEQ ID NO: 8060 - DNA, 279 bp, Candida albicans
gtgtcttattcaatcacagactgttttcagaatctctccaatatcttgtcctgtattaaaaccccatctgttagccagctttttgttaaattacctagcttaagtcacgtgatcaggtttgtagtaatatcacgcgtactgcatattataaaatggctggcttgttgcttgaaccaaagaggaaaaattattgaaactaactttaaaatcaatacaaaaaaaaaatgcgaagaaataaataatgtacaaagcaacaacaacccttttgctttgaagtaa

SEQ ID NO: 8061 - DNA, 198 bp, Candida albicans
gatatacaaacaataaatactattttttgtaattgttttcacgaagtaaataaagaaacaaaaaaaaaaactaactactgtaactttatattaacttgcaaaacaacaataataaataaagtagataaacaatatcttttttttctttattcaatgaacaatagttgttgttgtcgatgtctagcatttatcttataa

SEQ ID NO: 8062 - DNA, 183 bp, Candida albicans
aagaaggctaagttgttgcagttgaaaacaagcgggccagcgccaaaccaagaaagttacggaaaaaaggaaaaaaataacaagaagagtcttcagtattcatcgatcaagtttaccgcaaatttttatggtgtcaatttttgtaacctccatatttcctttgttaagactataaaatattga

SEQ ID NO: 8063 - DNA, 225 bp, Candida albicans
aacaccaaggcaagcacttgtattactaccaataaatcattaagaattcgatctttaggtttaataacatcatctaaaaatttatcaatcattaaccaaatttacctgaataaatccatcaattccatttgtcaattcaatacctaccaaatatgggggccccccaagtttcaattaatatgtttgaaacaacaattaattcgtcttaaaaaacataaccttggg

SEQ ID NO: 8064 - DNA, 234 bp, Candida albicans
atttggttaatgattgataaatttttagatgatgttattaaacctaaagatcgaattcttaatgatttattggtagtaatacaagtgcttgccttggtgttttataattgtgggagtaatataggtttaatggttaataatataacacagtatagatttgcaccttttagctattgggtgaaagttaaagtatatatgttgatcgtatttatgagatataacaaaaaaaagtga

SEQ ID NO: 8065 - DNA, 255 bp, Candida albicans
ataacaggtattgttgtttttgttgctattccacaaggattctcttgtattctattttataaaaaaatctatgtttacacattgtttgaaataggagtaaatgggggaaaaagagaagttagggagacaccggaaaacatagagaaaaagagagagaatgtgaaagaatacaatgtgtgtttacttgcaattcataactacttttgtataaaattcacgtttagaaatttaaaaattctaaaaatttatgagtga

SEQ ID NO: 8066 - DNA, 192 bp, Candida albicans
tttcttagattgtttttcctttctctttgctattacacatttacaaagagtaattttttgaaatccacaaaccactcaaccaaccaacaagaaatccacatagaagggtatttaactatatctttctttcattgcatatacacagaacactcatcagcagaattaatttataaaaacattaaattatcctaa

SEQ ID NO: 8067 - DNA, 318 bp, Candida albicans
aaccaacctttgagttacgctgaagttgcctcattgggtaaaaacaaaaagcaaaccaatatggccaaacctagtaaaggcgtgatcaataagaatcaatttaacgtgttaaatgataaggatattaacactaatgacgatagtgacaaagatgtcattcatggcaaagatgttgataattatcaatatgacccaataaagtctggtgacgagtatgataaaagtaagagttataaattaaaacaacaaaagtcagttcataagaaaaaacaattacatcgtgagtttaaagctcaaaaattaaaagcaagcgcttaa

SEQ ID NO: 8068 - DNA, 234 bp, Candida albicans
tttataaaaacattaaattatcctaaatgtttaaatcatctttcaatgctagtagtttcattcctacatggttcaagaaactgtcaacatcaacacaatcaaatgctggttgatccaagtactattcctagaaactttactatatcgaacactgataataaattgatcaatgtgtcgatgaacaatgtccaacacgatgatgatgaattcattgatattgaaaccaacctttga

SEQ ID NO: 8069 - DNA, 213 bp, Candida albicans
ggatgttgtgggttgtgggtggttgtgggtcataaattatttagaaacacgttgataagagaatccactaaaaaaattcataatcagatgtctatatgcagtatacacctaattttttttacttactcatacttaaaatttgaaatgataaacaaacaacaaacaaaactaaatttgatagagataaaaaccacatgtgtgtatgaaggttga

SEQ ID NO: 8070 - DNA, 1314 bp, Candida albicans
gatatgactactgcaactgctacccccacagttatggctacccctacaacaactcaccgtaccacgttaatgtcgacatcagatgcattaattacattttcagatcatattttacatcaaattgataatttacaaaaagttgaatataataaaaagggtaggaaatatcgatttgttaataatacattccaaaggattcgtcaagaagataaacatttaattatttatcctgaagatttaaatgaaaaattatcattttattcagcatttactatattatataatattggtgaaggagaaattttacaacaattcccatcattttgttgtacaatattaagtttagcattagaattagagaaaaataaatggtatgaagttgaaaattcttcaattattcattttaaaaatgctaaatatgatccaagagatttaaaagatttagctgatgattatattcaatgtcatcctattgaaaatcatcatattgaatggggggttaatttaatgattgcttcaaaattgaattttttacatactgatcatcatattggaacaaaattagaaggttattatatgaaatatttcattgaatcttattatggagaagaggcattattatcccatgatgtattagtagctttgaaaagttgtgtacattgggggaatataaaggggattttatataaattggatgtacctaatattaaaattgatgatgaattgaaaaaatgttttgataatttccctgatccaatggaagaattgaaattaaatgtatatgatcgatatcctagtggtacttcgaaatattcattaatccgtaaaagtattgatattttggccgattgggaattttcaaaattgattcctacaacaacaaatattgaattggattggttatataatttatgtcatgaaattgaaactaatcctataaaatatcatttacgttctaaaactaaagatttatgtgttgatccaattaatttatcagaattaaatatgaaatttggtccagcaataaatcaattattaaattatatttctttaattattaatatttttaataataccggtggtgaatttttattacaaaattcgaaaattcctaaattaactcctgatttaattaatcaaaatttgaatttatataataaattaattcaaattaatgaacaaattgaaatttatttatcgaaaaattgggatgttgatgatataattattcgtttagatagtggtgattcaaaaaattcattatttactaaagtaatggaaatgagacaaaaatatatcgatgattatgaatag

SEQ ID NO: 8071 - DNA, 252 bp, Candida albicans
cttcatcattcacctatctgtctcatcatagctttcctagaaaacttccaagctatatacaactatccaacgcccaatagccgcaaaaaaaacttatcactcagactacagactgacatccgtactatcgaaaaatacgattttcaagtgaccatatctggttctcttgtttcaaagtgcaagaccaagcttagaaagagaatcatcttgctaaaacatttatttgaaacagctacaactagcaacaggtaa

SEQ ID NO: 8072 - DNA, 348 bp, Candida albicans
gacacacccaaatttcaagtaatattcttcacaattattatcatagggcggttaatgtcgaggaccagacgctgcaataaaggaaatagccaaagttcacattttcggggggaacacacacggacacacacaccattggtggtaaattgttctactcaggataacagccagtcggtcaaaatcaatgagcagcagttcaacaaaatccacattccatacataatggagaagcaagatgagagtatttctttaagacaaaaagcgaccatgaaacattgcaagttcatctcaaagccgagctactcgttctccaccccatcttccttaagagaacttttcttggactga

SEQ ID NO: 8073 - DNA, 243 bp, Candida albicans
gcatatctttggtttatttcacagcttctcaagcttgagaattactgctttggccatctctcgccaccacgcatcgtctttcttcccctctcatttcccaccgaacctcttcatttcaacgttacattagcgcttgatacactctatttcaattacggacccgtatcatatgtaaagcaatcgtgcaaatcactaagtttgcaacttatgccaaactttgagctgtattaccgcacatcatag

SEQ ID NO: 8074 - DNA, 519 bp, Candida albicans
gtaatcacttcattggtcttaacaatcaggactttaaattgtttttttttgtttttgaatctccaattgcctcccatcttcatgacaatcataaacgttaatcctggctttttttatgagcttacaaagctcccctctgaggttattgctttaattcttgggttactaccaaaatgtatgttaccagaattattgtatttcccgccaattaaagagatcgttatatcaacaattttttcaaatgtaagcatcacctatcaaactgaaagacatcggggtaatgatggagcagaggctggttactgggaatgtgactgccacgagttctgtttcacactcgttgatttgttagaaggtattaaaaaatggaatatatatccaagatccatccatatacacaatatggatggatttcaaaacgaaccggataccttcgttgaacttttaaagaaagctctgagtattcatggtacattttatcaaaatatgggtctggatcaagaaacccagttagatttg

SEQ ID NO: 8075 - DNA, 201 bp, Candida albicans
gagcacaaggcggagttatttagaatcctcttctttgctatgttttgttttgtacttggagaccaattaattaatcaacccactcactcactcactcactcactcaccaccgccacttcgactgccaccacacacacacacacacacaccgcccaccctacaacacaaacccaactatatattagttatactatggtgtaa

SEQ ID NO: 8076 - DNA, 219 bp, Candida albicans
ccagaagatttatttgtatatcgtagagaaataaagggtgggaataaaccattattgataacattagttgttgttaccaactcatttttttatactatatatgtctgtttgtctatctatctatctcatttaaaaatctacagacgattgttaatatcaatgttatgttcaatttttcctactaatagtttacaatttcaatttcctcttttcctatag

SEQ ID NO: 8077 - DNA, 471 bp, Candida albicans
aatttattgaaaaaaagtgtggcatcaaagccttttcttgcaaaccatgctgttgtctatctgctctgtgatacattaacaataatactaacttttaaacactccaagatggcaaatgaaagaacatttctatcgtggattagaacagcattagtgtttttaacatttagtattggatttttacaattttatcgattagagataaaagccaacaccaataccttaggtgattcaaatttactgcaaatgattcaaactttaggtaaaccacttggagccatgggtaccatattgagtgggttgactgtcacatttggaactattcgatatttccaagttcaagaattattacttgatgattattatccagttactcgattcacaattattattttgatacttatcaatttaagcatccttgtggtgttgtttattctaaatatagatatatctctctttgtaatgctgtga

SEQ ID NO: 8078 - DNA, 192 bp, Candida albicans
aaaggaaagattgttgattctattttggcaacacggttgtcagtgtatgtttacaactctttttttgttttggcaacagaaacaacttcccctactacaagaaaactaaaaaagcgtcatgccacaactagctgttgtgtattggaattgcaaatctatttaatacaagatatactttcaaaaacatcttag

SEQ ID NO: 8079 - DNA, 201 bp, Candida albicans
actgttaatgccattttaggtgatgttgttctacttttcgttgttgttattgacgatgacaaagataattgggctttgccaatgattggtcgtattatcagtaatttcgatgagcgtggggttaatctagatatcgtatgtaatgaattgaaatgtattactctagatcttcaccacgaggctggccggatccgcgcctaa

SEQ ID NO: 8080 - DNA, 309 bp, Candida albicans
tataactcaactgactattatcacttagccatcggatctttatatttgtttgtcctttattatcagctcatgatagtaacatttaattcaagatcacaaagaaaggaaggaaataaaattgattccgacaccaccaccaccaccaccacgactccaattaccgcagcaactgggattactgctgttttaacagttatacatgaggaagaaggcctgcagaaaaatgtgaaacatattaatggatccaaggactattataagtttaaagatggaagatcacggaatggatgtttaacttgtaaagtctga

SEQ ID NO: 8081 - DNA, 213 bp, Candida albicans
ccccattatcataaacctaatcaatggatctacaaaaaaatagagcaatttaaattgcccacgattattgatattcctctttttatgatatcattgtttcaagtgttgttgctattgggaaagaaatacaacattctcaaatctttttcctttgattttaaagttatgagaaacgtatctaaaacaaaaccaaaaaaaacaaaactcgaatga

SEQ ID NO: 8082 - DNA, 201 bp, Candida albicans
ttatataatagttgcaaataccagcaacaaaaaaaaaaaataacggacattcaattggtagcagagcgagaagaagaagataaagttacatgcaccaccaccactaccgtcactattgcagttattgtcgttttgagtatcacattcaacaattttattatcaattccaagagcttccctaaaggggcttgttatacatga

SEQ ID NO: 8083 - DNA, 207 bp, Candida albicans
aggggcttgttatacatgagtgaatactataatagtaaaagaaatatattgcaagtaatacacacaaaaaagtatttttgtttcgggggacggaggagggtggacgagggtgagcaaagttggaattggaaaaacataacaaaacaaattaaatacttaaaaagaccagacccccctcccccccctttggaagtattatttacttaa

SEQ ID NO: 8084 - DNA, 279 bp, Candida albicans
ttgattgtgaaaatgtgggttgaaaattgcttgaattttattgtgggacgaacaaaacgaacaaaaattgtagacagagagacagagagagttgttttgttggagtatgaaaatttgttccgctggataaagaaagaaaaaaatttaaaatgtgggggagacagagagagagaagaaccgaaattaattataaggaggggaagaactaccaaattaaccgtctgtaaattattcatagttgagaagcatacagacaggaagtttctacttcaattatag

SEQ ID NO: 8085 - DNA, 198 bp, Candida albicans
atggttatcttttcggtactactaacccatttgttctcaagattttggattttcgtatcatttttgttgcaaattcaggagaaaaaattgctttcaccaaaatcattaccaatgtgtaatgtcgtgacacaagcaaaaggtagtaatactaattgttatatcatgaaaaatcttgaccaaaacaggttgaaacaatag

SEQ ID NO: 8086 - DNA, 273 bp, Candida albicans
agacaaaagcattttattactttcattggtttggtttggttttttttttttcaatattattcattcattcattccattttattatattatattatattatattattttgtatcatttgaaattggtttagggttgaatgttcttgccctgactagttttagtttctatagacttttacatttcattatgtttttactttttttttttttgttttttgacattcatcttgttatttttcctataacattattattatcatcatcatcattttaa

SEQ ID NO: 8087 - DNA, 408 bp, Candida albicans
gaaaaaaaccggcccttttcccaggcaatggtattcaaaaaatggaatcaattatccacaacaacgaattactgttgtacagggacccatcaggccaattcaggaactttgacaaatcttataaactctaaagaaattgaaaacttgaaacttgaaaacaccgagttgataactaacttaaataatttaattatcaataacgaaaaactaacacaaacaatcaatgccagagatcaaaccataaaatcattaaccaaaatcaacgacaaattgaataataaaattgatgcattaaatttggaaataaacgagaaaaacaaaactatagaattgattaatgatgaagtattgacaaatcaaatacaattgaatgtattgagaagtaaactagagtcgttggagaggtaa

SEQ ID NO: 8088 - DNA, 267 bp, Candida albicans
gacgatctatgtttatacacggatcaatgtcaacctaatcaatacggttattcttactttctcttggcagataattggaattccaagtgttacattttcatattattgtataatagtagtcgcctactactaaatttcaaaaacacaatcccgaaaggtcaattgtatttttataatttttaccttgaagatttaagccaagttttcaaaaattcggttaaacttaactttaactcaaatgatttctgtaatatgactagagtttaa

SEQ ID NO: 8089 - DNA, 210 bp, Candida albicans
tctgattcttgttcattagtcattcgtgctcgaaattttttaactgcatatattttggtaggatcatttttagatgttaataaattgactgatccactagctcctgtacctaataatttccctggtgatccatatttagcaaataaatttgtggcattagaattaattggagccggtttaccagcaccaaaatgtttttgcttttcataa

SEQ ID NO: 8090 - DNA, 222 bp, Candida albicans
aataaaaaattggaaagagtatattatatatatatatatactttgaaaatattcatttcaagaatgggtttgaattctcaattttatttttctaattttggttcttattattattatctctaccagaacaatgtatctttttactctagaaatacaaaatatcaaaaatctaacacaagaatgaaaaaaaaagagaaattaagcagcaacaacaggaggtaa

SEQ ID NO: 8091 - DNA, 183 bp, Candida albicans
ttcttcctaagtaaaaattatttttggttctcacttgtttcatctcaacaacaacaacaacaacaacaactcaaacagttctctacattaacacaaacaaacaatcatagcaatgaaatttactcaaatcttatcaattggtttattatcaaccattgttcacagtgctgctattccagataa

SEQ ID NO: 8092 - DNA, 408 bp, Candida albicans
cacaaacaaacaatcatagcaatgaaatttactcaaatcttatcaattggtttattatcaaccattgttcacagtgctgctattccagataatggtaatgccttatcaagcattattggtggtgctaaacctgaagaaattgctgctgctggtgaaattgttaaaaacgttttaggttcaggagttcttaacaatgctgatgtttctccttctgttgatttatatactgttttgaatgctcttaatggtgttgctggtggtgttattactaaaagagatgaagaagatggtcaacaaaaagatggtagtgagttcgaaaaaagagatgttggtgttgctttaggacttgctgtttctcttttgaaattattggctatcagtgtcagtcttggtggtctcatcaattga

SEQ ID NO: 8093 - DNA, 267 bp, Candida albicans
ttgaagagcaaagattgtggatgtaaatgtaatgaactagttcaagattgttctgtttcccgtatgatatggaacaaaaaaaatcaatttaagcctgggaaaagaaaaagaatagaatattatttaatgataacacaaccccccagtttgatgagaaagggaattttttctaaattattaattaaagattataaattgatggcaacaaaaaaggggaaagaaaaaaaaaaattgtacaaacagaaaatccgaaaattcaaaaaatga

SEQ ID NO: 8094 - DNA, 270 bp, Candida albicans
gtaatgtctgaaacatttccagaaactaacactcctgtacaaactccatctactgaaagttttgttaacaagatgaatgctggcgacaaaactattggcaataatattttctctcaagatagtgatagtaaccaacaaagttcacatcaagaaccgctttcgcctcctaatccatctcctactcccgagaaaagacaattagacgatgaggtggataatagtatcgagccagagagtacgaaaccaaaggtgaatattcgcaacgcctga

SEQ ID NO: 8095 - DNA, 519 bp, Candida albicans
  unsure (469),(515): Identity of nucleotide sequences at the above locations are unknown.
cgacatggaggagggaaatgtgtagtctataaggattgtttaaaaaaagaaaaattgaaattaactctaaaattatcttacgtggctaataataattgtatgtgtgtgtctgttcgtttttttctcgttgtctctgcctcgttgaatttttcaccttccatccaaatccacatcaattccattcttggcagtaaacaaagaaaaaaattctggcctaaacgaaaaccaaccaatatactaaccaacttaccaccccctttcccaaaaatgctgagtccaaatgatagaaataaaaaattctttaatagtttaactccaatagttttaagagataaaccaatttcaagttatgcttcatcagaaattataacagttgcaattaatcaaactggtactagagtggtatattcacgtacagatagatcagtaaggatttggaaatgtcttcctgcttcagtagttgacccanaaactattgttgatgcccatctgaaagcagtcgaatgtgtatcttnttaa

SEQ ID NO: 8096 - DNA, 225 bp, Candida albicans
agacttttggatttagatttggatttttcattgtctgttgatggaattcttgaaaataatttggcatcactaaatactttgattaaaaaaatcaccatattggaatttatttcatttttgagcaaagtggccaatttggtgaaactttggaaaatgatttttttactgtataatatgagacttataaatactctgtcggttgataatttattattgaatgcataa

SEQ ID NO: 8097 - DNA, 207 bp, Candida albicans
atggtgattgaatgctcgtgtaattcaactaacattcttgaatgttacaacttatgtagggtaaaaaaaaaggagataacacaaagttctaaagtttacacaaaaacactgattgctaagctgtcaacaattggaccttgggcttatacatgcatgtccattgacactattaagatttattctacttttacgttcgctaatacataa

SEQ ID NO: 8098 - DNA, 366 bp, Candida albicans
atggatgatgaagatttatatgatgaatttggtaattatataggagattcattagattcatccgataatgatgatgatgatgaaactcaagatgatttatttgctgcagcacaaccaccatcaatacatgataatgaatatctgcaagatgaagaagaagtagaagatgatgatgatgaagaagaagatgcaaatggaaaatcccagttagtcaagaccactacaactaacagtaatgatactgcattagttaaaactaatatagatacaaatcaagcagaaactatttatattcaatcacaaactcaatcactttccaatcaaccaataattcaacccaatcatggaaaaaaccatgaaacttga

SEQ ID NO: 8099 - DNA, 210 bp, Candida albicans
tacagtctctatactttcttttgcttttcttttctttttttttttttcataatgacatgtcaagaggattgttcatgtaagaataatgaagcccccacaacaaagacaactgccaccacaactaatgttggtgatggccctggccctggccctatccctggcaataatgatgatgatgatgatgacatttggtcagatgatgatacgaaa

SEQ ID NO: 8100 - DNA, 231 bp, Candida albicans
ataattgtatggcagtttttttctgctttatgctcatatctatactatctacttgtatataaacattttataaatatattccctatagtctatatgttgtatgattcaagtaatatgtctgattcccaccacaatggtcagaattgttatgtggtctcgtgtgtgggtgtgtgcatgcgtgcgtgggaaagaaaaaaaatatttttaaatactttcaaacaaaacttttag

SEQ ID NO: 8101 - DNA, 408 bp, Candida albicans
atgatttgttttgttacccatttattattttgttgtaaagtattggtccttacacacaaaataaaacatataagctaccaactgagtacaaaatcaaaaggaaaaaaaaaacttattgtttctatttccactactacgactattatttctactagtagtgtggtggctttggtcgtgatggcgacaaaaacaccggagttggcacgggttataaacttatccgctaccaaaaattccggaaaatatgattgcttggccagaaactttttcttatttaggtcatctcatctcttcgtaatattgattattgaacatcatctaagtaatacaattaatcttatacagatacggttgaatagaggcatacatatacatatacttcatatcattggtctccataagaaataa

SEQ ID NO: 8102 - DNA, 183 bp, Candida albicans
gatttagtttatggcaaatatttctttattgcctcaattaagattagaagaaacaacaagagaacaagagaacaagaacaagaaaaaaaatatagtaatatatatttctgggcaatgcagcaattctcggatatcaccgaaaaaaaagatcttagcgggcacgacacgactctcttgatataa

SEQ ID NO: 8103 - DNA, 594 bp, Candida albicans
ctcaagcttggaccttgcagcccggtggtgaagaacaacaatgtcgttcaagttatttcgaccagctcatatattttcagtgatgaaattgtggataatatatttaaccaacaatccaaacctgccaaatcatccactaaatatattgaggtatcttatgaaaatgcaatcagtgtatctcaatctcaaatatgggcgaggtttaaaaattgtatacctaatcattcccagaatcgggcaacttataaacaaggatggtcaattgacttgggatctggtggtaatgcaagattggatttcagtaattttttgggtggaattggtccagcatttaaaaatgaattagttggtagtttcggtattggtggaagtttaacttgtgaaatcaatgctgggaatcatttacaaattgccgtgttggtgaaaagttttacagtagataaagttaaacaacgtgaagtcaaatttacaaagtttggattgaaaaattccaaaaaaaagggttggacgtttttccccaagtttgtattgtttgacaaaaaaagccttgagattgcttgtattacagaccccaaattcttagactgctcatag

SEQ ID NO: 8104 - DNA, 213 bp, Candida albicans
catgtctatatatatatatatatattaatggattatagttttatggggaggttttgttgtaagcatcactacagaataataattgccaaatttggaatcaacaatgaagaacaacaaatacttgaatgcaaaaaaaaaaaaaaaaaaaaaaagatgcatatggtagcgtggtgtaacagaatcagtcaattatcaacattagttaaactgtaa

SEQ ID NO: 8105 - DNA, 198 bp, Candida albicans
aatactggattgattgaattaggaaatttcattgcctatttaagaaatgacccgaaaaaaaaaaaaataaaaaaagataatctaaaattaaaaaaaagtttaaaaaaaattgtttctttttttattttggcggctctatggtcgtgtttttttttttcattttttttagttttagttacctcttttgaaacagaataa

SEQ ID NO: 8106 - DNA, 378 bp, Candida albicans
ctattactaagtcaagaacctaaattcaaattgcctattggaagtatttcttctgttttagatattgattctattgattctcatcttgataaattgtcattggaacaattaaaggaaatgtatggtgattatcttcctccatcaattgcttcaaaccctacaaaaagtcaaattatggaagtggtacgtagtgggtttttccaacagtgtgaacaaaaactcagtgagctgttacgaggcaactcaggagcagggtatttgatgtcacaaagtttgaaatacgattataaaggagaaggtgttgaaagctttttcaatggtgttagagaattaggtaaaaaggaacaaaacgacaaagatgaagacatgaaagattga

SEQ ID NO: 8107 - DNA, 279 bp, Candida albicans
atgtataatggaaataaaaatgaaacgaaacttaccaccttagtatgcattttactaaggcaactgactttgccactaagaagtaggaaaatcctcacccccttttcatactacaactcaaatgatattttcaaaacgttatacaaaaaacttcttaaattaatactatacaataaagaaaacgaactaaaaagacaattagaaatacaacccagtttaaccaccgaaaccatacaaggttctaccttgtctcttcaaagcgtaaacaacatccaatga

SEQ ID NO: 8108 - DNA, 216 bp, Candida albicans
attaatctattcgagtttatggaattacattttttttgtaacactcttattagagacaattcgaaagcagtttacaacaaccaattcaataacacattcattgttaaactcttttccgttgttagtcgtgtttcaaaatattcagaccagatcaaacaagtcataacaagatattttgtttgtaattataattcaattataatcaattgttggtag

SEQ ID NO: 8109 - DNA, 249 bp, Candida albicans
aatcagactcccgagatgcccaataataatacaaatctaacccagcccacttgtacaaggtacaattcactaatttgtgtgtgttgtgtaggtctatgcaaatatccaaactactgtgttataataccggtagagtataaacctcctagagaagaaaacaactataacatttactacaacttttatacagcatgggtgttgaacttcgaaaatctggaaaaacaaattggaatgctcaaggcatattaa

SEQ ID NO: 8110 - DNA, 267 bp, Candida albicans
aatctattgaaggatacccaatattcactcgagcaggacgaatcgtttaaacagcaaatttatactaggaacattgagacatcggattttttcaatttgtcgcagattctacagtacgattgtgaatcgatgttgttgcttagagattatcgaccatttgacgatcaaataggtttgacgagaagtacattaagtatggatgttattaaagattactataatgataaaacggttatactagatagcttgttttcgctgaatagataa

SEQ ID NO: 8111 - DNA, 1164 bp, Candida albicans
aagggactttcccaaattatcgggtatagaactgttaaattaattttttttgtcaacagagactttcctacatgtgatgtcacgttcaactgtcttgatcgaagaattttccgtcgagtacttccagaaaatgtgaagacaaaagtagcggctgatttcagtttccatgttgttttaggaaaaaataacttattggaccatttgagtgatatgatgttggatacaccgacaactgcccatcgcaatgtattttcggaatcgtttttatgtcttggggaaacaatcatcttaaaagttttcaataaacgacagaaaattttgggcacttatagccgcagcgaactaaatttcatttcttggttaaataaaaaatgtttggatagacatggattttgtcaagaagaaataaagaagttgattgcctcatttcataaaaatttaggcaaaataacgagttgggaacttgaaaaacaaattcatcttggtgcttatgtaagttatttattgaactttgttgtgcttatgttgaagtttggggctcaagcttattttgattcatcaaaagggattttccaatcttttgaggcatttttggcatatgttgagaaatacactattctgcctagtacaacagtggattttttgatgaataatattcaatacaatatcatgagtattaatgttccttcatacccaccacaatttttatttgaaattgaatctaatttgagaagtttggagtttgtatttatacgcccgacagtattcaaagatgaatctattaacgaacgtttccaaaaaattgaataccatttcaaatcgttactcaagtttttcagtgggtatgtgttgcctatcgtgtatgcctcgcgtgatgaaaattcggtttccatttacccaccacaggccatatatgagatatttcaagaatggcatacgaatgtcccctcagaaacaatgagccatcatcaaagtatcgatgctaataatccactggagtatgagtttttgtatgatttatctagtacattatacatgtactattatgcagttgcagcagcatttgatgctattgtccacagggtgtatatttctctattgcgtcagctttatattgcccacaaatatactctatcgaaacatgaaaatattgactataagtaa

SEQ ID NO: 8112 - DNA, 531 bp, Candida albicans
gccatcatcaaagtatcgatgctaataatccactggagtatgagtttttgtatgatttatctagtacattatacatgtactattatgcagttgcagcagcatttgatgctattgtccacagggtgtatatttctctattgcgtcagctttatattgcccacaaatatactctatcgaaacatgaaaatattgactataagtaaagatcactattatttggaacgactatatccatttaaagttgacattttgttgcaacgtcatgtcttttacgcgtcgagtatatttgcctttttcagaagaaggttttgtttctaccacaattacactgattggtatagtccatttgatgatagattaaagaaaaatagatttaaatcaagaactattaggaatagttttgaagtgccaattcatagtttcaacaatacgttgatacatccagaacattatcctctccgtgacgagaaagttgctttagaatctattgaaggatacccaatattcactcgagcaggacgaatcgtttaa

SEQ ID NO: 8113 - DNA, 237 bp, Candida albicans
gtacgtgcacactttctctatgtacacacacccacattacataaactaataatcccaattagtaatatgaagagagagagagagatgaagagagagagagatattaagttaaattacacaaaaccgcctacttttagtcccccccaacagaaaaatctcccaattaggaaatgttataatcttatgtcatcatcaatcatccatcatcaccatcatcatcaccaccaccaccactaa

SEQ ID NO: 8114 - DNA, 198 bp, Candida albicans
attatcatatcaatgcaatttttattcacatttatatttctacttataccattagtatattcattaccagcagcatcacctaaatcaggcacagattttgatttcaatcaagaaattgaaacctttgtggaacaagcatttaatcaagatgatccttctcaagcagcagcagcgtcttcaccacggaggctggaagga

SEQ ID NO: 8115 - DNA, 312 bp, Candida albicans
aacaaaaaaacggaaaaagaaaaagaaaaccccgaagctgagaaattttggaacactttcctaattaggaaattagttgatttcatgtgcattaacagagacaagaatagccactgtttaattgggactcatctattcaatatctcctcattaggtgggtacttacatagatatactctctcctgcatcatcatctacactcatacactcttgatgtacacacacagacttttttttactggatttggtttaaacttgattggaatagtaatttattttactacttcttataaactttatgaactaagttaa

SEQ ID NO: 8116 - DNA, 429 bp, Candida albicans
  unsure (91): Identity of nucleotide sequences at the above locations are unknown.
gtggttagtttacaagatttaaaccttttccacccaccccacgatttgggttctattttcgggacaaagtccgttaaggtgcagatcaatnatatcccaatgtatagaacattacagggatttaacaatattccacagaagttactggttgatgatgacattaatttcccaacagaagttccaaaagcaaagaaacgcaaacatagtcaccacaagaacaaaaagaacagaagcagcaaagatactggaagtagtgggtttactttggcaacggcaacaactcccacaagttttataagtgacgctgcaagccggtttacatcagacactaacagtaaatacacccttgattcttctttagactcaccacaaactggtggagaatcaagtaatttaaatagtattttcaatagttccccaattaggtag

SEQ ID NO: 8117 - DNA, 1185 bp, Candida albicans
  unsure (159),(204): Identity of nucleotide sequences at the above locations are unknown.
tttatgaacatatttataagagtattcatagtatgctttcggccatggtccaaattccacggtatatccccacgtgccaatcctgcagatgatgtgaataacactgatcctaatttaaaaagaatttctcaatttatacttttaggagctgcagaagcnacggggaatagacatcatcatctacacgatggtaaaagtgcactntcatatgaatcatcgttggatattatgtctgtgcaaaataatgaagaattaaaagatgaatttgatgaatttattgagattccaacattggtgtccgataacgaatcagaagaaattgaatcgattgccactaaaacttcagcaccacattggaaatcgcaattatcattacaaccaacaccagccactagtcaaagtggcagtaatagagaaggtgtccaagctgcaagatttaatgtgcaatcagcaaataatcatcaacatcagccagtggtccatcaacatacctctatccagagggcaaatattaaaagaggaattcttgccaccagaaaaaataaccaacaaccagctatcactgttgacgatgttaaacaatctatcaactctacaacaactactactactacaacaacaacagcctcgacttccaaacaatcttcattggaatgttctcaggaacaattcaaacttgaaagaaccaaaatcatgaccattgttatcaaatatgtgactgcaaaaattcataattctttcccaccagattcaggtagaaatgttaaacaaaatgaattaccattggataaattcttgttaatattgacaagcagattaagaataaccttaccggtgtttttaaaagcaataatttatttgtttagatatatggatataatttatttattacgatacttgaatcaaaccaataattttgtcaattataatgacatgggatttgaattgaagaaattaattgtgggttgtcttaaacttgcaattataaaagagaataggattactaaaaacaaatatgttttgaattgggaacaaattactggattgaagaatcaagaaattaattctattgttaaaacattagttggaagaatgaatgggaaattaaacattaaagatgttgaagttgctaatatgaagaatgaaatgtttagatttgttaaaatgatatctacacaagtttag

SEQ ID NO: 8118 - DNA, 183 bp, Candida albicans
  unsure (108): Identity of nucleotide sequences at the above locations are unknown.
aaaatattgggaatcaataccagttattcaaatttatttaaggggttaaccttccggggtttaacaaccaaacttaccaaacgattaattaaccatcaacttggattnaaagggacccacccaaaccagggaacggagttcctaatttggattaattttaaatccttattgagattgggttaa

SEQ ID NO: 8119 - DNA, 216 bp, Candida albicans
cagtttttttatagatatatatataaatgtgtagaaaaatacaaaatgcaaagaaatgattctatatcgaacaagcttaaaatgttccagttccagctggaaagatatacctctctaaagcaaaatataaataaagaaaccatcaacccaaataaaaaaacctcaaaccatatttctcttaaagaaagaaaacttttctctattttggaaaattaa

SEQ ID NO: 8120 - DNA, 306 bp, Candida albicans
aaaaactgtgtatggggtggttttaaaccccgcccaccaccaacagccacgaactccgccaaattttcccctccttgtcgctacttctcctcttcttcctcttctccatttgctttacgtttgcttatctatctatctatctacttgtccttctcctcccccgctcaaaaggaacaaaatgataataatacttcaaataaacattataatcattatcatattttcttacaaaatttctataatattgaacttatatattttcttcaaatttttatgttattcctattgttgctatatatattataa

SEQ ID NO: 8121 - DNA, 984 bp, Candida albicans
atcataataaaaaggattgacctatcattttatcaagcttacaagaaaacaacaaccattgaagacaacacactcaaggtaagtacttttccattaagtaatttaccagagccattggtatttggaataaccatagccgacgcggagctagttgagccggagtcagcacttggtgatggaacaaccgagagtgtagcggcaggaagagcaccagcaccattgttagatccattgttggcacctgattcattacttgagccttcgttggatccattgcctgttccactaacagagcccaagtcactactggatccattaccagaactgttgttagagccattgtcggaattagaaccactatttgaaccattgttagaaccattaccagacccattagcagatccgttaacagagcctgagccattattagatccattaccagaaccattatcggtgtcactgttcgatccagtacctattccatcacctgaaccattattagaaccattattagaaccattattagaaccattgtcaggactcgagccgttatctgatccattacctgagccgttgttagattccccaccggaacccgagccattggtagttccattatcggaaccatcactagaaccgttacccgagccattatctattccattaccagaatctgacccactattagatccattgtcagtattggagccattgttggaaccattatcagaaccattatcagaaccattatcagaaccattatcagaacctgacccactggcagagccattgttagaagcattaccagatccattattggagccattatccgagccattattgaatccattaccagatccagagccattatttgaaccattattggatccattaccagatccagagccattatttgaaccattattggagccattattggagccattatccgagccattattggatccattgccagagtcttca

SEQ ID NO: 8122 - DNA, 378 bp, Candida albicans
aaccacctcatcattctagtcccatccaaacacgttgacattatgattctaattactataaatacttgcaaatatccaatctattcttctagtttttttttatatcatcacaaaacaacaactcaactaacaactaatcacaatatgaaattttctacagctgctttaactttatctttgtttgccattgtcaattcttcagttacaacatatggagctggattcggtggtgatgatgacgataattcaaaacatcataaatatgattgtgaaatcgatacttatgaatggaaatttgctttggctgttaaagaatggaagcattgtcaagataacaaattctgtcaagtgctcaccagccggaagagatcagcgtca

SEQ ID NO: 8123 - DNA, 594 bp, Candida albicans
  unsure (581): Identity of nucleotide sequences at the above locations are unknown.
tattatcagattgtgactgggccaatactatacgaactcatgatgactacaaaattatcgccaaaacaattgttgctacaattatccgaaaagttgtcttcaagtaacgggcgcgaccaactaacttatgatgaatttgctcaattatattacaaagttttaacaatattatctaatcatggtgatactaataaagtggctgacgatgagaacaataagccgtcaattgatttgatcactccattgttaaattttataaatttaaatgtcaattatggacaaaaagacaccactgagttaatatacattttagcccgattaatttggtattatgttcatcaccagtcgttgttgaacgtggatgttttattatcagtatttacttctttaccgtatactcagttttgtcagacaaatcacattcttcaatctgataccattttaaactatgttgattattttatgctattcagttttgacaatgacatcagtaataaaacaaatgaatatttgaaactctacactggtttcattgcatttgttaatcggcttattatccattgtcttaacgacgggcctgnaggaccatcctag

SEQ ID NO: 8124 - DNA, 186 bp, Candida albicans
actttagaattcttagtgttgctcccaaaaacatcccacacacgcagtaatttctttttcctcaatttactttgtaatagacaccagatattgttttattatattaaggaaatgttattattgtttatctacaccctaatattgttgttttacattggtgtcaaatgtaagaggtctcttcagtag

SEQ ID NO: 8125 - DNA, 279 bp, Candida albicans
aaagaacttggaagaaatagcaaaagtaagggaagggaggaagaaaaaaaaatcaaggattatgaatctttttttcctttctttctttctacttcaaccctctttatttttttaattgagaattataaacgaagagggaaaatagatttaaaaacacacaaaaataaacagaaaaacgaaagggttagaagtttgtcaaaaataacaaaattctcttattacttgattagttttgtttcaaagataattatgataaatgaaacaaacggctgcagttga

SEQ ID NO: 8126 - DNA, 252 bp, Candida albicans
aaactcttttttgagattaaacaatttactggtcatcctaaattgattttccattataacaataacgttactaaagaagtggagataaagaatattaaacaaaatgagattatcaaaactcttactgaatacagtcaacgatcaggtaatgaattgttcaaatttaatcataaagtcaaatcaatcaatgattctgttaggggtatttggtcaccattacaagttccaaaaggttatagacataaaatctaa

SEQ ID NO: 8127 - DNA, 285 bp, Candida albicans
atgaatatgtatgtctgtattgtagttgttaatgaaaggaaagaaaatgaaaaaaagaagaagaaaaagaagaaaaaaaacaactggggaagggaagggaagggaagggaaattgattgtttatgtattgattctgaattttcattcattataaatttttttgcggagtactttacaccaacagtaattcaatcaatcaacgcagctcatcacgggggtattaatttactctttgtttcgtttagtctcttttcccttctcgccttgacaaaccaatttttttaa

SEQ ID NO: 8128 - DNA, 204 bp, Candida albicans
aaccttttgttaattgtaattataatagtagtagtagtagtaatagtagtagtagatgttaatcaaaggatactgaaattgaaagggggggaggaaggaagacaagacagaagctaccaaatggtgggaaagggagaaacaaagacgcgtcataaaaaattgaaacaagaaattccaataatgactaaatgcgctataccataa

SEQ ID NO: 8129 - DNA, 291 bp, Candida albicans
  unsure (148),(154),(180): Identity of nucleotide sequences at the above locations are unknown.
atatcgcaaaccctggggctaaaactattgacaattggactcacggaaaaactttcatccagccttgccgttttttatcaacaacaatttaacacattattgcagaatttgggggaagaaaaagtttttgaatggcgttactccaacntttatntcaataaaaatatagaaggtttgaanaatttactccaaatgtccccccaatattatttgatgttacatttgaaaacacccggtaaagcacgggttttttttttccttgtcaatgaaagaagaaaagaagaggggtga

SEQ ID NO: 8130 - DNA, 186 bp, Candida albicans
tggggaatggatctaacaaatactaaaaattttcatcaaattctgcttttttttcttcttggtgtttctcaagacgacacaactatacagtataaatgtcgcacacaaaatcgtatttcattgagaccgataactgaaactgatagcaaacttcttgaaaagcacacatggccgcaaccactttaa

SEQ ID NO: 8131 - DNA, 282 bp, Candida albicans
cacggggtgaaaatcaacaacaaacgacatcacgacatctcgacacaatttattcattcggccgtcattttttctgatacttgggttaagttgggtgtggatgtcgtcgcatgtcgtgtttcattaaccctagaaagaagccgaaacaacaaacaaaacaacaacaaactaatttggggggggggggatggaaaaaaagaggaagaagaattgagcgagagaaaaggcgacaaaaggcaaaggcaaaacagaagggaaaaaaagaataaaactttcttttaa

SEQ ID NO: 8132 - DNA, 321 bp, Candida albicans
agatcagccggtgatattttaacagcattaaatcaatcaaatatacttgtcccaacaattatgaaaatcactgaaaatcaaaatttaggtactttggtgaaaactttagtttcaagaatttatgctagtggactcattaatgatttacctttagatacttattatgaatatgctaaaaaagaaaatattttaagtgatgcattacaatatattttaactgatcctacttggtcacctggtttagctactttctttaaaagaatggatgatgctggtgcttatcaaagattacaagataacatgtatggaatcaaaaaataa

SEQ ID NO: 8133 - DNA, 282 bp, Candida albicans
tctctttgcttgcccttcttccatatcacaacaaccattttctctaacatcatggcattatcggaacttgagaagaaaagacaagagaatattcgaagaaatcaagagttattaaaaaaacttgatttggattcaatttccgattcaatcaaaaaggaagttgataacaaatctttttcatcaccatcactgcaaaaacgacgcaaaactacgaaaaaacccgtgattaaaaaagagatactggaaccaagtagaagatctcgtcgtattgccggggattaa

SEQ ID NO: 8134 - DNA, 183 bp, Candida albicans
acaggatacaaaaatcgttcttccttgtgtggctgggcaaagaaaattccaaaccaaatgaccaactgtaaggaaacgaaacttgaaaacgctttaacatgggttagtattggattccaaaatacccctataacagccaatgggaaaatagcattgaaattaagaagaaggttcataatatag

SEQ ID NO: 8135 - DNA, 270 bp, Candida albicans
gagaaaaaaaaaaagagaagccaaaaaaaaaaaatcatccttctttttaatcaacaacaacattatcaagttttatctttatctcatattacaatattaattccacacacttcacattttatatattacttatatccacatataatacaggtatattggtatcttttttttaggtgtttcacattattctccgttcactcattcattcattcattcttgagtcttttttttttgtcttgtttgtcctgtgtgtgtgtgtgtgtgtgttga

SEQ ID NO: 8136 - DNA, 270 bp, Candida albicans
tgcaaaccacgacaaaatcatttggaaaatagagtacaagtacaacacacttaccgtgaattgattaaactaatcaatgataatttgtctcgaaacacaattgatataccattagtccataactttgctcccaaaaatctagaattagaacagcaaagatttaaaattccatccaatttctataaagaacctaattattcattatccataactgacgagatggaattttttttttgtgaaagtatcaagaatgaaattccattagtttaa

SEQ ID NO: 8137 - DNA, 414 bp, Candida albicans
ataatttttccaaaacaattttttttcttccgtatacacattttcagctcatctctggctatatcaacaatcatggcaagatcagggaaacgtaccaacaacaccatattcaggaagagtttacggatccaggaacaaaagaagtatgctgagcaggattcagatgtaaaacgatatcaagaattactaaagaaggatttagaaaaagatattcctcctaaacgagcgaaggggaaaagaaaagcaagaaagaaacccgatgatcaaagtgtcctggcaccaatagcgcttccacaacgacccaagtttgccagtgctcgaaagtcaaaagaggaagttaagcccaattattcaaattcgaatgcattgccgccaagtttaatgcaaaccacgacaaaatcatttggaaaatag

SEQ ID NO: 8138 - DNA, 534 bp, Candida albicans
  unsure (380),(412),(452): Identity of nucleotide sequences at the above locations are unknown.
aaaaaaaaaaaaaaaaaccccatacatgaaaaattatctacctaccacaagtttgaaccattgaaactagacatgacattactgctagtttttgtaattggtgtagcagtcaaagtggttgaagttcctgaaaatttgttcccccaaattgaaccactagtaggtgttgatacccccatactccatgtatttgaagaaataggaccagttgtcactaaagatggtgaattattcaaaaaacttgtacttgtaggagtcatagaagcacccattaacggtgatccattgttgttattactactattggtagataaaaacaaatttggaggtgatggatttctattggcatttggtggtaacaaaataggtgaattgctatntgaaccaactgaattatcaaataaattggtantgaaaaccagtggcagcagcagcaccagcagcagccccgngaagaatgagaatgaacctgaagtttgtttaacaacaacaccaacaacaatttcacccattttgaatattaatttggtgaag

SEQ ID NO: 8139 - DNA, 186 bp, Candida albicans
gaggtaaaaaacaaaccgatcaataacaaatttaataccaaattgccaaattgtttaaaaaaaaaacaaaacaacaaaacaacaaaaataacagttaaatataaaacagaagaaaaaaaaattgaaagtataaggatgctaaaatcatggaaaataaaaaaaaaaaaaaaaaaaccccatacatga

SEQ ID NO: 8140 - DNA, 897 bp, Candida albicans
ttaaaggagaaacaactctcaattgttaaaagacaattggaacaacaaaaaaaaaaattatcaacacttttcaaattcttcttctttttcattcaagataattacgtatattttttttttggggtcaagctgtttcaagccatgtcaatggatacaatatctatatctaaattaattaagaaatcaattaatcaaaaattacctccaaaattattcataagtttatttaataaattgattaaaaaacaatcaattaataatgaagaattcattaatgaattattaattcttgattatgatcaacatacttgttcttctttttcttctttgaagcaacataaatggaatgaatataaacaaactttaataattgaattatcatttagtaatgttgaaaataatcatttattttggaataatcttaatcaaatacctaataatttacaatgtaaatatttatcgaaaatcacaaaacttttatcacatcaatcacaacattatgataaagaagtattaaaaaattttattaaaaatgaaatcattgattatgtaatgaaatatactagtatcactagtatcaccaccacaaccaccacaaccaccagtaaagtttctggtaatgttttggaaaatattgtattattattatcggtattaattgataaatttgaaaaatatttacaagaagatactactaattcatttcaaaatttcattgttaaattattatcatcatcaaatttattatcatcattagttaatgatgatggttatttaactaattatttattaaataaatcgaaaattattttatcaaaaaatcaatatgatcaaattgttaatgttaataatatggtaagaactcaacgtgaacgtcaatcatcaaaccgtcaccac

SEQ ID NO: 8141 - DNA, 246 bp, Candida albicans
agacatcaagaaatgaccatgagagaatatgtggcaccatcacaacaggaacaacaccaacaattccataatgatgttattggtaatggtcaacatcaacatattaatggtgataataataatcgtgatccacatacaccaggtttccaaactaattttatcgatagtgcatttaattatttgaatttacaatcaggtattgatatgaatgaagatattcattcattatttcatatgatgaattga

SEQ ID NO: 8142 - DNA, 183 bp, Candida albicans
  unsure (18),(19),(20),(21),(22),(23),(30): Identity of nucleotide sequences at the above locations are unknown.
aacaagttttatgggagnnnnnncccaccncccggggaggattttcaaccaagaaatccttctttcccccccgccgagaaaggtttgtttaaagagaagaaagaacgggccattatcgggggtttaagagaatccctttcggaggaggttaggttttttttggaatttgaggaaaccccctaa

SEQ ID NO: 8143 - DNA, 186 bp, Candida albicans
ttgttaaacggatattcgaatcaagttcggatggagataaacaaaactcgcgggaaaaatagaaaaaaaaaaagaaatttttttgtttatactgaaagcggaattttgacttgctcggcaatgaagggagagaaagagaaagtaagacaacgagcgttttcaccagggggtcaagatccgcgctta

SEQ ID NO: 8144 - DNA, 228 bp, Candida albicans
agttttccattgcctgattttacaattattattattattaccgaaattatacctaaagtcattcatgcatacatatttgattcaatgattgtaagaactgcattgaacgacaatttagcgaaaatatttgggagcgctaatcggaaactaacagtatttagatcagattgttttcccttttgtgtggtgttgttgctctcttttatttctttaatttcttccatttaa

SEQ ID NO: 8145 - DNA, 186 bp, Candida albicans
agttttaagttggagattttgcaggggggtagagtaagggtcggagaagaagctggagagtacagttttagtgtaggagcagtgggggctgtttttgagtttttgggtggaaaagtcaaatttaaaaaggagctaaacaaaccagagctaacaatggaactggaactttattataaagcttgttag

SEQ ID NO: 8146 - DNA, 183 bp, Candida albicans
gacagttcgagaatgaaaaaaacgtcaatggaatgtttgagtgaaataacgccaggcatgttggacagagaaaaagctaatgcagatcgaaagggatcgggaagtactgagggaatggacaagagagtgagcgggggattggaagctggatttgagaaagaaaattcagagaatgaaaaatga

SEQ ID NO: 8147 - DNA, 513 bp, Candida albicans
cgtaaatcattctttgcaaacttaactcgtgccaaattattcattctcttgttcacaaataaaagatttattttgtcgagctggttcaatagactcattatttcaataaacaattcatctggaagcgataatagcttactactgttgttgacaatagtgttatgtgccggctcggagttttctctggagcgtctgacaattagatataacaaaataagtatcaatacaatagaatccaactcaaacattttgaataaaagtgttatatcgaagactggtttgaccaataaagtggggagtgctactaatgaagcaaatatggttcctaccacagcgaaaagtggcagcaataaagtgagcaaaagcgttatatcaaataaaggcttgaataacaaagttggaacaacaagcattgctccaagtacagttcccaccaatgccacaatgggcagcaacaccgtaagaaggattatacctcccataatacaatggtttgaattaaaaaatagctag

SEQ ID NO: 8148 - DNA, 201 bp, Candida albicans
  unsure (175),(184): Identity of nucleotide sequences at the above locations are unknown.
gctcaacagcatccagctacaacagccagcccagccgggttgccaatcttaaatatttacctacgttttttccctcctcaaaatgggcaaatttataatggctcaaacaatatgggagaactactatgggtcaattcacatgaaattccgcctaaggattgcaccacccgattcnattcacttnacccccttgggttttaa

SEQ ID NO: 8149 - DNA, 363 bp, Candida albicans
cttcccacaatgatttttaaaatatttagagtgatactaattatactttcactcatgtgctgcatcttggagatttttgcagtaactggatcttatgataacaaaaaatacctcactgatacctacctaatcaatttccacattgatagcttggatttgacaaaacttattgattccagtcgtataacaaagagagatggtgtgggttcaaaaatggtttcaatcaacccaagacaaggtacaccaaccaaaagagctcctgcagaatctggatggtactatgttccagggggatcaaatactcaaagtggcccttctgccactgcatcttctggtggtaatgctgttgcatcaggttctgcc

SEQ ID NO: 8150 - DNA, 312 bp, Candida albicans
ctaccatccccctttctctatttgaaacaaacctacacaaaatcaaagaaaagaatatgcaaatcattaagcaaaggaaactttaatccaggggatgaaattggagagagtaaaacagggtttagtggttacaggaaaaatagtgaatttgtgctggtgataagaaagaaaaatggtaaacaagaagaaagaaaaaaaatggcttgcttgttgcaaagtgagaagaaaaaattattaattgatttacaaaatcaaactgcaaccatcaccacccaccacccaccacccaaaaaatattcatcttataattaa

SEQ ID NO: 8151 - DNA, 504 bp, Candida albicans
tcctttaacttaagcggggatccgtccatccccgtggtgaagacattgctagttgctgttatagtggtatttaacatatacattgcagcaaccaacgtgttcgataaacatatctccaaccatgcaagcaaacagttggcagtcaaattaacccaactggatgtatcaactatacttaccactggtactttgaatctgaatttcaagaacaacgaacaatttcaggtcaataatggatttaaactcccgacgtttaaaactattccaacacataataaacacaaactgccaaataaaccaaaatatctagttcccaatgtaccatacgatgaactatcttttaaagataaaatactattcaaattaaatgaagtggacttcaataaggataaagattggttgaaaagccaagaattgacaagtcataaagtggaggttcatgtaaatgagtttactcaagaaatgtgggataacaaccccgggttattttttgatccaagattt

SEQ ID NO: 8152 - DNA, 183 bp, Candida albicans
atggaaactatattggaaacaaagatgatgtttctttgtttgttatgggatttgctttctttcggccccatggcttatggtaacgccttaacaaaaacattagataaatctgagataacgcgtacacaaaatcaaagtagaaaaaaaaaattatatttttttaaagttaagaaaaaaatttag

SEQ ID NO: 8153 - DNA, 222 bp, Candida albicans
tggagtttaaaatgtaaaatgtctactctttcttactttccttgtatgttttttattgttgaacctctgctactgctactgctactgttgttgctgctgagtggtcttaaagacatacaacaatgtatgttaatgcccaagaaggtaaaaatttatttcaagtcacctgatacaccaactaatcaacttgtagatgatactaatactgatgatgttgattga

SEQ ID NO: 8154 - DNA, 234 bp, Candida albicans
agtagtagccttggatacgatacgataactaagtactatgtaaagaacctagtagaaacaaaaagaatacagacagaacgaaaagcagctcttaaaaaaaataaagtatgtataagagctaaaactttgttgcagcaagcaaagacaatgggcatggaaaattatgaaatttgtgccgactattttttaatgtctaggggggcagggagtgacgaaataaacacatataaataa

SEQ ID NO: 8155 - DNA, 183 bp, Candida albicans
  unsure (53): Identity of nucleotide sequences at the above locations are unknown.
gggaaaaaatttagtgcaagaatcttaagtagtgaaaaaggatttcccccggngttcccgaaacttcgggttcaaatgattcagttgaggaaacgggaaaattttgttgaaaaatacggttacccagtttttattaaaccgccatttgttggtggtgtaggaggtatgagagttgtttcgtga

SEQ ID NO: 8156 - DNA, 183 bp, Candida albicans
tctttatttttttacgtatacaccaaaaaaaaaaaaacaaataaaatctgtatattaatgttggaaattagtcttatccatttatttattacttgtagctcattctcttactgtttcctgactaggggatgtccatttcatcgtcattttcaaaatcatgtgggtcttctgcattcatattga

SEQ ID NO: 8157 - DNA, 849 bp, Candida albicans
  unsure (22): Identity of nucleotide sequences at the above locations are unknown.
tgcggatcggcagcctcgtggntgaagacagacttgatgttttatgggttgaatagaatcttgggcaataattgtgattttcttaaaatcgatagtgttatccctaaagatcacgaccatttgaacaattatttgattgtaatcccacaaccaattccatttgatattgaaacaccacaccaatttcgaatagatatgaatcatgaatatcatttattgattcttcgaattaaaattgctgagctttttttgtcgttaattatcactaaacaaacttttgatttcctatataataaagagcatttcaagtcattgatacgagtcattggatttgaacagaaccatattgcacaatcacctcgatccaagcatgtgtatttaagattacaattgattagcatgttagtgaaaatcatagattatcttacacaagatttacgtgatgccagtgaactcatttatagtgagttgatgtatgagatttttgtcgtattcctgagaattgcatttggtgctgattcgttgtcaatagatgcccataaattattggttaaaatcaggaaccggccaggcggtaaaagtttgactgtattcaacaagtggtgtgagacaagagcaagacagttgaatcatgtgtcaatactgaatttcaatgttgaaactgttgctaatgtagaaagtgattttgccaatggtttagagtttccatatgaatcagaaacagttgaactagcaagaaatatattaaatcgatttgtggatcatgatgaagccgagaatttgtatgtcaatatgaatgcagaagacccacatgattttgaaaatgacgatgaaatggacatcccctag

SEQ ID NO: 8158 - DNA, 576 bp, Candida albicans
atgagtgaaagcataacgataacagctaatagcatatataaccctgaaacagatgtgaggcgtaacgaaagattccatctcgttcccagaaaaagacttgaagcgttagtgacaacaagtgggctaatcggggcaatgattggcttttacgatggagtaaagatttcatcactcagatacttgactgaaaacgcacatcgaatgccgaaaaccgtaggtgggtggtatttttatcataaaaagaagaattatgtcatgatcgttgctggtgtcaagagggcgctcacaactagtttcaaatatggtgcagctgtcggtgggttctttggtttggaatatttactagacattagtagaggaaatacaatagactttttcaacaccacaacagcagcattcttaacatcgaccttttatgcaatatacaacaagttgagctttatgcaaaccagaaacatgatattcaaagggacggccttgggcttgacccttggtttaatacaggactatttaattcacgccagaaagggtagagtctggtatttagataggtatacacaacaaaaactcgtataa

SEQ ID NO: 8159 - DNA, 195 bp, Candida albicans
aatatatatactacaagttttacaaattatagttattgtatagtcttgttcgaattggataccgtttatttgaagttttatgtagtacttgataagttactttggagagtaatatatgccaatgaaaagagagagagtaagagaggaaaagtaacagaacaaaaaaaaattcattatgttttgcaccaattatga

SEQ ID NO: 8160 - DNA, 312 bp, Candida albicans
actatgaattatactaaaaaacagaaggaggcaatattaaatcatcttagattggagagagcaaaagtaccgaaacggaatgaaatatccaaaaagaaattagcagaccaaacttcccaaaaggtactacgaagattgaatggagtcagtgtaacgttatgggatatcaaattgaaagacatatttcaagtggaaagatcaaagaaactagttgccaaaaaactagtcagagacgtgcaggacatgaggcgaaaactactacttgaacaaaaggaaagtccactgaagacaacacacacaagcaccacttaa

SEQ ID NO: 8161 - DNA, 192 bp, Candida albicans
agcggtggaccttccagccccgtggtgaagattcgttctcgttctcaaattgacattgaaaaaagaatatacgacataatcgggtacgatattgaatacaagcaaaacccactatttcttttttctcttttctatctgcaaacatattataagctgttactatacttgtgtttgccacttataagatcatga

SEQ ID NO: 8162 - DNA, 1818 bp, Candida albicans
cgtggcgaagactatcaaatacaggttggaggttatattgtattgtcaacttttagtatattttactttcctgatgatcaaattcagtacatgagcacgtcaagtgagataaatgatatagctattatccaatcacacgttaaacttcattgcatcaaggaattgaccaaaccggggaatggcatcagtgaagaaaattatgtttcatttgaaatcattgacaagtctaggtttttaatcattgcagagtctggtagaagttacttgttgtttactgatatggaaatatcctctaaaactacaattattatcaatcaaatgactatggttagccttggagaagttactattccttattataatggtctaagtcatatagctggagatttgtttttccaaagttcacagttctcaagatccgtattgtttctggtgttacccgagaagccacatattcatattagagcatatatcgaaagtagtccaccagtgctagatatcaaagacgggtgtggacagggagttgaggagttgtatacgtgtcaagggagctgggagggcagtgaattaaggaaatatggagcagtccagcacacaccagaacttcttgagacgaaaaccatagatatgcaaatcgaaaggttacgaatagtgaactcaacagtcatggtttataatatcgatggcgatagtgtggcactagaaacccacaacttgatgcccaaaatcactcacttgaagatagaactgaatgtgttggattattataaggacccaggtttccagtgttgtgttactcgtctgtctttgcttgtcaatgggaaaactatggtgaatgaatcctttatttattccagtgttgtgcctgaaattagtaccgtggttgctgtttctgataccaagagcattcatgtacaactgaaaaactacgaattcgcctttgaaagtgaaaaactcaaagaaattacaagtatcgatgcaattcatgttggcaatggcgcacttttgattttagcaactgattggagtggagattatcgtatttggaaagttgttaacaaaaaagccaaattaatctattctggcgaaatgaaagatcagacttttgtattagattctgccgtagtacaatcaggtgaaaatgacataatagcttttatgctgaccaataacggaagcttacatcagttacttatccatttaacagagaaaagggttgacaacgttaattttaccgaacaatatgtgagtgatgtcccatgttttttgcggaaatacaagaataatgtgcttgtttttaattttaaacatttggtggccttgaaaaaagacgaattgctggggttttttttcaaaaagtacatacacgtcccaaagcttccccttgccgatgtatgctttgcgaccgaagaggaagttttaattggatatcagaatggccgcatagataaagtgagaattgtattgccactgcaagttgtcagtcatcaaagcttattctcaaataaactatatcttaaatgcctacctgttccattatcgaaatttttagttggtgttgttctcgactgttcaaaggattccatcaatactcagctccatttggttaacactgactcttttgaaaatttatccatctttgaatttgatgaacccctgggtgtccaagttgttgatatttgcttgatacaagattggcagaatgagaaagcccacaaggatggtttgtttgtgtgtttgactctgctgacagaatttccattgtatgtatttggtattgaagagtcgagaatcttcaccacgcgtgaaaaatcgaaa

SEQ ID NO: 8163 - DNA, 381 bp, Candida albicans
  unsure (13): Identity of nucleotide sequences at the above locations are unknown.
aacccccgattancttttcccgtggtgtctggtaccccaccaacaacaacaaaagcaacaatatctaatgatcttgatcttgatattgatattgatagattgaataatcaattatctatatcatttaatttattgaatttaaatttacaaaatttaaaaattggtaatatgattaatcaaattttacaaaataaatttaatcaattatataaatttcaattcaataaaagcaccgacaacaatgatgttgttgatgttgatgatgatgttgatgatatagatatggatatgaatatttataaattgaatcaatggtatgatgaattgaatcatgttattgtaccttttataattcaagattttaaagacggttggatatga

SEQ ID NO: 8164 - DNA, 186 bp, Candida albicans
aacctgaaaatagataaggatagagaagagaagagcaacaaaaatcgacaatcactcaagaaaagcaagaagaaacgcaagggtaacaaagaaagaaaaaaactgaataataataataataatagaaagaggtcaagaaaaattaacaccaaatacatttttaaacaatacataataattgattaa

SEQ ID NO: 8165 - DNA, 348 bp, Candida albicans
ttaacattcttgcgatatagatatgaagtaatcttaaccgataataagaataataacatcagaagactcttagtatatgttttctttagtttggtagttccagctttttccgttctagatgcaaaaattaataataataataataatatctcactttcttggtgtttagaaattgtcggaactttccaattattaagatttggtagttttaagagagttgtaattcatgtgctttgtataaacttgacctactctttcctctcaatcacgagaaaaatcgataagcttcaatttttaaactcttttccttatctcttggtcaaaaatctctcttttggacaattttcc

SEQ ID NO: 8166 - DNA, 249 bp, Candida albicans
attacaactctcttaaaactaccaaatcttaataattggaaagttccgacaatttctaaacaccaagaaagtgagatattattattattattattaatttttgcatctagaacggaaaaagctggaactaccaaactaaagaaaacatatactaagagtcttctgatgttattattcttattatcggttaagattacttcatatctatatcgcaagaatgttaatcaacaacaacaacaacttcaataa

SEQ ID NO: 8167 - DNA, 561 bp, Candida albicans
  unsure (73): Identity of nucleotide sequences at the above locations are unknown.
ccaatgtcagacaacgaccttaaacatgcattgacagtaacgccactagcacatttggtgcccactcaagcantacacgccttgctgtgtcccctgaccctgccgcaagtggaagagccttatcccagaggtaaaacaatagatgttgccgacgaggaggtaatgaaattattgggaaaggagttgctagagtatgacgtggacatgccaatctttttcaaagagtatttcaaaaccggcggcacatcgtctatcccattgaacgagacagaaaggcaactacttgccaagaacactgttccctactgcaccaaggtgacaactgtccagcccccaagactatccgttagaaagaaatacaacgccaccgaaatggaccaccacaaccgcaactacgaaaagaagtttagcaaggaattgaaggaactaaatgtcaaacggcaaacagaacacacgcaacccaccaccagaaaactcgtcaaactatctgaagcagatattgaaaagtcaaccaccaccagaatcatgctgcttcttgaaacccctaccccccaatcattc

SEQ ID NO: 8168 - DNA, 252 bp, Candida albicans
atggaacaaatgagtagaagaacaacgactatgaatatatatatatatatatatatgatagaacttgaagtaaatattcaaaagcattcagtgaaagtaaaagtgagtgatttcaatttttcttgtcttcaaaaattaaaagcaaaaaaaaaaaatttctgcatggtttatatgcaggaatttgtttggcgatatcggagtttcaaaatcttcaccacgggactggaccgatccgcccttgactctaccaac

SEQ ID NO: 8169 - DNA, 297 bp, Candida albicans
aaaggtataaaactactaaatgcacgtagtcccccatttcaacaacaccaaccagaacaaatatcaactttacctccacctccaccagcacaagtgcaacctgtacaacctgtacaatctgtgcaactaccaattcaagctcaatcaacaccattaccaaaacctgctagcatttccccactcccgattacaaattcctatacttctatgaaattcaaatttatgccaagtaagagtaaagtcactcgtaaactacaagaatgtaaagctttaggtgatatcaccaatttacaataa

SEQ ID NO: 8170 - DNA, 198 bp, Candida albicans
atccccttttattttgtgcaactattcatggattggtcttcttgtcaagtgaacacgttagacaatgttaggcataatctaataaatggcatgttaattgaacaacgcgtaataactcatattaggagaaaggaaaataaacgagctgcttccaaccaaccaactaaccaacccccctttccaagaattaaaatatga

SEQ ID NO: 8171 - DNA, 711 bp, Candida albicans
ttttttgaaaacacagttattaatttttttctacataatgagatacgtcatcaacatcaacttgctttttcggtcttacaaactattgctgagataacaaccatcaaaactatggaaagggtttttgataatgaatgtttcactagctggattaaaattgtgtttgaagaagtggaaaatctaccaaatttgttcatttcactaagcaatttatttagcaaacatgaagaaatattagtgaaattaatggctacaaaaattaagccaagtgatgaaccctattcaatcgaagacttacgtttgaaggcaatgaaggtctgcaaaagagatactacagaaattagttcttttatggccaccacactaaagcatcaattcaaggacttgagaatgtactcgataaacactatcacacctattacaaaagtctatttgcaagtactactggagtattttcaaaacacccctgctatgaatgaagcactaaatacgttatcctctattttgatgcttaagcttaatttctttgataacaaagatacccggatcgtgattgagtttctatttgattcatactttaatttgagacttttattagaagactatatgctatatcgatttgattccattgaattacagaatcatcgaatctatcaagactgcttcaaacaatatcacaaaagttcatatcagcagcaagggccggacgac

SEQ ID NO: 8172 - DNA, 219 bp, Candida albicans
cttgttgcaaacttgtattacattgttagtagttactgtactcccttaactaccaagaattgttatcatgggactaatctaatcttgccaggtcgtgtgacaatactcaaaaaaccattgagcgaaaaagaagaagaagaagaaaaaaaaaaaaaaaactcttctggtttgttccacacccaacgcttgatcaacccaacccaaccaaaccaaacctaa

SEQ ID NO: 8173 - DNA, 810 bp, Candida albicans
ttctctggtataaccattatgaatcattatccaataagttctagttcaacatcttcaacatcgattctgtcgataaattcaaataattataattatttaaattcaataacaatgacaaaatgtaaattactccccactaaaaccatttctcgtggtaaattccgtggtattaatgatattagaagatttcaatgttataattctcaatgtaatttaaattttaatgaatatcaattatgtaaatattgtgctcatgtaccttatgtatcactgccattaagaataaaagtgaaaaataatctcaatgatgatgaggagtataatactggcagaacaggcaacaataataataataataataataataataataatcaatatcgatcgataaaaattgattatataccaccaactcgaagtaatgccattataagaaggaatagtagttatatcaataataacaacaataacaacaacaacaataaattaattgttcctcattcggtcacaacccttggcactactaatagtaatggtaatggcgatttaacaagtaaattgaatgaattttgggatcatttagaaatggggaaacttcaaattaaacaaagatttatggatattaaaattcaaaaacataaattatcatttaaaaaacgatcattttctgctcctcccatggtactaggaaatgacaacgataccaccactaacaataataataataataataatgaaaatatttattattcaacaggtactagtaccagtgattacagcaccaccaccactactactactactaggtaa

SEQ ID NO: 8174 - DNA, 1344 bp, Candida albicans
  unsure (1340): Identity of nucleotide sequences at the above locations are unknown.
acttacacaggagataaagatatcatcactgacattacacacatacacactacaacacacacacacacacacagtttagtaatgaattctattaaaccctcaacacctgtgtcatcaccaaaagcacaaaaagcactttcaattgtcgtacaagaacctcgaccacaaccaactacccctccaccaccagcacaaaaacgtcaaacaacattttcaagtcgacaaactaaacgactgtcatcttcatttttgaatacccctgaaccccaacaacaactgtcacaacaactgtcacaactttcagtttcaggggtaagagataaagaattgaatttggattctcagataccatcactaccgtatacaccatcgagtaaacgtcgaagttatgggatttttgaatcaccagtaggtagatctccttatggagtagcattaagaacccctagaaatgaagatcatgattcccctgaacaacggctgaaacgatatggtattgttgaaagagataatgatgatgatgatgatgacaatgaatatgaagatgaagagacacgtcacaattatactccaatgggtaatgttggtgatgatgaagatgaagagtcaagacgattgaaattacaaaaaaccccacaattccattctgctaaacgattatatgatactttaaattcagttatgattaataatcaaaatagtgctcataatagatatatgaatggaattataaatagtgggaatggacaatcaataaatgaaagtaccactaatgatagtggttctaatattattaataaatcacctaatttaaaaacaaatcgacattcatggtcagcaaatgtgaatttacaattttcaccatccaaagctccactaccacctccaccacaatatcaacaacataaattaccaccaccacctccacctccacaacctaaatttacaccattaacaacatcaaatagacaaccacaaaaccaagaaggtcaattttcaccaccaccaccacaacaaccacaacaacaaccaacaacaccaagatcatcatggtcaatatcctctacaccaatgggagtaggaatagcatcttcctcgatatcaccagtatatttaccaccacaatcatcaccaacaaaattaataatagaacccaatgatgaagaagtatctgcaaaggatgccataaggaaaataattcaaaaaaagagacattcaggtacaacatcgaaaactaatcctagaaccaccaccaccactactactactactactaataataatgcagatactgtagcagcagctgctatgacactaaatttcaagagtggtggtcatgngtaa

SEQ ID NO: 8175 - DNA, 210 bp, Candida albicans
attattttccttatggcatcctttgcagatacttcttcatcattgggttctattattaattttgttggtgatgattgtggtggtaaatatactggtgatatcgaggaagatgctattcctactcccattggtgtagaggatattgaccatgatgatcttggtgttgttggttgttgttgtggttgttgtggtggtggtggtgaaaattga

SEQ ID NO: 8176 - DNA, 264 bp, Candida albicans
ggatgtagtctaataatgttgtgtattaataaaaaaaaagggggaaaaagagaaaatttgttgataatgatgatgggaagaattaaaaataaaaacttgaacaaagcacaactacaaagcacaacaacaaaacacaacaacgccaaaaaaaaaatgtctctaattaacagacacaacaacaacaacaagtcactaattgttcatttttttttcaaaccaattgatatttgtaaatgtacatggagttttaggttaacaagttaa

SEQ ID NO: 8177 - DNA, 300 bp, Candida albicans
cctctctatagtgtcgtagtatatttttattctcattgtggcagttacatgtgccctgcaaaaccaagtcagtttgttaagtgtgcaaacccattgagaaacatgtgtgtatgtcccactcacccccctcttcgtctccttaaaatgtgcataaattatctaaccgacgactgttataattttactgtacaagagcaagaataccctttgcaatattcacgctttaatattcttatgccaatcaattcaactttcatatatgttagatcattttgttttttgttgctggcgttgggttag

SEQ ID NO: 8178 - DNA, 225 bp, Candida albicans
ttaattatggattcaattatcacgataaatatgccacgagataatatggagttagattatgactgccaaaaacatacaaaaggaccgaatttgcttgcttctataactccacaaaacacaaaattgctcacggagttgggaatgtcctccccccaacagacttctattttacatgaagctacccatcacaagtttatccgaaataccagtggtaagaatatttga

SEQ ID NO: 8179 - DNA, 330 bp, Candida albicans
aactatttcatgaattcacaggaccatttcaaggatgattttgaaggcgaatttaaaccaattaagtatttgcccaaacggaaaatagacaaagaagagtcatcaatcaattctgtgaactcgagtgctaatactaaaagaaacaaaaaggcgtcattggtgattggtattgatgacgacaatacatatctagatagcccattggataaaactaaacattccaaaacagtaccagatggtcaatatgatgctaatgaccatgctataactcttccagaggctgtagaagatgacattgaatccttcaccacgggcatggaaggtcccgcg

SEQ ID NO: 8180 - DNA, 264 bp, Candida albicans
cagcggtctgtcaatgaacgttgtttattggttacacaattctacagtatcccaaccactttactgaagagttcaacacagcaaatttctctatattgcacaacatatatcttaaatcaaaatgaagatgtgttattattcaattgcttcacacctaaaggaaggattataactagagaatcgtgtactttagccagttttgataatgaagacaaactaggtagtgtaaagtatcaaaaaaaaaaaagcaaaagcaaaagctaa

SEQ ID NO: 8181 - DNA, 483 bp, Candida albicans
acaacgttcattgacagaccgctgctaccaactgatctctttgaagtatattttttttttgactgcaacttacaacctatacacaagaatataaagataaaggtgaaatgcaataaatcactttataattcatggctagacttgtatatgtacaaaaaacttttgacaatgttccaaggtgttaccatattgagaccgttggttgcttatagttttatagtgggtaacaagcgtcagaaaactttatctcaagctccatcgtttgaaacaacaatcaatgttcaagttgaaataagaatatatatcacaggaaatatgtttttagtgaacaaaattgaaagctcatcaatacgtaaggaatgtctcctcggtcttatgtatcgaaaggcattgtataacgaatattactttatcaaaatactatatataaatcaagcgagagacgagaagctatttataccaaaaagaatagttctccgataa

SEQ ID NO: 8182 - DNA, 186 bp, Candida albicans
agagagagaaaggaaaaaaaaattgatattattaagcccgtctcatcacacacacagaggtttgaaaaattattacagttgacacagaatcgaaacatgaaggcagaagaaaaaaaagaatgtgtctataaatttttttcttataatgagatgagatttgatttgatacatcgaattctacaataa

SEQ ID NO: 8183 - DNA, 291 bp, Candida albicans
ggctttctttttatacgtttggatagattattctcttacaataatactacaatgaaagtcccaccagaaaaaccatcaaatattggtacattttcacctcaacaaggttattcgaccgacgtacacgtcaagactcacaaatattcagataaaccaaccccgatttctcccaatcaaaacaaagcgtatggctacgtcgcagaccacttagatagtgatcataggaagaaatacgcaaaagagggtggcaaaaagttgtttgatatattgctcggcattatatgtagataa

SEQ ID NO: 8184 - DNA, 249 bp, Candida albicans
tcaatgtcacctggtaaatggtctgctactatagttatatcaagtttagcattagagcgctttaattccaaggctgttgtcaacccaatgactccagctcctaatacaacaaccagtgccattgatataaattggaattgttgttatcaaaaatgccgaggaaaaagaaaaacttacaaagataaaataaaaagtggagcacaatcaaccaaccaaaatgatttgtctaattatgcgacaaaaatatga

SEQ ID NO: 8185 - DNA, 195 bp, Candida albicans
cttgatctttatacatttgagttgtaccttaaccttgattcaattgttgaatcgatgacagaatctattcttaattccttgattgtcttatatcatcaaagggagtttttgatctttagtatcgcaataggcgcaaacaacgacatttcatttcgacttttttttttttttttttttcatatttttgtcgcataa

SEQ ID NO: 8186 - DNA, 279 bp, Candida albicans
aaagggtgttcttatgttttttcttttcagggggggggatgggtgttcactctctatcttcttggtgttgaaaagttaaccttgatagttgagaaatctaaatatgtcggaaaagaaaatctttggcgtagatttgcgtgggccaattttttttctgtgttcttcccttgcattaaattattattttattgtcaaggatctattatgtatgtggagagttgtgtgtataccgaaaaaaaaacttctattaacatacgtactaccaaatatacaaaataa

SEQ ID NO: 8187 - DNA, 852 bp, Candida albicans
aatcaaaggttccatcattcaacgctattagcatatccaacaaaattgcattctgcctcaaccagcttacaaattggtaaatttgccaaagggaaatttgtttgtgaggatgaaattaaagtagttggagaaataaaatccattttgcagagcaaatatccagtggtcttgacagaagacaacaatgcatatctaatcaagaagaaggttcaaaaactcagcgatgctcatcacatacaattattacattatagagagaaagattatattgtggccattagcgataatttgaacttttacaatgacggcaaactcgaaaactcaatatcaagtgaaactgcattagaaggtgtgttatctgtcgaagattcgcttgtggtgttctggtcagggaagaatgaacttttattcaagaaaatagactggtcagacgacgaaattgtgattccacggggcgagttacttatgaacggcaccaaagctcatatcaaggttgccaaaccaaaggtgtacaaaacggacgccactagtttgatgaagaaattaagtggtatatcagaccacgccgcaattgttggtctctgtcaatcagttggcgattctactgttatcaaagaagtatcaaaagaaattggcttagagttatttccagtaataagtgacgccgtaagcaaagacacaacaaatacaaatcttgctctttggttcaagtggatatacttaattcacggtaaacatattgccaaacaagatatagcccccgtaaaggaagccaaaacccagcttgagctgggagtcaagcttatgtcacatttaattgccattcaaggaaaactacaacttttgaaatga

SEQ ID NO: 8188 - DNA, 264 bp, Candida albicans
cacgttttgaattaccgccatgataagtttgagttactgggagagctttcactacttgatggcattgttgtgcattcagtgctacttttagtttggttgattttggaaattacacctgaatgtatgatacaaagacaattatattccaatattacccctatattctgttcagccaagaaaacattaccacctaagcacctacatagagacagagttggtccaccactacagataaccactaatatagaacaaacaaacaaataa

SEQ ID NO: 8189 - DNA, 399 bp, Candida albicans
aattctccgcaaaatacaaatattcatcccaacaatgctaatatgagtaaacgacataacaagaccgattcagtcaatttaggagatccattaccattgacatatttaccaacgagacgacagtcaccatcaccatcatatcatcgacaacaccaacaacaactgcgacaaccatcgggctctttacaacaatccacatcaattgaacctttgcctccgccaacaactaaaccaacaacatcttcattgttgtcgcgactagcgaacaatccagcaacacaaccactaccacatgtgacgataccgagaactcctactactaaagatcgaataaagaacaaattacgacaattaattcatgaactcaatgagttagaaacatatgaagaagacaattaa

SEQ ID NO: 8190 - DNA, 195 bp, Candida albicans
attttaacgcgcgagtcaattgaaactggctctcacaataatctcatcaaaaaaaagaaaaaaagaaaacttgaaaccaaaacaaaccaaatttcagaaagtaaagaaactgtcttattcacaaaagcttttcaccaaaatccagcatacttgaaattctccgcaaaatacaaatattcatcccaacaatgctaa

SEQ ID NO: 8191 - DNA, 342 bp, Candida albicans
agaagacaattaataataatggaacaacaattaaatgatatttctaatcatttaattcgaatcaataccactgaaggtataactaatatgcatgaacaagaaattgataatgaaaaagaagaacaagaagaagaagagttattgaatagtgtgaaaacgaatatactgcgattacgatcacaaaatgagaatcaacaacaaggcatatacaaacttctctgtacattctgttataaacaaaaatatttgatattggggataagtatattgattatatcatttcttataagttctttaattgttgctgatttcaagtatcaatattgttattacttttgttaa

SEQ ID NO: 8192 - DNA, 240 bp, Candida albicans
tcaaatcaaaatactaatatgagtttatggggtgtatatacggggccacaaccccctaaaaaaccgttacaagaaatgacacaagaagaacaagcagaagaaagagctcgacaaatgattggattcatgaattcatgtcctggtaaaactgtcatggcaggagtatcagggtttgccttgggtgggtttttcggattatttatggcatctatggcttatgatacacctattgggaactga

SEQ ID NO: 8193 - DNA, 192 bp, Candida albicans
agtgcagcaacaactgcaattacaccaaaggcaccagcagctttggttaatgcaaccgaaccaacaaaatatgatgccgacaacaatgaaaaaagtgcagtaagacaaaggaaaaacccacttaataaaaccgtactcttgaaagtaagcaacataaagataaaactaagaattgcccaggcaatcaaataa

SEQ ID NO: 8194 - DNA, 942 bp, Candida albicans
aatataaaagtatcagaaatttttcaaactgacgataaaccaaataccatcaaacagatatacaaaaatttggtaaactattatttggattatacaaatttgtactatgaaattaaagaaaaggaaattattgttcttgttgattgtgatgacttttatttggaaagtatggatcatttggcccgcacgtataatgtgaatgatggagccaatggaagtttgaatgataacaatatactattggatttgattacgaggtgttctacggatataggtactgagttttacgaggattccttaatagaattgaacaaatttatctatcaactatattataaaaagtgtcgattcctagataatgaatttgaacggtttagagtgtttgaaaatttatatatattactaaatcattgtcagaattgcccacatttgaaatttaatatttatacatttaattcaagtttgattttccccaaattctataaacaggtcattctcaaaaatcatactttgcaactatctcaaactaaatcaatcatttcttcaagtttgaaaactagtattgaaaaaatattattctcaaatcatagtttgccgagctacaatttctttagtgatatatttattaacgaaattgtttcagggtgtgttagcaatcatgaattaagtcacatttacggagacacgtttcgagagttacattccaagcttgatcatttggtgaatgtcaattgttttggaataatgtttgaattttatcatggtgagaggtttcttgaaattgataaaatctaccagaaatttgaaaaccgtcatgacttaattactaacaccaaatttgaaatttattttgacaaaaattttgataagattaaaagagttatgaatgaaaaagttaaactggtattatgcaaaatagatttcgataatagtaagataact

SEQ ID NO: 8195 - DNA, 186 bp, Candida albicans
aggaacagaatgaaatgttggataggtttaatgaagaggtcgactacacgtccagcaaaatcaagcaagcaagacgcagagctaagaagatattatagtaatttgttcactacttcgatattatctgccattgaccctattcgtcttcactacggacgtgccggaccgaactgtatttcccgaaag

SEQ ID NO: 8196 - DNA, 249 bp, Candida albicans
tacgttgacccaccaatttctatatcttgggggatagtaattgttgacattggttatagtgttaaaaagaaactagtatgtggtgcatattttttttttccttcgtgtatttctgccgcttccgctatgattgctatctacaaatccacatcatcttctccatcctttttttttttccaaaccaccaagacaaatgagtacataccattcaacacaagacgaacaatcgtccaatacagaggagagtag

SEQ ID NO: 8197 - DNA, 471 bp, Candida albicans
ttgctatctacaaatccacatcatcttctccatcctttttttttttccaaaccaccaagacaaatgagtacataccattcaacacaagacgaacaatcgtccaatacagaggagagtagccaggatgctgccccacgccctgtctctcccagtgaagtacctgcggacgatagagaagccactcaattggaactgcaaccgttgttggatcccgacgacccgcgagtatcccccttgaaattagaaagaatacgattattaaaagttattgccacaacattggtctacgtaaacttggtgctttttgtggtattattggtaagtcagttctttgccatccccggattcaataatcgtggtaaatcgtttttgggactcgacttggccttagtgagtttatttataaatttaactactaattgttctttgcgttctgcttatcatcttcaccacgaggtggaagatccgcgt

SEQ ID NO: 8198 - DNA, 240 bp, Candida albicans
aataacgggatactacatttatctagtgcaacattcttattttcatttgattcctactacgacaatgacagagtcaaatctagattgcgggcagaatccgctaacaacaacaaaaattacaaaaaaaaaaatgtttatcctaagctagaccaattctttcacttccaatctgtaattagaagaacagttagaatgaaccctataaactattgccacagaaataaatactatgaagaataa

SEQ ID NO: 8199 - DNA, 201 bp, Candida albicans
acaatcggtatttgttcactgaaacaaccaacaagtccaaaagaaggacttaaattaaagtcaaaatttgtgatctataataatactactgaagttgtagaaagatttcactggaagatgaattgcaaaattattacgaaaacaattttactgagaagatcacagcaaaaacatcaaaaaataatttgctcgtataactaa

SEQ ID NO: 8200 - DNA, 210 bp, Candida albicans
ccctcattatatcaaaataaagagttgttgatgatcatcatcaaaagtagtagtagtagtagtagtagtagtcgatcaatttctgttaaggtgaaatctcacagaaagaaagatccagaaatcccgagattaaaattcttcatcgaaacaagccatataacccatacaggggggatactaaaaaaagtgagaacaattaaagatctttaa

SEQ ID NO: 8201 - DNA, 183 bp, Candida albicans
ttccctcgaatcgcttgctataacaacctaattcaatttctattgttgaaatacaataacccaggcgtcttaaatgaatttagaggggttttaaaaaagaataaaaagaggagttgtaagggagaggtaagaattcagtatattgttttttttgaatatagcaataacaataataatgattga

SEQ ID NO: 8202 - DNA, 1140 bp, Candida albicans
ttatacgcccatagtgctacccccacctattattctcaacctgttagttacatcatgtcaacatttatcacgacactagatgaagaaataaattacattcaggatttacttcaatctattccatttagttcagacagaacaacacactttttaaaagtgtacaaaatttctcatcaagaattgatgaagttgaatgaacaaccacttaaattccctgtagatgctaataagttgttaaagttgggtatctccttggggaatttgattagaactttacaaatagatgaggaaagttatcagcaacaacataatcaacaacgccagtttttacagaatttaaataatgctaaaaacagtggtatcaacagtgggaataacagtaataatggaaccagggtttcatcgacagtttctgacccatttagagattcgacaatattacaaccacctccacttaaacatatcatcaattcaaataatagttccaacaccaatttcttgtcacctaatgtatcacaaccaccttatcaaattagatttatcaagaatttggtgaatattttgaaaaactttgatattggtccgagaaatgattttgttcaatcaagtgctacattgaatcaatcggggaataataatggaaccacaaatagagatagtgtaagttccaatcaatctatattctataccccacaaagagtcatgtctaatgggagtaacacatcatcagctaatatgtcaccgattaaattgaattcaaagcaattactcattgaaaaattggagaataatatcaatttagataatttgttcatttataaaatcacattgaaattgattttggaaatctttcacattttgaaacaaaaccttatcaataccaccagtaaattgaatgatccatcatttgccatgactccaacaaaatacgattttgatgaaagctcatcgattttctcactgaattcttcaacttctcaagactcaagcttaactaatgatgaatactataaacttttatcagtcgctatactgagaataagtcacggtatcgtgcaaccttttgttattttgatatacagagaatttgcagaaactaaaataagcgatgatttcacacaattgatcaacagtttataa

SEQ ID NO: 8203 - DNA, 276 bp, Candida albicans
tcctcagtaacaactgctcagttcattattattactggtcaaatggttttagagtccctccgtatttacggcgattttgttttttttagtctaattaagaaatatcactttgaaaatcttaatcaacgtggaaaatggacggacttcctttgtaacaatatttcgaaaaaccctataaagactcaagttcccacaaaatctacaacgttcaacaactacaataatatatacacacacttttgcattttgttatcaacatattgtacccggttctag

SEQ ID NO: 8204 - DNA, 294 bp, Candida albicans
attaacttagtatttttacttgtaaataatcagttgataaccatttcagttggaattttaggtacaaaccatcatataggagaaatatacattcaggaaggagaatggttaaccgagtatttccctatacagagcgcaaggcgcaaacacgttaatagtgtaacaaaactggggcctggaaaaataataattgtgtttatgtgtaaagtttttttttactttagttttgtcatatttccggcgtattgcggtgtgtatatatattacactgaaatgatcgcctttcatttttag

SEQ ID NO: 8205 - DNA, 279 bp, Candida albicans
aaaaatgaaaaatacaaaaggatgttgagtctcacgaatatgacctgggaatatcttttgaaaaaatttgatgtaaatgatgttattacttttgacttaaagaattctgagggtgcaaaagatttagtgtcagtaaatattatggacacactgcaattgaaggagaaaattttgtatgatttgcgacacaattttattgacgttgttgattattgcagtttttattcaagtttggaaaatttattgaatgaattgattaaatatatagagagtaaataa

SEQ ID NO: 8206 - DNA, 495 bp, Candida albicans
ttaattattcaaacaaaagaggtaacgatgaaatctggtttactacttgctgtgattttaccagttgcttttgctgtgaaaaaagaccaacaaagttgtaacaccagttgtgtcaaggtcttacagaaacaacaagaatcatgcccgtcaggttcagataccgattgcttatgtaaattatctgactcagattactgggaaccattggctgactgtgattgtattaacccagataaaaaactttcagcatcagaaattaaggttcaaatatgtggggctccatcatcatcgtcaacaccaacctcatcaacagaaacaacttcatcaacagaagcagaaactaccgaagcagaaaccactgaacaaccaagcagcagtaccagcagtaatactgagtcatctaaaactactattcttgaaaccccctctatacaaaagctcaatgctgaatcaactactagtgttattacccccttaacagaatcagctgtggct

SEQ ID NO: 8207 - DNA, 219 bp, Candida albicans
aaacaaaaaaacaaaagccaaaaaaatacagactcaacagccccctttttttcaccagtaaaactttgtcccaccaacatttcattcgtttatttaaacttactactaccagtcatgagaggtatcattttattgagttttgttctcacatcatgtttagcggcagacgctgtccccgctgccgctgatgctgctgctgtgacaaccaccactccagct

SEQ ID NO: 8208 - DNA, 246 bp, Candida albicans
acaggaaaacctcgcactttctttcgttcgatttttttttcttccattgctaaattcttcatctttgctttttctttgtatcactttaaaagagttctttcccattcttcagctttttctcaggatattgcttcacccgaattgaacaagagtggttccatctggttattcttttttccttatttaagaatatatgtttatttagaaagattttatacttttgaagtattggctcaacccatttag

SEQ ID NO: 8209 - DNA, 834 bp, Candida albicans
attaagcttttatatatgtattcccaaagcagaaactttcacaaccacaatacacacttcaatgagtgtatgttttttaacccggagacacctcagcaaatttgtccaagagtgtggttaggaccatacaacgcgttgataaacaaaacagataattatgacagcaacttcctagttgagcacaatatcaagataatcatcaactgtgggacaacattgcagttccttgatttgattgaaaacaatagagatgtgtcggtcccatctgatgtattaattttaagtttggatcctttctttcagagccatgatgagcttgctgttaactttgtccaaaagtatagtcgaatattgacaaactacttgaactacttttataaaagtaatctaaatgcagccaaattgattgaacaactaccgaactcaactgatcgtatccagatatcatcacgtatattgtgtggggcaaacttgatgatgcaatttttcagtctaattaagttgattgatttattcaaactggtcaatcaagagatggaagttttaatcatatcacaggatggcaacgataatttgctgacaggacttatgattgcgtacttgatggatacttatcgctacaatttattgaattcattcaacatgatcaaaagtagaagaccgtcgatttacgattggtcaagtgttgaatatgacgctttgttgaaacagttttatgctcagatttgtgaaacaaattgccctacttcaatggacacaatcaagagatcaccgcaggaagatgacaatgaggtgttagcaggtggagacagaaagagaagatttttgaattag

SEQ ID NO: 8210 - DNA, 198 bp, Candida albicans
aatattttttttgttacatacactttgaagcgcggaaatacctcaggttatctcatcaaatcaatcatcatttcttttttttgtccactatatatacatattactaatgatttgaaataccaactgtcatgcacaaatctttatcaagggtcatgcttgaaagatcaacaagatcaagaactccagaggtataaataa

SEQ ID NO: 8211 - DNA, 195 bp, Candida albicans
tatgaaagatgtgaaaccaagatatatagatttgagagaatgggagattccacaggtggttgcagacgatggaaaagttattgtcaaagttatttctggaaaatcacatggtgtatagtctcaaaaggaattacatatactccaattaattatcatcattatcaagtcaaagctggtggtaagtttaaacaataa

SEQ ID NO: 8212 - DNA, 183 bp, Candida albicans
tgtacaaataagaaaactatatcatttgactgtaaaattcaaaaccagaatattaacaaacttttgttctcttgcgttatcaccatcatgactaatcaagaacaggaatgcaacaataggaaaaaatatttaattttagtgcatgagttcaaacatctaacaaaggaatctagagccatgtag

SEQ ID NO: 8213 - DNA, 189 bp, Candida albicans
tatatttcttggtattttagaatcagttttgaacaaattgtgataaatttggctggttctggttcatttaatatctatgttttccttaggtttgtgtattcaaaaaaaaacgtgattaatagtaagataattaataatatatggtttaaaaaatgtcatttttgtagcaagatttttcaattactgtaa

SEQ ID NO: 8214 - DNA, 225 bp, Candida albicans
gggtcaggtgttggacgacacgtaaaatccattgtaccatctgtaacaaaactgaaagaggtagacgagaggaatagtggacgtaaagaaaaagaaagaaatagcttctacgaccaaatcaacaagattttaagtactattgtgaaggaacaatggcattatgctattatctattgtataatcaaattccatttacttgacaaagagttggaaggaggcaaataa

SEQ ID NO: 8215 - DNA, 186 bp, Candida albicans
ttggtgattgactgcaaatattggaatctcatttcctttcagttgttgttaatcaaaaaatggtatgaaagtgcggtgttaacccacgcctcaaccagattgaacagacgagaaaatctactatatatattttctcgttcacaaggtcaaaggcgatacccaccacccttactccgtaggaagtaa

SEQ ID NO: 8216 - DNA, 258 bp, Candida albicans
tggaaaaaaaaattgattgagcaaattataataaaattaacgagtttgaagaatagacgagatagatcgaaaactcttttggtatttaaagaattatgtcaagcctgtacaagtctacgaatgtcaagaatgatccccctaaggatttacaataatcaagtttggggaacagtccctataattttgctgtcatttttgaaccctattctttctcggattgtggaacatccaaacagcgtagtgtttaatatttcttaa

SEQ ID NO: 8217 - DNA, 231 bp, Candida albicans
atgcaaaaaagaatagtgcaattgaccaactcaggtgataaatttgcaattattactgatacgtgtcagtattcatatacacatatacgtgagctctctatttggagtaaattaaacaagatgactctaaaaaagggagacaaatccaaacttacaataactcccacagttgtccattatttgcctccttccaactctttgtcaagtaaatggaatttgattatacaatag

SEQ ID NO: 8218 - DNA, 285 bp, Candida albicans
cacattagctgcagccattgcaagttgaaaaaatattttacaaattatagagaaatccaattttttactatcatttcatttgatgcaacaattgatataatattgcgaaaatacttggaatttttcaaagtaattaaaccagttcaaaacaagaacaattatgcatacacaaatgatgaatcagtcatttccataccatatttgttgggtgaccatattcgttccttaattcttgtgggggatatgtacttggactgtgtattcaccccgggctggaggtacgca

SEQ ID NO: 8219 - DNA, 357 bp, Candida albicans
  unsure (36): Identity of nucleotide sequences at the above locations are unknown.
ctactttccgttattgagtcctgtcggacatttatnactggaccggataagaaatatgtccactcgcaagatcctaatagtaaagtcaaccaacaattgcagaaagctcaagctagttatgaaaagagtggtattgatcaaaaattgcgtaaatattttgaagacgctgccaaactgccattgggtttaaagattcatgaatactataagtcatttgccaaagacgttactgatgtgcaccaagaagcagtaagattagctaatatcaagaaaagagaattagaagaaaagaaacaagccgaaagtggatctaccactactgagaccaaggacacttctatcccacaagttcaataa

SEQ ID NO: 8220 - DNA, 276 bp, Candida albicans
attgttgttctagtcgtcgtagcaaagcaacccaaattaaagcgagggattttacaacgggaattagaaatagagcggataatcagagtgggtaatacacccacaaatgttgagaggttttcattatttggatttgctaaatggtataaagttccagggatatacaaacaagaaaatactataccaagaagtatgggtttggtaattttcccatggcaggtttatttggtgggaagtggagaatatagagtctttctgattagccaatcatattaa

SEQ ID NO: 8221 - DNA, 579 bp, Candida albicans
gtgttgattgtttttcattcttttttttctttctttccgtttttgactttttttttcctttattttatcaatagagatttacccattattattaaagatatacttcttattgaagatctggaaatgtttgaatcagatttatctttctatctggcccttctaatattatgttgtccaatatcaatagttttcttcaaaaaattccctatcaaaggatatacaggtgcaaataaagtatcattatttttacaatgtttaattgcaatacttaatttgaatattctttacagttttatcaactcacttactatcacgctaggtcatgatggttcctctgctaacacccttacgatagatcccatcactacaacacaacaacagggccacgtggactacacacctataaaagtttccggctacacatttaaaaatcaagttgccaccaagaatttgcaatgtgatagtattgtttacgatcaagatttggaccttcaagtaagtcaagctgttgatttgaacaaaccagaggatcttaaaatttttcagagacaaattaaacgaactccgttctttaaataa

SEQ ID NO: 8222 - DNA, 720 bp, Candida albicans
acaaaccagaggatcttaaaatttttcagagacaaattaaacgaactccgttctttaaataatatttatgatttgttctttcaggataatgaagatgaagttgaagaaagtattttagaaagaaaatggtacaagttttgtgggtctgccgtttggttggacaaatatggcgtttactttatggtcaatagaattgcctattccaaaaaaggtacacggaacaatcctacaatttctgtattagctggtcaagtgtttgataaaaattggattgaattaactggcaaaaaattcccattttctggtcttgaatttcctactattttgcctcattatattgatgaaggtaaagaagcagagaaggtgatattgggtgcagaggatccaagggtaattttacatgaatatactaatgaaaacgggatacgaattcaagaaccattaattgcattcaatgctttaagcacagaagtggattggaaaagggcaatgcatatttatagaccattacatgatccacatcgtattattcgtttgtcaattgaaaactatgctccaagagaaaaggaaaagaattgggcaccatttatagatggtaacaatcttaattttgtgtataatttccccttgagaatactcagatgtaatattaataacggagattgtcaaaaagtgagtggtccagattttaatgacaaatctcctgacaatgctgggtaa

SEQ ID NO: 8223 - DNA, 279 bp, Candida albicans
cgaaaatgccagcccagccctgcgtgttgtcagttatttcgtctctggggtacttggaccagaacgagacgaaaaaaaaattatttatccaacaaactacttcctgcatatgaaatttacaatagaaaatataatcaattagtttggcaacggtttatgaagatcaggctctttccctacacatacctacttaaaaggataaagtgtaagattgaagtaaaatatgttaaaatggggatcaaaaactctaatcgaaaacaccttgtaaacatatcctag

SEQ ID NO: 8224 - DNA, 489 bp, Candida albicans
actatggagacagataaaatggatattgaaaatgaaaagtaccggtttatatcactagatttgtatgacaataaacccgaaaaagaagtgaagaaagtattagtcaagcagaccctactacattcaccaatcatcactaatattataactgactttaaagtccggatcaataaaccattcaagggtgtatctagtgagtcatttaatgacgaagagtttcagacccttatccctcaggaagaggattcgcaattagatgccttcggtgatagcgacgatgatgatgatcaattgttatttggtgtgtctaatgacactactgtcacattacccgaacagtctcagcaaataacaccacagtttaaaacagtcgaagtaattgtcaaacacacatctattgtagttgatgggatagagttttctacaaagtcagctattagatcatcatgtgttgtcaaatcaagtaccaatgaggacgagcatcattga

SEQ ID NO: 8225 - DNA, 264 bp, Candida albicans
tattgtgcttcttctttatcttcaattaatataatcaacttttataccattatgaagggtgttaaaaaaattaaaaaattatacaactattatgctattggattaattatatcgttgtttagttttgtctcagggatggaattgtattcatacttgagtgttcgccaaacgagtttatttgcaacattgtatcgtgaacccaccaaattcgatattaatctattaaaatcaaccaactatttaggtgcaataggtaattattaa

SEQ ID NO: 8226 - DNA, 411 bp, Candida albicans
aacataatgttttcaccaataaacatcaagttcataaataaagaaattggtagaataattgataatttatccaataaaggagtgattggtttggattttaaattcccttcatttaatcattttaattcacattgtattacttcaaattcgttacaattaaaaatgcaagaatttttttcaacattgaacataccaaataccaaatttaatttcaaaactgaaagagaaggtcaaacaattaaaattgttgacgttgaacatattcaaggtgaggctggtccggaaatcgttgatatgtttacttctaagaaacaacagttgctaaaaagaatgacgaatttagatgtcgataaagggttaataaattgtaatcttattgctaatgtattatatggagaaacaaatttttag

SEQ ID NO: 8227 - DNA, 189 bp, Candida albicans
atcattggtatcaaaatacatgataatgttggaaacatatccaataccaggttatatgggataccaaaacaacgatccatctcaatagatataatattatttacaataatcaataatactactactactaagaagaagaagaagaataatatcctaaacaacaccgtgggggattatggggtattatga

SEQ ID NO: 8228 - DNA, 279 bp, Candida albicans
ttacagccaaaaacgggtaaaattgaaaaaaaaaacaacaataattggaaaaataacacgataataaaaatatccgaaattttgaaattgtcaaaattggattctaattacattagacaacaattctcccccccactcctccatactctttttttaacattattgttttatcaattgtgtcatttgatcgacttaggttttcgtaaaattttttattattattatcaaactagagatatactgatattaaaatgtcggaaaagaatcccactctggtag

SEQ ID NO: 8229 - DNA, 231 bp, Candida albicans
cataagggggagagggttttaaataataatttcagatccaaaatggaaaataatttcaacaaacaaattgagccataccataagtttttattaacctatttaccatcagtttggaaaacatcgtggaaaaatcataaagagcatattggaatcgttatagtcaatattcaaaatataaatagccccaattcaaaattgttatcaatgatgtatataatcgagaaatattag

SEQ ID NO: 8230 - DNA, 1476 bp, Candida albicans
  unsure (113): Identity of nucleotide sequences at the above locations are unknown.
ttgccgtcaaaaatacacgggctttccatccagttccccgttttattcatgatactgctaataataataattttactgaaaattcttcatacgaacaagaattacgaatcttntgagtcgttatcatctgtgctcaagacaccaaacaacccagaagatgatgatggtttaagtaccaagccaccattatcatttcaggactatgtttttaaccatacattggcaacaagtaatactacagttgatagaattttcagtaattccactggtcatttagttcaatgtccattgtattacaatgactcgattgtattatattacgaagttgatgtcaatgaccactttcataagttggggtcgtacagtgtcctatttaaggtcatttccaatgaagaggattctaaaattattggttgcagtaaagcttatgtgactccagtgcaaccaaaagtgattagtaatgtcgttgcgtatggtgtgttggtattattaatggtgacattattattgaatgttattaccataatgtattcaacataccaggaatcgtcaaatccttttttgttcaaagcatcggctatttgtaatgaagaattgttgaaacaagtagatacaacattaccgggtattttcacgtatttgcagtatgctctttttatgggaggtttagacttggcatatccagggttcttccaaccaatacttggtcaaatcaaatggtgtgcattgattgggttctcccctgttttcaagaatgaacatcattcatataaccatagtgacaatgtttattacactttagaaactgggggtttaccaaacttaactaggtatatttcaaatgaccttataattaataattgggccaactttatagtgacattcattgttgtaatagttatgcacgttgtcctgagtcaacttttcataatgtcgaaattattattggacaagcttgacttggggaattcccgttctaagaagctgtttgtgagaggcggtgattttaatgggttttcaattttttctaaaaaaaatttttatcttattttaggacaagttttgcatttgttcttattagtatttgccatgccctttctaattttatcatctttccaatttttatcagccagtgatattctggggaaacgtcgttttggtacaaattatgctcaattgcgggaagatgcttattcgatggtcgtcccgtataatgaattgtgtatcccatccagtattttctcctttgccactaaaatatgcgatgggagcgaatactcgccatcaaagtaccctccaatttttgattccggacatattatgcataatactgaaaggcgaaattatgtatcttcacagttgtctcaagatataatgtatttacaccctaatgataatgccacactatttcataacacgcaccatattggtaattatactcaaaaagtggatcccagttatatgagaatatcataa

SEQ ID NO: 8231 - DNA, 183 bp, Candida albicans
  unsure (37): Identity of nucleotide sequences at the above locations are unknown.
ccaataagtgcggtaccttctagctcccgtcgtgaanaaaaaaagattcttggacgggaacgtcaaaaaaaagaagaagaaaaaagagaattgaaaaacacgcgtcgactgaaatgcaggtcgtgtctcaatttttcacgacaatggttttatgaatctttgatgaaacaacaaacttactag

SEQ ID NO: 8232 - DNA, 270 bp, Candida albicans
cttttctctagtacaaataaccagcttttgttagtcttaaatggagccccgagcagcagatccatcgttaagtatcgcccatcgcccgttgaaagaagagatttacaagaggggctagtagttcatggtattatacacaggcccaagctcaacagatcaactaatattgaccaggaaatttctgttattgcatacggcatatttagacccagagctagtaagtttgttgtttcatcaaagattcataaaaccattgtcgtgaaaaattga

SEQ ID NO: 8233 - DNA, 567 bp, Candida albicans
ttttcagcccgtggtgaagatccacagtatgtgtttgagaagaatcatttgagagggttgacaccagtcaaattgcccctagcatcattacgatttttggatgtgtgtcgttgtgatcttacttctatatcgccattattaagttcaatgaaagaaaaaggaaaagagaatactcctcttaatgtttctgctgtcaacaattggtatttgaatgttcgtgatgtgaggagaatgttaaaattgtacaagaatttcaccattaccgtcagtacgtttgatgaaaatttgattgacacttgtcgatattcttctcgtttatcttgtgaagaaacccattacaacgaaaacccagaggaaacagactacagtgacgaaaatggaaatagtgacgaggagctttactatggaagtcaggatctggatgacggtttcgatgaggattacgattttgatgataatttcggttttaacggttatggaggttttggaggtcctggagatgagagtcctgacaacgtttttcttgaaatgttcagagccatgatgagggacggggcgattgactag

SEQ ID NO: 8234 - DNA, 456 bp, Candida albicans
attgctgtaattatggcatcagaagaaactgatatcaaacttttcacaaggttaggacaactaccagatgatgttattgccttaatcattagctatgtccctaaatgtcaattacaaccattgttaggtttcagtcccacaaaaaaggcagtggttaaatcctatttggcaaatgtcaaaattactgaatgtcaagatcttattatttcgggaacatgtaatcaatctgaacatcgtgattgtcaagataagccagctgctgtgtctttgaaaaatcttcgattgcttgtgaagcaatggaatctttatcctaaaacgctttattttacaagtttcaaagaattaggtgctatgcttgatgttttcccagaagttttaattaatgctgaaggtattaatggggtatttgataaagaaagttctgggaatcgagtacaaaatataaagcaactcaca

SEQ ID NO: 8235 - DNA, 1671 bp, Candida albicans
ggggcccttttttttttaccggattttttcacccgggggccccttcattttgtagcgggggaccttcatatttaccagtatattcttccagggaggattcatttactcaagaaccttcatcttttacccaaggatcttcttctagcgaaggtccatcttccgactgaagagtcatcatctactgaaggtccatcgtcatctactgattcttcaacagatattacctcagcttcttcaacagatgaacaaagcagttctggtactggtcaatcatccactgaagacgaaccaattgactctactgagtctgatacttccagtgcaaccgattctagtactgctacagacagtagtgctactaacaccgataccaatagtgaatccacagactcttctactgcaacagataccagctctactgatagtaatactgcttcaagtaccgaaactaacacagatgtgactgattcttctactgattctaacactggagctactgaatcttccacagctactgataccaacactgatgctactgattcttccactgtttctgaaaccggtgctacagactcttctactgctacggataccaatactggtgctacagaatcttctactgattccaacactggtgccactgaatcttctactgctactgatacaaacacaagtgctactaatacagacactaatactggctcaaacactgctactaatacagacgataatactgctactgatactagttctactgaaaccaacactgctactaatacagatggtactgaaaccaatactggtgctactgaaactaacactgacacaagtgctagtaatacagacgataacactggttcaaacacagctactaacactggtggtaccgataccaatactgacactaataccggtggtactgataccaatactggtactaacaccggtggtactgatacaaaaactggtactaacactgctactggtaataatactggtgctactgaaaccaatactgctactaatacaaatggtaatggtacaaatactaacaccggagctactgatacagctactaatactgctactggtactaacactaacactggagctactgacaccaacactaatactaatactggagctactgttacaaataccgctactaatactgataacgtgagtactacaaaagacattccaagccctacttctactaatgaaggttctaataatggtggtggttccaataatggatcaggatcaaacaatggatcaggtaacgaatcaggtagtggttcacgttcacgtaatggttcacgtgatggatccaacaatggatcatgtaatggttccgacaatggaacaggatcatgtaatggttccgaccatggaacacgatcaggttatggctccgacaatggttcacgttcacgttcatgttcaggttcacgttcacgtaatggctcacgtattggctccgacaatggttcatgttcacgtaatggatcacgtagtggatcaagatcaggctcatgttccgaacatggatcttgtattggttccaacaattggtccagtaatggatcacgtaatgggtcgggctcaagctctgaaaatggatcctgttcatggatcaggcccccgaatctggaaaccggattttggtaa

SEQ ID NO: 8236 - DNA, 339 bp, Candida albicans
tttgggccacggattccattaaccggagtccgatttccagattcctggagcccgttttcccatacccgataccattaccaaaatccggtttccagattcgggggcctgatccatgaacaggatccattttcagagcttgagcccgacccattacgtgatccattactggaccaattgttggaaccaatacaagatccatgttcggaacatgagcctgatcttgatccactacgtgatccattacgtgaacatgaaccattgtcggagccaatacgtgagccattacgtgaacgtgaacctgaacatgaacgtgaacgtgaaccattgtcggagccataa

SEQ ID NO: 8237 - DNA, 246 bp, Candida albicans
  unsure (228): Identity of nucleotide sequences at the above locations are unknown.
tttctgtcaactatggtattatctactagagtatcgattcaatggccaccaaaagaagctgaagagaaaacaagtacattagcattaaccacccctgttaataattatgttgacattagaatttttaaaactcaatacccgtgtttaaattcgacattaccattaccattcacacaagtatttgaacttggattagctgctaaagaaatctgtcttaaaagacgaccntggaagttactagtcggg

SEQ ID NO: 8238 - DNA, 267 bp, Candida albicans
agttggcaacatatattgctcttaatagtagatactactaaacaatatgtccttgaattcaacttattgaccttttccgaacttggatcatataaaatagctcaaattgctgtattggaatcccgcatattcttatcaaagcaaatcgtaccattgaaaaaaaaaaaagctaaagctaaaaaaatattcaattccgactccatcttttattccacattaaccccatctccatccacacatagctacaaaacaaatcatgtccgttag

SEQ ID NO: 8239 - DNA, 192 bp, Candida albicans
cttggtagatgggtgggtaggtggatgatgatgatttttcttgtcatggtgataataagggaagataggaagaaaggaaccaagaaaggaactaagaaggaggaggaggggggggaggaggaggattattgtttattgttcatttttattgaccaaaaacttgttgttgttgtcttttttgttgatctctag

SEQ ID NO: 8240 - DNA, 306 bp, Candida albicans
atctgttatcaaaaaaaacagattacacacatttttactctcataacctctaatgcctctcatattgttcttgttcttgttttcgttctagtttttcattttcatataaattatattaattttgatgactttattttttgtatattcttattcttgtcttcttctcttcaatctacaactcttattcctcctcctttccccttcattcttcactcttcatttatatatatatatatacttacttactttcataacattttacatatagttttatatatatatatattatatcataatttaatttag

SEQ ID NO: 8241 - DNA, 228 bp, Candida albicans
aagaatctaaaaactaattcgatcgaccccacttttaattaccgtacttccgatgtaccttttactgtatctggagtcgattataatgccgatagtattcttaaatccatcggggttataatctctgaagagattatccgtatacggatactgggagaaaactccacacaacaaaactgcttcgttttcaagacattatatacagatacatattcaagtgttaaatga

SEQ ID NO: 8242 - DNA, 240 bp, Candida albicans
aaaaaaactgcctcatttgaaattttgaggagtaaacggaaaaattatttttttctcatacagacaccagatagtaaaaatggcctggacacacacatggcaaactataaagagtttctccattttggtgtttgtgtcagacaggaaaaaattttctttccgcagatctccagatttaatatttcctgtggggacaaggaacaagagacggatgtacacaaattaacgagtagagtatag

SEQ ID NO: 8243 - DNA, 225 bp, Candida albicans
tcaagtgaaatttatcctacgcataaccatatcaccaagaagtttaatgaggtttctttagataatacagaattgcccattttattaatgcgttctcaaagcctagcctggtctagcctagttttcattcccttttcttggaatgcgagaaattccgaatattctcaatcttctagtccacttccagatagaatactctttatattttatactggaaaattgtga

SEQ ID NO: 8244 - DNA, 234 bp, Candida albicans
gtaatatttcataggaaataccttgctaaaaccggtgtaaacgtcttttcactaggttccaatgagctctacattataaaatactcaattctagtagcaccaaattacttcaacaccaacgtctctaattttagttcaacttcaggtaatcgaagaacacaaactagtttgtgcgaaagactgatatcattccatctgaatgtcttgtcacctacaaaaacactgatagattga

SEQ ID NO: 8245 - DNA, 234 bp, Candida albicans
ttaagaagaaaaaaaaggagaaagacaataacagtgttgtggattgaattcacatacacagaaaacacacatacatacaagcatattcatattcaaaaatcaaatcatatatatatacataaacttttttataatgcatctttatacatgtgtataataatagtcattttcataaacgtacacaccaataataataataataataataataataataataataataggatctag

SEQ ID NO: 8246 - DNA, 339 bp, Candida albicans
tatacacatttgagtatgaatttattgaataattgtgatgaggtttcatcctcttcgtcaaagaccaccaacaactttaataatttaataaattctactacagcagaaccaccacaaccacaacctcaaccacaagggttatcaacatcaacaactacgacatctgtatcaacaagacaccattcaccagatattgtatactcatctcacaccaaatccactttaattagtaaagccccatcagatttcattcaaacacaaccatcatcacctgaaccaacctcatcaatacaaacaatatctaatcaaataactgacgacctacctaatcaagaagtt

SEQ ID NO: 8247 - DNA, 186 bp, Candida albicans
accacattttgcaaaaaaaaaaatgtgaaaaaaataatgaagggtgcgagattcgaactcgcgcggtcaactgaccaacagattactctggtaaagaaggatttgaaccttcaccttaagtctgtcaccttagaccaactcggtcaaccctcccaatttgttgtcaaaaaagtatgcggcttttag

SEQ ID NO: 8248 - DNA, 201 bp, Candida albicans
actggtgaatcaaatttacttaccactcctttcgcaggtcaaataacagaccccctaaaaagttttagtttgatcatcatccacttcctgctatcactaagatataggaatcctccttttgttatagaccacattttgcaaaaaaaaaaatgtgaaaaaaataatgaagggtgcgagattcgaactcgcgcggtcaactga

SEQ ID NO: 8249 - DNA, 540 bp, Candida albicans
atatcttcacttcgtattcaatataaccaaattaaatcaacttatcaggaaaatatgatatttactcaagtaataattgtacttacagttacatctcaagctttatctgtcaccatttcagatgttaataatatcgcctcaaatcaagttaccaagcgattgggtggtggttctagaggtggttccagtagcggttctaggggtggttcaagcagtggctctagcagtggctatagcagtggttctagaggtggtagttcaagtggcagctcgagcagtggctccagaggtggtggctcgggtagcagtagttcatccggtagtagaaattggggaagtaatcaataccattgtagtggaaactcatgtggatatggtaattactatgcaccatctacagcagcagcagcagtaggatatggtactggccgctataccggaggaactcaatatggaaataatcagtaccattgctcaggaagcacttgtggatatgggaattattttgcgtctcccaccacgaggcctggaagatcccgc

SEQ ID NO: 8250 - DNA, 228 bp, Candida albicans
cggtatactataaatgaacaagttgaacccaaaacggaggcacttgctatcaatggccaaccttgtgggcacccatatatcatccctgttaaaaacgacaatgcagaaaacccaatcaatggggggaacccaaccataaatactaaggcaaatattatcaatgacccatatttcaaattatgccattcgtcagacaaatatatgaggaatcgaataatatgtatatga

SEQ ID NO: 8251 - DNA, 201 bp, Candida albicans
gctgaagacatggtattaactgcaccccaaccaacacaagcaacaacattaatagcagcaaaaagtcttgtagtaagatcaccaataagaaatttcgataataacatttgtcttaatcctaaagctgatccaaaacatgaaaaaaatgccacggggaacccacctagtattgaaaagaaaataatcactaatactgcttga

SEQ ID NO: 8252 - DNA, 609 bp, Candida albicans
tcttttcattcatactctttttttcttaattatattttctatttgtggttccatttcaaaactcattccttagtccgatacaattgcataatgtctcttttcagaagcttacaaaactcgccatcaactatttcaatctttcacaactcatctatccccctttctaataaattatatgatattttagaaaaagcctacgatactcaacctgaaaaacctaaacatgagtttcaaattgatttgatgaagaataagatgccaacttatgatcaatataagttgattgttgataagtatttgaaaggtagtacttctaaaactatcttgcacaattgcttcccattcttacatgacagcaaaaccgaactttacaacagtaagggtaatgttgtcactgtcaaaggtgttgaatgggcaaacaagactttctctccggcagagtatcaaatgatttatgatacgtttaataaattacaagaatctagtgatcagtcgataaataccattgcttccaatgtcttccaagctccattggtggttgattgggataatgatgtaattgccggagatgaagaaacattgaaagccattttgtcaaaatataattaa

SEQ ID NO: 8253 - DNA, 279 bp, Candida albicans
gttgttgttgttgttgttgttgttggactagtgggcgttttgttttttcttctttacattgtttggttcatcatcccatcttgtttatttcataataatggacaaagatatatgagatacaaaattagaattagaattgttaaagttaaaaataacgagataaggtttgtagccaggatttacaacaatactaaaaaccgaacggaggaggaagtatacgtgcagctgtatcactctactgctcgtcaaatatttgctttttctcttttctgtttgtaa

SEQ ID NO: 8254 - DNA, 264 bp, Candida albicans
caaagtagaaatataaattttttttttttttccgtgaggagagcaccacccccactttactctttttctttttcttcttcaacgatgtactctttattgaaacaatccattcgtccaaacctgttagttgctcaacagtttagaaccatgatcactgctcaggctgtactttatagtcaacacggtgaacccaaagatgtgttgtttacgcaaaattttggagatcgacgacgagaaattaactccgaaccaagttgtgggtga

SEQ ID NO: 8255 - DNA, 267 bp, Candida albicans
  unsure (44),(118),(176),(185),(186),(187),(194),(196),(197),(227): Identity of nucleotide sequences at the above locations are unknown.
acagattgcaaagaatcacagtcaagcaaaaatttcatgttatntctcactttgagggtacaaggggtatctcactcatcaaccaaagttggattcagtggctcttttgaaaaattcnagaagggagtgacctataaaattgattctatgaagttcgtcgcacgagaaaagaaaangaaggggannnaccgaanannaattttgaatatgagaatgtctatttatantgctctgaataagggtagttacaccggtaaattagtttga

SEQ ID NO: 8256 - DNA, 315 bp, Candida albicans
tacagatcacaattgctagagatgaatatctcaattttaaactttattaattatcctggatattctgtaaagcagagagaaagaggggggaactatttgtttcgttatggtgataacgtttgttcgttagaaagcagcaaattgataattccgtgcaatttccattattccgctgggcgcggaatagggaatagcttccaatatacttggacagaaaacttttccgcctcagagaaatcgcaaatactgtctccaagttcgtatagctcaaaccatcgtcttcaccacgagcggctggaagcatcaacgtcggca

SEQ ID NO: 8257 - DNA, 192 bp, Candida albicans
agaggggattcgtttgacaactattggtgggaattaaatgggaataataacaggaaacaacattcacttgaaaagttagatatatacagtaacagttgtagtaggtatggtgggaaactgtttatgtgggtagtggtaattgtggttgtaaatcgcaaaataaaaaaaaggaatacagacaacaaaaaatga

SEQ ID NO: 8258 - DNA, 300 bp, Candida albicans
gtaacaagttcaaagcaaaggaaaaagacaaaaaccagtgaaccgttgaaacagatatcaaattattccaaatatatgacgttggatgatttacagcaacatggacgagaacgagacagttccacagttgatcatgaaatacatcggaaaccaaggactagtcataaatctggttccagaatgtcaagtattggtcgagttctttcacgtcaaagtttaaataataataattctacttttgaaaagtatttggatgatgttgatggttctgatgaaggtgctggtatagaggagaagtaa

SEQ ID NO: 8259 - DNA, 225 bp, Candida albicans
atttggtggttgatggttccttgcttattttgctctccaatattcgacagtcttgttatttgggatattttgcaaaaaaatttgctcctgttgaaatgttctttttatttgtcgttggatgacgaaagaattattgaagaaaagaaaaacaacaataatagattaaggaggaagaaaatgggaaacaatataaatattttcaacactggaagtaatttcaattga

SEQ ID NO: 8260 - DNA, 207 bp, Candida albicans
ggaggaataagaaataaagttttttccataaaatttattttaacatactttgcatttaggaattgtacattagttgaaaatgtgtttttgtatgagttaaaggagtgggaaagagtgactaattgcacaaacttcactaatgtcgaaaagtcctggaatagaaatatgcatgcactcaacacaggtcatcacatctacatggaatag

SEQ ID NO: 8261 - DNA, 207 bp, Candida albicans
agcaacctagtatttattaggttcggaatttcaccaggggcaaaaaaaaaacaaaaagaaaagaaaccatgtactaaatttaatgtttgcatatattcatatttaaagaaaaagttgatgaataatcaatgggaaacagcaatactcacccctttcccaacagaatatacttttgggaaaatccgttcagagtctgttgagcattga

SEQ ID NO: 8262 - DNA, 603 bp, Candida albicans
acgtttcttgataaacttgtggattcggacagtgatagcgaagtggataaggaaaatgaaaatgttatacaagaagtggacaaatccaaaaatcaagaacagaacgatcacattatcactgagttggataatactgagcagtcagtggcaggtaataccaaaagtaccactaatggcactagctattcggagcctgaaaataacaatcaggtaaatcaagaaagtgtcactgccaacctagattctgttgcaagggtgccagaaccagaagtcattgaaaattcagaaagcgaagaggaacagatttcgaagataacacacaatacaccagccacgtcagtggaccttagcaacggtccagaggagacaagctacaaaattgatctggtccttattgatttgattgatgatgattttacatttagtagtgatactgaaggggatgaagttgaggttattgatgccgtttcacctgaggtttgcaaattgcccgagaaaccagccaccccaccgataagaaaaagtttaggtgtgaaaagaaaagtcaataaaactccagatcccgaaagcaattcaattagtatcccatcttctaccacatag

SEQ ID NO: 8263 - DNA, 285 bp, Candida albicans
aagtcacataatgaagtaactagaaaagtggtccaagacccatccacaacaaacaagaagtcactaggtgtaaaaagaccccgtcctgtaagtattattgatcaattaaaaagacaaaagatcagatctcaagtgatagtctcaagagaaactcagagtattatcgagcatgaaagtcggacgcagagttcacttcctagtccaagaaatatgctggatgaaattagtgaaattgatgttataatagatctagatgatgatgacgtcttcaaccgacgggactga

SEQ ID NO: 8264 - DNA, 639 bp, Candida albicans
ttcttattcggagtcaacaccgagccgccaaatggtattttttggcctatcggtcccttattgggtgagagaaaaaaaaaaggcgttatgaatttatttgtcgcattaagcaaaaaaaaaaaatatcaacacaaattatttgccccatatttgcggcctctgacagatacaacaaccacggaaactcgctttatgctctcgacttgtttaataaggaattgtgtttttataagaccaagattatctgtaatttgctttaaggcaatcagataccagtccaagaagctggatttccctgattataccaagattaatgatcctaaattgagagaaatcatcgaaggatccaattttggaactgaagcgattttgaaaaagcaacgtgaagatcaggacaagaagaagaaaatggagcaagaaagaaagaggttagaacaagaacgtgaagtggatagaagacgtgaagaaaagcgtgcaaaagaggaatctgaaagtaacaagactgacaatgacaacgaagcaaaccaacacaccgacgataagcttgccaaagtcaatgaaaaattggaatctaataattcaaaaatagagtcagtaagacctcgaggagaagatcttcgtcttattcgccaggacagg

SEQ ID NO: 8265 - DNA, 930 bp, Candida albicans
tatgtttcagctgctccatctagcaactcatctggtgttccagctgcgccatctaacaattcatctggtgcttcagttgttccatcacaatcagccaacaattcatctgcttcagctgctccatctaacaactcatctagtgctatttctgaaagtgttgcaccatcaagctacggaaactctaccattgcacaaccatctacttctacaaaatccgatgctgcatcaattactggtccaattactacagacaaggttataaccaatgagtctggcattgtctttacatctacagtaatcattacacatgtttctgaatattgtgaccagacttctgctgctgctgttcaatcatcagcatgtgaagaacagtcaagtgctaaatcagaacaagcttctgcttcatcagaacaagttaaggtcattactagtgtggtttggtgtgagtcatctattcaatctattgaatctgtcaaaacaagtgcagaagctgctcataagactgaggttattgctagttgtgcaagtgaattaagctctttgagttctgctaaatctgaagctatgaagactgtttctagtttagttgaagttcaaaaatctgcagttgccaaacaaacctcgttggctgctgtacaatcatctgctgcttctgtacaattaagtgctgctcacgcccaaaagtcgtctgaagcagttgaagttgcccaaactgctgttgctgaagcttctaaagctggtgatgaaatttcgactgaaattgttaacatcaccaagaaagtttcttctggtaaggagactggtgtttcccaagctactgttgctgctaacacacattcagttgctattgctaatatggcaaataccaagtttgccaacacaatgtcgttgttggtcgctaatttcgtgtttggtggtctcttaatttaa

SEQ ID NO: 8266 - DNA, 636 bp, Candida albicans
ataaatcgttggccaaaggatggaacagctcaattcattaccaccatccactcggaagaacacgtaggcgttcatgatattctacaccatattgaaccctatcatcaagaggagatccaaaaaaatgatcaatataatttggaaaaggatgtccaaccacctaacaatgaattgcacatatcgccatttgaacaccaagaacatgaccatgcacctgagcatactcctctgaatataccacccgaaagacctgaattgtatggccataaatttgttgagcctgaaagagtattcgataccgctgatgattacttcccaactcacattttacaagaggtggaaaaaataaatatttccaacaaaccagatactgaagcagaagttgagccaactagtgcttctgaattagctactgatgtcactgctttcaatttaatgaacgacaagctttcaaaagaaggggccattgaggagtctgcttttgaagagatttacacagaagataatgaggaaatagatggagagatttctgaggatgatattttggaggaagaggaagaagaagtggtaccaaaattgttcccctgggaatttagagaaagtggtaaagtggttgctgaaagagtgtttgattaa

SEQ ID NO: 8267 - DNA, 228 bp, Candida albicans
ctgaaattaacgattaatcaaaaaaacggaaacgaaaatgataatgaatataaaaaacaacgtaaccaaaaaacaaggcaagacaagacaaggcaacgctgtaatgcaaaatgcaatattaaggtaattactacggaaatcttttctgatatcttctttcatatactattgattcttatgaattttaatcaaacactctttcagcaaccactttaccactttctctaa

SEQ ID NO: 8268 - DNA, 189 bp, Candida albicans
aaaatattgccaagaaaaaaagcttgttttgtggccagtgtccgaaaaaaattttggggaatcttcggattaatttatgttttcattccatcggggaaagtggggggaaaaaattttaagcagttcacaaaaccttccaaaaaatatatggacaaagatgattgtattttcccgacaccaaaatcataa

SEQ ID NO: 8269 - DNA, 186 bp, Candida albicans
atgatttggatcacaatttacgagtcattagagctagacttaatcaacgatgatgatacattaacatccaccaaaggcatttcatattataggctttgtatttttatacagttgtatctacacgaagttaacgaaatcattcacaaaatatataaaatattctggaacacaagaatgatatattag

SEQ ID NO: 8270 - DNA, 237 bp, Candida albicans
accatggttttacttaaagaaaaacctcgaactatagggacagattcagataattcaatatataaagatattgaacaatcaataacaccaccatcagataagaatgagatttttattgatcaaatcaataatgaccgtataactgaatatgattcccatggagaagtgaaaagagatttgaaaccaagacttgtgaatcttgaccatcgggcctggaagatccgcagcatggcgcgt

SEQ ID NO: 8271 - DNA, 195 bp, Candida albicans
tcaataaaaatctcattcttatctgatggtggtgttattgattgttcaatatctttatatattgaattatctgaatctgtccctatagttcgaggtttttctttaagtaaaaccatggttcaacaagctgataagttgaatacggctagcttctttaaaaaaacaaaaaatacaaaagtaacaaatttgttctaa

SEQ ID NO: 8272 - DNA, 198 bp, Candida albicans
accgaactgaaaaaaagacaaaataaaaacaattttttggttaatcataccggtggtctctttttttttatcgtatatcatttaagctttaaaaatacgtatcagccgattgagatgattcataacctatgcaatgatcatcaaacaaaaaaccgactgatacgcagcgcattgtttggactcgctgtcacaaaataa

SEQ ID NO: 8273 - DNA, 219 bp, Candida albicans
gaccaaaatgaaataaaatcaaatgaaattgatttacccaatgctcgaatcgtagcatctcaatcttcaaaagaagttcatttatatatgtatgtgtatatgtatggtttattctttggtttacccgaagaaagcaatactcagctggaaagtatagatacaatcaacaacagcaaagaacccttagatgagcttgcttcaaatctcacacggttgtaa

SEQ ID NO: 8274 - DNA, 234 bp, Candida albicans
acttttgtaaatctgcctctgattcaacgactgttggtaaacctaattcttgcaaactgtgggaaaactccaaaaaatgccccatccaaatccaatgcttggaatcaaattcaagggccattatttaacattgttaccctgaaatctgggtttttctcctcacccattcaaaaaatttttggggcaattattaatcccataacgaaattccgggttattgaaagaataatttgg

SEQ ID NO: 8275 - DNA, 258 bp, Candida albicans
accagcataagccacattcccttgatctatattaccatgcaagaaggagttcagtttgcagcagcaactaatttgaaatccagaaacaaacaggggaatggtacagccgctgaatctccatcgttgtctccacagatatccgatcacagcaatgatgctggaaacaagtcaaacaatcattacaaggagagattgtccccatttagatacaaattgagatcgctcatattgcccttgattcgtcaagaaacaatatat

SEQ ID NO: 8276 - DNA, 186 bp, Candida albicans
ttagctttaagaataaattttttatcacttactaaaactgtacctataggagcacctaaagttttcgataaacaaagtgatacactatcgaaatatgaacaatattcttttaatgaaattccagtttcagcacttgcattccaaattcttgcaccatctaaatgtaatttaacattattttgttga

SEQ ID NO: 8277 - DNA, 312 bp, Candida albicans
ttagtttttaagacaaataccaataatatgccatatacctttaattttccaaagctgcagtcaagtttcaaatattctattaaaagtcttactaattctcggtcattcccaatgatatccatctatgttacaccacaatcaacacctaagtttatcaataatcagtccattgataaaatgacagtattgagttctttcagatcaagaaacagtttcattattgctagaagcatactttccaagctattaagaaaaaataaagctgatttccagaagttttcaccacgcaggggccggacccacgctagatga

SEQ ID NO: 8278 - DNA, 204 bp, Candida albicans
ttttggaaattagaaaaagaaaatgcccctcaaataaccgctcaacaagaatctgctaacaatagtgctgtggttttggttcattcaatcgaggagactactgaaagtgggaaaaagagtatcgaaaatggtactaaatcattgaaaaaatcaattgccaatattactggtttgaatcttgatgaggaagtgtccaagaaataa

SEQ ID NO: 8279 - DNA, 1452 bp, Candida albicans
ataaaagatatccttcaagtttatactatgaaatatcaacaaatacccaaatctatacgactattatgtgatatttataaacagttatcaaataaaccaaattccgtttatcatcctcaagtgggcaaatatttatctcaaaccaatgatttaaatctaatatatcaacaatggcaaatattaaccaataatagaaagaaaggtgattccatcaaaaatataactgaacgacaattttattctccatcaatttcatttggtgattatgaattatctctgatcaagaaattatttattaaacctacaaaaaaccatttttcatttataaccgggttaccattagaagatccaatattctccctgaaatctcatgataaaaatcgtcatggacaatttataaataatattgaaaataatttattatcatattattcaccatttacccaatatcctcaaaattcaaaatctcaattggcttataaatattatttacgaaaatttgatgaatcaataccaataatgataattttaaaaaaaaaatatcaaatgttttcaattttttcaatgaatcattgggataaaatatatcttgatatgaaacgacgaacgagaagacaaaatatgttaactaatgttgatgatttaaccattccatctcgaagaaatatgatgaaattatctcaaagaccatttgaattcacaagtattaatacaatagatttatttaaattggctcttggaaattataatgattttaaatcattactgaatccaacaactattttcctgaataagttcaatttgaataaaaatttacaaattgcaccctggaatgggaatgaattcacatcccaaagttataataataataataataatgatgatgatgatgaattgattaaaatgattgataaaaattgtcgagtggaaattagagatcaatcaactggggatattatcctgcctgatgattcaaaattattggaatatgtcaataaagaaaaatcatatgtgaaacaattagatcaagatgaagtaatggattatagtcaacaaataccttatcaattaaattttgataaatattatatgttaaatattttgaattttgatagtggtgatacaagactttcaagttttagtagaatattaaatacagcaacaacaacaacaacaacaacaacaggaggaggagataagaattcgtcaaattctgatatctcaccttctgatcttgaaattgttggtgttcgattatcattagataatcctcaagtgaatcgaatgattaatgaaatgagtgatattaaacttaataataaggatgatgatgttttcgcttatgaagatattttgaaattagttcatactcctaaaagaaatgtattacgatcattaatggatatattagccgtgaaaggaataattaaagttcgacaaagtgctgattaa

SEQ ID NO: 8280 - DNA, 189 bp, Candida albicans
ttaacatattttgtcttctcgttcgtcgtttcatatcaagatatattttatcccaatgattcattgaaaaaattgaaaacatttgatattttttttttaaaattatcattattggtattgattcatcaaattttcgtaaataatatttataagccaattgagattttgaattttgaggatattgggtaa

SEQ ID NO: 8281 - DNA, 192 bp, Candida albicans
atgaaaatagtagcgaaaatttccattaaatctttttcctctttagacgatgtaataggtaaattgggtccaccagttgaaaaatcaattgttttgttcgccatcggcggttttgatttggtgatggaaaaaaatcgaagacaacttataccacctttaaataatgctctcaagatatccacttcttcatag

SEQ ID NO: 8282 - DNA, 609 bp, Candida albicans
cgcgagtccttccagccccgtggtgaagaatggtattgtcccgttgttgaagatttaaatttatccacaacgactgcaactaatgttgatgtacaaaaagttaccaaaataagccatgatggaaccaatactattgaacaaatttcaagtaataaattcaaagtgatagttcaactaccaaattcaggatataaaccatattaccgtaatcattcaccagatgatttaccccaagttgcactcggattggaatttgaaaatcccgatatggctgctcaatttgaatatatgttggctgtttatgatgctagattcaaatatgaactgcaactgtattattatgatcgaatggtatatgctgtaaatataataaatttcaaaactattatgcaagaacaggaagaagaggaagaagaagacattcatgagttgactgaagagtttaaaaatcagaatattactgatgagtttagctattatgaaaaaacttcaaaagaattagaagagtttgaaaaagaaaatgctaacaagtttgaccacgatactaatgatgatgatgatggtaatgacgacgaggatgacgattttggagattttattgcatgttga

SEQ ID NO: 8283 - DNA, 462 bp, Candida albicans
aggtcggaatcaggtatgaataaatttttccgtagattaacggttaattcccccgtggtccgtaataattatttcattcaaactgataataatttggattggtcagtttccattggttcagaaaatgaagaaaaaatcggttggtataccgctgatgaatctgatgatgtcaataaattatattttagaagtgaaagacaaagtttaagaagattacctattagtggagcaattgttttcactattagaacttattttcttcccgttacacaattatgtgaagaaccttatatcccaagaagattattgaatggtatccagagttggagtgaagatgttggtgaatacaagggtttccatatttttaaagatgcattattgccttatttggagaagaaagctttggaacaagaagcaaatggattggatcctactaaggaaccacaggtatatccattttaa

SEQ ID NO: 8284 - DNA, 300 bp, Candida albicans
attgtgggaagaataaaatattttaggttttacacatttgaagataacacctataaaaaaaataaaaaggcaacatattattattccgattcctcaaaacctatgaacatcaatggttatataatccacaaacaccttactttttcctcccactcccccactgatttattcattatcatcatgttaaaattcttacctgaagattatcgactatatttggcctatcttcctgatttacaagcatgtgtcaatttattcatgacattcacaccattattttcttatggatcaacatgttat

SEQ ID NO: 8285 - DNA, 201 bp, Candida albicans
tataatgttagtaaggagttgtcaatcgccaagggaaggaccatcaatctatatataaaatgtacttccacagaaaccaagtatgtttcacaaaagataaatggttgtatcatttttttatataacagattgagtgaccccgtaagtagtgcatcacgactgcaaaacaaacataccttaagaataaaccagttccaatga

SEQ ID NO: 8286 - DNA, 285 bp, Candida albicans
aagatgtcagttgataaaacccaaaatgatgaattaaatattcacaaatctcccaaagatttaacttctgtaactaccaaaacaactgaaaatttggatttacaatcacaagctgatgaaatcttttatcatgattctagattatccctgtcattgagttctcggttgattctgatgatttcattggttggtgtcattggaactggtttattcttaaggtatgtttgttttgcagtcgtgatgcactacttacggggtcactcaatctgttatataaaaaaatga

SEQ ID NO: 8287 - DNA, 198 bp, Candida albicans
ccatcacatttgattttttttattcgacacctatcacaagcttgtgaaacacgaactcctgaagatgtacttattagtttgaaattggaggaaacgtttttttcatcagattttttatttttctttgacatggtttcttctatttttgttaatcaaaagcaaggattatgcttgtatcggataaatggaatgatctga

SEQ ID NO: 8288 - DNA, 444 bp, Candida albicans
gtcattatggaagttcacatagaccccgaagtgagtaaacatcaggagataattgatgccattactagcgcaaccactgccttgagtcaaagatcaccagaatcaccagcaagtcaacaacacactgaattaactgaaaaagaaaagcattctcacaaagacgatgagcttggctacgagtttattgatgcggagcaaaataaaaatgaacccaccggaaatgctgaagaagctttacatatgttacttaatgaacacaatgctgacagagaaatatttgaagaccttcatctgagtcattcagatacccaaaagtctcccaatgtcgaagacaatgaatccaagccttccgaagtaaagcttgtgtcgtacgatcctgattcaaaaccacctcgtttaggacgaccaagacgcaacataacaaacaccctagctccaccagac

SEQ ID NO: 8289 - DNA, 204 bp, Candida albicans
ttttgcacactgattaatattttacaaatcttgggttttctcgttaattcgcaaaatatgtacaaaagtatattaatgttgttatgtatagtaaaatctataactatttacattgatgatatttatttggtagctaattcggaaaaatcccaattgtattgttctaatttcttaacaatttcttcatacgacaaccaactgtag

SEQ ID NO: 8290 - DNA, 894 bp, Candida albicans
tcatttgcaaaaccaacctttgaagatcttggaatatatatagttatatggattagttgttgtcattcaatggattctaactcatttataactaagggtgaaggagatcaaccactgccgtataattctacagttgatgaatcaatactaaatgaagtctcctccgagaataatgaattgacaccaaaattatctagggagttgaacgacagcgatgattctccaaagagaaagaagaagaaaaggtcacttttggatgatgatttcttttcattagcaggatcatttgagaagagaaagaagaaacacaagcacaagcacaaacaaaaggaaaaagaaaagggaatcgatgtgcaagatcaagtgattgaaaatgatgggttgatagaagttccgataccacaactgacaaaagtgtctactgataaagagatttccagtgaattggcttcttctcagtcagatataccgagaaagaatataaatacagttcaaccagagatttctctactgcgatcagtatctattactccaccgttggtcgataggaacaaaataaggaaggaggtaatgagtagactaaataaggaacatatgcgtagcaaaattcctgatatggaagactccgaggaagaaagcgatcacgaattagaagagttgttgaaattgaaatcacaaatgccaaagtcgcaaactgagtcatcaccagagacttatacatttgatgatgaaagtgaaaagaaaagaaaatatattgtaagagtaacgtccaagttacctgcggttcataatcaaactttggaagtggactttggaacgaaaggattgaaaacatttgaaaagatactaaaggctgcagttgattatttcaaatcatttatcacgcgctgctag

SEQ ID NO: 8291 - DNA, 402 bp, Candida albicans
gtgcaaagtcattgtaactcacaacattcaactatgtggaagccacagaaagacaaaacttttagactgaagtatacaagtcagtatggttataatgttgaccattttaattttctcaatgattacaaggaagattggaatgattatgttgcatatgttaatgagagtttagtggagaaatactcttcaaggtcaaggaaatttgattcgattcccctaaacaagctaaacctagacgataccaaatatgatagtactgatgaagattatgtcagagaaaactttaaatacacaaatcctatagctttaaaatctaatagttccacgactaaagtggatttggttccggaaaccccagttcattgtcttaaccgccgggaaggaggcatatgcgtcgatcag

SEQ ID NO: 8292 - DNA, 480 bp, Candida albicans
tgtttgaaaacgatcataattgggaaattgatcccgactaccaacaatgtagctgagaatttgcgagagatggaattaaatggcgacaaatttctagacagagcacatgaacagaccaattttaaaaaaagggggaagaaaagcaagcacaagaataaaaagccacttgcactgaagaaggataagggaaataaaagcaagccactcaaggaggaagatgtattatcatcaaaggacgacaacgacgaagaagtttcaactataacgcctatttcgaaaagtaacgacttggagataattagagaaatcgaaatacctcacgattcaagtaggaaccaaccaactactatccctatagattattttggattgattcctagtattagcaatgaatgttgtttgatttgtcagtaccaagcaatatatggtactgaaccaaggcataatgaaaaaatgttacgatcaacgagttcacgctga

SEQ ID NO: 8293 - DNA, 282 bp, Candida albicans
tttgtcagtaccaagcaatatatggtactgaaccaaggcataatgaaaaaatgttacgatcaacgagttcacgctgaagaaaagcgaagacgagatttcaaaaagaagttacagaacgcaaagctgaaggtcttgaaacgacaaaaggattggcggcagaaggaaccagaacaacagcaaaaacagaaacaacaacaaaatgtgaataacggcatagactcggatagtagaactcaaccaaatactgaaactcttgcaaatagaatagatgaagttgattaa

SEQ ID NO: 8294 - DNA, 225 bp, Candida albicans
gccttgcatttttttatgacaatctcgaagattcatgaacagtcactgctgctgcaatatgagtttgtagatctcaataatcttttgggggtttctttagaaagcgattatgaaaacacctttattacagcattggtgggtatttgttcatacgaggaggctggttatgatgtaacgctcaatacaaacaaaaagacgacaattgtggcaacaacaataacctaa

SEQ ID NO: 8295 - DNA, 387 bp, Candida albicans
tgtcttacaatcaattgcggatcggcccgtcccgtggtgaagacgaagaaattgactaatgaattaatggtgttatatttacatcctagtttggaggcaatcattcgtcaaccaattttgaattatattgattctccaactccaaagaaatcacctgacgggacgaataggaagaccattaccagtgacattagcaagactccattttatagtcggttgatacctagtactgttcttctggacccatcatcattggtattgctgcccccgtcatctgactataatcaattgaatcaatatttacaaattgatgaatcaagtgagtctgcctacaatgatctccttgaattggatgaaacaaataaatacgattattggattgaatga

SEQ ID NO: 8296 - DNA, 219 bp, Candida albicans
tccaaacacacgatgacatgtcacagtgctacgcacactcgtttatattattctttatttggtgccgatgatttacacactcgcctttatatcgacaacgatttgatattgctttgtgatttattgccaaacttagtcactactttaattgcaaatcaattttacaaaaacaatgtacaaccatatgttaccgttcaatattactatcataagttgtga

SEQ ID NO: 8297 - DNA, 261 bp, Candida albicans
aaatatcaatttaaagaaaagacaaaaatcaattatcacatcattattattaatttatatttttttaaatctatagtacaaaacatatatataagttatacaattaaggtatttatttttttattatatttttatagttttttaatcataagtttaaattttaattattatatcataaagaaaataagagaaatcactaaagaaaggaaaccagtcacatttcttcaccgccgggatggaagctcaagcgttcgagaagcg

SEQ ID NO: 8298 - DNA, 222 bp, Candida albicans
aatttatcaaacaaatcgagttctggtcttagtatatatgaagattgttatttgttattcagtttttttttttttaacttattttatagtttaacgtttggatgtattgtatccttctattgtctatttcctaaagaagcaattctgttacatcaagtagaagaagaaaaatacgtgccgttcagaaaattgaaaaagagatttttttttttcgcaacataa

SEQ ID NO: 8299 - DNA, 183 bp, Candida albicans
attagagatatacacaaaaatggaatgcaagcatatgaaagtttttttgactctataagtatcagcaaattagaacacaatattagaaatctctttctaagggtttttcaaaaaaggaaatttactgttgatgagcttgctccagttgttttgtgtttgtgtctgttacatgaaatttcataa

SEQ ID NO: 8300 - DNA, 255 bp, Candida albicans
tctcagtactccatgaatggcagtatactcttttggatttggcattaccatttttgcagtagatataaaggtgaagttttcgtgaaagaaagaaatcaaacaaaggttgaattggttaaactattgataaaaactgaaaaactaaaaaacaaaacaaaacaaaacaaaagtaaattaaaacttgaaataataaaaaaaagaagagtaataaatcatatatatataaatacaatttcaattggaatgaaggaataa

SEQ ID NO: 8301 - DNA, 1239 bp, Candida albicans
tttaaccaattcaacctttgtttgatttctttctttcacgaaaacttcacctttatatctactgcaaaaatggtaatgccaaatccaaaagagtatactgccattcatggagtactgagactattgacatatctaaataattatcccgcagaaggtactggtactttatttttatcagaaaaggccaaaaacttaatgggtcccaaactaccacaaattttagttgaatattcaactgcaactcaattaaatttatttggtaattatcccgagaaatctgatgtggccccttcagcacttttcattgccttattttccatcattgccattttacatttgacagtgttttccattaattattatcgaggtcattatttttggttatcattgggatgggtattttatgccatttgtcgtgtgttgggatttgccttgagaatcgtatggtctcgtgatttaactgattgtaaagtagggatcactagtgaagtgtttttaattgtcccgactgtgttaattgcatcatttaatcttgttttggcacaacgtatattcacttggagacatccagttggtggatcaagaagaatcttttggactctaatgtggatcctttatgcattggttgcaggagtggtggccatgaccattgtcacttcagcggggttaaatatttatttactttctgaggccaattatgctcgttataaaaaagtgattatgtgtacatctgttttgattattgtttattcattaacagcagttgggttgattcttttggcgtggttatttaaaccaactaaaaaagatgaaaacttgtatacttatcaaccatggtggattgaatcattttcaccattttattttgtgaaaaagggcgaaccacaagctgctgctatatcttttttgaaaagaaatcataatcatcgttatgcaattcgtgttattgctgctactcatcatcttcataaaacagtgaaaggattaactaatcaacgtggtgatttgactcataatgtttccttgatgatcattggtgtcactacattgattatattggttagttctattctccgtaccattatttgtttccaaggtcgtatgatgtattttacttctccagtcggtagtcctgccgttatgtatgtctattggggtgctcttgaatttggagtcaatttattatatatcattggtcgtgttgatttaaggttttatcgaccagatagattaccataa

SEQ ID NO: 8302 - DNA, 198 bp, Candida albicans
ttaacccttgaaattggatttcaagtaccattcttccgtaccaattcaggaaatttttccttcaaattgagagcccctattccggatcaccgttcttcaacagtgaaaatcccaccagtctttttagcacccgacaatgccactgcggagaagccaaaatcacaggaaaccgattttaccgtcacacatacaaattaa

SEQ ID NO: 8303 - DNA, 234 bp, Candida albicans
  unsure (23),(169): Identity of nucleotide sequences at the above locations are unknown.
attggttttgaaatttttcttangaagtttgctgttgctgttgttttgatgaaaatgcaaaaaaaaaaattaatgacaatcttcttcttctcaaaactttgttgggtaaaaaaaaaggaaaaaatcaaaatatcaattgactttcaaacaagggtaagggtggcaatanggaaaggaataacaaataaaattcttaataatcaaaatctgaagaatgaaataagaattgagtaa

SEQ ID NO: 8304 - DNA, 207 bp, Candida albicans
ttgataataatttgttggagagaaattataccctttgtatccctttttgccctcctcgtttttcactacccgacagcaagttttaaatcatatttatttattttaaacttatcctatttatcctatttatttatttatctaaataaacctataaacacacatataaacacatttaattatggctcctttgacaattgcagtaggtga

SEQ ID NO: 8305 - DNA, 564 bp, Candida albicans
tcatttcaactcattataaacaacaaccatcgtactattgttaatacttataaatcacacatctgttaccatccttccatgacagaaagaataccattatttgaagaagataaagattatattgatgaagatcatattagtgaatttgccaaggcattaatatggcaagatgattatgattatgatgccaatactactgctactactgatattactgatactactccaataaatgatgaagtaccaggtattgttagttcattaccatcaacaaatggcaataacaagaataagaacaaggacattaacggtacagttagtgattcttcactgattacagatgaagatattatgaattcatcatattttgataaaccacatttatcaacaaatttgaaatcaaatagcaccaaaaatgatgatgatgatgatgatgatgatgatctaatatcaagaccacaatcgggaaccactgataatactagtactactagtctttcatctaaacgaccagatttaatcacatctaaaagtgattgttctcccatgggacaaacagaagta

SEQ ID NO: 8306 - DNA, 243 bp, Candida albicans
tctgttactgttttgtttctttttgtctttataaattgtgtggttttaactctggttgattctctcctacttttacacaaatcacccaacaatgaacctcaatggtcacgtgaccaagataaaaatgtgaaaacaaaaaaaaggcgatctccttcaattgccgttgcttgcccctcccccccccccaaaactaaatattatattgagcaagacaataattataatcatttcaactcattataa

SEQ ID NO: 8307 - DNA, 189 bp, Candida albicans
agacaaaccaaacatatatatatatatatatatacgaaaaaacaactagaatcggtttttattggaaatcttcaatataaatcatctttttctattttttttttaaaaaaaaaacaatttaaaaaatcagacaatatactttatatatcttcattaattcagacatatgcttgtcaaaaaaaattgtga

SEQ ID NO: 8308 - DNA, 201 bp, Candida albicans
atgacgagtcagaacctcgggtttcccgttgatgacaaacttttatttaattaccattcatgcatttctgatctaagtcaattttattgttgttttatttttttccaaattgaaattgttatactaactaaattaataaagggggaagacaatagatttataaatcaggattttagtgggtcttcaatagtcattatttga

SEQ ID NO: 8309 - DNA, 237 bp, Candida albicans
aaaaaagaattgtgttattataaattgaaaagaatacatacatacataacgcaactgatactaaattttaataattactccattctttctcatattctttcatttcacattttaatgttttttaatagaacaatttactcgattgttttatgcctccggacaatcacgatattacgcatcacgattgttattattgtttacttgttttctaattttaatcttttttttttaacctag

SEQ ID NO: 8310 - DNA, 267 bp, Candida albicans
tcgactatgaaacctgatatcacaggagcaattactggtcctaacaatggaactaaagaatatccagctaatgctgcattccgggattgggcatcaaacatatcggaaatgactccagcacatacattcatggggacacaaccaaacaagccaccaatgaatcggcaaaccatcatttgtgccgtggtttgtgaaaatgcacatccaagattgaaaaataatgacatccaacatgacacgtcaagaaccaatttacgaccaatataa

SEQ ID NO: 8311 - DNA, 294 bp, Candida albicans
tcatgttcagataagggggcaataattaatggtccaaatgcccatgccaagatttgtattgaaaccaccattgactttattatgggtgatgatatatggaaatcttctgctataaatgtcattgctggagataacattgatgatgacataggagcaaccaaggcatataatgatacgaaacctagtaaaaatatctttttatttattggccaatttctcgggtcttcagtgtcatcgggtccattccatgtaattaattctgggtctatggtatcgaactctttaccatgttga

SEQ ID NO: 8312 - DNA, 285 bp, Candida albicans
ttattgtctttggtgagatattattggttggacagaattatatttttttcttcttcttcttcttcttcttcttctcactataccgaggcaacaccacccgaaaaacaacaactactaaaaatccagaaatcacataataataataataataataataataatagaagaatgatcattaacgtggggaaatacatatatactcccatctcctccctcactcctccagcaacattgtatttcatatcacgcaaattttattttaaacccaatcaaatcatcagataa

SEQ ID NO: 8313 - DNA, 189 bp, Candida albicans
caacaacaaccacaattgatacggcgttatttggagattaaaatgactcaggaatttttttggtctatcaacaacaacaacaacttctggtttcttcttatgtatgccaaggttaatttaaaaactcttttctattttttcttaggtggtatcaaaaagataattacgccacttaaagatctaacttga

SEQ ID NO: 8314 - DNA, 354 bp, Candida albicans
atttacagtcgaacaatctttctccatctatgtgtacaccattgttacctaatcaataagacatctcaacatccacaaaaaaccaaactccttaaaatctcaaataaatccaaatatgcattaatccccaattatcaacgtaaatcttttaagcgtcttaaaaaaagcagcttgagtttaacatacacacattcttatatacaattactccatatacttacatcgctacaggccatttgtttttacccaagcttcaatagactcctactaaataaatcatctctccatctctatcttttacctaaaccaaaaacccatttctcctataaatcttacatgactactaccccatag

SEQ ID NO: 8315 - DNA, 207 bp, Candida albicans
aactcaactgattgtttaattcctgaaacagaattggatttaatcttctgttcaaaggcattatctctctatcaattacctactttatttcttttccaaaaaattactttaacatatcagttagatttaatattcagatttatgtttcgtttggtatggtcacttcatagtgccaaagttattgttgacatttttatgaacggttaa

SEQ ID NO: 8316 - DNA, 252 bp, Candida albicans
ccgaaaaatagcacaatagtaactataataagcagttgtacagtagtagcacatataacacaaacacaaaatgatagggaggtgatatttttaattttaaacattaataataatatacttgctgtttatagtagaattttagagaacattccattctcttacactcttcagaaaaacttggccagaataaatcaatctgtgtatttgatatatgtaaatgtatatgtgagtaatacgaagagagtcatttaa

SEQ ID NO: 8317 - DNA, 480 bp, Candida albicans
cgtgagagaaagagaaaaatgtcggatctaaataataatgaagatagattttcatttgaagaatcacccattagaacttatcctagttctccaacaccacatcctaccgaagatattaaccgaatattatcgagtgaatttcaaaagagaaatacaatcactggcaactttgacacagatccaaattctcctcaagctgatactcaatcaaatcatacttccccaatttctcaacaattaattaaccatatggatatggatagagaaagtatatattcatttgattcagtgagtactagtggaagattattagatagattaggtcttgaagatgacgatgacgatgaccatgaagatcacgttgatcattatgaaaccgatagtgatacttatactttgaccgataaacgagaaagtatgacatctatacagactacagggagattatcggatagactagaattagatactcgttcataa

SEQ ID NO: 8318 - DNA, 633 bp, Candida albicans
attcccaaattgcctatcacgaagaagaaaaattacaccacaaccactatcacaaccacaactacgattagtatttgcacagagacaaccacgggtatacaatcactaccgcctctacttcatcttcaacggaataatgaaacgcctaatcttatgcaatcagtgcaaagaccaatacaaaagtcacaaagtggtcctattcaaaatccacaacaagcaccagctcatttaaaacatgtcccaatgaattttgtatttagaaacactaataattccactgaaactattaaatcagatatggcatcattaaagaaattcgagactcgtaaatctgttgttccggaaataagatctattgattcaaatgatgaagtaccaccaccaccaccgcttccttcaataacttctacaaatacaatatcgaaaaattcatttacaccatcaccagcgcgctctactgaatcacttggaagatcatctttagatcaatcacctattttgtcaccaattctacaaccatcacccacaggtaatagtttagaatctaatggaggacatcaggggttcgttgaattaaatgacgaaaatagtgtcataggattaagctcgatgaaaccaatacaaaaatcaaat

SEQ ID NO: 8319 - DNA, 261 bp, Candida albicans
tctaaagatgatcttccaagtgattcagtagagcgcgctggtgatggtgtaaatgaatttttcgatattgtatttgtagaagttattgaaggaagcggtggtggtggtggtacttcatcatttgaatcaatagatcttatttccggaacaacagatttacgagtctcgaatttctttaatgatgccatatctgatttaatagtttcagtggaattattagtgtttctaaatacaaaattcattgggacatgttttaaatga

SEQ ID NO: 8320 - DNA, 207 bp, Candida albicans
atccgacatttttctctttctctcacgttaatgaataatctagatctccctatttcactaatgtttcaacttaatttaaggaaggagaagggaaaagaagaaatggtacagctaccagacaggaaacacgtaaaaaaaacagaacagacaagtaaacaatatagacagttgtttcaaatcaaaatttctcaaaatgtgtttaaatga

SEQ ID NO: 8321 - DNA, 243 bp, Candida albicans
aaatttattctttcaagaatatatgtcaaatttcatttcatttcagataattatccgatttcattctcattgtttggttggttgttatttttttttctgttaaaaatgctcaatacaagaaaaccaagaaatggtagagtttcgaaaccaatgcatagaatacgtaaattattctatgtaatattgcatttcattgaaactacgtcttcacccacggagctgccagaatccgcgcttaggtta

SEQ ID NO: 8322 - DNA, 240 bp, Candida albicans
ttgcttaaaattgcattttcccatcaaatacacacgggacctcaaagaaaaaaatatatacctctgtctcaattaactttactgaacacttataacgttaatttcttggtgataattaataaagcgacagtggaagaaaaggaggggaggagggagggagggaaggagaggaaggagagggaaggagagattcaaaacagtaaattacttgttgttgttgttgttgttttaactttgtga

SEQ ID NO: 8323 - DNA, 249 bp, Candida albicans
tttaacaatggatggcaaaatagtcggagttcgtacaatttcccaatcaaggaattagtggaagagaattatgactgttatgagctgattaatgaagaatacgatgacagagattgggggagcttacgttttgttcatgtaaaggttcattctggtatggagggaaatgaagaagctgatagattggccaacttagctgttgatgaatatggtcaaagatccatttttcgttcaatttttggattttaa

SEQ ID NO: 8324 - DNA, 228 bp, Candida albicans
aactccgaagtgtggataataatagattgtacaaaacataatcttcaagaaaaaaaaaaggagcagaaggaaggaaggaatgagcgaaatgactacaaccggagtttagatacacacccacacataataattgcaacagttgaattattactattacaatccatctttcaaggacagagcattcttaaaaataaagatctgataaataataacatgtataaaacttga

SEQ ID NO: 8325 - DNA, 234 bp, Candida albicans
tatttgaagaatagccatggcaattcaaaatcaagaacgaaagaaagaaagaaagaatttcacaatttcacctgtgagattttagtcaaagaagtacaaaaagtggaagtaatttttagtcacgggttaagaaaaatttccttccttgaccttagcgccatcagcatccccttaatggtgctaaactccaggtgcatgattcatacaataatttgctatcatcaagaaccataa

SEQ ID NO: 8326 - DNA, 300 bp, Candida albicans
attattaatttaaatttgctttcaaattattttggcacaaccaacaaccaacaacagtggttggaagataatgaagccggatttacacattttgtattggtaggaagagacccgttcaacaattgttcccccccccccactttcctttcccccatggtgtgccgaatcatcctcaattatacacttttcagttccaacggtaaaattaattgtttaattactttattgatgttaactaaaatttttcaactttcaaaccctatagacatctttcttatcttatcaattgtatacatttaa

SEQ ID NO: 8327 - DNA, 282 bp, Candida albicans
gcccgtggcgggatacttcataagcaattacttgatcccccatattctcacaatacatcacttttaataatgaaattcacaaactttttagcttctaccctcatggtctccgctgcctactcagctgttgtcccaactaagagtgaagaaatccatgttgataaaagaactcaatacactcttcaaggtttagtcagtgaattattgactcacgctgttgttgatactgcctccttgttcggacatgctttacaaggtggtatcttaactcaaaaagagtaa

SEQ ID NO: 8328 - DNA, 1290 bp, Candida albicans
agatttaaaagaaatgcttctgctacagcaccacccaatgtaactagcaccaaacctatatctaaggaactggatagtcatgttgctaatgataatggtagtgatagcgatgatattgatatcaaagctgctgatgctgcatttgtgccggctaaaataagtactgcaacttcagcaccaatttcaacaaatgttaacagtaatgtcgctaatgataatggtagtgatggtattgatattgatatcaaagctgctgatgctgcatttgtgccggctaaaataagtactgcagcttcagcgtcaattgttaataataatgccgctaatgaaagcgatagtgacgatattgatattgacatcaaaactgctagtgctgcttttgtcccagttaaaactggcactgcatcttcagcgtcaattgttaacagtaacgttgctaatgaaagtgatagtgatggtgttgatattgatattgatatcaaagctgctggtcaagcatttgtcccggttaaaactggcactactgaagctttagcaccaattgttaataggaaagttactaatgatagcgacagtgatgacatggatattgatatcaaaactgctggcgctgcatttgttcctaccagaagcggtactactgaaacttcagcgccaattgcaataatcgtcgatagtagtgaagaggaaactggaaacaataaaactggtaataatactataagtattagtcgcgagcagttgaaaacgtttgccaaaattatcaataaatccaaaatgggaagtgggtccttttcaaataattcatctaatggacaagatgttgttgataacaaaatttcacctgatactgccccatcggcttttgctggtatggttgaaatcagtgatgatggcaacggaatatctgggaataatacgcctaacaggttgaattatgatgacaatgaaagttatattccaaaatcatttgcatcgaacttcagagcacatgaacggaaaacacaggcactagggtctttgcaaattgtacatcaagatccagtagtagataaaacaccaactaaaaattatgagcttgctagtgataatatgctactgtatatttatgttggtgattcaggtggtgaggacatcaatgcagtatgtaggggaattgatgatagatcaaggggttataataaatcgagtgacccactgttcaccttttgggtaaaactgataccttcatctagtttttctttatcggttggtgggtggttcaagccactaatggccaatactagttaa

SEQ ID NO: 8329 - DNA, 288 bp, Candida albicans
attgtccttatatctcaactctacactcttgttccacttaaattatatcaatctaacttaccattcatcatgaagtatttgtccattttcttacttgctacttttgctttggctggtgatgcaccaatctcaactgactccaaaggcagtccatcattaattgctaaatttgaaaagacatcaaaatcaaatattgaaggtactatcaaattcacacccgctaataacggtaccgtttcagttagtgttgattgtcttccaccacggcggctagaaggaccacgctcc

SEQ ID NO: 8330 - DNA, 255 bp, Candida albicans
aaatatcccatgatcaattacaatgggaccgcaacattctgttactacgctaatattgaaagtacaaatacaagggtacaattaatttcttgtcaaaaacaaactaggcgtagcagaatagaaacatcacttattaccaaactgaaaaatttaggaggaagaataggttgtgaaaaatataaaaggaagggcactttctgccaaatatttctgaattgtccttatatctcaactctacactcttgttccacttaa

SEQ ID NO: 8331 - DNA, 1032 bp, Candida albicans
accacagatcctgcccacaacaatcaaacagtgatagttaatcctaaaacaaataaactatggatcaattcaattcttgatttaataactcaaggaacatcatcaacatcaattaattatgctgattattcaacaggagcaagaatcttgggatttttaactagttcatcgacatccagtagtagtagtagtcatcatagtactcctagtatattacaaaaaatgatatatggatggtggatatataaatccaatttttatcaagatgaatataatgccaatcatgtattattagatgatgatattgtttggaaaggtggtgatcaaattggtatacgattaagtactaatattattcccaccgatataattcttgaatgtcgtgacaacaataataatttgccatcaactcaaactcaaggaattttattatcaattggatttaaaccaagtacaaaaaatggatttgataaattatcaaaaataccattaggattattgaattctcatggtcagttatcaatgacttcttcttcttcttcatcattacaattacctaatcaaaatgaaaataaatatatttctaaattcaaattaataaaacaatatcatattaaatcttctaatggtggtggtgttgatggtatttatcatattcgattacctattagatttataaatttacaaattagtggtaaagatttatatttcaaatttgataaaattatcaaagacaacaatgataacatcaacactattgataatattaatattaatattaataatattaaagtatatgggataaatgaaattaatgcaattaaatatcaagataaatttcaattattaattgataagttcattgatattgaagaaaatgatcataatgaacaaattagtactactactactactagcaaggtgattgaaattaataataatgagaaatcatcattaatggattttatgacatcaagaaattctgaaaagtatcaacaacaatatgatatgaatgatgatatatatttatga

SEQ ID NO: 8332 - DNA, 201 bp, Candida albicans
tgtgaaaacaaacaaacaaacaaacaaacaacaaaaaaaaaaagttttagcgagcaagaagcaagaagcaagaagcaagaagcaagagcgagagaattgagtgaatggttaaataaaaatattacacaccaacccaacccaacccaaccaactactaagttaaaaaaaaaaaaagaaatgttaataaagtggatagagtga

SEQ ID NO: 8333 - DNA, 1230 bp, Candida albicans
atcatgacagtgacgtttactcgacaacgatcgtcttcagtgacttcaatatcatcaaatcgttcattaacaccaagtaataacaacataaatagtggaacttttactcattcatctgctccgacaccgacaccaactccgacatcacagccacttcatctccctcctttatcaatgtccaacggtagtgaccaaaatccgcagcatgtattaccgagtcaaattaccccaccacttttaatgatcccaacatcaggaccaactatatctgaaccaacaacaagaacaacaaccacaaccgcaaccgcaaccacaaccacaaatacgaatacgaatgcagacacaaacacaaacacaagcacggcaacattaccatctacgaatgttgcaccacaactaccgtcattactttcaacttcgacttcaactagtaatacctcaacaactccagtgcttcctgcaacaaaccctactccaacgtctgtacgaagcatgtctattgttagtttggatagaagtcccagaaattcaattgtatctaccgatgacaatctacgttcacatactagaaataacagtaccactagtttagcatcattgacgagtcatcctgttgcagtacatgggttaagttctgttaatctggcacatcctttaaaccctttacatgttcatcataaacaaatgagtaatggcagtgccataatatcggatgatgattctgaattggaccagacaacaccttcaagaacaatactaaaaccaattcgtcgacttaaaagaagaagcaatagtaatgatccgattaaccgagatttcaaacttaaatttgatgacagaagtgtacatcatataaaccaacaacaacaacgacaacccacatcccccactttaatgaccattaacccacaaagtgtcaatgcaagtccaacttcagtttctctgtcacgatttcaagatcttgccccaattactattagtaatagttccaacaatacaaatcccccattagactccaaaaatttgacaaaactcaaatcaacaaatttaattcaacaatcaatgtatattaaacggaaattggcaatttcaaaagatttacaaattgaatattttaatagtgtttcccacgacaacaataatagcatacattcagtagctacaaatacccgttcatcatctccaccactgccaccaccattatcaccaccttctatttttagtgaataa

SEQ ID NO: 8334 - DNA, 216 bp, Candida albicans
  unsure (188),(202): Identity of nucleotide sequences at the above locations are unknown.
ttagattccaaatttttccctcctttaccactggcattaatgtcacgaaaatcaacagcgtcaccaccaatccccatgtcattaattcctccaaatcaaccaattttgcaaacattacaagaacaaaatgaattgattattaaattaaatcggcgttggaatcaagctagtgtaaatgaatccaaatnggccaccaccgggntggaaatacgcacg

SEQ ID NO: 8335 - DNA, 273 bp, Candida albicans
tttggaggaattaatgacatggggattggtggtgacgctgttgattttcgtgacattaatgccagtggtaaaggagggaaaaatttggaatctaattattcactaaaaatagaaggtggtgataatggtggtggcagtggtggagatgatgaacgggtatttgtagctactgaatgtatgctattattgttgtcgtgggaaacactattaaaatattcaatttgtaaatcttttgaaattgccaatttccgtttaatatacattgattgttga

SEQ ID NO: 8336 - DNA, 204 bp, Candida albicans
ttggacattaaatatgagcgttattacctttcaatcgatggaattccatattttaataattttttctttatgtttagaccaatctcccttttctggctcaaaactttattgaatattaacgaccttcaaggcaatttagtttcgcttaagactgctatcacattaaataatctactattacaaagcaagcttaatttaagttaa

SEQ ID NO: 8337 - DNA, 183 bp, Candida albicans
atccacgcatgtccggccagtcggcaggtgaagacaaagatgactaaagagaagaaaattggaataagaaaaaaaaaagaactatataaatactatacatcatgtaagtattatcaaacgaaaccactaaaaaggtctgatatttgttgcagtagtatttttcaagctagcaagtccaattaa

SEQ ID NO: 8338 - DNA, 186 bp, Candida albicans
tggtggatttcatgttatgaaatggttataaagaaagctccattgctcaacaataggttttctatgaattttagacagacatgggataccaaccatttaaggactgtattattaagaccgcccacattagcaaaagaagttattagaaaactaattatttgcatttgtacaaatttcagagtatga

SEQ ID NO: 8339 - DNA, 1428 bp, Candida albicans
agacattcgctgggttctccaggaagttatgactctgcaaacccacctcgcaccacgaccttgcatttacaacaacgattacaacatcaatttcaacaagctcaaatcaaggcagaaagggaggcagaaagatcgacaagacatcaacaaagcgaacaacagtggccagtatcgaatgacgatagtcacaaatctctgtcacagttgacagcaagtgagggaggttctactgctaatgcttttaccagtgctgggagtggtgctgactttgccttgaaacgaagtagaagaactgattaccggaaaaaggaaacagattcgaaacaaaagacttcgaataattcgcctcctacaagaaagtacaatgtccggaattcccagttgttatttaactacaagaaaccagtagattctccttcgctgtcaccttcaccttcaccatctacatctcaaagcatgatgggtcacagggtgaaacacaagaaatctcaaaagccattggaagcagcattggctaacccaatgatggatggttcagatatgtcacataacccgtatcccactgcttcaaccactattgatttcagtcgtatgggtgctaagaaatcagccagacaatcacttagtccagagaatgcaatggatggcagatctcgaacaaagcccgaaaacaagactcatcgtggctatctgcatcaagaaaggtctcatccttatcatcaacaaccacagcctccagtgcaacctcaaacccgccaacaacttccaccagcacaacaagctcatagacaatcgacgagacaaacccacaatcatccgagcacaggagttgaaaagcatcaccgacaggataacaagcgtgtaatgctgtcagcttctaatacagacataaatgattttatggttcaactgaatcaatttcagactaatggaacaagaaaccatcgatatgacaacctccataaaaaggataagactgcatttttgccaaatgaagaccaccaacgtaagtcccattcgacaagaaattcaaatgtaagaaatttgtcttcctcgtctcaacagcatttacatcaaccgtatctgacaacttctgttgcgcccaagtcacgtcaactacatcaaaatttagacaagttgagatccgagatcaatgaatttaaggaaagcttgaataaatcggaattacctggtgaggaatcaaaaagagaacacagactgcgtcacgaccagcaccaccaacaacgacaacgaccagcaccatcacagcaccaacttgagcctcgcaattacaaccacaatgaccgtcaccaaagacaacagcatgaacatgtacaaccccaacaagtccagcccttacagtcagatactagttttgatatcagtcatcaagatttaagtgtgaagtcgtcaccgccggaaagataa

SEQ ID NO: 8340 - DNA, 213 bp, Candida albicans
ttcatcttttttttttcttctaatttttcactgttcaaagtccaatgccaaacgacaaagggaaaaaaaatttttgttagattgttagactgtttgagcaatgttacacgactagattgtgtgcatagtcatacaggtgggaaatctgaaaaattggaatctgttatcctaaaatatctcaagcaaaccaatatctgtgatatgaaatattga

SEQ ID NO: 8341 - DNA, 210 bp, Candida albicans
catagattatacaccatacatacatcacatacaaatcattccactatgtctgacttgcacctacaaatattaaaacttgtggatgataacagtggagttattgaaaacactcttaaatcacccgagttatcgaaaatagatgtcagtactttaaaagccaatttaacatctctttgggccaaaagatatgattgttttctccaaaattga

SEQ ID NO: 8342 - DNA, 201 bp, Candida albicans
ttgatttacttctttatgcacacttataaatacataattgctgttttccgagttatcgctagtttacattcaagaaatgttttggtagttgtctcatttttggcatccaataaagattattttctcattcgctgtaatttgctaacaaatacaaaaaaatttttttttaggcttggtattttttatttttcaatttcttga

SEQ ID NO: 8343 - DNA, 186 bp, Candida albicans
atcgttagtgtagttaaaatgcttcttaaaaaaatagaaaataatttaagtactattttaaaaacattcacaacaagagtacaaagtagaaaaagggatggtaggcatgtttgtttgtttcaaacttttgtgataactatatttttatttagtttatttgcaatattgcttttgaaattattatag

SEQ ID NO: 8344 - DNA, 201 bp, Candida albicans
ccacccaatgaaaataacccgacatccaaaggagtagatcgtaaatatttattagcaaaatcaggagaacttaatgctaaaaaaattgtaaaacttgaaaaatacccagtattgattccaatagtttgtgccgttgaagcatatgataaactttctggtgataaacaagttaatgcccatccatcaacagcaatatcttga

SEQ ID NO: 8345 - DNA, 270 bp, Candida albicans
gttaaaagggggttggtaaaatggggggccggggaacaacaaccaccctataaaccggagcgggggaatcaaattcaagaggtagaccccctaactaactccaaaaggacaacgcaaaataataaaaggcttggaaaaaaccaccggtataaatatttaaataaatactttaccaaccaacgtttcccctttacatattacacattctgtttttcttgggatcacctagactttccatatgtcagaaaaccaacaattctctgtttctga

SEQ ID NO: 8346 - DNA, 741 bp, Candida albicans
ttattgatcaactcccataaaagactcaacaatatgcctttaaatactccataccctgttgaaaagaatactttcaatatttccgatgaagacgacgatttccctacaagaaatttaaacgaaagttcacctttaacacaatcgacaaaaagatatatgaaacaagattttgccaattcagttacatctctaccttcattacctcccaaaccatcacatctacaaccacaaaatcgtccacaacatcaacaacaacaacagcagcagcagtacccatacggcaacttatcagccaaacaactgaataaacacaaacaaatgtttgaaaattccgttcctgaaaccaataaaaaagattatcttgggaatactaccacagttagggaattacctcctataccagataatgagaaactccattcgaaaaatccattttctgattcacgttatgctagtcgtgattatgatgatgtggatttacctccttcaccacctcattcagatccatttagaaatgatgaaatatctgatgatgattctcattcagatttaaaacataaaatgaaacgaaatgaaaaaaatcgaattcgttcattacgaaggaaaccaagatttcattatactaaattaccttattttaccatggtgatttctcttattcaaatcattgtatttatagtggaattagcgaaaatggctcatcttacaggttcagctttccaaacgataccatatgttaat

SEQ ID NO: 8347 - DNA, 504 bp, Candida albicans
attacttatatctatatatatatctttatgtcgtttatatatcctcaaccaatgagttattacaaccactctaattcatcctcagataatattactaataacaacactactacaacaacgatgtcaattgatattcctaattgtcttactcctactatcaatcttgaagatcaattgaagttgatgaaacaacaattgtcatccaattcaaattcaaactctacttcaacaactagtttaactaaaactaatactaacactaacacaaccaattcgcacgtctcatctcctagtgagactttgcaaccattatcaccaccattgtcaccttatcaaagaaatgctacattattttcaattaaacaaccattacctcaattaccagcttgtaatcctaacagtaaatcatatttaaaaactggtaatcatgaatttaatttagaaaactttaatgattataaattaactattgatatcaaaccaattgctaaaaattattatcat

SEQ ID NO: 8348 - DNA, 219 bp, Candida albicans
aattggggttcctgcttcagtgatagcttatgtcattattgtaacagtcgggcatgcaactatgaaaattatcaatttttgatagaagtacaaatgggaaaaaaaaaacaaaaaggggtttacttacatggtatgaagatgtttattgatatagaggatgtgtgtgtaagtcaaaaaacgaataaattaaatagtacaaatggatatttaagtaaatga

SEQ ID NO: 8349 - DNA, 264 bp, Candida albicans
ccatatgtgtttctcgaaaaaggaagttttaaatatggagtaaagaactgtgaatcaaaagaaaaatactcaccacaaattgattctcgtgctacttttatggaattggtgatgatgatttattatacaaaaagaaataccacacaccatttattcaaaacagaaattcttctcatacagcttacgataagctttttttatattgactttatcgtcataatgtgtaattctatttcaagagagcaatgtgcaaaaaaaaaataa

SEQ ID NO: 8350 - DNA, 375 bp, Candida albicans
gtctccggccacatccgaggtgaagaggttagattctcaactgctttgttctttacagctttgggtataatactaaatttcaaattagatacttctgggtcgccggatgataattctggtaacaacaagaaaaaatatttcaatcacacggcattcaatagtgccatatcttatatactacttgttcttgccttgtttgtgctatgtgtcactggtgttaattattttgttactataaatcgatatgctaaacataaaatcgctacttatagctttaacaatttgacaaccataattggaatgacaagtatcattgtaacgttgatggcaataaatatcactatgattgttgaagggtatatagaacaatcttaa

SEQ ID NO: 8351 - DNA, 183 bp, Candida albicans
ggggtaagcccaagaggcactaggagattttcaaagaggcgaaggaaaaaaattaacaccaacaagttattgcaattcagacaagtattccagccaaatgttgaagggccacaggattgtaattggtgggccccaaaaatggttagtgttaaaacccattgcatatgccgcccccaatgttaa

SEQ ID NO: 8352 - DNA, 213 bp, Candida albicans
ttagggaaaacctgggatttggtggtagaggaagaattaaatatttgtgggggttttattcaccgtaggggagttgataatcaccccggggaaaataaaacttacttgggggaagtttttccaaaaccaacatacggtgacgaagaatctgtgtgggaagttcaattatacaatgtgaagttgaacgggccagacaaaaattaccaggaataa

SEQ ID NO: 8353 - DNA, 354 bp, Candida albicans
attcaatttagaaatgggtatcatcacaatgagtatgaaggtgaagagtatgacgattatgagggacaaaaaagaatggattacggtcgttcccggtcagtttctcatgaacctccaacaaaccactcaaatgtcaatggaacatcacccatggtaggaccaacaaatggaaacaaatttgaaaggtcattaaagtcaccaacgttatcatatataaataattcagaggaattgccagtgaaaaccaatttttcaattgtgaaaaacaaagttgagattgatgatattttagataagagaacagattccgcatctgatgaagaagaagaagtaattggtaaaatggaagattga

SEQ ID NO: 8354 - DNA, 282 bp, Candida albicans
ttcgatttcttcaaaaaaaacggggggttaaggcaaatgggaggtggaagcatcattacccttgttatggtcattgaaaagtatgatttttctttagtgcaaattaatttaaaaacacacaccaccaatactgtacaggaaaaaaagaatatacaacagaaaataaatgaaatgaaaaaatcaaagatcaaaaatcatctcatacaatttcaaaccccattttctcattcaataaaacaacaacagcaacaccagcatcaacttgcttactcctttttttaa

SEQ ID NO: 8355 - DNA, 213 bp, Candida albicans
ttacgcaattgcggttccttccagcgcccgtgtgtgaaaacaaatcgattaatgcaacaaactgttttgtttttttcagaacaaaacctcacaccaatagacaatgaatacgagtgtcgtagttctcgagacagattaacaaaccggttggaagatagaagaaattcattttgtggtggttctacgttggttgatgctgatgttgtaaagtaa

SEQ ID NO: 8356 - DNA, 183 bp, Candida albicans
atggaaactatattggaaataaagatgatgtttctttgtttgttatgggatttgctttctttcggccccatggcttatggtaacgccttaacaaagacattagataaatctgagataacgcgtacacaaaatcaaagtagaaaaaaaaaattatatttttttaaagttaagaaaaaaatttag

SEQ ID NO: 8357 - DNA, 264 bp, Candida albicans
cttaataatttggacacaacatcgattcaatataaaactattctgagatttaatgctagtgaaattgttgcctctccagaacttttatggtcagctataccagattcaaatattcgtggactcgttttggataaagttattgttcacgctcttaaaaatgtgtattatgtgtcaattggtcttggtgtggtttgtgccattacatcgttatggacaacaaataagaaagtccctaaagatgaagacgtacgtaaaagtaagtag

SEQ ID NO: 8358 - DNA, 261 bp, Candida albicans
cagaaaaatactgctgccacaccaattgcatcaccatcattaagaactatggaagatattaatgcatctgctactactactactactactaacattggtggttatggaggactaggggataaaaaaatcactcatttgtcattgaatacacaagtgccgagtcaaccatcatcggcgatgagttctagtgtaaagagtgcaactatacgaccaccattatcaccattattagtatctacacaacaaccacaacctcgatga

SEQ ID NO: 8359 - DNA, 222 bp, Candida albicans
agcgcgggtatttccaggcccgatgtcagacttcggggtcgttctagtataggtaccccaagaagacaatcaatggtagcaccagtttcaacttctaactcttcaagagatttattagaatcgattcaagtattagatttatcgaaacgatcatcacgaaaacaattcccaatattcatcaccaagacgtcatttatctccagcaccaccaccatacgttga

SEQ ID NO: 8360 - DNA, 183 bp, Candida albicans
tttgaattgaaatcaaaatttcataaacaaaagccaaaaaaatttgaacaacaaaaagacaacaaaaagacaacaaacgcgacatttcttacaatagaccacgacaacgacaacgataacgacaacgacaaatttatgaagtatgtgccaaaatgtcgcatcatatttaattatagtctttga

SEQ ID NO: 8361 - DNA, 717 bp, Candida albicans
caatacgtgcacgacttacgaaagttttttttttttaggacaattttttttctttcattcctctttttgacaaccaatcaaccaatcaaccaattctactatttaatatattcattcattcacgtcttctatatcggtgctttaaacagtacaatgagtaatatactgctgattgttgggaaacaagtcactaaaaatactgaacaattattttacactcgaatacgacacattaattgtaataataacatcaaagaccatttatcacgactatcatcactacaaataaaatcatgccattatttttcaactgacaattcacgtatacaacaagtttattcaccaacttgttttgattggataagtcgaactgatcaagatgagaatgttcatagttggcaaaacaattatttttcttctagattctcaagaaataatataccaattaaaaacaagtatgcatcattacctttccaacaacaacaatttattgaagaaatggttgaattaataaaactggggaaatcaatattggataaagtgttagggaacctgttatcgccagaattgattgcagtaattattgataaatcatttgaaaattgtccattaatgccatcaacatctactgggttagagattccttattttaaaactgccaataaaatccattatgatataccgtcttcgaccacggggctggaagaatccgcgatt

SEQ ID NO: 8362 - DNA, 405 bp, Candida albicans
gatcatcgcggtacggtcggctccctaggagaagacttaggaccaccatttttgcaatcgaatcttgaagaagcacgttttgatgatgaaataactgtagttactgaatgtaattggaatttgaatgtcattgatgccagacaaatgttgaaaaaaataaaggggctcagtttatatgttgatggattccataaaaccttaaagaacatatccctgcactcttcacgtttgcacattttagatgttcatgacgatcccttttttgatgaacaggaatataatgccagtctagaggttgtatctagctgcagctcagaagatctttattgtggaagtgattctgatctggacgaagaagaaaatgagagggcaaagaaaagaagaaaaaaggggaatccacaatga

SEQ ID NO: 8363 - DNA, 201 bp, Candida albicans
ggaaatttatttatgagagcattgagtactgtgttaaatccacagcatttaatatcgataattgagatgattaaaaatatcgagcagaatgtgtttacattagacgaattagttgactttacgaataaatttggaggagaaaccaaattatttcacgaaaatgaaatgccattgaagatcaatatgtttaataatcattaa

SEQ ID NO: 8364 - DNA, 501 bp, Candida albicans
tggtcggatcttccagccgctggtgaagaatcaggaatagcacaaacagtagcattaatatctgcccctatatggggttatttggtcgatgctagaagaattgggaaatgtaatactttgggattggcagctattgttggtatgattggtaattttggtttgagtttgattcattcatattcttcaaatacttataatccaaaaacttttatctgtttcttcatgattagtattattggattatcacaaattggtttaattattagtagtatgagtgtattgagtggaatacctaatgcccatgatattatggggtcattgagtggactctacagtttctgtggtggtataggtattatgattatcagttctttgggtggttatttaagtgatcattggatattgggcccattttttatattgggattgtttaatgttgccttgttggtgatatattattcttattcaagacaacagaaatcaggcaatcttgtagtatag

SEQ ID NO: 8365 - DNA, 939 bp, Candida albicans
gggttcaaattggtggatctattgtccatggtgttctgggtggaatttttcttatatttgaaaagacgtacacgtaaccatttgaccaatcaacaacccgatgtcaataaattcatagctggtcgtgatggtggtgatctagatgatgatgacgatgaaagtccattggaagaagaagacaacaaacacatttatcatgataatgctggtgacaacatggtacaaaattctaaaatgggatggtttaaatcgatttttagtaattctgggtctgggacatctaatgcatcaaattcgaaattattggggggtgctgttggtggcggtgtcgcaggtgccagtggcggtgccggtgctggtggtattttcagaagattagatcgtaatggtgatgatttagaaagacaagctggtggtggttatggaagcactggtcgtaataataatgacactgataatgattttgtttatcgaggagtaaccaattcaaataatcttgatcagatatttagaagtaataataatacttcaagtgcagctagaaattcaacaattgccgatggatctgctggtgttacttcaggtactaattcagccaagcatactagaatgagttcatatggtcatccattggctaaccctgatgattttaatttcaatgaagaatcatacccaatagctggtggtgttataggtggtggtgaagattatcgtccacatactgcattcagttcacattatgacgatgatcaaagcagcagtggtagtactagtgacgatggagaattccatccttcagattatgattcgtttataatgcctggagatgaagcaccagaagaaccagctcatcagtaccgaccaagaaatatctttagtgatggacgacaaaattcaacgaattcattatccagattccatgaagatgatatcttttaa

SEQ ID NO: 8366 - DNA, 243 bp, Candida albicans
tcattggcccttggtcttatacaacaactaaagagtctcattctttttttaaaaaagactattgaaactaaaagtccaacgttaaatttacacgggatcttaaatacgggtgtaataaacaataagcaatctggtatcaccgagtttccatctttgttattatgtggaaactataacctgcagcttatcacacaatcaagtttttttttttgttcttccgaaagcaatctaaactttaaatag

SEQ ID NO: 8367 - DNA, 213 bp, Candida albicans
ccggttttaaatgagacatttaaaagcaccacaggcgttaatgggcgagtaagtactaaagtacttgaatcaagatccccgagaccagcagatttgattgatagatgtttcaaatttggagggaagattaataatgatttgagaaaatattgtgaattctgcaagtcatttccaatatattcaaaactttctaattctagtaaagaattctga

SEQ ID NO: 8368 - DNA, 363 bp, Candida albicans
tcgacaaaaatacacgaccaacaaaaaaaatatagaaaagttaaaagacaccaaccaacaacaacaacaagaaaaattcaatttcaacttgggccactctatttaacatacacttttgttcatttaaaacaactaatcacatatatatatatatactatccaataatgtttagagatagaactaatttatttttatcatatcgtcgaacaattcctcgtgattcattccccactaggcgaacccgattcagtgatttaaataatgaagaagaaaacgaaggactaatactatcgtcaacaataggaaatcaatctaatacgacaagtaagaattattttaaagccgccgtggaagtgtatttt

SEQ ID NO: 8369 - DNA, 258 bp, Candida albicans
  unsure (19),(20),(25),(81): Identity of nucleotide sequences at the above locations are unknown.
ttagtagaagttcaatttnntcctntctttccttatgttcctgctcatcgagattattcatccatcgcatttgggagtganaaaaaaaaatccaatcaatcaatcgatcaatcaatcaatcaatcaatcaatcaatcagtgtgcttaattgatcgacaaaaatacacgaccaacaaaaaaaatatagaaaagttaaaagacaccaaccaacaacaacaacaagaaaaattcaatttcaacttgggccactctatttaa

SEQ ID NO: 8370 - DNA, 207 bp, Candida albicans
tcaataatgagttacgatcctatacatgatacatacactgcgtccacttctagtcagcaacagcaacagcaacaacatcaacaatcatctccaccaccttcgaaatcaacacatttacatgtaacaggatcttctccaccttcaataaatcaactcataagtccaaacattgaaccatcacgctcagatgtgaatcaacatcagaat

SEQ ID NO: 8371 - DNA, 687 bp, Candida albicans
tcacgcaatacgcggatgcccccaggccgcgtggtagaatacaccgagttcccgcacaaaactgtcaatctaatccacccacacgagtgtttcccacaagagccgttgtccaatgagtttaaacggctcacacaggactcgctcgaacgagcaggtgtcaatgtgtatctcaacacgagaatcagagccgaatcaatagagaaacgtcatggtgatctcacaacaacaaacaataagacgattcattcaaacctaaatatatggagctgttccaaacacaacaacattgggtttctctcacagcatatctacgagaattacgtgacaagcaacaaaaacatatctatcaaccagtacttgcagctttacaatgcagaagcaaacacaacaatagagaattttttcgtgttgggtgatttggtggagttacccattattaaatctgcaggctgggccatgtacatgggacgacaagttgccaacaatttgagcaacttgatattcaatgggatatttgttgaaccgttcccggacttgaatgccattccgtacgggatggtgattgttggtggtaacaacgagattatcagtgagctagctggtgaggttgaagtggataatgagcattataagcaagagtatgaggattattgtataggtaaaattagagcgactatagatatgtaa

SEQ ID NO: 8372 - DNA, 204 bp, Candida albicans
gggagacaaaaaaaatcttgcagccaaaaaaaaaagagaaggaacattcgattactagaagaagaagaaatagaagcattgatgaacacaaagggtggcaacatagaaatcgatccttatataacagagaggggagagaaaacaggtgaagtagtgatattgatgatgacgtttcgtcaccacattcaaaaacaggacacataa

SEQ ID NO: 8373 - DNA, 237 bp, Candida albicans
aatgaaattctatatttgcaagtgtggattcaaataggggtgcatttatacttgatgaggagaagatttactaaagaggaaagtgtatttgaaaaaaaaaagagaggagaagtaactacaaatctagtaaaagtgaaagaagaagtcgttgggttggtgttgagtgatgatgagaggggtggtagtaatggtggtggtggggcgttgttattgtcattgttgacatttgatttttga

SEQ ID NO: 8374 - DNA, 270 bp, Candida albicans
atcagttgcatctactttataaataaattacaaaaatttgtacatatatatatatatataaaatgcaatcaattatacctaatatacaaagtaataataacactcaaaacatcttctgtatatatattacagaacaattactgctttgataaaactactatacttgatttttcactcccacctaccaacaatctatataacctctacttccccgtgttatctcttgtctttaacgagctttatcggcttcagcagaagcagtcaatctag

SEQ ID NO: 8375 - DNA, 252 bp, Candida albicans
ttagaattaaaaagtagacgactagtttcactagatttattgaagtgtcaaaatatattcagattggttgcaactgatggtctcgaaaatgcaacaggatttttttccccaattttttgcaaatttttgtcaaatagagtagaaagtaccagtattcgaaattgtcacgataaagcgattataaatcgtacaaatatttcaatttatcatttaaacacatgtcctcatctgtgttgtatgtatgagacataa

SEQ ID NO: 8376 - DNA, 291 bp, Candida albicans
ccaagcataactctctattactacactaaaaaaaagaacaaacgacacgtcattagagatgaacataatacccctagtttatttttattgttcatcactcgtaatagcaacaataataatattatagactataaaaaaaatgacatggcaagctttggtgtggtagttcttcttataatagtttgtataataaacaccagacctaagcctggacttctaaaaatagacaatttcgttccatcgggctcttacacctataaaacaatttataaacgtaattacaatttttaa

SEQ ID NO: 8377 - DNA, 282 bp, Candida albicans
ccaattagtagtaattcagcccacaagaaaaaattctccatggtacacgaaaacactttgtcacgtgatgcattgtttttcacgtatgaagagatgatatcattattggaagcaggaggaaactattgtatttgcttaatccccttattaagataccgaagacccagtcatggtcagggtcacaaaaatgacattaaaaattgtaattacgtttataaattgttttataggtgtaagagcccgatggaacgaaattgtctatttttagaagtccaggcttag

SEQ ID NO: 8378 - DNA, 612 bp, Candida albicans
attgaaagaaaaaaatacgaagaaactaccatgtcagcacaaacaacatatccaaagagaaatttggaagtgattccatttagttatcaacttgaatttattgataaagttgtttcaagtccaacaaaatctcagcatcaatcttccaatagatatcataacaataacaacaacaaccaccatcatcatcatcagaatcaacatctgcatctgcaccaacagtatcaacaatacttgcaacaacagcaacaacaaaacaagtatactttggcagctgtggcagcagcggcagcattacaacagcaacagcaacaaacatttttgttacaacaacagcaagcccaacaagcagcattggctcaaaagaaacaacaacaacaacaacaacaacagaagcaaacacagcatcaacattcacaactgtttgttaattataattcccaatcccctcaagtttttgatctgcatactcctcctcaagttttcggtgatgtgccaatggataagtctatcaccaattcttccatgtttagttctgtgagccaacctttaaatactactggtaacattgatttgaaaactaactttgatcttggatacataatagtttaa

SEQ ID NO: 8379 - DNA, 303 bp, Candida albicans
tcaagtgaaaatctaaagagaaagagaaagagaaacaacgctggttgtaaaaaaacgaaaaaaaaaaaatttttgattgtgtgtgtgtgtgagagtagtgaaagtagtgtaattgtgttcaaatatactttatttaattggacgtgtggcaagggcaagagagacagagaaaaatctatttttttttatagttccaaagtacacatactccaatgtaggcacatgactaataagatagctgatccacttcattattatttgtttatatgcagatcatataacccacgccaaccaatagattga

SEQ ID NO: 8380 - DNA, 192 bp, Candida albicans
gatcatcatgatgctcaagaacattttgttgataaattgtatcaatttgctcctaaaaatagatatcatccattagaaaaggaaggtcctttagttggtgaagtcgatgaaggagttgataaattggaaaaattgttctacgatattaaagataaaaagcttggtatggatgatgttctgttaccatcttga

SEQ ID NO: 8381 - DNA, 639 bp, Candida albicans
tccaattcatctattacaattctcattctacattatccccctaaaatgacagaaccaacgttaaatttccatatacaaacccatcaaaatcaattcaaaatccctcatgaattgattaaaaagaatttcaaactcatacaaaaactaattgaaaagcaaaggaaacaattgattgatgatattagtaagatcaaaaaatgtaaaaccacatcacctagttttaaattagaattgattcaaaaattaattaagaattttgaaagttttatgaaaaaacttcagaattttataaataaagatgaagaattccgatcaagattaattgccagattggagaatttaaccgaattacaacaatatgtgataaccaataatgataatcaagaaggacaaaatcatgaagaaagtacagagaataacaacaacaacagaaacaacaacaacaatagtactaccactgatgatgataagttattggatttccataatccgaatttaataaattggtatcgtgatcaaactaatttacttatagttgattacttgattaaatcaaacacaagaactagatttgaagataacggagaagataacccaggaaatattggattattattgctcaaaaatttaactaaaaca

SEQ ID NO: 8382 - DNA, 219 bp, Candida albicans
cagataactgtaaaacaaagaaaacagttcttcatagatggatggcggaagtatttgtccaccagcaagtataaatacttgaacatttctttaagaactgggttggtcgagaatgtaccaatatatatttttaggaatattgattccaaattgacagtcctgagtgttctccatagggagcagctcgataccgcaaaaatagttaggggcagggataag

SEQ ID NO: 8383 - DNA, 246 bp, Candida albicans
agaaatgttcaagtatttatacttgctggtggacaaatacttccgccatccatctatgaagaactgttttctttgttttacagttatctgtcaagagcaagaacatttgttattgctataattgtaggattgcactttcaaacaatagaagagtctatagccatgggtatcggaaacacaaagtatacgaattgggctatatattttcgtatctttcttttttacccccaaaaagccaaacaataa

SEQ ID NO: 8384 - DNA, 753 bp, Candida albicans
atatcttcacttcttattcaatataaccaaattaaatcaacttatcaggaaaatatgctatttactcaactaataactttacttacagttacatctcaagctttatctgtcaccatttcagatcttaataatatcgcctcaaatcaagttaccaagcgattgggtggtggttctagaggtggttccagtagcggttctaggggtggttcaagtagtggctctagcagtggctctagcagtggctctagcagtggctctagcagtggctctagcagtggctctagcagtggctctagcagtggctctagcagtggttctagaggtggtagttcaagtggcagctcgagcagtggctccagaggtggtggctcgggtagcagtagttcatccggtagtagaaattggggaagtaatcaataccattgtagtggaaactcatgtggatatggtaattactatgcaccatctgcagcagcagcagcagtaggatatggtactggccgctacaccggaggaactcaatatggaaataatcaataccattgctcaggaagcacttgtggatatgggaattattttgcaccatcagcagctgcagctgcagccggatacggttcagcaagatattatgctcagcaccataattcaacttccagtgaaagtgaaactatttccggatcatcatcactaaatattccttctacccatttttatttaataggttttgctgctgcatactcgattgtattataa

SEQ ID NO: 8385 - DNA, 540 bp, Candida albicans
tcgtgtaggaaaacagaggaaaaaaaaaaaagaaaaaaaagtcgacgtcaaaaaaagtttatcttgcttatgcatgggaccatgattacaattgatttttttcttaaattggttacattgccatatactgtgaccaagacggtgttgcagtactatacggtgggcacaccatattcacgtactaatcaggagttccgcaactcgttgtggaagaatgtgttgttatcggtgcagtaccatgtttcggggaactacaagaaggagaatattaaagcggttatctaccagccgattgacaaggtgattgccaagttcaagacccatccattggcatcggggttggcgcattttggggaaaagtttgatgagtatagttattggatccacaaggcagatacccagggcaaggtgttgatctatatccatggcggagggtacttgttgaacatgtttgagtcgcagtttgtttttgtttcggcgttgcactatgcgttggatgaccatgcggcggagaacacgtcgattttggtggttgactag

SEQ ID NO: 8386 - DNA, 330 bp, Candida albicans
attggtaacggccaggagtctaaaccaatgttaaatcttgtgttttttgctattcaaaagaacacactattatggaatgtccacacgcaggggggctgtaatacatgcgggaaaaagggccataaagcggctcattgttatttaaaaaagcgaaaattgcaaaaggagcaattcttcccaaccttgcaaatgaaacgaaaaccattggaaaacagaaacatagaagtaaataatagaagggaacaagaaataaatttggaaaaacctacccaagggaacaccaaaaaatactgttgttttataacctccagcattctggatgttatctaa

SEQ ID NO: 8387 - DNA, 198 bp, Candida albicans
aaagagagagaaaatattctgtttcttggattttcattgcgtttatataatttctcccggaatgtgtgtggcgataaaccttatctcactaacacaatagggggggaagtgattttcgcaaacaaatcgaagaggggaacaaatttagatagtgtcatgtacaagttatcattattatcaaccacaattagtagataa

SEQ ID NO: 8388 - DNA, 192 bp, Candida albicans
  unsure (24): Identity of nucleotide sequences at the above locations are unknown.
cttttatttccactaactgttgtnaagataccgttacctcaagtgtcaatcaaagaattgacagatggtgtacttcttagcattgacgatgaagaggatgatgacagtgatgatatagatatcgagtttattaacggactggtaactattttagtaataccagaggtaaatagtattactttttcattctag

SEQ ID NO: 8389 - DNA, 291 bp, Candida albicans
ttgcatgtgattagtttgacaccccaaaaaagtttatttatatttagtaaagcttcttttagtttattgcatagactaaaaggagaaactagtacaaacttcattgtcgtgtttgttatagcacaaattgtgagcttgtatgaaggtcagaaacaaaccagagcagaatcaacagcagaactaaaaatgttcttttcttccatcatatatgggctttttagttgccactatgttgaattctgttcaactagggatgtcagtactttcttttttattcttactatcaactaa

SEQ ID NO: 8390 - DNA, 183 bp, Candida albicans
  unsure (107),(116): Identity of nucleotide sequences at the above locations are unknown.
tgttgccagaacgccatattatttacatacacgcgcattaattattatcctaaggggcaacacagcgccgccaaatccaaattttcacttcaattgaaaacttgcanatataacanatacagcaagtttaattataaagcatgcagtagtagtactgtagataaaagtaggatggatggatga

SEQ ID NO: 8391 - DNA, 186 bp, Candida albicans
tatatatcctgtcaatttaacaacagtaacaacaacaacaacaacaacaactataaacactcattaatatttctttttttgggacaattcaagtcaagtcaattggtaatcacactactttatcataagacagacagacagacaaaaaaaatactaaataaaaaaaaaaaaaaagaaattccgtag

SEQ ID NO: 8392 - DNA, 213 bp, Candida albicans
gattgtttgtttgaatcagttaaatttataaagtcaatctttggaattttgagattgtccaccaccacctacgagttattttatttaccgtatttgacatttttccgtaatgtgattgttaaacgtaattttttatttcttggaacaatttgtagttgtagtaatacaaccaataaggaaaaaccagcgagtataaacaaggaattaatttag

SEQ ID NO: 8393 - DNA, 333 bp, Candida albicans
tcttctatttctttccacttgattataaaatcaactaataaacttggaaaacacagaataacgcccactcaaaattccataacagtcaaacgaaatcggtttactttattaacagataaagaactttatgccgctatctacttttctcaaaacaaaattagattagaattaaagaaagaaaggatgaaagaaagaaaggatgaaaagaatattaaaattttttttttttgtttcccaatctctctctgtcacagtttcacacacacacacacacacacactttctttctttctttctttctttgttggtctctctatatgtcaagtcaattaa

SEQ ID NO: 8394 - DNA, 201 bp, Candida albicans
ctatttttcctttttctttatacactatctttttcttttttcaacatgacagtatcaaatagccagactgtgaattacataaatcctgaattgacagacgccgagaatgctaaacctggcagacacgtcaattttccgttttggatatggccccattccacagcaattttaaaaaccaaaagatctttttctttgatatag

SEQ ID NO: 8395 - DNA, 1713 bp, Candida albicans
aaaaatgggaaacattcagttaaagggagggatactccaaaaggaaatggtggggtgttaaatatgatattattagtagcgaaaatgagaatggaaatgaaaatgaaaatgaaaaccagttggaacagggacatcaacactattattattagagatagactgaagttatataatcattttttacgttatccagaagtggtaataaacaacaatgacgatagagctgagctagcatcgacgaagaataatctattagtcagactgccaaaactgaacaacagaagattaattggaagttcaagaaagaaaaccctcaaatccaaatccaaatccaaatcatccaagttgaagcataaatctagaaaatcacataaaagaagacctaagcttctcaaatcaaaagatgtcgaaacaaatgagatcaccacagttgaagtgatcacattaactatcacaaaagtactagctagacacgatttggcagcaatagtaacgccaattcaacaacatcaaagtggccacttgattattggttacccattacccatagcaactaaaagtagactccatggctattataaatctagtggtgttttaaaggaagttgatgcaaatccgacagaagaatatgattctggtgatggaaaggaaaatacacaacaaaatccaattccagaaaagatgaggcttccaacaaatgatgatccttattctcttaagccaacacatcattatgacccatctgcaacaatgcaaaacccccacaaacagtttaccaataggactgggaattttgaaataccaacaaatgtacaagatattgatgacattaccttccctattgatttatccagtctggattccacactgaatttgtattcaatactaccaatgaatcaaactaatctaccagatgttaacacactatcactagcaccaggaactggatccgtgcctcctcgttattctaatcatcatagtgaattcaccgttgaaagaccaccacgaccaagtcgaactaaaaaaagacctcgtattaaagctaagaagactatgaaagtgtcaacacaaatatcttctgctatgtcaaaatcaatccatatcactagaattggaagcacatcatcgggcattgcttctggtattacaaatatagtaatccctaattcaagctcctcgatctatgacaactatcaagatagtagttctgataaacaaccagtatctttgtcgatgccaacaaagaccataaccatgacaactgataccacttctgaacctgtcacaatcacagaaaagttagataaaccaaaatttcctgatattttcactataataaggagcaaacttttgagcaaaaaaccacaagaaaccaaattacattcaccaacttcaactgatacaaagtcctccaagttgatgtctagcagtagcagtaataacaataaaccggagattagcaaaacgacaaaagaatacaatcaaactcaggaaagcacactgtacaacaccacaaaggcagttcctaaaaccagtgtcgtatcatcaacaacatctactaagccaaacgaccaaggcaataatattttaaactcatttatacagttcacagaaacaatacactctcgaattcggttcccaactgctgatgacaataataataatgctgttcttcaccacagagggcgggaaggatccgcgctaagcgggaag

SEQ ID NO: 8396 - DNA, 1743 bp, Candida albicans
caacaagaaaaccctcaattttcaactaataatttacttatacatcatcattcatcaagagtctatatcaataacaaaatcaaaaccattcaacaacaaaagaaattactcaaatcacctacattttcaagttcatttaatataccaatatctccattgatatcaaatagtaatcttgccaatatacctagtccaacacctgcacttacacatacacttacaacaccaacaagattacatctgagatccaacaataaacgagcattaatgcaatttaaaagacataatcatatgaatattaaagattcgtcacttgatttgaaaaaaacaacaacaactattctgaggaattttgatagaacagatattgtggaacaagaaggggatacagattttgatgaagaaaaagaaaatgaagaaactgaagaagtcgattttgatcaagtacatgacattgataatgacaaatccccagaatcacagttttcagaatcagaatcaaaaagatatagtcaagttggattttctactaatgggaatattaaattaccaacatctaaagtcacagtaattgttccacctactccagttaaaaaaatggaaaaacctccattaatcgaggatgatattcaaccatcatccatgacaccaccaaaattatatcatcctcaatttcaaccaccaccatcatcgagtaattccattagaactgaaaatgaagatttaaatcgaagagggtcaataaggaaattaatggataattggaaaaaatcattaattgttcataaggtttcgtcatcggcaactgatatgccaattaatagaaccatgtcgacaaaaccatcaactgaagatcttgatagactaataaacaatgctatgagtgttatgaatgaaaaaactgtgattggtaaaagagtagatgttttaagtgcaagaataatcgatgaattggaatatttgattagatattatattagtagtgaatcaagtagtgttattcatgaaatgaattatcatgatgacactggtgatgacatggaaatggaagttattaatgacaatgataatgatcttgaagaagaagatgatgatgacagaccacatcgaaggacaagacaggataaaggtgatgttgatttacacccaatagaagtatctcctacaagagccgatgaaatagaaatggatattaatgatttatcagatttaaatattgttaaaattgataatcttattaatgatactactgctgataatagtcattcagtgaaagttccaaaaaatatatctacaagttatttcttagatgaaattgacattggaaatgacaataataatgataatgataatgaaaatgttaaagaatcttcttctacttcatttcaaagtcctataagtattaattggaatgatgaagataatattaatttagatggatcaattgaaaaaactccattagaagaagaatttgaaggctttgaatttctgcaagaaattaccaccaccaccaacaataacaacaacagtaccagcaatgataaaaaacaaacacagccagattattctgaacctaattttagtttccaacattcccaatcgcaatcgtattctcaattccaatctcattctcattcccatagtaaatcacatgaaacttcatcaatttctacacctagtaatattacacaatatgatgcagaaattgaagaattaggtatagcaatgagtccacaactgatc

SEQ ID NO: 8397 - DNA, 198 bp, Candida albicans
tgccaactcaaagtactatggtgcggaccaatggttctaaaagaagaatcttatgaaacttgggatgtgccgtatccagaagttgcaaagctgtttctgaatgatttaaagaccctaaacagtttaatgccggtgtctatgagaagtgtatcaattggtactgataattatttaattagttatctaagctacacctaa

SEQ ID NO: 8398 - DNA, 486 bp, Candida albicans
gatggagatctcaccatcaatgctacggggttcgatatcacaacaacaagcaatgatagagttcacaaagttaatcaacaatcatcaccaatgccaaagaaaatagttatcgcaagagaacgttatcctcctaaagtattatatgatggcgaaggtaacttgaggtactttggagaaagttcaccattgtcctttcttttccaatgtcggaatgtttttgttgataagatcggggattcaaatttcacactagaaagcaacgattccttggaagtcattgaagattctgacgaatcttatgaaataatacaagttgcacttcctagccgtcaaatattggatgatattatcaagattttctatatgaacattcaacaggcagtctactttgtaaatattgatttctttaaaagtcaaattattaatcctgtttatgaaaattatcgcgctcttcacctcggtaatagcccgacccgcggtttatgg

SEQ ID NO: 8399 - DNA, 282 bp, Candida albicans
cccatcggatcttcaggcgtggtgaagaatttagatcttataagctttgttttgttgtttatcacaactaacacaaataaacctttaaaactcaaaattcattcatctgcggttttgagtcttgtttgttctaaatttcacaatttagtgtatttttattgttcatttacatataaaatattaggcaaggaccagaaacagtatgatatccgagtccaaataaaaaggaaaaccaaacaaaaaaaacaaatcaaaccaattataatctcaaatccatcttga

SEQ ID NO: 8400 - DNA, 222 bp, Candida albicans
gttcccataaatttaccacgtatcttatttcatagaaatgcgttttatttagagttgaattatgagtcaagttgttggtttggcagaaacaagttcaaacagaccaattcacgtagatacacaaaagcatatattttttatgccttgccctttatggaaactgaattgctcattgtggctttttttgataaatttagtgatattattttttcatgcatttaa

SEQ ID NO: 8401 - DNA, 1632 bp, Candida albicans
cacaaaaacaaaaacaaaaacaacgatgatgattatgattatgattatgctgatctatttattccatttagtaattcacaattagatgatattgttaatatatcaaagtataataaattgacgttatcgttatcgctaccaactatactagaaccaacatcatcattgccaaataaatcaccccgattaatttctagtaattctaataataaattatggcatattagccaacccaaaattgattatattaatattggatcaactctggaaatccttctccttgccaaatcaaataaaattttagatacaacaacaatatcatttcaaattgtcatcaacaagtacatcaacaacaatgacaaggttaaaacatttattattattgaattgataggagaatatttaggtaaatttttatattataaattttataaaatttgtcaattatatttatattcttggtcaattcaatgtaatcatttaattaattcatcaataacgtttataattctgggaccaaatttaaatattgagaaagttttattaaaatttatttattacattaatcaattattactcaatgcaacaacagctacaaatagcagtagtggtggtagtggttgtagtggttgttattgtggtgggaaaattgattataaattaatggttgaattgaaaaataaaatacgtttcaaatataaaaattacagcaataatgaagatgaaagtagtgatgttattggcgatgatgactgtttgaggaaaatcattgatagtagtataatgttattagaaaatgatatttggacaattgaacaaagaatcgatgcattaaatttaatcgaaattgatgatttattatctttaatgaaggttttaattgttggtggtggtggtggtggtgatgatgatgatgatcaaaggtttattaatgttttaatatctacttcaatggatgaatttaatgtgataaacttgaatcaaataattatgaatcaatgggaaattccaataattaaaacaagttcaatttcaaatccacaattgaataaatcattaagtagaattttattacctggtcaaaatgaattattcaaatataaactaaccaatacaacaacaacaacaacaacaacaacaacaacaacaacaacaacaacaactactactactactactactaataataataataataatgttgtgatttataattatatacaaatttttcatcaacggaagccaccaccaccatcaccaagtaccaaaaataaattgaattattattactattataaaatgattttatttaaatttataaattatttcattcaacaaaaatttaattatcaatttcgtataattaatcaaattggttacatgatttattccggaataagaataaataaacaaacaatgggattatatttttatatatcaagtagtagtggtagtagtgatataaacacttatcaagaaatcttggatgaattgaatcggtttctatatcagttagaattagagttggagttggagttgactagtaataaaagccaatcacgatcacgatcacgatcacgatcaatgaaattattggaatatgttgaatcctttttaaaattcagcccctaa

SEQ ID NO: 8402 - DNA, 186 bp, Candida albicans
aatgaaataaaagagaaaaaaaaaaaaaaacaacgccctacaatcaaaagatttaaccaatggcttagaataaagattgctattcagaatgaagatttggatagtaaaaaagggttaaaatttgttaatttgttgatttcttggggtatgttgtatgtagtatgtagtatgtgtgtttggtattga

SEQ ID NO: 8403 - DNA, 219 bp, Candida albicans
aatcaaaacaaaacaattctggaattgtttccaaaattagatttcaaaagtgcaattctccaacagtatttgtttttattgcaattgtgggtgcaattcaaattatttgcgtgtggagaaagagaatcagggagagcaattattgtaagtcaaccattgttaaattatataattagcttcccaaacatattaagatcagatctacctaatgatatctaa

SEQ ID NO: 8404 - DNA, 189 bp, Candida albicans
tgcggttatgctatcattgttgagtggaatttacagaatttgtgttgtgatcaagaacataaccataacctagaaataaatttaatctctgaagaaaactataccaataaatcacaaaatgacctttttgttttatcaatctttatgaaatactgttacagcaaagtgaaaaactgccagttacaatga

SEQ ID NO: 8405 - DNA, 279 bp, Candida albicans
tatttacatctttacatttgtgatttgatcgacaagcatttgattcagatcatattatatagctatattttgtattccatctattactcagcaggatatacagagagagaatctattcatatgatcaaaagacagatccttttgataatgacggtatatgattatatattatttctcccctatttaagacctcattggaatactactaattatacccaatttcaaaaaaaaataaaagtaagtaccaaaggatttattattcaatttaatcttttttag

SEQ ID NO: 8406 - DNA, 183 bp, Candida albicans
atagcgtcattacaaatcacctggaaaaactttttatctaccgacttgatgatatgcatcacttgtttcaaaaacgactctctctcaaaacattttaacaaaaacttgttgccaactacatacaagtctgagcgtaagctgggtgttgagttagaattaagaatacctgcaatacaagtctga

SEQ ID NO: 8407 - DNA, 834 bp, Candida albicans
ggagcgggttcttccagcttttgtggcgaagtatggccggcttcaatattgaattttgttcgagagaatttaatcaataaagtctttaatctgttcaaactactaaaagagttagaaatcaccatgagtttattgtgctttaaatttgatcccaccattgagaatttgcaagaccaagctgatttgccagtagaattgaaaaagctttttgatttatcattgaggtatcaatgttatcgattggtaaacaatgcaattttgaaactttataataacgagtataccgatgtcagtattgcaacaactaacaaagacatgcttcgatcaaaatcaccgtttagcgatagctattatttaacaaatgatgaaaccgttcaagaattgttggaagaccgggaagaatccaataaacggaaaatgaccagaacctatcatggtcctaaatttgccgagtttgatttatcgaattataaacataaatcaagacaacaacaacaaggaataaactatgaactgtcagattttgttacgctagaagaacaacaacgaaacaatgaacaagaagaactagaagcggtagatgaggaagacgaggatgatgaagaagaaataggataccatattaatcccgatgtcaacttgtatagtaatggtgatgctgacaaagatatgaaggacagtagtatcgacaatatagggactgaaaatgaagatgagatgaatagaataataaatttgtcattggattcgaggttagaaagagtaataaaattatggttgttaactgagcagagaatcaaagatttgaacattgttgtcacaaaccgaaactaa

SEQ ID NO: 8408 - DNA, 285 bp, Candida albicans
gattttgaaatgaacgaagagccagaattcggtagcattatcattcatttacgaggtagagtactaacccttatcaatgattctgagtatttacgtcaatttaaccaatcaagcggaaaaaaatccgataacagcagcgacaataacaaaaacgaattgaccgttgataatgtgaaaatctacaataataaaaatattgaggttggcactcatgaaaatgacaactatttaagtaaatgcaatattgaaactggtaatacaattgatgtggttgttgttatataa

SEQ ID NO: 8409 - DNA, 225 bp, Candida albicans
tacctcaatgataaatcaaaaagctttttcaattctactggcaaatcagcttggtcttgcaaattctcaatggtgggatcaaatttaaagcacaataaactcatggtgatttctaactcttttagtagtttgaacagattaaagactttattgattaaattctctcgaacaaaattcaatattgaagccggccatacttcgccacaaaagctggaagaacccgct

SEQ ID NO: 8410 - DNA, 225 bp, Candida albicans
tcatttgtacacgttattgaacatatgtacacgccctacacacacttattacacacaattgtcagacaacccactaccacccgcgtagtcaaatttttgcttcgtcatacaattacttcaatactaaaaaaatttacaaaaactattaacaagttacaacaacaaccgcgtccaccactttccactttttcatcaacggtcttcaccacggggctggaaggatcc

SEQ ID NO: 8411 - DNA, 186 bp, Candida albicans
acatttatttgtcatcatcgttatcaatatgaatccttattgtttttgttcccaatttgtttgatcaaattggaattcttgttatttcatgcaagatatcatcaaatcaacatcaccttaagattaaagtacaaattggtacaaaccacctggcagggaagacattctggacataattatttttga

SEQ ID NO: 8412 - DNA, 258 bp, Candida albicans
ttacagatttatactttgaaactcattcactcaacaatttgctttccctgtgctctttacaggataataacatcaatggcacgaaacatttttttgtgtttagaagtaagtggttttgttgatattgattctgtttttgatgactttacaaccaaagatctaagaaatagcaattgcacaattacacaaatcattccgtgccgtgaaaacgattattcaatagaaacccaagctttccttttagtatcagggtactaa

SEQ ID NO: 8413 - DNA, 198 bp, Candida albicans
cttaacttaacactgtaccacaaatcaaatcaaataataaacagacaaaaaaacagttggaaatttacttggtttaactttgacgaaaccagtacaaccgtcatttcaccgtcatcaccgccacttttccattacacggtcacctcctcaattcaacatcgacctgaatttttgatgttgaccaccggtggaaatcca

SEQ ID NO: 8414 - DNA, 216 bp, Candida albicans
  unsure (25),(117),(189): Identity of nucleotide sequences at the above locations are unknown.
gtaatgttttctttttcaaactctnttgtatttggatactggattttattgattcttgatcttgataagtctcggcatcctgttcccaattatgattatgattcaccagacgattangttaaccatttttgttcacaggtggttggcttgaacactggtgttcataaaatccttgacctcgattccgtnttacacgatgaacctttcgcccattaa

SEQ ID NO: 8415 - DNA, 228 bp, Candida albicans
  unsure (89): Identity of nucleotide sequences at the above locations are unknown.
aaccgtcccaatgtaccattggatatcattctgaccttcttcggacaaaatcatcgacgggaattattcgatcgaccagatattagacntagagctgatcccacctggcaagttatgcctgatgccaacatacatcaggaaacaacaactgtacagactcctgatcatggggagttagataccatgatcaacaacgaacaccaagtaccacgattatggggagggtaa

SEQ ID NO: 8416 - DNA, 417 bp, Candida albicans
atttcaagaaaagtttatcaaaatgaaatgagagagctagctgtatgtgtgaagagactaataaacttttggtgcgtggaatctttagtattcgtcttctatatatatactctttttttttacttgccagatgcatttgaaaatggatcgtgcgtaatctttttttttaccacaaagttaaagcctctttgttttgattttgcgttatgggtgttgatagtatcaccaggtgtaaaggttgacggtggtagtggtgtggtatataatagagcttcttctacttctaaacaaattgaaatggctaacactttttatatccaaagaaagaaaggtgtatttaaagttcgatttaaattagaaagagattcgtcaagtttttttaaaatctcaatttgtggttgtaaaaaagttttttga

SEQ ID NO: 8417 - DNA, 210 bp, Candida albicans
tttacgaaaaaaatattaagattattttcaattatcaacaccaaattgaaaataatactaactaacttacatcacatcaacaaaaattcatttctatgtaattatatgtacggcattgaacagtttaaacaattattattaagcattattgttttctcatctaccatattcattaatcctcattggtcgaacggaagaaaggaagtatga

SEQ ID NO: 8418 - DNA, 198 bp, Candida albicans
aacaacacatgtgggcaaattgctgttgttgttgttgttgttgaagtcatttatccattacaaaatttagttcaaaattttttagcaagtgtacaaattttgcctttttttcttattttaaaaaatgcatatagattttggaacaatcggagatcagaggaggagaaggagaagaaggagaagaaactagtggaatga

SEQ ID NO: 8419 - DNA, 189 bp, Candida albicans
gtgtatgtgtataacatgattcaagaaaatatactgcaaaagcccaaaaaaaagcccaaaaataatggactttggatacacatgggtagaaagaaaagtagaataatcttcaacccaaatttgaaagaaagagaaagaaatagagaggaggaggagttctacaaagaaagaaagaaacagaatatataa

SEQ ID NO: 8420 - DNA, 192 bp, Candida albicans
cattacaggtatttatatatatttaaactacatactcaactatctatatatatatctgactattctacatctggttatagtacacacccccccactcatccatacatacaattatatttattatttcaatttaatttttttttgcatatcaaattatatttatttcatttcatttcaatattactttattaa

SEQ ID NO: 8421 - DNA, 261 bp, Candida albicans
aaagaaaatcctttcttaaacaaatatttttggggaaactattggtatatttatattagttcagttaaattggtaagttatatttatttaagatgtatacataaaaaaaaaaaagaaatagaaataaaaaaaaaaaaaattttcattttagtgagaaagaaagtaaaactttatttattacacaaaaccaattttttcaatttccacctccagtcaaaaaaaaaagaattaagacagtttgggttttgtgtaactatctaa

SEQ ID NO: 8422 - DNA, 207 bp, Candida albicans
aaaaaaaaaagaaatagaaataaaaaaaaaaaaaattttcattttagtgagaaagaaagtaaaactttatttattacacaaaaccaattttttcaatttccacctccagtcaaaaaaaaaagaattaagacagtttgggttttgtgtaactatctaacggggaggttttttctttctttttgttacttgaattcaactaacaaatga

SEQ ID NO: 8423 - DNA, 333 bp, Candida albicans
ttatttataatgtcagggtcattttggaaattcagtaatggttttacatcactttcaaacatttccactttattggaaaattataatagagacctggaatctggtaaagttgaagaagaaggacaacttgaggttttaaagaaattattagatgaaaatgatttgttacaagagttattatcaaacaatcctatgctaatgagttttttgcgagaagataaaatattaggcatgcttgtgaatttagtaattcttgaaggcgctgtggacgaagataatccctctataaaggattctaaaaatataattgatacacaagaatctacttattga

SEQ ID NO: 8424 - DNA, 1317 bp, Candida albicans
ttcttgcgagttaaaggtgaggtcaaaatgattgatttgagtaaaaaaatgaaattgatggaaaatcattttaaagataaatatagacattttacgtcaccatccgaagattcgagaaactcaatgcccgcaacattaaagaaaaagatatttttttccggtaatcttttcatggtatcgatatatatgcatattttcaattattatgaatccaagcaaaatgttgaattgtcgtttttttatttgaagaaaatgtttgtcacaacgatttttgaaaccatgccatattttactgaatatgtgaccaataccaatgacgtgttcaattcaggttctgatattattgctattccagggtacgagtctgtggctcacaaatcattgattgttattgcagcaatctatcttcgtctcatgtaccgtattcgaatgtttaaaattaggtatgatcataacactcggatgaactcagatgcaattgaggatgaggagtataaggcacatttcaataagctaattaaatgtagtgacttgttgattgaatgtcgtgagatatttaggtgtggtttagccaagttgtccaatcgttactattatgcttggagagtgaccaaggcacagaactttattggttcaatgataacagacaagttttttgaaagctacaagccgaaatgtgtgcataacggttattcaacagaaatgaatactgagttgatatatattttggaaagtacgttggataaagtgagagaaatgaacaaattaagaaaattgcatcaaaagcagatgaagaatcagtctcatagtaaacaagtgctccaaaagctgcattatcatcaactgtaccaactgcagccgcaacaacaactgcaactgcagcaacaacctcaatctcaatatcgatcccaaagtcattcatggaatggaactggagctaaccctcagtattcatatggggatcaaaatctgcttggtgagagaaacccatcccttgatcaaacttcaatggcgtcaaatactacttctgatgttgatatcaatgattacaagaccaatgatgagattgatagtatttggttgcaaatgatgaatttaaagaatcaagatactattgggacaccgggaaatacccaattcggtggtggtggtagtggtaactggacaacaagtttccaagctgatcaatcaaacatgacctttcctcaagtatcaaataaacctgctggtgggaatgttgctaatgtgtcacttggaacaagatcagagttaactagtggaaattatgaaatgggttccgtccattacactaaataa

SEQ ID NO: 8425 - DNA, 579 bp, Candida albicans
ggtgcatttactgggtttaaagacagggatttaaaagttgttttgagatttttaatagattccaagattaaatttaattctttaagcttatcaggcttttcaaatctaattgcatttcatcctactgtcacaaactttctgttactgtataatacaccaattagatatgagatccctggtttgaaaaagttggccattgttttaggttgtagtggcatacgaaaccgaacacatacatttctttctgacttggaggatttaacaattaaggattatcaggttacccaattgaatttacctccttttttgcgaagactatctatagccagattttcggattcggtagatatcatatccgaaaaattggttagtctagagtatttagagcttgagtatctgaagaatgggttttttatcaaaaccgaaatagctgccccaaatttgaaaacattgatcttaaaaaaatgtcaaagcgctaccaattttgatgaattgagaagattccaaaagttaaagcatctattgttgtgggttacctccttgagtttgatctgccattattgtactggcttgatctag

SEQ ID NO: 8426 - DNA, 198 bp, Candida albicans
aatttttttttgtcgttttatttgaaattcagtttttgcttgaataatgttgcaaaaaagattcaaaaatcaattcaaatcttaccacaactgttcatcactcaatttctaaaattcaacaacagaagttttaaagcatttattatagtagagtatgctatgatatacttttatagtatcatatatagtttaaagtag

SEQ ID NO: 8427 - DNA, 687 bp, Candida albicans
gccacttttatctttatacaataccaacacacagattcaatggatgaactaattcaaaacataatagagccatcatcattatctgaagatactatcaattctttacatgaattaggagatttattaagagatggcacaaatagaattatcattcatgataaattatcaatacttttacctcgattcaatcaaattttatcattattaacaaatcaaaatcaaaatcaaaatcaaaatcaaaatcaaaatcaaaatcaaaatcaaaatcaaaatcaaaatcaaaatcaaaatcaattattaatgaataaattacaattagaaacattaagagtaataattaatatattagccaataatgatttgaatcgagattttttcaccaatttaactccaaaattgtcagaaataaacaataaaaaagactcacacaaagataaagaaaagggaggtgagtttgatattgatattatagttaatgagttttggtcaattataaagatacatttagataactatatgaataaaattgatcatcattctgatcgtattattgaatttatttttatattattaaatcaattcatttatgatactgatcataaatctcaatatttagaatttttcaattcattgaaaatccaatgggaaatatatcctttgattaatgaagataatataggtgacatg

SEQ ID NO: 8428 - DNA, 234 bp, Candida albicans
atgttacgatccagtcaacatatacgacctatttggagtcgtaactttcatcaaacaactacattttatggaaaacaattacttcgtaaattacgtgatgatgatattgatcctttaaccattagaaaacaccaacaacaacaacaacaacaacaacaacgtcgaaatcaacgcaagataccatcggaagaatttgaaactaaatctactacaagttataatctcaaaggagct

SEQ ID NO: 8429 - DNA, 765 bp, Candida albicans
gtgatacttttgtattgccagactagtattagtattgttgtaaaaaaaaatttttttttgaaccaaacctctttgaaaaattttggtgaatattctcaaataaccaatcgcacacgcacacgactagcttatttattcaactatactatcggtatgctaaaatactacaatcgagcattaacgtgtgaagagttggttctacaactatcatcagtgaaagatacaacgtgttatatattaatttctgatccaactttatattattcacaccacagtaatgatactatcaaattatcatggaaagggatccataatctaaataattgtcagttaatattgattgagtcttggtcagaaataaaagagtttgtgtctaatatagttgatcgatgtcttattgtgttttatggaattttcaaaacatttattgaacttggattgaatagtaacgaaggagaaaagaagaatgggtttttgcaacatcatcatcaattttgtggatgggaattaaataaattgtttcatctacttttccttaaacaatcaatgtatggagtagatgtaattgtaaacgatggtattgaacatgataatgataatgtgggtggtgaacctttgatttggggtttgcaaatacctaatgtgagagaaaagctacgtcaggatacaaccaccactaatcaagaagaaaagatgatctcgttacgagtaatatttattaaatggtttgaaatgactaataaaatagactattcaactgtataa

SEQ ID NO: 8430 - DNA, 1140 bp, Candida albicans
tttgttttgtcaagaaatatatatgtatacatgactacaactagcacagcattattagataccttatcaaccgaggtaacaaaccttaaccaatcaggaactgatagcttgaatgatttgctacaggattccaatgaatttttagccgaactaagactaatagaattagatttaattgaggaagtgaatagtcaggaaaatgaactcacaccccataaaccagtggacccagttgacaagttactgaagctttcggataaatggtataagtcgtctatttccagattaaagtcctacaattctgcaaataacaaattcagcaaaaacattttgaataatcccaagtttagtattgagttggatgatgcttatacttatccattgttattgaataattatccacgtaataatttggacggtcaccaacaaaaacatggatcgacgaggagtaaagacatcaatatagaagcaccggaagaaggtcacccattacttccaaaatcaagccagttggaacaaatcaaaaatgaaaatagagaagagcttatcaaggcaattgttcttcatttattgaaaactggtcaatgtgatattgttccagaagtgttgaaagaattacctgcaaatacatcaaatgttattgatcaagatctatttaagaagtttgaggttttgaatcaaatagttgataatataatagccagacatgatttatcattggcacttcaatggtttcaagaaaagtataatgaaagagtagccattaacgctaaaaactcaattttgccaccaaatacaagtgcggatacatttggatctataaatctatcttgggatcagactgactcctttcatgatattgaatttaaatttcacatgctacaatttacaattttgttaaacggagagaactcttcattcacgcttgataatgcactaaaagcttatttgtattcaaaagataacttttccaaattctttaaagattacatccatgagatatcgccgttgatgacattattgttattcagaacagataaagataccgatacttttgatgatttctcgaaaaagcatatggttactactgttaaaattttcattaacaaaaatgaaacaggggttctatatggagaatga

SEQ ID NO: 8431 - DNA, 270 bp, Candida albicans
ttcatatttataacacttgttttagactacaacccacccttgatccttacatatagagaactggtattctcaactttttttttttatttcacattcctcgtttatactaaaactcctagctatcatcctatgacatcagtcgaaccagatattgaaagtgaggcattattagaaatagcagctaatgatgcttatcaagccataattgaagaagaagaagaagatgttgatgaggctaactcatctcaagatgaagatgttatttggtga

SEQ ID NO: 8432 - DNA, 231 bp, Candida albicans
attttcaattcttcagtggataattgtgattctgggacatacgataataatatttctaaatttgttgctcttggtggtcttgaaagtgttaaaaacccagcaatgttatcttttttggatggtgatggatgtaaacatacttttgatttgacatataataattctacttcattcagcagcaaagttcttttagtaggcatttggattgctaatgttggttgtttcctgtaa

SEQ ID NO: 8433 - DNA, 207 bp, Candida albicans
aggaacgaaaaacctaaacaacataggaaagaagccccaaaaaagaggataataaagaggaaaaaaggaagaaaagatgaacaaaacaagaatgcaagtaaaacgggaaaaaaagatagaaaagggaagaaagagaggaaagaaagagaaaaaggacggagaaacaagacctccccccccttccctttcccttcccacttcctataa

SEQ ID NO: 8434 - DNA, 201 bp, Candida albicans
aacggaataatgttggttacaacatgcttacatttcaataaaaagttattgaaaaaaatagaaaacaatgaaaagaagaaatgcacaaacttgggtacaacaagtcaaagtagggggccacacgaacagaattcaattcaggttccaataatgtactccaacaacaaaaagcatcaactaactctttgttttggacactaa

SEQ ID NO: 8435 - DNA, 249 bp, Candida albicans
atgaaagtggtttggcaagatgagatagaattatatctgtattgccagattgaaatattacaacaaacactttacttcaaagatagtttcgataactttatatctttggaaacaaaaacaaacaaactaaaaaacaaattaaaaaaggaaatgccaaccggtatacccagaagtatagatcagcccaaaaatgaaagaaaattgaagttgaaaatagaaacacaaattaaaaaaataaaaaaagtttaa

SEQ ID NO: 8436 - DNA, 231 bp, Candida albicans
tggggtttcaaaagagtatattcatttgggccaatttttacaccgaggaagttatacaacaattgtttggttcctattataataataaccattaatttaaaaaaggataatcatcgtgttctaaaaaaattattaaatccaaacataaatttatatcaattttttaaggaatggattcgctatttaatgatatataacatgttaataattattaaaaactcaccttattag

SEQ ID NO: 8437 - DNA, 273 bp, Candida albicans
tttatcaaatttcctatcaccattacaaatatttccatgacaatcattacaacggacattgatctttttcaagaagtagcaaaacttccatatgaagttattgctctaatcgttagttatttaccgaaatgtatattgccacaattattgtatttccaacccattcaaagggaagtggcttctacaattttgtcagatgttaatgttaccgagagcatttatagacacaagggtagtgatattcttcgaccacggcggctggaagatccgatt

SEQ ID NO: 8438 - DNA, 222 bp, Candida albicans
tttattcaagttgttaatttttttcacctccccgacgggattgccgaacgaaggttagaatattttgttgataagatagagagaaattttgtaattagtgcacgctatactctcttacaaatctttcatacgaacagcaaaaaaaggggaaatccgtaccaactggacggaatcaaccatttcgtgtcatttgactttaaatataattggatactagtataa

SEQ ID NO: 8439 - DNA, 198 bp, Candida albicans
aacaacattctaaaaattattcacacattcttaaaatgtgttaatattcgcaacattatcaattctatgtgttcagaattggttgcaaagttatcaactcaattcactctatataaaacttacactttctctacatttttatatttttttatattggcttttctattagaatcagtcaatactttttttatcatttag

SEQ ID NO: 8440 - DNA, 234 bp, Candida albicans
aatccttcctccattttattgggctgggtttacttgtcacttttgaaaaacgtctcaagtgtttggatattttatacttttcgcctacaagttgacaaagatatgaaaggacagatgacaaccattactagttggcacaaagtgttaggtaataccatgcagaagaactcaaatattttacatcaattacacgatcagaagataacggaaggaattgttaaaccaaggagttag

SEQ ID NO: 8441 - DNA, 189 bp, Candida albicans
aaattatattacatggtaattaaaccgaaaccaacaacgatagaaataccgatagtggcaatcttagtcaacaagttgacagaaacaatgctggcagcagatttactaccacttgaaccagatgacgagctggaagaagaagaggaggaggaggaagaagatccagatccagagtcagaagtcgattga

SEQ ID NO: 8442 - DNA, 324 bp, Candida albicans
gtgcattgcttggtgttttcatttttggcacagtttattatcacagtgctcgagaaaggtggtaaattgttgttgatttggaatggtctttatgattcgagtgattggggaccttttggtgcctttgttattgctcctgttggtggggtgattatcacattggcttcagctgctttaagaattgctgtgctatatgcttacagtaaggttacaggaagggaattcactgccttggataaacctgttacagttgaagttgagaaccaagaccatacctacgggtccattgacgatgatgaatcagatactaaaaaggtggtataa

SEQ ID NO: 8443 - DNA, 510 bp, Candida albicans
ttcgatcgttggtccttccagccgcgtggtgaagatactgggtttcttgctgtttggtctggagatttgatagtaggcgatgaaaatggatacgatgcattttttatccttttgagcaagatgccaagatggttggtggcatttgtgctcatcttttgcatagtattatcgacgtgtacgtttgattccttgcaatcagctatggtctcgaccatctccaatgatgtttttagaaacaaattgcacatcaactatgtgagaataatgttgattttgataatggttccgattgttgtgttggctgtgaaagttgccgataacattttacaaatttacttaattgcagatcttgtttcagctgctattatcccgtctgtgtttttgggattggctgatacttggttctggtatttgagaggatttgacgtcatggctggtggattaggtgcattgcttggtgttttcatttttggcacagtttattatcacagtgctcgagaaaggtggtaa

SEQ ID NO: 8444 - DNA, 306 bp, Candida albicans
atattttctaataagtatcgtcgttttttttttcttggacaattagattctttaaaatttcaccaataccactctttaatgtctttcccccccctgttcattatcaattgctttactgatacatcagcccctcttcatttgttgcatctattttcccaacaacacataaaatgttcatgtataaataacaatagaaatgccgctggaattgatagtttattcttttttgtaatcaatagttttgttcaaacattaagcaacacaatatactataccaaaatttcttatgtcaagtggagattctga

SEQ ID NO: 8445 - DNA, 186 bp, Candida albicans
tgttcaagtaaaaacccaataccttgtaaaaaaaatgtgaaaaaaatgaatacaaataaaacaaataaagaaatgactgatttcatagtacataaaagcatgaaaaaactgaaaatagcccaagctattaaaaagaatccaatggcattttgtaattcttttaatgttggatcaacggttgcataa

SEQ ID NO: 8446 - DNA, 810 bp, Candida albicans
gaaatttcattcatgataaatcatcaatgtgaaaaagccttaactattttatttgataaactgacaacgccaactacttctatatccacagggacagggacagggaggaggagtataccattaacgatagataaattaatttcattatattttgaaattaataaaatcactgatgttgtacaaattcaatcaattcatatgtggaataatttaatgaatgaaaccatagcgaataaaattttgaccatactggaagattatttattaaaatttacaaaaattattattgataatgggaaatattatcgagaaatattgattttatatttaaaatttattaaaaaattgattaaattgacgaaacacaaagattcaccaccatataaagtgcttgaatatatatttcaaaatcttgataaagatcataatagcaacgatattttggatattaaatatttacttttacagcaggggagaagatatactaaagaaatgtttatggaattattgaaaagtttagtacatggagtcaatactactaatgttcttgaacaattgaaaactattgctatagttaatcaacaaatattaaatggagagttaatagttaataataatgatgttgtttatgaattattagtgaaaaattattttcatccgttagaaaatttattaaatcaattcatatcattattagaagattcaaaactacaagataataataataataataataataatcctaattgggaaatcaaaattttccaaaacaattttaaattttatcgcacagccgtgacagatccatgt

SEQ ID NO: 8447 - DNA, 291 bp, Candida albicans
atgtttttgaccccgtgcatcgaaaaactttcaaatttttttaagctttattcaaattcctccttctctctctcatcctacaacaaagccaattttttaattaaaaaatattttaaaaaaaaaattcctctctccgcaaatcttattcactcacttatttccagtttctctaaacaaacactttttcaaatgttcaaaacaattgacaaatttgctcctctttttaaaaacccccaaaaaactttgctaaaatctaaattcccggcaaatcaacggttaaaaaggataaaa

SEQ ID NO: 8448 - DNA, 228 bp, Candida albicans
ctagaaattcaagtggcgacagagttttcaatcaaaatctcactttttttttgccttctttttcccatgttgtttgtcgtgtttccattatacattgtcgtgcgagaacaaaattttgattctcctctagctactgttccattaaactttactgattctgtttcattctcggttggttatcttttactgaaaaggtttagattacaagtaagagtctatgaaatctga

SEQ ID NO: 8449 - DNA, 306 bp, Candida albicans
gaatggagatgtgttgagatgtgttggagattaatttccgatggtagaaaacactccattcagtgtgccagattagaacgagtaggtccactgggatacgtccaacacgaggtaggactgggagaccaaaaaaaaaaaaataatttaaaaaaggggggcgggggggtagactgggtattgttattgttaattagttgtgtgtgtgtgtgcctgtgtgtgtgtgttgctaattttataaagaaatttctctctctctctctcttttgtaaaagtgtaaacaaaaacaatgaacgaaccgaacgatga

SEQ ID NO: 8450 - DNA, 393 bp, Candida albicans
acaggctttcaaatcatgtttggagttggtaaatctggaacttttaaaccaaaatatggtaaaaacaacccatcatcaacgtcatttttaccactacctgcaacatttcatcaaattaatcgaaagaaacgattaccactaatattaattgtattatttattatatggtatatttttttcaattcatttttatcaccattttcatatttattttctaaatcaatttcaaaaattcattatcctcaagctcatccattaactagtactcaacttatagaaacttcatccaaatatatttatccccccattggaacatgccccaattattattaccatttaaccccgaggagattatttattgaccactacctattaagaagatggaatggataa

SEQ ID NO: 8451 - DNA, 237 bp, Candida albicans
aattatgcagtgaaattaatgaaaatttacaagatcaaacaattggatttcttgatttctattaacaaatttacatcgagtgatttaccattagaaatgagattacctgggaataataacaacaaacgtagtagtagtagtactactactactaatactagtatatgtaatagatggatcgttgataatatggtggtatctattgaaactcaacatttagtggaaaatctgaattaa

SEQ ID NO: 8452 - DNA, 333 bp, Candida albicans
  unsure (30),(34): Identity of nucleotide sequences at the above locations are unknown.
attggacgaatgatttctggtggtaatctngacnattctggtggtggtatattatatgaatttggaaacaatgctgatgatgatgatgatgaagccgttgatgctgatgaagattttgttttaagagtgtccatcgaatacaccgattcatcatcagtagatgccgatgattcagttaatgatgttggagtagatctatatgacatcacgctgggacttgatgaccttgatttgaatgaatatgtagtggacaaggaagtcaacgatattgaatttcttttcactcgatttactgttgccatgtcagttaaatcagaagtcacattctcttga

SEQ ID NO: 8453 - DNA, 231 bp, Candida albicans
  unsure (172): Identity of nucleotide sequences at the above locations are unknown.
atgggggtgggagagccgaggataaaatataaggcgacaaagaaacagaaaaaaaaagtagaacaatcggactgtcggcggcacgtattaccactaaaatctgaaacattaggcctcgatccttggatttatgttagtatttgtggaacttctcttcatagtgggaatgacnaaattgaaaaaaaaaagaaacaaagaaaaattagtaataatgaaaaaaaaacggtttga

SEQ ID NO: 8454 - DNA, 192 bp, Candida albicans
ttagtaattcccacccaattgattaagaaaataactaaattacagatcaaaaaaaactattgtaagaatcaagtttcttatggtatggatttgaaaaatttgtttctgtataccttttttttttgctgccgaagtgagtatgttgttgatggggagggggtgatgggattatgtgtcgtagtgttcttgtaa

SEQ ID NO: 8455 - DNA, 204 bp, Candida albicans
atcagttttccttttaaaaatgattcaaatcaaatcaaatgtttagatttttctttttctcttttctttcttactctctctttctctgttcaattatttaaaaaagcttacttgttattaaagagatttcaattccaatataccattttcaagtcattcggaaacaattgccctaatcacaacaactctttcactaccttttga

SEQ ID NO: 8456 - DNA, 306 bp, Candida albicans
  unsure (111): Identity of nucleotide sequences at the above locations are unknown.
atatcggttgagggatatgatataagagtgttaacctatagagatgggaaaaatggagcgttggtggaattcaaaccgagggaggggccaaaattgttagggggttttttnggtgtaaacaacaaagcccaggaagtggtaaaaatggggaagcttgtacaacgcccaattaataataagtttaaaaccttcaaaagagagaggggggaaggattaaaggaaaattacattcccaaaccaacgagacgattaattctatcaagactggaacaaaacccggaacagggtagtaccgacaaacaatag

SEQ ID NO: 8457 - DNA, 213 bp, Candida albicans
cagtttaataacatgaagcattcgtttgatacccctcaacgaggtaatagtatacaccattcatttggcaaccctaatgcatcaaatacaactcgatcgacaataaatattgttgaaagtcccgacaatagaggatcaataatagctacaaatgaaacatcatcttcgccggccaccacaaaaaaccctcaaagactcatgttcaattcttaa

SEQ ID NO: 8458 - DNA, 261 bp, Candida albicans
gctccagattcaagtaacttacttacacctatgttattatataatttttgggatataatttacaccttaaacttaacacacttatttacacgtcaagaagtattgacacatctcaaacatcgtgtaattgaaccaactatactcattatggttacaatctatatgcatttgttacgttacatttgtctaaaaatgaacagacttctagttggtaaaaaaactcaagttgaaatcggaaaattcggctgttatctaatataa

SEQ ID NO: 8459 - DNA, 192 bp, Candida albicans
gtaagttacttgaatctggagcttagtgccagtaatcttaaaaagaaatcaaaaagaaaatgtgtatattcgttcagatcaattcaggcgttattattgttgtactttacaacaaagttgcaaattgatttaattttcgcaacaagttttgacccaaaaaaaaaattatacattcgattaataatctattaa

SEQ ID NO: 8460 - DNA, 189 bp, Candida albicans
agacttttatctctatctttaattgtttcaaattatatgattgaagttattaatgaaatggttttaattggagaggggggggggggggggaggaggaggtttgttgaaaaagttgaaaaagttgaaaaaaaaaatttatccgccgccgtctggccctcccccaacttccatttgttcccaatcgggtaa

SEQ ID NO: 8461 - DNA, 306 bp, Candida albicans
ttttcacaacaattaccagcaaaccttaacatgtctttacttgcgagagtgttgcagatatcttcagataaacatctgacgaagaaatcatcatcagcacggacaactataactccggtgagttccagaacttcgcaggtatcgaagagttcatcctccccaccacaatcggtgaatcaatcacctcattctgcatacacattatccatcaacattgaatctccacctataatattatacggagctcctgttgattgtggaggtagaatctcacacagcggtaaacttgactcaggaggagaataa

SEQ ID NO: 8462 - DNA, 201 bp, Candida albicans
aattatacaacaaacactcttttttttttgttttttaccaatttaactactcaacccacactactactatatatacaacataatgcatatatcacacacacacacacacagactaacaatacatatatcgcatatatatatcctctaattctcttcaacttctctttccattttttcaagttttggtatttttttttttaa

SEQ ID NO: 8463 - DNA, 243 bp, Candida albicans
aaaacaaaaaaaaaagagtgtttgttgtataattctaatcaaaatgtggaaaaacttaaacttaaacggataatatcgtacaaaaataataattttaaaaataaaaaaaaaaaaaaaaaactcaataaattaaataataagcgtttatgcagctatgcctcaattctctacaaaatatttctctctctctctccggttacctccctctctctgtctgtaatctgcataaatactgaaaaataa

SEQ ID NO: 8464 - DNA, 249 bp, Candida albicans
cacaaaaatgaaatacacccaataaaaactgttgaaacatttatccgtcaagcttattcgatggagtacaacactttacatttcttccgaaacaataactatataaacccatgtaagtctcccctcttttgtttcaaacgtcttatcaatttttctcttcactacttttccaacttaacaatcttcacttataatctcaacgaatcatgtcgtccaagatcgaaagaatcttttctggacctgctttaa

SEQ ID NO: 8465 - DNA, 423 bp, Candida albicans
acgttcataaattgtcgaaacaataactgcaagtttagcatagtattaaagaatttagatcttataagctttgttttgttgtttatcacaactaacacaaataaacctttaaaactcaaaattcattcatctgcagttttgagtgtttattgttctaaatttcacaatttagtgtatttttattattcatttacatataaaatattaggcaaggaccagaaacagtacaatatacgagtccaaataaaaaggaagaccaaacaaaaaaaacaaatcaaaccaattataatctcaaatccgttccatatcaaatccatcttgatcattatttttgagccaccgagaatacatctctttgtagttaagtatgcttcaaatcaattgacaaaaaatgaaaacatcaactacaactacatatattga

SEQ ID NO: 8466 - DNA, 201 bp, Candida albicans
attattgtccattattacaacatcccaataagcagactgtggattgaagctaaattatttattgttatttacacggattttcggcaccccccttccggctttattatttatcttattatttcttttcattcacatattattctgggaaatgaattataccatatttttataatctggagtaagagggaaatgaggagttaa

SEQ ID NO: 8467 - DNA, 336 bp, Candida albicans
agcgtagcaagcacaaatagaaacaccattatgtcattgaacgtagtgatcataggtgtagaactggtgttggtattacttactacaaagaatctttcttttcggtacaaaggcaaaggaaacagagcaataacaataataataataatagtggcaacaactagaaaaagaagaagaaatgttattgattcagccaacgcaataagagagaagagctatggtattgttattgttcaagtagttaattgtgaattatgttgttggattcagttttcttttttttttttcaattgtattttgcaaatatttcttcctcttctgttgtactatatataa

SEQ ID NO: 8468 - DNA, 387 bp, Candida albicans
aagatgacttcaacaaatggacaacattcacaacaacaacaacagcaaccaggatacaatattgccactgcttcatcaccagcttcagctactgctgctgctgccgcaccaactaccaatacatcacctacaactgctcctggtatagtggattcaacatcgtctcacactactgctacttctggtgccactgcaaccgtcacatcacaaacagttattggctcacagcccacttcaacgacgttaacttcagacccatctactgcgttccatcatcacagtcaagaattcagacgagtgtgcttcagggagtctatagttggtagcagtggactcgctgctgcgaaagccaccgccaccaacggataccggtactggcactactaa

SEQ ID NO: 8469 - DNA, 216 bp, Candida albicans
cgaaaccaaattaaacccctatttatttattgtgacaaattctcgactaaaaaagtgtgggagacacaaagaggaataatacaagcaaacaacgacaataaccaactttttttttttctccatttgaattttgaattgaattcggttatacaatttcaacaacaacaacagatcaaaatttttaggaaaaacgaaaaaatcaccggattaggttag

SEQ ID NO: 8470 - DNA, 222 bp, Candida albicans
ccgatcacaacaacaaattacatgtgcatttattatgttttgcagaacttacaattgcccaaactttcatgttgctgttttattgtatcacctcatactcttcacaagaatgaatacttgtgcattactgaaacatggagtgacgaaaccaaattaaacccctatttatttattgtgacaaattctcgactaaaaaagtgtgggagacacaaagaggaataa

SEQ ID NO: 8471 - DNA, 189 bp, Candida albicans
tgggatattcacatggtgtccgcatttgaatttgatatttatagccatgaacaagatgtcgatctggtgttatcgaatgaatggcgagcgaatatattccatcaacaacaaatcgattgtcaaacatatagcgttttaccgcgagtacttttgtttgtcggggacagacaacttgatcaagatatatga

SEQ ID NO: 8472 - DNA, 216 bp, Candida albicans
ttgtatattgaaacacaaacaatttatcatttaatgacgtttcaaagcaatttatctagtctagaatactgctatatgataatcgagaagaattggaaagtatacactactagcattgtgacgcagtggaagcgtgcgaggctcataacctcgaagtccctggatcgaaaccaggcaatgctaagtattattatttttttaagtgtttttttttga

SEQ ID NO: 8473 - DNA, 192 bp, Candida albicans
agccattttctatttatgtatatgtttttatttatatcaataatagaatctaatgaagaaagattaaaaaggttgaatagtaagattattaaaaaaaaaaaaaaaggagttgttgttgttgttgtaaaatcaagaatagttcttgaatcatatataaattttttttttctgttttgcgatttcttcttatga

SEQ ID NO: 8474 - DNA, 297 bp, Candida albicans
aagtgtattgatttgagggaattttttaaaaaaaagatgggaagttcaaccaataatacacaatcaaaagctacccccagtgtgttagaaaatgaagtcaatagctcaaaatcatcagttgtttcatcaacgtcttctgctaaagggttgctacgtgaaaccactaatcatggtactatggaaacatcctcggttcagatatctgaatcagaatctcgtccatcgaaaatggtacttgtattaacacttgcatcatcaatttctggattgtctcaccacggcgctggaaaatccgca

SEQ ID NO: 8475 - DNA, 1077 bp, Candida albicans
  unsure (819): Identity of nucleotide sequences at the above locations are unknown.
ctttccagccgccgtggtcgaaaacaacttcaatcccaacaacgtcaatctcaacaacgtcaagccaatccacatcaacaacatcagcaaaattacttgcaacaaccacaacataataatgctcaactacatttgaataggaacctgcatcagttgccacaacaacaacagcaacagcaacatcaccattatcaacaacagcaacagcaacaacaacaacaacaacggttgcaattaccacagcagctacgctcctcacctcaaaacagatcatttcaaactcaaccgaatgaacagcagcgggtcaattctttgtcaagatccactgatgcaacgcctctactgagacaaatagtccttgatttcggcacttcggtaccgttacccacacaatctagtcggccaactcttgaagaacaaggatcgtttaatttaaatttattgcgtcatacaccaaacctacagactgttgcaagccatagtccttggtcacctgttgctacagaacctaagaatagatctttttctgactcaaacattgcggtagtgaacgggttaaatgaatccgatcccattgaagatagaccccttgcctccctaagtggaaggtcgaagtctaccaacaatatgtcaaaccataacaccagtaacgtttcctcctcgaattatcaggtatcagaaaagcaacaacaagtacatcgattgcagagtataaatgctaattctaacaagaaagaagatactgaagtcgaaacgacaactgatacaaatttacaacaaggtctgtcagctgaaaacaccacggacgagcagaattcnatcagatgcaatgtccaaaaaacaatgcttgcaatcaaaaattctgaccccagtcaaaaccatggacaagttgaggacacccaaaccaagaatagtatcaacggtactattactggagttggtgggaacgctgtttttgaaggaaacctgaaactccaaacaaactctgttcagtctcatagtaactcgccaaggaaagagcaaaatagtacttccgtggtaaccaaatggcaatcctcaacaaatagtaatcggtaa

SEQ ID NO: 8476 - DNA, 1350 bp, Candida albicans
atcaaactaatacaaccatacaaccacacaaccacacaacccacaacccacaacccacaacccacaacccatttcccatcaatcatgtcaatagacgatataacagacaagattttggatttcaataatagtagtagtagcaacacattatcttcactttctactggaaatacaagaattccaccgcaacaacgtaaattgtctcatttggtttccaattccccatcttccaaattatatcaaaaatcatttgaagatgacaacgttactaataatacatctgatatcaataataaacataaaaacttaaataaacctactaatgatgaattaactacaagaataaaatcaatacaacaattagctgatcgaacgatcgattctatattaaaaggtttaccccttgaacgttcatttggatatttgaattatgaattcactaaattatgtcgatataaacatgttgaacaaagtaagttgagtgatttaatttttgaaaaaataatcaatgattttaaaacaaatttgaaaccaagtataattgaaatcttacatgataattatcaagatactgactcaataatacaactggttaagaattttctaaacctatttactaattggtattttcgaatgtctgatttaagtaaagtatttatttatttggataatcactatcttgtacaacatcgtaccaaacatcccataatgctgtttgcaattgatttatttataaatgaagtatttgtggaagataaacaacttgcaaaaaaagtattaaacactgagttccaactactttgtaaatggagagaacaaatagaaatagaaatggaaattgatgatgatgatgatgaagaaaatgatttaattaatatggatgtgattgatcaaagcttgctgtttactacagtattggttgatttacacaatcaaggttttaaatttgatttcaatgaacaattattgagttcaataatcactcattataaccatttaaaaatatcatggcttaaaaatgacgctactacttatttatcaaaagttttaggaacaatcaatgaaaatttgagattttttaaagcggttggtaaaaatattaattttatcaaaaatttatttaagaaacttcgatggaatttaatattttatgatttcaataatttattaccaaaagttttaccttcattattaaagaatgagcaagaattaggtattatttatcaatattgttgtcatagtgttgaagattttggatatgattctattctgatatttatatatcaatggggggtttacaccaaatcagtgtttgaatctattgtggatgtctatgacaagttcgactaa

SEQ ID NO: 8477 - DNA, 216 bp, Candida albicans
  unsure (204),(205),(206): Identity of nucleotide sequences at the above locations are unknown.
aacaacaaaaaaaaattagggaggttagagatcaataaaatattaaaaaaattgtccaaatttgaaaacgaatcgactaatggaactaatatatcaacagatatctgtgaaatcgaaataaaagaagataatgtcactggaaagggaaattgcaagtttggggggattcacttgcaaagaaatgtagtggatagagaaatgatnnnagagagttaa

SEQ ID NO: 8478 - DNA, 432 bp, Candida albicans
ttggtagggatatcatcattttcagctatggaattgaattctattttgggagttgtgctcgatactgaagaagacgcagttgaggttgcaagatgcaaattattgaaacatgagtgtgatgatttcgaaaccacttcagtccttgaacgagtcagagagtttgtaaattgtttcgtttctgatttacctgacgaaggaataacgaaattagatggatttctcaatggtgctcgagaaagatttgacgatggagacccagatgttgcttttgttttggaaaaagttggcgatggtgatttggaattattgtctaatgtctttgaagatgattttctcaatgcactttttctcatcaaaataggggaacaacaattagcatcttccacatttgtatcatcctgcgatgccgctggtgaaaaatcctcaaaatag

SEQ ID NO: 8479 - DNA, 579 bp, Candida albicans
tcaattatgttacataatgaagactttatcccgaattttctacaggattcttcatcagcatctatgacgcatacgttacgcgtcaaacgaaatcgaccaaagagttcctattttgaggatttttcaccagcggcatcgcaggatgatacaaatgtggaagatgctaattgttgttcccctattttgatgagaaaaagtgcattgagaaaatcatcttcaaagacattagacaataattccaaatcaccatcgccaactttttccaaaacaaaagcaacatctgggtctccatcgtcaaatctttctcgagcaccattgagaaatccatctaatttcgttattccttcgtcaggtaaatcagaaacgaaacaatttacaaactctctgactcgttcaaggactgaagtggtttcgaaatcatcacactcatgtttcaataatttgcatcttgcaacctcaactgcgtcttcttcagtatcgagcacaactcccaaaatagaattcaattccatagctgaaaatgatgatatccctaccaactatgactttgatcttcaccaggcggtggaagatcaacgt

SEQ ID NO: 8480 - DNA, 192 bp, Candida albicans
  unsure (160): Identity of nucleotide sequences at the above locations are unknown.
aaagataatggcaaaaaaaaaagtttagccaaacacgcactgaactttatccatcggaaaaatatattattgagagaactgttaggtgtgtggaaattgagaaaaaagagagacagaaagagtagaagaaagaatatattgcaggagagaaccaactatnttaactccgggatgggcatcaagcttggttat

SEQ ID NO: 8481 - DNA, 816 bp, Candida albicans
caacacaacaagttggtgatgtctgaactatattttctacgtcatggtgaacgaattgatcacgcattacgagaggatccagatgcaaagccaatattggaagattataaaccatatgatccatcattatcacaaaatgccattccacagatagagaaattagtggatgaaatttgttcattaactcaagcgttcactgatttggaatctacacaacgtaaaaacgtctttattcatttcagtccgtatttgagatgttgtcaaactgcagatctattaataaccgacttgaaagcttcattattgaaaaagtatcccaattataaaatgagatttcagttgttatgtgattttgccttgagtgaatggatacatgataaaatgaaaaataaaccaccttttgtcgactcagatgatgcatataatatgtacacccctaatttgaaatcattgaaaaacaaaagtgcctgctcaatgtttaggccaactatcacattaggtcaatataacggtcttgatctaagttacaaagattatcaaactagatgcaaagattatttcaagaaattattggcaacatatgaaaaaccaatgtatatcaaaaacaaagacatcattatcgttgtaacacatggatatgcagtgaacaactttctatcttactttatcaatcatccgattttcgaagaacttcctgaagcaaaagcaaattttgctaaaagagttttgaaagatgatatcaaggatgtcgaagacgagaatgatcctgcaaattatacttggaaattggtacacgatgccttgggatttgattaa

SEQ ID NO: 8482 - DNA, 186 bp, Candida albicans
ttagaagaggaactcttatgtaaacaacaactacgactaaaaaatttcaaaccattcgtttctttgttaaaggattggcaatacgaagacgaagaaagaaagaagaaaaaaaacaacgaacgacgacaacgacaaccacgaactcaaaaaaaaaaattgttcatcataatcaactctatcaactaa

SEQ ID NO: 8483 - DNA, 279 bp, Candida albicans
gcgttagttggacgttttggtaaatctggatctctagctttttgtttacccattgtggtactagcaacatctgatggaccatttgatgattttgatgaaccggaagctaaagcgattttcattgctgatgatgatgttgttgaggatgaagaagaagatgatgacgaagatttggattttttattaccggtctttgattttactaatgaatcatctaatattgtgggtgttggtggacatgccatttcttcaaaggcaacaataccatctggcaattga

SEQ ID NO: 8484 - DNA, 198 bp, Candida albicans
tccagactaatacagtttacaatattgaataattttccaccaagccatatgaatattgggttattgaaaaaaaattttttttgttatcgtgagataaaaaagtatctacaggatgaaggttgcaagttactttcacaaataaaaaaaagatggagagattcaaactttgaaattaaaactggtgggtatccaatttga

SEQ ID NO: 8485 - DNA, 213 bp, Candida albicans
cagaaatccggttctcaaagaataaggatgttgccaattttcttttggtccaatatgaaatcatttcgatctaatcagaaccatttgaataccttgtcacccctccttattaacatcaaaaacactcatctagtaacattcacatttgccaaacctgtgaaaacaactatatttctaattgatgggatatatataataattatggtaatataa

SEQ ID NO: 8486 - DNA, 450 bp, Candida albicans
acaatgacaacaagtccaaccctaacccccgtcaccatgtttagattaaaatcattgtccttgccaatattgaaaaaacgaaccaccggtatcactccatttttcagtaagagattaatatcagattctgttggtaatggatcaaaaggtcaaccaacatggcccctgtttcaatcattaataaattcattttctagagaaagtataaaattatttggttggtcaatggccttactggtggcattattaatttggccggttgggataattgatttatctaataaaattgatcatgtacctaaagataaaggtgcacaagtacaattacatcgaattgaaggaacaattgataaatatgaagctgatgttgaaatcccacaaacttttgtaagtcttgataaactggatgaagaagaaggtgaagatgttacagttgatgatgaggaatag

SEQ ID NO: 8487 - DNA, 201 bp, Candida albicans
gaaataatgaatatcattgaatgttgtatacatcggaaagattatatacatgaacatagaactgaactgccaagttcattctatttcacattcaacagtggcaatattcacaaattactcagaagaaaacagatgtatcaggcattggctaaaacgaagatagtaaaaaggctgcaagataatctgattttcccttggtaa

SEQ ID NO: 8488 - DNA, 345 bp, Candida albicans
ggccattttaaaaatggacagattgcttctaagcttattatatctatcggtgagaaaatgttgtttattatgagttttgtcatagtgggatatcaattgatgtctggctcgatttcaaaagtgttgccaaaaaaaagtcttgctgtacaaggcgaaccttgttgcacaggaacgaccaaaacttggcaacaacaacaaacgcgtcaatttaatatttatcacactattataattttaactttcgcagaaagaatatgcgaatttcttgcaggtgtgcctagacgaaaccaagtctctctctcctattttctaaaacaaataatgttcattactgacgatcattag

SEQ ID NO: 8489 - DNA, 198 bp, Candida albicans
  unsure (38): Identity of nucleotide sequences at the above locations are unknown.
aaaaattatcattaccgaacagccaagtttgatcaaanggtattactgatggtatacttgcctttgattgtggccgttgttgcatattggtcctattcaatgttttttcccatattaatgatgtttaagaaattggcagaacaatatttaattcctcccatccgaagaagaaatatcttgaaaacaaatttattttaa

SEQ ID NO: 8490 - DNA, 258 bp, Candida albicans
  unsure (169): Identity of nucleotide sequences at the above locations are unknown.
gtctattccaaactatattctggatgtaatggttatctttttttatttattgatgattggatggtgggaaaacaagaacgagccgatttgcaacaatacaaacaaattatctttacagtctctatttccattttcatagtaatatccggtatccgtttcggtagaacangaaagaaacattcaaactcgaagtcttataaaaaatacttgccaaggaacactctcctattgttgtggttagttccctctttattgtag

SEQ ID NO: 8491 - DNA, 294 bp, Candida albicans
cttgcacattctaatatcaaacaatttttaacacttccttttaaggaaacgagacgagctattgtgttagaattggtagtctttatttttttgatactcatctactcctcccccttttgcaaacaccttttttattctaaatcaggtttgtttcctagttcaccacataatactcttggtgttggtttgtctttgatatttttcttttgctacctctctaattcattccctaattttttttttcaggtagtgatagcaagaaaagagttggaaagatttgtggcatgtgtataa

SEQ ID NO: 8492 - DNA, 219 bp, Candida albicans
aagaaatactcagcagaatattactatacgtatacacatatacacacggaagcaactttactcggtagtggtagcaaagtcgataaaggtgtagtgaagagaacccattacacaaatagaagaatacaccaacccacccacgcacccatcacaatcacaattgttgctgtgcgtgtttttgttttcagcacctatacgaacaatcttgctttagcttga

SEQ ID NO: 8493 - DNA, 537 bp, Candida albicans
acaatgcctaccttgaaagttgcatacattccagagcacttttccacgccactattctttgctcaacaacaaggctactacaaagcacacgatctcagcattgagtttgtaaaagtccctgaaggaagtggaagactaattaatttgctcaattcgaatgaggtagacatcgcaattgggttgacagaagcttttattgctgatattgcaaagggtaacgaaaatattcatgttctagacacttatgtcaaatcacctttattgtgggctgtcagcaccggttccaatcgtgacgatgtcaccgacgcaaagcaattaaaaaggattggggtgagccgaataggatcagggtcgtatgtgatgagctttgttttggcccatcaattgggggttccttcttttgaccaatttcaggtcttatccaatttccagaatttacgggactctgttaatctgaacgacggggtatataggtcagatgcattcatgtgggaatactttaccacccaaaagtaccatgataaccatgaaatctaa

SEQ ID NO: 8494 - DNA, 315 bp, Candida albicans
ttccatgctatggcaaaacttattgatttatcaacgaataaagtaacatatgttgtaaatgaaccactcactgggaatgcagtggctagttctgccaaactagacatggttgcaaatataaccgacccaacaaaaatccatacaatcaataaacccaagggtccagcatgggccaatgagctaccagaagatataagtagaccgcttccaattgatgcacctaatgatatccatgtcaaatgtcttgttttcaatcgtttggacaacggtgagcttgcagtaatcaatgcatctctttctaattgtgtgaaatga

SEQ ID NO: 8495 - DNA, 321 bp, Candida albicans
actcggccaactcgtggcgttgttaaatactttcagcaacagattaatggggtttcttatccaaactatactggtgtttacataattcgcaaaaccattgatcccgctgaatttttattcaaagagttgttgatggaggacgagctaggaaatgctgtaaagactgtcaacgggccaagtttcgctgaatatttaacaagtctacataaggctattcgtgtcaaaatagatagtgataagtcgtcgcaaagcattagacaattggtttcaaatgtcgaacatggcaatgaaaccttagcgcaaagatatatacacttttaa

SEQ ID NO: 8496 - DNA, 243 bp, Candida albicans
attttatatatattcttcctctttttccctttcttcttcacaacttctatttatatccctccaccaataaaaagaagaaattatagaaaaatgttgtcagctcgtcctgttttacgtactgctgctcgtacagctactattgctgccagatcatctttaagagttgtatgtattgaacactattcgacatggaaaggagcaacagaaatagagacgaatccaatgcaatattatttccattaa

SEQ ID NO: 8497 - DNA, 252 bp, Candida albicans
atagaagttgtgaagaagaaagggaaaaagaggaagaatatatataaaatttatgttgaaaaaaaatttgtagaaatgaaagaatctttagtgcgagaaaagaaaaaaaattgtgtcttgtttctcaattttcattggcactttaccgaacaaaactctccttcgcaatttgattggtcgacagaaaaatgcgcagtcacgtgccctcaagtgttgaatatggataaacatggggtggaaagaaggaattga

SEQ ID NO: 8498 - DNA, 240 bp, Candida albicans
  unsure (156): Identity of nucleotide sequences at the above locations are unknown.
ttaactgatttgatttgggaaaaaacaaattttatatttggagaattgaatttcaatcattttaacaaattcaaagctttaattcccacctatcaaatttcattattattttgttgtcattattttttttttccttttctttctttctttcttttntggaacaaagtaatagccgataaaataaataattcacatagcccaattcatattacattgacttttgacaagaggtatatataa

SEQ ID NO: 8499 - DNA, 210 bp, Candida albicans
actctttctctctttttctttctttctttctttttttttgttctggtgcgtgtcatatatataactagtagtgtacattgttcaaataacataaaaactacaataagacagaaaagagtaacagagagtgagagagtcaaatcacacacaatagaaaatacacctctacgccaatacttggaaatatacaagtattggagtttgttttag

SEQ ID NO: 8500 - DNA, 405 bp, Candida albicans
atagagttttatagtgatgtcattttgttatgctattattgttgtaaacgtgtagtgcaatgtgaaattactctgtccaataggcttactatattacatgtggattacgtttataaagagtggagcacattaattctaatagaaagacatagacacccttatccaataggggagtttttaattttcagtttttacttagtgtgtggttcttgtgtgtatgttgatttgttgatagtgaggaatttttcaattgctgcttccatttctaagaagggtgaaaaaaaaaatgaaacaggaaaaaaaattttcctattggtcccccgaattttatcttttcaacaaagatatatatatattctactactattactgttactagtcatattctttgaattgcattgctaa

SEQ ID NO: 8501 - DNA, 1182 bp, Candida albicans
ggagcgcggttccttccagcccctgtggctgaagaaaaaagtaaatgtggtaaaatatctatcaaagatttagaaagttatattttcaataatagcaatgatagccttattgataaaactaaaatgggtgggaaaatcatttatttagatttaaaaccattaattgatataaattccataaattatcaaactttggaagatttattaattttcaaaaagattgatttccgatttcttaataaatttcaattttatattcattcattaaatgttaaacattggcaatttccattatttatgagtccatttttcataagatttattaataaagaaaagacaaaagtggaaattgatgactggaatcgaagaattatggatggattagatttggattcaacaatgatatctgcagcaacagcaacaacaacaacaccaacaccaataactaataataatcataactctcgtgtaagaggacatcatcatatgataactaaaccaatcaccactccaattatcaccaccaccaccacaaccaccagtagcagcaattcaagtttttcaccatttaccgttgatgttaaacatttttcatatattattcaaaatttaaagaataaaatccctggatttaatcaatggcaaattaatcaacaaaaaattttttttaacaatatcaaaaatactaattttcaattcactttaaaaggagttgatgaaaattgttggtttaaaaattttaattttactaaattaaatttgaaaacttattatttatatcaagatgattataaattgattaatttatttaattttaataatttaattaaattaactattgattttggtcaatcaccattgaattttatacctcattggtgtcaatttttacaaaatttgaataatttggaaatttttaatttaaatattggtaaaatttgtttaattgatatttgtttgattatattgaaattgaatcgattgattgaatttaatcttaaaacatttaaatgttggactcaaactttttggaaatggttgatattaaaattgattaaacaaaaatatcatggtcatcattgtagtagtcataaactgaatcaacataagcctaaaaatcattgttcaagcccagacaaaaccaaagaattcaaatttacaatgcaatttatagatagttag

SEQ ID NO: 8502 - DNA, 261 bp, Candida albicans
  unsure (226),(234),(249): Identity of nucleotide sequences at the above locations are unknown.
ccgaaggaacggaggaacggaacgggagaagagggacaacacccaacatcaaccagaggaaggagaccaaatatcaaaaaaaaaagaagaaaaaaaaaacaagaaaccaaaaaaaaaaaaaaatctccacccgagaacgaagatctcgggaggaaaaacaaaaacaaaacaaaagaaaatacaaacacaaaaaataaagaaagattagtcacccggtccggccccntacgtttncgacgagccgaacgngaaaatggcatg

SEQ ID NO: 8503 - DNA, 183 bp, Candida albicans
  unsure (11): Identity of nucleotide sequences at the above locations are unknown.
gccagaaactntgttccatggcccgcttgtgttaaggcaactaatggcttgtatgtagcaaaaacactagcattagccactgataataatgcagacaaaatgacagcattgaaaatagaaggcaagactttgattccacggttggaaattgcaattacaaagggtgaacacaggccaatttga

SEQ ID NO: 8504 - DNA, 219 bp, Candida albicans
gatcaattttgccgcagagtgttcatttgccgcaaaaaaaaaaatggcaatgttaacgctgccattcatttattcgctagtataagtccgatgcatggagatgaggcaaaaaaattaaaatatgaccagcaccaattagctttaaaccaacatcactatgcctgttccaatgtaaagttgaaactagagggaagagatgcatttagctgcactctttaa

SEQ ID NO: 8505 - DNA, 321 bp, Candida albicans
tcttgtaattattgtttcttcaatgtcatggtaccacccaggaggaaaaaaccaaagtatgaaccagtggagataaactcatcttttgatgaaatatcatcggattcacaagactcttcgtcttttgagcattggtcgatccaaccaagtccagtcaaaaaatcacaaaccacaattaataacaatcaacaatggatagataaatatcgaccgaaaaccactagtgaaatctgtattaatccgacaaaattaaaacaagtaaaagaatcgatgatgaaaatgatcaataaaacttcaaacaccagagtattggtgctatct

SEQ ID NO: 8506 - DNA, 1647 bp, Candida albicans
ttagtagtaaatattttcctatcttttgtgcaattcaataagagtaaagtgaagtgggtatggaaaaaaaaaaatatatatatatatttcaattcatcaatactcataatacttgatatatcccattcaccaatccaaccacttacatctcctatcaatctcatgtttcgtcgaatacatcccatcttatctaagcagagtaatgctttacagacattgaaatctggaatcatattcagaccactatcatttattacaaaacctacaacactgacaacgcttagaaccacaccaaaaattatatcacacacattaattcaatcacgaactttaatgtcgacgaaaacaactaatttaggcccatttaaattcacattacaaatattaactggtgtttattgtggtttacttattgttagttttggtctgtgttatttattatatagtgatgccaatcaacgacaaaatattccatttgaattatcattagatgatcatattaatgctgttatggccattaataaggatgatgtatgtgaatcaccacgtcatgcaacaaaacattatcgaagattattgattgatttagctaaacaagagttgggcgacaccaccactattgatgaaagtaaatttgataatcgatatgatgtaccgatattatctacggattttttaattcataataaatctatcaaatttataaatttttatattgatatgattttaagatatagtaaatgtttattatcaaagggggaattagatattgctattaaaatgttgacaagaattgttgttgatgatgattttatatttttcaaattaggtgatgctgaaaaattatctagtagtagtcgagtattggctaaaattactcctgatattactaaaaaaatatctatattacaaagatcaattgatatgttgattgaaactaataaatcaatgcaaattgataatgattatatcttgttagaaaattccaaaatttctgatgaattaatcaattgtttaaatgatttagcatctaatttagctaaattatctcaatctcaatctcaatctcaatctcaaggacaacaagaattattaaatcaatcattacaaatttatttatctgaattaagatcattacaaacaattagactgaaaattgaatccaatcaagcaaatcaagctacatacccacttttcaatgttgatcgagccaatttaattggaatgattaatactatcaaagctcatattagtgaaatcatgtgggttaaaggtcataaagataaagcaattaattttctggaacaaattttacaagaattatattatgatcgatattctgatcctaaatttggtcccatattattaaatgttttaaataatcttgaaattatgtatcataatttacataaaccagaagatgttaaacgttgtcaaaatttaaaacatgatgtatccatttatgaaattcgtaatcgatttgatatcccttggtatgatcgagtaatgaaaagaattagtaaaacaatttatttacgtactccaattggattagttgacaaaggattaagagatagatttgaaccaagagcaagagttaaagaattagatgaatttgaagatgaagatgatgagaatagaagttaa

SEQ ID NO: 8507 - DNA, 366 bp, Candida albicans
tcaccagtttcatctataaattcaagttcagaaaagaaacatgacaccaaaccaccaattccaccaatgaaaagaaataccacattaaatgatattaaattatcatcaccatcacttacaaattctataaagagtgggaaagttttaaaagatgatagtgatgttgatacaatgaaaaaacttgatgttaaaccaatgattcctaaaaaacctgaaaatttgaaatcaattcataaagatggaaaattggacaataatgggaattcaacatctcaaaacacaaacggtggtgaaagtggtggtggcggagtagccacacccaaatcaatggctagttggcaaccattagttcctggtcgtaaatag

SEQ ID NO: 8508 - DNA, 282 bp, Candida albicans
tccaaggatttcagacagttgatatcaaaaaaagaaaaagaagaagtaaatgaaaataaccaaaagaattttttttcatcctccatttttaatacgttgcactttttactcgacgctattgttggtgaatatattacacgacccactgaaaagctacatatcgatgtagaagatcagatcaaacttaaaattggaagaattatatgcaggttgctttcaaaactcaattactcattattctcatcaccatcaccaagtttcaatcaactcatgaagttgtga

SEQ ID NO: 8509 - DNA, 228 bp, Candida albicans
ttaacttatcccggtccttttttttttccttctttctatacgtatcaattacgaataattgagaaagtatggccaatgaaagaagaagaaaaaagagatcaatttagtaattataatcatttcgactgtcaaacaaggttgaaatggttccttattttaaaatatgtttatgaatatatgaattattgttatattttaatgacaaagaaatgtagatttcatcagtaa

SEQ ID NO: 8510 - DNA, 1449 bp, Candida albicans
ttaggcagctggttgggcacggttaaatcctatcaatggttatattcatctaaagcacaaaaaaaaacgttgtcaactatactaacttttgtggatgagttgaactcagaaatgaaagatttgtgcagtgatttgcctgggcccatggcgatactattttatgatgagccaggatttctatcaaattcagcaataaactcagaaattttgttgaacctagataatggttatgagaatacgttgatgattcaattcgagtatttttcacaccttttgacaattaatcgattactgttgcaagaatttcctcaagatatggataacaaatttttgactcgtagatgcttacatcacaaaaacattgccaatagatcagcaagaactatactatatattgccagaaatttagcagaaaaaaaggtaaactttattcttataaattggtttagttattctatatttgctgcctttgcccatcttggaagtatgtgtcttgaagacccacaaagtccagaagcaatatcagatattgatttattaattgacatttcctattcgtttttagcatttgagaaccaatcattcaaggtaagtcgattttcattaaagcgatatgtctacgatatttatactcgatgtattctaaaattgtatcttaaagttgcaaatgaagaaacacggaatatgtttcatgaaaagtataagaatttgcataatcatttacgattggaggaaacgtttcatgaattttttgtcaatgaaaagttaggtttcgatccaagcaaaacttatcaggcattaaataagttatttcgaccattttggataaattctaatgagagactcaattgtactcaagtcaatgctgctgatgatgctgctagcaatcaaacgagtagtacgccattggaatctctgtcatcatcaagtggtattctatatgggaactcatcatcatcatcgacttctttccaaccacctatagttcatcaaagaagttcagtatcttctcacaggtttgattacacacaagactttccgcataattgtggaaaacctcttgaaatttcctatctagtccatcctcaaatgaaacattttgatgctgccattgattcggcgacacaaaggagtggaagttctaatgataaggaattaccagaaacatttgatctactggctattagtgccatcaatgcagctcaaatgcagcagcgacagcaacaacagccaccattttttactcctccacctcatcctccactaccagaacaacgagatcaacaacccctactattatcacaatatcaacaacaaccggagcaacagccggagcaacagcaacagccacgtagtaatcgattcaattcaaactttactagttttgaagaaatgattgaagagaattatgcgggtgacttgaactttcctaatatgttttataactga

SEQ ID NO: 8511 - DNA, 348 bp, Candida albicans
aggacactaataagcccgaaatggtttctccattgtaaaaaacaagcttcatttatagttaatcaagcattagatgaatgtaataatgttaaacaaaaggcatcaatgatatttaataatcaaaatgaagaattacaaacatttattaaatcatcaaatgataaattcgatgtattggcaaaacaaactaataaattttttaataataattttaaaatttttgaaaaaaatgatcctcaaccaaataatattgctgatagttcatttaatattgaaaatcttgaaggagtgatatatgaaagatcttttgaaatagatattgatgattatgattcatctattgattga

SEQ ID NO: 8512 - DNA, 207 bp, Candida albicans
aagttttgtgctggtggctttacaagtttgcgttacaaaacgaatcaattacgacgaaagggataccaaatgaaaatcaatataaagatagacacaccaacggtaaataaattaattactgatccaaatgtggggaatattaataatgtacatcttaaaatgatttactttaaattacaattaaggtcgtttccttttcttttttag

SEQ ID NO: 8513 - DNA, 516 bp, Candida albicans
actatcacaatgagattcgctttcacaactgtatcattatcccttttattgtcttctttagttgcttcagaagctgcatcatccgatgttcaattcttgactgctttggtaggtgattatcaagatcataagaccgattatattaaattttttgccaccgcaaaagatgttccaggtgatttatctacgttggctaccaaagtgttgacttatactgatgattcatacacaactttgttgaatgatgattctttgaatgtttccaacttagaagcatatgctactagtttgccatggtattccagaattcaagctgatgctggtggcaaaggttctgcctccggttctgcctctggctctggttctgccaaatcaactgcaagtgctgaaaaatctagtggctcaagtgcttctgcttcaagcactgcaggtggttcctcttctaaaggtggtgtaagtgaacttgttgcccctgttggtgctgttgttggtgctttggcagttgctttaatgtaa

SEQ ID NO: 8514 - DNA, 246 bp, Candida albicans
  unsure (1),(2),(6),(7),(10),(11),(12),(13),(14),(16),(17),(18),(19),(20),(22): Identity of nucleotide sequences at the above locations are unknown.
nnttcnnttnnnnntnnnnntnctgggggggggggggtttacattaaagcaactgccaaagcaccaacaacagcaccaacaggggcaacaagttcacttacaccacctttagaagaggaaccacctgcagtgcttgaagcagaagcacttgagccactagatttttcagcacttgcagttgatttggcagaaccagagccagaggcagaaccggaggcagaacctttgccaccagcatcagcttga

SEQ ID NO: 8515 - DNA, 213 bp, Candida albicans
aatatttgcacggcatttcgttcgtttctaacattatttagtgtgtggattaagggcatacaacattatgaagcaaaaatacacgctattcgttcctctaatgttggaaatcatgagttaatttttggctatgttgagttgctacatcatcataattggttggactttgaaattagttttattgtattgcctaacaacattatttacacatag

SEQ ID NO: 8516 - DNA, 282 bp, Candida albicans
cgttcggttgtcttattagtcaataattgtacaaacgaaaaaccaacaagccaacaacaaaaccaacaaaatctacttgtaaagaatagtatatacagactgatgatacatccactaccactaatgctgcaaggattgcctgtttttttttttttggttttgtttatattaccatatcaatcaattaatgaattaaagggattccaagaattcaccaccacctcgagttttatcaagaaaatattattaaagggcaagttcattttcttgatatcaaaatga

SEQ ID NO: 8517 - DNA, 207 bp, Candida albicans
aatccacgaagaaaaaaaaagaaaaagaactctcacacaaccgaatcattgatactttttgatttattcaaaaacttttacacacaacctcctaattatcatcatattcaacaagcccaattctgttttccctactcatcactacatgttgactcactcactcacccttttgtttacaccccaataaattctcatatacaaagctga

SEQ ID NO: 8518 - DNA, 210 bp, Candida albicans
ttaatatttacttcaagggcattcacatacatacatataaacctttttttttttttttaccttgaattacccaacaaaacaaacatttcaagactcaaaaaaaagggcaagtttaaggaagatacaaagtttctttttatgtctaaccatattgtttcatttagttatttattggactataaatacctcataaattggatacatcaatga

SEQ ID NO: 8519 - DNA, 201 bp, Candida albicans
atgtcaacttcaaagttgaaaacaaagattagcgtgtttcaattttttttttttttagaaattcattttaaccaattaaagaaatatcaattatcagttgtcaatattaatattaatattaatacgggaatgaaattaatgcaaaatggtaaaattgaatatcataatcaatctgtaaaagcctacaaattagaatgcttg

SEQ ID NO: 8520 - DNA, 198 bp, Candida albicans
gaatgtcatgtgacaaggcctgtttccacctcccaaaaaaaaaaatttacaaacagccttgcaaaaagtcttcatttagagacgcgttttctaatagatattataatcttattccaatcaaaccgcggatcaatagagttaatgcttttatctactttagataatcttcaccacggggctggcggatccgccgcttaa

SEQ ID NO: 8521 - DNA, 387 bp, Candida albicans
atttcaacgttgcacataaaaactaatcactacttccaaaaccaaacttctaacgatcacgaacaccgaaataatatgaagtgggtcaatttattaagttggtctctgttatttatatctatttttgcattaactgaatctgactcaaaacataaacatcaacaacgtcgtcatgatagtaatgtttatctattgagcaatgggaaagtggtttctaatgatgataccactttattaactaaacatgaagccatgacttatcttgacacatttttggaacttgatgaaccatatgtcaaattgggtgataatgatcaattaattgatttacttaatggattatgggatactaaaaaactaggatcccctaaattgattgttaatgtc

SEQ ID NO: 8522 - DNA, 225 bp, Candida albicans
cgaagatttgataaatatgaattgcgtttaaccggctttgatttggttcctgaacgagtagttgtagttgacatgttgcaaaaaaaaaagacaaacaattataaaagtattaattatcaaactgataactacaaatactttagaaatactgactatagaacaagaaattcgtttaactatttatattcaaatttaaaggcaatcggtatctgcatatatgcatga

SEQ ID NO: 8523 - DNA, 390 bp, Candida albicans
ttgtttgtcttttttttttgcaacatgtcaactacaactactcgttcaggaaccaaatcaaagccggttaaacgcaattcatatttatcaaatcttcgtcatttgactaacaaagatgtaaccaaagcagcttatacattgttagaagcatttgctgaagacgatttagctaaaatgtgggtttgtcatatagaagataaagctgaacgtcagttatgtgaacttactttatatgaagcttatattaaacaacacattgccaaaggtattgtcattggtcaaggtgaaactgaatctggatttgaaactgtatcgatatggtcacaccctaaatcggaagaaggagggattagattcgtacacaaatttaatggaggctggatacggtaa

SEQ ID NO: 8524 - DNA, 282 bp, Candida albicans
attaattcatttaatcaagaattatttaatttaattaaatcatcaaatgataatatattaaattttgccaattatataagcaccaccaacaacaacaataacaatacttcccctaaaacttccaattcaaattcaaattcaaatttttcatatttaataatcaataataatccaattttaaatttatcaatttgtcaattatttaaatttatcaaattacataaattaatcattgataaattaccccctccaacaacaacaacaaaaacaacaataacataa

SEQ ID NO: 8525 - DNA, 231 bp, Candida albicans
acaacaataacaaaaacaacaataacaaaaacaacaatatccaatgatcttgatattgatattgatagattgaataatcaattatctatatcatttaatttattgaatttaaatttacaaaatttaaaaattggtaatatgattaatcaaattttacaaaataaatttaatcaattatataaatttcgatcccatttttcaccttgggatgaacggtacgcgaatgagaac

SEQ ID NO: 8526 - DNA, 264 bp, Candida albicans
ctcgaaggattgcagaattgggaaaaaatattagataacccaagactaccaccacatccaataaataatagtagcaaattggctttaaaatctattgtatatgctccattattacacaaaaaaagttctttatattgccattttaagggtatagtaatcttaaagtggggggggggcacttttttgggggagaaagaggggaggaaaaagagatcagaaatacctgttactggatattctcgtattgtattctcgggtaaatag

SEQ ID NO: 8527 - DNA, 243 bp, Candida albicans
gaaattgttgatttagattatgttaaagatactcctgattgggctgtttggggatcacaatgggcaggatttaatcctgaaaatactaaatatgatagaaaagccgaccatttgaaacagaaagctataacagatgatcacccatacaattatttgaaacgccaccaactaccactaacaactccaataaactgttcctgccctaaacaataccatttgggtttacactgttgggttggttga

SEQ ID NO: 8528 - DNA, 246 bp, Candida albicans
attctaattctattcctccaagttgttgttgttgaggtgtttttgggtgatttgaagtttatttcagctttcacacgttgttacagggacgtgtttggtcttctaattattaattattcttatatcacccccttttctttgtcttttgtttcgcaactatggctttcccaaatgccccaacaatacaccgtgttattctctaatcataactataaatcatcaactattattccagtgtttgattaa

SEQ ID NO: 8529 - DNA, 267 bp, Candida albicans
atcaattatccaatcatgttgtcacagatcactagatcatctgttagaggtatcagattattctctggctccagaattgctttaactgaaggtgccattcctcaatccaaagatgccttctccgaaaaggaaagagctcaagaaaatgtttacatcaagaaacacgaagctgctcaattgaagaaattgaaagaaaaattacaacaacaagaagaaaccattaataaattggaaaaagaattggatgatcacaagaacagtaaataa

SEQ ID NO: 8530 - DNA, 192 bp, Candida albicans
acatggctggatcaatttgatactcaaacaacaagaacaacaacaaacgcaatttttcaattatatatatatattggcaactataagctaattaacctaaccaaccaccagcagtcttattcacatactacttactgttatggtaataacaaccaagaactgttttttatcaagacccaacttcttgggtgg

SEQ ID NO: 8531 - DNA, 210 bp, Candida albicans
gagatatatatatatatatataacattggtagcgttgaaagagatagacagaagaaggaggtgggaggaggaggtggagacgtgcgtgtacattcagataattatcctgcatataagtactttttattattgcgtttgtttttttttcttttttttcttggcataaatttgtgttttgtgttttgtgttttgtgtgtgtactgtggttag

SEQ ID NO: 8532 - DNA, 384 bp, Candida albicans
tacacatctaaacaactcttactcccagctatggtcaaacaacaatcaaaagaagaaatagcattacaattgaaatcagcagtttatctaagtgttgctaaaatagtggaggcaaaactagaagatttgaataatgataatgctgcgacaacaacaacagaatcaaataacaagaataataataataatatgttaattgcaactccaacatttattgcacaattagttgaattggtatataatcaattaattaatttaggagaagatttagaattgttttgtcaacatgccaatcgagatattgttgaaccaagtgatctatttatggtgacaaggaaaaaccctactttacaacaacatttgaaagacttgctacaacaataa

SEQ ID NO: 8533 - DNA, 189 bp, Candida albicans
agacagttgatgttcctctctttctctcaacagccaagtttttttaaagaatcacaatgttacataatcttggaaatcaacttaaacgaactgtatattacaaacttgaaattccataagcaatttggatacagaccaggaggaggcttgacattagaaaaaaattgttacgttgaaaacgatttttga

SEQ ID NO: 8534 - DNA, 201 bp, Candida albicans
aaaaacttggctgttgagagaaagagaggaacatcaactgtctttagagatttgaatattgatattgacaagacatttctagaaatcttaatctcaaagtttaattgtaagctcgtcttcaaattcttcagtcactatcctcaaactcaaatgaatctaattgtggaaacttttaaaaaatatttgaatcgggttgattag

SEQ ID NO: 8535 - DNA, 222 bp, Candida albicans
ccccccaatcatagactttactccaattcctgcattgaaatgatctattgtggctggccaatagaaataacattaaagaaattcaaaatctacattatacaatcttataacagtaatcaaatattgacaattacacaatttccactgattagccagaatacttcatttgaccttattccatttattgttgtagcaagtctttcaaatgttgttgtaaagtag

SEQ ID NO: 8536 - DNA, 219 bp, Candida albicans
ttgaggaatactcatgaccatgtttcctattatgaagtgatgacatattccctaaaaccaactttagaggaaggaagaaacatatacttgatattgggtactcgttctacaacatttttgtttcaagctacttttattgaacgaaatttagagaaaaacagaatactacatgctactacaatcccctctaacctacagtattactttgttgcaccttaa

SEQ ID NO: 8537 - DNA, 228 bp, Candida albicans
aactgtttgggcttggtccatgaatgtttgcatgagaaggttattgttgttcctgggttcttcttcttgattaatccacaaaacttggctcatatggaagagattatttggtataattacgttagaatcagttatggacctgaattgcaccatttggaaaatggtatggacggtattgaacgtattttggacaggtttgggtgcttaccatacgatatcaacagttag

SEQ ID NO: 8538 - DNA, 381 bp, Candida albicans
actatggagccgcgattaggaacccacaaatattcacagaacactcaattaaatgcgaaagtaattatgtctggcacttggttctttcaatccgaggacgattttataattgagttctttgcaaaatacttcaaatacataattgtacaatcatctcacactctctggtatgataacttcaatacacctatttactcttgtgcaactgagaaaactgaaacagccgttatcagtaacattgggtgtttgaaggtatttttgttggttgcgaaatcaaagtatggcacttttcaagactccagatggccatccactacgcacaatagtgtcaatcaccttccaagaaataagtggtcgagctttactaccaacagtagctaa

SEQ ID NO: 8539 - DNA, 273 bp, Candida albicans
attcttaaatttatccacgtgatcaacaaattgactaaacaccaagaagttagacataaatatattaccagtgttatcaaagtattaaagatattttacattaattctacttctttttcttttcaaatatcaacaaaatctattcttcacacacgtttactccacttcaactttaactttaactgtaaacacaaattcaaaaatctatacctacaccacagctcctatgctatatcttatttcgacaactgccctggaagttccgcaatcccc

SEQ ID NO: 8540 - DNA, 186 bp, Candida albicans
agatattttacattaattctacttctttttcttttcaaatatcaacaaaatctattcttcacacacgtttactccacttcaactttaactttaactgtaaacacaaattcaaaaatctatacctacaccacagctcctatgctatatcttatttcgacaactgccctggaagttccgcaatcccct

SEQ ID NO: 8541 - DNA, 411 bp, Candida albicans
tattcttgctttttgggaatccttaacaatcaaagcaagagtatgaaaaccttattgtttatttatcttcagctactattattactactgataataatcggtagagttgttaaagtggagtatttacatttggtagtggaagtggaaacctctacaataaacgaactgtgcttatcagaacggtatgatggatatctgggatcattctatttgaacacgacatttgctgaattaatgttgaaagaacaccacaacaagaagaaactccatccaagttgtcccctcaaatggtcttcagaacttttcactatgcatcctcatttgcacctgaatattcttgctccggattattgcaacattcgggtgggtaaatatggaaaatattttacttttggggttattggccattag

SEQ ID NO: 8542 - DNA, 213 bp, Candida albicans
atattcttgctccggattattgcaacattcgggtgggtaaatatggaaaatattttacttttggggttattggccattaggagccataaaaaccttggtataatgaagggggaaatttatgttttaccgttcacaaaaatttttttacccttttcacgggaattgtggtggaccaacactaattcccttgggttgtgctcacaaatctgttga

SEQ ID NO: 8543 - DNA, 408 bp, Candida albicans
agcactacaatgttagggcgattattcaaacaaaacaataacacaacacagccacacaaccctcatcatcaacctccaatacaatcttcgagtaacccaaccactccacctgctttaaccagttcatatgaggactcttatactcgagaaatactttacggaacccacaatgccaatcaactaaaaccttaccaattcaacagtaagttatttcgaataataatatcacaagatggaggaaatttgcgtacgaagcaggttttgtatgatagtgccaacgatgagagcaatatttactcaccaacaaaatcccaatcatattcttgcttaatgcaacaccagcaactactaccactacaacgaccaacttcagaattttcaaatttccaaaaggcctgttctggctaa

SEQ ID NO: 8544 - DNA, 891 bp, Candida albicans
attgaaatgactatatgtttggggtgtggacctccatccaatgaaaaccattccgccaccaaattacatgttttgcccccattaaccaattctatgtatgaaccatatcctgcagtactaataacccgattattttccattagtgatggtgaatttattgattcttcattgttttccagcacagagaccaaggagtggcagccaaacccagcattggtagttaaagagtcgagcatacggaaagtttccttgaaagatgatacctcgaaaaataataatgtcaacagtagatttgctattggaatagttatcccattggaatcgttgggtagtttgatagacatagtatttaacaattggcatgaaatcatccattatactataaacttgcaaaaattaatttacaaaaaattattggtacatttaaaccaaggccttacttacgatagcacacatagttatactgggtgtcaatatttaatcaataaaagaattcaatttcccaattttattttacaacatgataatgaaattggagttcaaaaactcaagttgatcaaaactatacattataactataacgtcccgaaactcataaattcaaacaccctaatgaaatcatcagtaacaaaagatttgtttcaatataatccaatgttggttaattgggtgttggagttgttgaattggctagaatttaaagatgggagatactcagaccactcaaattcctttttaggcagtttatttgctatattgactccctttaaaaaactgctcattttgaaacctttttataattctagttgtgcaaagaaagaaataacaagagtggtagtaatgacaggtaacccagtaattgcgagaaaacttgttttcatattgaatgga

SEQ ID NO: 8545 - DNA, 276 bp, Candida albicans
gaaaaattgccacaacatgaccaaggcacctctaacgtgttttggtgtacattcagcggcataagcaggaacagtagcggatttgaccccaattccgaatccaaggaagaatctggcaataaacaaatgccaccagttgttgacaaacccttgccaaatacaagtgacggccgaaatcaagcaggtccagaaaattgtccattttctacccaaatgtctattccagtaatcggatgtccagcatgcaatgaccgagcagcacaagtatggtgctga

SEQ ID NO: 8546 - DNA, 291 bp, Candida albicans
aattactggaattcttccttcttgtttcttcttcttttttgtgaaatatatttaaaatccttattgttttttttttctaatattaacaaaagaaagaataaccacatccattatgacttcatctataaacctttagttaatcgagtcgtggatttctgtacaatttcgatggtttttgtaactaataattatttgcttgctaaaaaaaaatggtatttgcctaattggggcggttcacaaacaaaaatagaagcaactccaatatttctgacgacgagaaaatcccagtga

SEQ ID NO: 8547 - DNA, 369 bp, Candida albicans
aaagaaattataggagatccagagtctcctgaaatcttgacttcttttgttttcactgtcatgtacggggctgcgctgcatagccaggctgggcacagcaataattgcgccagagcacacaacggtaataacaaaaccaccaccaccactccaactaccaagtgtgtctcaatcgaaaaaataaaaactagtcattcaaacggtcatttttgtgttattctgcactacttatacgcatgcactatatcaatgatgagaatgattgctattttaaccgggatcacaatgtacaactgtgatggggaaaagacgacgaaggaggcttgtgagacgaagaaagagaaatgtgatcccgtctgtcaagtttga

SEQ ID NO: 8548 - DNA, 207 bp, Candida albicans
atctttcttttgcaacaaaaacatgttttgcttacatcatatactggaagtagaaagaaacaagacgtagcaaaagaagaagaaagacagaagggaaacagccgcattgcttctcgtgatcaacctcgaaatttcctcactgggattttctcgtcgtcagaaatattggagttgcttctatttttgtttgtgaaccgccccaattag

SEQ ID NO: 8549 - DNA, 246 bp, Candida albicans
gagttttgtctattagctaccccagcaaaagcttcaaaccaatcagcaaaagcattaatgactcccataatcccaccagccacttttactttgtcattatctgataagaaccccgctgcaaagagaataatggttaagtcatatgtgagcaatgcccaaaagaacgataaagtggacttcacaacacacataagcaacatggtggtaaatattgcccacccaatcaacattaatcctatagcatga

SEQ ID NO: 8550 - DNA, 186 bp, Candida albicans
aaaagagattggattctggttatagttatttatttgattttatcagtacttcttcatccttcatccaaaaataaaaataaaaacatgaaagaaagaaaatttcttattttgaatatactttgtgattcaaattactttgttaccattttacttttaattatggtaactttaacccgtcataactaa

SEQ ID NO: 8551 - DNA, 183 bp, Candida albicans
agaaaagaaatattttctatcaagccaaaaaagaaaaaaatgaaacatccatttaatttgattttgtgtaatatttattattataaaaatagagttgaccagaaaaaactgcaattacctgacgacgacgacgacatcaactgttcaaacaaagttagttatgacgggttaaagttaccataa

SEQ ID NO: 8552 - DNA, 183 bp, Candida albicans
  unsure (155): Identity of nucleotide sequences at the above locations are unknown.
aatgggagaggtcatctttatgtcttcaccacggggctggaaggagccgcgcaaagcgcaaaaaagacaagaaaagggctagatgggacacgcacacagcagaccacagggagagagcgtagtagacaacaatcaggagtagacagacgtaacgnagagagaggctacatcgatgaacagtga

SEQ ID NO: 8553 - DNA, 432 bp, Candida albicans
agaccggtcaatgacggccaacaagagattgacgtaggagatgcaacagaacaaccagaaaagggggaaattgatgacactagaaagcaatcgaataatgctgtcaataataccgagacacaagaaactgcaacagatgatgcttttgatacagttccacttgagggagatgaaaacattgcaactgctgcaaaagaaactgagccaacatctacagaaccaacagagtccgtggatgttactaatactaacaactccgcaagtgaagaagttggaaaagacgacaatgatgacgaagatgatgaggatgaggatgcagacaatgaagggaaatctaatgaaactcctgaacagtcatcagaaggaagtgcaactggttcaccatccaagaagaaaaataaaaagaaaaagaagaataataagaaaaagtaa

SEQ ID NO: 8554 - DNA, 216 bp, Candida albicans
acatcggagaaggaaacacgaaagaagcaaaaaagaaaggacaagaaaaaaacagaagaaagaaaagggtcacaaaaaaaagaaaagaaaaaccacagcacatctacaaatcgaaaacaagcagaagaaaaagaaaaaaaaaaaggaaaaggagaaggacaaagaagccaaaaggaagagaaatcaaacctaaaaaagtcaatcatcaccccatga

SEQ ID NO: 8555 - DNA, 213 bp, Candida albicans
aaatggaacattctttggaatagtcaaatcaactgtttattaccaaaactagaaactgatttgaataataataataaattccatcacgactgtcaaaccaatttacaaaaattcattaataataatgatatatgtgagcgaataaataaattccaacaagataataattcacaattggataagataaatccatttgatttaaaacttaaatag

SEQ ID NO: 8556 - DNA, 387 bp, Candida albicans
acgtcatcaataaatggtataactaatgatatacaacaatatcataatcaaatgaataataatttaactaaaattaatcaagaattaacccaaattcaacaatttgatgccaataccatgaaaatatcacccattaaagaatcttcaagaatacccataacaacagcgaatatgcccaataatcaatttaaaccaattaaattacatcgaagtaatattgcttgtggtggtggtggtgctacgggcaaatctctttcacccacaagaataccaacattacaaagatcaaaaagtaatgttcctgaagatacatcaccacaagattctaccacgaccaataataataaaaagagaaaaatattacaaacaatggacaatttattatga

SEQ ID NO: 8557 - DNA, 213 bp, Candida albicans
cctttctcaaataaaatccaaattaattttgaaaaaaccgaaaatttaaaatcaaatgaaataccttttgaagtactaacttatttgcaacctaatagaatcaacgatgatgatgaggtccatgatgttcatggtggtggtggccatgttcatgatgaggaccaaatgaatgacgacgattatgattatgatgatgatgatgatgggcattaa

SEQ ID NO: 8558 - DNA, 204 bp, Candida albicans
acccatattctggtggtggactacctggaggaggagcagcagcagcataagtatgaccaggataataatttgagtaaatattatgtttcatatcatcataatgatgatgatgttgacgatgatggtgatggtgatggtgatgatgtgggtgatgtgattgattatgttgatgaagtttatttaataaattatgaagaaacatga

SEQ ID NO: 8559 - DNA, 372 bp, Candida albicans
gtcaaaacaccagttgcagtagtagattcagaagatgaagcagcagcagtagtagaagttttagattcttttaaggtagatgaagtggaactagcagcttcagaagaagattctttagtggcagaagcagaagcagaagcagaagcagcagcagaagatgattcttcagtagaagcagtttcagtagcagaagaaacagcttcagatgagccggcagcggaagaagaagccttggctgaactagattctttagtagtagaagcttcaacatttgaagatttaccagcagatgaagaagcagaagcagaagcggaagcagaagattcttcacttgaagccgattcagattcagattcagatgatgaagattga

SEQ ID NO: 8560 - DNA, 279 bp, Candida albicans
tgcttgggtgtagatgctaggaaaactgttaaaaaaaaacagagagatctctgttcaataatgtcatcgaattcagttttgaattttaccaatgagaaaatagttgaaaaaaaaaatgttcgctctcgcaacaacacattgattatctatgcaaattctaacgtctataaactctgtataaacttcattgtacaccaacaattacttaaaaagaaaaacacagatgaatacattaacccattatcaaaagtattttctcccaaaaattccaatttataa

SEQ ID NO: 8561 - DNA, 204 bp, Candida albicans
aaaacttcttctctttttctccacaaattacaaaactcaaacatgtctacctccaacacacaagaagatgtttacatagaatatttaaattatgattgggattctttccaagaatttcaagatggtttacaagaaattatggataattatttacagaacttgcaggaacaagattcttcaacacgccgtgccaggaccatgtaa

SEQ ID NO: 8562 - DNA, 249 bp, Candida albicans
tttgagttcaatttcgttcccacatttaataactcgccctattatttttttttttttttctattccactttacaacaatttctctcttacgaaatcaaacgatatttatgtatctatgtagttttttttttttttttctttactttactttacttttatttgcctgttgggattagccaagtagcattgatcattagtatcattttgttattgattgaatattatttaaataataatagaatagaataa

SEQ ID NO: 8563 - DNA, 213 bp, Candida albicans
  unsure (51): Identity of nucleotide sequences at the above locations are unknown.
tccctccgggtccccaccaacactcttcgcggcctagctcctaccccaganggtgaagacccgacccaaatttactcattgacaaaaaaaaaagtaaaagtaaaagtaaaattaaaagacaagaaaattgtcgttattgttgttgttgttgttgttagagaagatctacaagaaagaaagagggaaagaagaagaaggaggaagctaatttag

SEQ ID NO: 8564 - DNA, 282 bp, Candida albicans
acaaccaacccagccagcaaaaaaatacaaaaaagtctgcaaccaactctcaatccacagacagcaaccattcttacaacaacttcaattaattcaattaatagattgattaactactctaaacacttgtcattcgctttacattctagtcaactccaaacaagaacatcactcagtggattaaccctcccttctactattgacttactcaatatctttcacataataatacgcaacacccatccactaccgccacaacaaaactcccctctcagaacataa

SEQ ID NO: 8565 - DNA, 279 bp, Candida albicans
gtggttgttgtttggttggttgttagtataatttcttttttttatccggttgaattctatattttgtcgtgtaatttgaatgaaagaaataattccactcacacactaaacactctttctatttctctttctcttgctatatatataaatatcatttggtttgcacttagacaaccaacccagccagcaaaaaaatacaaaaaagtctgcaaccaactctcaatccacagacagcaaccattcttacaacaacttcaattaattcaattaatagattga

SEQ ID NO: 8566 - DNA, 312 bp, Candida albicans
tttggtattgaaattgaaattcaatctacaaccaacatttcctcatcattaacatcatcaccaccaccaccatcaccaatgtcatcatctacaaataatgataaactaattaagggtttactcaaacgatataaaaaactagaggcttcattaaataagtttaattctaaaaagtataaccacagtaacaatggggcaatattaaaaggaaatatactacgtacttcactattaccgtttttaagaatttccacttatcagttggatgaattattcaccaaagatacccccgtgtataagagtttatccaat

SEQ ID NO: 8567 - DNA, 198 bp, Candida albicans
ggaaatgttggttgtagattgaatttcaatttcaataccaaactattcaaaaaaatgcaaacaaaacaaagcaaagcaaaacaaatcaaagtaaagttagtagagaataagccgaattctctcctaaaaaaaatatttatctatgttgtgtgtaaaaataaaccaaacaaacaaacaaaaaaagccccaaaaaaataa

SEQ ID NO: 8568 - DNA, 234 bp, Candida albicans
gtggaaattcttaaaaacggtaatagtgaagtacgtagtatatttccttttaatattgccccattgttactgtggttatactttttagaattaaacttatttaatgaagcctctagttttttatatcgtttgagtaaacccttaattagtttatcattatttgtagatgatgacattggtgatggtggtggtggtgatgatgttaatgatgaggaaatgttggttgtagattga

SEQ ID NO: 8569 - DNA, 228 bp, Candida albicans
atgaatattataaaacaacaagggaaaaatatcgcagttaaaaatataaacacaaattcaaataaaaaaaccacgaggaggatggaaatttggagaaaatttagatttattagtccctgtttaattcaaacccacagagcatgtaattgcaaagtatacaaacacacacacgttgaaataattgaaaaaaaaaaaaacacaagcaaaaaaagtccaatgagtttgtaa

SEQ ID NO: 8570 - DNA, 240 bp, Candida albicans
catgtgaccaaatcgatttttcaacactttgcgattcattctaccaatcacgttgaaaagacaccatttacgaaggtgatgatgatggtcttgttattgcatgatgttgtttacttcagtatctgtaataaaaaaatagaaacaatagccacaactaaaactgaaaaaaaaaaaaaacacaagagaattgcgttagcaagaagggtagtccatacttttgcaatcatatgtatgttgtaa

SEQ ID NO: 8571 - DNA, 189 bp, Candida albicans
caccaacaacgacgacaacgaagaaaatttcacgtcgttcatgagagaatatcaaaatttttttcattcgttcagtattttatcgctttctttttacaatttttaaactatacattcttctttaacactcaaacgtcgattgaaacaaatattcaaatagtatgttcaattatagatgattatctttga

SEQ ID NO: 8572 - DNA, 249 bp, Candida albicans
acagtagataattataatatgactgaaactgataatcaggaaaaactcaactataaatacctaactaattgtgttccgttcaaaaatcgaactacctcaaaactacaatcacaaaattatacaaatataaatactcaattgaaaatggctgttaaaggtttaggagaagttgatcaaaaatacgatggtatgttttttataatagttgttcccacaaaaattcaatttgtccattcaatgttcatctga

SEQ ID NO: 8573 - DNA, 498 bp, Candida albicans
cggatccggcgttccttagtaaagattgggggcgcaactgctggtgctgcaacaacaaatgtatttggaagccgtccaaccacacctgcattcaactttggtggagcagctaccactactgctgctgctgctcctagtggttttggtgcaattggtaataaaccaccgctgtttaatttcactggtagtaaagagtctactcctgatccggctagtgtatttggtcaacagaatataagtggtacctctacaccttttagtagtggtggtgttggtactggtgctcctggtgttgctggtaacgtttttggacaaccaggtcaacaaccagggatatttggtggtactactaataacaattcattcacatttggtggtgcccctagcgcgcctgctgcttctggtgttcctggtgttcccggtggaacgaatatgccagtggtaactccagctcctaatcctcgtagaattcttcatcctagatcaagaagaagataa

SEQ ID NO: 8574 - DNA, 195 bp, Candida albicans
atgtcgaatataaatcaacagaagttaattaataacaataagatgagagaaagatatgtaaatgttggtggtggaccatttgaaagaatctacactaaattgtggggtggggaagtgtgtgtgtaccaaaatcaaagtcacatgggcaattgctatattgcttctgctggcactttttttttttggtttcattga

SEQ ID NO: 8575 - DNA, 192 bp, Candida albicans
tttgttcttttacgtgtagatctaactggtctacgagaaatcgttatagtttcagaagatactgaattatgtgttgatgatgcaaatggaactttaaatggtttggataaacgtgtagcagaatcggtgacgcgtggtggtcgtttatcctttggtacacctgcaccggaacataaaggtgtagtaaattga

SEQ ID NO: 8576 - DNA, 249 bp, Candida albicans
acagaaaaacttaaatcccaaatcgatataatcacaataacgattgaattaataaaattggcagctattaaacgtggtggcaatggtaatggtaatagtggtgggaataccattttacaaaatattttacaattaatcaatgatttacaaattgaatttaatgaatttgataataatattaatgaacttattaagaatttaattggtaataatgaaaaagaatcacttaacaagttgaacattatttga

SEQ ID NO: 8577 - DNA, 219 bp, Candida albicans
actgagtccaatggagaggatgggaattcactgaaggagaggagggcaggacaagaagctagaggaatgagacttacggataaaaaattgccggttaagcaagaagccggattcaggcgcagcaggtgtgaagtgacagaagggccagaccagaatccactcacggatggcaagcaggcgaggggccagtcagagagatgtcattggcgcagcaaataa

SEQ ID NO: 8578 - DNA, 252 bp, Candida albicans
gaactcaagttgcaggatgaggtagggcagactgcacttcaatcacggatggctagacagggacggaactatgaactgagcaagaagtcagaagaagtgaatagtttgtgtattagagtagtaatctatgtaggactaagtcaaaactggcgagtggttgaatggcctagcagtctggaagtcaatcaaatggaaacctgtcgaatctgtgtggctcacggatgtctaacttcttggtgtacggatgtctaa

SEQ ID NO: 8579 - DNA, 234 bp, Candida albicans
ttaattgaggggaacggccggttcttaaacggtgggttggaaaaacaccgttcttcgccaaaaagtgtggccaaaaaaacccgggggttagttttcttcaacttcaaggggggaacaatccgtccattcatccaatggagtttgcccatcgatgagagcaccggctggggggaggaaattggagattcacagaaggttagactgagtccaatggagaggatgggaattcactga

SEQ ID NO: 8580 - DNA, 237 bp, Candida albicans
aatatgtgtgtgtgtccatgtatcaataaagtgacagaagaagaaaaaaaagagtttttttttcatcgttttttgccagtaatagtgaaaagttcaacaattaattttttttttgggcttcagttagaaggaaaaagatttgaactgaactcttttcaagaaaaacttccctttttgcttccagcttatttattttcaagaagcatttttgaaatctacaatgtctcaacagattaa

SEQ ID NO: 8581 - DNA, 219 bp, Candida albicans
aagatgcaacaaaaacaagaattcccaatattaacaacacgaaagcaacttgaaatgttgaaattgatgcaaaattttttatttttttttgtaaattttgctgccaattctaaaacaaatttagactctttacgaagtgaaacagactatgctaccaacttacttatcattgttgttacatttttttatagaaagtactactacaactacctcttctga

SEQ ID NO: 8582 - DNA, 225 bp, Candida albicans
aaacccaagaaaaatttgtacaatgtcaagaaaaagcgtcttcagattgaaacgccttcgttaaagtcatcaataaaaaaaaatacaaagaaattttcagcctctggctaccattgttgtgataatgctgatgtaaatggtaccaatcatcaaggtagcttatacttgccaatattactcaatttggtttgttggtggatttcacatttcttttttttcttctaa

SEQ ID NO: 8583 - DNA, 249 bp, Candida albicans
accataactgttaacaattatatgagtctatacctccacaatttcaaatgccaacaaaaaagccgcctctaccctcccttcttttttgtggttttaagagtaattcaactcactccttccaatcatgcaatataccagaattttgaaaatgataattccatgatcagcccaacaataaagcccttaaaccttctattttcattcatccccataaaaaataacagtgaacaaaatttcttgttagttgtt

SEQ ID NO: 8584 - DNA, 198 bp, Candida albicans
catgcatataaggatcaagtaacagttgaagtgagttcagaaatattttggagtaattacatatacgtgtttataattgtaaacgccgtgccctttcacgtatatagccgtggaaaagaaaaagaaagtgaccaactgaacccattgattaatggtttggttttgttgaacaggttaggtattttctcttgtgtctaa

SEQ ID NO: 8585 - DNA, 213 bp, Candida albicans
tcatttatccttactttcatatatatatatacatacattaatagattttactgtttcgacaatatgagtgcttcacctccagaggaaacccctcttgatactacttcatcaatacctgaggaacctgaacaacaacaacaaccagaatcatcaatagaacatcaagacgatgcggacggagtcttcaccacggagctgccggtccgcattaag

SEQ ID NO: 8586 - DNA, 261 bp, Candida albicans
attaaaatgaacgaacgaacgaaaaaaaaattaagcaagaagaaaaaaaaacaaccttcccctttaaaacaacaacaacaacaacaacaaattcaaaacacagtaacagcaacaattagaacaaccacaggaggtttattttatttttatttcattatattttattttttaagtttgcaaccaattttttttaatcatttatccttactttcatatatatatatacatacattaatagattttactgtttcgacaatatga

SEQ ID NO: 8587 - DNA, 222 bp, Candida albicans
tatctaaagtggtgtggttgtggtttgatttctattgctctgagattgatggcttacttaatcttatacgctttaactttgaaatatgttgagttttatacaaggctaagtactcaatatcttattaataaaaatgtctactggattggaaagtttttgataattagtatttttggtggggaacagtatatgcacaatggaggccggaaaagtcgttttttt

SEQ ID NO: 8588 - DNA, 219 bp, Candida albicans
ccaataccacaatatttgctcttaaattggtcagaattttttgctgatatggtagtgcaaaacacaccacgggacaaaacaaaaaaaattaacgtcatccacattcataacacaagattaattttgatatctaaagtggtgtggttgtggtttgatttctattgctctgagattgatggcttacttaatcttatacgctttaactttgaaatatgttga

SEQ ID NO: 8589 - DNA, 198 bp, Candida albicans
ttgttgaataatttattctacaatactccggatcccccaccatcagggtatattaatccaagaacgtttataaaatctcttgaaatggaaatcaactcattcatcctggttcctaggaaaaaacttcttatttctaacaaacttttaccaaaattacttattccttaccttttgaatttccttccaatatccggttaa

SEQ ID NO: 8590 - DNA, 222 bp, Candida albicans
tcaattttcgttttgttcaaatcattttttgccaaacagttggttgtggcgaagaagaagaagaaaatgactaaaatttcattcgggaataaacttttttttttagtcctcgcccgccttcttcccccccccccccccctgaaacgaaagagagaaaagtctaaatacggaaatagcatagaatacaatagaacgtcaatcctatccacaccaccaccataa

SEQ ID NO: 8591 - DNA, 324 bp, Candida albicans
cgatgtcttccacccgcggttaataatgaagaattgcatagattaacaatacctttattttttgtcaagggtgccgataaactaattggatttggaatgcttggtgttgctgcttttgtattcacatactacactgcttgggtatttgtattaccatttatcaacgaagacaatatattgaaccaattctttttgccaagagattatgccatcaaattaccaatattattattattcattgctgccttgggtgtgggtacatttgtcggaaaagttttgattaaaaatcaacagaaacagaaaagtaagaaaaaagcacaataa

SEQ ID NO: 8592 - DNA, 708 bp, Candida albicans
ttttcttctatttttagttattattatttcttattttttttttatttttgtctatctattccatcccaaattatcaacattaaaacagaaatggatcaaaattctgtttcaccagaagttgctgtggaaaagaaatcgggatcgatatctgacaatgggaaaacaaatgaagaaaatgcctcaaaaccacaagttaaacagacgagtactcattatactcccaaattaattacatcattggattgtaaaattctacaatatcaatataacatttacaaattagaaaaatcaatcagtcatatacggaaactccaaactgaatgtcaaggatcacctaatttacctttgcttcattatattgtattattggtagggtgtacattttctatcaatgacaaagcattcgaccccaaattagatattttatccaattttcaattatttagaagtacaaccattaacataacagccacaacctcgcatattccatacgatacaccagatttaccaatcacaccattgaatgatattccggaaatatcgacatcaatcaaatgtttaaaacaattagagtcattatgcaacacttgtctacagggatacaagaagaaattggatcaagcaaaagtcgaaaaatcaaatgaacttggaaatgttgactcaatagatgcttattatagtacaattgaaaaaatagtttcaaattga

SEQ ID NO: 8593 - DNA, 228 bp, Candida albicans
gctattgatgttggtggttgtggaagtggtggtgatactgttttggtgagactactgcctaaatttgttgatgtatcagttttgttaactgatctatctgacatgacgactaagggggagcaaaaacttggtataaatagggcattaaaaaaattggataatggtttgtatactttcttttctgtaagatttttcgttaagtggttgagtttgttgattgtggattga

SEQ ID NO: 8594 - DNA, 195 bp, Candida albicans
acactagagttatcaataactagggggaagagtacaactattactattgcctttttgattaatgaatatgtgatctcattcaaaatttgtatatatgggggggggggggaacccgcaaatgagggaattccaataaataaacaaattattgaaaccatcaacttctgtaatccgatttatttgaatggatgttga

SEQ ID NO: 8595 - DNA, 219 bp, Candida albicans
attgaagtaattattcaatcaaatcttgtattggctttatggatagcgagagagagcaagatcttcttggtgatgttttttttttcagtttcagtttcagtttctatttctgtctttcatcaaattcgtattactcaagtcgtgtatttattaccaattcgctataaaagcaaaataaaattggtagcagaattgaacactagagttatcaataactag

SEQ ID NO: 8596 - DNA, 276 bp, Candida albicans
aaatttcaaaaaggcaaagaaaaagaaaagatagttgtaaaatatttttggagtataaaattgttgaaagtactttggaacagggggctattggttttcgtggtattttttgttcaatggttaggagaattaaacaatttggcacgtgatacaagagaaaacctccaggaaatacctcaattcacaaaactacactctctcactttatggattgtggtgaattattataaagtcttatatgtaaattttaatctaaattatattaaggaaccttga

SEQ ID NO: 8597 - DNA, 189 bp, Candida albicans
aagaaaatgtctgatgctgtattagaggatacaatatatgatgatgctgttagttttactacaaaaccatatgattctgtttatcctaaaatcgattcatcaattgtcaatttaccagtgacattacaacgattaccacgaaataatagtatgagtgataatcgtttagtttctaccctaaattttaat

SEQ ID NO: 8598 - DNA, 294 bp, Candida albicans
atcactgattattttgattactttatgtccgataattatcttctaccctttgattcgttattaccaattgagattttataccaaataatacaatatgtgggtattgaaaatttgatacaattattgccaataccagtgtcgccttatcttcaatcttcctttattcatcacaaccccaatataaagcgagctattgataacttgatagtcgacagtaacataactttcaacaatcgattagtacagcattcattgattcatagatatctaagaacacgatcgtgtcttcaccac

SEQ ID NO: 8599 - DNA, 189 bp, Candida albicans
gaagacaaacaagggagggtaagacttgggatagatcagagaacgaagagcaggacaagtgggcaagtgaactggccggcaaatgagagacagtggatagacacaagtgagactcacggatggctagccgggggagtgaaccgaggtcaagcgaacaatcttcaacacagcggccgaaggaccaagatc

SEQ ID NO: 8600 - DNA, 225 bp, Candida albicans
ccggaatattgtgatatatcttcttctttaatggcaatatggaaatctcgaatcatgaaatatatatacgggaaaattgaggtgaatgctaatggttcagcaaatcgaattatacaaattataatcatttgtcgaattgggaaatcatttaatgattctttatatgatgatggtagaaccattgcatgtacaggtgttattgaagaaaaggaaagatgtattttt

SEQ ID NO: 8601 - DNA, 183 bp, Candida albicans
  unsure (118): Identity of nucleotide sequences at the above locations are unknown.
cctgacatgcataagatcagtttgtttttgtttggttcggtaaatatggacgacgctgaaaaaaaagaaccaccattttttggacgaacgaaggtggtatcagtcaacgaaccaaaanaaaaaacgaaggacccatatttatcttacttaatttcttttaagatcttattgattcacacttag

SEQ ID NO: 8602 - DNA, 237 bp, Candida albicans
aatttgaacaaattagagttagacaaagagaaacgtgtcgaaatcgaggaagtcaccgaatcaaacgctacagaagtcgataaacaatggttgttttatgaatacttgggtttattgaaatcgtattacagaaagtatatcattggtgatgtagagtgtcacgataaagttaaagaaattgtcggacaattggaaaatgcactggctaaagacgaaattcttaaatggtttggctaa

SEQ ID NO: 8603 - DNA, 192 bp, Candida albicans
ttcgaccttgggaatatcaggtgttcgctgtctattctccaacacttgaacctcctttctagaaaaagtgatgatgaaaatattttcttgagtgaaaatttttcactgtcgacaacgagtgctcaacagaaaatatttcatcttgtgtcgggtaaaattagcttggaagacctaccctatagcgaacaataa

SEQ ID NO: 8604 - DNA, 603 bp, Candida albicans
  unsure (395),(441),(501),(533): Identity of nucleotide sequences at the above locations are unknown.
tggatacgagttcagatatatcactaccaaccccaagatgtcgagtactgttacgaccctgaaccactagccataccctgtcagatgtggccggtcagccatgtggggctcaatgatgatgggagtatggttgtgttggtgagtactagacagggtgtcatacagggttatgacaagcgggagttgaagtggacactgtcggtgcactttcgaggtaaagtgttggagtcgtttttcaggcggagaactgtgccggggtttttagcacgtaaaatgattagaaagaagaggggcagtgatgcgtcgatgtcgtcggtaaattcgctgatcaatgcgaactttccgccaccaatacagatgaagtcgtttggacagaaacagcgtgagaggactantagggaagagtttgtgatggtcatggatagtggggagatacttgtngtgtcgtgtaatgatgggaaagtacagagttatgatgtgaagcagcagttggtctgtgcnataaagaatagaacccccagggtgatggatanaattgtggtgcagacgaaagaattggatattattgtggggaaacatgtcaacaacagcatgaaaaagcaa

SEQ ID NO: 8605 - DNA, 225 bp, Candida albicans
attaagtacaacccgcgtaatcgtacttcaatagcatcaagcgagtccaatggcaaaatgctgttattagtagtagaacctccaatattattcaataaagtatccaatgaagtgacacacaatgactcgagtgattttatatcagctttgggaaggttatttgatttgcttggtgacaacggtttggatgatgactgtgatgatatgaacgccaatagtttttga

SEQ ID NO: 8606 - DNA, 210 bp, Candida albicans
ctacaccctcttcatttcgtgttgcaattcccactaccactaggttcacatttcccaccgccattgactactcaaactacaagttgttctatcgtcccttctccaactagcaagcacgacgagatacatgtctgggcatttacaatagattctactcatcattttgcatctgccatgcatcttcaccacgcggctggaaggacaacgtac

SEQ ID NO: 8607 - DNA, 1659 bp, Candida albicans
  unsure (530),(533),(1508),(1527),(1536),(1640): Identity of nucleotide sequences at the above locations are unknown.
tcaattatatcacaaaagattgatctgcaagatattccgttgatgttagacgatgggtcggggacagaaaatggcgacaaaaagacgaagagaagatatagagttgatcgtgataatatcaagatcaacaaaagaatcatgtctcaagatacagaggatgtcataaaaatgtttaaaaaatttgacgatgaagtattgaccaatccagaagctagatctagacttttgagtcttgggtttgaaactagaaaacgatacattactacttttaaacattatataagattttgttgcaaaaagaaattagataaattttttgtcactggagaattgatgaaagagttttatcaagagcaatttgcaatgagttcatcaaataaacctgtcattaggttaagaaaaatggatccagcattttcaaaattacaggagattaatttcttggtttatcatttagcaaataaggatatcccaaatcgacatttggcgttagagtatttggtatataaggaaatgggtcaagatcttcntantaatggttcatcagacggaaaaattaataccttcaatgaatcagccccagtagcagccccagctccagccccagccccagggtcattaccagggtcagtaccagtatcaaaaacaggaccaatagcagggccagagtcagtaccaacacgtacacgtgccccagtattaccaccaattgaaaacttagattcagggcaaagaccttcaacaaggagctcgtcaaacaaaaaaactgcagaacaaaaggaacaggaattaacaccattaacaagaaattctgcaaacaaaagaggtcggaaaagtcttaaactgaaacttaatcttcaactgtcgacttctggcaccgatatgggagagactagtctgtcagatagcaatgcattaaaaatgatcaatatgcaatcaagatatgtgccaccattgccacaacaacaacaacaacaacctcaacagccgccacaaaaagtattatcacagcgggcactaccaccaacacattcattagtttcatcatcagtaccatcatcaataactacttctaatgataacaaatcaggtgatagcactccagtttataccaaaaaagtgacgaagaaaaatattgaagcaattcgtaaatcattttccaaaatgcgacaagatattcaagaagcattacatcgtgatgtgtcagtagatcccgcatttgtttcaaaattggctgataatatcaatgcttcattagatgattttgaattacaattgaatggaccatcaccaccacctccacaaatgaatagtaatggcataccaataattgatttaaataataaaatttataccgtgtatgacattttagaagaatggtataaaattgaaccaagtattgctactagattagaaaaatggggagaaggttggataagagattcaattgatcataatacgtttttggaacggaaattggtcgtggaatttgttgagagaatgagtanagaatgtaatgttgatatntatgtgatngctaatgattgtgatcgatatattcgtgataaatcaatcttagaaaaaatttatgctgaacgtgaattagatgttgatgaattatgtgaaagaattttgagatntggaacaagacaaaggtga

SEQ ID NO: 8608 - DNA, 252 bp, Candida albicans
agacttgtcttgtcgcttcaaaaccagaattatacccccgccaaacacaatcaggatgtgaatagggagggcgtggtcatatgtttaaccatcttttatttttattatattctgggagcgccaaagaaatttagactttatgaacttcaacatcatctcctaaaatcgaaaaaaaatcatcaaagtccaactgaaatgattctattggctctgctggctagactgattgctgctaaatcagctatagaatga

SEQ ID NO: 8609 - DNA, 201 bp, Candida albicans
tttatattgattaaatattttgaattgatttctattgatttagaagaagaagaagacgtggaaagtttagtggtggctgattttttgacaaatattttgattggtatacttaaattatcagcaattttaacaaatgtaacttgtggtggcatattaatatgttgtagttctcttaatgtaaacctatcggagtttgtctag

SEQ ID NO: 8610 - DNA, 198 bp, Candida albicans
aaaaaaaaacgaacacatcaagttcaagttcaagttcaactatcaaataaaaaccaacctttatattatccacaaatgtcatcaattatacttagatttagatctaaagatggaatgttccgtattacaacggattcatcatcaaatttcacttttatgttagaacaattaattgagaaattatcacaatccaggtaa

SEQ ID NO: 8611 - DNA, 300 bp, Candida albicans
  unsure (90): Identity of nucleotide sequences at the above locations are unknown.
aaaagagttttaacaataaccagtaaaacccacacatccaaccagaacaacaagaacaacgaacatgaaatatatttagaaagtgaatcnaaagacgctttttggaattacccatcaccactttcattccatgattccccattacaaattgatatagatagttcatcatcatcatcaacctccccttcctcctcatcatcgttaatttcatcttccggtccaactaatcattctatagctgatttagcagcaatcagtctagccagcagagccaatagaatcatttcagttggactttga

SEQ ID NO: 8612 - DNA, 666 bp, Candida albicans
acaaactccgataggtttacattaagagaactacaacatattaatatgccaccacaagttacatttgttaaaattgctgataatttaagtataccaatcaaaatatttgtcaaaaaatcagccaccactaaactttccacgtcttcttcttcttctaaatcaatagaaatcaattcaaaatatttaatcaatataaattatcaaccttatcatattcaattatcaaaaaatcaattaaattcaataataaataaattaaaaccaaaaattctccccatacttatttataataatcatgatcaaccaattacaaatattgaaactcaacaattaattattaatgacgaggaggatactttaaagattataatacctcaacaaactatacttaatgtgagagcaagattacgattaattaattatgaaaattttatcaccaatagtggtagtggtaatggtaatgttagtgaactggaaattacatcattatggaaaaaaattggtaatagtgaacataataataatttaaagatgttaacggtaaagaaagatttcaaatttcctaaagactcagaaaaggaggatactaaagacgttaaatttaaattaaaacaaaattatataattgataatttaaaggattgtataaaagtgtatataaattga

SEQ ID NO: 8613 - DNA, 294 bp, Candida albicans
actcactctttttttttcttggttgctactatcaattatttttggcattttactgttgcctatcgatatacttccaccatggctgagaaactagaattgccgttacattccaaaggagcaagttcatcgcggaagaaagtgtactcattgtttattggaattaattttattttaatattatgtacacttttctcttatggttcagataaaagcaaacctattaaaaccccaattgatgtctttagaacgtttatgcaagagccccatgaacccaattccctttgtccaattgtc

SEQ ID NO: 8614 - DNA, 195 bp, Candida albicans
ctcggagtaatcgaaaattgtaggaatagacaaaccaaaaaacatccaaagcacaacgtgttcttacagtgtacaacacaaaaattccaaactaatgaatctcaacaactgaatgatcttgaaattgtaaagcaaagtgaagtgattagatttgaattgactaattatattttagttttattgaaatccaactaa

SEQ ID NO: 8615 - DNA, 234 bp, Candida albicans
ccaaatcaagtaaagtcagctattcaagatgatccattactcaaaataaaacagcagcaacaacaggcacaaagagttgcccgaaaacaacatcctagtgataagcattctcatcgttttagacatagttccaaaagttcatccgatagagtgcacaaatcacatgagcacgagagaagtcgaaagcataattcctcacatactcgtcacaaagatggatcaccccacagataa

SEQ ID NO: 8616 - DNA, 252 bp, Candida albicans
ttatcaaatttcacttgcaaatcacgaatatatttatcagctaatttttcacttaattctttatgttcttgttgtattgtctgtgctcgttgtaataatgatggtgataatgtaggtatagttaatgatgatccagttgatgagttgaatcgtgggaaatttggtatccttctaggtagtattggtcgtatactaccccaagacgataaaccaaaacggggtggtatccttagtaacaaatgcatgtggtaa

SEQ ID NO: 8617 - DNA, 450 bp, Candida albicans
tttttcaatattttcacacatttgcatatatacattagattagcaccttaccacatgcatttgttactaaggataccaccccgttttggtttatcgtcttggggtagtatacgaccaatactacctagaaggataccaaatttcccacgattcaactcatcaactggatcatcattaactatacctacattatcaccatcattattacaacgagcacagacaatacaacaagaacataaagaattaagtgaaaaattagctgataaatatattcgtgatttgcaagtgaaatttgataattataccaatatactatctatgtttgacaaattagaaacttttacacaagaatatattgaattaactgaaatcaccgatgatcgtgatttatataaagtagctcaagaagaacttaaattttcaccacgggactggacggatccgcgctta

SEQ ID NO: 8618 - DNA, 240 bp, Candida albicans
cagcacaacgccaatggaagaagaaaaaaaaacaacaacagtatgaaaatcagaatcaacaatattgaacaacaactgtacaattttggtgtggaatcccttacatcaattcctactaagaatcaacagtcatggccattcaatttttatttctcatatctcgacaaggtaaaaccagattatcaaaatggtatcaaacgatcctgcaaaaggagaaatccaagattatacgagaattaa

SEQ ID NO: 8619 - DNA, 327 bp, Candida albicans
ttttcatacctccttccaatccacaaacaaatcatgtttcaacaacttacttataggctacgattgtttcgtcgtcgtcacaagtatatcttcattaattccatattcttactggtcattataatatttcttatatattcatattggagtaatcttcccgctgaagataattcagcaattatcaatgaaaaaggtacatatcatcgttcattatgggaatcgataactatggcgttgtttccaccgaaaaccaaaccttttgaagaaaagaaacctcaagtccatccaaacaacaatcaagtattcacccggcgtggaaggacccat

SEQ ID NO: 8620 - DNA, 204 bp, Candida albicans
gattatgcctcgactatgaccaacattccaaacgagaaattggactgtatgctatgtgaaaagaaagatgctaacaagtataaaatagagttggctctagcaagtgaagcatcagagaaagaactcaatgagctcaagcttaatttagaaagaattaagaagcagaggatattgatatcagtttttagtatctttttatattaa

SEQ ID NO: 8621 - DNA, 186 bp, Candida albicans
ccttcaaactcagaacaccaagaaagatcagctgaatcagatctacaaccacgtcgtgttagacagaaaaggaccagaatcagtgaagatggacaaattatcactaacaacagaaaactagttgttgattcagaaggggccatggaacgtttgtccatatcgccacagcgccaaataggacagtag

SEQ ID NO: 8622 - DNA, 228 bp, Candida albicans
agagcgtacaccaagaagtttgagaatctgtgcctgtttttttttttcgttaattgggtttacaaggtaggcattagtctaactgttgttaaagatggtacatgtatatcaaatgagatctatacaccatgtaaaacagaaaccatgaatacgctggtacaagatacaaccgaggtgataagaaggcgggttagcaatgctaggttatctgtattagagtatatgtag

SEQ ID NO: 8623 - DNA, 222 bp, Candida albicans
  unsure (1): Identity of nucleotide sequences at the above locations are unknown.
natgcactccttgtagtcacagcactcatatcaaacctttatcatttccgttacaactacattcacgactttaaaaaaacggaaggaggatttggaaggaaaactaaaaaaaaaaatagagaacgcgctggtgtcaaaatttcacaaacaccaattggcggctcattgcctacaccaaaaaaatttaaagaaaaaaaaaatttcgcgtctcagattttgtaa

SEQ ID NO: 8624 - DNA, 222 bp, Candida albicans
aaacaaacaggaaaagttagaccaagcagtagagctactgtgctcggtagtttcaagcccgaggcacccccagccccaataccaaatgcagcctcagccccagccccagctccagcaccaacaattacctacttatccgcctccaaagtatcaaccccgatcgatcccaccaacaatcaagtacaaatcgcaactaaaccaatacttgctagacaaagctag

SEQ ID NO: 8625 - DNA, 816 bp, Candida albicans
agggttattcttgtttttatattttgctattattatttttatttttatttttttattttttttggacacccaaatcaacatcaacccaagatcatgattcctcccactacgaacaagaataaattcaaacaaaaatggacgaaaataaagttgagatttagaaaaaacaaaactcatgaagttgatgatcaggttagtattgttgtcagaagctcgtacgatagttgtgtgaaatgtatgggagagaaattacccttagacgagttgacagatatatcaactcaaatacaccctcaacaaacatcaccttttaaggagaagatgattttagagaccgcaaaacacattgaaaacaaacaggaaaagttagaccaagcagtagagctactgtgctcggtagtttcaagcccgaggcacccccagccccaataccaaatgcagcctcagccccagccccagctccagcaccaacaattacctacttatccgcctccaaagtatcaaccccgatcgatcccaccaacaatcaagtacaaatcgcaactaaaccaatacttgctagacaaagctagtgatcccaaaccttacacgagcatatcctcatattacatgaacctacataacagttttgctaattattacttgattgttcaagatggatcttatcagtgtgtcaattataaactgttggaaccagaaatcgaggatagcagcaggttgcttaaatcccattatcggttcttttatggtttttttgtattgtatatatccatttttgtgatttacatttatgtcgtcacaacacaagctctataa

SEQ ID NO: 8626 - DNA, 285 bp, Candida albicans
tttgaattgaaccaaactagaccttacggtttaaaagagggaaaagaagaagaagaagacaacttgcatatttcatatattagaatgaaaagtccaattgagtatattcacaggttaattattgttttttttttctttttaatttacttgattagattcttattttggtttggaaatttattcagttcagttacaatttgtggtttgagtttgttttgtttgtttattttgttcttgttcttgttggtattttgctatatagatcaaagtacaactgcattttag

SEQ ID NO: 8627 - DNA, 435 bp, Candida albicans
gagcatttcatgagattgcatcgcagccacatttccgatcaattattagaagacacatttgaccgtgttgccgatatagaagctttgggtagaacaagagaattggttcttaaagatttacagttaggtagtcattatgaaatgttgaaaaagaaacaccctgaaggagaaaatttcaaattttttatgatcaaatcacctaaacaaaatgatttacatggagatttcgataaatataatactgaggaaatcaatcaagctgatgatgatgatgaagatgaagacgatttatatttagaagaaattaaccgtaaggattgtcgaaaatggtggaagaagagaatgcaaaaatatgatcgtttatttcttcctgatgataacaaacattcagaagaaggtgatcttgatataaatagacctcgagaggatgagtag

SEQ ID NO: 8628 - DNA, 249 bp, Candida albicans
ttcttaagcgggcagtcggctagccaccgtggtgaaagaaaagattttgattgtattagtgatttatctgatgaccaattatggaaccacgtgaaggaatgtaactgtatcaatccatttggtctccttgacaccaacacccttaaaactggtgttattaaagctggtaaagctaacatcaatattcaagctagtggttccttcagtttcggtaataccgattctaccctgaccaccacttcatcttaa

SEQ ID NO: 8629 - DNA, 204 bp, Candida albicans
gaatcgggtcacaaaaattctttcaatttttcaaataagaaaaaattgcatagggcttgctgttggatatggctagagccaaagaaaaaggattacctcacgcctaaaatggaatttgaaaatggaggagatgagttgagctttgtgttttacactttccctattcaattgtgccgcaaaacttcaatatctaacacagtgtga

SEQ ID NO: 8630 - DNA, 216 bp, Candida albicans
ggcaaaaaaaaaaatgagagaaaatctgacagagacaaaaaaaaaattttttttcatagtaaactaaacaaagggcaatcaaatcaattcattgccaaattgataactagaaaaaaaaagcgaagagaagaagcaaaaaaaaaaaaaaaaattttttcatacattgaaaagttattgcgtacacgacctggttttgtgtattttataattctatag

SEQ ID NO: 8631 - DNA, 249 bp, Candida albicans
acttttccatcttattgctcatatcgattatcattagtactttataaattcatattcatcatgcattcattttataccagaccaagtgcgttccattccaaatcttctactgctttactattaggttatttggccatttctactactgtgccattctttttatcatataaagaaaccaatagtaatgccattggtaatcaactgttaaaaggtacgatatcagctagatcattattcaccaagttatga

SEQ ID NO: 8632 - DNA, 195 bp, Candida albicans
ttgaaagggggctctgatttaacctccgccctgccacatttgaaggattttttttttatgcaagttcttttatattttaataatatgtttgagaaatataatcaatttttgataaatattcgtcaattctttacccctaaaaaaaaacaaagagccaaatacatctgtgtcttgttaaaacaattttcaaattga

SEQ ID NO: 8633 - DNA, 576 bp, Candida albicans
tactatctcccaccagcaatgatagcacggcaatcttatagaaaactttttagaaatatttcaattacaagagcattttcaaactcgcatttgcgaatactggaaactaaaaaggaacctcaagccaattcttcatcgtcgacacctccacacaccgatgatttgtattttgggaagttcacgaaagaagagtacgaagatgccaaaaagataattcaagagcaaatatcaaaactagaaggacaaattaagggagattacaatgttcgtgagaatttaggaaagttttctcaattccctgagccagcgtcacaagattcaaaaccagtcaaagttgaaaatcttagtgatttctttcgccaaacaatcaaattaactggtcctattccattgagcacctacatgagacaatgtttaacacatccagagtttggttattatacaaccagagacccattaaatttgcggacaggtgattttattacggtctcccgagatttcctctgtgtttggagagatgattggaatttggtatttcagtatttggcaacagcaaaaatatccagaatcaattag

SEQ ID NO: 8634 - DNA, 249 bp, Candida albicans
tcttacattgatgatgactatacttttttttatacacatatatttttgattggttatttcatttctttctgtttagctttgttactttgttccggttttgttatttttggattatttctaacgtttaatatcgctttttgggatgaatcactagttgttactaattgttatttgagttttgtttatagagaatctttgtggctttcaagagtattttcatataccttttttgttattgattttcgttga

SEQ ID NO: 8635 - DNA, 192 bp, Candida albicans
cacaacaacccaagaattcgattctattgggcccgacccttggaagttctagtaaatgaagacaattcaaaatggcgaacgacagcgatgacgaaagaggacagtgaggagtacgatagtactgatgacgaagatgagagcgagtttgaagatgagtacacaggaaacgaagatggtttatttgcctattaa

SEQ ID NO: 8636 - DNA, 216 bp, Candida albicans
cagaatacaagctctgagaacttattaacctatgatgctggttataagaaaatattgtttaataaggtaaaaaaaaaaaaaatttcacacaaaacaaacaagacaaaagaacagaacagaacagaaagatcaattagtaataaatgtcatcatattcattacattacaattggaaaacctttaattatcaggattaatcgatatttgcaatattaa

SEQ ID NO: 8637 - DNA, 204 bp, Candida albicans
gttaacaacctcaaaattataatacgtcgtcaaaatttttttttgagacaacgtaatatggtggggtggggtgggttattgaaattcacaaattattacaatttgttatacccaaaaaaaaaagaaagaaagaaagaaagaaaggaaaagtatgaaaataaaaaaaaaaaatcaggatataagatcatacgatattttttatga

SEQ ID NO: 8638 - DNA, 204 bp, Candida albicans
gttaataataagtcaattattattcaagttttagaaactttacttaacggtaaaagttttaaacccagaatgggaagtacagtacaatgcaatgcaccaagaagaagaagtttaaatgagaaatatgagtcaaggatttacttgctgatgatgatgattttgagtaattctagactatgctttgacaaaagacttgcaagatga

SEQ ID NO: 8639 - DNA, 300 bp, Candida albicans
acaattaaaactccgcaagattacaatacaatacaatacattacaatacaatacaatacaatcacaaaaaaagaccaaattaggcagttgaatccgatcataactagttcactaattgtgcatttatgtatcatgtataccccaggcacatatacatatgataataatacccatctatgtgttaccaagtttattactgtttattgcggcattcaagcattcaagcattcaggcattcaagcattcaagcgttcagacattcaattcaatctttcatcacaattttgtaatttaggttaa

SEQ ID NO: 8640 - DNA, 222 bp, Candida albicans
ttccataaagtttttatggtgtgccactttatgcggatgtctacgtccaaaaaaaaaaacagcacaaaattttctcatacattaaaatttattcttacttatcatccaccttactctcttctagactacatcaatgaatcaacatattatatacactcgaagatagataacatggtattgataaaaatatgttttatcctggttctgtatatcaaatattga

SEQ ID NO: 8641 - DNA, 765 bp, Candida albicans
  unsure (742): Identity of nucleotide sequences at the above locations are unknown.
actaatcaacatatatataaatacttcaccccccctccctcctccacaacattcatcatgtcatcaaatcaaacgcctactactgataatgtattgcttactcttaaggaagctagaaagttagctctcaatgaacctcaaaactatcctaatgtattacgatctatgtttaatctcatcaccaaagaacctgaaacacaacaacaaacatcagagattcaacaattaattgttgattttatgtatgaaacatttataaataattctatattacaacaaagcgtcaaaatcgaattagcaattgattctttagatgcattaacaatcttgaccaatattcatgatattgccacattacgtaaagtcattgatatatcatgtgttatatatcgattacttttccaatatgtggcacttaatgataatagtaatcaaatttggagtaaaattactgaattgaaaaatgttttggttaataaatttcaaagtaatttccctttaccaccaagtgataatactgaacatgatttattaagaaatattgctacaaaattagatttattaaaatttatgatgacaattattgatgtttcttcgaaaactcgtataattggtgacccaatacaaaataccaattccatgcaattttcgttaaatgatgtaccacccaatcatagtttaatcaaatatgatcaaatggaatatgaatcacaagtcatttttaaatcaatggtaattaaangggtgttttccaaatttaaatga

SEQ ID NO: 8642 - DNA, 186 bp, Candida albicans
agaaaccaagaagttagagaaataaagaaaaaggccaaaaaaacaaaaaagaataaaaatttaggtgttgccagaatgattatggaatatatatgtatatttaaagtattaatctattgtgtcaaaaaaagtaaaagtacaagtaaaatcatacttaacaaaaataataatttgcgggatgactaa

SEQ ID NO: 8643 - DNA, 285 bp, Candida albicans
tataacaatattaggtcagattcttccacaggtaaaatgattcaccaactcaaggttggtgtggaaaacagtggaaacaatggaagcaatggggatggaggaaatgatgctagtgttgttgtggttttgttaacgagaacgaacaggcatcatccccttccaagttcacaatcttcaacaaacagtaaccaacttaatagttctcaaacagcaccaggagctgctaattatttgtcaagtgtcagtgttggtacattgatgattttggtcttagggttgatttga

SEQ ID NO: 8644 - DNA, 225 bp, Candida albicans
acatctaaaaaaggcttgactagacaattacttttagagaagcccattttaccccctccaccaactcttatcatttggaaaaaattgaataaaaatgatgataaattgaatcaaaaacttgttcaagtagcggtttcattggaaaacaaaaacaggatccatttggagtcagtttttacattacagaatttacacatcattcttaaatacttacatactttctaa

SEQ ID NO: 8645 - DNA, 720 bp, Candida albicans
attcaaaattttcaacaaatgaagtttattatactattatttgctttaattcagatcactgttgctgctaatagagctcttatcatagattacctgtactatggttgcaacttaaactgttatatagctctgaatcaagagaatacatgtggcgcccatgataatgatgtttcggaccaacaataccatgcttgtttatgcatgaattatgattattttactaatttgatgaattgtaattgttttgatagcaatgtttattatgtctcatcatcaatttgttctatggcaactgcaagctcagaatttgaaacgtatgatggtgccccgtcaaccatgaatgtctcgactactgattatagctcatcaactgaggatatttcattcacagaggatgtttcattcacagaggatgtttcattcacagagtatagttcattcacagagtatagttcattcacaaagtatagttcattcacaaagtatagttcatctgtttcttccttcactaaagtcatttggtccactttagagacttcatcgattaagggcattgcagctaccacaagcagttattttaccaacgctcaaacaacttcaggaactgctaatgattcatcaatatctaaacctagtggatctcagatttttgttttatgtgtgatttcagttgttggatttattttctttttccttttcttcctcagtttatttgtctag

SEQ ID NO: 8646 - DNA, 195 bp, Candida albicans
gataattattttttcttgccgttggggggggtgggttccttttttcttttcgcatccaagaaaaatttttttttctttctcaattcaaatccaaatccaactcaaatcataaaaaaaaaaaaacatgaagttaatttaaattctgttagcttttatttctatttttcaccacaaactccaattggatttacttaa

SEQ ID NO: 8647 - DNA, 192 bp, Candida albicans
gaaagaaaaaaaaatttttcttggatgcgaaaagaaaaaaggaacccaccccccccaacggcaagaaaaaataattatcctattttgttagaaagaaggaaagagggagggagagagggaggggcttgttttccttttctctggttatggagtttgactgtcgaagggggtattgatcaggaaatacattaa

SEQ ID NO: 8648 - DNA, 183 bp, Candida albicans
aacggctaccaaaatcatcaccaacaaaaaaaaaatgaaaggaattacccaccactcactactaatagcattcaattcacaacctacaaggggaaaagttattcaattggtagtttgaaagaaattaatatggttaaaagggaagcagcagtagtagtagtgggtgggtcggttggtcggtga

SEQ ID NO: 8649 - DNA, 234 bp, Candida albicans
gacgaactttacaaatttacacgactcacacacagatttttttttttttttttggccattttccacacccagggcagacagacctcaaatattaaattaattgttcttcatcccattgctaatacttcattcaagaactttaaaagtattgctgaagacttataccccaatcaaaggataagacgtgaagtaaaaggttcaaaatactacaataatggcttcaattacaagtaa

SEQ ID NO: 8650 - DNA, 207 bp, Candida albicans; identical to SEQ ID NO: 7046

SEQ ID NO: 8651 - DNA, 222 bp, Candida albicans
aatataataatttttttaccccctaaaaccacaattaatttgttcatgcaagattcatcagcaaacataatatcccccatttgtggaaagaaattaattattaagggatacaaatccaatatcacaaagcacaagttttgttattactttaacccaaataagactcaatataatgcaaaaaaaaatgaagacaaaattattcttcaacccgccttgggttaa

SEQ ID NO: 8652 - DNA, 195 bp, Candida albicans
agatcttcacgttcaaagaaagaacacaaattgacgcaaaattataaaatgcaaaatctaattcgaattttaagatcttataattcttcttttatttttaattatataatagtattaaaagtatatttctctagccacatttggaatgtaaataaacaaattattgggtgttctgcccaaagagtttcgccgtaa

SEQ ID NO: 8653 - DNA, 426 bp, Candida albicans
aagaaaatcgctattcaaatcatttccatgacaaacagaaacgaaaacacagatgtcaatgtcgatttttgtcttaaattatcaaaattaccacccgaggttcttgttgtaattttgggttatttaccaaaatgcgtgttgcccgaattattgtatttcccaccgattagagaagttgtcgctttcacaatcttatcaaatgtaaatattacatacagtatggaacgtcaaagatggaaaggtgaaccatgtcctggttacattgaaagaaactatcatcggtttgatataaaactcaataatttgaagaagggcataagtcaatggaatatatacccgaaatccattcatatggatggctcagatcaacttgagcaagttttggaaactttcccccgaacttttaaccaaagctctggatattaa

SEQ ID NO: 8654 - DNA, 201 bp, Candida albicans
tctgtagtacgagatgaaagtgatgatctggttgatgaagaaatttctgtcccattggatgtattgacagttgaattaaaagtgtcattagtggaaaatggtgtgtcagtcaatttgctagggttgattaatgcaagagctgaatattttgtaaataattgggcatcagttaaatctcgaggccaaatactgacaaaatga

SEQ ID NO: 8655 - DNA, 195 bp, Candida albicans
tctattactaaaactgggttccatctgaaatttttgaaaaaatacatttttcttgtcatgcataaaccaagtataaaccaaaacctaactataatgctattacaagggatggatatattaattaagttctatctatcatcaccacgtttactttcaaaattgaagtttctttttctatcaactttgttggcatag

SEQ ID NO: 8656 - DNA, 228 bp, Candida albicans
aaggaaaggggaaataaagtaagtagggaagagtggattcaacaaaatgaggtgaacaaaacagtcaaaacaatgaggatttggaaatgccgtaaaacaaaaaaatttcttccattggataatacaagaatgccagatttccatgaaaataaagtttgcaactacttaatgcgatgcgatggttggttggttggttggtgtgaatttctttttttctttctgggctaa

SEQ ID NO: 8657 - DNA, 234 bp, Candida albicans
  unsure (140): Identity of nucleotide sequences at the above locations are unknown.
ccaaccaaccaaccaaccaactatccactcaatgaatttgaaacaaaacagagaatggtaagaaaaatagactttatacacgcacactatcataataatctccaattccgggacaaaaaaaaaaagaaagttataaacanatatagacgaagatcctcacacctgttggtttttttgtctttccttatttcaaacgatgattacaaaatgttatgtccaagtgttccgatatag

SEQ ID NO: 8658 - DNA, 891 bp, Candida albicans
agtttctccacccaaacatttttcatcttgttctttaactcttacttctcaaccatgaaagaatttcaattcgacccagaatctttttcaaaagtaacatacaacatcggaggcatttcgacatatatctacaactccgacaaactagcttcatacgttgaaaaattcaacaaatttgaccatccgatcgaagcaattccaatcaacgtgatttacttaattcaccataggggcggcagtcacaaacatacagaagcaattgcttataactatttaaaacaattttatgacaagaaatcccaagactatgatattcctttgatttgtgttacattcgacaatcctaaccatggacaaagattagttaacgaacatagcaactccgattgggcagaaaataatgaaacccatggtgctgatatgatgtcaattattgaagggactatccaaaacataagattgataatggattatttgccatcttatttaaacttggactcttatttaagtgacaaatttaagagaattaaccctggaactgaaatcaaattccacaatatcttgactggttactctttaggcggccatgtagttattcgctatggtatagattacccccatgacgttaaaataattggaccagttgttggatgcagtgacttgacttcattattagtgactagattaaaatcaataactaacaacgataagaaatacttttatttcaattatgacgaattggatctcaccgatgaacagaaaaagcaatatccagaaacattacataaaagaatctcgaaacaagatcaagcaatttttgaaaactatccaatgaataacctcaaaatgtttgcatcttttgagtcgcccccacgccctgaaaatcgggta

SEQ ID NO: 8659 - DNA, 192 bp, Candida albicans
tgttggccaggagcatgcagagatagagactttctaaggatccaaagtcatataaattcatttgagcaatttaggaaacctgttatcaatgggattcagaacgcaacgttctgtgacttgcttgcgatgtgggatttgatatatagtaacggttttatgatgttggttgatactacaaatgtcgggtattag

SEQ ID NO: 8660 - DNA, 189 bp, Candida albicans
attctttattatagtttctgcttcttacaaaatcaaaatttgcaaatcaatctcctccatcttgcaggaaaaaaaaaagagaataaaaagtcagatcaaaaaactttgattcctttttacgagggaggttttttacaacacaagattttaattacatatagtattactacaatatttatgaagatataa

SEQ ID NO: 8661 - DNA, 225 bp, Candida albicans
aaacaaggttcaactgctttctgtagaacaaaaaaggccgtttttgccatagttaaggaatttgcggtgatgtccgttgaagactgcgcgatgaaaaataacgctacaaaaatcaaactagtgccgatttatacctttttttctatgagtgctaaccatgcaagaactgttagaaacgaaatacaactgctatctgtggaacaaaaaagtccgttttggccatag

SEQ ID NO: 8662 - DNA, 204 bp, Candida albicans
cgagtttgtgtctgcttaagtaatcatgcgagaattattaaatctgaaaaagttataacagaagaagaaggagagagagaggaaaaaaaaaagtgtacccagtctgaaaacaaatcttcgatccaattgtttcttttaccaattgtatactatcaaccccccctcagcaacagatattttcttcatagaatatcacccaattaa

SEQ ID NO: 8663 - DNA, 186 bp, Candida albicans
attgtgtttggtgtttgttttagtaaaaaaatcttgtacgtgattttcacaattattgagttcacttcctcacaagtcagtgttcaagaaataagttctgtttataagacctatagtctcatctctctctctagctgtaaggatttaaaacttttgaaaacaacctttatctacaaaaaaaattag

SEQ ID NO: 8664 - DNA, 189 bp, Candida albicans
gacagcaaattcagtaatgaaatgatttcctcccttaatgcacttttatttcaacacaaacggataatgcagatagaagatttgatctttaatgaccatactaatgatataaaaaaaaataatgtatatataccagtggaagttgaagttgaaatatcccatgaatgttatattaataaaataaactaa

SEQ ID NO: 8665 - DNA, 294 bp, Candida albicans
tccattttaactaatttcatcatgtcggagaatttaaagagagcagaatcattgtttaatagaataatgaatcaaacaactaacaatgattcatcaacatcatcatttgcatcacaatcatcaacatcaacaacaccaatactggaatcatcaccaactacatcaaataatactactgccaatacttataattcacgccctaatatttttggatccagcaaattcaattcattttcaaaattcggtttcctactgtttcatctaatattcccaaattggatattgaaaaattaa

SEQ ID NO: 8666 - DNA, 255 bp, Candida albicans
ccatttattcgaggtttgactgccttggtattgtttgaagctgctaccaaaccaaaaaatacaaagccgggtaagctatataaatactatcaagagaaattgtcgtgtatgattttcaattattttttcatcactttttttctttctttctttctttcttactggtgttgctcaaacatactctgtaattgtatttaccattcattcattaatttaacctataaacagtacattgtatggaattacccaatataa

SEQ ID NO: 8667 - DNA, 207 bp, Candida albicans
agaggcggatctccagccgtggtgaagatacaaaacaatatagtagacaagttcaatgtctggccaacacacacaatcctgactatattgcagaagtgtaaaaggcaaatgaaagcagccttgtcgcaaactaagttggtacgagaatacgtgattccacacgactatgtgcatatctcgcattctttatctcgcataaaaacttag

SEQ ID NO: 8668 - DNA, 744 bp, Candida albicans
attgcaagttttagagtacacttgctttcatccctattcttcatcattatcaaaatgcctagtctggaaagagatacattattagctgaatcaaagactattttaaaatccgtgacaaattggaaaccaggtaaacaattcaaatcaaatgttatcccggaaacaatcaccacatcaacatattccaccacaaatatcagagataatcaattttggtgtgctcgagaatcattaatcccatcagcttataaacaaaaagtcattgattgcctaattggtactgcaaatattggatcaactcattctgatcatgaagtaaattatgttgaagaatttgattccctaaagatttcaaatgtaaccgagtatcccgatggtggttggagttatgaattacatgcaaactataagtttggtaccattggcataagtaataggatgttttatgaatcggttcatatttacaaatttgacaagagcaaccaaactgaggaagatgacaaagacaccaattgtgcatatattataagtgtgcctatagatggtcctactggaaattttgtcattggtaaatatcattcaattgaaaaaatatcatggagtgataataaagattcggacttgaaatggattatggcaactacatcagatgctggtggatatttacctcgctggttaacgaatatgattttaccaggagcaatttctaatgatgtaccaagtgtattaaaatatatacaataa

SEQ ID NO: 8669 - DNA, 621 bp, Candida albicans
gtggcgagcgctgatcttccatcccggctggtgcaagacgaacaaattgaaagtgttgctatgggtggaagtatgttacaaacaagtgtaaactcaatacgatcattgtatgttcctaatgatattgatcaagatttcttttacattacatgtaatccgaaacaaagaaatttccaaagttcattaccttatttaccacatctttcaaatatgaatagtgatacattgaccaaatatcaactaacggcattatattatttacatgatcaattgagtaatattttccaaccgacatttttcgaaaaccaactccatgaatttttccataaattcaccagtaataaattaaatgattggatgttttattatattaaatatcaagacaagtatatcattatcatgaaaaataaaagtaaaaatacaacctcagtattgaccaacaatcaattgtctgcaagtgtaccacccaccattgaaagatcaatagtcaatagaatatctgaaggggtattagattatactaaattggggtttttagagaatcttggagatgatgtaaagtattggttaggtactcaacaagaagatctagagtcaatagaacaggtttctttactgtga

SEQ ID NO: 8670 - DNA, 261 bp, Candida albicans
tttatttatatgtcattcaccctttcaaatgaattgaataagaagaagaaaatacaatccatattgattctttccaatatactaacatcaataactgtttcttttagtcgttcctttttttataattcacttgtttgtcagatagtctcaactgtacattcgtttttcaactactgttcatttattttaattatcaatgagattttcacaagctactgttttagcctttgcagctttatcgttagctgctccagcttttga

SEQ ID NO: 8671 - DNA, 246 bp, Candida albicans
tttgaaccaacattgtttgcacccagaggcaatacaccatttccagaaccaccagaagaatatggccatgattgtccagcagaagcagaagcagcagcaacagtaataccagaggcagcagaagaaaccttaggattaacaatgccgacagtattagaactagaaccagaaccagaaccagaaccagaaccagaaccagagtcagagccagaacctgcagctatagtattaccagcatttgaataa

SEQ ID NO: 8672 - DNA, 222 bp, Candida albicans
ttaaaattacatttgaaattatgcaattttttcctcgacgtactagctgatatattccctgaaactgcagatgatgaagatgaagatgatgaattccccttagatccactagatcctaaagatgaagcaaattcatcaaatttatttaaaaaagttcgactggtagtcatgggtgtggatttaataccattggtgttactagtgttggtacttgatttttga

SEQ ID NO: 8673 - DNA, 249 bp, Candida albicans
gaggttctagatttgaatcccggtttagtgttgaataaaaagccccacaactgcttgccaatgattaacaataatgaccaaaaaaaagagaacgagaaggagaaggagaacgagaataatagatttacctttctgttaatctgtttcaaattaagcgatatgaaacaaagactggaaactattgcaatagatagtaataacagagcctacaataatgatgatgttctgttatttggtactaacgagtaa

SEQ ID NO: 8674 - DNA, 216 bp, Candida albicans
tgtaaaaatcaaactaacaacgaacgattcttcccaaggtatagtttattctattgtgtgattattagcacactattgactaattcaatgacaatttatcagacgatcattaaatttgtaccaacccagctcaacaacaataacaaacacacaattagcaggcacaactttgtgaaggaagtaaaagtgaataataataagaattatacccaatga

SEQ ID NO: 8675 - DNA, 780 bp, Candida albicans
cgacatgcgttctgccatgcccggtctgatgtacaagagatgaggtatgctaaaatttggacaaattcgcatttcaactcgagtgtgaaaaaatggatattgcgttgcagagtattgcattcgagaatttgcagttttattcatgaacttgaaaactatatagtgcatgatgtcattgaacataattttgaggaaatcaaaaatttgattcacaccacggctactaacttggcgacaagtgaactaggatcagacataaatgatgaaggtgataatatattcaatggatctttgattcgaggtacatttaacaataattcgatctttgattccaaagttcacaaacataggacaacaacatacgtggaaggtatttcaacagttgaacaattaattcaaaaatttctagattattcaagtactttgttgaatgattcgttgcttacccgtgaagagtcgttgcgtcaattacgtaaaatgttggacttcattttccatttcaataattacattgtccaagtaaagaaagttttggtattgttgaaccatgaattgttcaatgagtattctaaggaattccctaccaagtttgaaaagccaatggatcaagagctgatagataaaagatttgcaaacttgagtgatacttttctaatgcagtacgaaaagtttggtgaaaatcttgttacatttttagccaccattaaacaggttggtgaaagagaaaaccaaggattattggaattaagtaatagactagaactttgtttcccagaatag

SEQ ID NO: 8676 - DNA, 204 bp, Candida albicans
ctccagctgttgaaaattaggaatgaagggaatttaacaaaacagagcaaaacagcaaaaaaaacggaaaaatgtttatcctttcttacattttggatttacaaggttagtttcttttcctttctccctttctctttttcacttttgtacaattatcctaggttaattaggttagaagtcggcatttatgattggttaaattaa

SEQ ID NO: 8677 - DNA, 207 bp, Candida albicans
aaatacaaacctgaaacggccaaaaaaaaagaggaaagaaagacagggggtgtactttcaagtatgtatgaaacagcattaatttttttatttcatttatttatccagccatacatacatacatacatacatacatggaaaaaaaaaacaaggcgaccacctcagtttcaaatagatctcaataaacgaagtattaaaaaatcttaa

SEQ ID NO: 8678 - DNA, 255 bp, Candida albicans
  unsure (147),(165): Identity of nucleotide sequences at the above locations are unknown.
gatcaatccaaaaaaataaatgcgctgtcaaaaaaaaagagaaagaaaattaatccgaccgaccccctggttgtaagttactactatggagaaaattatgtgggacctgaaaagaaaaagagggtcccaaccgaagaaaaaaaaaanacagtttgtttttttccnaggggggtgtggggatgggcgacaattaccaagactacaaccacgagaggcaccataaaaaaaatacaacaccctggtgaattaaactaa

SEQ ID NO: 8679 - DNA, 255 bp, Candida albicans
aagatattgtatagagatcgcatctgtatgaataaacaaatgtatttatatatgctatttttaaagtcttacttggctaatccattcttttttacaacagcctttccacacgtgaacttacataagcaatgggcttgttctcttcagacaataaaagcaacgctaagacagaaaaaaaaaaatttttttttgcgtttaaattctacttatatttttgcagaacatcatttgaagagattattgattaaagtatag

SEQ ID NO: 8680 - DNA, 186 bp, Candida albicans
aaaccaaaaaaaaaaagaataccaaccgaagtcaaagttgaaagaaacaaaatctgcacaagagatttaagtatatttattttaagtaaaagaaggatttctattatttttttgtttaatataacccatcatattgaaacaacaacaacaacaacaaagcgtgttaggtcacagatactaaaatag

SEQ ID NO: 8681 - DNA, 1008 bp, Candida albicans
  unsure (953): Identity of nucleotide sequences at the above locations are unknown.
atggaccagcaagtttggaaccctatattttcaccaagcgggacaacaccaggaaagtctccttcttactacaatgagttggctcctcaatcacagagtcacatatctaatcaagatccgcaactcccattacagactcaacaccaccaactatttcatatagatggtggctccaatcattcaaccccgtcaggtaatattcaactaccatcgtcgtctcaacaaaacacgccacatattgtttctaatactcccactgcttttgcagacagtgatcaggtgttcttacaacatatggaaatgtatgacaaccaacaacacactaaccagtctgcaggcaatactccgggaccaatatcattccataatcataatcctaatttacaacaagcatcccaacagccacatcagcacatatccccacatttgaacaacctacaacaacatagtcaacagccataccaacatcaacattctcattcacgctcacatatagactctgaagcaccatctgcaaatgacaccccaacttcttctggtgccttgggcatggccccacaaccaccactcctttcatcaacaaccaaccctcaatcttttgatctcgggttagacacaataggttttattattcctgaagagttgaattttgatactgatccaaatcacatatcctctgcatttccgccgcaattgcctgctgaccagactccaagtttattagcagttgataaattgaaacagttacaacaacaacaacagcaacaacagagacaacaagaccctttaagtgaactttcatcgccagtgctacctggacaaaacgatcaatcatataatccacatcattactatcatcgacagagttcaagcaatagtgtttttgtcgccggcaaaaatactggttcatccgtttcagcaccctcacagcacgtaagaactgatgctgtctntaccccccttagtttcgcccgtcgttgcccctttagatacaaatggcaaggctga

SEQ ID NO: 8682 - DNA, 399 bp, Candida albicans
  unsure (16),(231),(255): Identity of nucleotide sequences at the above locations are unknown.
gaactgatgctgtctntaccccccttagtttcgcccgtcgttgcccctttagatacaaatggcaaggctgataaggaaaatggtaataatagtggtggtcacaacaatctgcataatagctcattctcccctcaacctgctgtacagatttctttcgaaccattgacgttccctgcattgaatgctgagccatcgacaataaaatctaaaggtgggaagaaaaatcacaangaaactgatgaacgaagaagatcnactagttcagcatatgctcctagtttagatgagaaacaaccatacccacgtttaaatcctcttggaagccaattttgcaaggtcatacaaacaatgcttacaccgtccaatggttattggttaaccatacaaattaccaattaa

SEQ ID NO: 8683 - DNA, 1032 bp, Candida albicans
acgcggatcttcacccgtggtgggcacgatgtgccggtggcggagatgattcaagtgattggacgtgcacgtaacaaggtctcgcatatggtggagctatattcaaatcgggaccccgatgaggtgcggtgttttagacagcagatggcggcattttatgggattcgagcagcgtgtaataactgctgtggagtggttgacgccgagcacgaggatatgttgaggaaactctgggaagatgagccggaggagacgaaccagtatgatgagatagttgttgttgctgagactgaggaggagaagaattggtatgatgagatagttgatgaggccgagagtattatgcagcagattgagatgggcaacccggtgataggcagtactttcaagtattgcaagatggcgaagtatattcagatgttcaagagccagcccacgtttgaacatgttgacatgtgcggatactgttacatgccggttgcgtactgcactcgcggaagacatgggtgccggtatcagaagacggtgaagaatgtgatgatggtgaggtggatcttgggagacattgatgttgaggggatcaaagagattattggtggggtggaaggggttgaacagattaactggattcgtgagaacgaggagtatgcgagtgctgggattcgggagtattgtcagcggatggtgtcgcacagttttatcaatgtggatgagttgcctcgggggatgccgacgacacagctgatgtttttgatggttgtggaacagtggaaggatacgagtgtgtttggggagggcgaagaggatcaggcggttgctcggaatgctgatgggtactttgcaagcaactggaggaacgaggttgagtatatgacgtttaagatggaagacaggtgccagtggtgtggcgtcggagtcgggcggcatcagtgctgtgggcggtttatccccaagttgttgtatgcgatatttgttgaccacaggatgccggggtatgttggggatttgcgaattttcgaaccctggttttga

SEQ ID NO: 8684 - DNA, 237 bp, Candida albicans
tggcaatttaccaaatctacaacaaaagtgaatcctgttttcgttcctcaatttatagccacccaaaatccctgttcaattgaaaatctaaactatacagccttagttgcgttctccattttaattctacctttgtattttcaggggttgggtcgtttttccatctctattgaactgttgttagttgaattgacagcaattccttactgtaaaattcctatcctcccaatgaattaa

SEQ ID NO: 8685 - DNA, 234 bp, Candida albicans
ttcatatttgaccaagttaaatgtttaatcactggaggcatacataatataaatactgataataatatccaaaaaattgataaaccatttataatccaaccaattttccctaatttaaatgctgcaccacgaacttttttccgtttattaatcattaaacataatatcgggacaccattagctaatgctaatgatatgacggcagcacccataaatgcattaaaagctgattga

SEQ ID NO: 8686 - DNA, 528 bp, Candida albicans
atagtatataacagagttttttttttccttttaatacccccttatccctccaatacatttagaagaacacccccccttccacacgatatggaaaaagataatcccttattaccttttgcttataccaactcatcaattaacgattctatcccttatgataccacacccagagacaagtccaccattgatgaaaatgcaagtagtaaatatcacacgaggaaaactgttttatcagcatcgtcaccattgaaacctcaattacgtcgagtagcattatctgaacaaagatttcttcctagtttgaaaagaaaaatgggtgaaagtttcaatgacaaagataatattaaaagagtcgaccttgaagatttctacgacgactcaaatgaagaaggagaaacacctacggtaattaatattgatattgacaacgacaatgaacaaggtgaaaatgataagtaccaattgcctccaagtagtccaccgccacctttatatttttcaccacgaccgcggcaaggaccatcgtaa

SEQ ID NO: 8687 - DNA, 240 bp, Candida albicans
ccccccccacaacaagtaacaaacaatggcaatatattttgtggtaaaacaatctgccacacaccgagggtgaagaatagagaaacaacaattgttataggtgcgtgtaataatgttcaatttgtggagagagtgtgtgggtgtgtctttgtggacaatcttgagaattattttatcacattcaccaccaaaccacgacaatctcactcatatatccaacggttaaattttagacaaagt

SEQ ID NO: 8688 - DNA, 231 bp, Candida albicans
tcaaattggtcagaaatttatttaagcaaagaaaattttttctttttttcttatcctggtggtaaagttacacgaccactaaattttcctacctcctcctcttcctcctccgatgatcggatgacaattagtcaattcactattggttataatttaatcattaaccaaccaaccacattctataattatcttatcattctaaaatcacatctgatgatgatgactaagtaa

SEQ ID NO: 8689 - DNA, 222 bp, Candida albicans
cgatcctgcatatttcgtcataattcacacattcttaaaattattcacacatccttgaaatgtgttaatattcccaacattatcaattatatgtgttcagaattggttgcaaagttatcaactcaattcacgctatataaaccttacaatttctctacatttttatatttttttatattggcttttcttttagaatcaatcaatactttttttatcatttag

SEQ ID NO: 8690 - DNA, 186 bp, Candida albicans
cctaaatacattcccttctttccttctttttttatttccattttcacatattgcttctttcaaattcgtatttcagattctttgctacaagatactaatacttatttatttatacaacattcacacactcacccccctacatccttcatcttgtcttcaccacggggctggaaggatccgcgcttg

SEQ ID NO: 8691 - DNA, 426 bp, Candida albicans
aataggggatttatgtgtaagatcaaaaatttccaaatgttggaaaagtggtttaaccatgttttaaagagaataccttcgagaattttaggacaaagatttgctcctattaaatcggaaaaagaagcagcattatactttagaaaattgatcaagaattcgatggaagtttctacattaaaggttatgatgaattccaaagacttaccaatggtattccttactagtggaggcgttaatagtgtatgtttatctatagtaattattgacattggactttgttatccgctcgtgtttttggctgcaacctttgttacaacaaagaaaaaccaggtagtaggaatggacggagagataccacaagtaacgaaattaccggaaataactagtatttgtacttatacatttgaaaacaacggtcaataa

SEQ ID NO: 8692 - DNA, 324 bp, Candida albicans
gctctcaatataccactattgaccgaagcaataccatcgaaaatttgtaaaacactcaccaaagggttcaataaatcgacaatgagtgaaatcacttcaggatcatctgagaaaatccgagcaatctcgtatcggaacgaaaacaatgctaaacagtttatggtggaaacaatcactgccgccaccatggctactctagtggctaagatagctccaaccatattctgcccaccaataaaattagcaatcctggtggtagcagcaattcccacagaaaatggtaccatatatgtaagtgatgcaatactggaaacggcactctga

SEQ ID NO: 8693 - DNA, 195 bp, Candida albicans
gaaatgacagagcatgtcaaattttccagtctcacagaaataaaatcaacgcgtgatatagtaccgtggatgatgatggctcaacaaactacagtagatacttttaatcctctcatagctatacatatttcatttactaacagagttgtcaatattgccatcaatcatcaattgactaaactagccctggtataa

SEQ ID NO: 8694 - DNA, 369 bp, Candida albicans
ttttatttctgtgagactggaaaatttgacatgctctgtcatttctcatccttacattacccacacacatccatgccaacacaaagaacttcccgaccagctacccacgaacagatctccaagtccagagtggtgaatgcgtcgatcttgacatttttgaccgtgctcattttcctcatattgttgtatcatttcatatgggctgtgcaggtgatgatgtaccaaccatatggtaatcttctcaataacatagtctacggaccagggactttgattgccaatgcaggactaagctcgaaattgattaaatacattaacacaaagttggtcgaagataaaatagaggcagactacaagaagtatatataa

SEQ ID NO: 8695 - DNA, 489 bp, Candida albicans
  unsure (3),(44),(101),(106): Identity of nucleotide sequences at the above locations are unknown.
atnataaaaccgaaattttatgttagtgattatgcttgttcatntggtcgtgattttaaagctcaattatcaacggtggttttatttaaaataatcaaganaaatnatcttaaattgaaaaattgggataaaattgtggaaattattgaaaaattatatcaatattcattgattattgatgagaaggatactactactactactactaccaatgataataaggaaggtgatgatgaaaaggataataaggaagccactgttgagactgacaactcaatattgaaattattgccttcaaaagatattaaaaaattccctattaaaagaataactaatgatctgtttctttcaatattgaaaaatttaattgataatcaacctactgaagaagaaattcaatcaactttagcagctatggattgtattaaatcattagatatcttgaatgtattaagaattgttgctgaatccaagaaacaagctaactaa

SEQ ID NO: 8696 - DNA, 243 bp, Candida albicans
cgatcctgcatatttcgtcataattcacacattcttaaaattatgcacacatccttgaaatgtattaatattcccaacattatcaattatatgtgttcagaattggttgcaaagttatcaactcaattcacgctatataaaccttacaaattctctacatttttatattttttttatattggcttttcttttagaatcaatcaatactttttttatcatttagatacatctttcatctattaa

SEQ ID NO: 8697 - DNA, 213 bp, Candida albicans
attatcttttctatatatcaaaacacgacacagtcacgtgccaaaaaggatataagaaggaacttcaaccctaagaaaaccaaaaactaccaatttaattcattctacataaactcatttgaaactatagcaagccaacaatttacgaacaatttgatcctcactattctgttttgcaccgagcgggacgcagaaaatatgaaccctgatgaa

SEQ ID NO: 8698 - DNA, 201 bp, Candida albicans
cctcatttagtcctttctttcagttccaaagtaggatgtgcaacatggccaattatcaacaataagctagcattgcataatggtagtgattgtactgaagagaacaatacactaatctattccattgacgacggaataagtggactgataattcacatggataattcagtccactctgagaggaatttcctctttatataa

SEQ ID NO: 8699 - DNA, 465 bp, Candida albicans
caaaccaacaaacttcatctaatgaagattatgataaatttattgatacatttggtaatttgcccaactttgattcttctaatcataattatggctacaaatctaattcaagaaataattcccatcaatatcaaaactaatggtgttgattattataatgccaacaattatcacaacaaccaaacccccaaccacaaccacaaccccaatcacaaccacagtcacagtcacagtcacagtagcagcaatgtaccacagtatgatggcaataattataacaaccacttgacgaaccatctgccagaatccgtaactagttccacgaatttatctacatcaagtagtaatttttcaaatctgacgtatcatcaagatccaaataagaataatttgacagattcattagatgtatttatgtataatgttgaattgagtgatattttatatgatgtgaaacccaattaa

SEQ ID NO: 8700 - DNA, 474 bp, Candida albicans
aatctcggatcctccacccgtggtgaagacttgaatcatagatatagtatggttcttagattattagaaagacttgaaacttttttgaaattgagatatcaaacatcagcaggaggagggggaggaggtgttaacaataacaataacaacgccttatctataaaattagaacaagaattcacaaacttgtatctttacaatgggaatgtattatcttcagatcataatacaaatacaaataccaccaatactattactactactactattacagacaatggtactaaacaaaatcagcatcattcacaagattttggattagaaaagactttatatatcttaaaaatgggagaaaatgttttgaattatatttatgatttaaatttaaaagtttgcgtatttaagaaattgggtgatagtttatcagaaattagaaaatatttaattgataatgaatctactttgaatggttaa

SEQ ID NO: 8701 - DNA, 189 bp, Candida albicans
  unsure (161): Identity of nucleotide sequences at the above locations are unknown.
agaacaaaataccaaattactaattcaagaaaaaactcgtctgtatttgtatttcatctgaaattactatgtcaaaagcgatgcccaccttcccttactactttgagtaagtcataccagtttgatagcaatttcttcaatgctatcatctgcatcttcanccacgagccgccaggaccgcataaggtt

SEQ ID NO: 8702 - DNA, 477 bp, Candida albicans
aagcaacaaagtcaaatagttcaacctgatagtaataataacaacagttctagttcaagaaaagaaccacaggcattacaaggtgttcctcaaggaccacaaccaccaccaccaccatttcaacaacaacaacatcatcaacaatttcaacaaccaatgtattcacaattccctcctcaacaaataccaccaaatcaattaccaccttggatgagaggtggtccattaccacctcatctacaaggtaaagggttcccacctccgccaccaccaccaggatttatcaacaaacaaccgccacaaaatcagaatcagaatcaaagtcaaggccaaaactcgaatcaaaattctgatcaacaacaacaacaactacaacaacaaagacttccgcctccaggaatattcccacctggttatatgcctggtccaccaaccggatctaatttcatgcctcccccactttctcagcaacaatag

SEQ ID NO: 8703 - DNA, 213 bp, Candida albicans
tttttttattttttagcaaaggtaaagtatacgaaatgtctaagaattgtctttttcctaacaaactacaagtacactgtttttaattatttcatttatttatttatttatttatattatacaattgattccaaggcccctacggccttgcacggccatgcacctacattttataaaacttgtgatatttgtaataaaacatttaataattga

SEQ ID NO: 8704 - DNA, 186 bp, Candida albicans
ccggaaatccagttaatgcatacatatgtatatgcagtttacaaaattgtgcataataaaataatatttgttgttattatttattatttttccggatatgcatttatctttcttttttgcagcacaattattattatagcacaaacttatgtatcggcaatacttgatgatattatttcttcttga

SEQ ID NO: 8705 - DNA, 591 bp, Candida albicans
tcgtgtagaataaaccaaataagaaaggagttgagaaacaacacactcacactcaccattgttattctttgcttttttacagtttggttggcaaaactaaccgaacagtatttctactgcaacaattgttcaataatatttatgaatactacaaatgaatcaacaaactataccactataaatgctagctctgtaaattggagtaacaatcaaattaattcttctttttccagtttgcgagtgcaaattaatgattatgatacttatcaaactctcccaaccagattggaccaactatgtactcaagtcactcaagttccgataatcagaatctatgggtctttatcggtacaaaactctttaagtaacacagattcgcctaacaagaagaagcggaaaatagatgagactacatcaccagcagtttttaatgttgttattcatgtacataatttctatccatatatctatgttgactgtcacgaaactgattttacgaaattggaaaatgacgattttatcaaattaataacagactatttagaaactgttttagaggatgtcttcaccacggcctgggcgtccaagtca

SEQ ID NO: 8706 - DNA, 891 bp, Candida albicans
accaaaactacgtccagtaactcccaagtagagagtaacaataagcaaatgaaaacaccggagaggaaaactatcaaacaatctatacgaattgaagaaactaaattatcgggggcgagggagggggggggaaaattaacagctaccacaaccacctcaagttcccccacggtaacatcaagtccaaatgtgactactagtaagttcttcactcctaaagcaaaacctattgagaaaattcaaccagaaaacccaacaactgaagaaaatttgaataaacccgattgggactccagtttaattgatgattctgaaattactgattatggtcacggtcataatcacgagtcatcggataaaccagttgatacccagaacatactagacgaattgactgataatgataatgaccatgaagtagaggaaccgcaacaggaaactgattctaatgcaatcaaaatacatcctatagttgatgtaaaacaatcaccacaaagtgataatggatttgatatttgttctaatgacgatgaaattgaagaatctccaattaaaaaccgagttgtagcagttggtggtggacaggaacaagttcgtactcgattacttgctttaaaagaatcatttctgtatcaatctacaaccaaatcaactcatcaattcactaaacccaataatgataggaaaagagttcctttacaacctaaaaatataaatcggatagaacagaaatcaccaaccaaatcaataaagctcaatcgaaaagtagatcaccatcatcaaaggtaccaagataataacaacgttaatatcctgaaagtggtatcaactgttaattctagaactactatagatattagacaatttgcatttaaaaaacaacaaacctag

SEQ ID NO: 8707 - DNA, 201 bp, Candida albicans
atttaccaatttaattgtcttgttttctttttttatttatttattttgtggcaattagtaaatgtgttggagtcgctttcattttccattttcaaaatgagagtgagtagtttaaacggagggtttagtaattatgcggggggcaaagattcaatgccaattttgacggattatttgagagtattattttgtaatttgtaa

SEQ ID NO: 8708 - DNA, 384 bp, Candida albicans
cgattctatgctattcaaaaaagaaaggaaatccagaaaaaaaaatatgtatcagtattgaaattaacaaaactaatttttggtgagagtttaactatggtagtgtatagagtgtcaaaaaagttttttttctcactgctctatacattaagttattctgtgtgtcacgtgcattttattagggctcttagggtttcatgcgatgttgtttttttctctcgtatcctctcacaattcacatttgttttgactttgtttgctatttcgtttgtgagaattcatagtgaatgggttaagcgtataacactagtacacctcatcacctgtatcacttattttaacacagtgcagtcatggcaaaaagagttgcagatgagcaaataa

SEQ ID NO: 8709 - DNA, 603 bp, Candida albicans
catattttggctgatgcaatttatggtgcattctcttgtaatgttaacaaactggaaaagcacaatgcaatgaagctagtgaaaatagatacagattgtatggggaatcaaattactgcaataacagctgtgagactgaaaaactacacatatactattattggcgatgctcttggcaatgtgaatattattcagacagactcaaatgattctatgatatgtcgggtccacaaattcaatattggtgatcagataaactgtatttttgctttgggtagaaagaaatcatggggagcacaaatttgtgtagtaggaacagtgctgggtggtttatttgtattgaacaatactgatttaaatgggtgtaatgattctttggtagaatttgctgcaagaaatcatctcgagcttttagattgtgatggagagctggtgaacaataatgagaaatctcaatgtaaagaaattgttagtgacaccgtcattgcaagagtattgagtcacattattgctaattcaagcgagttttcacaaacctacagtaacttatacctgaacagaaatctattacagctggtacattttgagtgtaatagtttatag

SEQ ID NO: 8710 - DNA, 201 bp, Candida albicans
  unsure (88): Identity of nucleotide sequences at the above locations are unknown.
gattggaccagttatttatttgaacagggattggcagagggccaaccaaatttttacaaaggggaagaggagggaaagaacacccagncaaaagattatttcaaaattcaatcatcggagcccaacattattattgtttccattggtttatgtactattcaaagcgcgatgattagtgtgaaaacaggattttcaacatag

SEQ ID NO: 8711 - DNA, 576 bp, Candida albicans
atgtatattgagagttcgatcaacgacaaatacattcgtacattgaattttgggtgtttccctaaaaatgtattggaattccaacaatcacaagattatttccaacagttaatattcattgattatcaattgcaattattaattgataatgaattttttcaaaatgaattattacccatttcattattatctgagaataatgtatcagctaatgaaaaattacaacaattaatcaattattcaaattcaataagtttaaattatgaaaatacaccaaagagttacgatgagaaattgtactatgctacattaatgtctcatttatattatttacaagataacttttttgaaatgagtaaatatttgaatttggttaaagtttcttatcaagccagatctaataatcaaatcgaaacagcatcttcagcttcatctgttagtttaaaccaaatagaattcattgaatatcttacaaccagatattacgttttatttggattaagtgcggggaacaatggagtgaacatttggttagagtatttgcaaaattttaaatccccatataataagtcttaa

SEQ ID NO: 8712 - DNA, 321 bp, Candida albicans
tattgtattattttattgtatcttttccagttgatcccttatacaaaagtcaaatcttgtctcatctgctgtactgtttggccatcacttagttacccctttgacttgatgccctcaaagccgtcatctagtgtggccactttacataaatattccacccttatcccgtctgttattatatacatatattactttgaatatcttcttgaaaacaactttcttctacttgtacaaatagaagtcgatttaataaatcactcttctttcaaaatcggtgcagacaaactcacccaagatctacaatacataacaaggtgttaa

SEQ ID NO: 8713 - DNA, 300 bp, Candida albicans
aaacaactttcttctacttgtacaaatagaagtcgatttaataaatcactcttctttcaaaatcggtgcagacaaactcacccaagatctacaatacataacaaggtgttaactaatatttatcatattcgttttcaattccaccacgttttcattttaattagtgccaacttgttcactgttcccactaacacattcgtttacaattcagtcagattctacactttaaaaatcacaccaagaggtatacacgcatcacttatcaaagcattcactatcaacttactcataatttgttag

SEQ ID NO: 8714 - DNA, 279 bp, Candida albicans
agagacgaaaaggagttcacatttctcttttcccgcacatttagggattttcgcaactacattattacgtcagcacaaccacaccacgacgacaaacacacggcaagaaggtacgaggaaagaacaatcaaattctatttgaacaatactaaaacttcaagaacaaacatacccgttgttgttgttgagaatcagagatcctttaatcaacaacttaaagactatcaacagaacaatcccgttgtaaacttgggtataaacttttcgtctaatttgtaa

SEQ ID NO: 8715 - DNA, 858 bp, Candida albicans
caacacacaatactaaattataaatcacaatttcaggttcatttaaatatatatattataataagtaaggagatgatgttgggaattttaaatcaacccaaaaagattttacaattaaagattcgagaaaattcaacagatttattatctacatcaacatctttttcatcaaggacaacacaaggatcaacaactgcaccttcgtcgtcaagcattcaacaacaacaaacgtcatctttaatgagcactaaccaaaattctttttcaacgacaacaacctcacaattcacttctaatagtagcccaaattccgcacaaactttttcatcctcaccagaaaattcgtcttcaagaatgtcaacacctactacttccatttctactcagccggcttctaccacaagtattcaacagtcacagagtttacaaacttcacagcagtctcaaccatcacaacaacaatcacaacagtcacagcaatcacaatcaccaacttcgacaagtcaagcaccactgtcgacaatgtcagataataatacctcatttgtttcaccaagtgatacaagcttactggtttctgcaacaacaacatcttcaagttccacttcatcaagctcatcatctctgacacctagcaccagcgacgtaacaacaagtagtagtgctagtagcagcccaagctcaaccacatcttcaagttcatcgacagcgttttccagttccactacagaaacttcgtcatcagccaccagttctagctccacaacatcttccagtattctgtctactcaactgaatacttcactgtcctcaaatacttcattttcagtagtcagccacggggctggagaaaccgcg

SEQ ID NO: 8716 - DNA, 285 bp, Candida albicans
gtagacagaatactggaagatgttgtggagctagaactggtggctgatgacgaagtttctgtagtggaactggaaaacgctgtcgatgaacttgaagatgtggttgagcttgggctgctactagcactactacttgttgttacgtcgctggtgctaggtgtcagagatgatgagcttgatgaagtggaacttgaagatgttgttgttgcagaaaccagtaagcttgtatcacttggtgaaacaaatgaggtattattatctgacattgtcgacagtggtgcttga

SEQ ID NO: 8717 - DNA, 543 bp, Candida albicans
atcgcggatcttccagcccgtcgtcgaaactgtaatttcaatatgaacaaggtccaaaaattacgtatagtatatgaattctcagagtcatttgacatgcatgcaatgcttgatgttgttgaaaaattcacctctctcgagagtttaaacgtaaattttgatgagttaggtttggtatcgtttgttgagaatttaaaggaaaacacattaaaagaaattggtgttcctgagtcattagattcatttaaaaccatttatccagcgttgttacatcacagggattcaataaaagttatttttgagaaccaagattattttcatgcaaattttgttgagtggaaaattgctactgaacctaattttgatgttgatttggatcttgatttgaatcttgatgaatttccaaaattagagtatgttgtcaggaatggaaacatcatatttgtagataggaatgaaccatatcctgaatttgtctctgttgaatatcatcatccaaggaaaggttattttgaatctcatccagggtgggaatttttctga

SEQ ID NO: 8718 - DNA, 210 bp, Candida albicans
agtgtggaaaaaggatttcgttcaattctagtagttatctcaattggagtatcatttttggaagtatatcatatagttgatgtagatcgtatttgtaatatcaaacatcaaaacaaagatatttcagatttcaatatacaaattataatgaccaaccaacaaatctatgaatggttaaaaagaataaaaataacaacaaagaaaggataa

SEQ ID NO: 8719 - DNA, 213 bp, Candida albicans
aattctctggtatatcaaaataaatatttgaaatctgaagaatggattcatagttacaagtacattattataaatacatttaaattaagttgtaatgtattatttagtactagcatgatacctagtactaaaagttttaatagatattgcattttaacttgtgctatatctatgattcctattactggatatcgctctcagcagcttcagtag

SEQ ID NO: 8720 - DNA, 1461 bp, Candida albicans
aaatcgtcgttcaattctcactcactcccctttcgatttctctttgataaatatatatttcacaatttctccttagtcccttgctttgaagagtatttgttgttttcagaaaactgcctcgttactgtcattttaaatatgtcatcaaaaggtattgatcttgaattatttggtagactagcaaagttaccagaggatgtcatctacataatccttgattatattcccaagtatatacaaaaacagttgttgcagttcgtggctatccgaaaagtggtagtttcgtgttatatttcaaatgtggaaatttctgataatgattattcaccatttgatttagaagagtccccctttggacctaatccatttgaagaatttgcttttggatccagtccgtttgaccaatatcctgtgaagattaaactcaagaaccttaaaaaggctatacagcaatggaagatttatcccaaaaaggtttattttagctcattgaaggatttaattactgttcataatagttttcctgaacttttattgaaagctcatagtatcaatggtgtattcgataaacatgttaatgattctaaaacagatgatttatccgttcttacacgtagaaatttgacttatggtaacttggaattaagaaattatggcattgatttcagtactagtaaaaaaaagttacctaaaaaaatttcatcgctcactttaatgaaaactcatataaatgaatttaattttgaagggttgaagctgttacgagctgaaattaattccgagtttaacaatacgagagaggtttttttcccaccagatttgaaggtgttggaacttaagatgtttggtaagaaacggttgcacattccctctaacttagtttgctttaatatcactggtgaagacagcaaattggatttggttggtggtctcatgaacaagttggtgtttttatttatttcgtcgcatactctccgatcctttaatgaaactggtataaatgcaccaaatttgacttcgttgacattgcttgaatgctatagtttcactaattttggtattgtgaaaacatttaaacatttaaagtatttgtctatggtaggtgctagattcccagttgaattgtttgatggaactagcttgcctaatcttctgaattttctttgtaatggggaaggtgctcaattccatgttagtgaatgggatgatatgaatgaaattactcacaaaatcaataacctgactataaaattcccaccaaaattggaagatttggcgttggctgatttggtggttccgagaaacgttgagtacacttttgaattaccttcatcgttgaagaaattgcattttgaaaaagttcccctcaattattccggcttccagttgacaaaaaatttggaagaggtaagcttggagcttccagaagttattttcaacacgccggcgaagatccatgta

SEQ ID NO: 8721 - DNA, 312 bp, Candida albicans
gacctgccaggtcgtgaagaagacacctattggtgcaattatttcaacaataagaagataaatgtaaaacaaacagcaccgaaaacgaccaaagataacggtgatgtcaatgcaaatcctcaagttggtgatattgtgaagaaagatttgttggtaaagggtcaacaaacgttgaattttccaattgcaaactcagcgtcactgaaaacccctgaagggcctgttaagaagtcggtcatactgaatttggtaacaactgaagatgatagaattacaaaagatggtgatgatgacgtattaatgaaagattaa

SEQ ID NO: 8722 - DNA, 183 bp, Candida albicans
ttatggttttacattggtatcacaggaatcttacacattgaaaacacaaattatcaaaacactaagattgttattgcctttgctttgcaccaattacaaattattattacctgtattagccttaaattggcagatgctaattgctttagtgacaggttcaaaatctttatctacaagtattga

SEQ ID NO: 8723 - DNA, 636 bp, Candida albicans
atcaaaatgtcattaacagtacgacaacctactgaagaaagttattggaattttaaagtgaactcgcaaaacaatgctatatcaacaatgtccataatatcacaaacggattcattagttgtcaccaatgtcaacgatgacaaactttatagtatggatattaatgatcaatttagagttgatagaaccattgtcactggtgttgaaatacctgatgtcagcgtagtagatacatttgaattcaattgtattgtagctgccaaagatgttgtatcattaatcgatttagaaattggtgaaaaaaattatgaattttataataccccgaaaagagaagaacgtgatatggttagaaatgccattattgattgtaaatttattaataatcaattaatggctacttgtgggagaaattctcgattgaatttatttgatattagaattaataataacaatggacctgttagtgatattgcctttgttaattatgtaattggtggtgaccagaaatgtattggatataatggagattatattagtgttggtaattccataggaacaatattttcattaaaattaagatatctgcgaattattgaagataaagtttcaaattcctcaattatatctattgca

SEQ ID NO: 8724 - DNA, 225 bp, Candida albicans
tattcaccagtaggtagcattgaaagcaaaaaaaaaaaaaaaaaactagtcataacgcttagatattggttaggagagagagtaagtgtttgtgtcataccattcacagtcaatacccgaaatcataatcctattcaagatggattgaaaaagtccgaagacaatttgagtatcacaaaaaccgtttgtatagtttttatttttttttttctgggtatattttag

SEQ ID NO: 8725 - DNA, 576 bp, Candida albicans
gaaatttgttcatcttcttggggtcaattatctgatattgatgatatttcattattatatattacttctcatcaattacaaaattggttaaatcatcaaaaatttttcgaatctttattgaaagataaatatgaatttaaatttaatgaattagttgataattttttaatcacaaacaccaacaccaacaccaacaccaacaccaataccaatggtaacactaatgataaagactcgacaaaattaactatgggaagaattgatttatcaatttttgaaaaaataaaaactcaaccattaaaaattgaaactattattcgtccaccaactttaattgaaccaatcaatgtattaggttataatgaaccagatcaagcttgggttcatcaagatgattttgatcgaattggacaaaatggtcaaggtcaaggtcaaggtcaaggtcatccattttattgtgtatatagttcaattggtgatcctttaaaagaagggattagaggattatctattaatgttgaacaaagtttacaaaaaaaatataagaaattaattgaaatttggttacaagattaa

SEQ ID NO: 8726 - DNA, 195 bp, Candida albicans
aacactttgcaaaacaacaatatacttgggaaaatccaaagaaatgatcaaaccttgaataataaatataaaaatgggaggaaaaaagtgaatttttctgggggggttaaaacaatttatcgtgtgtatcctgctttattgaacacacaattacttgataacacagatatttgccacaatggaaaaagtgcttag

SEQ ID NO: 8727 - DNA, 198 bp, Candida albicans
tatctttacttgttgaaactagtgttggtagtatcaatattactgatcttggtcaatccaaattgttctgacactaccaaatgtaataatgctcagggtaagattaagaaatttcgggagtttagtgatacaaaaagccgagaagtgaaaggaaaaaaaaaacagggaattacacaaagcaacacattttgtgtatag

SEQ ID NO: 8728 - DNA, 324 bp, Candida albicans
ctttatttaaaaacaaaaaaacaaacactatatagaatgtgggaaacaaggaacacagttaaaaaggataattcaaaaatgtttataggcgggtctacatttgttttttttgaaaagacaaagaaaaaaaaacaacaattaccaacaaagtatcacaaaaccattgtaaccataaagaagtattatgtagttacacaagtaagaaaaaccacttggtgtaaatctgtcacattcgaatgtcagatagacatttcatttaagcacatacatacacacacagagagagaaaacgagagaagaaaagaaaattggtataaatattga

SEQ ID NO: 8729 - DNA, 219 bp, Candida albicans
agtatgcaactaaacattaacactatcattgatgtctggagtttactagaattgacaaagacaaacaaaatcaattatataagacaagatcacgtgacaaagtataacctgataatagattacttactcaataatcttggctgcaaaagtggtaatcgcatacagagacagctattgttattaaaattactcaaacatattcagttgactttgatttga

SEQ ID NO: 8730 - DNA, 192 bp, Candida albicans
atgtggcgccggagtttatgttttgtcgcctcgctgcgtttaaagttgcctgactgcatattcacttctaggagaaaaaaaaataaaatacagtccaaaccacactacgttttagtggaaaaacaaggagcacctagcgagcacaagttgagtagagtgtcactaaatacttttttgaatgccaaaagctaa

SEQ ID NO: 8731 - DNA, 1068 bp, Candida albicans
cccaatttcctcctccaaacaaacaaatttcaccccttgcgactaatcttctctttcttttttccaatctggcccataaaaactacagccaaatcattagatatgacattgccagcaaattttaaattcaaatctactgaagatcctaaaatcattgaacaattgtataccttatgtggtactgaatggggtggcaaattgactccagagcaatttggttcagcacaagccaagggaaatttcaaatatgttgacgaaggtggtaggattttgtcgtactacatcgaagatgtcaacactggaacaattgttgccaccacatcagtaaagttttgtaaagccttctacaagccagcagacagatctagtgcaatttcgtcgatcccagatccgtcgctttttggagtaaacaacgcgactgctctattgattagctttgttttcacccataaggattatcgtaagttgggattggctggacaatgtgtcagtaaggcaattgaagcaaccgagaaattgattattaaagaaaaagtggactccagtgatgagtctgttgctgataatttcaagaagatgtcgattgctgatggaaccaatgaaacggatttgcaattggcaaactattatttgagcaaagaatacatctggatattgtattctggtgttaacacttattatgaacgatttggattcaagtcattccctatggacttttatgaagtaccaaatacgttgttgaccaacgatgttgaatctgctatcgaaaacttgattaaggaatcgaaagaagagaaacaactgccttcaggaaagagtatcaggttattattgggtgataatcccgcagaccaagagattattcagtttattttacagaataaagaattgaatattgtaactgaaattaacaaattgcagtttcatctgaatttgcaaagtgacagaaaatcatctacttctttgacaaatatgacgaatattttgtcgatgtcaaaattggggtcaagcaccggtttgtcttcagttgcagaaacaaatgcagcagctgcatcatcttcttcacca

SEQ ID NO: 8732 - DNA, 264 bp, Candida albicans
tctctgatgaatgcaataaaaagccaagagtgtattgctgtatcaccacatacatccagtaacccaagaagaagtgaatttcatttcagatctcaattagtagtcacgtgtgtctcacgtgtaagtatggtctctattgtattcccaaagaagaaattcgaaccgaaatcggaattcaaggatagcatgttttcgctacgtcatactggcatacataacccaatttcctcctccaaacaaacaaatttcaccccttgcgactaa

SEQ ID NO: 8733 - DNA, 195 bp, Candida albicans
ctaaccacaaatggcttgggtgttctttttttttgttgctctttttttcggactacacgttttactatcaaacaacatcaaccgtctggatatgagaacaaaaaaggcggggtgaccgttatttttaacaacctaaaaaaaactaaaaaaatggcttccacttaccaattaaaccaaaaaacccccccagtttaa

SEQ ID NO: 8734 - DNA, 1320 bp, Candida albicans
tggtcctgcgccggtgtgttgaaaatcaattcgtttggtgatcttggaatagtagcagcaaatttagaatcactcgaattacataaatgttataaattgttgtattgtgaaaatttacatcaatttcaacatttaaaacgcttagttattaaagattgtacttttttcccatttgatttgtttgacagagaatcgttccctgaattgacaagttttgaatatgaagggagaattttttacgaattggatcctctgtctgaaattcccgatagttttggtgtttttaatttgattttcccttcaaagttggagttattaataattattaatgccaaatttgttaatgttacctggagtagtttacagtttcctgatacattgctaaaattgattttttttaacgtaacatttgatgatggatatttgcatcttggacaaaatttagaatatatatccattcatgatgcaccaaagcttgcactcaaaagcagttttagagttcctgcaaaggccgacaccttggtattaacagcagactatatgataattgagagtatggagtttatgtatcatttaccaaagggacttactaacttgggatttttggctcacaaaatgggtataataatgaaaccattaactgaaaagattaaatggccttggtggatggaaatattctcgttatgtggattttatattgatagtgacactttacaattattgaatttccatgagtctggtcttgagaggatttacattcgtggaggtaatgttaaaaaattacgtgctgagtggtttccaattggtgttaaaaatctcagcttaccaaatatgggaattcaagaattgtcggattcttttgaagaaatgaaagaattaaacagtctttctcttgaagaaaatcaactccagaatgtaaacccgattaaattaccactatcattaaaatccttagatgtcagaaattgtaaccttcgagtgatatcgccatttttagtatctatgttagagagtgaaaataaagatatcaaattaaatataaatgctcgggagaattggaacttgaatgtcactgatgtgaggaaaatgttgaaaactttgaaaaaactcaaaatcattatcagtaactatagtaagattttgacgaatatagtcccatattcttcacgtatgacttgtgtgtatagtgatgaaaattatggttgtaaaagatcaaataatattgatgatattgatttggattgtgatcctgaagaactttacaatggaagtgcaaattgtctggaaaaagaagaagaagaagataaccatgacgattaa

SEQ ID NO: 8735 - DNA, 186 bp, Candida albicans
atcccaatggatgtctacggctttgtgaaaatagttgccaatgatcaaacattgctaaatggaactactaaaactaatacgtacaatgtggttaagttggttgatcatttatttgaaccattccatatgattattaccattgataggaataattgtgtcaaattatataaagctgctaactgttag

SEQ ID NO: 8736 - DNA, 204 bp, Candida albicans
aatactctacctttacttgatctttttgatttaggtttagttattgaattagatgaacttgatgccgacgattcagctgatgaattagatgacatagtcgaatgtgtagcattggttaatgtcggcgttagtgttggtaaagaatttactactgatgataaagtattcaatggaggtggtgcacgtaaaggaggcacggcataa

SEQ ID NO: 8737 - DNA, 234 bp, Candida albicans
gttgttagtggtgatttttcgagtatgagaaatgaaatgaaattgcataaatatctaaaatcaaaaatcgttacagatttggaatgtgcgtttttccttccctctctccaggaacaaaacagaccatcaactagacccacacacaacgcgcgcatctttttggtggaatatgaaaaaaagaaaactagttcattattgtattcatcttatcattattcattagatagacattag

SEQ ID NO: 8738 - DNA, 222 bp, Candida albicans
catatatctgctgtatcattggaattaatagaactgaatatggcaagtgctagtactaccaatcctggcatttattctgcaagacaaatactattattagctcaactactacattccgataatataaacaatgttgacaaattaacttcattgaatgaaaacaaaatacaaaatattattattcaatggaaacaacataagatcaatcatttaaatagtgcc

SEQ ID NO: 8739 - DNA, 282 bp, Candida albicans
ttatcaactttagctattttggcacgcgtttttagtttgattggtttgtccaacccaagcaaatcaccatcatcttcgtgtgtctgtgcaggctgttgggtcgaggagtctctatcaagttctaaatcatgttgtgtattatctatatttattccttattctgtttcgtccatcacatatgacatggtaggtatcgattatgatagaaacaacaaaaataaaaaacaaaaaaaaaatatcctgaacaaatttggaacgcgtttattatggtatacgatttaa

SEQ ID NO: 8740 - DNA, 384 bp, Candida albicans
atcttacggacagaaagaaaaaaaaaattttgtattttcgatttttccacattggtgaacatacaatataaacatccacactttctatttgtcgacactatgagtacttctattgctgatgcattcaagaaattgaatgtgtctccagaaagctcaacttcagaacatgaaaaaatatttaatgtttcttatgaatatttatcaaaagtgaaaaaattcaatgatttaaaagcttcaaaaaattgtcttgtggcattgattaatttggataaatattataaagccgaacaaattattcgcaaacttccttcttcattagtcaatctgttaattcttgaagtggcatttcttcactcacggcggctggcaggagccacgctcaac

SEQ ID NO: 8741 - DNA, 258 bp, Candida albicans
ctggacttgcagcaccatctaccaaatacaaaagaaatccaacaatgcgagtatcaccacaagctagtcagcaaaatcacaagaagataccccgataacaatatcaatgtgaccaaattccccaaacatttgactaaaaccgacacgtgtgttgttaatgatcaatacttagctcccttttttttatttggttcctacattgattgccttttgcatattgcaaaaaaaaaaaggctaattatacccacgaattggtaa

SEQ ID NO: 8742 - DNA, 240 bp, Candida albicans
tactcgcattgttggatttcttttgtatttggtagatggtgctgcaagtccagttatttttttgatttccttcgcttaaattcgttacacaatatctctatcgttaactccaccctagtcgggtttaatctggggcaaaaaaagggcaccagatatgtcttggatagttcaccagatatctgcagttactacaaagatatgacttacctgtttttgtacacctcaacagggccggtataa

SEQ ID NO: 8743 - DNA, 243 bp, Candida albicans
ttaagaaaaagaaagagaagaagtaaaaaattagataatttttttttatcaggtcattttttttccggcctcctttttgttaaaactgagcttcttgattgtctcaattgtcatgtatttttgtggtttgtaagaaactcatcaataccaaaatgtgtgaatatgtatgtaaagagtaaggacaagagtttaacatttaacaatagggaaaataaaattgcaaaaataaccagtcctgcatag

SEQ ID NO: 8744 - DNA, 195 bp, Candida albicans
aatttttctgtacctttaggtatattaacaaaacttaaaacaaatgtagttacaatagatgcaagatataaccaaagaaatatcaccgataaaatcttaaccggagcaaaacccaaagccttatctcctaaagaagttgtcaatatcctaaacaccaaaaaatatgaaccaatggaaaaccaagactcaatatga

SEQ ID NO: 8745 - DNA, 279 bp, Candida albicans
agaacccgccttttgtctgttaaaactattaagttgtcaacttttagcgaaatatggcacagggggagtgaacagacgggaccgagcggtagtaacaaacgaaaagaagaatatgaaacaccagaaaatgtcgaaaaacaatacaaatcacgagttctatttttttatacttttaacaagacaaaaggaagccttgtatgtgaaaaaaaaaagagcattttaatgaattgcttaatcaattatctttcccccttttttcctgtcattgttaccttctga

SEQ ID NO: 8746 - DNA, 303 bp, Candida albicans
catattattattatgagatggatggatggatggagggaaagagaaagagtgtggtggtggtaccttttttgtgtttcgatgtaccttgagggggacactcacacgcaatatagtttgaaacaatacaaaattaaaattaaaataaaaataaaaagactaaaatcgccaaatagttttgtcattacctattttcatatttcagtagatacaatagtagaactattagtcttaagagttattattattacacaattcacattccttatttccagcaaattttcaggtactaaaaattacatataa

SEQ ID NO: 8747 - DNA, 249 bp, Candida albicans
tcaaaggaagcaaactgtcgagccggtgacaacgaacccattattttcttaaacttagaaggactgaatgagcgtccattgttgttaagcatactcaatatcaattcaacaaaactggttgtcaacattccctttgtccctaatttattgttcacgtttatatgtcgtttgtatgaatggtccgaaaacgattcagttatcgtggggaaaaaaaatgaagtaagctgtggagtcgcagccaaacattga

SEQ ID NO: 8748 - DNA, 186 bp, Candida albicans
agatcattggcaaaaaataaacttttagaattggtttattgcttgtttagtctttgtaatgcaaatactaaaaagttaaaaagctcactaattaaaataaagcagaaaatgattacaacctttgccacagtgtgtaatttgagtccattgtttttatattacttttgttgttgggtctatttgtaa

SEQ ID NO: 8749 - DNA, 318 bp, Candida albicans
tgtaagaattattttttttttgtgtgtggtagattgagtcgtgtgctattggttggttggacatcaaccaaatggtatcatactactaaatccaattgttatatagctcttgtagtttacaaagtgttgcgaaggatagtgtcagaaataaggagccaggtaatgaaagctaatgttgaaaataatacgatcttgttccccgtatcttatttggtagcgctgaaattgttagtgagaaggaaaattaatattattatcaggactggttgcttatcagtcacaccacctcttaatcaatcgccacgaaaactaatataa

SEQ ID NO: 8750 - DNA, 186 bp, Candida albicans
gttataacgccgcttaacaacgatactaacacctgctacagagtagagtataatgtgtcagtaactataataataagtgtgcaccaagagaaaaacagcaagtattttctatcaactattgctccttatcaacacattccaaccattacgataaacaacaaatcccgacacaaaataaaaaactga

SEQ ID NO: 8751 - DNA, 264 bp, Candida albicans
  unsure (68),(73),(92): Identity of nucleotide sequences at the above locations are unknown.
cattttcagcatcgggtaccttcaatcacttctagcctccatttttccaacctgatccatcctattanatcanatcaatctcgaagaaaaanattggtgaaatcaccaggtgaaacaaacctgttgttagacgaatctttgaatacatcatcaactgcaatagcggtatcaaggcaaaaactccaccacacaggattatatggtaggtcaagtgctaaatatcaactgtttccacgctttaatctgcatcaaaacctcaactga

SEQ ID NO: 8752 - DNA, 195 bp, Candida albicans
  unsure (194): Identity of nucleotide sequences at the above locations are unknown.
ggggccctaaaatgttgttggacccataacaaaattcattgtccttttttaggggaatgggaagggaaggaatttaatttcatggagaaaacaagaaataatcctccgtccaaaatcagtgggcagaaagggatttttggccattccttatttttttataaccatagaaatattacccattatacttggtattna

SEQ ID NO: 8753 - DNA, 207 bp, Candida albicans
gataatctatactatttcagcaacaacatggttttattaggagatattatacaactgcaacagaacttttctaatctaacaacttcaataccaagtttagataatctaatatttcaaactcaagtgaaaaacaagatttatgatgttcagtcagcacctagttgtactggcatgttttcaccacgggaggtgccgcaccgcgcttaa

SEQ ID NO: 8754 - DNA, 195 bp, Candida albicans
tcgatatacattaaagaatgtacctcttgcgattgtcaccccaatcaaccaacaactgatggtgatggtgatgagacgggatttggatgcaacccaccaatcaagtttgataatcaacccacagataccacggctactttcgaatccacaatatataaatttcagtcaatatcgtatattaagaaacgagcataa

SEQ ID NO: 8755 - DNA, 636 bp, Candida albicans
ggggaaattaatatttcacacaccattggtgacaatttctgtaccaatattaatttacgtttgccctttttcatattgctaaaaactttctccacacacacacagacaacccatatcatatataacaatcaaatgtcaatacttcggagagaaggagcattaagggttagtcgatatacattaaagaatgtacctcttgcgattgtcaccccaatcaaccaacaactgatggtgatggtgatgagacgggatttggatgcaacccaccaatcaagtttgataatcaacccacagataccacggctactttcgaatccacaatatataaatttcagtcaatatcgtatattaagaaacgagcataaagagattgataaaaaggaacttgaacgtaaaattaatgtcaataaagtggttgatcaattaagagaatatgtacctgatatattagaaacatcattacccaaatcaattatttctaaagatatatatttaagaatatgtccttctcaatttgatgaaaattatttacccaaattgaatggactcgtcacatattatactacttgtaaagccatccaattatttttaacttcagtaattcttcaccacgcggctagaaggaccgcaacttgc

SEQ ID NO: 8756 - DNA, 189 bp, Candida albicans
ttcttctatcacataattccatcgattactattttggggaaaaaaaaaaagaaagaaaacagcacaataatcacttcatcacgtgcagggaaacccacaaacattgacagtgattgggcaataaaaacatgtattatacgggtcttctctaaatgcagagtaatcttgattcaaaccatgttaaattga

SEQ ID NO: 8757 - DNA, 219 bp, Candida albicans
ttggttttaatttgggggaacttagcaactatactaattggaatgtttaaaatctccaatgctgaaatcaaacttgaaggagctaatttattgaaaaagatggctgatgcaatcatgatgaccaatggtttggtgactgctccccttatagctgcaaatttatcgtcgcaatttaatccctgccatttgccaacacctgcagtttcttgtccacggtaa

SEQ ID NO: 8758 - DNA, 342 bp, Candida albicans
ggacgcggattttccatgcccgtggggaagacattggcaacaaaatctcaatctactataactcaaatcccatcatctcaacttcattattcaaccagaacaagatcaactacaattaatgaaatcaatgaattgattaaacaagattataaagccagtcacaataaattcaattccaattctaatggtgggaaaattaaattattagatgatgttgatttagaaaaacaattgattgaaactgctggtgggaaaaatcatgtttggacatttatattgaaattggtcatattgactatattagtattaggatcaggaattttgatattttatgctttataa

SEQ ID NO: 8759 - DNA, 210 bp, Candida albicans
caagaacaagaacaagaaaaaaaagtaaaaagtgtggattcgacaatcaaacacacattttttttgtcttttattgaaaatcccttaaacaggttgacagctaaaaaatgtactcaaagttgtattataaagtatgtgaattttgggataaaagctgtaatggatgtttctatttggtactggtttaataagttccttattctggtttaa

SEQ ID NO: 8760 - DNA, 240 bp, Candida albicans
agccaaccagtattgtacttttttggaatattttaccacatgctaattgttatcaaaaatagtacaagtaataactttttgctagaactcaaattgaaagaattaaatgcaccgtttgatttatcatttgaggtaccaattacactaagtctttcatcctacactttaaacatacttcaaaatcaatatattaccagtaatatacaaaaaagacaaaaaataatctctctaactctataa

SEQ ID NO: 8761 - DNA, 186 bp, Candida albicans
atcgtaaccaaacagaatgtatcggttaattggttattaaccattgttgaaaataataatgggctaataaatgttgaagcagcagcagttgaagaggaagaagatccctatttttgttatattaccaatggggtacattactatatttgggatattgaacctctctcctgcatgaggaatatttga

SEQ ID NO: 8762 - DNA, 192 bp, Candida albicans
tatattcacttaattcattccaaaaaaaaattaactcaagctaaagattgtacaccaagaaagttgagttatcttctgagtctcctaacctacgatattgttattattattgctttattatcatatgtagattgcttgccggaactatcgccaccatcgccgccgtcgccgtctcatagtacaagattctaa

SEQ ID NO: 8763 - DNA, 225 bp, Candida albicans
agccaaaaacttttcctattggaaaatgtaatttgtatttatttacgtattattattattgttgttgttgttgttactgctatttccaagtataattctcctacattcattgcacaaaacaagtatctgatgagaacaaacactataagcgtcaacatatacgcctattgttgtattcaaaacatccacttttggccgggacccggttgctatgtcctcaagtga

SEQ ID NO: 8764 - DNA, 408 bp, Candida albicans
agaaaaaaaaccaccatgtttagatcaatacttagattcccatccaaaatatctactggggtgtcagtattcaaacaatttgcatctactactactactactactaccatcaatacagtatttgcaagaccttctatactagcatctacgtcgacaacattcaattcatcatcaccatctttagtatcttttttcccatacaatagaccaacttcaactccagttgaattccaaccattatctatagaaccaaaagaatatgatttagatactgttgataaagatgatgataataatactatgcatgcattatcagtattaagaaaaagaagattgaaaatgaagaaacataaatataagaaaagaagaaaggctcaaagagcattaagaaaaagattaggtaaataa

SEQ ID NO: 8765 - DNA, 204 bp, Candida albicans
acaagacattcaatcaatcaatcactggcttgttttaacctatcattattgatctttcatagagaaaaaaaaccaccatgtttagatcaatacttagattcccatccaaaatatctactggggtgtcagtattcaaacaatttgcatctactactactactactactaccatcaatacagtatttgcaagaccttctatactag

SEQ ID NO: 8766 - DNA, 264 bp, Candida albicans
tatcgatgttggtttgaaatagcgggtattggctctagttatagattttgtaaaaggtacttttcccacacttttacaagaactcgtaaaagctttagaaaatatcaatctattcattccaatcatattgaagagttcatggaattgtatgtgaagttatattggtgtgtatatgctatgtcccatacaagagttccaaaatttgagtctaatattgattatggttttcttgggtgtttttttttttcttccgtggcccgttaa

SEQ ID NO: 8767 - DNA, 267 bp, Candida albicans
ttggcggtattagctcattttaatatacttatatcaagtgtgcaatttattattttagagctttgtaaattttgtcaatatataacaccctggcatttacagaagaatttgggaggggggggaaataatgtttttggtgaagtacttattgggcgtgcaaaaaatattaaaatgattattcatctttctccagaggaatcaattgatatggacgtcggtttcctgcaaaatctttgtacaaccatcttactttggcatgctgtttag

SEQ ID NO: 8768 - DNA, 195 bp, Candida albicans
attactttgtcctttcattatttcgaactttactccccgtggcaaattaaaatcttgaacttttcaggaacatacacggtctatatttttttcagggggaaaacaaacaaaacaagaagtcgagaaaaaagtgacttgaatttgtacattgggtatgtcaaatctcttcaccaactccattttattcttacatag

SEQ ID NO: 8769 - DNA, 186 bp, Candida albicans; identical to SEQ ID NO: 8748

SEQ ID NO: 8770 - DNA, 201 bp, Candida albicans
agtctgttggcaaaaagtatagttacatctttcaactgggttgctagtattgccttttcatcaattattattttctttactgagatgtatgatgccaaggatattgattggtggggtaataatgttgtgtataaaggtatggattatatgatgaatggatggttgaatgctactattgatgcaccggattggttattttag

SEQ ID NO: 8771 - DNA, 285 bp, Candida albicans
  unsure (143): Identity of nucleotide sequences at the above locations are unknown.
acaagaggtaccactagattgttattcacattgatgtttcaaaagtcaaaaacaaaaatgcaacctttcaattatcagtggcaacttttttttgaacaagattttaaactaatcctaccgtcaagtatatctttaatgttatntatagataagagcgttatcggtgataactataaccaatacccaaatgtaaatcaagaacgtgtcaattgtgtgcgcgttatattttatgcgcctttatcaatttatgaatttattcccttgtgcgtctttaaaatcagttag

SEQ ID NO: 8772 - DNA, 318 bp, Candida albicans
aaaaaaagaaaagagagaaccgacatatattcatatatcttgataatatctttcccagttatagatcaatttcaaatgtctgaatctttgaatattcaagaattaactgataattcttcaattataccgatcccaaccgaatcaactgatgttcaagacgttacttctgtatctaacaaagatactaccactaccactaccactaccaccaccacaacagaatcaacgactcgtgtcagaaaatcatcaccatcaccatcagctaatgaaaatgacaagaaacgtcttaaaaaggaatttcaaccaagacaaaagtag

SEQ ID NO: 8773 - DNA, 588 bp, Candida albicans
tggggaatattgcgcggatctgccagcttcgtgactgatatatatccagttgattatgatcctactgatccaaatcgcccgaaaatcagtacttattccagtgacgttgttcatagaatgagcatgaattatccttcaccaccacaaacccaagcaacatccactgatagtaatggcaagtcaccatcgtcgtcatcacttgataacggccatcaaagtcgaaactccaacaaccttaatggtaatggctattatgatcaggataatagtagtggtagtaacttgacatatgatagatcaataatatttgagcgagttaatgaatcaccaattaatgctcatcatcaacagccacctactccaccaccaggaataattgctagtccaataaggaaaagaaaaggatttgttccatcagtgtttagaaatagtagtgatagtcatatccaccattctaatgggcataccaatggatcaagcccaggggtagctacagaagaaattccattagaagattttgatgatgaacaaaaaagagcatctagaataagctacgaaaatcaaaaaagagtatcttcaatgaattaa

SEQ ID NO: 8774 - DNA, 339 bp, Candida albicans
cctaccactatgtcacactccgaccctgatgttgcactttttgttggattaaggaatcttccattggacatcattgctataatcattgattacctgcctaaatgtatcttaccaaatctattatatttcccaccaattagaaaaatagttgtttcaagaattttatcggttgtaattattgccacacaatcatttaagcatccttggaatacctcccgttatggtgaatttcctacctgccaatgtacatgttttttggaaagaaccaaaaaatttgaaacaagctgtggatcaatggaaaatttaaccccaaattgtacatatccacaatttgtttga

SEQ ID NO: 8775 - DNA, 201 bp, Candida albicans
cgaaatttaaagttgaaacactttgcagcgcgattacagcatccgccactttggagtacattcggaaaacccccttttaatttgacttatttacacgacaatgctagttggaaatttacttataagtcatatccaagagtcaactatttacgtttgcaattcttagtatttataaataaatgttttgttcatttcttttga

SEQ ID NO: 8776 - DNA, 354 bp, Candida albicans
tcattagatattcagataataatgccattcagaccaagttacagaagaagatacaattcaaaaggtttcagatctaatagacctcaaaattctcatagaagtgaaccacgaacctcttctggtcgtgatagaagaggatatagaagatattatcatcaacaaccttcaagatatgcttatgttgaagagcctgatagtgaaatcgatccaactgaggaagatgaagaagatgaaataatcaacaatgaagaatacgacgaagtaccacttgagtattatgatgatgaggaagcagactttgatgaagaaggccttgatgaagaagacaggccaccacgggctgaaagaccgcgt

SEQ ID NO: 8777 - DNA, 2001 bp, Candida albicans
  unsure (2000): Identity of nucleotide sequences at the above locations are unknown.
ccgtcaaatagttcatcaccagcaaccccatcctcatcctcatcctcctcacaatcagtatcgaggtatcataataattcaatacaagccaaacaacgatatgcaaatcatttagctaaaacaacaacatcaactaataccaataaagagatcaaacgaaataaaattctgaaaatccctaaacttatcattaaaaatcccaatttatcatcatcacaattacaatatttacaaaatttgagatcccgtttttctgataatatcaatgaattcacttatactccaataggtttaataaattttaaaattggaacaaccaaaactcaatcacaagataatttaatcaatcgaatttcaaatataccgccaacttatgttccaacattagttcctcgtggttatgtaattaataaattcaaacaatatttaatcatttcccgattaggtatacgacaacctatactagttaatggtaatggtcatacgtatgattattatcctcgtactatcgtgatccaatccccggaggggaaaataattgaaatacccatgaattggcaattttatcaccaatctaatggacaaattgataaatatgattcaattgataaattttatcatgaatgtggtattgatggatttgacattaatatactatcagggggaaatatcaacaatagtatatttttattatcaattatgaaacataatattcacggtaatattaattttatattacgatttaatgtcataaactcattgaatgatgaacctgagttgagttttcaagattatacttgtcaattaatggaatttttatatgataatatattgaaacaaaatttaaataaatcaataatgaatcaattattcaatgcattaggaattcccttgtgttatttcactaaagatatgcctaatcattcaatccaacaaataaatcaaatactacaacaacaaaatggtggtggtggttcttccaccaaacagaaggacaaattatctagaaaaattaatgaatttctttatcaacaagaacacaatccaccagggatattatatcgatttgaacaatattctaatactaaaggatatagaataattaattatcaaacttttcaagatttcatttatttaactatatcgaatgggtttataattaaatttaaatggtcaaattatcaattttcaaattttgaattaattaatataaatattgagaattcattacaagaaggtcaattattaattgttaatgataatgataatgataatgataatgataaggaaaaagaagaagaaatagaagagaataatccattttatatacttagaactggatctaaagtaataaccattaagaaaaaaatgaaactaacaacaacaacatcatcatcaacaaatggtaatcatcgaagcaataataatagtagtagtagggcaattcattgggaatgtaaacgaatattatcaaattataagatcattaaaaaaatattgctaactcaaacaaatcaattggtagttatatcatcagaatctataatatcaataaatcttcaaaatttgaaatcaatatcatcaccaatattggtgtgtgattattttaatgataatgatatttatcaacaatttgaattaatagaaacagtaaaaaattatggtattagttgttatttgatttttaatattgataaaaattataatcaatttaaattaattgaattagatgattcaatgaacaccactacaaccactaccaccactaccaccaccaccaccacctctactattggtaaattcaaagaattgataattatgattccattccaatttcaaaaatgtggatatttgaagaatttcaaattaatgaaaataattcctctattgaaagatgataatgataatggtaataatggtaatgaatcaactagtaatcgattaatgattggatttaattttttaaatcattttgaaatgacaactataattgagacatnt

SEQ ID NO: 8778 - DNA, 279 bp, Candida albicans
aatttatcggatattttaatattattgaaaactttaagttcttcaccttcagatttatcgagaaataattgttcgaaatttataactattaatccagaaagagtattaattaatgggaaattaaaacaaaaatctcatcgacaaactattgttgttaataatgatggagatttattgcaagaaaaacaaacaatttctggtagtgggggtgggtttaagaagaaattagatgatacttcatctggccgattattgaaaaagaggaaaacaacaaaatag

SEQ ID NO: 8779 - DNA, 183 bp, Candida albicans
atccaatggatggatgactttaatgactatattagaacagagtgtataatagtaattagtttgttgtatagattgggttgcaaaaaattgaatgaaatagtaattggttggcaaatttacaaaacagcacgtgattgcgcactaagaaacagaataactatcgaacattgtagaatattctag

SEQ ID NO: 8780 - DNA, 216 bp, Candida albicans
ccatgtcaaaaattgatcagtagtactttatcacgtgacacgttttataattatgaatgtcccacaaaatcaaaatatacgaaaactgaattagtttcccttcattctgtgattagaaatggaagaacgactacaatgcatttagtatgttcaaaggatttcaaatgtttatatattttttgcatatttcaatcattctataaattaattaaataa

SEQ ID NO: 8781 - DNA, 240 bp, Candida albicans
gtcaaagagtttaataagccattaccagatataggaaatatcccttgctactgtggccattgtcacaatcaaagtgcatttgccgtgagaacaattaattgcgttactttgttttttattccggtgttgcccttttactaccagaaaagattgaaatgtaacatttgtggaacaactggtggtcttgacgctactgcaatggatcgaatgaagctgggtcaaccagtagctataggttga

SEQ ID NO: 8782 - DNA, 186 bp, Candida albicans
tcgcctaataacactaaaaattcatttgtggttgatttgtatttatgtgtaaattaccccaggatattattattgcaattaggatgtatagaaatcgcaactgtttctatcatcaatttgactagacatctgcttgacttaagaagaaaatatttagtatatcagttttatgtacatatagattga

SEQ ID NO: 8783 - DNA, 219 bp, Candida albicans
aaaagaaaacaatcactctttggaggctttataacccgttataattacgatagttttaatagaagagaaaactcctccatccatccattgtattctcctccctccccaatcatcatcattagacgatatagaagaacactagttggaagtgacaacatatacccaaaacttgaacattccggatacattccacaatattcaactcataaaacaagttga

SEQ ID NO: 8784 - DNA, 225 bp, Candida albicans
tataaaagaaatgaatccttaaatatacatgggtttaattttttttgtcaaatgtttcccagcccaaaaaatcaagaaatttttgaagatttccatcattattggtgtactccattattttttttcactcatacacaacaactacaacaaatctttgaattaacaaagtttttggctattatgatgatgacatacgggcctcttgccattttttgtgatttataa

SEQ ID NO: 8785 - DNA, 444 bp, Candida albicans
ttgaattgtggtgaattcaacaaggaaaacccagaaagtgcacactcaactggaccatccattgacaatctcgtggcctttggttttaatgattcaattgcggctttaataccaactggggttttgacagtacgagtacgcacttcagcggtctttgctgctactgctgctgctgaggcggctgtgcttgaattaaatcggatctggagtctggcaacctttaacattgtgttgatgttgagctgggtatgtatatgtgtagttaatgtgaatatctatgttagaaaacgtgttgttgaatattttttaattagaaatgaggagttctattttaaaatttataatattagcctttcgaaaggtaagatgtccccaataggtacagatgagggagaaaaaaagaccacggagcaatggaagggggtaattattgatttccaataa

SEQ ID NO: 8786 - DNA, 228 bp, Candida albicans
tccaaccaaactccgacttacttggactttcattttacaacctgcttcagcaatgtactaattcaagtaaaatcaccagatagatcatcacaaagagttcaaagtctacacataacaatatttaattggtcaataatgaaattactatatcggcgaaatcatctgagcatacaaccgttgtccaaacttgcaggacaaatggacacgtcatggttaaccaaattataa

SEQ ID NO: 8787 - DNA, 270 bp, Candida albicans
actgggacaatggttaatgaagaattcatgccaacgatggacaaattatttgaagcccatctttcaaaatgtatctcaacaaccgaaactcatgtcagagctatgtaccttgacacaactacaaataggatcaccgattcgtggaaacagtttatacaggaaactgtcaatcaagctatgcagccacgtttcccaggactgttcagtgaaccagttaatatattgtccaataaaaacaataacctggtctttccatctccagctcaataa

SEQ ID NO: 8788 - DNA, 255 bp, Candida albicans
gttagtacagacttagatcgcaagacaaatgaatcatcaggcaaccaagaatctattgcttctgaattacttgctcaaagtccaatccaagaagtagtgatatcagacaacgaccagcaggattcaactgacaaagtatctttcaattcaactatgtctcaccctccttctacaatctcgttgatccatacaacgggtccattaaaaattctgaaaattattaattcacccacaacatccaatctttcagtttga

SEQ ID NO: 8789 - DNA, 471 bp, Candida albicans
aagatgccaattactgatccaagaatttctcgtcatatattgactgatgaagatgaatctgatgaagatgaatattataaacaattgcgaatggtgggaaatcaagattatcaaccaactataaccattgaattgaatgataataatatggttactagtactaatgctaatgctagtggtactgccaataagattaaatcaataattatacttccaccaaatctttcaataatacaaactgaattaattaaattaggacttgttaaatcaattggatcaattagtattgaatttcctgatttatatcttcatgattcttcaaataatattactactaatagaagaattagaaaagaacgagaaattcaagctgaaattgtacatgggaatggcaatacaaatgataattttcataatactgatatggattatgattatttttcttcaccagccggctggaaggatacgaac

SEQ ID NO: 8790 - DNA, 321 bp, Candida albicans
ttaaatggggttctaaagtttctaaaaaatacgttccaaaagatgtttctaaaaaagttagaaaggctgctaaaccatttgttaaatggttacaataagctgaagaataataataataaagtgatgatgaataaattttttaaaaaaaaaaaaacaataacaaactttacttatctgtttgtttgtttgtatgtttttttcattcatatatatagtctgttactattgttatttctatgtataatagctatttgcaaatttacttatttgatatatatttcgtttaaagaagaaaaaggtgatatcagcaaatatcattag

SEQ ID NO: 8791 - DNA, 192 bp, Candida albicans
aaaataacaaacttaaaacacaactgcatcacgaatgtttatagtttattgttacaaataacatacagtggggggggggtctataaattggtcctgacaacactatatgtagagagaagttttactgtggtttttgatttatttatatgcatattctttatcacgtcaacaataaataatgaaaattgctga

SEQ ID NO: 8792 - DNA, 267 bp, Candida albicans
  unsure (158),(164),(165): Identity of nucleotide sequences at the above locations are unknown.
aaaatcccatattctctttgtttaaactccttcattctaattgtgtgtgtacgtgtgtacgtgtgtatggaagtaaatgtatgggttactagttttgtggcgaagaaacagaaaatgaaacaatctgaatgctataagcgaatgatcgaaagaatganagatcnnaaaaaaaaaaccaagaaaatgcgaagtaaaaaaaaaaataaaacctccccgtcttatcgggatagacaggacaagaataatcttcttttaattctcctataa

SEQ ID NO: 8793 - DNA, 309 bp, Candida albicans
ttaaatctgctagtgtacactaattgtgacctttctattagatcattatctttcttaaatgtgttgaaatcacgagaaattgtaaatactactaagcctgtatattcaacacagaaatacatcatagatgtttttttttcttattattgtgtgtcaattaacctgtctccctctcctttgaacaatcaattagtactttacaactcacaatttgtaaaccctgtccggatacacattttatttcaaattaccgtgagtgcatgtactaaattcaactggtcgtcgtttcatttcaaggtcaacgcataa

SEQ ID NO: 8794 - DNA, 189 bp, Candida albicans
gcctttattatagtaatcattgatccgaaaaaacaaaaaagtacagtcatgatcttgttattttggcatcgtcatccgaccaagatacatgctattataacttggtttgcacctaaaaaaaacaatagtaagcttgcactttcttttcaccattttagtattaagaaccagccagaaagaattacatga

SEQ ID NO: 8795 - DNA, 237 bp, Candida albicans
gacattgtgcctctacggctgttgaaaaactggatcaaagtacatatagtccaaatcatattgaataattcaaggaacccttctatttcgttgcaatatatccacagctcaatatttgatcacacaccttcgaaatgtactggtgatacattgaaagaagatatatatagtgcagaaagagtttggatgaacaatatcaccgacatccctgtggtgtcaaacgaagattatatgtga

SEQ ID NO: 8796 - DNA, 240 bp, Candida albicans
tttcagatagatattattcagaaatatattctgtatcgtactactgcgtcaacagtaaattctgcttatatttgtttccgagtgtataggggcagatccacgatcgatgagttctttatcttgtacttaactattctcctaaacataggaggtaaagttagcagaccagcatgtatctctaggatagatcttgaatacggatataacggagagagaacgtatacaactttgtgttcataa

SEQ ID NO: 8797 - DNA, 567 bp, Candida albicans
attgtgagaaattataaacaaaacaaaacaaaaccaaaaaaaaaaaacatttacgaaccaaacattcttcttcttcttccttcatcaaatggttttcttatcatcttaacctctatccacttttccattatgacaaaggatgatatcaaattacttttatcagaagatttatcaccttataaattaaccctattaatagtaatccatctatatttatgtaatgaattaccaattcctcaattaatcactttgactcaattgatagaaaacaaacaacaaccacgaccacataatctactatcaactcataatattatacattcattatcacaattatgtgaattatttaatgatgtgaatgtaacaaaacaacttttgaaatgtatttggcgtatcaattcaatagaacaattggaaaatgattatatcaataatttaataaaacgagttaaatcagttgatttaattacattgaatataactccaggttctacaaatagtggcaaagtagtctcatcaaaatcattatttgtaatcagcccgccgtggaaggtaacataccgggtt

SEQ ID NO: 8798 - DNA, 570 bp, Candida albicans
attgtcccgacgatattatcagatgatccattattaggagttttcaataatccaaaattccctccattaccaaaatatattaatttagttaataacattgaggaagaggaacaaaaagaggaacaagaagaagatgcgattattgaggatgaagtggaagaacctattaaagaagagttaacaacaccattgaaaaagagaaaattggatattgaatcaaatgaagaaactgataataataatattatccctgttgaagatcaatctaagattttcactgccactaaagttgaaaaattgacaacaacaacaacatcatcaattgagaataatcctgttgtgattgaagaattaacatcttctaaagaaattgttgttgaatcaccagttgatgaaccaactaaagttgataacataataccaactaccactactactactactacaacaacttctttaacatcaaatactgctaatgcaaatgatgataatgataatgatgatgatgatgaatcttctgattttgaaatgcctgaaatcaatcttgatcaagattctgatgatgaatga

SEQ ID NO: 8799 - DNA, 288 bp, Candida albicans
  unsure (11),(25): Identity of nucleotide sequences at the above locations are unknown.
ctcgcgcgccncgcacattgttccngacgctgctccttctacggcctgttgaaaagaactacaacaagtacaacaacaattataactactactactactgctactacaatagctatatctgactctatatgtttagaaaaaaaagggagaacttacaataaaataacgatgaccaaacttgtgaatattattattatatatcttgacacacaacctgcgtcgtatatatatatatatgacgaaagtgtcctatcctcgattagtaattatctattgtgttctatataa

SEQ ID NO: 8800 - DNA, 396 bp, Candida albicans
gtttcatattcaatcatggaagataaatatataggccttgcattggccatgtcgtcatcattggcaattggtacttcgttcattatcaccaagaaaggtttgatggacgcatcagcacgaactggtggcacagatggtgttcaggcactggattaccttcaaaacccaatttggtggggaggtatgatcaccatggccattggagaaattgctaatttcgctgcatacacatttgcgcctgctattttggttacaccattgggggccttatctgtcatcatcggtgctgttttggcagcaatatttttaaaagaaagattaggaaccttgggtaagatgggttgtgctaggtgcctaattcttcactcggcaggtgacgatccacgtatagggggg

SEQ ID NO: 8801 - DNA, 591 bp, Candida albicans
atccaccgacttcaacgaattcaagctgagctattctcagaaaagaagaaattagggtcagataataacgatgggcaacaaaaagttgaagaaaaagaagagtctgcattagaagaagctaaagatggtggagctgatcttggttctggaactatgggaatgggggcaaatgctgacgatagtaaaggtgagaagaaaccacctatgctatttaaattacctttcaaacaacaattattggcaaaccttcggtccaatgttgaaatgacaacaacagtccaacaaccaaccccagtatctagtgaagatgattctgatccagtagcagttgagattcctgtcccagtagtaccggaattagttgcaattattgacaaaagcattgaagaaaaactaaaaccaataatcaaacaagtagaagcctcgacagttacaggagaagatgtcaatttgaaagtggttgaaaaagtgtctttggtgtctgacaatggagacaataggaagcatgatgtgaaattggtgccagaaactgctgcccctgctaaagttgtaaagaagctatcttttgctgattataaaaaaatgaaatag

SEQ ID NO: 8802 - DNA, 222 bp, Candida albicans
  unsure (208),(209): Identity of nucleotide sequences at the above locations are unknown.
tactatttattttcaatgaagttaatcacacttttaggattacttccattcacattagcaagaacttttcatatagcaactaatcaaaatgttgcgtgtttagaaattaaagctcctacagctatttcattgactataacaattggtacagctagtggagcatatccaccgggcacgatatttaatttttgtcatcgactgggatcgnngagtttccgttga

SEQ ID NO: 8803 - DNA, 243 bp, Candida albicans
aacaaatgccattggtttgatccatatcggactttaatagctgcaggaactttctcaacagatactatccaaaacggtccatcagtcccattaatatatacatgtttgtgtatttgtagcaccaattcttgcactaagccttgtgatcacacatatgaataccaagcggtgcaatcagtatttagtttcgaatatgacacgtttatgattatgttacatggaagcaataatggactaaattga

SEQ ID NO: 8804 - DNA, 234 bp, Candida albicans
gaagaaaaacaaacaaaaaaaatagaacagggactaacgcgtgttgttgtgcgcgccttaacaattaaaacaccagaaaaaaaaacaaaaatgagacaacagttaactctaataacaattaatatagaaaggggaaaaaaaaaaaagaatattaagggaaagggttgcaaaaataaatgtcgcgagcctttttctattccttctctgtccgttattttttttttgtcgtcttaa

SEQ ID NO: 8805 - DNA, 186 bp, Candida albicans
ttggttatgagtaacaattgtctttcaatagaccaaactttttttttttggttgttttcaattgttgccagaaatttcttggagttgcaaaaaaaaaaaacgcaaacccgtcgattaacttctgtcaaaaactttaactaccaactctctttaataatagtaacgatgttatatattgttttataa

SEQ ID NO: 8806 - DNA, 234 bp, Candida albicans
attgaatcactaaatgaatggaatgtagatgcagtagattgtggtggtggtgccagacaagttggagtcaaaattggcgtgtttggtgtagacgatgatgtagatgaaatagttgtagatgatgctactggtgatgtagaaattgaactagtatttgatgatgtagttaatgatgatactccaactaatggattattgttggttgtagtagtagaactattggcaaaacaataa

SEQ ID NO: 8807 - DNA, 693 bp, Candida albicans
gcagactacgagggagggagaaagaaaagagaaacggaaaaagaatgggaaagaaaggaaggccaggaagagaagagggaagtacatgcagaaaagagcacgggcatcacaacagaagaaggcaccagcaagatacacagatcgaaggggagcgcaagtcccgaaacccaacacagctattcgggtgtcaagaatggggaggaactcaacggtggtgctagactgacggaatcttcttcatctccacgtccattcttaaataaatcattctcatcagatgatatcataggttcttccaccacaagccaacaaagaccaagatactcccaaagacatcaacgtagtcatagaaaagatgcaaccaccaccaccaccaacaccaacactaccacttcgaatctcagtagacctgatttttcaagtttaagttatgctgatttattaaacaattattgttttgccaatagttctactactacaaccaacaataatccattagttggagtatcatcattaactacatcatcaaatactagttcaatttctacatcaccagtagcatcatctacaactatttcatctacatcatcgtctacaccaaacacgccaattttgactccaacttgtctggcaccaccaccacaatctactgcatctacattccattcatttagtgattcaattcatatttaa

SEQ ID NO: 8808 - DNA, 270 bp, Candida albicans
  unsure (25),(29): Identity of nucleotide sequences at the above locations are unknown.
agttgggggcagctttttgtccttnttancggactgtttgtgaaaaaagtaatactaagaatgataaccattcttcacttgctaaaaaaaaaaaaaaatattaaacattcatatttgcttccattcattcattcattcattcatattaaccccaatgtttcaaagtatataacatatatattatatatcatattcattttcttagtctctttcggtctgttttattttatttattcatcttttataccagcaacagctctaacactataa

SEQ ID NO: 8809 - DNA, 327 bp, Candida albicans
gatctatctattagtttaaaacttcaaaagggtcttaatcacaaattcgtcaaaacaccagtaaccactctattagtgctaactaccaagatcccctattattttattgaaatttcccaatcactaattacaatcactaccatgacaatacttactactgacgttgatttttttcgggatatatccaaacttccctccgaaatcattgtcataattatcggttatttgccaaaatgtatgttaccacaattattgtattttcaacccattcataaagaagtggcttttataatcttattacatgttaatattactgaaagaaaatga

SEQ ID NO: 8810 - DNA, 363 bp, Candida albicans
aggtgtgaatcaaaaaaaactccggttgagaatttgcatacagatgggtcaatggatataggtacagtcactttcaagaacaataagcttgtgaaacggtttaatgttgtgaaaaaagagaatgctatcatcaataagttaaataagacaaagaaggaaatacctactgatgagtttattgtcaaacaggatgagttgatcaaagaaattgctaatgagaggaaacaagaagaaagagaggccaaggagttaagtaaacaatacgaatatcagaagaaacaaaatgctgacccgtatgctgatttgtttgctagtgaatcaactagcaagcctaccaattggtccgaagatagtttctggtga

SEQ ID NO: 8811 - DNA, 438 bp, Candida albicans
gtggctgaagacataaaagtggttaagattacgaaaaatgattcaatcaaaaataaagttgaagtcatattcaaatctatcgaacaagataaactaatacttttaactggtttatcgaattcaattgccaaactaatatgtattacagaaatagtcaaacaaaaacagaatgaacaacaacaacaacaacatgaaccatcacagaaattagatcaatataacaaacttctacatattgatagtacagtaaatcctagttataaacccataccggagaaagaaaataagaaagtcgatacaaaacaattggagaaagaagctttacaagaaatcaaaggtcccaaaatctatacattgcctgtgttgtacattgtgataggtaaacattcaattgtgtcaaatatagagttagttaattggacaaaacaagacaaataa

SEQ ID NO: 8812 - DNA, 225 bp, Candida albicans
aaaatatttgatgctaaaggcaatagagttagattatatggaccaggtatgataaaaagaattgggtatgattttgaatggtttcaatgggaaggaatgaaatatttactatgtatttatgatgttaacctacaaatttttcaggatgttaaaaaatcagatttatgtgatgagattttggagcatttaagatttttggaaagtacacagaatataactgattaa

SEQ ID NO: 8813 - DNA, 1152 bp, Candida albicans
ttttgctacacatatagtattaatattattttgccaccaattttttatacacacacatacacctcataccaagtaaacgcgctgccaaattcacaccacacaatgactgattattacgaaccaacatttttatttagacagaatgctattaaacgattcagtccttcattatcaccaatatctagtgttgaaagtttatctttagttgattccaactccattagcaacaacggtactactactactactactactacatcaagcatatatcaaaatgcttccaattcttcatggttactaaatccttataatgttaaagatactgcaattttgaatcaatcatgttgtttaaatcgtactaatgttaaatccaattattggaaaattcctgatgaatcaatgaatttaacatcaatgtcaattaataaaaatcaaggtgggaatcctatattagctatatcatcaggtaaatcagaatcaaatctatttatttatgaattgaatttatttaataatcatttaattcatcatcatactattagtttacctaatatacatgctatgaaatggatcaataatactcgatatttggttactggtaataataaagggtatgctcatttggtttcaaccccaaaattagccactcatgatgttttcaatactaatagtaatggcgactttgattacaatgatgatgatgaggatgataacaattcagcagaaatttgtaaacgattcaatcataggaaacatttaaaacaaaatcaattggaaaatacaatatctacaccaataaaacatttaaattttttgaataatcatgaaaatttattatcaatatataatgattatttattttattgggatattaaaggttgtcatcaacaaactagaccttcaccaatttcaatttcaaccgtttcgggtattaaaaattttgatgtcttagaaaataaccataccagtactaatactagtaatgccaatactgtcgctatttgtggattatttggtgtttcattatttgatttaagagattgtcaattcaatattccaaattataatactgcacaaatccatgacaagagtcaatcatcatatcgtaaattatcggctaatatagttatatggtgctcgccacggggctga

SEQ ID NO: 8814 - DNA, 210 bp, Candida albicans
cctgaaaaaagaaagaatttattttactgtcttctcaattgggtagcatcaaccagcgatttatcttctactacttctacttctactacttttacttcaatttctttttacacccacaaatctttttcaatcagaattgtaaatcctttgatgcagatgattgatatatatatatatatatatagattagaaaaggaatgtaaatcttaa

SEQ ID NO: 8815 - DNA, 204 bp, Candida albicans
cttggacgtagagatcgtgccaaactttttggtggcggtggtgtcagtttcattgtatgcatacaatcgccaaaaaaaattagctcaactgcagaacaaagagacaacaacaacaacaacaacaaattggaaaaatcaccaaacaaaaaaatgagagagagaaaaatcaataaagacaacacagacagtctgcaaatatcctaa

SEQ ID NO: 8816 - DNA, 213 bp, Candida albicans
aacgccaattgcggttccttccagcccccgtggttgaagaatacagagtacgtgaatgaagctcctaaatatgttagagaagctataagagcttcatacgatgccgggtgtaaaggagcttttggatttgcttttgcaacaattgttcttggtgtcatttcatctttattcatgagagaacacgttttacacacaagtattaatagagactaa

SEQ ID NO: 8817 - DNA, 1485 bp, Candida albicans
tggattttcattttttttgcacctatcatgaaaacttcgtcatcaagctcattgagcatatcgagatcaagtaatttggagtcaccttcaatgtcactgatttcaagcaaaatatccaatgaagattccaaaaataaacctgaaactgaaacagaatcaaaagttgaaacaaaaggaagtaagcatgaagatcggtcaataacagaaacttccgaccaactggcaaaacaagagcaagaaggacaaggacgttcccaaaacgaaccaaaacaagagttgattcaaagtttgaataaatatgttttcaacacgcaatgtggtaatggacaaactttcaataatttcccaattattgttagaattcctattaacgataaacaaggtaggcaagaaattgagaattttgtttctggatgttcaggaatatcagcagtctatcatcatcaagagaagaaagaaattgataaggcggtggagtttttcaatataggattcactacaaagaaggaattggatgatttgatttataaattgtaccaagaacaaattgtttatgaattggattattcaaaatttatatcgcatccagggattcttttcattaaaaatttatcaagcaatttgatgtttgataataactataatcataaagaagacagaacagaagacgactacgacgacgaccaagaggaaacagaaacagagtcaattaccattgtggaatctactgaacccaagcataaattgtttgaatttttaatggataattcatattttaaatcattacaagaggtgaaaattttcaataatgataataacaatatttctaccatacctttatcatcatttgccattgttaaattttctaatcatttggatgttgatattttaattaaaaaatataacaagtatgtccccaatattttcaataataataccaatattccattgtttctcaataaatatcttaatcgaaaagaaagatttgtgttcccaggagcaccaaatttggccaatactaccaataacacaactaatagtagtggtggtactagtagtactggaacaacaacaacaacaaacacaacaattagccccacaagatcaatggataattttaatcttattattgttgaaaatttactcaattttttacctcgaataaaattgaatgaagaaggatttaatgggtttataaataaatttaatagttttggtaatttaattgatcaaatttatttcccactttcagataagggagcaaacttggaagaaattaaaactttggattttggattcattaaattcaaacaactaggtagtaacaacaacaataatggcaacacaaatataatggaaaatactttacgaatattgtattatttgaatggattgacttgggaagaatttaatcaattggatgtaaacaatttacgttcatttttacaagaatgccaatttgaacagcgcgaagctaccaagtga

SEQ ID NO: 8818 - DNA, 285 bp, Candida albicans
aacaaacagaaagcagaggaggccaagaagaaagcagaggaggccgccccacaaaagtttgacaactttgacgactttattggctttgacatcaacggcaataccaacgccgaagacatcttgtccaacatggactacgaggacctaaaattggacgacaaagtacctgccaccacagacaactacttggacatgaacaacatacttgaaaacgacgagctgatactagacgggttgaacatgacattgctcgacaatggcgaccacgcaaaacgaagagtttga

SEQ ID NO: 8819 - DNA, 252 bp, Candida albicans
tttataatcgctattctactggctgatagttttggttatattactaccccagcaaaattacatttgatccattctccagatgaattttatgcaactgttatttcattgtttgtagggttgaactttccaaccactactgcagttaacttcatcgaacatgaaaatcccgccgttaccgacgagccagaacaggtttatgatcaggattctgatgacgaagaagtagaattgtcttatatccgtcctggtcct

SEQ ID NO: 8820 - DNA, 222 bp, Candida albicans
aatacattagtatcttcactatccttccttattcagacaaacaataaaagagtatatttaaatccaaagtttgctcatgtagtagaatttaagcgaagtattcttgtgaaatcattgtctttatcgctagaattgttcgtctgcaaatttctgaattttttttgtgccgtagatgaagacgggtttaatgaaattgaggtgggggcaggaggcgatctatag

SEQ ID NO: 8821 - DNA, 435 bp, Candida albicans
tccagcaaggaaatgaatataaccaataagtttcagcataccccgatacaaggacaaccacaatcgaatttgcaagcacaacaaattttgttgctgcaactccatcagggtcaagctcaacaacaacagcagcagcaacagcaacagcaatcatcagctggggtacttgggtcaggcttccaacctagtgacaactttggtgaaagtgtgaaccaaaatatttatcaaaataattatcagagtgcccagccatcattgcagcaacaatttttcccgcaattccaacagtcacaacaacaaccatctcagcaagctaataatgcactgcaattacaacagccataccaaccagcacagcagatggtacgccaaacttcacattttcaacaacaacagcaacagcaacctagcctgcaacagctagtcttcagccac

SEQ ID NO: 8822 - DNA, 201 bp, Candida albicans
atgaagacgggtttaatgaaattgaggtgggggcaggaggcgatctatagaagagagctgtttacaatttcatattctatattagtcatttctcacgttaaatgtctaactccgtttatatcgagagtactaagttgtgtctgttattgttttggtaagctttccatgagtcaacttcaagcgatctttatgaaaaaataa

SEQ ID NO: 8823 - DNA, 201 bp, Candida albicans
aactgctttgaagtgttgtggaatctcatgagaaatacttcgtctccttatggtttggttgtaaaacctttggcaacgagaaaagaaaaaaaaaaggagtccttacaagtccctataattactctacaaaagccttgttttgcaattgcatgcagttacgacaagacccgccttctctgtgttcgaagttttcttggctaa

SEQ ID NO: 8824 - DNA, 585 bp, Candida albicans
tatattagttcaccatgtggccctattgaaattttttttttttttggcaatatctctttcttcttaaagaaagttcttataaccttgtattcagaagatcttcaacagtcaaacattctatcgatcttactacaatacacacaatctcacgttcctgcgattaaagaaaagtgtaaagttaaatatcaggtacaacaggcacaaaatcaacaacaaccttacaatcaacaagcagacaatgaaaaaatgaggttcactttgaaaaaaatattctttgtattcctaacattattgataatactgataggttatttattactacaatcagttgatttacaacgtataagggaacttttacatgatagtgaaaaatttgatctcgagagtctaaagcaagctagcttggagataagaaaagagattcattatacaaattatttattcagtggatacgacaactttacacagcagttttccgacgaggaaacccttaagcaaacttcattaaatgataaatgcaaactagttttcacacaatggaaagagtcgcatccagactttgaattcacaactttcgaagcctga

SEQ ID NO: 8825 - DNA, 714 bp, Candida albicans
agacgtacaaccactatagatgaaaccacgactttacctcctgttacaacttcaattaccaaaaccacaactcaactgtacactgtgatcatctttacagatatcaattctgaaacaactttaaccggggattatacatttattcatacaaaaaagacgagaacagttttaaacacggattatgtcaccactactattcaaggatcgatagtaaccgtcactcaaacaactacagatatagtcactgaaatagttgtgacctgcccagatcatgattttgcaaccacgttgactggcagtgcaacgtttgtcccaccaaccacagcaccacaaccagttgagacaccaactccagaaccatcaactacatctgaaataccgtcaattactgaagatactactacttccgatgaagctacttccactactgaatcatcagctttaccctcaagtacaatttctagtattaaatctgaaagttatgtaccgtctgccactacttcagttttggatactagtattactttagaaacaagcagttcttctattgaattttctacttcaactcaagaatcttccagtattagaactttctcatctagctccatcggttcatgtactagtagctcaatctcaactgaagaatcattgagtactactaaattgctgtccaatttcacaagtatttcattatccggaagagttatcatctag

SEQ ID NO: 8826 - DNA, 231 bp, Candida albicans
tcatttaacaatgccgctatttacggacaactaatttcacaacactttgtatcaatattacgtgaagagaaagaactagcaggatttacttatcacatttgttgtgatactactttttccggttttactttgcaagaagatcgatttgtgcgacggacaaaaaacaaaacgaacaacagtcaacacttacaaacgacacaacaaaatcaagagagattgtctacttattaa

SEQ ID NO: 8827 - DNA, 201 bp, Candida albicans
ggcgtgcgggatataatttcacaatctaaatggcgatataatttttatacacgtaaattaatgaatatcaatctccccaaaaagaaagttttacaacaaaatgaatcttctcaacttaatggaggaggaagtaacaaaaagagaaatgaaccgaaagagatagaatattcttattatgatttactaaagaatttgttttag

SEQ ID NO: 8828 - DNA, 354 bp, Candida albicans
  unsure (23),(196),(219),(224),(236): Identity of nucleotide sequences at the above locations are unknown.
aagaaggaaagcaagaaaagagngagagaaaaagaaagccagaaaaagaaggggggggaagaggaaaaaaggaggagaaagaatgaaagagaagacgaggggaagagaaaagagagggaagaaggggaggaaggaagagaacagggaagggaagaagagaaagaagaggaaaaagagagaaaaccaaaaaaaaaangaaagaaagaaaaaaaaaaaaanaaaanacccctttccgnccccccctcttttttccccaaaacagttaaattacgaaactatattaatataatattatcattttatattgaattcaaaaaaaaaaggggtaaaacaaataaaaggaaaagagaatag

SEQ ID NO: 8829 - DNA, 240 bp, Candida albicans
atattggctgtgtgttttgggtgtgcttgggccgggcagagggtgggagagaggcatgaatgcggaagaggaaggaggtcattccattccattccatcgcctcattcttctccatcgttcattcatttaattacgacagcagcagaagaaaaaaaaaaagaattcagatgtagatcgcgtgccaatattatgaaatattccatttttgggaaatttagcttcaatggcttacattggtaa

SEQ ID NO: 8830 - DNA, 240 bp, Candida albicans
cccatcatctctagacgtcgtacaaaatttcacatcaaaatatcaagtcatagcttaggttctgtaaagtcagcagaagatattcattataagaatcccaaagaaactagaatggaaggagctgaacttccagttaaattaaataagttagtcaagaaaaacaacaacaaaaatgtgggccctagttttgagaaatatttaatgtggcaatcttacttgaagttagtactgaagaggtaa

SEQ ID NO: 8831 - DNA, 225 bp, Candida albicans
gagatgtataatttctacacgattgatgaagattttagaattacgtttattccttttacacaagaggatacgttctccaaaaattatgaatattggaaaacaatattaacgaatgaattggaacaacttgttgtttcaatcaaaggaaaaaatttctcaatttcgattgagacaaaagaggaaccaatgttcttcaccacggagctgccagatccgcgcttaggt

SEQ ID NO: 8832 - DNA, 288 bp, Candida albicans
acgtccaggttactattttccaatattatatttttgtttttgctgctaaataatttaactgaagtgaattttctttatttcaatattatacttaattgcaaaaaaaaaatagagagagaaaaaaaaaatcatcagctttcttattatttacaactgagaattaaaaatatcaaaaataatcctattatcagttattatatactaggatttgttattacaatttgctttacaagagaacctcattgttcaagtatcttccagaatctgaaacaggtattatataaataa

SEQ ID NO: 8833 - DNA, 267 bp, Candida albicans
  unsure (249),(259): Identity of nucleotide sequences at the above locations are unknown.
aacatcgttatcctgtttctcatctcaaaatttttccctgctagtttcattaagaatcaaacaatcattatgctttatcaacaatcatatccaatgacaaataagttattaaatgctagtgctgctggtagtacatccacagcttctataattgacggtggttgcacgttgtcgaaacctggcagtggaaaaacaaaatcaacaacttcgttaccttcgtgtaccgacttcttattctatattcgactncgccccacgngattgtaa

SEQ ID NO: 8834 - DNA, 207 bp, Candida albicans
  unsure (6),(52): Identity of nucleotide sequences at the above locations are unknown.
acgcanattcgcctccgaattattcacccttacctagaaaaaaaacaagganacaattcctcccgcaaagtttccttattagttcattatccgacaggaaatttgacaacccacatatttataacaaagatttcatacgtgtctgcccaaataaaaagtaataatacatgtacatatatctatttctctatattaattattgattaa

SEQ ID NO: 8835 - DNA, 312 bp, Candida albicans
tatcgtattgattgtggctattataaggatcacacattattattattattattacaagtatacaaaaactgcaaattagtttatattttcttgaatgacaacaacaacactatcaccaaaaagttcaattcacacgatatatatatatatatatatatatatacaagttttaattatagaatgacaatatctagcatcaatacaataaaagaatctattggtcagtttgtcttgaatcaacttaatgttgaaatacctacaatatatatatatatgtgtgtgtgtggcattatcaaatgccgagccggataa

SEQ ID NO: 8836 - DNA, 525 bp, Candida albicans
ttttattatttgaagtcactttacatttatctatctacctatctatctatctatctatatttaaatcattttcattactctttctttctttctttctttctttcttttttatttatttattgcaacaacgtcacttgtctttctcccccttctccccttctcccttctcccctccaagaaatgtcattaaatacatcaactacaagatctaatactacaaatacttcaaaaagaaatcttcaaccttcttctccatctcctccaccatcacatccacatccacatccacatccacaactggtacttgatctaataaatcattatcctgaattacgccttccatcacaacattatccacacacacacacacaacagccacctacttccccaccacgtatgatgacccctgatgaattttctttttcttttggttcatggcataatattgatatacgtgttcctgaaagtattttatcttcagatggtgaagaattagatttagatagtaatttacctcactacaac

SEQ ID NO: 8837 - DNA, 237 bp, Candida albicans
atcaacttaatgttgaaatacctacaatatatatatatatgtgtgtgtgtggcattatcaaatgccgagccggataagatgttattgataaaaaaaaaaaaggatgcagttattattattaaacaatctcctattaatgcatcaatgtcatgtatatatatatatagtagtagtagtagtagtagtagtaatctattattgttgttactctgtaatatgattaggaaacacgtctaa

SEQ ID NO: 8838 - DNA, 246 bp, Candida albicans
ttagttgactttattatctttttttactttttagttttattatttgaagtcactttacatttatctatctacctatctatctatctatctatatttaaatcattttcattactctttctttctttctttctttctttcttttttatttatttattgcaacaacgtcacttgtctttctcccccttctccccttctcccttctcccctccaagaaatgtcattaaatacatcaactacaagatctaa

SEQ ID NO: 8839 - DNA, 324 bp, Candida albicans
tgttgttgttgtcattcaagaaaatataaactaatttgcagtttttgtatacttgtaataataataataataatgtgtgatccttataatagccacaatcaatacgatattaaaagatctatttttagtgatattcttctctactattctgtattatatgtttttataaatgtattaaaatacgtattatcatcaattttacgattagtaaaccaagtaactataaattactgttccaaaaataggataattactttaaaaattttgcaaaaattttacatcaaaagactcaagtcttcacctcgggactgccaatccgcctaa

SEQ ID NO: 8840 - DNA, 720 bp, Candida albicans
tatcatttgcattgtaactctttaaatatgactgataaggaaaagaaagtcaacaacagtaatccacaagaagatgtactgcgattttctgacgatgatagtatgagtattcaagacgctgacattagcgatagtgaacacgatttattgataagattatcacaacaagcacaaaatcgtcgagcatcgcaaaatcagtaccacaatgatattaatgttataggtgatgactcccataatgatacaactgccagtttagaccttgaagttgtctcaaacgaacacgacattgaagatcatttggatgatgaaattatcgaagaagacgacgatgacgacgataacagtgacaacgatgataattcacacgatcatagtgacgattttgaagatcctgattctatgagtatgatggaaactgctgatttcttacgtcaattaatgcaagcaagaagaaatagaaccactgaaatccgtaatctgaatagtgacagtgccggccagagcctaaacgaggatgatgatgaaatggataatgacgaacatgacaatatcaacgatgatgacgataatgatggagatggaaatgaagatgacgaagaagttgaggaggaggaagatgaagatgaagatgatccccgtgctgatcttttgagggcaattgtgcggttacgggcggcaatagaaacagcagtaatggtgataccagctccattgtaa

SEQ ID NO: 8841 - DNA, 189 bp, Candida albicans
tctttgtatgaggggaacagagatgtctacaatcgtttatcaacaactccaaaaatagattttcacacttcaaatgttgccaaaaagaggagtaaaaaagtggggcatcatccaggtacgatcataatattgttgtttgcacaacgtagaagaagtttagatattattctttacatgataacggcttag

SEQ ID NO: 8842 - DNA, 183 bp, Candida albicans
ttgtactggtgtctgatactcccgtggatatataagtttatttttgtgttctgtatgctgtggtggtggtcaattacttcattggtcactcatgaaacaatagacctacatgtatctcctctacaacaaccctttgttaggaaatcccatatcaatactcaatgtgatcaaaaaatagtatga

SEQ ID NO: 8843 - DNA, 309 bp, Candida albicans
acgctggctcaagtttatcaacaaactatggattctcctatacacattggtgacttgacaacacagtcaattcaacaaaaattattcgagacccatataaataacaacaataagaacaagaccattaacaacaattgtgctttattgtcgacaatttattcgtccatatactctggtgtaaaaactattcagttaacagtgaaactagattctgacaaaaacaacaacaacaacaatgatctcaaatttgacaacaaaagtcatggtgaaattatagttttgagaagagtacaagactcggttggttaa

SEQ ID NO: 8844 - DNA, 225 bp, Candida albicans
ataataagaaaaaaaaaaagagaagacagacacattgcacacatcaacccacaagaatttttcacattgttcttggtcaatgtttcctgcttatccgaggtcatttattctaataatataattcaaaattcaagctcggtgtcgattttcagaatttttaaatacatgatcgtcaaaaatggtattattcaattgtataaaaacaacagaaaccgaaatagctaa

SEQ ID NO: 8845 - DNA, 189 bp, Candida albicans
tttgtaaacgctactcattacacacccttcttgtttggtagtatgcttttacaatacagttatgtacctctgcaagttttagcggggtcagaaaagacgacagtgtcaattgcactaacaataagatcacaaaatagtggaaaagtagaaataatagaagaggaaggggccccagcagtcggcccatga

SEQ ID NO: 8846 - DNA, 186 bp, Candida albicans
ggtaaagggagaactgttcttacaaataacttaaaagaaaacgtggttcataaatctcatattggaaataaaaagtatgtagagtccgtgatgacttctaaaaaaaatagtgaaagcaaaaagacatacaaaaatacagagccatacagatacaaatattataattctttaacaacatttctgtga

SEQ ID NO: 8847 - DNA, 201 bp, Candida albicans
ttgagtgtaagtgtacactatgcacgaatgttgtttggaggggattggttgctaaattcatctaatcataatgggggacttctaatacttgaaatgaaagtgttgaggacagtgatcaaaaaaataaacagtaggttgttatttaggggaatatctttatttatatattatgtaaagtctgtcttctttttttttacttga

SEQ ID NO: 8848 - DNA, 201 bp, Candida albicans
ggactgaagagcccacacacatatacacgtggtaggttatctgaaccttataatctccatgatgacattaacacaccgtatatacgttattcaattatatataaccataatttgaaatatctgtctctctgtctgtctcctgttatttttttagttttgcgtttacctattgttgttgcattagatgtactttttatctaa

SEQ ID NO: 8849 - DNA, 261 bp, Candida albicans
gtttgttcaagagggacaaccgggtcggaaggtcccaattccacttcatcttcattttcaattcgttcttttgtagattttgaaaccatcttatcctttttccgtttacttttaggtgaagaggaaggtggtggtggtggtaaggaaggtaaatttgaaatggaaaatattacgtatacaaacgatacagtgattaacccagtatataaccaaaatccttttcttctaagtttattaataaacctgtcaattggagtataa

SEQ ID NO: 8850 - DNA, 204 bp, Candida albicans
aattacttagtacacgaccttaatttgtcacatacatgctttactttctccgatccaacggggattcattattattatttgcttatgacacacacacagcaagttttagttaactcctttcccgctcctttgcttacccacccccaacaagcaaacaagcggacagaaaaattccacaaccttccaaaactttttcacagttga

SEQ ID NO: 8851 - DNA, 492 bp, Candida albicans
acaaaacatctcccaaaacaccaaaacacattaatgtacacaataatagagagatattatactccaattgacaggtttattaataaacttagaagaaaaggattttggttatatactgggttaatcactgtatcgtttgtatacgtaatattttccatttcaaatttaccttccttaccaccaccaccaccttcctcttcacctaaaagtaaacggaaaaaggataagatggtttcaaaatctacaaaagaacgaattgaaaatgaagatgaagtggaattgggaccttccgacccggttgtccctcttgaacaaactcattctaatgatcatatcataaattcttggtcaaaaagacaattgtatcaatttttatgtgaagaaaagatttatcctgatgttgatgaagagttgaatacaattaagaaacaagttattgaaatttatgagtttaaaaagcaacatggtacattagataaaaagtacatctaa

SEQ ID NO: 8852 - DNA, 648 bp, Candida albicans
tctccacattcaaaaatgtctacaactagtgctactacaggtagtagtactgctagcgctactggttctagtaatcctggtaatatactaatagcagatttacctccaccactacattctcacacttcccctaatattgcattatcaatcaaattaaatcaagatttcattcatcaattaaaatcacatatggcaaaattaccttcttcttcttctggtaataaagttaaattggtggttaaaaatggtcaagtatctattaaattgaatgaacaaatacaatatccatgtttgaaattccccgagaatttaactattgatgtatattctaacaataattatgatggaagaataattaataaattgaccgtggtcactgattccaaaaaaatcaaacagtacaataatagtaatagtgttggtaatgatactgaaaaggatcgtgaggccaattccaacgttataactcctataagcactcctagggatttgcatactcctattataccgtctaacaataacaggaaagaaaagccgctatcaccgcaaaaacaaaaatccgtaatggatgtttactggtcgataaatctcataatccatacacagtattgtcttcacccacgtgggctggacggatccgcgcttaac

SEQ ID NO: 8853 - DNA, 279 bp, Candida albicans
atcaataatgtaatcaacaaatcagttgattttttgtctaaaaaagaaaagatagtagctgcaaaaatacaatttttctttcattgctgtctagtttttttaataattgccggactacaaaaagagctcatatatgccggtatctgttgcttgcaacatgtatgttctaatcgaaacacaccaccacggcaaaccttaagaactgaggcattgtccactcccaagagtttatacattagggctgaacatatcggccttgaccaatgtgtgaatctataa

SEQ ID NO: 8854 - DNA, 567 bp, Candida albicans
cactggatacagcaaacagacttagctaaaactgcaactacaacaacagcaaggaacttcaacatgcaaacaaccaaatataaaccacaatatgctaaacaaacatatccaaaaactccaaattcaaatcaatatgcacaaccagacaaagaaaagaatcagacctacaaaagaaccactccatctaaccaatataagaaaaagactgtcaacaaaactatcaatgtcaaccaacaaccaagaagaagtagatggggattaggtggatttagaagtatgtggcacattccaatgatatttatgttttggcgtgggttttcaaaaaaccgtcaccaaccacaaccacaacctcaacagaacgagtcaatcaatgtcaccaatattaattatccatctttccctgaaaatgctactgctcctgtgcaacattctcagccaaacaccaacaacacagaacagagtttaccaagctcttcacagaacatcaaacccaaacaggatgagaaccactcagtttttttataccacagtgccgaggaagagaaggaggttgactcgtactactga

SEQ ID NO: 8855 - DNA, 210 bp, Candida albicans
attatagcatatccactaatattagctgtcatggaactcaaactaactgcagctaattcggttgaacctaatctcccaacagaaaatactgatgctacagttaatgaatattgtaatagaaaagtgacaattaaaggtaatgaatatttgataatgactttaatttcattgagtatcgttgttttcggttcaggatcaatttcttgttga

SEQ ID NO: 8856 - DNA, 354 bp, Candida albicans
cggcattacgaggtgaggactgggttaatacacttgtatcgacgagttcttttgatccctagagaatcaaaccttgtacaagatcttgcaaatggcataggggagttagctaaattgcatattgagtcacgatctcccgctgacatatgctgtatcttttgtttattcaccgcagggtgcgaggttttgtgtccagaaatgcaacagttttttgaacaaaggttccaaaatttgggacaaatgggaaatatcaatgcccgaaagggtttgcaaatcatgaaacggtgttggaaaacgaacgaagattggataactgcggctgaaaaaattggtgttgatctaacattgttgtaa

SEQ ID NO: 8857 - DNA, 309 bp, Candida albicans
tcgagagcaacgcgtaaatataaaatgtttttttttagtcgtgcattttaccttaatacagaacaaacagaaagagctttaaaaattctgaaatcaagagaggaaagagaaaaaatttataattcactccttctgaacaacaaacattactaccgactttcttcttctgcaatcttttatttaatcttagagctgcttgttgttataaataagatatttgaaaataggaaaacagagcatagtccaatagctcatatatatttgtacattattgttaatatctttttttttttaatcatacatatatag

SEQ ID NO: 8858 - DNA, 669 bp, Candida albicans
gttctagcaatgccggctgcaattagacttatgaaaaagacggtatccttcagtaaggatgtatcaaataacaacaacaatttagaatctgattctgatactaaacaatcgcctcaatcatatttgacatttatccctcaaattaaaaatagtttattagttgttccatttcataatatatttatacttgttgggatgttttattctgggttaactcaagatttagaaacggtgatgtggaaagggtttcttacaagtatacctatacaagtgatttataattacattatttatatcaatttattaccattaaagaaatcaactagaaatgatcatcaaaataattcaagtggttctgctattaataataataataataataataataacaatgttccacttttgattggatcgagtatatttgttagtattgtattatcattgccattatttgttgtgattattttaatgggggcaccagtttataaatattcattgaaaactttatatttgtctttacatttatctcaattaatttttaatcctttaattatattatccaatttgaatgtcaacaaaattaagagattattcaaacaggatcatttgtacagaattattttccatcatggtatattatctagtgttttgttcattttgacttggcct

SEQ ID NO: 8859 - DNA, 219 bp, Candida albicans
ccaaaaaagaaaagaaaagtgtctatgaaatttgagtcaaaatttttgcaaagtgaatggagtcttgttttttttcacacattcttttttgtcaaccgcgataacaaactttcctacagaaaaaaaattatgagtcaacagaatttatcaacattttatttagaaagaacaactccaaaaaagcaatcccccgcaaacaatattcttataaaatattaa

SEQ ID NO: 8860 - DNA, 519 bp, Candida albicans
tttcgcagcaatgatgcctccttccgactggtgaaaaccagtgttgttctggcagtcactggttcagaaactgagattgaaaatctcgattgcagtacagttcatgatactgatagtcaagacgatggtaattgtgataataacaattctattcctattgctgacaggaatgctagaactcgttgctttgaatatttaattggtgccattgatgaagcttgggctagatattgtgatgctactacatcttttgaagatgatgtttttggttccaataaattaggtaatagtacaacaaaaagagcttacaatggaaagctcaacgataataatgataataacgaggattacgatgatgatgatgaagatgatagtgctgatgaaacttttgataacaatactgatatcacagattattctgatttcccacatcaacaaacaattgcatcaacacaagcatcatctaaaccagatcaatcgtcttgtcaattacaagatttgaaagttcgtttgacgaaa

SEQ ID NO: 8861 - DNA, 204 bp, Candida albicans
ttcttcgggtttcgggggtggcgacgcacagtcatcattgtaaatttgattattaagcctagagcgaagactttgacaaattattgttattccgtcacactatgtgcaggtctggggattattccagaaagatatagtttaaccatgaaggaaacctataacattagttttattggaaacaaattcacatctacattaaagtga

SEQ ID NO: 8862 - DNA, 378 bp, Candida albicans
acaatgttaagaacagcattaggagcatcaaaacacagtcgagcatttagaagagccatggccttagaacttcgtcccttgcgctcatactcagtcgagcaaccacccccacaaccaatcacggaaacaaaattcgctgctgtcaaagactacatgaaaaaagtacaaacagaggatacccaagaatctgaaaaagttttaaagttctttagaaagatgggagccatttcaatcgtcgctgtattggcatctattgcatatgctgcatatgagcaatcatataatggtaattcacaaattgttgaagaacaacagctcatcaaattgcctgacttgtcacaggatataagataccaacagagaggagacgagaagtag

SEQ ID NO: 8863 - DNA, 264 bp, Candida albicans
gacaacggtatagcttcgtatcaactaatcacttcattcaaggatgttgtttcccagttttgtttacaaaataacatattaatgaaacctttaaaagatgaactactgttgcaaaagggattcccggtatatcagtttagtcagaatgatttactgaacaagaaaatttgtgggtatattgacgatgacgtgttatgggtgggaaaaattgacgatcaggaatttgtgccaatcaatctagaaaatttgactaattatatataa

SEQ ID NO: 8864 - DNA, 183 bp, Candida albicans
aggaaatgcaaaaagaaagggcgaaaattagcaagcgtaggtgatttcaagtttatttcaattccaagtgcgcaattagtatttgaaccaaatttatttattttcaccgcaattaattcaaaaatgctcacaccaaaattggcgcggagaatagtctgtggaatgggtttttgcctattttga

SEQ ID NO: 8865 - DNA, 201 bp, Candida albicans
  unsure (35),(40): Identity of nucleotide sequences at the above locations are unknown.
cttcgccaatattatggcctatcgggctggttaanaaaanaagaacaagagctgtacagagagaggaaaagggagagaaagcgtgttaaaagaaagaaagaatgggaggaaagggcagcatcgccaacattgccagcaatggtaggtcgaagtgaaaagtggcaaacggtcgagttttctattggtacaggtagccgctaa

SEQ ID NO: 8866 - DNA, 231 bp, Candida albicans
aattcaaaagatcaattccagactgaaacttcaggttcactgcagactttcccaaatgtaaccttaaacaaagtacactatgattctattgaattcaacagtccagaactccaactttataataactatacaaggctacgtccaatcctattgcttcctcccatggaagttaattttcccatcaataccaatgttgttcgaattgatgaagataaccatttccttacttga

SEQ ID NO: 8867 - DNA, 201 bp, Candida albicans
tatttcttcttctttttcctccaccaatcaattttatcaaattatatttcattacagaaagcagaaagatttactaaattatattttgtcattgaatttcctaaaaaaaaacatctcactactaagagaaagagagagactatttcatttactccccctcctactcgtatcaacttttttctaacccccttcacccagtag

SEQ ID NO: 8868 - DNA, 744 bp, Candida albicans
aaaggaaatacttcaaaaccagaagataatccatttgtgataaaattaagatcagtgaaaagcaccataaataagaaatattcggaaaatttacccgaagtgcagcccatcaaaaccatcattggaatgtcccatcaacaaattcttcattcagatttatctgatgtcaaaatcaagacattaatgacatcatcgtcagtgtccaaatatgctgctaatgcagtcaagtttgtaacgactcataaagatgatttatttggtaattttgaaaacaaaaagatttttttaacgttgtgcattaatattgccttgtatgaatcccttggttataagaaaactactaaattataccctaacgttttggaattatttggaggatacgctgaaattaatttagaaacaactcgtactaaattaacgccatcgaaaaaagatattcatcaaaatgatttggattattccgtattgtcttattttggtcatattttgatttgggcagctcatcaacaacgtcaaggtaaagtcccaatttttgctgataaatttggaatcagtttaactagtaaagaagttcgctcaaagattggtggataccatttatgggataaattgttcagagaattacaaggaatgaattccaaaagatggaaacatgtgattaagtttagaaatgcctttcaatacgaagaggatcagtttatgattattttaagatttatgcagattgatgaaaacataccatag

SEQ ID NO: 8869 - DNA, 216 bp, Candida albicans
ggtaatatgtttgtcaatgttaaatgtttgtattatttcttcttatcctatgttatatctattcatcaagacttattacgttcttctttcgttttggtaggtgctacaaaacaaatgaatactatcctattagctgagaatattattccgttatcggagcacaaacattatcccagcttaagagatatgggtgtagtatttccctatcttacttag

SEQ ID NO: 8870 - DNA, 717 bp, Candida albicans
aaaaggccaaacaagcaggtgaccctccacgaagatacaaaaccgggaaaaaggctgctttacaagcggcagaattattctgctgccgccgccgctgcagcagcagcagcctcaacaggaactggaccgggaaacacactcccaataacgacgtccgcatcaggaattatttcgcaattatctgctacaactcctgctaatgttgctattcaaggtaattcacaaatacagacaggtcaaatacacgatgtaatgtcatctcaggacacttttaattccatatcaagacaaaattcttacatcccaccaactgcccaacagttaccacacatgtacaatatgtctcaatcgacaccagcttcatctcaacaaccgattgacaatggaaatacattgatcgggacatctaacggtggttttgggcaacctgaattccaaccagttagtaacaacaatatgccagcctacccaaacgacattcagaacttccagatgttccaaagaatgcagcaacaacaacaacagcagcagcagcaacaaatgccaactcagcaaaggtttttccaaaatggatcggcacccaaccctattcctcaacaaattttacaccaagggaaagtactgtcttcacaatcatcaaatgatagcaattggtcatttagtaacacacaaaaggatagcgatacttcaattaactcaacagcagaggaaccacga

SEQ ID NO: 8871 - DNA, 291 bp, Candida albicans
atgataatagaatatgatacgcgtatcaatttggcaatggtagcgcacgcgtcttgttttattttttttttctcaatgggggaaaggcgggctggcggtagtaataataaaaataaggcgagcggaatagccccaaacggaactcaatttaaattaaaatttgggcacaaccacaacaaactcgcaaaagaaaatttttttttttttacttgggaaaactgtctcacttataatcttctactaacaattctcaattcattttcttttatcaacattttcaaaatttattaa

SEQ ID NO: 8872 - DNA, 186 bp, Candida albicans
gaaaagtggagaataattaagccttattattccttacctaatcaagtcaaaaacgtttctattatgattttatttatttttcttgtagcattgattgatagatcggagattcaatttacgtatcatcataacatgttggattttataataatgatgttacatttggataaaacataccttttttga

SEQ ID NO: 8873 - DNA, 453 bp, Candida albicans
caatctaattcaaagatcttatctcaacacccttcaacgatgagtgtggttcagtttattaatgaaatcaatcaaacatacagtatatcagacaatcgtcaaaaaattgatcaattgacaagactactatctataaatcctcaacaaaataaatatattgctataatatataattccaaatccatcccatcaacaataacaacattatacgatgatgattggtcagcttttagtttaattttaaccagttttattaaattatgtcatttaatggatccttggtctcttttgaaatcattcgatttatacaccacttttttaaatgatttatcagttggattcaataataattcttatggttggttattatcaaatattattaaagatacaatatctcaaatggtaccttgggcaagaaaattgtgtgtcaccacggcctggaaggatccgcac

SEQ ID NO: 8874 - DNA, 288 bp, Candida albicans
tatgttgctaattggtttagaaattcagattcagttaatgatggaggtaataatcgaatgacaaatttgttatttggagaaattataggaactgaagtggaagatgaagttgttgttgtagttgttggagttcctgttgtcgttgacgacaaagatggggatttcgatagtattccaggagcagggcctgaccttcttggtgttatagatgccataagtgaatcgatattgcttggggctttgttcttcttagtatttatggttttatgtcatttacttcttttttaa

SEQ ID NO: 8875 - DNA, 201 bp, Candida albicans
tcgttgtgttttggggaattgagagctaaggtgaggaagggaaaaaaaaaaaaacaacaaaaaattgtgcgtatcgacactattcgaagctcaagttcaacaccatcaaaacttccaatgctactgaaacctgtagattataccctggaacaagaaccttactattatcaacacaatcatcaatatcatgtactgaaatga

SEQ ID NO: 8876 - DNA, 204 bp, Candida albicans
aagttctacacaactgaattaaaattaacattgcatattactgatacaaattttgataatcttcacaaaagtggttggtttattaagttatacatgttcttgattgaaattttaaactatttgagattacgtgatatttttcaattgatcaaactctactctagtaacgttgatgaagaagcaatctttgataatatgacctga

SEQ ID NO: 8877 - DNA, 1683 bp, Candida albicans
aaaatatggctaatggtgaagatcatgcagtcaaacccattaacaatacaaaaactgggccacgatcaaaaaactcagaatcaagatcattatcatgcattaccaccacaaccaggttcatgcactatatcagaatcttcttcaaacaactcattgacgaaatcaacactttcattcaaaggatgggaaatcccgaataaaggatcaacttcaattaccatggacccatgtcaggtagaaacaaccttatcctcgtcatctgccactggtatacccatcaggggaacttcatcccctggttcgttatcaatggcatatttgtcgtcgtctttaaactcgtcatattcatcttccaattattcattgagtaaattgggtggttcatttatggaaaagtggaaaaattcttttggaagtgtcagtagtactagtggtgtggcattgggaggatcagggataggaggaacaacttctgggggtatcagtaacgggtttaacaacagcgctaatggcagtggccaaaaccatacaacaacagcagttaccaatggcagttactttgatgatctatataattttagtaagcgaacatcgccatattcgttgagaactccgtcaccggcagttgaatttgatgagtataatttttcttcaacaaagccaatcaatatcgtcaataattcgctttcaagtaatttccagctgcagctttcaatgactcctagtcgattatctagaactcaatcaatgtatgatttatatggtaacaaacctggagggatgatgaatgttatgacagaagaagaagatatgtcagaggctgaggacatacatcagaaaagtgaatccaatagcagcaccaatagcaacaataataatgcagtaacgggtatgctgacattagaactcaaaagaaccaaaaccagtgtaattatcccattaattcaggataatatgataaagaacatttccgaacataatcaaagtttaatcaaggagaaatgtaaactaaacatggagcacaaactaaagatgaatagagtggttgatgataacgtattgcaagttgaatcgccctgcatacgtaacggcaccagtcataacgaacatatcgttttcaagaacaaaaccttgattcctgtggttgcatttagtgatgagtttagaccagagtttaacgttcagtcgtgtccgataaaccctaaattggaacaacaagtaatggcagggatgaagcaagatttattgttttaccagaataatagtaattatgatgaaatcgtatcacggacgattttcattagtttgcgtgcacgggagatcaaattgattgaaatgaatatcaacaataaagacaataaagcgttttcattaccctcttcacctacgaaacaaatgaccaataataatggaactacctcaaccacaaccaataatacctacaagacgaaaatcaagaagatatatacccctacaaagaacaatggtaataaagaattgattaataaaatcgaaaaagcgtttagtgaaattgggcatctatttgctattcagcaacaattataccaacaacataataataatcctaacagaacaaacgatagtggttacaacaatagtgagattacgaaaagagaatttcatgagaaattgtgtaaattggtattacaaattataaattag

SEQ ID NO: 8878 - DNA, 225 bp, Candida albicans
aactgtttgctaccaattgtctcaaatatatataaacttttcacaccaagaatattaaagttcaatattacgtttaagtttacttttcatttttgcacagttaataaatataataatggtgatgcttatttagatgtaaaatacgatgcgttctatattttaattttattattttgggaacgattattgttgtattatgcgctttttaatttttatttgatttga

SEQ ID NO: 8879 - DNA, 252 bp, Candida albicans
ttaacgacagtagagtttatcgtggttgttgttgtagactcagaagaagcagatgccaataagagggagaataatttcatcaaattattcattatgagcttcgcccctgtacttttgtttttttttcatatgattaacatacttcttgttatagttaataacccttattttttagctcgaacttgcactcgtcaagttcaggatttattcaaactcagtctcaacacattttcatttaaacttttagtctaa

SEQ ID NO: 8880 - DNA, 207 bp, Candida albicans
tcatgtcaacgtaccattttagggcggaaaaaaaaccctcgccatccagaaagaaaaaaaaataataaacaaaaggacacgaaaaaaaaaaagagaggaaaacatttcgtgtataattttcaatctacttacttaatattaagagtaggaacatcatcgtcttgtcttgtcttgtcttgtctgggggagggttgtctcaataattaa

SEQ ID NO: 8881 - DNA, 519 bp, Candida albicans
aaatgtagcaaaacaagacaaaacaaaacaacttcaagtaacaattctaaacagcccttttacatgaataatgcaaacattgtagcaaatccactaatcatgaatgtcataccaattgataatttagaagatccattagcatttggaatcacttcaccaggagtaccagaagaagaagaagaagaaggtgaacttgattcattagcaataggatacgttgatggtactgatgccacggaaattaaagtagtacttgaagctgtcacagtagaaatatcaccacttgctttagaatcagctgcagaaacaccactgttgttagtgttgttattgttgttattgttgttattgttgttattgttgttattgttgttattgttgttattgttgttgttgttgttgtcaggaccagtaccagtaccagtagttgtagttgtagctgtattaacaccagtatcattagaagcggtagatgtagcagtattatcagatgtagcgatattagcagtattagattga

SEQ ID NO: 8882 - DNA, 333 bp, Candida albicans
gaagtctcagatgcccctgaagtttcagatgattcagatgaatttattgtgtctgaagcttcagaagttgtagcagatccagtagtttcagattctgtagaagatccatttgtttcagatgcatttgatgaggtgtttgaagtttcactggattcagttgttgttgttgaagctgaagattcttcaccacttgttgatgacaatgaagctgaatcagtactggcagtactggtagtagaagaaacaacagaactactagaagaagagccatcatctggtgcattaggaactggtttacattcaacattacaagccgaaggtaatgatttttga

SEQ ID NO: 8883 - DNA, 753 bp, Candida albicans
  unsure (93): Identity of nucleotide sequences at the above locations are unknown.
tataatttggaaaaaacttgtaggggtaatgataattcatcggttacttccagctcagacggttgtactgattccatcacttcagaaacagcntcatattcatctacccccttatatggggattcatctcaagtatcttctggaacaactggtacatcaccagataccatgcccagttcccaaacagactatacttcttctggttctggttctcttctggtttctccttcttctagtgttgtccaatcttctggtgttaccaatagtacaccaaatactggtgatgttaatactcaatctaatactgctaatatcgctacatctgataatactgctacatctaccgcttctaatgatactggtgttaatacagctacaactacaactactggtactggtactggtcctgacaacaacaacaacaacaataacaacaataacaacaataacaacaataacaacaataacaacaataacaacaataacaacactaacaacagtggtgtttctgcagctgattctaaagcaagtggtgatatttctactgtgacagcttcaagtactactttaatttccgtggcatcagtaccatcaacgtatcctattgctaatgaatcaagttcaccttcttcttcttcttcttctggtactcctggtgaagtgattccaaatgctaatggatcttctaaattatcaattggtatgacattcatgattagtggatttgctacaatgtttgcattattcatgtaa

SEQ ID NO: 8884 - DNA, 189 bp, Candida albicans
  unsure (69): Identity of nucleotide sequences at the above locations are unknown.
aatgatgaatctaaaggccgccgagaaaaagataatttccctgttccaaattatctgattatgttttanaattctattaaaaaaatgtggttagttgaaatgaaagtttgttatttagttcccacaggtttaaattggattatgttttcaccaccgaaaggattttttctgttctggttaaattttggg

SEQ ID NO: 8885 - DNA, 1149 bp, Candida albicans
tcaattctgacatcaaaaacgttgcacattatcccattattaaaaccggaatttgaaggacatcaagaagtggaatattcggaagagccagaatctaaggaagatgacatagatgaagaacatccacaattgaatcctattactgatgaattagacaaggaccaagatacagttgaaaaaacaactttgtctagaaagcgtggaaatgagggtgacctggagtcatctatgaaaagattaagaacagcagttggtagttttgtaactggaatatttaataggaaggacaaaattaaccaaaattttgagaacaacgccgaagaatcatcaccaaaccagactgatgatgacaacgaaactggcactaaaatggatattaataataaaatagaaatcccaattttagagaaagaactggaaattctggaaactatagaagaagctgacagtgaagaataccacagagatgaagctgaacagatctaccaagacaatgaaaatttagaattaccttttgaacaaggtacagatgcaaatttcaatgaagaaaaaccaacagatatagcatcaattatttcctcaaagaaaatctttgagtacagaagacctgtaattatgaaacgtcgtactagaagaagaggaaggagaactttaaaatggctgcacatgatcacaaatgagttggaacttatacaagcagacaaacttaatgagtcgagattgatagagaaccaagaaccaaatgatgaagaagctgaagtggaaactaacaatttacttgagggtttaaatgcaagtgacgattctgtggaaaacaataggaatgttatgaatgtcaagaaagaagtcgaaaataaccttgatacagactctgatgtacaaaatgaagaacagaaaatcaatcttcccaaggtgagagataattcaaagaagaaacaatctataaaacaaagatttatgggtttacttccagaagagttagaagagcttggattggatcctaacgctgtcagtgaagaaagcaacgaggatgagtcgactcgtcgtggtcgaagattaagaagtcgagacagtaaaccttctttctcattacagtcttctcctgtgagttcaattgaattacgagaacgtccagcatccgagaactag

SEQ ID NO: 8886 - DNA, 183 bp, Candida albicans
  unsure (180): Identity of nucleotide sequences at the above locations are unknown.
aaaacaatcggaaaaaaaaagtggcctgttttacaccaaaaagggaggaataaccgagacgatataccaatatttcaggtagatgaaataataagaaaatacaaaaaagccgttttctgcataatgaacttgaatgagactggtaaatatgttgatattgacagaaacgccaagacaagntaa

SEQ ID NO: 8887 - DNA, 183 bp, Candida albicans
atttttaaaatagtaaaaattccagtactatttttttttagtcatattttggcaccaactttgatgcaaaaaagaaaggcgctacaactaaaaatattgctcatctctgcgtcgatgccgttgtcagcgttttatgacagctttttttttattttcaaaatgaaaaggaaaacgcatatctaa

SEQ ID NO: 8888 - DNA, 222 bp, Candida albicans
aaaggaaaacgcatatctaagttatatcaaattcacacggaaaaattaaagttgtctacacaaaatatagttaatccaggtaaacagagaagaaaagaaaagaaaagaagaaaaaaacaatatcaagttgttccgatgaacaaacaatcatcaccaattcaacaaccgttggcaccctgttttttcctactgggctgtacagttttaacaataatatattaa

SEQ ID NO: 8889 - DNA, 288 bp, Candida albicans
cattttttttctaatttttccatattccatattcccatttgcataaacacatataattcatcaatgtttcaatatataaaagctactcaaagaaatagattaactaattcattattcagttctacatttgctatatgtgtacttttagtaggggctaattcagcaattccttgtcctgtggatagtaattatagtaatgattcgaatgagaaattacaacagcaacataaaaaattcatacaacaaaaacaaaatatacaccagagtaataaggagaacgaaatatag

SEQ ID NO: 8890 - DNA, 1707 bp, Candida albicans
tggggcacagtcactttggaatggaatttggttttggaacagtgtcctacagagagaatttggaagctcatccatttggctgtgtcgaatattagggatagcccgtacttaactgctagtactatgaagtttattttgccttatttcatacttgtggaatataccatgagtatgattactaagctcaataataagcctagctcgtgtgactcaaatcctttaggaatacgatactggcaattattttttgaaaccttctcgggcgatttgtttgaaaagctgaattttgaagctggagctaaaaccaaggaagcagagtcctatttcatactatgcagaatattagaagaatcgggtgtttggtggactacaatcattaaagctttacaggtatacgaggcatttgatctatcattattactagagtcagtgttttgcttatgtgtatttgcaagaaaaggattctcatgggaacccttacaattggtataccagaaagctattttggaagaaactctaggtgttgaattctactatagataccttgaaattgtttactttatgaatcagagaaataattggccacttcctgaaaccgttgtactacaaatttattcctcaatcacaagaatgaaatttgcaaattttattgacgaaattggtatgcctgacttaattgggaaagtttctaaccgatttgatatccctgatgattcattttttgaacgattcatgcaattgctttactggtacatttcaggattatctgagccttcgaaagtgaaaaaattagtaacaaagttattcacattcagcaagtttcaatatgtcaacgatcaaagccatcatgttatgtttattaatagattgaatttcatattattgttggcgctggtatgtaaagtggatttgaaaactcaattactaaatttgttggaaggtattgaaaatgccaaagacgcaaagcttatcaaattggcatcacagggtgtttgtgtgttaacagaaattgccatacaaagagatacaaagttgcccatagagggtatttcaattgttatacaatgttgtatcaatggatattacaatgttcatgggatactaaaggtatggaagaatttcttaatttcgcttaaagatctttttcgtgatccattgagtcgtctttcacatctgctccaacttttgaatatatctaaatccattgatatcaataatgttcctgacaaaatcattatagatatatgtcatgttttgtcgcatataacttcgtccatgataaatgtgaaagatttggttatacagaagcatatcaaaactattaaatcttttaatgagtttgtattatccttgttgcacagacaaatggggcgacttcccttgccgagtgtgatacaagaaaaccgtgtatgcgatttaattgaaatattgctatccatatgggtccaatgtgcctttgttttggatgaaagttgggacagattgatattacaaacgtatgcatatactggaaaccagcaactgcgtgaacagtttgcattatatttttattctaaaattttgcaattcaataatttgaaagggtgcaaggaacttgtcacgagacaagtattacgggatctagtatgtttcaatccgtcaaagtatctttgttcgatattacacaaagtccagaaagaaaaatgtgtacccttgacccgagaatga

SEQ ID NO: 8891 - DNA, 192 bp, Candida albicans
cccccccccatcaaccaaggtagtctgctacccgacgttaagaatatggtcgttttattcgctggttttcattttgtaacgtttgattttagaaatttgatatttaaaagaaaaataaaagatttaaaattttgtttgtataataatttaagaatatataagtctatcgttttacaaatttatcaattatag

SEQ ID NO: 8892 - DNA, 192 bp, Candida albicans
agcacattgttgcaaccacaatattttcttatcaaatgcatctcattttattctagtttagaatatattcactctctggacatttctaacgtatattttcaggagcaacttcagcaactcaacatttaccaagctacctcattccgacaaaaaaatatagaagggaagtcgtgttcattcttcaaaaaataa

SEQ ID NO: 8893 - DNA, 195 bp, Candida albicans
caaaacgaatataaaaaaaaatgtagaacaccaaaaaaaaaaaaattatgtctctcatcaatgttagaaagaaaaacaatcaacaagtggtacccaccagaactacaaccatcaaagattcctagaaccaaaaagaatgccaccaggcccatcaagaatcgtatgaatggcacattactcgatgaggttgtttaa

SEQ ID NO: 8894 - DNA, 183 bp, Candida albicans
actaaaagtacagctattaactctattacgaatcaaaacccgcttcctccgccagtacaattcccagcagctccaccactacatccactagcaccgacacaacccgcagaagtggaattattgtcggcaccacatacaccacctatttcaacaacactaccaccaattcttgcgtggccataa

SEQ ID NO: 8895 - DNA, 243 bp, Candida albicans
aattcttacatgggtgattctcaatggtatttcgtcaatttcctcactttattttttttcgtgcgcccggcgaggtttattttgggtcaccaccattgttcatcaccaccgcaacaacaacaacaaccagcaactatactcataaactggtacgattttgctaccactgatccattggtacaaaatgtaaataaaaacgtcatgcagcattttttttttgatcagctaatctcaaaagactaa

SEQ ID NO: 8896 - DNA, 1170 bp, Candida albicans
cctcaaatattttttggatttgtattaaataatattttaatttctggtggggtattctattatattgtcgtattaataatgacttcaacagatgaagattccggaaagaaccaattttccacacctaaagcacagcaactatcaacgaatggatcatttccattaattgatcaaaagactaaaccacagttagatatggaaaaaatgagagatatattagtagaagaaacttgtttatatacaaagggtgtacaagatacagatgttgattggtttattaccgactcctcgatagatccaaatgctgatgtgcaacccctggttaattccccacgagagacaaacttgaattcacaagcaacaatcccaacttcacatctcacttcagctatttcaaactctaatgaaaactatactaataaaacgaagccatcgattgctcccattcaggaagaaaatatagcatctgatacctcgccacgtcatcatcgacatgaaatagaacaacagcaaccaagaagacgaagtagcgtttcagtaagcactagtggtgggtttttgtcgaagttgaaaagcaaattccataaggagtccccaactccacctggcaatcaccaagacgggctttttaagtctggttacagtgtaaatccagataagaaatcgaatgatagttcaaactccagcattgcgtcgttgtcatcatcacccaagttagtttccggttctaaccttcaaagaacgatgtctaccccagcatacactcatgatacttgtgatccccgattggaggaatacataaagttctaccgaaaaagtgatcgtcgtgcatctgttgcttcgtcatcccattctgccaaagatgaatgtttgccctctgttttagttaatgcatctgaacctaccaattataataagactaaagatgaagtgaatgccagcagagtttctggattttttaaacgaaaaaacagtgttgcaatgaagaatggagaaacgagtctgccaagatctctggtttcagtgtcagtcacgccacagtcgcaagtaaaaaatgggttggaaaataatcctagcttccaaggtctaaaaccattgaaacgagtagcatttcattcttcaactttcttaatagatcgtcttcaccacagggcctggaaggaaccgcga

SEQ ID NO: 8897 - DNA, 204 bp, Candida albicans
  unsure (3),(4),(10),(93),(154): Identity of nucleotide sequences at the above locations are unknown.
ttnntagttntagtccgcccctttgccaacgccccacaacccaaattttttcaacaaaaaaattactcagattataacagcgcacacacacantacaattcacttcacttactcatacacttcatcattttgagatttttagttgttgttcctngtattttcttttctattttttatttcaggaacttctgtttctttaattga

SEQ ID NO: 8898 - DNA, 231 bp, Candida albicans
caccaaaagacaaaagtagaagttagacaaccaaacgaaaaaaaaaaaaaatcaggccaaatattaataatagttttattgtttcaatttcatttttcttcttcttctaccatccacattcatattcacatttcattactttctttcaatacctatattacggttcagtttaaaaaaaaaaaacctccatccaatgaacactggaagttcccaagattcaataccaattga

SEQ ID NO: 8899 - DNA, 186 bp, Candida albicans
atgtactgccaaagcaacaatgccataagcaccctctcccaaaatcttgagcactttaaagttttgagatatgttgaatactacttggcgagtttgagtggggccagtagatttcttcatttcttattaaaagtcacagctttggctttatggaaaataaaaaaaaatgtaaattgttatagttaa

SEQ ID NO: 8900 - DNA, 216 bp, Candida albicans
atagatgattgtatccttacgagtctcttgccttacacctcaacagactatcaaaatcctgcatatacatttatcgcacctttgcctccttcttattttgttcatttaatttttttttggatcatggtgctcggctattataatacaaatactttgcctcctcccaatattaatcaattagtaaccccgatcatcaattcttaccaacaaccatga

SEQ ID NO: 8901 - DNA, 201 bp, Candida albicans
agtattactgttatggttctaattggaataagcagaggtataatacaaaactctgagtatttagagtcttcaagtactttgcttaaaaaaaatgttgttgaagtgaactcagttttacgttttttagggggatcacaaaatttagggcaattatttttcccaaaaaatagagaaaaatacgaaacgattatattcaaataa

SEQ ID NO: 8902 - DNA, 183 bp, Candida albicans
ggtgtaaggcaagagactcgtaaggatacaatcatctatctaccaatattgtacagtgtaaatcttaaaagagttcaaggtgttctcaaaggcaaagtgttcaataagtttaggatgattgtaatagctagaagacctggaaatttcagtttgaatttactacataacccatactgtatatga

SEQ ID NO: 8903 - DNA, 192 bp, Candida albicans
cctactgatggatggacatcagaaccaaattgtaacaaatacatgtggtgtgcatattcaagtataggtggtcgaaccggacccgaagaaactagtcataaagagacactatatggtttattggttgagtatacccctgaagaaattgcatatttcaattacttaggagatgtatgggttggaaaatattaa

SEQ ID NO: 8904 - DNA, 396 bp, Candida albicans
  unsure (207),(364): Identity of nucleotide sequences at the above locations are unknown.
tttgattattatcagtatacaatatttgtacataaatcatcatcatcatcatcaataatgttttcaacatcacgtcaattaatcaaatcatcattaatccatcgttcatattctactactactactactaatggagcaccaataaaagttacaacaacaactactaggaaaaaagttggtgcatttagaggaggattcattggattnttattaggtgtcactacaacaggaggattatcatattattatttattagatcaatataaattagctaatactgtggttattgctgatattgttgctttacaaaattcaattactaatttggaaaaacatattaaatcatttgaagaaagaaaattcngaagaagaaagagagggagattgagaacctga

SEQ ID NO: 8905 - DNA, 228 bp, Candida albicans
agaaattgcatatttcaattacttaggagatgtatgggttggaaaatattaataaagccaaccagatatagatttgtatatataaaagaaaaactttttcaacctaatgggggggggaaatcattaatctttgtagattatgtagatttaattaacctgtgcttatacaaaatagcgagccaatcaaatcaattaacaaatctttccttcctacctacttaccactag

SEQ ID NO: 8906 - DNA, 1107 bp, Candida albicans
tatatgatatttaaattgaatgattataacgcatttttaacttccttgtttgataaaaataatgaacaattacaaagacatcaatctcatcaattacaaaattataatcaatcacagaattctaatacaataatgacttttgcaaataataataataataataataataataataataataataataacagaaacaacagtaatataaattcagaaattgctgatgatgagaataacactaataatggtaacacatatcatcaaaatggaggattcccagtagattttgattttggtttagctcctcctccatttattgctgatttaccacacaataacaccaacaatggtaatggtaattctaataattcaaaatattacagtttaccattgagtgaaacaacaactacatctaataggtataataatattgattatgaattgcctagtaatactgaatttatcgctgaaattggtgcttatgttaaagattccaaactgaacaacaatgacaacaataggacagaaaatctccaatcaaaaaattcgagtaataacaccaataattcaaatcaaagaaatactactacacctactaaacaaaataatagtaataacgataatgttgttgttaatgatattgatcaattttcacgatttaatgaatttggatcaaatttaggagatccaatgatattagaacaagatgaacaaatgaataattctgacaatcccatgatatttaatttaaacgatcaaatggggaataatttcaataatgagcttaacagaagctcgcaatattctaattatcaacaacagcaacaacaacagcaagtttctcaaggtcaaatatttcaagatcaagtgagtcctcattcaagaatgagtaatattcctcaaccaatatctgatcatcaaagaataaaatctaataatcatgaatataattcgaatttacaatcaccaatgtctatagaaactgccccatcaacatcaacaactactactaatttcaataaaaatactgctccaaaaacaggtaagaaaagtcgaaattcaataaaacgatcatcatcttcaccacgggctggaaagtccgcgtac

SEQ ID NO: 8907 - DNA, 210 bp, Candida albicans
caatcaatatttgttgcatatcaacctatatttatccttttatttcaatattatattgaaaagtaccatcgttttcatttactttcattgattagcctacacgtcggtacatatttttgtattgcaagatctttcaaatcattttcattatcaactacagatacatatcaagtggtcttcttttcaaacaatttattatttatcctatag

SEQ ID NO: 8908 - DNA, 1176 bp, Candida albicans
aataaaaaagtggaggcatacaaatgttatcaagaaggattatacattatcgagaaaagcatcaaggattataatattactgtaccggaaaaactattcacgtcgttgaaaacacagtacaaagcgttaaatatcgaattaaagaggaaaagaaccatggctgaaacaaaggagaccactaaacttgtcaaaaaaactaggatacgaactactgatccgtttgcttattttccagttgatattttggaattgattttccagaatattccaatgaaccaaatcttgaaatgtcacactgtttccaaattatggtaccatacactaacctccattcctaggctctatgattttaaatgcagagcaaacattgccttgaacgagtttgtttcgggggtacgattgtttaagaaaatatgctcttactcaaactccaagctggttcaacatgttaggattaaccatgcctgtaacaaacagcatttggcaaaaatgttagatattttaatacgcgagcaaggaatattgccgcgaaacctatctataatggataagaattttaatttacaattattatttcatttatttgctaagtcaggatggaagttgttgaactttcagaatttagagagtttgaaaatagggatcaactgcagcataaagtatggacatgccttgttgaacatgttcaaaaagttgaaggcattggaaatagttatccttgtttctgaaaaaagttcattggatttgattcctattcaagataaattatttagaagattcaaagaccaggaattggaagagtatgggttagaacgattgcttttagttaatcatccaaagctcttgagtgacaatcccaaccccatatcaccccaaacatatagtccttacccgatattgttaaatcgagttttccctggattgacggaattgactttggtgtcatttgatttctccaccacacttcctcagtttggagagtttttaatgcaaacaccaaagttagagaaactataccttgaaaataatcaagcaataaatatgctaatttttttccaaatgcttgtaaattataaaccaacgttcaaattgcaagagtttacctttagagattcctctgtcgtttcggcaatcctcgctaaccgtcatcgacagccgatgaaatcatgtccaacg

SEQ ID NO: 8909 - DNA, 339 bp, Candida albicans
gccgcagatattaccaaacaagtaatgtatttgagatacgttattagactcagaagtcccgcacagtacaaagtagaacaaaacgaatctaagcaccgtatttgccattctccaaacaacaacatcctcacgataaagatcaatggctcaactaactcctatacgagggtttaccaacactcctgtaacacgatcgatatgtatgatatcgactgttgtgccgataatgctatcggtgttggctataaaatatgtcgtcaagtttgctatcgatccttacatcattcaatacaaccaattctggagagtggtgacttaccaattatcagtagtcaatga

SEQ ID NO: 8910 - DNA, 1680 bp, Candida albicans
tacttccagttcatggctaatacgtatttcatttattcaggaatcaatgatgaaaatggatatggaaataaaaataaaaatcattattattataaacaagataatgttacaaaattgaaaatcattaatgaaataaaacggaaactatggattaaactttcatcagtacaaaaaattaaaattatgaaacaatattatgatttaataatgaaagggtatgaaattgatgaaaaaaatgattatcaattaatcaaaataactcatgacaagtttaatataatgacgaaagcaggagaagatgattgttttcctatcacctcaaaaacaaagagtaataaagtaaaatataatacaaaatggccaactttgattatcaaacataatttaactacaggatattgtaaaattgatggagtatcattattagatggatgtaattattatttatggaaaaatctacaaaatttacaaaatctacaaaatttacaaaatctacaaaactgtttaaatgattatgaaaaatatcaaattttgaaacaaaattggataaatttaaactctaaagaacaattacaatatcaacaagaatatgaaaatgttttaaaatcaggtaaaatattactttttggagaattaaaaccaattacacctaaattgatcgaggaatccaatgttatcaaaatcaaatatacaccaatatggggtgaacaattcaaatcagtatcatataaaaatcctgttaaattagaaaatttacgatttttaattaatcaaaccgttgggaatataattgttgttggtaaaagtaaaagtaaaggtaaaactaagactaaaacgaaaaacaatcttgattatgattatgcatggaattattatcttgccaaaagattaaatcaattgggtcagaatatagacaatgttagtgataattaccatttagttgcccaagaatgggggaatatgacaaatgaagaaaaatcaaatattgataaagaatatgataatttattattatcaggtaaagattatttaaatggagaaattgtcactatagaaaaaaaaatatccctaatgaataataatcaaggcaaaggcaaaggtaagaatctaattcatgaaatatttggacaagatttagtaattccaacaaaatcaagacgaggaccaggtggttataaagtgaaaacttcgatcccagtattaattgatctaaaatcagggaaagggataatattagatgacatagatttagtttatgcttataattattatcttggattaatgttaaggaaattgggcaaaggcaaggacaaggacaaggacaaggacaaggaccaggaccaggacaaggaccgtcttcatcatactgtggataatatttcacaaattgaaaatcaatggattttaatgctgcaacaagagaaattacagtataaatcagagtatgaatcattattacgtgatgggaaagatatgcttaatggagaaatagtttcattaagggagaaatttgaagctaataaaactatatcatcaaaaataagtggtcaaggattgaaaagggcattattcccgaaatcaaacattgattttaccgtgaaactgatttcaagtggaagtggtggtgatgatggtgagattgggcaagataatcatgacaaaacagacaaagaatttata

SEQ ID NO: 8911 - DNA, 279 bp, Candida albicans
tcgcagacttcgccagtgcaggttgtaccacatatgtcgaattcgacagaccaaatgagtttctgggaacaagtcgagctacagggtactgatggatacgagtttaatggagagtttatgctagatttcatggagttcataagggctatccgcccccaggattatgaggatgatgacctaaaagacattatacaagctcccaatcaatacgaaggctacatcgggcaagatttcgagctacaccaagaaggtgttcataatttaacgaagcgagaatag

SEQ ID NO: 8912 - DNA, 189 bp, Candida albicans
ttatatttcttgccaacggcattgttttttactggattcctagacttcttagagataaacgatttgtcaaaacaaacagattcaaaccgtattttgctttcgttgacatttggcaaaccattaataccccgttctcaattaaagtcggaaagaaaacccactacttcaaacccagtctacttgccttag

SEQ ID NO: 8913 - DNA, 279 bp, Candida albicans
gaagccaagaaaataaaagctttatggaactacaagattcaagcatttataattgtgaaaagattaaatagctttgtcagtttggatagatacacaatgtcaactattaaatatacactaagatttgtaatctggttaatcatttacgttattcccactgtttcattatttaataataccagaattgaaagtgcagaagacctgtcatttctccaacagattgcagagtttgcgaaatgggaagagcaaaatctatatcaacgtccagcagatccaccg

SEQ ID NO: 8914 - DNA, 879 bp, Candida albicans
accatctggtttatttttccagtttatatacttgaatatttctccttggccttggggaataattatacattagatacaggtgatcataattgttgtaatgtgtttgccaaaatcaatgaaggagagagttttgaacaagttttaaatattgattccaattcagtttcatttcaattgacaaatgatattccaggaaaatttgttccattgaaatcatttcacatcaacaagttagtggacatttcaaaattaatacccattttgagaaatttcttggtattgattaatttgtgtcgtacggtgataaaaagtaaactgactcaattgcctgtattcaatagtaaaagaagaagaagttctagatttttgggaatacctactactgaaagggaattgactgaagaattcaaacacaaattaaaagaatcgttgaaattgccagatgatgttaccgatgaagagattcttggtcttagtgccatttctgaaaccgcaaattattccactataccaccagcaaacaaggatgatatagatctcgaatcatttttgggaaatgaagacaccaccaatagtggtgatgttgatacaaatggtaaaagaggtactgaccacctcccagtgaatggaaacaactatttcctgttgaaattggagagtattgatcttagttcacgaggtgatttgcaattggcatttgaatcacagtttaaatcagaagaggtgtatatcccgtttagaatatcaaatggtgaaatagtaaaattacaaaacagtgatgacatggaaactgatgatactccaagttcgaaatttataaaagccttaaatttgactgaagatataattagttcatataaagcagtatactcaaattaa

SEQ ID NO: 8915 - DNA, 183 bp, Candida albicans
gataggttatgtttttatgacacagtcgtcctagaatcagatcaacatcctgtaagtggcacgttgagtagaagtgattattcatgggatattaagaaaacagaaattgagctcagtttaaatggggtttgcaaagtagagaaaatagtgtccccaaaaggggctatcaaatgtgtagtttga

SEQ ID NO: 8916 - DNA, 240 bp, Candida albicans
aaattatcaattccattatccgaggcatcacgtgtcgactactatatgcaggctgccaaattagaaagacaggggagacggaaaactcgatcaatagacaaccccgactaccacaacgacgacgacgcggagaaattggcacgaagccaggagacaaaagagcaacagaaaaaaaaaaacacaacaacaacaacaacaaaaaaacttttactccgtgagttaaatcaattaattgcttaa

SEQ ID NO: 8917 - DNA, 861 bp, Candida albicans
gcttgttgtatgaaaataaggaaaacaagtgaattcatacatttaattactatgatattatcaatattcatttcaataagttcatgttcttcttcttcgcattccaattctcattcccattccacttccatgtcaatctcatccctggcttcaacattaccaattatacatattaaagatgatatagatgaattaacttattttgatttaacatcaatcaccaccagcacagtatataaaataaataatgatcaagcattagtatatgaaaacaatcaatggatacatgtacaaaccacatcaacaccaatcatccattctaaattcataccaatttcccattgtttgaatcaaaaatggggtgatggaggtgcaattgattttcaaaccacaacaatatataccatgattaacacatttgatttagcattgactttaagtataatattttattatgaaaaattgactcattcttgggaatttagtaaagttttaacattaagagatatatattattgtagtgttgcaccaggagaaattggacaaatttggattgatttacaatatcatgaatttaaaagtattaaatatcgaatattagaaaattttccaaaatttactatacacaacagagaagaatcaaataataataaagttatatctagcaagaacagaaagaagaaatttttactgaagaagaagttaaaatttggtaaatggaaagaaattagtaaaatgtttttgttgaatgggaaaaaactgccaattattagttgtataacaactaacgataataaagacaaacaattggattgtgaaggtaaatcattattaaaacttaaagaatttaaaatgttttga

SEQ ID NO: 8918 - DNA, 201 bp, Candida albicans
aatccgtggcaattcaattcaaatgcactcggggtgtgggaactttacagcaaaccaaaccaaacagaaaaaaaaaaagaacttgaaaatgagagcaaccccacacacacagataggacgaaagaatgtgaagtttctctgcaaccatttttgtttttatctcccaccaccattccattgtcccaaccttataatatttga

SEQ ID NO: 8919 - DNA, 228 bp, Candida albicans
  unsure (27),(84): Identity of nucleotide sequences at the above locations are unknown.
attatcactgtcagtgatgttcctcanccaaagtcagggttggcaacaggaacaaaatccacattgtttccaaagccagctcanttgtttggctgtgtgaaatctccgcatattaagctagaggcaactgaggagacatcgcgagacagtaccaatgagaccaggaatgattacgagtacctgtcatgggaaaattgttttacagtatttttatactatctttgttga

SEQ ID NO: 8920 - DNA, 354 bp, Candida albicans
gtgcaaagtgggggtacgagagccaccgctgggacggtttatccgatcctgggatacggttgtgccggttgccaacgcttgtaccattctctagtaccaacttacatcctggggactggtctactgccacccttggccagaaaatctgggctggcggggacaagggctggggctgagatcaagcttgggccagagccagagccagagtcagagccagggccagagccagagccagagccagagccagagccagagccagggccagagccagggccagggccagggtcagggccagggtcaatggctgacgtccctaagctcaagggaaatggccaatcccagagcagggtctaa

SEQ ID NO: 8921 - DNA, 210 bp, Candida albicans
accggactaataaaggggaggaacacgcacttgacagaattaaacgaccttatcacaattataaagaaaacaatagaaagaaaaaaaagaaaattgaagacaattattgttgttgtcaagaggtttacacatatattacatcatattaatgtgaatggtaggataatattagggtcttgttataataatcaatttctttttcagatttaa

SEQ ID NO: 8922 - DNA, 213 bp, Candida albicans
tttctgcagctacataaagtaataataaatgtggtaaaagtgacatcatcaagcctcattggtattgaagacgcaaacaattttcaacttgtgtgtgtgtatgggaagagagagaaaaataatatacaacaaaataaaccaatcatggcaatatcaattgaaatacattttcttgcttttgtaatgaaccgtcattatacgtcatgtccgtga

SEQ ID NO: 8923 - DNA, 2064 bp, Candida albicans
  unsure (1164),(2059): Identity of nucleotide sequences at the above locations are unknown.
caagatattgactcaatttctgttataccaaaaaactaccagccttccaaggaattattcaattttcttcaattatttatagacatgaatatcgccttttgtaaaatctattttttgatactcatcaacaatatttttaattttgctttagttaaaatgaaaacgatttcaattctagcttttttggtattagctagattaattgaagccaatgatttattccaagttaaaaccattatagattatcaagatttgtaccttcatattaatccaaataattttcaagttaaattaagtcattcatctactgatgttttcgaatttgatgaaagttccaataaattgttttgtgctggtacaaatgatataattacttataataaagagaattgtccttatattatgaaatttgctgatgagtcactgtcctcagttttaggttggtcattggatagacaaacacttagatttgatcatgatttgtactttagtggtaccaaaccgccctattcccttttagatgatccatcgggttgtgcaaattgcaggaaattaaacatctttaggacagtcttagaacccaaagtagaaaaagaagaagaggaagaagaatacgatggtgaagaagatgacgacgatgaatctttaacggaatttgaatcctcgactgactttccaacaatgactgacgaatcaacggaagttgagccctcaactacaactgagtctgcaatttcaacaaccgagacttcaaaagatgaagaatcttcaacaacagttgagtctacaacaacaccaaagaccacaacaaccacgtcagttgactctgtaacaacaacttctaaatcaaatgagtcattaactacaactgaatcaaatgaatcatcaattacaactgaatcaaaggactcctctacgacaactgacgattctacaccagaatcatccactactgaaactgataagacagaaacaacaattgaagaacaagaggaagaaagtaccacatcttctcaatctgaagaaaccgaaggaccatcaggaggaaatgtcgattccacagtcgcaatggtcatatcagcaatgtgtcaaggtgatagagtttatttttattccgatgaacaatatatcactcttttgaatggtgatttggcaacatttaanattgatgatgggtatttaccagtcaataataacaaatgggttaatgttaatattgaaagattattagaattagttgataatcaagaagatgccactcaaggttggattattaatgatgaaggtatatttttggtacaagatggattttattcagatagtgttagctttagtgcttgtggtcatgattcagggtatcgagtttatttaggtgaggaaaatggttgtgaacctttaaatcaatttagaattatgaatattgaagaagatgaaattgatgaaactgagacgacggaatctactaagacgacagaaactactaaaacgaccggtcctgctgagacaactgacctggccgaatcgactgatgatctgaatgagtcgagtgcaccaccaccaactgaagatcctagtgatattccaagtgctactactactgatgaagccactgttgatccatctgatgaacagtctattgctccaactagcgagccaaatgatgaatcaactgaatctgaagagcctaatgagtctgtaacagtgactggtgataccaccacagatacttctgaacaaggattgacaacattcactacagagaccaccgctactgttactgattgtgaggatggtgatgattcatgtacaccaagaactacgattcgtagtaccgttatcaccacccattgtccaatagtcaccaagactgaagttgaaacaattgttactgatttaacaatcacccttactacatgtattgatgagactatttgtgaagctacaactttggttgtttcaaccactgtggttactactaccttgactacccatgtcgtggtgacagaatattttctgaatgctcatgaaagtgatgggtcctctactattgctaatgaantataa

SEQ ID NO: 8924 - DNA, 228 bp, Candida albicans
ggcgcggttaaacataaacttcggatcctgtcatgttccgtaggtgaagacgcttgggacgggagaatttcatatgaaatacaaatactgttcgaattagggtatgtaacatggctaattatgaacagcccgcattgcataatggtagataatgttactgaggagaataatacactaatctatttccttgttaggaagtatgtggacttatcagttcgtccactgtag

SEQ ID NO: 8925 - DNA, 585 bp, Candida albicans
caggatcaggctcaagcacagtatagaccacaacctcaatatcacccacaatctttccaaataccgaataacgctcctcataagaatattttcaacttcaagctggaaattagttcagcacccggatcaataaaacatagtaatgtcaattttattagttcagccactgagccagcaaagcccgtgtttctgttcccgtcaaatgaaaacaccagcaaaagtaatttgaaactgaatgttcaaaaccaacagcaaccagttcaatcttttaataaaccggttcataatttttctttaccgacacagtcaactttaaataaagttccattaacggccccatcaagtttatcatttggtatcacttcaccacagaaggagaaggagaaagaaaaagtgaaaccgttagagcaaccggataccaaagtgtcgattcctgctcccgttaggacttatatatcagttgtccctgaaaaagtaaaattgactcaatcaaagatgtttccattggctctccaacaagtatttgaacagatattacaggacacaattaaatcagaattacaggtgttctttccaaattattaa

SEQ ID NO: 8926 - DNA, 357 bp, Candida albicans
tgcatttttggttcgctattcattaaattaatcgagttctcaacccagccatctgccccacattataatgcaattatatccaatagacgtattattttaatatgctctggttcattagttagcacgggtatttttttgcagctcataatagcagcatttcgggtacttggaatacgtaacatttcgttatgtactagccagccattcatgagtgatatatattcgacatggtccaccaacgctttgtatgtggaaggcggtgttttatatgccatattctttacttggtgggtaccgctttctgactccatttatgccaaaagagcagcacggtatcacaataaacgggtaccctag

SEQ ID NO: 8927 - DNA, 369 bp, Candida albicans
ttttatttctgtgagactggaaaatttgacatgctctgccatttctcatccatacactatcaacacacatccatgccaacacaaagaacctcccgaccagctacccacgaacagatctccaagtccagagtggtgaatgcgttgatcttgacatttttgaccgtgctcattttcctcgtattgttgtatcacttcatatgggctgtgcaggtgatgatgtatcaaccatatggtaatcttctcaataacatagtctacggaccagggactttgattgccaatgcaggactaagctcgaaattgattaaatacattaacacaaagttggtcgaagataaaatagaggcagactacaagaagtatatataa

SEQ ID NO: 8928 - DNA, 216 bp, Candida albicans
acaggggttttctactatcgtaagatgcaggagttcgaatctccttggtgtcaatatttttttttcattccagaaaagcgtttaagatttatatctagctctacctacttacatgctatattggcggtaagctctttctacatacagggcactgcaacttatacttcatccagttttccaagcactcagtgtgaaaaatgtgatgacacggtgtaa

SEQ ID NO: 8929 - DNA, 201 bp, Candida albicans
cagacacaattcaaaagaaaaccaaattcagtaaagatacttactcaaaatattatactatctattaatgaatcaagaaagatcagtgatatagattcccttttcttttattcacttttgatttttagggaatctccaaatcaaggaaaattcaacggaaaacaagtaagatttaacactatggtgatcttaaaagtatag

SEQ ID NO: 8930 - DNA, 234 bp, Candida albicans
ataataaaagagctctatgatttcaatttagttccaatacaagacaagataatatactcaaaacatttacatcaaaataataaacgaaagaaaacggagattccatattatttattgtcatattcattttataaactagagtattctgaaatacctcatacacacaccaaacaatacaaaaataggttgaatagaatacgagtaattgaagaaaccaaaactgttgtgaaataa

SEQ ID NO: 8931 - DNA, 1188 bp, Candida albicans
atgaatggtattatgacgacatcgagtcattcaaacttttataatcaggatttagttggggcaccatcaagctcagatcacattcctggtccttcatctcaggaccaacccactaataataattctcctcaacatcaccatcagcatgaccaatctcaaaccactcatcaaaaccacccattaaaccaacccattcaccaccatcctactcagcaaaatcagctggagtcacaacagtcaagacaatcacatcatttgcagcaacagcaactacaacaacaacagcagcagcagaatcaacataaccaacaaaacttagcttcatcttctacaagttatgaaatgccttcgatatatcaacaatttacaggctcttaccaactaacacgagtaccagagaactttctattggaaaatgcaaactactacgctttacaaccaggatttcctcttgttcaggcagctgattattatagtactccaacaaccacctctgccaatgattatcaaaactcgacgataaatctgataattagcccatcattccaaatgggttcagtttcgacacctgatactcaaaattcaagcattcggagcaagcaacaacagcaacactcatatcagcaacaacaaccacagcagttgctgcaatcacagcatcaactgcaagttccagatatattttatactcaaggcggtacaattggaggttatgtcacgacaaaacaacaacaaaaagagttttcaagaaaaaccagtggagatcaaacacttgttccccaaaccaattctaaattacaacaacaaatttcggagacttcatatttgcagcagcagcagcaacaacaatcaccaccaacacctcaaaaacagcagcaacagcaacattatcagcatcaaacaactcaaccttatggtggtacaggctttatgttgtattctcaaactggaggtccatcttcatcaccagtggctggtaatatctcaataccaacaacgattgctactactggtcagccaaattctcagtttcagttcacttatggatcgcctcaacaaggatcttcatcaaaaactaatcaaatgtatttatatcaaagacagcagcaacaacagcaacagcatcaacaaccgcaatcacaacaaagtcttcaccacgggcgctggaaggatccgcacttgcgtccc

SEQ ID NO: 8932 - DNA, 702 bp, Candida albicans
  unsure (560),(623): Identity of nucleotide sequences at the above locations are unknown.
tccatgtcgtgcacgagttatcaaatcagcatcatttacctgataacgtcgtactccacgacaccaaccctctcaccaaatttcaatttcttacaaccaacacataatctcaattatatatatcactccctccccctcaaaatggataatcttgatcccaattctagtttacaagtagagaaattacgaaacaggaaaagcagggctgtatggcagaataacaacactactactcataataatccttatgctaatttaagcactggtgaaaaaagtaggagtcgccataacactggtagttcttatgtttctccatatggcggtggtaatggagaggagaatgcttatactgggaataataacaaatcaaatactagtggtaatttattacaagttcctggagcaggaggaggaggagatttgaattctaataagaaacaaagtcgaagaatgagtattcatgtgtcagctcgtcaacatggaagatcattttcacaaactggtccaattgatatggcaaatctaccggcattacctaaaataggtggtgttactactantggtgtcggcggtgctggtggtgatgtcatgacaaggaactggggattgacgattgaacccanaatattcccagaattaagtcaaggatcagcagctgaagttgatgattattacgagacatcattgagaccgaagaattaa

SEQ ID NO: 8933 - DNA, 201 bp, Candida albicans
gatgatcaaggaaatgggaaaggagtgtttatgattgagggaagaacattaaaagcattcagggggtttcataactgcttagcagatatggtggaaattttgggaggaatattccagacggtggttttggtttgttgggggtgttttggacaccggatccttatgatccagcatctgaatattctggaccagaggaggtaa

SEQ ID NO: 8934 - DNA, 267 bp, Candida albicans
ctgcttagcagatatggtggaaattttgggaggaatattccagacggtggttttggtttgttgggggtgttttggacaccggatccttatgatccagcatctgaatattctggaccagaggaggtaatttcagaatatgattcagatgatctttacaatggaagtctggataacgagtacagtgatgaggatgatgaattttattatggttctagcatggaggaagattcatcaattgtaacaagtgacaatgataaagactcttga

SEQ ID NO: 8935 - DNA, 387 bp, Candida albicans
aataagttattttcattttcaatttgttgtttgtttcccatacccaacttgacaatcaaagaaactgaaatttcaactatctactcagttttcgtacttcacgtttttgttttatcgaatatagtttggcaaatccttcaatttataaagatattagttcaagctccttacattcgcgtactgtttttttcttttttgcacattaaaaaccaagtacgtaataccaattacaacacccctgaaaacaaagtaagagaggttaaaattaaatatataaaaaagaaaagacaaaggaaaaggaaacttaagtttacattacagaccgtgtcattcttcaagcccacatttatatatttaacaactttgaagagccaaaatatactttaa

SEQ ID NO: 8936 - DNA, 1386 bp, Candida albicans
gctcctccagtgaagtcagttcttccagtgaagtcagctcttccagtgaagtcagctcttcccagtgaagtcagctcttccagtgaagtcagttcttcgagccaagttataagttcaagtgaagtggtcagctcatcaagtgaagtggtcagctcatcaagtgaagttagttcatcaagtgaagttagttcatcaagtgaagtggtaagctcctccagtgaagtcagctcttccagtgaagtcagctcttccagtgaagtcagttcttcgagccaagttacaagttcaagtgaaattgttagtagctcaagtgaagttagtagttcatcaagtgaagtggtcagctcatcaagtgaagttagttcatcaagtgaagtggtaagctcctccagtgaagtcagctcttccagtgaagtcagctcttccagtgaagtcagctcttccagtgaagtcagctcttccagtgaagtcagttcttcgagccaagttataagttcaagtgaagtggtcagctcatcaagtgaagttagttcatcaagtgaagtggtcagctcatcaagtgaagtcagctcctccagtgaagtcagctcctccagtgaagtcagttcttctagccaagttacaagttcaagtgaaattgttagtagctcaagtgaagttagtagttcatcaagtgaagtggtcagctcatcaagtgaagttagttcatcaagtgaagtggtaagctcctccagtgaagtcagctcttccagtgaagtcagctcttccagtgaagtcagttcttcgagccaagttacaagttcaagtgaaattgttagtagctcaagtgaagttagtagttcatcaagtgaagtggtcagctcatcaagtgaagttagttcatcaagtgaagtggtaagctcctccagtgaagtcagctcttccagtgaagtcagctcttccagtgaagtcagttcttcgagccaagttataagttcaagtgaagtggtcagctcatcaagtgaagtggtcagctcatcaagtgaagttagttcatcaagtgaagttagttcatcaagtgaagtcagctcttccagtgaagtcagttcttccagtgaagtcagttcttcgagccaagttacaagttcaagtgaaattgttagtagctcaagtgaagttagtagttcatcaagtgaagtggtcagctcatcaagtgaagttagttcatcaagtgaagtggtaagctcctccagtgaagtcagctcttccagtgaagtcagctcttccagtgaagtcagttcttcgagccaagttataagttcaagtgaagtggtcagctcatcaagtgaagtggtcagctcatcaagtgaagttagttcatcaagtgaagttagttcatcaagttga

SEQ ID NO: 8937 - DNA, 303 bp, Candida albicans
ggacgtggatcttccacccgtggtgaagatttgactaatttagaatttgttttagcagtattagatgaaggagataatgttggttgttttagtgatactaatgatggtgttggagtaatagatgaagttgaagccgttgttgatgatgatgacggtttggccagcagttgtgacgacgacagttgctgcgtcgatgaaggtaatacgattggattctccgggatttcagaacttagtagtggtgttttatccgtatcattgcttgtcatattaagtatatatatatatgtgagtttatattaa

SEQ ID NO: 8938 - DNA, 225 bp, Candida albicans
tggtggcgttgctggagaaaatgtaaattagttgagcaaaaaaaaaaaatagagaaacgagatttgaaggggacaacaaacagaaaaaaaagatgtcagtgcgcctattcagggttgttaactaaatactatacatcaaattcttgcttatatatgtattgtatctcttcgtatgtgaacggaatgaataccttctcaactcctgaaggatcttttactagctga

SEQ ID NO: 8939 - DNA, 204 bp, Candida albicans
tatttaaaagtgttgcgcagaaaaaaaaaaccaaagaaacagaaaacctccactgacaatacattattccatcatcttattatcatgtcatataatggtataggattacaatctgttagaggctcggcaacgtctggtcatattcaaaagaatattgctaatcaaatatcaaaacagtcggcaccacgccctggaaaacgcgcg

SEQ ID NO: 8940 - DNA, 207 bp, Candida albicans
ttgggatttccaatattcaaacacgaactaaacgcggaattgaattcactcttggaaaagaacaatgtaactagtagtgtattcatgtggaaaaaaacaaaacaactaaattcggaaaatcacgcgatgagatcgttttacagcaaattacgggatacaaataccgcctcaccaataggagtgcaaatcataacctgctttatttga

SEQ ID NO: 8941 - DNA, 216 bp, Candida albicans
atcttaattctattctcgtgtatgaaaatcgtaaatgtaagtactttaagttattccacagttgactcgaaagtgggaccaacggaagttattgctaaggtccatttattcttcatgtgtgtactaggaatcttacaaaaggatggtagaaagaagacgaagccgaatgcaaagaatgtgcccaaaaaaaactgtggaacaataggaagtacttaa

SEQ ID NO: 8942 - DNA, 186 bp, Candida albicans
tctcagttaggagcagtattgaacatgggtaccaatgaaccacaagcgcttttacatttggattgggggaattatataattggatttaataaagacccatataatttattattatcaagtggaggatattcatctggagaaggagcagttgtttcatttggtggcaagtgttttgggagttggtag

SEQ ID NO: 8943 - DNA, 390 bp, Candida albicans
acgttgaagttcgaatatgaaacagaaattgaaacagaaattgaaactaaaactcaattagaaattcaatttgatactgatgttgaaattgaatttgaaactgaatatgaaacacaaattgaaactgcatttgcaacagaaattggggtgtctgatgttgaaactagttccgttgatacctcttcttcaatagcagatgtcacctcccagtctattgaatcatcaccaattgaaagtgtggttgataaagacgacaacaacggtgacaacaacgatagcgatgatgacgaagatgatgattatgaagttgttgtacaagaagaacaaattttgattctagaagaagaggaggaggaggaagatgaaccagaaactgccaaaaaattatga

SEQ ID NO: 8944 - DNA, 204 bp, Candida albicans
agtcttcctcgaaaagactctcatattcttcaccacgtggaaggaggaggaaaggggttgatgggaaaaacagtaactaaagcttcctttcatcacttgtcacagaaattgtcccctgaaattaccaattattccgaaaggctgggtctttcttccaaagcagaacttcagtttataactacactccaatggcaacgtttctga

SEQ ID NO: 8945 - DNA, 204 bp, Candida albicans
tcaagtaatacgactggcagcagtaataaatgcgtcttattactttgctggaagttattatgtacttatttatccataaatattagctatcaattacttccccatttttgtaaattaaagcataatcaattaatcaatgaacatttacttaaatatatcaattcatgtatttcccctgtttattttatgagtatctttccctga

SEQ ID NO: 8946 - DNA, 336 bp, Candida albicans
tcctataaaaggattttttacctttctttttttcctatgtttagttttagggatgaaacaatacatattcatgtagatttatactgtaaaaaaaacaaaacaacaaagagaagagaatcaaaatcaaatttgcttgttcctagaaacaagaggtttccgtctggcttaccagttataattctgatgtttagattcgtaagattaatacaagctcctcaaggtgtttactataaatcaagggtgatagagccctgtatttgtgaggggtcaggagtttggggttcatttactattacctctcgtaagaactggattaatgtgcgggtcgtatactga

SEQ ID NO: 8947 - DNA, 252 bp, Candida albicans
tggctctttaaccttgtttcctttgtgttttcttctttagttttcgtctattgttttattaactttagacgggataatatgatgaagcaggcttgcctaattttcatctgtatatgccagtactacgcccagttgttggtaaagtacgagttgcgtgaaaattttcgaagtttactcaattctttgtttttcacaaacacaaaagggttcaaattaggaaatcttttgtaccaatctagaactgaaatttag

SEQ ID NO: 8948 - DNA, 198 bp, Candida albicans
gtagatgattcttcacttgaggatgattcttgtgaagatgaaggtccctcagtagatgatgatggttcctcagttgaagactcggtagaagaagaggcctcagcagatgatgatggtgcagttgatgattcactagaagaagcttcagttgaggaatcagtagatgacgacggaccttcagtagatgacgactcttga

SEQ ID NO: 8949 - DNA, 186 bp, Candida albicans
  unsure (51),(155),(170),(171): Identity of nucleotide sequences at the above locations are unknown.
atgtcaatagcattaattgcattgaataatacgaaaaatggcaagaatatntgtttcaataacatcttcaattatattttcttctttctttgttatatgtgtcacctaatgaatagatttatgaaacaaaaatcgggaattgatgagatattatngataaataagaatannaaaccagacttttaa

SEQ ID NO: 8950 - DNA, 984 bp, Candida albicans
  unsure (5),(7),(61): Identity of nucleotide sequences at the above locations are unknown.
tttantngtagaccgctaataatcaatgactatgattgggatgatccagcacgattcaaanatacaaacgcttcagtcctaccacttgatttcaattcaaaatgccatatcgagcttaccagaatatgcactttagttggaagaatagtcgccaatttttatcaagataaaatgatagatgtgaagaaaaccaaaaatttagctatacagttgagactatggtcaaaaggtttagatcctgagctagcatttggtaatgtattgaatccttcacagatatctaacaatgaagataatggtaacactgtcatattgttgggtattcatatattgcacttatgggcagttatgttgttgagtcgtcccttttttatgtttgaagctatcagtaaaataaatcctgagatgcgtaaatcgtttgaagaagaggaagagttaagcaaacagttatgccaagcagctacaaaggcctctattttagcaatcaagttgatgaatcattatattaatactacgttccacgaaataaagcgcatggagtgttatgtgattataacttgttgcttttatgcttcgattatactaggtataactattctcaatgggacatttgaagaagctggttacactgaaaatgatttgatgaatctgttgaaagacgctcaatatatcttgtcgcagttttcagtttgcaacaaaggtgccgagagatattcagaaataaatttagatttaatctcggcgttggtaaatcgacacaagggtaaagaagtgaaaccagtagtggacaattggagttgcaatttgtttaatgatttcaactttggagatacttctggccaaaatgatgttcagacaatgatggattttcaacaattttttgtgtcactggatcttatacaatttgaagaaatcaccgatgggacaagttctttaccctttgattataacaattataatttgtttttcggtgacaaattgtaa

SEQ ID NO: 8951 - DNA, 246 bp, Candida albicans
ggaatttgtaacattgaacaacttaataaattagctgtaatagcaattaatgatggtgggactgataaaaaatatttatcatataaagataattcacaaagaaacctagcaacagcagttacagctgatgatatacttgatttccgattaggacgtacacttttgttttcaatatcattggtggtgttgttagataaattattcagatcaatggctaattgtagacaatcttctaaagttggatga

SEQ ID NO: 8952 - DNA, 759 bp, Candida albicans
atgacaacgtttttaacaaccacttcatctatcacaactaataatcttaccaataacttgactaatactaataccagcagctcaactccaagaacaaatacaggaacaacttgtactaataatgttaaagaagactcaactaatgatacgtcaaccatatccactacaggttatttagctaaatatcctaatttttcaaaatgtgtttcatttaataatttacatcctcaagaatatgaatctgatttcccttataccactccaatttataatttaaataatcaacaacaacaacaatcacatcattcaggttcattctttgatagtaattatacttttggttcttcaaatggttcaagttcaggttcaggttcgggctcgacaccaaagatttttatgccatttcaagatttcaattttgggaataatagcaacaacagtagtaataataacaccagtagtggtgttggtcgaagacatagtagtagtgcaggcactactgctactagttttattaaaagaaaacgtttgaaattacctccacctccagctaaatcaattcttaagaataaagttagtcaacaacaagttgaatataataatatgtttgaaaatatatctgaagccaatattgaatatcataaacaagaacgagaacaagaacaacaacaagaagaagaagaagataatgatgatgataatagtcaaagtggtagtaatggtggtagtggtaatagtagtgttaatagctcaccttaa

SEQ ID NO: 8953 - DNA, 273 bp, Candida albicans
acttctttctttccgacattttataaggtactatcaacagttatcaaatatataaaaactggaattcaacaggcttgtgagttttctatttgtttgagatttttttgttttcgaattttttttctctctctctcttgttgtattcttcctcttcgtcagaactctgagtactatatatatgtattgcagtggttacaacgaaaacactttatattaccatctgtgtcacaaattagcgtgctaccaccagagatttaccaattgaatatatga

SEQ ID NO: 8954 - DNA, 201 bp, Candida albicans
tgcaactatacaatgaatggcataaaaccttctaatactaaccgcaacccatatcaaggaaaacttgcaaatttgcgatccatacggttctataatttacatttaaatgttagtgataatgtggaaaataactcaaaccatgcaacaacctttactgggaacatccaaaacaaacgcaattacccacctacaagaaatccc

SEQ ID NO: 8955 - DNA, 192 bp, Candida albicans
acgtgttctctgctcaatcgatctactatagacttttacaacccaatttatataagggacacatgcaaatgttgccgcataaaactgcacaagctgtctttgcaagcagaacttagagaagcttattgtctaagtatacgtgttatcctactaccagaaggatttgaagagggtgatagtgctaagaattga

SEQ ID NO: 8956 - DNA, 498 bp, Candida albicans
ctgttgatagtaccttataaaatgtcggaaagaaagaagttcagttcaagaatctcgttgatatttaactataatctgtcaaattctgtacctacccagtcatcaattcaaaatctgggctcacattctaaatcaattggcgctccaagatcgaccccatcaaattccaaaccatctggttcgacctcgtctcctagaccattgagcaagcctttgttgaacacaaacaattcaaggagcaatgcatcattagttacttcaaccctgcataacaatagtagcgtacccgtatcatcaagaactgacacaaacagaaaaatagtatcgtcaaaaccttcaataaatacattggaatcacatactcatagcaataacaataacaataatagcaatagtaattatcatatgaataataacaataattttaataatgatccttatttaaatgataacataacgctgcccgtgcaacgtcataacgagggatcaatagaccca

SEQ ID NO: 8957 - DNA, 198 bp, Candida albicans
aaggaggtaataagttggactactttaagaaaaagacactttgtatttcaaaatgaaagggttttcaataaaaagggcggacatatacgtttggaacaagacaccatcacaccaacaaaaaaagagaaatatggtccaagttgtaaagtgattcttgtgtgtggtgtcttcaccacggactgccggaacgcgttatta

SEQ ID NO: 8958 - DNA, 228 bp, Candida albicans
agagaagaagaaattcaagtaaaaagtaatagttgtagtgacaacgatgagtcggataaattagttttgttagacgacggtattttggcagtaaaaagaacatttcttttttcttgtataaaaaaagctctttttaagttgttccgcatcggattaatgtttaactttaacagcaacaatactaaaaagctgtcaacggcacaactaaatttcaaaccagggccgtga

SEQ ID NO: 8959 - DNA, 210 bp, Candida albicans
ttatacacttattttatttataaatttactttcttgtttttagttttgttagttgatagaattattgttggtctatatggggaccaatattatttaacaagcttgttgcttacattgatactaacacaaactagatttgagaatcctcattatccaaaattcacctccagtatagtttgccactttgtttattccctacatggtggttga

SEQ ID NO: 8960 - DNA, 561 bp, Candida albicans
  unsure (500): Identity of nucleotide sequences at the above locations are unknown.
acaaaaatgaaatttttcactgctgccgccactgctttattattctccgctcaagccttagctggtatcacccaatacactttatccatcgaagccgatgacgaaagagttaatggtaagggtatcacattcaaacatgaaggtgctggtatcaactatgccttcgtcagtgacagttctgccaaattcagttatgatgatgaatccaaacatttgttctacccaattaactctcaaattagctacaaccttggtactgagggagacattgttcaattttcagtcactactccatcttctgttgaaatcggtgatgatggtgctttgaaatttgaaggttctgatgagcttttcgccgctgtcagtattaatgatccataccactattctgacaaagactttgctattattgttcaaggtaaaaacatgctaatccaatcacacttgttgctcaaaaaacttataatgttattgaaattacataactggtttattgcccnaaaatccacccagaataaacgtcttgagaagagcagaaaatacctattggttaaaatttga

SEQ ID NO: 8961 - DNA, 318 bp, Candida albicans
  unsure (53): Identity of nucleotide sequences at the above locations are unknown.
attggttctttcaattcggacgatggaaaggattcattgttaaagttattaantacaaacagggaggtgctggtattaattaggcttttgtcaggaacacttcatgttaatttgcttacgatggtgaatcccacatttttttataacccagctgttccacaactcaaatataactttgtaatggaagctgatatcatacaattttccgtcactccaccaaaatctgttgaaattggtgaagatggtgttttaaaattcgaagattctgataaactttatgctgctgtcagtatcaacgacccataccattactgctga

SEQ ID NO: 8962 - DNA, 480 bp, Candida albicans
atcgaatttgtaaatcgaaaaatatcaatttcattaaagaatcaattgaatatcaaggtgaatcaatactacaatagaattcctaaagattttttatatcaagatatatgtgatttaatacttgaaggtgactcgaaaacgttggatagaataagtttaaagaatataattaatcacgtcactgtggatgtgggatcaacagaaggaagagataagagtaatacctcttcatcttctattgttgaatatattgatgagtttttattaatattgataaacgaaggagaatatttgaaagccactaaatatatgattcaatttattcgaaaatttaaagatcaattcaaagtaccaattatacaatatgagacatttcaatatttacttaagctgattgaattgaatagtagtgttgatgaattaagtccaattaattatggattattacaactttgtatcaatcattatcaacggaattaa

SEQ ID NO: 8963 - DNA, 351 bp, Candida albicans
ttcaaattcatttcaactgaaagttacttgtatatattatcatttatgaatggcttatgcgtgtatggaattagagtttccataaggagcacttcagcagtgcaattactacgacgatccgttagtagaggaagattaaccaatgcatcatcaccactatatatgtcaagacgtcataattcaaccaatcaacaacaggcattactagacccacaagatagaatcaactatattaaactgttaaaactgaggaaagaagttagaaaatatttaaatcgaatttgtaaatcgaaaaatatcaatttcattaaagaatcaattgaatatcaaggtgaatcaatactacaatag

SEQ ID NO: 8964 - DNA, 1185 bp, Candida albicans
tacattaacacaattcaagactttagtttgtttattaaacatatcaacggatttaacttgcatatttttcaagtattgttgaatgtattatttaataacttagtggttgataatgatgtggggattaaagtacaattggaagcatttgtcaatactttattacaagaaatcaagtttgaattttctaatgaaaactccttctttggagaattgttcaattttatgccgtggaatcaaaagaattatattttagacatcctagaaacaaagtttttgttagaaacaaatttggacaacaatcaaattaaattgattataaatgatagaaacttgttaccaccattgaatgatttcttcaagaaattttcatcatcatcatcgtcttctacttcgtcatcttcttcttccttggtacaaactattgagactgatagttcgtttttccttaatttatttaatttcattgggaacttggtcaatgtggccaattcacaagaattaattttggaacaagccaatagcatcaatgatacaatttcaatttttttgaggatattaattattcataaactgtatttatgttcaatgatatctagaaataccaatgaagaaaatgtgattttatttgttactaaattaattgatttacttaattctgattatttgactaatcataatgataaattgagaatattactttatgatttgcttttgttaatgaagtcgtcagttagtgaagaagtgaattcaactacagaattaaatgaaaatctgcaaggtaaccgaaatggaactggaactagtggtggagggtctaatgcaatctcaccaaatcaagactcaatactagacgatcagaacaccaatagcactggtattggtaagggccagaagtcacaaatcggcgttaccaacaataatgatatgttggatgttgcccctacagtttctctgattcaagtattgtttgatttaccagaaccaaatgctagttatccttttaaagaatttatagatgataaattggttaaatgttccattatgctccacgaacaagaattacagtatggtggtgattatcatattttcaacaataccggactttatttgatatccacgaaaaatgaatctgtgagtttaactccctttgtccctggattaaataaaactgctggtgattattaa

SEQ ID NO: 8965 - DNA, 1662 bp, Candida albicans
ccaagaatcatggaagttcatttgaaaattcttgaaaatttgccagtattaaataaccgacaatgtgacagtatattgaaacgttggactcctacaggatttgattttaaggggaaattttctcaaggacaatcaattttacaagattccatcattaccaaaatttgcaataatcaattaactgatgatatagattctcaatgcattggatatatcgattctttgagtgttggattacgatttttattgataaattggttaaccaatgaattaaaactgaaaataaaatcaactaataaattaattcatttcactccaacagtgattaccaaactttatcaattttatgcgaaaaattcaggactcacggttttctttaaagttgtcattcaaacaattttgaaaaatgatggtggtatgattatattttatcttgattcattgtatttgatatctaaattggtgattagacattataaattaatcaaatcaattgctggtgcttctgaattgtccgctgcttatgatttgtttaaattaataattcaagtttataaagatttgaacacccgtgaatatgattgtttcaagtttagttcaatttggaattttattaatgctgtcattgaaaaatcttcaccaacatcatcggcaactacaacagcaacaacttcagtttcgatatcttccttgtatttaacaatggggaaacccaagaattccaaactcaaatcagtgcaaggattacatgtgaaacaaaccatggactcaccaatgtgtattaatacagtcgatgaatcacatactcatgacactagatctggtgcgaaaaggtatacttctactgatttcagaaatgatctttattttttggttactttacaaccaagagcattgaccagtgaagaaaaacaagaagtatttgatttgattgaaattgaattgaaagatttggattctgctttagagttttggtataataactttgaactacttggtgaagaaaaagaaatcaatttaatgaagataattaaaagtttggctgtcaccacttataacgatcatttaagtcaatttaatgaaaaattgaaacaatttgttatttcaaaagttggtgaatcgatagatcactccaaattgagtaatttcttgaagaaacttgctattttcgatttacttcgaattaatgatcttgtcaagttgattcaatcaatacaacgagatgaaattaatcatattgatgataccatctcctttatttatgaattgatttggggtgaactcgacaaagctcactttagttgttctcaattagttttgttacaaatttcccgacgcatgtatcaggaaaaatcaagctatcaatgtattattttattacaacaaaggttattgaaaaacaaagaatcacaattacaaaccaatccatttttcatcaaatataaagcagacttgttgtcatttttccataaagcaataattaccaataccaaagccattcaaagtcaattcttcgataagttgtcacattcagacagtttacaattattgaatgtgttacttcaacgtcaagagaatgatacattaacacaattcaagactttagtttgtttattaaacatatcaacggatttaacttgcatatttttcaagtattgttga

SEQ ID NO: 8966 - DNA, 264 bp, Candida albicans
ataattaatatcctcaaaaaaattgaaattgtatcattgatgctattggcttgttccaaaattaattcttgtgaattggccacattgaccaagttcccaatgaaattaaataaattaaggaaaaacgaactatcagtctcaatagtttgtaccaaggaagaagaagatgacgaagtagaagacgatgatgatgatgaaaatttcttgaagaaatcattcaatggtggtaacaagtttctatcatttataatcaatttaatttga

SEQ ID NO: 8967 - DNA, 255 bp, Candida albicans
gtatgtgattcatcgactgtattaatacacattggtgagtccatggtttgtttcacatgtaatccttgcactgatttgagtttggaattcttgggtttccccattgttaaatacaaggaagatatcgaaactgaagttgttgctgttgtagttgccgatgatgttggtgaagatttttcaatgacagcattaataaaattccaaattgaactaaacttgaaacaatcatattcacgggtgttcaaatctttataa

SEQ ID NO: 8968 - DNA, 456 bp, Candida albicans
actgtaaacaatcctttcatcaaaaaatatatacatactattttaattatctttgattctttctttgttttctttaacactttaaaagatatcatgtctaatatgaattatcaattcccaccttcgtcgcctttgctcgaagattattcttataattcttcaaaagaccctttcacgtcagttgcgtcagctaaatccaaggttgctgaagaagcggcagaagctcgagtatctcgtgataactatccaactccaaatccatcttcctcgttattccgttcatcttctccagcaagagaagcttacggtgataatgatgttttcagaccagaacctaaacaaacagcaaatatcaacaaagatttcaatgttttgaatccagataaatcggttatgcgtatcccattggtcaacacacacacacatcttcaacccgccgggcgaagatccacgtac

SEQ ID NO: 8969 - DNA, 495 bp, Candida albicans
caaaaactattaaactttctcagtgggggaataacaattgtcaagatgaaaatacaaaaggtcaacaatcgagttaaacaattggaaaccccaattgattacaattacgactctttgaaagcttgtaaatgtgattcctgtgattactggtcaatattaagtcccagtcaatcaagcagtttatttttaggaatattgattcccattatttggttgatcaatttattcagaatcatcaattgtttatattttacaaatagtgaaccattggcagccacggcttaccttcaaatttttaaaaccaaagtcagaatgaaaagtaatgtcccattgacatctcattacatcgaatatcataataataatagagttgaaatgtacagttgcttaggacatattttagctgctatgatgatttatggattagttttatttgcaataataatggcgtttgccaaagtcaaaaagagttgtgattttggccccaacaattga

SEQ ID NO: 8970 - DNA, 333 bp, Candida albicans
ctcgtatcaacaatggatgaaaatgttgatttttatatttttctgttttctgttttttttttagtgaagatcttggaatttcaacaaaaaattccagtttttgatgcgaatccctcaaactattcttttattaggggattaaagagaaaaaaaaaaactacaatttttggacgtgttttgctctttatgtattataacaaatttactttaagggcaataaatgttgttccaaacattgttgacgacagagaggacactctgggtgttctcgaatccaatccacaatgcagtcccaacaaaacaaatgaccacaatttgcagctgatggattaa

SEQ ID NO: 8971 - DNA, 648 bp, Candida albicans
tgcaattattttcccacaaaacaaattcttttatatattatatgtcagattattacaatgagcgacgctagaatttgtgttgctttgtttttaaaagttctccagttggtaggagatctagcatgttttgctacgagtataaaggcaggtggtcattataatgggttgataatagccgttacagtgttcagtttcatttataatatttttagtaattgccttggctggtttggtatgaaaggtaccgtggatacagaggacgtgagagcttatagacaattcgttctaggtgggggtaccttatttttccttttttatattgggagttctattttccaactcttcaccggttacaacaacaatttgaataattttggttatggttctcaccttaaaccttatcatcactatgcaagttggtgtattggcgttacttgtgctgtactttactgcatgcaggttataatgtgtgaatgctggggtattacttttgcttccatacatgacttatcgacaggattctttaaaaggcaaccatttaaatttgcctgtctggtatttggcaaatcccaagttgatcatgactgtgaggataataacaacattggtttaaagtcaatgcaacataatactagtaatagtacttga

SEQ ID NO: 8972 - DNA, 207 bp, Candida albicans
gtcatgtatggaagcaaaagtaataccccagcattcacacattataacctgcatgcagtaaagtacagcacaagtaacgccaatacaccaacttgcatagtgatgataaggtttaaggtgagaaccataaccaaaattattcaaattgttgttgtaaccggtgaagagttggaaaatagaactcccaatataaaaaaggaaaaataa

SEQ ID NO: 8973 - DNA, 186 bp, Candida albicans
agaaaatttgaagaacctaatacatctccaattagatttttagattctttgaagaattcacagaggaaacgtcagaaactttttaaaccaaacattcttgatatgtcatttgaaacagcagaagttttaagcagtcctcataatttttatcatcgaaatcttcaccaccggctgaaggatcagcat

SEQ ID NO: 8974 - DNA, 267 bp, Candida albicans
ttaaacaactttgtaaaggaaaaaaaaaaaatatctacgttattcaatgtacgtatatgtagtatgtgtggtattagtagctctttcttattattcaatagtattttattggttaatattttttatttcaattatctttatgtatttatgcatcaattgttaaattaccaaaataaccgaaaaaaaaaaatgaaagaatttctttcccaattaagaaacaaagaaattgccttatgtaagaaattacacgaccttgacttgacttga

SEQ ID NO: 8975 - DNA, 189 bp, Candida albicans
aaacttaaaacaacagaaaaacaagaaaacgaagtgaaatctccgaaccatttaatatataaaaagggggaaaccgaatttcatttatatatctattataccacattacttaaaagtttagttattggttcttattttttttcatatatcccattattattattattactaagaaagaattatctataa

SEQ ID NO: 8976 - DNA, 1269 bp, Candida albicans
aatatgacagcaccttcaatatcaaatcaacagcttccaccacctccatattccaaaacagataacctccccacttctaattatcaactgagtttaaatggttcagtgcagggtcaagatcaacaagtacaagcacaagtacaaggacaggcaccggagttggtttctgcagcagagactttaaccctgttgacaaggaatgccacacctccatctgatgctgatacagtggccatggatgatgcacaatcaccagtaatactacccccaatacacccacaacaccaaagacatccaattgtatctactgtttctatggttgctagacacccaatagtgatgaatgcagttaaatactatgaaacgtcgaaaagaaattatccatccttcaattatgctgctggtatagttgaatctgcagccatacccgttgtcaataatattgaagccaaattaaacacaagacatcaaacaagacaagcctcagctgtatcttcaactgatatcaccccaacaaattcaaattttggtgattacaaaattcaacacgatggaaagaatctgttacaaaagaaaagaagattcagtgcatcgagtcaaacaaccaatatttcttcatattcttcaattgataccaagaaaagattacaattttgtattaatattttgaaattagctaatactaatatcagttctaaagttgaatttcttcaagagaaaatcgatgaaactgaaattgccgttaaagaggaacgagagaaattaattgctcaaaaatcacatgactcgaattcaactaatactactgaacaagcaacacaaaagactaaaacagaaatcgttggaacagttaagaaaatcatacatttaatatccaatttccgtccttcatctttgggtgatacttcagtggctaatggtttgagtcccgtttcatctaatggatctcaatctaatcaagattttgaattaaagaatgccataagagatattattatgagtttaccacaatcattacaacaacaacaacaactgcaacaactgggcccaccatcaaattcacaagatgatgtgatattcaaatttgcaaaagaatcacttgtgatgattagtaaattaacacaaatattcactgaaaaattggatcaagtagagcattgggtaaatggagatgaagaacaagaacaaaaattacaactgcaactgcaactgccagaaggactagaaaagcaacaagaagtattcgccccggggctggaagatccgcgt

SEQ ID NO: 8977 - DNA, 267 bp, Candida albicans
agtctttccaacaacatggtatttgatactagaactttaatcttcttaagtaaagtactcaacgtaattgcttggcttattgaaatagattgtggaggaaaacgtgttgcaaaacttacatggtggttaactatgtttgaagagcaattacttgagcctaactcttcttattttaattatgtggtggcggtttccgtactttctcaacaaaattctgttttaggggttgcgcaagtttctcaattgttgatccgcaattcaacatga

SEQ ID NO: 8978 - DNA, 432 bp, Candida albicans
caaacaaccatggtatcccgaagccactcatcaacaccagtgccaatagatgctagtcatcctatccattccctaaatattggtaatcaagaccaaatagcatccttgtccatacaaacacctataatcttactataccaacaagaagaaaatggatttcaaacaccagagttagttgcgttaagaaacagcaacaaatacgtgttcgttatcaactggctctacaattaccgaggctatttaaaactccaatcagagttatttgatgttgatttatttgaattggaattattgggctttttcagtgcattcgatttatcgagtctattcatcaataaattaaaattggcattaatcacgtctgttcagaactctaaacatgttgagttagaagatcctgagtttgtcctcctttctcaactagccgagtaa

SEQ ID NO: 8979 - DNA, 186 bp, Candida albicans
attgcaattaaacatatttgcttagtttcatattttcctcctattcattgtttcagtattggcagcgtggtggatatctgccacctatacaaaccatttataaataaaatgaatgatcaactagtagaattaaggttttgcagtgcatttactattaacaacagcacacacacgtactcgaaataa

SEQ ID NO: 8980 - DNA, 192 bp, Candida albicans
agttctagtatcaaataccatgttgttggaaagactttaaacaaaggaattaagaatcagaccattgatggatttattacagatattaaaatagggaaactcaacccaaccacaacaaccacaaccacaaccacaaccacaacaataactacattccagtcgttaaatcttttcccaatttctttgttatag

SEQ ID NO: 8981 - DNA, 186 bp, Candida albicans
tcaggaattttgacgaaacccgcaaatatgtcttataaagaaaatgttcagataataataatactgtggtcaaacttgaaatgggaaaaaccatgttatacgtcatttacgtcattattgttacttgctaatattggtttagacgaagagcaagaagtgagaaaattgaaaggggggaaatcctag

SEQ ID NO: 8982 - DNA, 195 bp, Candida albicans
acaagtaaaaaaaaacaaaaaagaacaactaatacaaaaattcccatacaacaacaacagcaaaaaaaatgtcaacgtcaacaaaacaaaggaaaaacgaaacgaaacaataaagtgaacagcagtacaatcagcaccaccaccaccagtggaaaaaaaaaatcacaaccttcttttataacacccactctctaa

SEQ ID NO: 8983 - DNA, 195 bp, Candida albicans
tttcatatattagtactatatttatctagcacattaggcagtcaattatattacctgtatcaaaaccatttctcttttaggaaaattgaacgaaagtgcacactaattgggcaaccaacaattattgaagtctacattacaacttcgcttaaattgccaagtggaatagactttacaagtcagttcaaaaggtaa

SEQ ID NO: 8984 - DNA, 507 bp, Candida albicans
  unsure (3),(4),(5),(30),(31),(56): Identity of nucleotide sequences at the above locations are unknown.
ctnnntgtttttcattggagtaaaaaaaanntaacctttcaaactgttaagctatnttcaatgtcgtgtccacaatctattgacgatttcattccagaacaattcaaattactagatactatctcttcccactctaacaactttgtttgtttctgcaaccattgccactccaaattatttgacgaaacatcctctgctggagtccaagaagaccaaattcaaaaactattgaataatcatcttctcattaaagaagtgcattgcattgcctgtcatggattcgttgggtttaaaattaaaagtttcatcccagatcaatatggttatatttataaaacacagaaagtgggcgggctaaatgattttaagaactttctattgtgtttggaaaatggaatatcggaagaacaaagatatgccaagtttattaaaactaacaaaaagtatattgataaatattttatctgcgtgacaaatgtggtggcaaatttcaagagtcgatcctga

SEQ ID NO: 8985 - DNA, 186 bp, Candida albicans
cttcctctaatggtagtattcttatcaatggaaaggaaacaaataaatacaagaaaaaattggcaagtgaaaatgggttgtctttataaaggtatgtatgaattatgggtaaatccaaaaaaaaaactaaaacaaaagcacggatatacaagcgaaacagaagtgatggttaaaacagtaaattaa

SEQ ID NO: 8986 - DNA, 858 bp, Candida albicans
caagactacaacttaataaaaatgggatatccaccaaatttcaaaattgttactaaatcattaacagaaaacattttattagcatcaacggctttttcaagagtcgataaattcaattttggtgctcgtatggcggtatttaaatttcctcaatcaaataaaattattttatggtcaccattaccttatacaccacaagtaattgatgttttgacaaaatttaccaataataccaatgaatcaaatttaaatattgcttatgtgataattcctgatcgtgaacataatttagctgctaaatcatataaagaaaaatttcccgggtgtaaattaattggaatggaaggattagatgaaaattcattgaaattggattataaatttataaaactgatgggtaataaagttttaaaaaatgatgaattaaaacaaatctttaatgacagtgacagtggcttgattgttgataattttgaatttgtttatttaccaaatcatgcaaatcaagaattggttgtatttgataaatcatcatcaacattatttgaagccgatttattattcaatttaggtgtaccggggtcaactctgggtgaaaccattttagaacaatattcaccagagttggggttccctaaagggtttaatcctcattctggttggtcatttataactagatatttacaaccatattctaaagttggtcgtttcttatttagaaaacttgttgatataaatcatagtaaacctggattagaagctatttataattcatgggattttaaaactattgttatgtgtcatggaaatattataactaaagatgctaaagaagcatttaaacatgtttttgtataa

SEQ ID NO: 8987 - DNA, 1743 bp, Candida albicans
caagatcttttgaaaagtgctacccaaagatcaatagctttacttgatactccacctagacaacctcataaattgagtattattaccaaggcagagaaaaatgaaattgatacgccagaacatgaaacaaatgggaaagaaagtataaacaatgatgatgatgataatgataataaagaaaacagaaattcaagtttggtaaatgataaattaaaagtacttcaaaagaaaattgaaattgaagctgaagtcgaagttgacgatgatgatgacgatgacgatgatgaagattttgataaaaaggcatttttgcaaacaccatccaaagttcttcgagatgtcactaataaaccaaaaatccaatttcaaactccagcaaagcaaaaattattagcacctagttcaccatctacaattattatttccagtccagctaaaggagatgacgatgacgatgaacaaaaagaagaagaagaagaaggaaacgataaagatggaattcgtggtaacaagaaggggaagagtaatattgtgatcaatattgagaatgataaagatgatgaatctttaatggtgccaccgagtccaacaccagcgaaaaatttacctaaaaaaccaatgatgggagtattttctgaaaagaaatcgaattcaactactggtggcaatcaaaatttatttagtcatttcaacaataaaacagatgatataattggtaataataaatttaaaaacaagaataaatccaaacacaatcaactggcccaaccactgcaaccacaactatcccaatcccaatcacagccacaaccacaatcgacaactttcaattttaaggacaataggaaaaaagcagcaaataaagcaaaaatgcaagcaggtatgaataaatttcaaattgtattaactgacgtacacacattaatcaataagaagaagaaaaacaccaaagatgatgatcaaaagaaacaacaaccacagcagcaacaaaaacagaaagaactgcaaaaagagaaacaacaacaaacaagtaataataaatctgataaaaagattatatcaaaacaatcaacacagtctctaccgcctccaccaccaccaccaccacaagcaccaacattaacaacaactccacaattaactcatcaactgtcatcattacaagatcacaatgtaactatgaatagttctaaagatcatagtagtataatatctgccggtaataacagtatgaatactagtcattttaatattacaactgatcattcatcatttgaatttggtggattatcatcaacgccgaattcgaaatttttattagataaaatatttgaaaagccatcaccacaaaccaccaattatttcttacaacaacaacaacaacagcaacaacaaatccaacaaatccaacaaatccaacaactacaacaattacaacaattgcaacaacaacaacaacaaattatactgatgataccttcacaagatggatcaaatagtacaatgccaccacctctaggaaaacaacaacaacaacaacaatcagtacaatttattgcttcacaattcccattaatgacaatgacaatgtcaactcctcaacatcaaggtataattaattacaatcctcaaatttttaccaataatggttcttcaataaataatgatggtaatagtagtactactagtagtagtaatagtcaagaaacttcacctgatggattatttaattatggtcagtag

SEQ ID NO: 8988 - DNA, 246 bp, Candida albicans
gaagaagaagttatgagtactcataatatcatcttagacataattaacgactcatcgtcatctaaaatagatcaattaaatcaattacaaaatgtcattactcaattgtcaaagactgaactcttagaattgaatgtttcatcaatcaatatcgaatctttcaaattgattgtcaatttattaaaaattgaatcaataatgacaaactctcccaagatctgccccaaagagccaagacccgcatcg

SEQ ID NO: 8989 - DNA, 1239 bp, Candida albicans
agagctagtggtggattactttacgatcatgaatatgtaagtgtgattcaaagtgacaaacgtttattgagattccccatacttgccaaatacaaagaaattatactagatagaggtcatttcaaaggcagaattcacaaaaacttgagtagccaaacaggcaaactatgtttagataagaacagtcataatcaattatcaatttcttatggtgattatcttgcagtttctaccccttactcacagggagatctgatttatcatgttctttggtttaatttcaagaattttttcgcagactctttaaacattatccatcatttttggtttcaagattttcttattgtggttaatagacgttcaaggcatacatttgaagagaacgaagaagttgatgatgttaacggtaacggcgactatttagtggatgaatttatggttttagatgcatcgaaaacaaaatatggaatgggtggtgaagaaatttcattcaccagtgattcacttatgtggaaatatgatttcaaaagtacatttatcgatatcaatttatcagaaccaacaaaggggaaaagtcaagttgttatacttactgctgaccatcgattaattgttcttgatttatcaaccaatagacttattaagtcggatacggatataaagcattataaaatatttatatcggtgaacaaaaccgtcaatttatcaactattaatgccaaaattgaattaaatcaagtggttcaaacaagtatgattaataatagacatttcttatttttacttgccacgggtgatatttatcttttgaaaaaccaatctcgagaaacatcatcatcattatcatcattacgcactccaattgaagcaataaaacctagcaatatgtatgatttagtgaaattacattcaaatattgaatttttcaaattcaaatcaattaaatttgaaaatgatattgaatttgtttatttgtttaatggacaagagattcttgtttatgaagtttcagaattaattgaaaaatcttataatgataatgatagggaagaaaaacctgaagatgtattggagtttaaagaagaagaagaggaaaatttattaccgatatgtattcatactgatggaatgcaaccatttgaatttgatgctgttttcaatcataaatcattagatttgattggattgaacactttagcaataaataaaccaaaatcgggtggattatttattagaaac

SEQ ID NO: 8990 - DNA, 1065 bp, Candida albicans
  unsure (2): Identity of nucleotide sequences at the above locations are unknown.
cngggggggggggaggggggggggcgggaccttaatgaaactttgacctcgcaacaaatagatgagattgtgagaattgtctctgaacggagagttgcaaagttcccgaaaaagtttgtttgtagcgatctaatgaaggaggaattagcagagaggttgcggtacgagtgtcttgataacattcaatattgcattgtgacgaatcctctgcatcctcatgttttggcattaaatgaattgttcttgcaaaaagatctagcatcaaactctgcaagtgatattgaaaagaaacagttgtatattaaaaatcctgaaacattcaagttgaaaaatatcattaatcgcagatttgccatggaagactcattggatttattcaagccattggagagaaccaacaaaattgaactgtatttccctgtgttccatgatggccaagttgaagactataaaaatgtattcaatttaccgagccatgatcaagttcggaaactattggagcattttgtggggtcgaagtctagtatcaaagattacgccaaaaaataccatagcgaaaagaaattaaattcaattgaagagtacgctgaattcataaatgtgatatctcttggttttaaaaagagattacctggactgtcgctaactgtgattgtccctgcatacatcaatccagaagaattgaaaacaaagcttgctgtcgaactaaatgacactatagatagagtgttagctgttcctgatttcttagtatctggaacaaatctagaaagtgaaagctttatgtttgccggattggatacgttaatgtaccaaactgcattcacagaaggaaatattgataagaaattgaatttgggtgtgaatgagccatatggggatttgctccatgttcatatttggaggcttttatcctcaacttcagtatcaagaaagaagcgtgttatatttgcattgaatggtaataatgcaagttctgaagacttatctagaattggtcaaatatttgcattcaataatatctcaggacaattggaaataaaaccgtttgttcgagtttcttag

SEQ ID NO: 8991 - DNA, 672 bp, Candida albicans
  unsure (595),(596): Identity of nucleotide sequences at the above locations are unknown.
gttttctttggtgggagtttatttaatttgtcagaaatatatttctatatatctatttgttatttattcatcatgaagtttacgttcaagtttccgatttcaacattgttcaaatataaacctcaaaaattcaattttggattagaacaagaaattcgtctgaaattaaattctttaccttctgtcaccaagatttataccaatccagatggatcaccaagagttcctagtgatgaagaattcaaaactattgctgaattacaaaacttgtattataaaagaaattattcagaatggaattggatattaccaggaattccaaaagatcaattacaattattcaaagataattctcaagatttaactcattttagatttgtttccaaagattcaggtaaaatcattgataaaattccttataaagatgctagtaccggtgaattaaaatggaaaatcatcagagaaacttcaaaagccgaaggatgggagattccatatttttacattgtattaccagtgtttgcttatatattctatgttaaatacactcaacagactaaattgagagaattagaaggtccagattggggcgaannaggaattgagattgagagccatgggaagataatttccatgggagacactgctacaagccaaagaatttttgagtaa

SEQ ID NO: 8992 - DNA, 186 bp, Candida albicans
aagggtagcccttatattattaatagcagtgaggcaatgtttccattatacttatgcggcttagacaactttgctacagtattgtatcaccaatataactccaacaaggctgcttttgggtggctcaataattacatgatgaattcatatacattaaaagttactaacaaatggaaaaccaaataa

SEQ ID NO: 8993 - DNA, 618 bp, Candida albicans
gtacctattaattttagttcattatcatcggagaattctaatacgttggttcttgctcgccgtaaatcatttgcattaagaagtatccccatctttatgcctaatacattgattggttcattgtattatggaaaaggtttggataatattcaattcaaaccattgaataatacttccactttgcaatcaattccattattagcatcaaatatatttcgcaattgggtagaattgaattataaattgaactttatttatcatgtgccaatattgactactcctggtgttgattctaaacgatttaattttgggtttttcgaaagtaacaaaatcgaaaataattggaataaatatatatccattcaagaagagtataattataattacgattctcgagtctttattagacacgctattgataatgcattaggtcatgtgagtttgatgattaatggtagcaaactattaagatggaaatttaatcaaataaatctaagtggcaaggaaacagcgattgctgataagatttggtggaagttcatactactatcgagagtaatgaaggaagatgttttttcaaatatgattcgaaaatttgatagtttttttaggtactaa

SEQ ID NO: 8994 - DNA, 1158 bp, Candida albicans
gaccttccttatattttatgccattcagttttaccaaccatacaaccccaatcccccagtaacgatttttcaactcagtatagtatcaactcatcaatcatgtcatctcctgacgcacctttttggaagtaccacatattaaagtttggtaaagatctatatttaacaaccaacccaggaatgaaacatgtctattgtcgcaacgcacctggctatttcattgaagtggtaagctccgaccccattaccataaaacccacccctacttcaggatacagtttaatttttagagattctactgatctaacggagaactcaagggttccctttatggttataacgaaaaaacctgctagtgaaggtggcgagtttaccttttttataccaaaagacaagttcttgaaccaaggtactgttgttaaatatgaggatttaacaacatataatggggtttccttcacaaagagaatcgacgaggctttttttccctataccggccttcgaacaaaatatccacaatattttcaaaatcacgaaatccgtgatttaaataacgtaccttggaatatagggtcgataccaagagttagaagtagtaaaatgacgaaaattaaggaaaccttcaaaagcacatcaccgtcaaaaagcaaaacccaccccactgctacgcacgatgaagagtttaaatttattggtaaacgaaatatatattttcatcaaaattacgtttctactgctcaccatgggttgaaatatagagaatttgaaccaaggtttatttatggacatgattatgggcaaagtttcccaccggtacttgcaatgtttagaccatttgaaaccagaacgaaaaagaagattatccgaactgtgaagaacaataaacattatctaaatggtagtttaaatgaaaacccttttcttgaaaatgtggacgatcagtatggtactgaaactaaaaagttctatcaaggtagtgatggtttatattatctgaacaacacaagtgatgacttgcctgacgaaaataagttgggatggataacaatatacgaagatcttgaaatctttggaggaattagaaacagaggtatgtttgatattgttgttggtatgacacttgctgttggatatgatagttgtttgtctaatgagtag

SEQ ID NO: 8995 - DNA, 183 bp, Candida albicans
ttttattttttttttttgcaactaattattaatagtaagatattagtcatacttcttggtgtattgaatatattattgtatgttgagggtgtattagtatacatttggtttgatcttatttataacgttaaaaaactatattggtttctagtagaagaaggattgagaatacatttagcataa

SEQ ID NO: 8996 - DNA, 207 bp, Candida albicans
accttttggttgaattatttgcaaatatttgctgcaaaaaaaaaaaatgactcacttcccaaaacaaaaccacaacattcaaacaattgcactggtattgaaatcatcaagtattgtaaatttattagtttatttacctataatatagcaattaatagtgtaaatggatttgtgctaaaatcaagagcaggattatcaatgatttaa

SEQ ID NO: 8997 - DNA, 282 bp, Candida albicans
atgattatggtgtattatccaaatatgaaatcaacagtttctcccagtgtcatgtattcgaaaaacaatggggattataagaaatatcagtttagtagtcaatcaacacgtgaattagattatcataaagtagaaaagttctttgacagtgttgatcaggataatgggacttgggaaatagttaaagaaagtctgatagatactgaaacattgtcacatcaacaacaagaagtagattatgaagacgatgatgatttagcatttgaacacattgaattatga

SEQ ID NO: 8998 - DNA, 255 bp, Candida albicans
ccaagacaaaaagcttatattattataagcccattatacaccagccatctttgcaggacaatcaacattattattacattattacattattattctttgcttgagtgtttaattgttaaacttttaacttactctcgtagagttattatctcgaaaaaaaaatataacgattttatactttacaaatctatattgttctatattggaaggaggtgtgataattcgaaaggagtttttaaattattagatagttag

SEQ ID NO: 8999 - DNA, 210 bp, Candida albicans
attatgataccaactgtacatatatatatatctatctatcatatattattagtaaactgtgtaagtgtgctgtattttactaagtacctgcatatagtgtgccttaacataacaagtttaagtattgtgacgtggtttgaattggaaattggaaatttgttaatcaaaacgaaagaaaaaaaaacaccaccaacagcaccaaccaattaa

SEQ ID NO: 9000 - DNA, 234 bp, Candida albicans
gcaaactcccatggaaaaacccatccgggggactgtaaccccaataaaatcaaaaggtgttgtcaacattgggggggggtatttccggggaaattgttgtggctgggtatgacgctaatgcccatgaatatgggggatggaatacaaagagcagattgtcgattccagggtttatggtatgttcagagaaccagagatcttggatgttgttgttgctccaaacttgtacggtga

SEQ ID NO: 9001 - DNA, 195 bp, Candida albicans
aatcaaaaggtgttgtcaacattgggggggggtatttccggggaaattgttgtggctgggtatgacgctaatgcccatgaatatgggggatggaatacaaagagcagattgtcgattccagggtttatggtatgttcagagaaccagagatcttggatgttgttgttgctccaaacttgtacggtgatattttga

SEQ ID NO: 9002 - DNA, 240 bp, Candida albicans
tgtatctgtaacaacaacaacatcaacaacaacaataactattcagccacttctctatctatctatccccacttacaagaaaacactacaccaccaccaccatcaccacttatgcatacatgctcaattctacttatgtgggataacttatttttgtactcgaatattttatgtttttttgtgtcgatttttgaatttcttgacatacatttgatgatgatgaccattatatttttttag

SEQ ID NO: 9003 - DNA, 660 bp, Candida albicans
aacggaagaaccaaaccagggaagaaatttgtcgccaagaagaggtcttgggtatggacatggtttgatcaagatttacacgataccaacattgccaaatgtacatattgcaataaggtaattataagatttgcatcagataaagggtcaccgaagaaattacttgagcatttgaaaactcacaaaataaatataaactcaatcaattttgctcgaccagtaccgatagatgggactgggatgacttattctagttctggccagccgttatcacaacctctgcataatggcattaaaaaagaaccaggaagtaatcaaactcatacttctcagctttctgacctatcattacaattggcaagtagcagggatactgacaataaagaaagcttaaacggaacttctggtcctggtcagccgttcaactcatccaggtttcgtataaatgtggttaaatttcttactgaaaacaaattatctatggatgtcttgaaatcaaactcttttcgacaattggtctatgatttgaggccagaatcagttaatgatatactggaagtaacgagtatgtatgatgcattcctagaatgtactcgatacagtcctgttgagccgggaaataccgactctaatttaagagttaacggaagcaatacatga

SEQ ID NO: 9004 - DNA, 234 bp, Candida albicans
cgctatgtccttttaactaaagaaagcaaaagagcttcaaacaccgactcaactaactttctcaacctatatatacagtgtgccttacatgaaaaaatttttcagtcacgtgctgtactacccttcatgtttctcgtgctaattaacctttctgcaattacgatatcgttgcgttacacatcgaatcaacatcattgtaacaatatgttgatcaaatcaactgtaatattttaa

SEQ ID NO: 9005 - DNA, 210 bp, Candida albicans
tccttccagcctcggggtgaagaatctctaattactaaactgcaaagtacattaacatgtgtatataaaacagaaatatatatatataaaaaaacaatgaatacaaacaaaaaagttgctaaaataaatgtaatcatactagaatacaggtttaaaagtttattgactctcaatcttttaatcttaataattcaaaatgaatatagctaa

SEQ ID NO: 9006 - DNA, 192 bp, Candida albicans
attattaagattaaaagattgagagtcaataaacttttaaacctgtattctagtatgattacatttattttagcaacttttttgtttgtattcattgtttttttatatatatatatttctgttttatatacacatgttaatgtactttgcagtttagtaattagagattcttcaccccgaggctggaaggac

SEQ ID NO: 9007 - DNA, 219 bp, Candida albicans
attaatcagaatttgatattttcagtatcgtttagaaatattcccaagatgaatattctcgtatacaagatttacttacagcacgttaaagctttgttaatatggttctttatcatttcttttatttatttgctttattatattgtaataactatacacgtgtatatatatatatataatttatatgaaaaacttctttataatttcattttttcctag

SEQ ID NO: 9008 - DNA, 186 bp, Candida albicans
agatctcgttttgttggtgcagtgattattgtgctgacagaacctaaactgaagcgtgccaaaattgagagtaaggaaccgatcttcctatactccgatataggtgaagttattatgtgtatcctctttttctcttcccttaatttatcctgctataactacatattatccgtccatttcttttaa

SEQ ID NO: 9009 - DNA, 195 bp, Candida albicans
tatcttatattgcagtattatgtagattttgagttcattatttttcttggagagagaaaaaaagaaaaatcaatttttcacaaacttcacaatagggtcatcaacgtaagttatgtagtaagatcagaagaaagaagtgaattgatgatcataagaagaagaacaaatgtaggcaagtatttgtataatatttga

SEQ ID NO: 9010 - DNA, 231 bp, Candida albicans
gtcaagagtaaggatataattattgaacgaagaactaaaaaaaaaaggaaattgattgaagattgttacatagtcaaccggaataaaacaaagaaaaaaaaggtaaccaaggaaactaagattagtattgaatttaagtatgtatatcttgtttactgttttattaattgggtggtgttagttatttccaaatacagttgtttcatgattgtttcagaaagaacatattaa

SEQ ID NO: 9011 - DNA, 213 bp, Candida albicans
gtccatatcctcagttcattgcgcgataaaattggagtcaacgccgcgatgtcactagaaaaaaaaaaactgttatatatagcttgtattgcgagaccagatactaagaatctatgcaggatgaaatactggattagggatatagccctaaactatcgttttaccagaaagaaaaaaaaaaaaatttgctgcaaaaaaagattagtagagtga

SEQ ID NO: 9012 - DNA, 321 bp, Candida albicans
cattcattcacgggcaagaatacttgtgtttctgcaaccttgtgggacaacaacaacaatgtacttgaacaaaatcaaatgataaatgatcacaactcttcagaatttgggggggttaagaagaattacgtacctttcaagctcttgggttttggtgtttgtttccagtggatgatagtcagttcgtttggagaagacagatgtaaaaaactggaaaaaaaatatttactatttggtactatttcaatcaagaatccatgtaaaagcaaatatgacatacatcaagagttaaaaaatccttttagtattttactaccttaa

SEQ ID NO: 9013 - DNA, 345 bp, Candida albicans
  unsure (110),(113),(151),(152): Identity of nucleotide sequences at the above locations are unknown.
tttcttgaggatcaggaatcaaaagggatcggaaacgaaccccgaaaagtcaggaccacaaacagaagggcaaccccccaccaacaagccgcagaacaagaaccccccgntcnagaccaacagaaacagggccacacccccccacctcatnntcatcaccaccttcatagtccacaccaccaccaccaccattattatcatcaccatcaccatcatcgccttgacaactctagtgaatttacaccagttgcaaataccactaatgggtcaacaaagcggaaaaatgatgaaacagaaccattgaaacctcatcggcaattatttaaaaagaccattctaaattaa

SEQ ID NO: 9014 - DNA, 246 bp, Candida albicans
atattaatcatcatgacaaagaaatattcttcaaccgaccttaaactgtcgaaattacttcatcgagatttaaattctcctccaatagtcattgatcatgccaatgggaataatttattcactcaagatcatcatcaattatttgatagtgttggtggtgcggcagtaatatctgttggtcataataataaagaagtcattgacgccatgatcttccaccacggggctcgaaggatccgcgcttag

SEQ ID NO: 9015 - DNA, 1659 bp, Candida albicans
actcaggaatatgtgcatatattgggtaaacttcaggaaaatgacaaatacaacactgaagatcaagcatcaagtaatacaccactaaaggaggaaacacaggaagaagagatcataccacaacaacattcctgtgatatctcagaagagccacagcctgaggagcagccacaggtgcaagaaccttttttcaatcattcaaaccctcctgacctcaaaaagatgatttctatatctaatttgaaattaaagccaatgaggtgtacatcagccaccagtcccactatctccaagaaaaagtcacgatatcgattatcgagcatatataatattaaccctattgcatacgaagaatcaacaatggaaacatcggtagccacttcatccacatcttctggtgaacacactatcacatcagattcccatgaagtggatcactcaagaatgcaaaatagtgtaacgtattcatatgaaactttggattcccatattatgaatggaacaactgaattacatggaaacatgactcctgttaaaatttctccagaagatacggaaacaccactaaatgaagtcaaagcgacaacgagaggaagatcaaactcgttgcccacaacttctactaaagataattcagtccctgataacgatttcctcaaagaatttgattgtgaagatgatattctacggttgaacagactaaagcactttataagtgttagcaacctacctgggatacactattatgaccatgattatcaagatgacacaggaagtgattacaatcataaagatgatgttttctttgatgaaatatatacacaatcaccatcgccacaagcacgacgaaataatattaatgatggaaattatgatgtggtatcgattgtatctgacttttcatattattctcctgaaaagcaagagcatcaactgctgggaaccgataatgatgatatatttgattataatgattttagtgattttttgagaaaatcacgactagatttgaataaagatttacaacaagcgtttcctcatttaatgcctgcacctcaagtcaaagagacacaacgatataagtttcataatccaattgaaaaacaattgacatcatctatgatatcaacggcaactcttgatgtacaagcatcagcaatattgaacaataaaattgatcccaataacaacaaactttcctatagacctggtgccacctcaacatcaataacaaatagtgcatttgcatcatcttcaccatctgcctcatcaatattacattcgtatatgcaaaaccccaaaacaaccacgcaacaatctaatgaatcaacccattcattttcatttaatgatggatttttcaaactatatcattcgatatcagatactcccaagaagactagcataacaccccccaaaatcaaagaattgaaaaaatctaaaatgattaaaagtaatcctatactgatacctaatgaagctcaattgaaacgaataccaccgtcaaggactgatggatctgtttcgaaattaataattggctcaaatcaaacaaaaacgataagacatggtgatggttcgatttttaagaatccagtagccaaatcttatgattattctgcattaagagatgcattagcgtctagtatattagattaa

SEQ ID NO: 9016 - DNA, 291 bp, Candida albicans
atgagaatttatccagttttcaaaaaaccttcaattgtgaattcatttaattcatttcaagaacaacgatgttttgttattaaagatggtacacatcatttctctggtgtcacaattattagacaatataaagttgttgctgaatctaaagcttcaattacttatatgtcgaaaaataataatcacaataaaaatcaaatcaaaaatatccaagaagagaaaattcaaaaaagtttgcatctgtcaagacgtgaatatagttcatttatcgatgattcaggctttgaatag

SEQ ID NO: 9017 - DNA, 219 bp, Candida albicans
  unsure (196): Identity of nucleotide sequences at the above locations are unknown.
tcatcaatttacaaaatacgggaaaaccgagccagaacagactcggaccagaataaactctattttatgaaatatcagtgtcaaactactaaacttcctatatacatccgtcgtataatacattgccactatttactttgtttaaaggccacttcttccggtagttcaaacgatacacaaaacatgggttttgtangagaaaccattctaacttcatga

SEQ ID NO: 9018 - DNA, 363 bp, Candida albicans
acactatttttaatgattcattcatcattatatttatttaatgaaatgattaattattggcctggttggacttatattaaacataatctttctcaaatattgacaagtagtaatgataatggtaatgataatggtaatgataatggtaatggcaatggcactagatctttaagtattggtgataaattgttattattatggaatactccacaattgataattggagggttgattggattatggtggtttatgttattaatgacaaatatttatttccatctgagtttagaaaaattggtacgtttgggatttggttatattggtgtcgcacgattatattggataccgagatggttattataa

SEQ ID NO: 9019 - DNA, 192 bp, Candida albicans
acggttaatttcaaggaattgaccaaatcattcttgtatatagggtttacacccccgaaaaatggatatttgattaaaacaaataataaattaagtggtaaaagaataagtgcgattactgcccttaaggaaatcataataaatagtgtcaggagtgttttgatgaattcaattgaagttttaattaattga

SEQ ID NO: 9020 - DNA, 222 bp, Candida albicans
aatgatgatgatcttgtcaagtctggtgaatatattaaaattgccattgatagatttaaacaaaattctgatttggttatgttgaagcagtgtttacaatatcaagtttatttaatgaataaatataatcaaccacaagaaatggagttggctaatcgtttattaaatgaaataactcaagagttgcaaaatgaagtggaacaaggatatatatataattag

SEQ ID NO: 9021 - DNA, 396 bp, Candida albicans
accaaagtcatgttcaaattactaataccgaataagtataattacgtgatacgaccattggtaaggtttaaatctataaaatcaccaaaatcaccaaaaccaaaaccaactgcaaaactcagtccaaatgtgttttctctgggtaaattttctcaactacataatgataccagcaccactaatattgaatcaaaaataactagttttgatcaattgaagatttttccttcggttatagaatccataattaaagaaatcaaatctcactactatttaaaacgtccacgacattctaatattgatgaaattgatatcaaaccaactcccgtccaaattgctgctattcggaaaattaaccaaaccatgaaacttatagtgcccaataaagatttataa

SEQ ID NO: 9022 - DNA, 384 bp, Candida albicans
aatctagttacctttcttcctctttttataaggttctttaaaatgagtacaatttcagcagatgcattgctaaacgaaacaaagagagaaagaaatgaaagattcaagaaccaactatatcaagcagcagcaaaaggagtactacaaggcacattaattgcgttgatgacagggtatgcattatcttacaaatataatcatggggtaaacagagcatatttcaaaacaacttacaaagtatggtggtttgttgggtggaacgttgttggtataacttttgccactgatactgctaaaatgaaaatcagtaaacaggcagctatggaagatgaactcaaacgaaacagatatattgaacaggaattgagcaggaatctcaaatag

SEQ ID NO: 9023 - DNA, 189 bp, Candida albicans
tttcagttcattttggggaaggagagagagtcattgttatatttttcaaccggtttattacaattatcgattattttgattattcgtggatcgttatcgagtctcaaaattattaaaataaaagagccacctacgatcacacacaaacttactaaacttaaacaaatttctcttaaaatctatctttag

SEQ ID NO: 9024 - DNA, 249 bp, Candida albicans
aaaaacaatcaatttatcagagatattgtcagttgtacagcctcctcatattttatcttgtccgttagttgtaagaactgtattgtggcgaatgaaatcgttatacgtgaaacagcgatccttccaactactatggttagtagtaacgatgaatggtgtacctcgcaagattatgtctctctaaataccaagaaaaaagaaagacccataattgtgtgtatggaagcaagtgagacaaaacaaaaataa

SEQ ID NO: 9025 - DNA, 204 bp, Candida albicans
ataccgcaagggaatccccaatttaccacccgaataattcctatttcttcctccgcctcactaatctctcattcctacaatcaccacatgtttaaaaaaggcctaccattagtcggaaggttcccaccccaagggtttcctttttaccacccctggggtgttctccataagcgaaattttccccctggcgacaaagaaacttga

SEQ ID NO: 9026 - DNA, 201 bp, Candida albicans
cttaaatccgcttctgacagtgagccccataaaataataaaaccaaattataatagggcggtgtttaaactcccttttgtagaagatctgatggggaaaaaaaagcccagatctaaacctaaacctaaatcctggactagttttcagtattggttgtatcactgcttccaccaaggagttacgctgaaatttagacaataa

SEQ ID NO: 9027 - DNA, 222 bp, Candida albicans
  unsure (139): Identity of nucleotide sequences at the above locations are unknown.
ctttttccccccccccccaatttgtttagaggagccccaaatttccccccgttatcaccaaaacataggatattagacccatccataacccttgcctcattatatgatgatttgaaaaagtataagccctatattcatntacatacacccggagatttaagggagtcggactaccattcccagaagacacatacaagtcgtatatatccacatctgcaataa

SEQ ID NO: 9028 - DNA, 1413 bp, Candida albicans
actaaaagagatccggggttgtctacttcattgtcagttattaatcccacattggaatctgaaattaaaccgaacccggtgatattgaatcaattgagtttccaccccccaccaaatcttaatactggagttttgtatccaccaaccgcaacagcagcaacaacaacaacatcaagtcctactaatcatcatttacatccctattttgtcagtctgataccaaatccacaacatcatccaatgctagacacttctcaacatcaagagactacatcaacagaccctaatcaattcgattattcccatctatcaatgcctcaatccacacccttgctaatgaaatacgatatcaccacctatgtaaggttaattgaaacagaaaagtattacatgctattggatcttgccaatgaattagatatttggaaaaaaattataccgtcattgtgtttgcaaatttccgagaatgattcattcttgttagattgtttgatgagctgttctcgtaatacatctgttaaccttttggacttgactaatgaacaattgaataagtggtcgcaattgaaaaatgctcccgtgatatcagaaagaattcaacaatttgaacatatactaataagtattgtattaattttacttggattatatttgaatacgactaaagttcgactaactgattatcataaggtgattttcaataatcaagccaaattgttttcccacgtattgcgcaagatccatacatttatcacatcaaataaacccaattcggcagtattgacaaatgccattcaatcaattactatgctcaaatttttcatagataaaaattatgacttctcatatgaatttaaaaatatccagaagggaagagttactgatacactggaggaaatcacgtattctaattcgaatttatattccaacccggatatatcctatatttctacattcaacgaatacgagattatctacttgaataattcgtatcagaatcttgttcacgttgatcaaagcaatagtatgctgatgggcgaatctcaattatacaaagatctattgtggtatttgatgaaagttgattttgtcattaattatccagaagctgccaacaatttggttcttgatcataatgttgtttatcaacaaattactaatgcatcgactgatttgagtttcagtaataacttgaattatttgaacccaagatcatatgcaaattattttttgaaagaatttattatcaaagtattgagtatgggtagcaatgccatcattgaagatgccaataatcgaataaatactctatttaattttattgatcaaagctatatggacccagaactaaaatcacaatttcatcattgctttacctggactgtacgctacattcacccagtaagtgattaa

SEQ ID NO: 9029 - DNA, 336 bp, Candida albicans
attattattgttttaaatgtttgtttgtactatcccaaagttgaaaactttgaaaaattatcgttgttcaaaaatcaaatatatgtctgtagaatttatcgtggcaagtatatgaaaactagtacagctttaatgactggctttgaacaggaaattataacgctggtgggcacttcactgaatcttcatcttgcaaaaaatctgtcgtcatatgtagccgaattgactttcaaatacgaccaagatctaaacacaaaacagatacacgtgactaaaatatttagaagtgctgtactaagaatttcttttacatttcaaattgaaattagctattaa

SEQ ID NO: 9030 - DNA, 186 bp, Candida albicans
atatccattaaacacggcaatttatctagttcattgttttcaaatttgatgatgatgatgccgtttaatgtgaaactggcaaccctgcatacaggaaaagtagaagagaaagaaaataaggattatctaaacgatcttcatgctgaaagcaaaggaacaaaaaaattttatctttttcatcagtga

SEQ ID NO: 9031 - DNA, 297 bp, Candida albicans
atattctttttaacttatttttcaatcaagaaggtactgaagatatcaattaactctcagttaaatccatattaccagttgtggaataatcagaagaaaaaaaaaaaagagagaaaaatcacgggaattacgttctcaacagaaaataacaataatttttttttattcattccaaggtataacaagaacgttaggaataatataaaattatcaccaaagctgccatcaacgtgtgtcgacaaccaatcgactcctcccttaactagaaccatagaacctcaacatttgtttctatag

SEQ ID NO: 9032 - DNA, 231 bp, Candida albicans
tccaccccaaaaattgggattcaaaaaaatgttttgggaggcagagaagaggagggaggcaaagagaagtcaagagaagaatttggttatttcacttgtattctctctagatgtggtggtggtacatataccagcaaacacgagggaagaaagattaacttaaaaaagtgtataaatcttgatcttgatatggacatagaaacgaaaaaggataaacaacaaatgacataa

SEQ ID NO: 9033 - DNA, 255 bp, Candida albicans
attgttaacctacatacacatatccttattcaattgactatctcccgatctccaccaccccctcggataagccaagctaatttagttctgtctgtcgtcagtttgaacagatattataaattatattataacaaggacggacggaattattcaattgttgttcataactctaaccctccatcaacaacaatagtagtagtacttgcatttaccaaaaaaaaaaaaaacgttttattatttattatttattattaa

SEQ ID NO: 9034 - DNA, 1908 bp, Candida albicans
acatataatgtatgtgctaccagtaataaggataaatcgtcatcgtcaacaacattaccttcatcatcatcatatgaagagatttcttattattcattgaaattattgacatcaaatttatttatcaagaatttccaattttgtgtggggaaaatattagcatttttaaaaatgtttacccagattactcaaacatggctagaagaaaaagaagaagtcaatgatcaaagctcttgtgtgaaatatgaatctgaatgtttaaaagagtttttatgtataactttattgttgttattgaaaattaagaatagtgaagatgaaagtacccttgatgggaatgactcaataatatcttcagatagtgcatcaacaaatgccaccaccactactactgatggattgaaactaattgaagttgattatttatttcaaactttaagacaatatcatatgatgtcaataatgtctgaatttataaatacagaaataatggcaattgataaacataaatcaaaatttgtcattttaaaatttagctgtgatataatctttgaatatttctatcgagtagaaatattatctgatatacagttaagtgaattgatcaatgatagtaataacaacaagaatttgatatctacattggttcaatatttactacataatgaaaactttaataattatgatttatacgccgatgatttcaataatgaggataaattaatagcttatgaagaattgaaactattgttattaattaatgaacaatttttaatgaaatcttttaatactaacaataagaatttagtatttgatgaattaatgatggggaatataaccaatgggaatttaaataacattacagggtttattaatttgttaatttatcatttaaatcgagaagaatctcatattattaaaatattaatacttaaatttttatatctggtattcacatcatcctcaacatgtaaattgatatatttaaatgatttaaaaattcttattgatattttgttaagagaattgaatgatttggattataatgaaaatattgttttaacaatgacttatcttcgagtgttgtatccaattttgatgttttctgaactttgtgaaattaatgggaatagaaacaggaatggttatggacatggatataaaagtcaagaaattctagaaacactacggaatataattattaattcagaaataaaatcagttgaaacggaggaagaattgagtatttctaaattagcagttaaatgtatgaatgttaaatggctaaagaaactggtccaaaatcaggattccaaacaaggtatggttattccaagtacaaaatctactaccactaaatcactaccaactcaaaattccaacagtcctgaagaagaagacgaggaagatgagaaaatcaaattaaatgaagagattaatacttctaaggaatccttaaccaattcatttactagagttgcatccgttagagcatcttcaagaagtgattatcataaacatacaactgttcataatatagaaagaaaaaatagtatgaaatcgtcatcaaccaacagcaaaactaataattccaatgatcatgatgattcaaatgatatgataatggaaaataatgggaatatatttttatccaaattttctaaaatgtcaatcaatgataatagtaatcgtggtagccgacaacttacgaataatacatcaatgtcagattcattattgtataattcaagaaaaaacactcaatcagaacgtaccaacaacaacaacaacagcaatcaaaacaatcgtgacaatcataacattcttgatttacctacagaatatttaatttctaaaccattaccaaaattacctatccctgaaaaaaggcatcttcaccgcgcgtga

SEQ ID NO: 9035 - DNA, 498 bp, Candida albicans
gaattgatgcccaaaataattatacttttaatatcgcgtcattcaataacatccaatagcagtactagtaattctaaaaactctactttttggtcaattaatgcatatgttgatgaatcaaatgatttattaaccgtcgcaactcataacaaaaatgaatcttcaacatttgaaactgagagtactggatttgctattgaaaatggttatttatcctataagaattctactcactttttagcatgtccaacaagttcatcattaaccaccaccaatgataccattgttggtggtaatggtaataattttacaaacagtagtattaatggagatgctggatttgaaatttatgctaatccaaagggtaaaactacttgtccaaagggaattgaaggttatgatattaaattattgactgaattgattgtcacttattcatattcggaaaaattcaattctaatggatttttcaaaagacaactttccaaagatttataa

SEQ ID NO: 9036 - DNA, 327 bp, Candida albicans
agagttttcaagataatctatacgatgcgggaaagttacaagatttgttggatacttcagataataagaaattgtttggccattttacaaacccttgatcaaatagaactaatattcatgaaaaatgaaagacaattcaaaattgttttaaattgggaaattgtaattggtgatccactcactggtacatgtaattctcgaatacaattgtatataattgatattcttgataatactaccaaaaatctcagtcaagtatttgaaaatctactattacaatatgacatttccacatcattaacgacaatcatcaagactatattttga

SEQ ID NO: 9037 - DNA, 900 bp, Candida albicans
  unsure (754): Identity of nucleotide sequences at the above locations are unknown.
gctattgtctgtccagcggcgtcgttcgaatataattccaattgtgaagtccaaacactctcagatgtgttacagacatcatctccaagtaatcaatcatcaagacaattacaaagtacaggaggaggaaccgcagcattaaatttagctgaagccaaaattgtcacgcatgaagataaattaatacaattacaatcactcaaaatccaactttcagaacaacgagatcaattgatcaaatctcgaacatcatcaactaatgaattgaatgatttacgtttgagacatcatcaattaactcaagaattatccaaaaccagaaaggaaaccaatatcaaaaaccttcttgattccaatactagtcaatatattaagaatttggaagttaaaaacttgaaaaacgacgattatatcttgaataatttgaatgtgctaccttcaacagattgggatttgcgtttaacatatattaaaagatttgtaccttatttggaaattgacaaaattagaacttttaatgaatgtgatagtgaaggtagtatgataagaattattgaattccaattaattttaccattaatatttcagatcaattttaggttattggttaattgtgaaaatgatagtttaaaggggattgaaattgatgatttattcaaaatatcaatgatttcaaattcattttatcaaatggtgattaaaaattatatcccgaataagaaaatcagtacgttaatgtttggattgaattctntttctaaactattacataaacgaatgtcaacaatcaataaacttgtaaagagttttcaagataatctatacgatgcgggaaagttacaagatttgttggatacttcagataataagaaattgtttggccattttacaaacccttga

SEQ ID NO: 9038 - DNA, 639 bp, Candida albicans
agacaattattgtttttattaagtaatgccgttcatggagtaccatttttaactgatcaaaaaaatagttatttattggatttctttgtcaacaccaaaatacatccagcaaatcgagctaaacgattgctttggttattatatacacttttagaaacaaattttactgaaaccgatttgcataataatccatttggggctgattccattccatcgattcaatggttggatgattcggaaatgaaaaaatttgacattgatcctgattatgaaagatattatgctgaagaaatgtttaaagccagaatgcaatatttggcaaatcctgatgatgagcagtacaaggaacattctagaagatcccatgggtatggtcatttgaagaaaagagatgccgaagatcatgatgatacaagtggaggagaagaggttgatgatagaaagaaaaaatctgttcctttaaagaaaaaattgaaacgtaataatcctaataaaccttcaccattgtcaaagaatgttataacatttcatgataaacgtaatcgtgatatcaaaagtggcgacattttaaattttgatctcgaagttagtattcatttccccggtaaaagatttgaaagaattggcatcaagatataa

SEQ ID NO: 9039 - DNA, 660 bp, Candida albicans
attttgatctcgaagttagtattcatttccccggtaaaagatttgaaagaattggcatcaagatataaaagttctgatattatgaatcaatcacccaatgaacttgaatcagttaggcatcctcgtgacatagtggagttgtctaagccaatggttcaagaagttcgtacttcttcaaaagccagtactgcttcattccacaagaaaatcaccattttggggaactggttatatcgatatttcaaatataaaaaatccattggaaatcgattagtaggtatagaatgggaagacattagatatgatttggttcatggtgtagagagttatttatatgaaaaatttggcaaatcattgattttggataagatgttgtctacacattatactggagctgaaggaaccaatggttctgataaaaatggagtggttgctaatggaggaaatactactggtagatttgaagaagaagaaaatgaggtttatttcgattatgtaccactgagagattatgacaaggccaacgagaaacaaagttttattctacatttgattagctttgtcaatgactggtttatattaagattaagaaagaatgcttctttaactcaagttaacagaatactgattgatctcgataatgagactgttcatatgtaa

SEQ ID NO: 9040 - DNA, 336 bp, Candida albicans
attgggtggtacatattcaaggatttggaggtaattgttttcactgcacttcatgttgctaaaaaccttgatactcattttgacaaggtacacatctcagtgaatgatttaccagaagaaatccccgatccagttatgtatgacttttttataaattatctcccagcatcaattcaggagtcagaaggtgttaaagaagaagctaaagctgaggtcaaattgttaaccgatgctgctcactctattcgtgttttgccaatggtgaggaaatttggaagtcaaaagtccgagtttgacttagattggattgctgatggtatgtggtgttggggttag

SEQ ID NO: 9041 - DNA, 522 bp, Candida albicans
atgacaccacaatttcccccccttttcctttaccctttattttatttccatttagtttattcctttttttatttcattatgatatctactttatcatcttcatcttcttcaccactaacaacttcaactcataagttggaaaatccaatagaatcacaaagaaaacgatataaacataatatgcaatccatgtcatccaatactcatcatccacattttcaattgtctaaagacaatgaaaacaacaacaaccaccaccatcaacatcaacaacaacatgaaccaaaatatataagtactggaacatctttacataacactaataatggaacctttaccccaatcactcaaacccattctcatgaatatcttatgatgatgggtgaagaaaccatcatcaataacaataataataaacttgacatagaaatgattactgaagataaatttttccaacctcaacaacatattgaaaaacctaaatatgaagtcttcaccacgcgggcgaaggaccgaacttag

SEQ ID NO: 9042 - DNA, 240 bp, Candida albicans
gtgaagaaaaatgtattcctccagatacttcttcttctctgccgccttagatgtctgcaaaaagaaaaaaaaaaggttgacatgaaagaaaagaaaaaaacagcacagaaaaatcctctctgcattttaaaccaaggacaaaaaaaaaaaaaactcacacctgtggctcaattttcattaaccaaaattgattacttgatacaccactcaattgttattatatataacgcccaggcataa

SEQ ID NO: 9043 - DNA, 186 bp, Candida albicans
actagaccaataaaagacctgtcttctgagtgtgggtggtggagcatgcgtgagtgtgtgtatcaaccagaaagagaaacaaaaaaagaacaacaacaacaagtaacaaaaactcaatcagacaatttgtattacttaaatgagaaacagaaggaaaaaaagttgaaatataaaccaattagatag

SEQ ID NO: 9044 - DNA, 204 bp, Candida albicans
aaaattaacagaactttttttttcagtattggcagagtcagcgagagctgtagaaagtgtttcaatatgcaggctctagtaaagtatagcaccttcgcactcgtcattactaacaaaaaaacaaaattgcttaatgtgcgaggtgcaagtgaatcaaataaaccagtcacgtgtataaaaattgttttagggctacagccctaa

SEQ ID NO: 9045 - DNA, 192 bp, Candida albicans
tttttccttgttttgggggcagaggaatttcttgagtttcacgatttatctaccggcacggaccaagaaaaaatccaaaaattaggattcagttcatctccgccaggggaattgagattacaaggggcatttcgtatacttaacacctggcccaatgtggttttacattgccttaacttaaatgtacattaa

SEQ ID NO: 9046 - DNA, 216 bp, Candida albicans
gacaagaaaattagacagggcataattatagcgcaaactttagtttctttttttgttttagtcggtgctcaaaaaagttttaattgtatcttgtgtgtttgttgtccttgttttagttcatctgattggttgatttatgatcttgctttgcaaaaaagaataactggaggaagtgtgaaaaatcttgaacttacatctgtcataaagaagagctag

SEQ ID NO: 9047 - DNA, 186 bp, Candida albicans
aatttttcacaaaaaatatgtgctaccagttgtattgttcaattagtattagttattattgttcaatactcaatcaacaagaatactaaatctaacttaatcggtttattcatatttatttggttagttggtgttatgcctaaattgctgcttataccactcttggttaacacactactattatga

SEQ ID NO: 9048 - DNA, 477 bp, Candida albicans
acactgtttcaaagaccaactgtccaagctctggtattaaattccctccaaaaaggtaattctggtgctaatactttaactacaaaaacaactggaactactacttctggttctggatctacttcagttccagctacatcttatatcaacttgactggaaaatcaggttgtctcatctcaaatggtaaatactatacttctggaacttgtgcaacctatcattttaacactggttcttccggtaatacccaaatcacttcgtctaaaggtaattgtggaattgattctagtaaccagtttacttgtagctcttcaactagtgcaactgatttccaagtatcgggtggtagtatcggatacaatggtaactttgattggtgcttgggtgctgtcactggatctggatcaactgcccagacaagtgttaaattgtctgatggttcatgtagttctttcaaattaacactttcatcttag

SEQ ID NO: 9049 - DNA, 237 bp, Candida albicans
caaagtataaaaatgagaatttacttgggaaaggagctcaagcaaatacacctagagttactcaaattgttcacatattggaaaggtcagaaaaaattacaagctcaagaagtcgaagaagaggatgatgatcctggtgttatggaaacttccaaaaaaccattttacgaagtttggaaaaaatgtttcctccaacaacttgaagcccccttaatcccgattttaaccagaatttga

SEQ ID NO: 9050 - DNA, 246 bp, Candida albicans
aataaaaatgcgtgtctcaacaaactttttttttcaacgaaaaaaaaaaaccagctaaaacacaacaactctttttccctaccaaccatgtccgatgaagagatagatgatttgtttggggaagaaactaccgaaaagatagttgatttgtcgttaccgcgccatgcagttgtgctggttatggaaaaggatgtgagggtttttgaagacaccagactttttaaacatcgaagcacacccatttga

SEQ ID NO: 9051 - DNA, 192 bp, Candida albicans
aattcaatgatgctactgggtttagcttgttatatttttagcctacgtactatgtatgtgagagtaattgtttgtatttttacattgaagttttttttttcgcgtctttacagtttcctaattaggacacgttacgtaagctcaacattttggctgcaattttatgggcgtgtaattatttacaatttgtaa

SEQ ID NO: 9052 - DNA, 201 bp, Candida albicans
cccaatattgaagaagagctattattgtttattatttgtctatttgtagaatttatgagatttaattcttatgccgcaaaattgaaaaaaaaaactaaaattgcacataaatcttggccgatccgaaaaaaaaattatttacgtgaccccccaaaaaaaagctacgcaggcgaatcatacaaaccatgcccaaaaatataa

SEQ ID NO: 9053 - DNA, 195 bp, Candida albicans
  unsure (26),(37),(38),(40),(136),(141): Identity of nucleotide sequences at the above locations are unknown.
ttgaattgtaaaatgtatgaaaattntatcgcgtttnncnagtattatagttttggcaatacgtcagccaaaaaaaaaaaaatgagtatatattttgggtcgtgtgtggaaattaaatgtcgtttcgatgggcccnccaancggaataacacgctaatccttaattatttgccttccttgttaatacacacctaa

SEQ ID NO: 9054 - DNA, 558 bp, Candida albicans
actatttgcatttacatttactttcttagaaaacaaacgacacacgtttttcttatctcatcaccctcccatcaccttaacagttctactcagccacccctattttttactagtactttttggaatatgtttcaacatttaaatatcattgctactactcaacaactacaacataatactccaacaatgttactttctcaatatcagacttatcaattatttattaatcaattaatatcgatttttgcatcatttgaatcattattatgtaaagttagtaatcgaattatatttattatttggttcccaataattttgtttttcatatttgatattgttagttgcttaagtgtgaaattattattaaattataatcttcttgataatggtggtgccacaacagcaactcatcacgcatctaatggctgcgggtgtggatactcatacgggcactttcatagaattctaataatcccaacaaatcaattaaaggaagttcaattcttattcaaagtcaaagtcttcttccatttatatttggaatattacttttacaat

SEQ ID NO: 9055 - DNA, 324 bp, Candida albicans
acagcttatgatgtaaaaattggctataaatctctctctcttcagggaatgattttttttttcttagtgttgttttcttatgatgtgaatattatatgtatacagtacactattatatattattacttattgtttgttataaagacaatagaacaatacaacagaaaacctaagaaaattccagacccaaccaaaccagccccagccagcccaaccgatcaactgccactaccacgtcttcttctgtttccatccctgtcttcaaatttaacgagaatgagaccacttaaagaatgtaattatgtacaggaacaagaaaattaa

SEQ ID NO: 9056 - DNA, 279 bp, Candida albicans
agattcggaaatactcaaaagaatatcgtcaatgttagacattttgaaggtgatattagtatatctgttgcaataaaatttgggaggaaagaaagaaggaaaaaaagtagaattggaaattgcattgataagttgggctcccttttttctttatatacgttttggacgaaattgtggcgatcgcggaattatttccccctattgtttgcgactaaacgttcaaaaagtagtttgggtgctggtcaaaattctatttatcgtgccgtgcatacgaattga

SEQ ID NO: 9057 - DNA, 186 bp, Candida albicans
tattcacatcataagaaaacaacactaagaaaaaaaaaatcattccctgaagagagagagatttatagccaatttttacatcataagctgtttaaattagtttttttctttatttttaaaaccaccattcaatcaatccaatcaatcaattcaaataacatcccaatagtaatcctgattaaactt

SEQ ID NO: 9058 - DNA, 219 bp, Candida albicans
aattatatattaataatcattgagtcaatattgtttttgaagtatctttgtttgacagttttttattttttacatattagtaatactagatcaatttcagccatatatacttcccacacccctgttcaagatattcgaagcgcttcttataatagtcataagtcaatttccattataagcctagtctaccaattaccaattcattcacattcatactag

SEQ ID NO: 9059 - DNA, 279 bp, Candida albicans
actcaaaccaaaaaaaataaaggttttttttcttcagtattattcatttcagttaattctaactctaattggttctatgggttggcaatttatttagattcattacacaaattacacaacatacaacaatcaacggcgaaaatgttaatttatttacttacatacaacagcgagaatgtaatatgcgatttttactatgtacagttattattagtcctgattaatatggacaagtttcatttggttttcacaagccgtggcaggtccatgtcaagggag

SEQ ID NO: 9060 - DNA, 264 bp, Candida albicans
gaacaggagttttactcatttaaggaaactggtatactttcaaataatttaacaaaagacaaattaatgaaagtattatataatgatattatttattggacgaagaataataatatcgaccagaaaagcgatagaattagtgaagaaaggacgagagagcagggaagagcgacattttattatttggatattccaaagaaactgaaaatggcaaatcggtgccttttaaattttcaaaatgggcttgtggtggtgaatgattag

SEQ ID NO: 9061 - DNA, 402 bp, Candida albicans
cacccaatcaaaatgaaatttactacaattgctgctgctgcctttattgcttgttccgttgaagctacttttctcccacttttgaagcttggtggaggttggaaaggtggtaacaatgaacctccatgtgataccccagctcctccacctccaccaccaccaccagctcaaactactccatgtgatacacctccagctccaccagcaccaaccaccccttgtgacactcctccagctgaaactaccccatgtgacactcccccagctcaaccaactccatgtgaaaccgaaggcggttcacgcggtaatggtggttccggaggctacggtggtggtggtattattggtagtatcattggtaaaaaagtcaaatttattgaaggtttattgggtggccattaa

SEQ ID NO: 9062 - DNA, 186 bp, Candida albicans
attatgtgggctttcagctctttggtaacctatgggaatggcaccgataatgattcagacaatgactctgataatgattctggtgacaattcagatgatgactgtgatgacggaaatggaacagacaatgactcagacaatgactctgataatgattctggtgacaactcggatgacgattgttaa

SEQ ID NO: 9063 - DNA, 333 bp, Candida albicans
tggaagaggaagaaacggatgaaaattgaaaaatcttttgatagggatgaaatgagaaaccacattagtaactgtggtcaatttgattgggatactgaatctggagagacaacaagggaagataatccaaatgtaactaatttattgaaacacccagaaaataaagagttaacagttaaagatcatgccgctccaatgtcagaatacaactacataaatgagagtttgattttattttcttccaatatagtgaataagttgaaagatattgagtacaatgtcgttgaaaaacggaatgaataccaaaaaagaattggatttggagttttctag

SEQ ID NO: 9064 - DNA, 201 bp, Candida albicans
aattttcacggatattgtcaaaaccttggggactcaatgtctgatcatataaataatcactttatgaaatttcaggagtgtgtattggatccggtgtatcctgacgtcggtcaaaatggttctggtattatggaaggatttaaacttaaggctgaagggggcacagattgtgattcaagaggggatagatccgaaatatga

SEQ ID NO: 9065 - DNA, 252 bp, Candida albicans
tgtgagagtcaaagagagagagagagaggaaagggtagtgcaaaattcacaaaaattgtgaatttactaagctgtaattatttaatatatcaaaggtcaccccagatattgtacagagggattgtattggttaggtattatttgatttctatttacaagaaaaaaatgatgcccaatgattattctttattggttttagtgccggtatctttggtttcctcttctggtaatccagttgacagctttcaatag

SEQ ID NO: 9066 - DNA, 192 bp, Candida albicans
tgctctacggctgttgaaaactggccattgcggcaacaaacaatttataccttttctccacattatgaaatcactatgaaagctgttgaagaaaacattaaaaaacgaaaaaaaaaaggcattttcaacttgtcatctagtttcttttattcttcggttttagtattttattttattttgttttctttataa

SEQ ID NO: 9067 - DNA, 198 bp, Candida albicans
agctcacactgcaaattggaattcttggagagtattgaacaactaaaatgtattaagaagtattatttaaagttggaagaagagacgaaagaaactattgaaagctgtcaactggattaccagaagaggaaaccaaagataccggcactaaaaccaataaagaataatcattgggcatcatttttttcttgtaaatag

SEQ ID NO: 9068 - DNA, 294 bp, Candida albicans
tgtacttgtttgttttccactccaaacattctcggtaatgatggtcccgttagatcgatatctaaaactccaacattaaaccccttattgactaatgttaatgcaacttgtgtcgtaactgaagattttccaacaccgcctttaccagacaaaattaaaataatatgtttgacatgttctatggatttggggacttcctgtaacaattccgacgacatgtcagtgaagaataatattagtaataatacaatagaatatattaatcgagaaatgggcaggaaggcaaaccgatga

SEQ ID NO: 9069 - DNA, 189 bp, Candida albicans
ggtcgtgttagaagctcactactttataggcattccttagtgtttagttatatattttttaaacctaacaattatacttttttttttgtctcaactctaatgttatctattattgaacagtgttgtttcttttactcaatacttatgagacttgacaccgtttatttagatagagataatttacaatga

SEQ ID NO: 9070 - DNA, 339 bp, Candida albicans
cccgtattcatgtccgaattagaccagttagatgtcaagttagtcgaccaggatgaactagaaacgtctataaccaataaagcaaacaaggttttgctactgaaagatgcagagttagatgaaaagagattgtcaaaggcgataaaagagttggagtcaacacaaaggcaaattgcaaatctatcggcaagactagcacacccgagaactaaaataagtgaaaagaaacgattaaaagacgaaattcactggtatgaagagaatgaattgattcctagacaacaagatgttgatgatatccgaaatacattgaaagaaaacattcttaaccagccgtag

SEQ ID NO: 9071 - DNA, 186 bp, Candida albicans
ctacgccctgggaccacaaatgagacctcaaaggatgccatgagccactaccatttaagaagagtccttgaattattgtcctgttatgggtttgttcaatacatcgattatttccaatgcgattatacaaaagagaataatcagagatcaggaaatagtatacgtgatttaattcaatacttataa

SEQ ID NO: 9072 - DNA, 264 bp, Candida albicans
cgacagattaaaccgacaataaagaatctaattatatctaatgattcaataactacatcatatgaaccaatgtcatatactattagttttaataaagataattccaatagtttgaacaatgcaaaaaccaagaaacaacaacaaaaaaccgacaagactattaaaactggaaaagaaaacaccaccatcactaccactactactgttgttggtggtggtagtggtggcggtaaaaaatttataccggatgataatttcactaat

SEQ ID NO: 9073 - DNA, 222 bp, Candida albicans
ttttgtgtctgtcgtgctgtccgtacaactttacctgtgaaaattgattttttttttcttctggtgaggattttttgtcgttctttgttaaacttcttatttgtcccactagatggagagcaaaaaaaaaagtctgacttttactctcaaccaatcaattctacagaatctgaaccagagagagggagaaaaaaaaaagctctcaacgggtcatgggtttag

SEQ ID NO: 9074 - DNA, 189 bp, Candida albicans
caagacaagattagatggacaacatttggaacactgcccattaaaataagttatttctctgtacagtcattacaaaaaagaaaaactgcagtacacttcattgattaccacggattcatttttctcacttcgtttttttttgatgaaaaaacaatagatttgagacaaacaaagaaaatacacgggtaa

SEQ ID NO: 9075 - DNA, 216 bp, Candida albicans
aaaaacaatagatttgagacaaacaaagaaaatacacgggtaaaaaccatattatataatgcatatggattgtctcaaatgtggatttctttttcttgggtcaattgtatctacaaatatggagagtttggggtaagaataaactccgaacccaagactattaccacaattaatacttttaaagacaaaaaaaaaatcatccaacaattgcattaa

SEQ ID NO: 9076 - DNA, 192 bp, Candida albicans
caagtaagaaagtgtggctggaattacaagtccgtgtatggtagcacaattggcaatattagggtaggttttcataaagcaaaatgtggaatagttttggatgatcaacagcacgtgactactgttaaccagatggctgttgagaaggcaccaagagagtacaacagttctctattagaaaccaatttctaa

SEQ ID NO: 9077 - DNA, 495 bp, Candida albicans
agaatttctactcagccagcttctaccacgagtatgcaacagtcacagagtttacaaacttcacagcagtctctacaatcacaacagtcacaacaatcacaacaatcagaacaatcacaaccgtcacaatcaccaacttcgacaagtcaagcaccagtgtcaacaatgtcagataataatacctcatttgtttcaccaagtgatacaagcttactggtttctgcaacaacaacatcttcaagttccacttcatcaagctcatcatctctgacacctagcaccagcgacgtaacaacaagtagtagtgctagtagcagcacaagctcaaccacatcttcaagttcatcgacagcgttttccagttccactacagaaacttcgtcatcaggcaccagttctagctccacaacatcttccagtatactgtctactcaactgaatacttcactgtcgtcaaatacttcatttgcaagttcaacaacagccagtagtagt

SEQ ID NO: 9078 - DNA, 285 bp, Candida albicans
gtagacagtatactggaagatgttgtggagctagaactggtgcctgatgacgaagtttctgtagtggaactggaaaacgctgtcgatgaacttgaagatgtggttgagcttgtgctgctactagcactactacttgttgttacgtcgctggtgctaggtgtcagagatgatgagcttgatgaagtggaacttgaagatgttgttgttgcagaaaccagtaagcttgtatcacttggtgaaacaaatgaggtattattatctgacattgttgacactggtgcttga

SEQ ID NO: 9079 - DNA, 1170 bp, Candida albicans
ttcgaagttttggagataagttttatacaggggaaaatattcactaatgatgcattaccaattgaattatcaattcaagaaataatcatttatttaactaatcaattttctgatcaaaataataataataataataataataataataataataataaccataaacctaatattaataaattaatttcattatatgagaaattccgatttagtaatcaattaataaatcaacgagaattgattgaatttatgattgaatttgataaatttggtcaaatgtgtcaaaatgattatcaaatcaaatttccaagatcaataagtcatagtcgtaataatagtactaataaattaagaaaattgagtagattaggtggtaaatttagtggatttgacttatctgattatagtagtgcagcattatttgatgatgatgatgatgaagaagaagaagaagaggaaggtgtggattataatcaagaatataatagtgaatatgatgatgattataaagaagaagaagattatgatgacaacagttcatctaataataatccatttcaacattataaagttgaaagtaaatattttgaaaaggcagtaacaaatagtgatgataatgataacaataatgataatttggaaaattcttcttcattgaatattagaggattacatcatcaaagtagttttagtagtacgaaatcagtgattagaaataagttggcattaggtaatcgtccatcattattgaaatatgattctcacaccagtggtaatactagaaataaaaagcaacgtcaaaaacgaaatgaagtgggaaataattctgatgataatgatgatgatgaatattatcaattgctgagaaaacaaagtggatatattactgattctgaaaatgaaggttatgaattgaattctataaataatgaagaagaagaagaagaagaagacgaagaagaagaagaagaagaagaagaaggctatgatcaagatgatcaagatgatgatgacgaagaacaattttatcaatttagaagaggacaaagaactgtaccggaaattactataaatcaagaacttaatcagcaacaagaaagaagatcaagtaatgctgatagcatcaaacatttatctcctacaagcagtatcaaaaggtatttcaattaa

SEQ ID NO: 9080 - DNA, 198 bp, Candida albicans
agaccaaatatgaatagaaatgtgtttccaataaccaagcaaagtaatggggatctcattaatcaaatcaatgaaagtattaattgtggtggtagtggaattgttggcgaaggaacgttattaccacctaatattcattatgaagatgtaattcgaagttttggagataagttttatacaggggaaaatattcactaa

SEQ ID NO: 9081 - DNA, 255 bp, Candida albicans
catcaaacatttatctcctacaagcagtatcaaaaggtatttcaattaatagagttattttgtgttctctttactaatggtaatgatagtcacaagcaaataacattagtatttaattgtagggttaaaaataataatatttatttaattttgtctaggttttgtaattccatcatgaataaaataataaacaatagtgccatcatcattaatcatggcaataattttttcaacgcgccgggcaaggaacacgta

SEQ ID NO: 9082 - DNA, 204 bp, Candida albicans
ccaaaaaaaaaggaatccaaatgtagtacaaaagctgcaaatgttaaacgggttaaatgcattaaatgggacaaaaccaacttacacaaaataaaagcaaaaaatttaaaaatgcagaaacctaaaattaaccacaaaaccaaaaaaaatggaaatagaagaatgaacactttttgtgtgatattaagaaaggatcctttttag

SEQ ID NO: 9083 - DNA, 219 bp, Candida albicans
tcacaacaacttttgatattaacaagatcaacagatagagaagggagtagagttaaaagtggttgtaaaccaattttattacatgtttgtgtgttgtctaactattgtttaactaagatttcaatcttgaatctaaaacctaaatctctaaactatagatgtaaacaaaatcttaaattcacaattttattacaatataaattatatagaaacaattaa

SEQ ID NO: 9084 - DNA, 1671 bp, Candida albicans
gtcacttctgaaacttcatttgataaggttcaacaattcaccgaaatgtccaatttattattgcagtttgttttgaatatattaccgcaagagaatacgttcgagaatttaagtttaaccatatttatattccataactttcttgtcagtttgaagaaattacaagattcattggagatatccggaatggactctaaatttattcagttgatttcacaaacaagcttattatttgatttattaacaaaagttagttcctttatgaactctttgtatttgaggcatgtttcctatttaactgaagaaagtggattgtctctgattattcgaaagaaattagaattagacacacataataaggaagtatttcaattgtttacaccagagtttgtcaatttgatggaccatgatattgacaaatacataaatattatttctaaatatcaagagtcacaaaccactggcgatgcaataagttccttaaatgcatggtttgacaaatgtggaaaataccttaaaattgttaaacctgactctaagaatatttcaatttccaaactagacgtatacaaatgtatacctcatttacatacgacactttccaacatatcatggggggaatttgcattgaaaaatatagatgaggaatttgcacatctatcgactaccatgggtgatttgctttggcagcagattacacaatttgttgattttatgtccaatgctcatgctgaattgaaatcaccagaaaaattagtttatgttatcggaattatcaatcaacttaaagtaaaaatttccagtttggaaatccccacaactaccgccactgatgataccaaagaaattgtcaacaaattgagcaatctgttatttagtaaattgattgagtcagtaccaagtgatgatttctatttgttggttgatgaatcaatacaggaaagtgtcactattgaaacagtcgatataccagttagaccaaccttaaaacttgtacgagccctttacaaattatcgagtaattatttgagcgttgctcaaaactccaataattcaaatattttcctcgaggctcaagtgactgaggattttattaaatgtaaaaacaaatgggttgaaaaaaacttgattggagaagtatttttaaacggaattgaaaagagcattaaaaagaaaaaagaaaaatcactcaaaagtactgctgtcgatggaaaggaatcaccagacagagctttggaaaaggaaacaacacaatctgatagtgctaaaataaaaacaaaggaagaaaatgaagcagaacaaactaccaaggagaaatcagaaaaagaatcaaaagaaaagacagaggatgacggagttattaaaacagacgaagctaatgtaaacagtttagatcaagccgaagaaaaaattgacgaaccacaatcggaatctaaagagaaagaaccagaactgaatgaagaagatgatgacaacggaaaaaccgagattgttaatggaaccacatcaataactaaaactcaagcattaagcataatagctaactatacattcctcttgcactttcttaactcaaaagttgatcttgaggacattgaaagtgtaactcagttaattaaaacccattatcgagcagtcttcacctcggagctcgacaaatccgcgctatag

SEQ ID NO: 9085 - DNA, 192 bp, Candida albicans
aagatatttggtgatattatgttgccagcagcatacatcacaaaccaaattccattagctatagtttttttcgaagaccctgacacattggcattcgatagaatccaacacaagataactggacccccaataataaactgcaagaatgaacatccaactagagcccatctatgcgttaatggtatgacatga

SEQ ID NO: 9086 - DNA, 279 bp, Candida albicans
aggccaataagaccgggtaaaggagggatacaaatgacaaataatactatgcaacgcatgttcttgacagtaaagacaacaataccagctgctacaacgacaactaattccacagcaccaagaggcatttgtaatgcggtggcctggattcccgtaaacccaaatcctttaattaatgaagaggcaaaatttgatgtgccaccattgataactccacatgcaagacctattaaggcaacaaaatatacaaacaaatcttgtaatgcttcaactgcttga

SEQ ID NO: 9087 - DNA, 561 bp, Candida albicans
ttcccgctggtgagccatctgcatatgtcggccaatttgaaccaagtatctctgcaacaaaaaattgccagtcagataaacttgaatgagttattaagagatcttaatgggacaccttcatctactacagattttattaatcaatataacaatttcaaagttcccgatactttaatatccacaaactcaaatccaataactcaacaccaagcggatgacgaagaagaagatgtaatagacaatgaagaagatgatgcagaagatgatcaagaccagttcttttccattgtgcctcaaaatcaacatggccataaatttgccaatcttcaagcccctcaaccagtttctaatacaggctccaacacgttaaataatggcccagttacaacggcaacaccaagtggggcaattggtggtggtggcaacaatactggtagtttcctttcattattcaatgctactaattttgtggatgatcaaacagatggtaataatggtgctactggtgttggcagcagctttttcaatttgtatcaattgaataatttgcccgaaaagtga

SEQ ID NO: 9088 - DNA, 321 bp, Candida albicans
acgttgatctccacgtctgttgaagacgacgataatgtgtcgatcaaatttcatcgcgaaggttcttcatcagagatagtgttgaattttcccaaaattttttggacatcttcagatgtagccccagctaagactaaccaagggggggccactggtttgatttacggaagtctaactgccaacaagagtgatttctacgtgttatcaactccgaattcaaaaatccctcaagatctagctatcactatcaattgcctaacgaatttgaaccactctaaaactactccccgctgtaatcaccacaacaagtcaaccatctag

SEQ ID NO: 9089 - DNA, 732 bp, Candida albicans
aaaaaaggaacacttttcgttaacctcgcaatgattgttgaagtacactcagacgtgttgttacacgtatccgatttatttgcacgaggagtagaaaacaaacttggattgttattaggatatggtttagatgatagattggttgtggtgaaacccattgaacttgcacaagtggacccgcagtatttggagaaacgatatagtttgtttaaagacgtttaccccaatctttccattgtgggtgtctatgaaattggagggaacaatccggatagagctaatatcttagatatcccagctggtcgcatactttatgtatcagttgatcacaacatccaattcaagagttttatcgatggagatttggtaaaaacagtgattgaatctagtgaaacagaggtcatagcaaccaaaactattgatacaaacaaggagtacaccaaggggagacccaaagacgagttgacagttgccgaatttaatcagaatatggtgaacacattaacaaagttgtatgagaggttgactaagatattggaaactaagggtatggataaagaaattgttgagattgccaacgcattgcgttgttacaaacatgtcaaacaatcgacagacatgaaattgcaagctgcagagttggcattaattacggaacagattgttgaattggaaaggacaaaaataggaattgctaaaaagatactagttaaagagccgggtcttgtgtag

SEQ ID NO: 9090 - DNA, 183 bp, Candida albicans
  unsure (76),(85),(121): Identity of nucleotide sequences at the above locations are unknown.
aaacgtttttattcggatttcaagttagtcaatatccaagtcgttctgtcgggtaagttggttaatttgtcggagntaatttctnaacgtcccagtttcgagtttttccaattattttgtntagtctcgaagatggtcgtaaattttagcaatcaaaataacttgttctctataactatttaa

SEQ ID NO: 9091 - DNA, 489 bp, Candida albicans
cttgttctctataactatttaattattcaaacaaagatgggttggttttcatttagtagcagcaacaaggattcttctgtatcaactgtttctcttccttcacaacaaattgaacaacgttctcatcaatcattaaacttacctcaaggttcagatattgccacaacattaaatcaattgtcttcacaaaccggaaatgatcaagaagttaaagtgaaagaaattgataatatccaagataagaatgaaattgaaaaaaccgtagagagttttgttgaaagttatccaatttctaatatgtttgttattgatggagaaaaagattctacacagagtattatatgtactacgactgatagtgggaaaacgtgtttgaaattaaaaatgaattcaattcaattatttaaaatcatgcaaaagcaggagtacttttgttctttgcctgatgatattaatgctacatattttgagtgtcgaaaaattaaatga

SEQ ID NO: 9092 - DNA, 309 bp, Candida albicans
caaatcatgacaattctaagcactgatgtggatcttttttccgaagcagcaaaacttccatctgaagttattactataattgttgatcatttacccaagtgtattttaccagagttattgcattttccaccgattagaagggaaatcgcatctacaattctatcagatgtatacattaccgaaaatgttcaaagacacaagggtagtgacgagctacttgttggacattccctgtgcgattgtagccacttcaaaatcaaactcattaagttgaaacaaggctcttcaccacggaatggagatacgcgt

SEQ ID NO: 9093 - DNA, 228 bp, Candida albicans
atcatgcccccaaaaccattagttccacgtacacttcatatccctggtgttaaacgcaatggtgatttactctattatatcggcgataatggtataacatttcatcctaatctaaccatagaccgtagtttgttgggtgggatcggattgttctttaaccctggtgagggtggtggaaatgaatccacccagactcctcaaggtacaattgtgaacagtaatgtctaa

SEQ ID NO: 9094 - DNA, 942 bp, Candida albicans
aggtccaatgtgcaaatgatggccaacgaaaaatttgaggttacaattagttatgaccctgaagataatatcaaggaatttttatacacgtatggattttttcctaaaatagtcaacaataacattggtgtcagtgccaattttaatgaaaatgataatatccaattatttgaattgaaattaaacaatttggaccgttatattcctaagagtcagtacttgtgtaggtggttgaaagtcttaccccaaattcaattggttatcaagtatgcttcttctgatactgttgataatgcaaacagcaacaatgagtccaacatgagagtttatttcaactttttctccaataatttaccattgttgtttattcccgagatagcttataatgcaggttggttggatgttttaatacctcatttcattaaatataataatatccctccaaattgtcgtactaatattgatgcactagagttggttaatatgtttatatatcaagaaaagcattgtgattatattaatggtattgatccaattggggttaaattgactacgactgatgatgataatgttggttccagtcgaaaagcgccagttttgttatctgatttatccaatattttacaagtgacaaactctgatttcgaagacttgataaaaaaaacacttgagttcattgttactgtttatttaaatgaacaagtggaacatttaaaggatcagttggacttaaagaaaaagcttgtcatgtgtggactcgctaataactttgatgaattggttgataaatatcagagatttaaatttagagtatttcagcaaattatcaagcaatacaaagaggatctttcaagcttgattttacctgaaagtatcgccaaaagggcatgggagactaaatatcgaacaccaccccgagaatttatttttgaatgtacttga

SEQ ID NO: 9095 - DNA, 282 bp, Candida albicans
ttagttggatctataataataatgaaaaggagttatactagtaatggtggtggtgaagcagcaggagcagggcaagttgaggaaatgtgggactttttgatagaaattgttcaaatcatgttggcagtgattaattcaatgatttatcatttgatttggggattaattgtttctcgaatgtatgtatttttcatatttggtacattgataacagtttttgaaccatgggaaagattaattggtcccataatatcagttataaatacaaataatgtctattaa

SEQ ID NO: 9096 - DNA, 336 bp, Candida albicans
  unsure (295),(310): Identity of nucleotide sequences at the above locations are unknown.
aagttggacgagctccaaaacgttctacacaagctacaaagccgccagttaaaagtgatacctcctccagtgatgatagcagtgatgatggtagtgaaggtagtagtgatgatagcagtaaaggtagtagtgatgatagtagttctggtgacagctccagcgacagcagctccagtgacagcagctcaagtgaggaaagttccagcgatgaaagtagttagatttataatgcatgttaacttaattaggcaaagagtacacctagatgtggcgcttttcattatctattattcanatgacctgtcttcanccaccgggctggaaggaaccgagctt

SEQ ID NO: 9097 - DNA, 2100 bp, Candida albicans
  unsure (1460),(2095): Identity of nucleotide sequences at the above locations are unknown.
agacaattgcttaatgactcgtttgctggaaagatcaagaggtctaagtatactccgcatacaagtgctaatgcatcgatagttaatggcacgggttctctgtcgaacaatacaccccaatcaaacacgccagtaccaaaagacaaccctgttaataaccccaacgtcccaacgactagtgttgacaattcccatcaaacaggtaaacttggcatgttgaaatcgttgatagatttacacccaccgacctcaactaaacctattgctagtggatttagtttttccttgccaaaaaatacaaagttgtctagaaatttcgatggcagtgatgaaagttctgaagaaagcacatcgagtattacaagtgatgatggagaccaatctgaaactgtgacgaccacatcaagaattgatgatattgattctctggaaaaacgtggtgcttccaaccaaacccaaccaagcgaaccaaatgtacgccgagtctctgaaacatctgatgctccaaataataatgtgtcagtgaatgttaatgagactcaaatgggtcctgaaaaggaacatgaacctttacctgaaggtaaaactgaagtttatggtgaaggagaagttgaaattacagaaaaaactgaaactgaaactgaaactgaagtcaatgctgaagataaaatggaggttgaatctgagcaagttgaatcggaagatgaagttgaagctgacgacgagtcggaaagtgaatctgaaagtgaatctgaaagtgagtctgaaagtgattcaggaagcgaatatgttgatgaatcctcagaaatttcttcgttcaagaacgaaaggagagccattcggaatgttcgtagaccacctgctataatttcagatagctcagcttcgagcagtgacgaagaagttgtcgataacccgagagcccctgttatagatacagatgactcgtcttcgaacagtgatgaggaagttgtcgatgtcccaaaagcatccacaaaggtctcggatgattcgtcttctaacagtaatgaggaaattgctagtaaccttacaaaaaagtctgatggttcatcttctggtagtgatgaagaaattgttgataagccacaatcccctacaagggtgtccgatcactcatcttctggtagtgatggagaaattgttgataacccagaaacacctgctatggatatagatgactcttcttctggcagtgatgaagaaatttttgataagccacaatcccctaaaagggtgtcagatcaagcatcttcgagcagcaaccaagaaattgtcgataacccagaaaccgctacaaaaatttcagaatcttctagtagtgaagaagaaattgccaataatccagaaactcctactatggatatagatgaatcatcttctagtagtggtgaagaaatggctagtaacacaagcaaagtgtcggacggctcggcttctantaatgataaagaagttgccaataaccctacaaaggtatcagatggtttggcttctagtaatgacgaagaaatttccaataatccagaaacccttacaaaggtttcagaagactcatcttctagcagtgatgaggaagccagcgactctgctgttatgttagatggcacatcttctggtagtgacaccgaaagttccactaacccagaaacacctcctaaattgaatcagaagcaaccaattgcaaacgctggtggtgataagaatgtttcaaacaagtcagaaattatggttgcaccgttgccaatagcaactccacgtgtgcaaggtttggcgttgactccaactgcaagtacaagacgtgctaaaatggttttgagtaaagaatttgttctggatagtgatgatatcacagatgacggatcaaatgccaatgatggtatcgagaaggataaagatgatgtaaatttgaaatccattcctgtcaagaaggctaatgatccaactgtgtctatgtctgaaaaagtgccacaaccagatagtaaggatagtctgagtgaatcaagtgacgattctgagtccagtgaatctgggtcaggatctgattctagtgagtcaagtgacgattctgattccnagtga

SEQ ID NO: 9098 - DNA, 726 bp, Candida albicans
  unsure (81): Identity of nucleotide sequences at the above locations are unknown.
gtgaatcaagtgacgattctgagtccagtgaatctgggtcaggatctgattctagtgagtcaagtgacgattctgattccnagtgaatctgggtcgggatctgattcagactcaagtgatgagtcaatggattcgtctgatgaagagtcgtctgagtccagctctagtgatgaatctccagcagtcaagaaacctgaattgaaaacaactggatctaaagagaagcctcaaccagtgaaagtccaaaaaacaccaaaacctatcgctttttctattggcgaacctaagaaagtacctgtacctgcaccagcaccaaaaacgactcaacggttggcttcattaaaagatttaaagcatccacgtaccaccattgagatgaagaagcctattcttttactgccaacaaaaccaaagaagaagttttccagaatttttgatagtagtgatgatgattcaagtgagagtgaaagtgatagtgacagtgaggtgcccatgtctcaattgaaagttggacgagctccaaaacgttctacacaagctacaaagccgccagttaaaagtgatacctcctccagtgatgatagcagtgatgatggtagtgaaggtagtagtgatgatagcagtaaaggtagtagtgatgatagtagttctggtgacagctccagcgacagcagctccagtgacagcagctcaagtgaggaaagttccagcgatgaaagtagttag

SEQ ID NO: 9099 - DNA, 333 bp, Candida albicans
tactggtcgagaattgaaagattgttatttttttctaacaaaaaaagaaacgccatacaaaatatttactccaaatcttttactatcaattttttttcaaatgaattattttattctcactatatagtgtcatttattacaatacatctcaagcaagtgttgaagtttttgttaaataaaaagtgtaaggaaactgaagttttggctagaaagctaggcatgtcagataagaaggtgagcatctactattttgattgtggatttctccaaggcgttgaaataccattgagggttctaatagcaaccaaacttttgaaaataagtattatttga

SEQ ID NO: 9100 - DNA, 891 bp, Candida albicans
ctcgcaggaaatccaagaaaactgggaatatctccaccttctccaccaaaacttaattttactgcaacaaacatgtctaattcatcctcatcattaagttcaactaccactgccactgccactgctactgctactgctactgctactgccactgttcccaccccaaaaaatgatgtaacccttgtggatgcattaaccaccgagtttgatactaatattaatattgataaagattatagaatgaaacaatatttaactgatcaaaataataaatttgatcgattgattactaaaaatttagatattgtattaaatggtgatataactaaagatccaaatgaaaaaattttacaattaatttatgaaaatagactgtctatattcaattatgtttataaaacggggaaaaatcaattatcaacaagattaccctatataccttatttcaatcccaaatcaacatcgtcaacaaaaaattatcatgacaatgaggaagccttttctgactctgactcttctacaacgtctacactactaggtagtccattttcggaacaagtagatgatagaaatattgatgccatagatttaaatgaaattgaagaattaatatcattacttgataataatgaacaaaaaattgattatttcattaattcattaaatgataatactaaacaattattaaaacgacgattagaaaaagattttcatgggaaaggtgaagccattaaaaatttaataattataagttgtagaatatcatttaaaattatgaaaaaaattcaagatatttttaatcataaaaatatggatactttgattgaatatgttttaaaaattatggtttatgtggattctaaattagatgaagaaaataagaaaacataa

SEQ ID NO: 9101 - DNA, 621 bp, Candida albicans
ttaggaaggttaacggttaaacaacaaccatgtgccaatttatggaaggtgaacaaaggggggaaaacaacattttgggtttttttcattgcaattgttgaagaaattttacctaaatattcaccacctaatgataaaaattttttcaattcaattgatgaaatttatcaagataatttcaaattgcaaaatttattatcatcatcatcatcattacccaatttatcgaatcatttaaataaatttaatattgaaattgaaattttattaatgaattggtggttaactttatttattgatttaaaattcattgaattagatacatggtttaaaatttttgataatttattaatcaccaatgttgatgatattggtgatgaagaagatgatattgatgataatagtaacaactaccatcatcgacgaagaattatattaccggctatgacattggctatacttaaaaatttggaaaattatttaattaacttaaattctcgtgatttaatatatcaatttttaaatcatggtgatgataaatttaaaataaaattttctgatttaatgaaacattataattatttcttaaaacgtaaagaagtaatagatgcatttcgttaa

SEQ ID NO: 9102 - DNA, 195 bp, Candida albicans
aacctaacgcgtatccggcagcctggcggtgaagatttgctttttcatactagtcggcagtcggctgaaaaaacaaattcattaacacggtcgcgagaaaaatcaaaaattaaaaatattatttttcgatgtagccatagttttttagtcgtggtgggaggatgcggatgcgtcgtcgtagccctgggtgcttag

SEQ ID NO: 9103 - DNA, 255 bp, Candida albicans
  unsure (222): Identity of nucleotide sequences at the above locations are unknown.
caaaaaaaaattgtgtgtgcgtgtgagttggtaaaagaaacgaaaaaaaagcaatttctacatttgctatcttcagttttaaggcatttgattacccaatttgaaataagtccaaaagatatctatttaaaacaaacagtatttcttgtatttatcaatttatcaaagaatctagcattcatatataatcaatctaatttcttggtgtttaagaaatcctcnaatcttgacccacgggctggaaggatccgcgtc

SEQ ID NO: 9104 - DNA, 195 bp, Candida albicans
cgatttgattataagaatagaaaggaagaagaagaaaaagaagttataaaagatttggaaaaaaaaaaaataaaaaaaaaagaagaatcaaagtcaaatcaaaaagggaaccttcgtgaaagggaaaaagggaaatcaagattccatacaatcaaaatccaaattcaaattacatataatatgaaacagaactaa

SEQ ID NO: 9105 - DNA, 1326 bp, Candida albicans
agacgattgcaaagtgattatagtacccaatggattgaatcaactcgtttgatgaacaattcataccttgagcaagctagagaggaaatcaaacaagttcttgaaacgtcaatgcaatcgttacatactaataaagcagaaaaattgtttagcaagatcagacgagctattgccataacaatagtacgaactagttatgaagtcggattgagtttattgaataattatgttgcagttgtggatatttcaacacaaccgaaaaccaaagaacagcttgtctcaaacagttatgttgaatatttgttctaccaatacgtgttacatatattttccctgatttggttcccatcctatgacaatgaatttcatagatacaacttgtctcagagacaatttccaggaaaatacgaaactaaaacaaatgtgaccagtaattccttcaagactttagaccagatttattccaaagcacttaattattatcagaaaaacgaattattatttggccaatacgataatgagacacgttatttttgggcaatcaaacttttcaatctaagtttattgttcaagcagttcaaattatgtgaattttacgatcaatttatcggatttttccttattgaaaaagaaccactcaattttcttgttgacgacttgcaaatgcttttgtcaaacttacttgtcatatttggaattacaactattttcttgaagcctttcaacgaattgactttaatgaaacttgataaagatgacgcgttgatagatttatttactgacgtaccagaaagcttagaatttcaattatataattccgtcatgattcccttggcaaaatgccaatttaaacaagtgattgtgcaattacagaatgagacttttgttgccgagttagctgctcaactagaatacaacttacctgtcgcctttagaaatgccagtggcactaatagctcatcattaattaattatatggcatcaataattgattacaagaattttttcgtgatacttactagctcaagacaaatatcaagattgcagatgcttgagttaatgggccatgatacaactgatgataggtcggccactaaattaaccaatgatttgataggtgtaattgttgcattggatttgcaaaaatacggtatctattatgatgctaacaaccaaatgtttgttaacaacgaaacgacaaaggacagcaacgcagatgatgtggccaaactacaagaaaatattgacgacttaaaaaatgaattacgtgctgaatcgctagcgacaaagatgaccgctttactattggataaatactacagataa

SEQ ID NO: 9106 - DNA, 528 bp, Candida albicans
gaaaataatatattaaaaaaagttttaaaaaaaaatgaaaagaaaaaaaacaaagaaaccaaaaagaagggacgcggaaccaaagacggaaaatatttgtttatggataagaacatacacggaaaaaaaaacggacgagagattccaccactacaaccattagtatcattcgacgtcatagcttgttgcccttatcacgaaaatatgagtatcgaagtaatcagcaactctcaaaataccgaggctcctttttcgcaagagttcattatcaattttatcaaagagaacgttgacgtgccttctaagcaattgataaccaaaattgctgaatgtttgaaggagaaatcgtccatgcataaattctttgtacaatcaactagtttacaaaataaagacgacttgaatgatttgcaaatacaatcagactttgctgccctctgggataccaaaaaggacggatgcttgtctatacagtatggaatgaataatgagatattgattattactatttactggatatctatttaa

SEQ ID NO: 9107 - DNA, 780 bp, Candida albicans
aaccatttcactacaccaaaaatgacagatgacagtgctacaccagcatcaaaaaagaggaagctcacctttgacaatgaaattttgaatcctttaaattttcaaccgatgattaacaaacagaaaatatcaacagctgtaattgagaagttttggcaaccattagattctgtaaattcacaatcgatggacaacatcatgaacgttgctttattgaaaacacttgatgagctgcatagcaaagttagcagaagcatcacaaatgtttggtttaattctgcaaacccagaatctttcaagtcacgtttatcacaaacaaagcttccaccccctagttctatgtacagttcaaaattgaggatacgggcgaatgaagttgccgacgtcttaagttatgattccttgacacgaaagaggacggttttggacacatatttactggcagaattaaaacaattacaagagctagagaatcactacaatcagtcattattggcatacaagctggacttggaatatttgaagaagtttaaatcaacggttaaaaacaacgagctgaagtacaatgaggagctagaacgtaagcgtgaagagttaaatctaagtgtgcaaaataaaaacccagatgatatatatttattgtcaactgataatgattttgaccctgagacagacgatgataccaagttcattcttgaaacaatacaggaaaatttgtttcaatcaaaattaaaaaacttgaatgataagttggaagtgttatgcaatgttttagattaa

SEQ ID NO: 9108 - DNA, 585 bp, Candida albicans
aggatattccacagcaaaataacaaaaactgatgagccattaccaagtaattcatctgtgcattccaatgacagttcatcagcaagagcaaaatcaaaactcgaccacccatcttcgccaggatctctattatcacctagcactccagcattacaatcaatcccagctgatcgtgtggcgcaaactacatctccaattaatgcaagtctaccagccgtggaagaaagtgacattgagcacgaatcagaatcagaaatccaaggcgatgaaacagagagtctgggtctacaggttttaccacctatagacgatgttgttgcagcgtctccttcctcattgactcatgaaccacaagagcaagtcctagattctgttgaatcttgtattagcttaccaccaaatagagatcaagcatttgctggtaaagatggagagatgtgttctttagttgacttgaaaccagcagctttgaaaagtgctacagatttgcaattgggtgctgatggtatgtgcaatttgggatataaaataaaaaagcatcaccatactgaagtaagtaacgtttctaactcaagccgcaggtaa

SEQ ID NO: 9109 - DNA, 192 bp, Candida albicans
  unsure (56): Identity of nucleotide sequences at the above locations are unknown.
tatttggggcagaattgtggggaaaatgagagaggggaccccccaggtggccgttnttggtatcatttaagtagggatggccagagtgtaggggggggcgaggaaagagactttgggggagaggaagggagttggttgataaattttgaagagtgggtgggcgattatcattggtggctaaagcggaattaa

SEQ ID NO: 9110 - DNA, 504 bp, Candida albicans
  unsure (378): Identity of nucleotide sequences at the above locations are unknown.
atgaataaattgatttatctgccaattgaattattaaacttgagacataattataaatatgatatttatcttccggaattggatatatcaacacaacaacaacaacaaccatttttcccttcatcctcctattacttttccagcaaaactgtcataagaattttccgaacacggcaaataaccacaattgtgtcctactacgcgcttgtttggatccacaacacctatttggtccccccagttaattccgctttagccaccaatgataatcgcccacccactcttcaaaatttatcaaccaactcccttcctctcccccaaagtctctttcctcgcccccccctacactctggccatccctacttaaatgataccaanaacggccacctggggggtcccctctctcattttccccacaattctgccccaaatattactgagaactccacactcctggctcctctagagaagaaaaaatctcattgggagccgccctgttcaccc

SEQ ID NO: 9111 - DNA, 189 bp, Candida albicans
accaaatggcgccaactctttaaatgtttgggaactcctgcacgttgctctccattcttattagggatatatacttttgaacccttactattggtatcacctattaacagtagaacatatattaattatacattatcaatagtacatattataattcaacttagattaaggcagcaaatgcggcaataa

SEQ ID NO: 9112 - DNA, 222 bp, Candida albicans
ttaattattaaaacaatggttgcagatcacacggcaagaaaaaagtcaatcttgtcaatgcgttttcctgtcatcgctaatacgccacagttgggcttagcaatacatcagcggcaaaaaaataaaaaaagaaaaatctcatcatttaatgaaaaaccaaatatgaaaacattggataacacaactgttgctgtaattgatagtaaaaggacaaacttataa

SEQ ID NO: 9113 - DNA, 756 bp, Candida albicans
aagatgatgtctttttctttattatcaatagtttccattgctttagctgctaccgtgagtgccacttcagacggtacaaacgcatatactgcttacccaagtgttgctaaaactgcatccataaacggtttcgctgacaaaatctacgaccaattgccagaatgtgccaaagaatgtgtcaagcaaagtactagtaacaccccatgtccatactgggatactggttgtttgtgtgtcatgcctcaatttggtggtgctattggtgactgtgttgctaaaaactgtaagggaaaagaagttgattctgttgaatctttggccacttccatttgttcatctgccggtgtcggggaaccatactggatgatcccatcaagtgtttctgatgctttggctaaggctgcaaatgctgcatctgcaacaacttcagctgaaacagccaccaaatctgcggctgttgagcttgccactacctccgacaccactattgttgcatctacttcccatgaaagcaaagtagctgaaacatctgatgcacaacaaactgcttcaattgaaaagtcctccgcagcagaaacttccagagctaaagagacgttaaaggctgaagaatcctctaaagctgaagaaacttctgttgctcaatcttcttcttctgctaatgttgcttccgtgtctgctgaaacagccaacgctggtaacatgccagttattgctattggtggtgttattgccgcatttgctgccttaatctaa

SEQ ID NO: 9114 - DNA, 231 bp, Candida albicans
ttggattattggaattatgatgattggattattgatgatttagttacctactttctctttattattaatacttatttcggttttcttttttgttttctgtattcagatacatatacactttatactactgttcaaacatactctttaaaatatatgtttattattgtttttataattcattttactgttctttttttttgcaactccattgagttaattttgttgggttaa

SEQ ID NO: 9115 - DNA, 219 bp, Candida albicans
gaaacgttgagacattttttaactggtgaaaaaatggctgcagaaaaagaacacgagttctctattgctttcaataaaaaccagtcttttcttctttttcaaatgtccaacatatgtttattggaaggaatgatagaaagtataaatagagaatatataaagaaaacatattttttttttcacccacaattgaacaagtgtaatagatttcatgaataa

SEQ ID NO: 9116 - DNA, 237 bp, Candida albicans
actttagagttatttccaatagattactgttgtctagaggataaagacaattttagggcgtgggttttttttattttttgcaacccagatcatattacatattgcatttcagaacatttacaaatagatagacaattattcttatccagtaaagtgttcgaattactttattactataactcaattattaaagcaaatatattcctaattatatattcttacaacaactccttttag

SEQ ID NO: 9117 - DNA, 186 bp, Candida albicans
tatgtagtcttcaccaccgggctggaagatcagcgtgcttcgcagacacacagagaaggcgagggggccagcggacgccatagtaggggcgcgacgcgccatctccagagatatggggcacgggcagccgcgtcacgtcactcggcacgaccggcgcccatcactcaacaagtctcagcggacgcg

SEQ ID NO: 9118 - DNA, 195 bp, Candida albicans
agacccatttccgtgttatgtatcacctgtctgtgcaaattactggtgtcaacagtatcgggatcaataattccaatctttcctatcccagcagaagataagtatagcaaggcaggagagcctaaccctccagcaccaacaactaacaccttagagtttttcaatttgatctgggattctaaggaaccaaattga

SEQ ID NO: 9119 - DNA, 198 bp, Candida albicans
ttgattgatcaactttccaaatatataaaaactaaaactatttaccccaaaaaaattatcaataaatttcatccagtctctttttttaatcccttttttcttaagattatttatttatttatttatttatttaaggaaactaacaacataaactacataattaagaaaaaaaaatgtcatccaaacaacaatacttga

SEQ ID NO: 9120 - DNA, 330 bp, Candida albicans
tattacgaaattcaacgaaaggaattatttttcatacgtgacgtactaaaaattagtccaaggaggggaaggaaatctggaaggaacgttgtaggcgggcaaaggaaggacaggaaagaagggtgttgtgttgtggcagccaaatgggacgatgacgacgatgacgacgaagaacacgagggccaacaaaagaaagaaaaaaaatatgccaacggaattgttggaattgtgttgattgctgtttttgttgagagagttgtttcgagggtttttgtggattttccccaaattccaacaaacgtttacagtttaaaagtattgaatatataa

SEQ ID NO: 9121 - DNA, 201 bp, Candida albicans
aagaaaggacaaaaaaggacaatgaatttggtgatgtctgataaaaatttaaacaacaacaataaaaatttgattaaaccatacgatttagttttagttttaattttaattttaattttaattttaatttattgtttttttgtggggttgaacagagtaattgctattgtttttaaagttgaatatagataccgactttaa

SEQ ID NO: 9122 - DNA, 903 bp, Candida albicans
ttcagtaaagcaccatttaattggaaaatcttaaactttcaagtcataatggaattatcaaactatactcattgggaaattgtttcatacgtacaggtatttttgtttgcaattttgcttgttgctttcttggtaattacatcaattaaaaaaaaagaaagaaaagggttacgtcaaatcttaccattctttatctttttcacaattttcctcgtattaaaaatagtcggtggtattcttggtttggtgtttattcatcaaaaaacttttaatgttagtttatttattcctacattcatatttgattcaattggtttgggttttatagctagaagtatcacatctttggtcacccataatttcaagtatcaagatgatttgcctgaattctttagatcaaaacaccaaaaggctaaaaataacaatagttccaatgcatacaaaaaatccgataatgacagtgacaactataatgatgataatgacgaaatcaactattggccatttagagtattaacaatcatcttgattgcagctatagttgtgaatattgtgggcaccaacatcagtgttaacaatcaaggttcttcaatgggtacttcattaattaaagtaggatcaattttatttttaattgaaattttattaatgattttatttttggttaccattggtttgagtggatctcaattgaataccgttgtttatttactaattgttggtttggtagttttgattgttagatgtgttttttcaatactcagtggtttccattggagcacctgggaaaacccaagtccttacattatctattttggtaaatatcagtattatacttttcttgcattgttacccgaagtgataactgctattattatacttgttgcctttatgttctggtag

SEQ ID NO: 9123 - DNA, 249 bp, Candida albicans
attgaattcttttattggacccttatgattcttaaattagagttaaaaaaaagcctattttcgctaaccacgatcatatatattataaatttccgtagatcgttgtttgatagtagttgggcttacattacattttctataaactgtttatttaatcatactggagttgtttgtatagatttaatgtgtaaggaagggattaattgttcgttgtatgttcaatctggtgttgattcgaattttacttga

SEQ ID NO: 9124 - DNA, 201 bp, Candida albicans
tattttctcatttttattagaattatgagccatgattcttcaattgcttgttttcaatttttcatgaatttttcgtttaatttgttcagtaaaaattgtttcttcgtggttgcaaaaaaaaatgcagaacagctgaatctccttattagaacacaattgaccaagacgttaacagatcatgtcgatgaagatcatcagtaa

SEQ ID NO: 9125 - DNA, 891 bp, Candida albicans
ctctccattgaaatcctattcacaaaaccccaaacacatttgtcagtcatgtccctaacatctatacatacaatagaatcaattctttcacaaataaacaaagatgtacaagaattagatattccaagtatatatcaactttccacaacaacaacaacagccaataccattcctaaaacatcaccatatatcacacgattcaaattactccaaatcaaaaactcattaactaatttaaatgaccaatttcatgcaaatttcaccagcagtaataataaacattatcataatgtaaaacaaacactagataaactatacattaatgaaattgatgaaaaattatatattgttgataaattaatcactcaatatgatgatgccaattcaccaaccacattaaatggtgatgatcaacaacagcaaaatcaacaaggagaacaaaatctacaacgtggtaatagtggagttattactaatgatgaagaattatcatctttacgtcaacgtttattatcatcatctaaattacatcaaattaatcaagacaacacgagcgaaagtgattctaccaaattgaatgaatatcatgaatcaattcaagatgatatagttaatgaattgagtgaattaacatcgacattaaaatctaaagctattgaatttagtaacaaattattgaatcaagattctgatatattacaacaaactcatgataatttatcaattaatcgaacaatgtttgatactttaaataaaaatttaaatgattatttacttaataaaactggttggagtataagtatttggacattattgaaatttgccgtggctttgattgttatatttgttgttatgttgttatttataattattgttcctagaattcgataa

SEQ ID NO: 9126 - DNA, 186 bp, Candida albicans
tgcagactcgccaagatttggaagaagatatcggaaggagtaatggggaatggaggacaaagaagtaagttaatgcaacaacaaatgaccgaagtcggctcaatgatgtatctgagacaagaattgccgaagtcgagcaaagctactgttcagcccacctcttattatctacgaacccgccgctag

SEQ ID NO: 9127 - DNA, 186 bp, Candida albicans
aaatactctgtgaaacctggtaaaatcaatcatttgacctttttgtttccatatggaagacctataaccttaaatgaactaacggatgaactaaagacccaaagcctttcctcttccccaggagaagatggtttcaattatattttcctcaaagttatatggagaagaagaaaaagcgaacagtag

SEQ ID NO: 9128 - DNA, 225 bp, Candida albicans
atacatttcatcacattaagaaaaaacatgctaatcctgatcaattactcacataacactaaacccataactataatcccttttcgtattctaactaagaatagtggtaaatatatttttttaaaaaatgaaaccaccacagaaaaaaaaaataagaaaacatctctaacaaacccaaatccatattggtgcacgcatgaccatactaatcaagctttaatatga

SEQ ID NO: 9129 - DNA, 258 bp, Candida albicans
atcatcaatcaattgatacaaatcacaaccacaactataactataactacaaatacaattacaaaaatgagattctttactgctgctactaccgccttattattttctgctcaagccttagctggtatcactcaatacactttatccattgaagccgatgacgaaagagtcaatggtaaaggtatcacattcaaacatgaaggtgctggtatcaactatgcttttgttagtgatagttctgccaaatttaactacgac

SEQ ID NO: 9130 - DNA, 234 bp, Candida albicans
  unsure (144): Identity of nucleotide sequences at the above locations are unknown.
tacgaaaatagggagagaagaaaaaaatcaacccttttaatgaaaaccaaacaaacgaaatttcagatgaaccaaaaacatttcggctttgtacttttctcggctcaagatacggtgtacatttttctacacaagtcgtcgtanttgtcgtcgtcttactctactgctgaggcaatttctagaattcgtcgtgacgccaccactacaacatcgacacactacataacacaataa

SEQ ID NO: 9131 - DNA, 600 bp, Candida albicans
tgtacaacgatgggtattacaattacaatttttagaatagtcaatttacttttcctaggcaatggtttcattcaatcaatatcaacaaaattgccacctcatttaataaaatcgggtcaatttcaattcttgactaactgttcattattaacttgcttagtctatatcatttcgacatttttcatactgactggacaagtccaatggttttataatcttgtgagtaatttagaattcaatgttttgtttagttattggaccatggcattatgtttcccgtcaatggttgctgaagatgacgttgatagaaacttattacttgatttacaagtacattttttcccttatatttatttaattatagatagtcaaccatcacttggtttgaaagagtcatggggttggacaataggttatatttttatttattgggtttatattgaatgggaatgtggtaaacatgtacatgatggggtgagtggttatccctatccttttttgaaaggtagaggtgtgcttggtagatttgggtgtatgtctgtgtttgcagctattgcttgttgtaattattttgtattaaagttaagaaatggggcttag

SEQ ID NO: 9132 - DNA, 669 bp, Candida albicans
tttttttcttctctccctattttcgtatcatttataccctctcttgttcttttatccttgcttcaaagaagaagaatagccatgacaaggcagggcttgataagtctcgtatcgttggcaatatgctgtagtggattatacgattgtttccaactagaattaccaccaggtttagtcaaaggaggccatttccaattcttgactaatgtttccttgatattgacaataatctatattttacaaaccatagtcactccaactagttacaatttgagattacagtataatgtagtctccaatttagagttcactgtcactgtttcttactgggtaatgcatctcattttacctcattggttaaacacaaattcatttgaaagagactattggctcgactttaaaattcatatatggccttatgtctacctcatatttgataatcaggaacaaattaagccgaaaaaactgtggacgcttactgccattattatcgttgtgtattggtgttatattgaaagagtggtgagtgtcaatgacgatgggatcaccaggtttccgtatccattcttgaataataaaacattagtggaacggttcttccgggttacagccatgtggttactcagttgtttaaattattttgtattgggatttagaaacagtttatag

SEQ ID NO: 9133 - DNA, 1149 bp, Candida albicans
tcaaatatgtctataaatcaagatccaagagaatattttcaaccacctccaatgccagcaatgccagcaataccagcaataccagtaatactaccagtacaattccaacaaccactaaatcagcaaccactaccacagcaattccagccaccaccacagcaattccaacaaccggtaccaccacagcaattccaacaaccggtaccaccacagcaattccaacaaccggtaccaccacagcaattccagccaccaccggtacaattccaacaaccggtaccacagccgctacaattccaacaaccggtaccacaacaacaactacctcaacaacaactaccacaagaacaactacctcaacaacaactacctcaaccggcaccatcaccggcaccatcaccggtaccatcaccaccaccagcaccgcgattgctgccactacccaccccaccatttccactacaaccagaagctgatcaaattcaagaagatgattatgaaactcgtcttgaaagagctgagcaagctttaaattctagggatttgacatcaatttatgaagcatcttttcaatataaagtcgacaattgggatttaagtgttagattgggacctgacttaacaagaagattgattcctgaaggtgaacgattactttcgccttatttagaacatgaattaagtaattggataatagattcatttcagtccggttatccacgaagtatgagtaatattagagaatatgctgaattattcttatcattatcacaagcacaagtgccagcacaagcacaaggacaggcacaagtacagggacaagaacaagcacaagcacaaggaagatcaactaattcagtagattttcaatgggttgttagtttccttaatagaaaatctgatttaatcccttcaattaataggaataataataatgcattacaaagaaattttggtccaacattcactctgattgataatttcgttcaatattttaatgataaatcaaaacaatatcaaatcaaaccatcaagggttttccaatatgatgaaactatttatattacgggatcttcaattgccaatatgtcaatttttggttataaaaataaagccaatattccaaattgtcaagggataaatatactt

SEQ ID NO: 9134 - DNA, 204 bp, Candida albicans
cagttgatagcagcaacattaatagcattaattattatgtattatcttgttttttttttttcttctgaggttttggttagtgccgaaatagttagtttttctacccccaacactagtttctttgtaattgcaagaatgtggaagacattcagaattcaaataaatgcaacctataatagaaaggttgcaatggggggggtttaa

SEQ ID NO: 9135 - DNA, 186 bp, Candida albicans
ctgaaaaaaatctatcaaattagaataaaaattttgtttttacatatatccgtgtcacgtgccaaagaagctaccatattagcttgtttctcttttagtttttcattagttacaatctcaattaaagatgataaaaacttaatttacaccagagagatgaatgtcaactttattattatggtttag

SEQ ID NO: 9136 - DNA, 195 bp, Candida albicans
atgaaggaaattgcagaagcaacaaaaggaaaggaactccgattaaaaaaacaaagtgggagaaagaatgaacattccataaatgcaatagaagcattcgattgcttttatatatatatatatatgtatgcacacccaccaatactttcattttggtttccattgtctttaaaagttgtgatttatttattatga

SEQ ID NO: 9137 - DNA, 201 bp, Candida albicans
ttagttgccaaaattgataactctctggagatgacagttaagttaagtatcaaacctggttttcttgtgaatacgatgcaacagtggagagattataaccttgaaatagaagccctacagaatcttaattacattgttcaacaaacaatgttgataagatgtctgtctgtttgtctatctagttatttgcttttgtcttga

SEQ ID NO: 9138 - DNA, 201 bp, Candida albicans
  unsure (113),(153),(165): Identity of nucleotide sequences at the above locations are unknown.
aaggatttggattttattttttttttgacattgatcaattgcatagggttgtatctcacgtatgttaagagggccagagagagagggatgcggggggggggggggttatttgntgaaattcatcaaaactgggcagacaagttgagcggacanagactgagagantggtcaaccaacccaaccaacccaaccaggaattaa

SEQ ID NO: 9139 - DNA, 894 bp, Candida albicans
gacatgaagcttttgactattttgactattgtggaattaatacttgtgggtggtgtacatgataccccggatgcaccgcatcaaccaggtttgaaaattgatgagagtaaccgaaaaaaacttgatgagttagtccatcaattagaaatactcaacgctcagaatagcaagttggagaatgacttcactgaagattacaacctaattctgagagatctcgactatgaggacttgtcggcaagatctgatcttccgatattagacactgtctttagacttgtcaacagttctggtgttgctattcttgccactgattttcttttgacacgggagccattacttgacactgccatagacacattgatacgtgccattgatgaacaatgggtaaacattactacaatatttatcgctcttgatcaatcaggtttacttttagatacattaatgcattctattaaagatccggatgtgttacctggcttattgagaatcacaaaagaagtgattaatcaatctggattccggattttcaacgttcgagaaaccaaagatcttgccgatcaatcgccagaagattctacttctatagatgtctttaaaagggagaattccttgttggtgttactattcacatctttgaaagattcaggtttggttgtttctttgactaaccatattctaacgaccccagaattggctcctggtgcagctcactttgtatggagaacattaaagttgcggcccctgacactctataaaatatttgatgcattgaaaagatctaatttaatttggaatttgcttagagagattatcaatgttccagcaattttatcaaattttagcacaattatcactcaaactatttccctgaaacttaatttacaatga

SEQ ID NO: 9140 - DNA, 213 bp, Candida albicans
ttgttgttctttgaacccaatgccttctacacacaaggccaaactaaaaagattacattgttattatacaacaactttttattgttgaaaaattctccttctcgtatgattaagacacaacaaagatataaggggtgtatggtgactattacaactaatatactccacattgttgttaatgctaatggcaatctatgcaaaatatatacctaa

SEQ ID NO: 9141 - DNA, 240 bp, Candida albicans
ttgattgatcgtctaacgaaaaatgttaaaatgaaaacaatcacttgttttttacacaaatatatttatccactgattgtccctgttgttgcagttgttgctgttgtggttattttgcccctgacatcttgtgaaattcaccaattattaaagggttcttcgtttgttttttttttatattttaattttaatcaaccagcatctgcatgctttgtttcatcgcgacacttttcaccttag

SEQ ID NO: 9142 - DNA, 183 bp, Candida albicans
ttaaactctatttttcttcctttgcaacacctaataaagtctgttgatgatttcaaaaacttgttttcgcttcacacttcaagctctcacacaatagaaaaaattattgctcatcttcatcgtcttgctataaacgcattatcacatcctccattagcacattactttaagatatggcggtga

SEQ ID NO: 9143 - DNA, 219 bp, Candida albicans
attgagtttctttcaagtaaacgaccaaggactgtcaacatctttgtattattagttattgtagaattgattgaaatctctattcaactgctagtttctaccttttttttttttttttttaagttctcactttcctttttcattctcaggtcaaattattttcactgcgaattgattggttgcgaatatatgcaggatattttagaactcactgcaaaa

SEQ ID NO: 9144 - DNA, 231 bp, Candida albicans
tttatacccaagtgtcattccgaaaaccgggaaaaagttgaataccatccagcattctcgggatctatctgccgtgtgaaagatgatacacatggtgtaatgttcaataagtatgctaccccttggttgccagaaattgacattagaaaattgatgaaagaattcctttttggcattaatggaattttcccaagtttcccaaggggcatcttggaacaagcaacattttaa

SEQ ID NO: 9145 - DNA, 309 bp, Candida albicans
caagaccactttctcgacaacaacaacaacaacagcaaacgttacatcatccatcaactacctcatctagaactaactcaattactaatcccgttgcagaacacccagcccctcaatcgtcatactttatgcaacgttattcattcaattactgtttatgaacatccaaaactgttgaggggtacatcacctaggagaataagatatgccaccccccccagaagtatacctgaacaaccgatatcatctactgctccaaccaccatgattaacttccacattccaaacccaccttctaacttctggtag

SEQ ID NO: 9146 - DNA, 237 bp, Candida albicans
atccatttcccattagttaaaggttcaattgacgttactttagctttaaatggtgagttcttaattggtgtagaggccgacatgaaacgtttaattaaggttgttgttgttgttgttgttgttgtgggtttgaataattgtttaaacatttattgggaaaacaagcagaattcttgttctaaactacgaggagggagcaaacaacaagaacgaaatcagcaaaaaaattgttgttga

SEQ ID NO: 9147 - DNA, 396 bp, Candida albicans
cagttaccgaaaaccatccagtacggtacaccaatcatgtcaaccaataacagcactcaacaaccagatgaattagatctaatcaaatcgaaaattcaagataatttaatctcatcaggaaattatgatataataaataaacaattaaaattacaattatatgaaagtggatggtatgataaagtatcaccaattgcatcaagagaattaatggatcatcaacaaaaaatcaattctagtaatagtaatagtagtaatagttataagaagaatgaattaacatttgatcaattatttgcttttgttaaaccgaaagctgaagaattggtgcctaatgaagttaaacaagatattttgaatcgaataactaaatatttagatgatataatacaataa

SEQ ID NO: 9148 - DNA, 210 bp, Candida albicans
gtcttgcagttcttcttctttcaattaaataccagaaaaaagccaatgaaagaaattggaaaacaaaaaattttctattggattaatttaagagagaaagagaagggcggcaggcaagaagtatttttttttgagggcggtgtgtattctgtcttctgtcttctgtctaagcaaaaaaataatgagattgattggctgtctcctaactaa

SEQ ID NO: 9149 - DNA, 288 bp, Candida albicans
aaagattttgtcaatataatagaagctcaatcttctttcttagacttaagttggacaatatcaaatatgcttgtatgttcttctaagtttcaaggtaaactggcaatatcaatatatttggtgttagcattgaagagggcaaaggagtttgaaaaagaaactaattcgtgtgtccaccaaacgaaagaacggttgacaattgttcttacacgtaattgtaacaactggaacacagtatcagcttgtgctaaattcgggaaaagaaagagagtttataagtcattctag

SEQ ID NO: 9150 - DNA, 207 bp, Candida albicans
attattcaaacacttgaattttcagtttccaatttgatttcaccgatgaatccagatttgcttaaagtatttttgattgaagttcccaaaaatttgggttttgatgatttcaagggtctccagcattacataactaaagttctattttattctgcaactgatgaagggaaatatttgaaaactctattctctattatatctccataa

SEQ ID NO: 9151 - DNA, 213 bp, Candida albicans
atgaatcttaatgtgccgaagactgacagcaatggacaagataaatttcaccagaagtgtgaatcaatgccaaagcccactgctgtaactgcagctagttctaactcagatcaaaatacaactttacaacacccgaaagataaaccactagaacacctagtggaacaactgctgcatagtaatgaagaacccaattttatccacagaacatga

SEQ ID NO: 9152 - DNA, 1167 bp, Candida albicans
ttaaaagattgcaattgggaagagtcacctataattgttcacaaccctgatttcaccaccaccgtaaacccattgaattgtcaatatatcaaagactcatggaaatatatttactctattctcaaaaataaacgattttatgctgaatactgtgattacaaaattgatgagccttcaaattatgttttcaatcattatgttgagattaatcgaacttatttattgagttataataaagtttgttggcttgccccaggtgattacaatttgaatattgctttggcagttaagaatggtcaaggattaggaaccaccaaatttgaggtcagatatcaagaattgaatgaactaggtgaaaccctcattaaactgcaaacattctatccccctagcaatataaatgaaatcttaccaaagaatcaatttgtatgtttgaatgtggggcattttgtaatcccaccaccatcagaaacagagtcaagattttacttcaaacaatttcaatccaatagtgatcataacaagctacgaagaattgaaattgtgatggaagaaattggattatacttgaaaagtggatttcgtgtgtactttattgacatcagtcaaccgtcaatgttattcaacgagtacgacctattatactattcaattaatgaaactgattaccgatattttatcaacatcctattaaagaatttatataaagctttaaattacgtccaaaatgccggatgttcggatgacttgagctaccaatacaaccgagacgtttacggagatggagacccatttagtattatcaataaatatgacaagcagtttttattggaatatgaaaagactaatggatttttatcttcatcttcctcgtcatcatcattggccttgaattccttgcaagattatgtattatatgataataagaaattgcttaactatggcaggtttttctacttgaacaaattcacaataaggaatttcaaatttactaccatctaccaacaacgtcaatttatcaatagatttggtgattatttggttgattgtaaagagcaagacagtaaaaagaacgttgttgatggggatgaaattccaattgaaagaaattgttcgtacgatcattatgggttgaaatggaaacttcccatattaggtcagttatag

SEQ ID NO: 9153 - DNA, 264 bp, Candida albicans
tggaacaactgctgcatagtaatgaagaacccaattttatccacagaacatgacaagaacccaccaccaagatccccagccaaatggacaaccatacttatacccagcacgagcaactccaccaaaacctctggatcagaaccgagaaccggggttatgagaatgaataaccccccgacgattatgggggatgcacctgaaatttataaacgtttcctattggccaaggttccccaatttaacatggccccaacttacaatgta

SEQ ID NO: 9154 - DNA, 660 bp, Candida albicans
ctttacagtacatcatcatacaccaagaagcacacaatggatgatacattagctaacatagatctgacagttttgcggctgacacttgatgaagctttaaaaattgaggaattaagcgttgaggatgccatgaattcaatgattcctgatcaaactcccgaaatgaatcaattgatcgaagaagaggtacccattttaattgaattagcaaaagaaaatgcaaatttcgaatttcctgtaaatgagcgtttgaattgtttaatacaagactttttgaaacagccttctatcaaaaaagaactcattaatgcacatccacacttcattgcacttcttaaacatccacatatggacccaaacttttgcagtcggatatttgatgagggttatttaaacaaacattttgacagaaaagaatttgaaaataataaggatttgcttgctctgaacccaggaccgacagaaccgaaacctaagaataaaaaatattcacttgagactattgaatttgttagctataccgaaactaaaaagtctactaaagatattgtcgatcaatatgatacagctccactttctatacagttaatgacagaagctattccagccaatactagaataatgaagtttttttcccagattccttacccgataatttaa

SEQ ID NO: 9155 - DNA, 243 bp, Candida albicans
tcggtatggattcgggctcccaacaataacaatggttcaggctcaggttctggttcaggtagggaacaagataatggaattattacgtcatcaatcggtcaacccggttcatcaacctcaactcaaggcccatcatcttccaattcagcaactatacctgaacaagcaaattcaggaaatcatattaaattcacattattcaatagattattgattggattagtttcaattgttttcatgtaa

SEQ ID NO: 9156 - DNA, 186 bp, Candida albicans
agccgcagagcatccggaaaaaaaaaagttgtggaagtagtaaatgcgcgacgggagttggagagaggaaaagaaaaagagtttttcactattgttcactttttctttcaaacactaatgactccatctgtaaatttctacttgctttatgtgtataaaagatcaagtataatatttctatattaa

SEQ ID NO: 9157 - DNA, 198 bp, Candida albicans
tctaatgctgtatcccaatgtttaaaagtgataatacaaacaataaaattgacagcaaaccatgcaaaacatcctactcgtaaaatccacattgatctactagtaccatcttcccaaaattggaaacataggaatccattatataataaacaaatgcaaagagcactagaaagaccaatttgtacagcaacaaaataa

SEQ ID NO: 9158 - DNA, 189 bp, Candida albicans
  unsure (43),(71): Identity of nucleotide sequences at the above locations are unknown.
aaaaaggggaaattcccattgacacaaaaaaataattctagtncgagttcactaagggtattgggggtggnttcattccaaacttataaacacacagaaattgaagttttttcttcttggaataatattgtaccacaacgtggaattttttctttatgcatcaagaaattggatttttctttcaaataa

SEQ ID NO: 9159 - DNA, 231 bp, Candida albicans
  unsure (21),(80): Identity of nucleotide sequences at the above locations are unknown.
ttcggtcattctttcaccatngtcaaaaagaaattttatttttcgtcatcgaatatcacatttttatcgtccatcaatcntaggtcaagcccttcccccccccgccaacttataattatgatagagtttaatcaaagtttaaaaaaaaaaaagaattcaaaacattgctactttaaatttacagaaacatatattctcaccttatcgtcaaaaaaatatatccataattaa

SEQ ID NO: 9160 - DNA, 720 bp, Candida albicans
tggatcaaagtacaggacaaagtagatttgttaaaggatgttgaaaaatgtggtgatttaaaacaaagaacgttagaattgatacctctggatactaaattgaacctgatcatgaatgctagtaatgatgttggtatgattgaagcaagaataacaccgctggactttacattaccaaatatcacacctacagtagaacaaatggatgataagatgcaaaaattgaatttgaaggatacccataaaccaacaaatacactaataccaaaagaagacaagaaagcatcttcatttaattcgactaatgctattaaacaagctatcacgtctaatagatatcttgagaatattttcacgggcgataatccagcgttaccgattaacttaaacacaatttatttcaagtggaaagtattgaaaaataacagtaaaatgaaaatcaaaaattttagtgaaaagaatttcattatcgatggagattatattcatttgacaccacctgatgatttgaccatgaatatgccacctgaatcgtcagtgataaatataaatggtcataatcatactcatcatcataattatttgaatcatcaattcaatcgagctcataataagactctgacgaaaacctattctttccatataactcaaatactcaaactaaagaagtacgttacaaatcctaattattttagtcttacacccacgggcctggaagga

SEQ ID NO: 9161 - DNA, 219 bp, Candida albicans
gccaatggaactaaagatcaagatcaagagattggaacaaatgatgaagaagacaatgacgaaaaatttttaatcacatgtaatatttatgatttggatttgaaatcaaaaatgaaatataagcattggttaaaagttgaaaatgatttacaagaaatttataatagttccaaccctaattggagatactgtatcaaatatgatcaaattcaccattaa

SEQ ID NO: 9162 - DNA, 219 bp, Candida albicans
agaaagattttttcccaattgttacgggatattcactttaatttgagaccaattttaattggtacttcaattgggttaggtgtcagtgcaccaactaaagcattatatattcttattgcttcacgtgttgtccatatttcagtggtgtttcaaaccagtgtctttggaagccacagattacgccgtaagagcttggccaaaagttgttggttcttataa

SEQ ID NO: 9163 - DNA, 264 bp, Candida albicans
aataaaggtgaatctattatacgaaaatctaagcaacgttcggtctgttgtttcggctgcggactcaaacgagtatttgaacccgttgaactcttatcaatacttttcaacaaagataaggtacaagtgaaaaaaaaaaaatcttcaacaattgatcgtaaatatggtacgaaacacaaacttattgaatctgctgtggccacagacgatattatactgttaagattggttgttgcggcatttttaaaaaaactaaagatctaa

SEQ ID NO: 9164 - DNA, 192 bp, Candida albicans
agtggtttgatagtggcaagcacgttcttatttagtttatatggtcacgatattattcaaaaatggtcagataaattatctctgtggattattattggtgttccgtcattgcctaggtttagacactgtcggaacaacaaacaaaagtggtggtctctttcgtcacttaacagattctgccgaggaatatag

SEQ ID NO: 9165 - DNA, 216 bp, Candida albicans
tattatttttttttgacaaccaaccatccaaccagccttgttttgttcgtctcagctttttttttggaaaataatacacgacccgcactcatacaaaataacaaaaaaagaaatttttattcccaattgggaaaaaaattactttggttagcctatgacctcataggtattctcaactttcacgtgacacgagtagttaatatggataatttataa

SEQ ID NO: 9166 - DNA, 267 bp, Candida albicans
actaataaggacaaggctccaaatttgtataaaggttgtacggctctagaaaactacatggtgcttgaattaaggttagttcaagaaaagagccttgagaaattgagttttctagaaattgagattgaaaatctcatcaaatctagacctcttctttatccataccaagaagttaaaagatatattagacataacacgcaatatttgttatctttaattatgattagactccacagttacggaaaaataattattatttgcatatga

SEQ ID NO: 9167 - DNA, 534 bp, Candida albicans
gacacatacgcgtggatccgtcgagttcccgaggtgaagatatcgatgaaactgtcacatcaagcattagtcgaattgtttagaaagaatttccaagaagaaattgttgctttacgtttaggtgaagaggcgacaattacagctccatcctcaagtcgtgtttccattttccacaataaacgtgctaatggtttaatgactgaacgtgccaattccatttcaaacatgtctggtgctggttctacatattcgggttcaagactagcaaggtctcctactaatgcctcatcagtgtcttcaaataattcatcaatcactagatcaggtagagcatcaaacacttcgggatatcctgcaagtgttattcaaccaggatatactgggttaaagggatcatctcttaaaaatggtaatggatctgtcacttctaaatcaataaacggatccggtaaaacaaatgcaataaatacaaaatggtacaggaggtgttttgttgttagagatcatttaatatgtatgaacggttttttgtaa

SEQ ID NO: 9168 - DNA, 363 bp, Candida albicans
gaatacacttgtctgtttttattctttattgggacccaaactactgtgacaatgacttggacgccaacttcttgtttcttaaaaggtgttgtcatcaaaccattcaagccgaaaaataaacggttgagtctgccagaatcagagaatttacctttaaagaatctatatcctggagatcaagtttacgtttttgaaaccaataatctgaaatggggaagaggatatgtaattcatcccagtattggtaatgatttaaaagtgatatcaataagacttaacgaagttgatcaatcttccgttgtgtttcccatgaaccgcattaaaataattgataatattgatttttggcaaaattaccaatga

SEQ ID NO: 9169 - DNA, 306 bp, Candida albicans
ataacacttgcaggatatcccgaagtgtttgatgctctacctgatctagtgattgatgaattatttgaagacactgatgaggcattagtaggagaccttgctagtcttgaacccgaatatgtagaaccagcaccagacatgtttgaaatggaattggcacgttcagtcattaaaccattagcacgtttattgtggaaaatggaaacacgacttgaggatggagctgtaattgtcgcctcttcacctaaacgtaaagcaacaatttcttcttggaaattctttctaaacaattcgactaatgcttga

SEQ ID NO: 9170 - DNA, 255 bp, Candida albicans
tctccaggatatagattctttaaaggtaaattctctgattctggcagactcaaccgtttatttttcggcttgaatggtttgatgacaacaccttttaagaaacaagaagttggcgtccaagtcattgtcacagtagtttgggtcccaataaagaataaaaacagacaagtgtattctcaaaaaaaaaaagaatatagtcttaaacgccttttattgcagttgatttttgtaagattatgttttggcttgttttga

SEQ ID NO: 9171 - DNA, 237 bp, Candida albicans
tataattttcgatttttttgtttgtgcgtgttaatgccctttctttcttacgcggttttaatacttaagggggataaactcttgttattttttttgcaacagttgtattccgcctcaaaattattcaaatgttacttaatacactctcttcgtaatactaattttttttatcacaattcacacgagcgtaattataattgttccttacttgtgtttttttttaaaggttgcagataa

SEQ ID NO: 9172 - DNA, 243 bp, Candida albicans
ttattattgttattgttgctacaattaactttgaaacggattaacaaacaaggcgtcaggggcaaaggtcgccaggaaaaacgaggccgccttaataaaaaaaaaattgctgcagtcattttgcacgaccttcgtataaaagagaaaaaaataatcaagaacacgagtaatcaaactttctacagggtcatgtcatcatcatcaaaaaagggtagtaggggtgagtatcaattgatagagtga

SEQ ID NO: 9173 - DNA, 225 bp, Candida albicans
atacttctacatgcagaagcggataaaaataagcacaaagaaaaaaactatgttccgacagacgaaagacaaaaattgcgaaacagcaaatatcaccaaacaaatacaattttagttaaatccgaatcactaaaacaaggagccaatgtcgtcatcgatggacgatatgtgtgggtgaaccggatttatagtcatcaatattatatatatcatttcgtgtattaa

SEQ ID NO: 9174 - DNA, 1368 bp, Candida albicans
aactcaaccactaaaactagcaatgctttatccaggctattcactagaaataagtcatcatctaacatttcagttcatccttcttcaagcgatgatgatagttcaccaaagacactccgagaatctacatctccatctgaatcaagcaagagtgttagtggcaataagttgagaattgccaaaaagttgaagtttcccaagaatcaaagcagtcggaaaccagatttgtttttggatactagtagcacaataagcgaagacagttcttcgcttcgaaaaataataactggtaatttgttaaatgagatgaataaatcaagaaagagctcaatgagctcacccatgagtaccacatttcatagtttgtttcatcgatcccatcatagtggcagcaaccttcaacaagataacaacctggctgccactggcacgacacctttgtcgggtaagtttgatgacttctcaaaagcatccaagacaactttatgtctttcctcaaatagctcgaattcaataatcagcaatcctgaactagctcagatatataatttcgccaacccaaatatttcaattgaagatggagaaaccaatatggatcatacaaatagttcctttttggatattcataagaaaatgcttgtgccagcagatctgtttattcagaataagctaaacaagtaccaccaaaccgaagtaggattgggcatatacgaaagtgaattagatcatgacaaagataataagatatactccaacctttatcattatttgaaaccactatttaccccatctttttcaatatccgactctggtcaaaagggtaagaggcgtccaatattgagtactagcgttgaagaaattgcaaattttgtaaaggagaatttttgtttacaccagcccgaccacgataaaagttttagactgaaaacaagatccagtgtatcaagcttgggtcatgaaaaggtagaggattttgattaccgtcagttatcgaatttgtttgaaaaattgatggccttattgagtcataacttgcaaactgctgaaccatcggaaatatctttacaagctttgatattgaacgcatggaaatattataatgcttatgttaggttttatttgctaagtatatttcaaccattgcaacttcacttgaatgggttatctatgataagtcataatggaagcaaaattaccagaatagatgaccttctacttgcttcgtttcggaaagtttttattactgaacagggaattggaagtggggatagagagacatctaagtttttgggaaatgctgaaagtgaagatcttacagggaatgggttgttgacttctactttggctgtgttgtcaagtatatcttag

SEQ ID NO: 9175 - DNA, 264 bp, Candida albicans
ttagttattatacccaacaagagacaaagacaactgcatcatcagatttcaacatcagaaaaagactccacattatctcaaacatcctacgatgaggaagatgacaattcattgaaaaccactgatactcattatggaggaggaggtggtggtaattttaaatacaagtttccaggtgctggtaaaattgaatttggaggtggggctggatttgactataagcacggcaagaaggaggactcagatgatgatgaggaagaataa

SEQ ID NO: 9176 - DNA, 204 bp, Candida albicans
ttacattccaagttgtttcaattgttacacataattaatattttttccatcaaccagttgcttgaaaaaaatagaactaaaaaaaaaaaaacaataggatcattaaacctattgacaatccctattataaactgttatgtgcttggcatcttggacccatcattacatggtgataaatcaatttacaagattgacaatatatga

SEQ ID NO: 9177 - DNA, 195 bp, Candida albicans
ttctttttttcaagtggggaaaaacatccattctcgaattgtcgtgttagattgccagataaattgaattttcctcctggccccttttggggtcaaaacccaaaatttgtgggcgaacaaaaatcaaaatttaccagattaagggatccgttccacttcattttcaaccagtgttttgaatctttaacaatttaa

SEQ ID NO: 9178 - DNA, 198 bp, Candida albicans
tatttgtctttgcttattttaaattttgggatttttttgttttataaagttactggtcaatcccccccttgtttaatatcataccataccataccattcaacctaaaagagaaagataatgacagaagaggaaaagaaacgtctacaagtattggaaagagatgccgaaactgcttatccatttttagcatcagatga

SEQ ID NO: 9179 - DNA, 246 bp, Candida albicans
tttgtactaaagccacgtttcaattttttaagacttagatatcacgcaactgaaacacaactgaagaactttccaatcaaaagtgtgttggtaattccctgtaacacatcccaagtttacactcatgacacattttctattctcattaatactatttacaaaaaacatactttaactccatttcgagacaccctatttaagtgttttaataaaattatcaagattatactcttcttcatattgtga

SEQ ID NO: 9180 - DNA, 234 bp, Candida albicans
cttttcttacaagtacccacacgtccctcatcctccttctcatcatcatcctcccatttttccgtttttaatatcattaaagttgtatatcaattagttattccatccattatccgtccatcttcaatattagagtataaaactattacaaaaataaccgttacaaaacaatacattttaacggataattatttgaattcaaattcagtccgatattattattattattattaa

SEQ ID NO: 9181 - DNA, 237 bp, Candida albicans
gcaatcgcggatcgccactccgtggtgaagactttagagaatgatccgtttgttgatcaaactgcaaattctaatcaaaataacaattacgggttccaacaaataccaacaggaaacaatttttacaaggtcggcaataacggcaatattggcagtgctaacaaaaacaacagtagcaatgtcagtaataattcaggggattataaggatttggattggttgaagtttgacatttga

SEQ ID NO: 9182 - DNA, 255 bp, Candida albicans
ccaccccagggagccataaatatccccaaactaaacaataaatttatggggttcggtggtaataaagtagttgttgcaggtatcaacaaagaacctggagatgtgtcaacgaggaacccacatataaacactgagagtattatccccactgttgaaattattcccaatagactgaaaattgataacatacttaatggcaataaggataacacaaataccacggcaacaataattgctttgagggcaggcacatga

SEQ ID NO: 9183 - DNA, 360 bp, Candida albicans
tgtcgatacaatattttccctagatatttagccgttgtatttgttaaaaatgccgatacaacaagcaacaacgaaccaaataaccaacctgacattttaaacccaagtggtaaagataacattccaattccaattaacgtatttattgaattaaatatagtctgtgctgctgtagaattcccagtaattagactaaatgaatgtcttttggtcgatactcgtgataaagttggtaataattcgctggtttcatcgaataccgaattatttgaccagtcaataggaggcggtaatgggaaatccatgtgctcagtttggttgttactgttgttttccgagggtatggagttgtcatcataa

SEQ ID NO: 9184 - DNA, 219 bp, Candida albicans
aactattggaccagaatgcccctgcctgatcttacagaccctcctagtgcacctaaacagcgacgccgatcgtttatggattatggtggtcccaattctataaacaattttgcatcgtcatactcgagggcccagcaatatattggaacttcatttatggagcaacgaagtgaatatatggaatctccactacaaataccatcaagaccttttacatga

SEQ ID NO: 9185 - DNA, 198 bp, Candida albicans
  unsure (76): Identity of nucleotide sequences at the above locations are unknown.
gggtaccaatattgtaaacttctttatccaaggaaggttaatcccttattctttgaaaaaataaccgaagggggtnggccacaacaccattttaaagttagtaccggtaataatggattaaccaagtacgggttattccaggtagggttggaatttgtcctttgcaaatggacacttgattttattaaaagcatatag

SEQ ID NO: 9186 - DNA, 1260 bp, Candida albicans
gtggccagtagtgaatcatttataattgattatttaaataatttttattatcgaatgtgtgataatttagttaatactgaaccaacaaattgtgataatgatgatcgaataattattgacaattataataatttaatgattgattgggtcaatgcattatttgatgatagaaatgaaggattatctgatgaattaattaaatcattaaatattaaacaaatttataaaattatccccattatttatcgacaaggaattattgatactaataataaaaaaattaattgggaaatattaaataatgggttagaatatttaagtcaaccatttcttacaccaataatcccgataattataaaatcattattaagagatttcaccattgataatgatttaaaatttaaaatcatcagagaattaattaaagataataacaacaacagtaataatatcattataaaaatggtgataaatatttgtggtaatgaaatacttacatttaaccctccagcagatattagggaatcaataattaaaactatggtttatttagataaatctgatcctattgctagagatattaattttaaagaatttattaaacatcaattacttggagatattcatattcaaattgaagaaaattttttgaataaatatatttcaaataatcgattaaattttatatcaaatttaattgaagaaatttataattttcaaaaatttaatcatgaagattcaaaaatttatattaatttaatgatttttataatgttattggattcaattgaaaccaaatctgataaagattattggaaaaagaatttcaatttgccatacccaatgaatttagaaacaaatgacctggtggtggtggtggcggtggatagtagatttgaattaagtatggataatcattattcttcaatttttaatgatgattctaggtcgtcatcatcttcatcatcatcaagttccaacagtaaagacgttgacaatttcttaacgaatggagatgaagatgaagatgagtttatgaaagatgataataacaccaataacaacaacaacaacaatgatgagagaataactacaagtcaacaattggaaaaattaaatgaaaaaattcatcgacatgaatgtttacttaatgaatttagaaaaattcgaactaatactactgaaactaatttatttgctaaatcaataagattattaaatgataaattaattgaaaaaataaccaattggaccatctag

SEQ ID NO: 9187 - DNA, 243 bp, Candida albicans
aaaaaaatttggaaaaaaaagaagaaaaattttgatgatgttggatggatgtcctttgctctttctttctctcagtcaaaaggggaaaaaaaaaatttttcactgaaaggaaaggaaagaaaagaatactctaacaaaaagaaaaagaattatttacacactttaaatacttcaacgttgtccggtcattcttccactcactcactcccttttttatacaccctttatatacaggcacaataa

SEQ ID NO: 9188 - DNA, 264 bp, Candida albicans
agacatccctatggcaatggcaatttccaaaatgaaatgagatcaaaactaataatacaaaatactaaaaaaaataaaacttacccatcaatgtatgatttgtcagccaagaattcgttcaatgatttgatagattcgactttagagaaatctgagaatgacattatgtattggtttgtgatgtgttggtgtagtaaaatgatacttcaaagaaaggaaaggaagttaaaaaaaaatttggaaaaaaaagaagaaaaattttga

SEQ ID NO: 9189 - DNA, 219 bp, Candida albicans
aattcctctcacctcaaccctcaaaacattaaaattgtggcgaccaatggactaggagtatcgcagatttcgataaaagcagcactacaaaaaaaatctgattttattagtcggagttatcaagtttatggctactacgcacttttaaatattgaaaataagcaaaataccgttgagaaagattattgtatttatattaaaagtaaattgttattatga

SEQ ID NO: 9190 - DNA, 198 bp, Candida albicans
gaaattaacaacaaggaatacaaaaatcactcatattctaaatatcagtggtataaattatttataattatttcttattttatttgtttacatttgttttcacagaaaagaaaagccaaaatgaaggaaatatgttttcatagtgatagtgtgttactattgttatcttccaagtggtttacttttaaggttttttaa

SEQ ID NO: 9191 - DNA, 369 bp, Candida albicans
ttccctaatgatattgatcaagattttttttacattacatgtaatccgaaacaaagaaatttccaaagttcattaccttatttaccacatctttcaaatatgaatagtgatacattgaccaaatatcaactaacggcattatattatttacatgatcaattgagtaatatttttcaaccgatatttttcgaaaaccaacttcatgaatttttccataaattcaccagtaataaattaaatgattggatgttttattatatcaaatatcaagacaagtatatcattatcatgaaaaataaaagtaaaaatacaacttcaacattgaccaacatcttcaccacgagatgcaaggaccgcgcatggttaaga

SEQ ID NO: 9192 - DNA, 1374 bp, Candida albicans
aaaaacccacccaaaagatcccatattaacttttccattggtttcatttctgaagtgtttcccaagtctaatcatgatatcaaaatgcccccacatggtctacttgaaaataggtcagaatattcaaaatctttcaatgtacttgactatacacaaattgttgacaacaaccaacgtttatttttaaacaatactattttgagtaagttattaagcaatatcgtgcatccattagtttttaatggcttacttagtttgacatgttgttactttgagtctaatgcatataaatcgttttcttttgttcataattaccaaatccgattgatattccacgagttatatttgagatatcatttgatttctattagaagtttaactgacatcatcgataagattgatagaagggacaaacaaaacagcaaagatactgatgacttgtacattggattgctagggtcgattctactcaactacatttctttgtatgatgataaccaaacctcatttgcattttcgaatggcataattcaattatcaatacaagttattgaattggctcataagcagagccaagacaatttcaaaggagggtatatcgaacatttaatattggcaagcaaatcaagtttttttccaagttacccttcccttccgtgtttagtagagttcaaagaaatgctagaaaagttcagacgttacctagtaatgaaaaaagttctgaataacggtatactatctaacattcatgcactaaatcagtttgttaacaaattattggggatttgtaataccaacgatagtatcaatgataatcccaaattattgaaacagttgttacgagagtggctacttattataccgacaaatttatacttatttaataccaaccctagtgacagccattgtatccccaatactactcctacgaccgacactttggccgcttttgctatcaataacaacgataataataatattattcaatataaaataattgtgatgatgtattatgaaacattaagtaaagtgttagataattttttccccaaaacattattttataatttatattcatttggatcatgttttactcgaccaattgaatttgcaaaattggattctcaaaaaatacgtttgattaatttacaaattttcagtaaatattgtttaaaagtttgtaaatttttcaaaataagattccaattattgaataatttactaactaataactttgaatatttagatcaatttgtttattcaataaatgaactccccattaagaaattcaataatcatgttttggaaaccaataaaatttttggcatttcccaaaatcagtacagttacctattgaagatttacagtatataa

SEQ ID NO: 9193 - DNA, 630 bp, Candida albicans
aatttttggcatttcccaaaatcagtacagttacctattgaagatttacagtatataaacagttttattcaagatacaagcaataatgacaacaacaacttcaatcaactgttgtatagttacaatcaccaacatttggctcattttagcacttccttttataatgatccacaaataaatttccatggaattaatatgggatatttggatcacgatcaatatcaatatcaaaatcgtcaaaataattgctttggatttgtgaataccttatataaacagtattctcaactcattaataagcatttacaagaatcgtattctaatatatttaggggggataaaagacaacaactgctactacgactatcggtgtcactgccactgtcactgttactgccattattactgcagcacattttgcagcaacagtcagttgaattgttaactgattacgaaccagtatatgccagactaatagaagagaatgcatcaatagagaataatttggataatgacgagaagctagcttggattgtgaattttgaagaattgagaaaacaagagatggatataacaactgcacaagatagttcataccaaatcttgcccacgaacggcaatcccgtctaa

SEQ ID NO: 9194 - DNA, 1380 bp, Candida albicans
ttgtttttgaaaatgtcacataaagctttgtttaaaggaagaagatttgagagggatggtactttatccaattcatcttcaagggcccaatcagtttcgagaacacccttacggtccgatgactccgattatgaaagtgataccgaagaacaagattttattaaaattgaagaattattgaaggagagattatttggtctacaactgcaagaaattgaattagcaaaagaagatagaattggtgctggggacagaagacaatatcaagctgccaacattaacaaatctagaattcaagaaagttcaagcattaatgatatcattaatagtttagagttttcacgaaatgatgtgtcgctgcagtcgcgagaattgttacttgtacaattgtataaattacttgtttccagaccattagttgtttgtaatgaagaaaatgcggggacaccagaatttgttgatgaagacaaagttgctaaattaatcaatattttcacttctgcaaactaccgaagtgaagatgagtttttatacttgtttcgttcgttgattgcgttaatttgcagtgatattgaagagtttggatctttggtgtccactgaattgcttaatcacatccagcatgtcattactgaaccatcgaacagtattgtcactaacagtatcaaggctaatgtgattactgggtatgtggtgctaacattgattttacacaacggagcatcgagttttggaattgatgaaagaatagccatgttgattgaattggcagaagggtacacagcaagtgccactactttgaaaaaagaagttgaagctggtgatcgagaacattcgacttttattaccgataaaaatttggataagaaattggtcaatgaagctaatgccaaagtggtggccgaagcatcagttgctgttgcagcaatccacggagtgggttgtttgttgacattgattccacatggatcatttttgaatgaaataatggaagacttgatgtttaagcttgttccacttttagacaatgacgaggatagagatattgcaaaagctgccggaagagtgattggtgttatttatgagatgtatgattacggacaaaatgctgacgctgacaatggcggtgattttgataatgaatacaatgaaaactctccatattatgaacaagagtccttgctagctattttgactcgtttgctcaacttgtcatcgaagaaagtagcgaaaaaggataaaaaagatattagttctgttttcagaaatatttccaacacaataaagatctataccgatgcaaattcaagggaacaagtgtacaagagaacacaagaaggattagaattactcgattgtacatccgatctgagtttataa

SEQ ID NO: 9195 - DNA, 393 bp, Candida albicans
gtaagttttgcttatagccaaagtgacaaacatgatttacgaagattctctacaaatgatgtgatcttagagaatgatatcagtgattacgacgaagacgacgatgatgatgatgatgacagcagtgatgaaggttttaatgggaatggccatattatacacaataggactccaatatcagaacgaacagcccgagtatcttcatcttcttattatagtgatatcgaggaagatgcagtaaatgaagaagaatacaaaatcaaggcaaacctattaaaaatgctaaagggattccaatcgtttgattcaatttgtactgaattgaataagtcaagaactgaagttgaacaattgattgaaagttttggtgctgtaaatattgtcaacagttaa

SEQ ID NO: 9196 - DNA, 183 bp, Candida albicans
atcgcagcaccttttcaaattgaacaatcaacaaacaaccaagacaacaaaggaaaaaaaaaaaatttgtatagtaatccaatttcagtttggaatcagccaaagcacactaccacccatttaactgttgacaatatttacagcaccaaaactttcaatcaattgttcaacttcagttcttga

SEQ ID NO: 9197 - DNA, 198 bp, Candida albicans
gatttgatcgttgttgtgttgttggacgaaacaaaattacatcaaatcggagaaagaggaagaagaatctacccgttaaccacatatatcaagaaccaattgggaattaaacgtaaataccataaaaaatctattttccatccgctttatcatattaacccaataactccatgccagcttatcattcgacatttttag

SEQ ID NO: 9198 - DNA, 219 bp, Candida albicans
aaatcatattcaaccaatagcggtgttctcgtaatgcccgttgctaggtttttctttactcctgaattcaagaaaaaaaatcgtaaccaacaggcggacagacagacagacagatacaaatccaagggaataatgaataactcgagtcgtgcttttgcttcttgcactgtatctgcatattctaaaaataattacataatcgctaatttaaccttataa

SEQ ID NO: 9199 - DNA, 183 bp, Candida albicans
actttattatcgtaccgttgttgttgttattcttggtcaacgtgctcaaatcacttttgtgacaaaatatgtacgagaattgatttgaaagattccacaaattttcaatatctgaatgatactatttaccaaacttcatcaattaaaccgcgtaatcaatcccaaaaaaattacatatcctag

SEQ ID NO: 9200 - DNA, 192 bp, Candida albicans
acactcgagaacatatcggtgttcaagttgcattttgaacaatttgggaatgataatttaggttatgcttataatgtggttgacaacgatgtaagaatacccgatactacatttgagcttctaacacaaactcatgtgctggaatttaaatcatcaatagttactgcatttcaatatcaaggcgaaagataa

SEQ ID NO: 9201 - DNA, 210 bp, Candida albicans
gggggacatggtctttccacgcctggtcaagacactggaggaagaaaactattgttactaacatgggaagctgcatctaaaaatggagatgcaggttgtgatgaattatctgagtataatgaatgggatgaatattgtgatggtgaacgaggatttaataaattgttattgttgttgttattgttgttgttaccactaccattagtgtga

SEQ ID NO: 9202 - DNA, 309 bp, Candida albicans
ggctttttggctatcactatgagaaaagtttcacgccagaatacttttttttcagatgtcagggcaaaagaacaacttacgagctctggtcaaaataaaaagctaaaaaagacattgagagatatcaatacagaaattgaaattatcaatcaccgcattagtaatcagtttagatttaaatgggtccagggatcacatgaagcttatcatgtttgcaaaaccactcagatttcgagtattgaatcaaaatgtttcgagcacgatttagtccacaggaaatgtgaagatcattcgaggaattatatgtag

SEQ ID NO: 9203 - DNA, 192 bp, Candida albicans
tgcccattagtgtttttatgcttctctatattagcattaaatttttcgcctagcacagatattgaaaacaccatagagtgcaaattacttccagatgtcggcatatcatttgcatccattacatctgaaaatggtagtatagattctgaagatactagctctctggacgtcgtgaacagtttcacgtcataa

SEQ ID NO: 9204 - DNA, 195 bp, Candida albicans
tgtttgcatccgagagttttgatttattcagtgttgttttcattggttgagggcaaaaaattcgcatcgagcagaaaaggtcgtgcccggggcatagtggataggcaacgattactgatgaaccacatgtgctacaaagaccaaactagggccgttttgaagctacaatcatgtagagtattgggtgtgaattag

SEQ ID NO: 9205 - DNA, 201 bp, Candida albicans
aaagtattaaaagagatgaagtgccaaagagtaaaaatacttctcgtaactcggtcgtgtgagttcggtatcaatcttggtgccgacacagcgcgaaaatcacaaaatactgtggtgcgtgtaacctgtacacaatttaatataggggatcagtattaccgccaattgtgtaagtcaccagctcaacttacaccaaaatga

SEQ ID NO: 9206 - DNA, 372 bp, Candida albicans
  unsure (128): Identity of nucleotide sequences at the above locations are unknown.
aatttaattaaaagtcaattcaatttcctaagtattgttattactcctcatacttattttcaagattactataacaacaacttaccagtttcttctacagaagataaaaaacagcagttgtcggaaanatatttcaaagtgaaaatgtatcgacgtggtggtgtaccttcattttgtgggatatctcattttaaattaattagtgaaaaagaattaccagtattcataagatcaacaagtttattagcaagtatatttgcaaatgtttggcatggtagtaaaaatgtttggtctcaaagagttaaacaattgaaacttatatcgtcatatacgttgccccaactgaattcaacaacggcgggggccgtataa

SEQ ID NO: 9207 - DNA, 198 bp, Candida albicans
aatttaattatcaaagggcaaatcagaatgaatcttcagaatcaaagtttgttacttcaaatgataatcaatggaatgaatatactacaaaataaaagaatattactgtgtgtgaatggaactaatgtgtttaaagtgattaaagttgagaataatgtttggtacactattcatacaaaaggttgtatatgtcattaa

SEQ ID NO: 9208 - DNA, 708 bp, Candida albicans
cttatgcaacgctctatttcaaaggaaattagtaaggaatttactacaactaacaagtatggaaaagatttatttcaggctattgttcaaacgtatggagagatggaggtcagagataaagtcgcttatattgggtcgttacaggataaacttttcaatggagctattaaagagtcagaacggtttactgtccatgatgaactttttgattttcttgaaggtcattcagaaggtgagaaacgcgccctttccaattttctttggttgtattacacgctgtcttcttttgctgacaaatacttggataatcctttacttgctaaacttgacgtaccgactatgaaagcatatttgaaatatcaagattctctttatccaaaaaccattactgcatttacagttgataaagatcagagacaagaggcagatgataaagatcagagagaagaggcagatggttcagatcctattttcagagttcaatgtctcaactgttttgggttgggacataattcatctgattgtccttcaccagaaagagatggaatgattccacaacttgaaactagattgaatggatttaagactaggagaaaggcttttcaaagagtgaaatttaattatcaaagggcaaatcagaatgaatcttcagaatcaaagtttgttacttcaaatgataatcaatggaatgaatatactacaaaataa

SEQ ID NO: 9209 - DNA, 234 bp, Candida albicans
cgcagtcatttgttaacagtaattcatattttgtgcatttctgcactaccactttattcatctagatctttctggcaacttccatttgtcgtgttcttacgaactgaacattaccatatcaacacattgtgtcaaacaatcgttttattgtttgcttgcttgttgtggatagtaaaattatttattgttacttgtcgtcacgacattagacacgacacaacacaacaacaataa

SEQ ID NO: 9210 - DNA, 612 bp, Candida albicans
tctaacattcatattttttcattattacagtgcttttttttttttcaatcaactatggatgataataatttatatgatatatcattaacttcaacaactaaacgatcggtatgtcaatcaccattaccaccaccgacatcacaagttccccttcttcctcctccattatcacgtaactcatcaaataatttcagtactacttctttatcattagcatcaccttcatcttctataccgaaaagagtcccatcattaccaacattgaatgaaactactaattcttctactctgattaaacgtcctggtgattattatattcagaaaataaattcatcgaaaagttcattaaatttttctcctcaacaacaacaacatcatcatcatcatcaacaccaacaattaatgatgaaacaaagaatgtcgactgattcactcacgtctgcccaatcatcaatatcagatgatcattcaattatttcatctcaatttgatggggtggctagtactagttcaacagcagcatcaacaaatactcctgattcaagattaaattccatgacttctgattcttttaaagagtcttcaccacggcgctcgaagacaatcacgcgg

SEQ ID NO: 9211 - DNA, 195 bp, Candida albicans
tcaccaggacgtttaatcagagtagaagaattagtagtttcattcaatgttggtaatgatgggactcttttcggtatagaagatgaaggtgatgctaatgataaagaagtagtactgaaattatttgatgagttacgtgataatggaggaggaagaaggggaacttgtgatgtcggtggtggtaatggtgattga

SEQ ID NO: 9212 - DNA, 291 bp, Candida albicans
  unsure (284): Identity of nucleotide sequences at the above locations are unknown.
gtttggaagaaaggttggaagaaagaaagaacagaaaaaaaatgtgtgaaagagaaatcaacgccccgaaattgtgaaaaatttgggtcgactgacaaaataaagaatcactaccatccatgcaacgacaagaataagaccacgagagacgagaaaccaatgaacgtaacgcaacagtgcaacaaaaaaaaaaaactggttgtgattaaaaaagagagacaagaagcaaaaaaaaacagtactctagatagatggggagtgggagcgagtcagatatgtagtcntatatag

SEQ ID NO: 9213 - DNA, 198 bp, Candida albicans
gtagttacaacgatttatttctcatttcttccatcagagttacacacaactaatttgcttaatattggaaaaactattcacttgattttcttgtcacgaaactactacaacctccactcttccttcccttcaagcaaaaaaaaaaaagaaaagaattacgatctacattctaatttactaagttttacccgcttataa

SEQ ID NO: 9214 - DNA, 234 bp, Candida albicans
ccagaggaggataacggcattggaccacccgattatgaatgtggggtgagtctaaaggaaagaaaattaagtgatgataagatttctgatgaggaggaagaggaggaagaaacaggtgagtctgaaccggattttccccggaggaggatatcaaggaggaagaacccggagaagaagttgaagataccaacaaagttgagaacaacatgggaattaatctgcagccagaagtag

SEQ ID NO: 9215 - DNA, 195 bp, Candida albicans
atgtcagacttgaagaaaacagattccgccaacgtatcaataaaatccactacttcgacgctagcaagtataaaatcaaaggccacaagtttaggtcaaaagctaaagaagaaaccttcatcgaaaggtcatagcccgtctaaaaagaccacccaagtagaggcaatggctcactatctagctatgaaaagctaa

SEQ ID NO: 9216 - DNA, 213 bp, Candida albicans
ttgcttcaagagaatattcaacttgaaataatctaccttctggtgaaaaagtggatacaccacgatcatattcacttcttgttaaaaacatattggtctaatttgagaatgcaattggagatagaaagattgttagtttcacgtcaacttagttgtctaagagatttgatttttttttctacggttgtttattgttggtggcaacaaaaatga

SEQ ID NO: 9217 - DNA, 237 bp, Candida albicans
tattgtaatgaattaccagaattggtgccaataccaccattagctgttgctgaggaggcactggtggaattggaagcagatgtgttgttgttgttgttggtggctgtggtattgacagatccggaagtggaagtggaagcggtggcagtggaagtggtaccagtagtagcagtagtactaatacctgcaacaataggcaaattagacatggttgataacatttgtaacagacaataa

SEQ ID NO: 9218 - DNA, 1230 bp, Candida albicans
ttgttttttaaaatagttattcttttttattgtctgttacaaatgttatcaaccatgtctaatttgcctattgttgcaggtattagtactactgctactactggtaccacttccactgccaccgcttccacttccacttccggatctgtcaataccacagccaccaacaacaacaacaacacatctgcttccaattccaccagtgcctcctcagcaacagctaatggtggtattggcaccaattctggtaattcattacaatattattatactggaaataacacatctaatagtgttgacggaaacaaatactcacttccttctatttacttcacccctcaagattctataaataatactagccacacttataatccttatacaactgtttctggtgcagtaactccacaaaattatcaacttgattactcacaatcgtcaactgtaaataacaactatcaattcaccttaccaaatcaacaattatcgtcaccacaacaacaacaacaacaacaatacaatcggtcttattcaaattcattgatgccaaattatcattataacaatactaccactaatatcaatgctaatgttggttctaatacttcaccacaattatccaatagcaatacaccaaatccaattagtccagtattaattcccgataaagacaatacttacaataatactaacaatgttcttgtatcatcatatccttcaatgacaatgaatcagatacaacaacaacagcaacaatatcttcaaccatctcaacaatatcaatatctgtacaatcaatattatatgcaaccctattaccacaaccctcaacaactggcaccacaacaagtgcaaaaaccagcacaaacagaaaaattgccgcatttatcagtaacaaacattgattattcttcattagtatcatatactgtatctccttcattaaaacgtaaacgcagaactgcgaaaaaatctttatctccatcatcaacattatcattatcaatgatgattaatcatgactcaacaaataatggcacaacttccacctcaacaacaacacgatcatcatcaacttcttcagccacgtcatccccaatgggtgttgcagctgctgaatccttcccatgttctcaatgtaataaattttccaaaaaaccatttaatttgaaatctcatatgaaaaatccttccaatgaaaaaaccatatcattgttaaatatgttttaa

SEQ ID NO: 9219 - DNA, 189 bp, Candida albicans
tcaagtgttacaggatctattaacaaaaaagtaatagtgaaacaacaatggaaaatgggtttattgaatttggtggttgatgcttccttgtttattttgctctccaatattcgacagtcttgttatttgggatattttgcaaagaagtttgctcctattgaaatgttctttttatttgtcgttggataa

SEQ ID NO: 9220 - DNA, 225 bp, Candida albicans
atttggtggttgatgcttccttgtttattttgctctccaatattcgacagtcttgttatttgggatattttgcaaagaagtttgctcctattgaaatgttctttttatttgtcgttggataacgaaagaattattgaagaaaagaaaaacaacaacaatagattaagaaggaagaaaatgggaaacaatataaatattttcaacactggaagtaatttcaattga

SEQ ID NO: 9221 - DNA, 246 bp, Candida albicans
ttgattggttgggttaaaaattttttttttcataaagaaaataatgaaagtgagaaaaatttaaaccccacattacatactcaacacaacactacacacacgcatttaacaatcatcatcagttggaatatattttacaaacaattacgattgtttaatgaaaactatttctgttattattatttaaccttttttttttcttgttgggttgaccctttttctattaactatctaactaccacataa

SEQ ID NO: 9222 - DNA, 207 bp, Candida albicans
  unsure (76),(93),(142),(143),(148): Identity of nucleotide sequences at the above locations are unknown.
gaaagaactattttgcaatccaatattaggtcgtgtattttgttgccactatataaaactactgcgagaagggaangacgggagaaactgganaaggaaggaacggagtcgcattcctcatctccagtcgtcgtggagaagnnggggnatacacaaacaacaaaacatgtgcgcaaacaacagcgaaacagaaaaaaaaaaaaatag

SEQ ID NO: 9223 - DNA, 726 bp, Candida albicans
ccactatttatacacagcacatattgtataatgtcatcaaatcgtaaccagggaatacgattgccccctatatcattcttatccaaccaatatctgcagaatcttcaacaacatcagcaacaacaactgccattgcaattactgacatcaccacagatatcaacgacaaaacttactcctgcttcaaacataggtatacaaatgtatttgaataatccaagttctcaatcaccaaacattgcatcattatcacctccacaatctaacgaggataatgtaaataaaaatctggaaacattggcatcacctcctcaaattctttcatcagtgagtcaaaatcgtccaccaccatcacaacaacaatccccggtctattcacagtttacattaccacatataaatcaaccacaacagcaacaacaacattcaccaccacagcagcaacaacaagcgcagtccccaccacaacaacaatcagcaccaacaccaacggcatcaacatttacacattctataatacaacaacaaagttattcgccacctcagtcaaatgtggaaaatcgtctagatcaagattctataaaattcaaaactatccaacaatcagaacaacaacaacagatagtgcaacaaccacaacaagctgcatatcaagaaacacttggttcaagaaaaatccaaaatacgtccaacaacaagcaactcattttcattcacacatcatag

SEQ ID NO: 9224 - DNA, 249 bp, Candida albicans
gaaaatttgacaataagtaaaagtttatcctctagtgtgtttgagaatgtaagtttggttgagaatatgcggaaaagttggagcaaaagaagaggagatatatgtatgtatacaaaccaaaagccttgttttcaaacccacagaaagataaaaaaacagtgtaaggatgggaatagtagaataagtattaatccaagaattcaagaaaaagaaagacaagttgaagaattggaagaagttagtagttaa

SEQ ID NO: 9225 - DNA, 186 bp, Candida albicans
aggataaacttttacttattgtcaaattttcttacttcaaaacttgactactatactatcaaaccccccaaattcagtttatttgaaatttttcttaaccgttttttccattcatttatttatttcaatcagggtaaccccccagaaaaagagtcttcaccacggggctggaaggacccgcgctgc

SEQ ID NO: 9226 - DNA, 213 bp, Candida albicans
tggctaatatgctctaggcttggtagtttattgtgtattatgggtgtgggtttggaattaagtggggagacacaaaaaagtgagaagaagaaaaaaaaaattaaaaaattaaaaataaagaaaaatctcttggaaaataatgtccacagatacacgaaattcgatttatatctttcggaattgttgttgtgtcgaatgaatgatggtgtgtaa

SEQ ID NO: 9227 - DNA, 237 bp, Candida albicans
ttctttcttattaatggtttttattcagctcttgatgtgttttgcttattatccaccaattacagaaaactaccatatagttttagtatacatgtattaattttctggccttattttcaacaacaccaatcaattacagatctacatagtcttagaatttcaattgaaaaagtagtcgagataaaacctaagagagtaaggaaatggattgtattttacgaaaaatgtaattactaa

SEQ ID NO: 9228 - DNA, 1014 bp, Candida albicans
cggaggaatgttccacaattaagtttacaacgacaaaaacaagaacaatcggatattactactgttgatgatggacatggtagagcaacttttaatttaatggataatgatgataataatagtattcatagtggaaccaccgggggtgttactggtggcaatggtgattattttaccagtagcacttcaagaagaccaattttacctcgttctaatcaaagtttccttcaagatcatatggtggcaatgtcaccaccagtacatatatctcgagttaattcagatatcaatttaggtaataataacaacaacaacaacaatgccccttccaatttgagtccattagaattatcacaagttccatcatatgctgaagcaatgaatagtgatccaccaacaattactaatgaagaattattttctccagcttatgaaccaccattacctgggtctcatattaatttacaagaattaaataaaaatttaaccaatcttcaacaacaaaataataataaaattggtcgtcataattcttttaaaaattcaaattcgttcaaattacagcgatcttcatcgactacttcaagaaattcttcacaaaattcatcaccaatgcattcaagaactgtatcaagtaataatttatcatcattatcaggacatcacactaataatagtcatcatcatcatcaacatcatcattctggtgcaacttcaccatcatcatcaatgactaatttacaaagattaacacctgcccatcttgctcgttcaagtagtactaatcaatcattaaatataccaacaacaacaactagtggtggtggtgatggcggggcaacatttagtttatcaagttcaccaaatagtacaactgcatctactacacatcaaagtgttggtaaattatctaatagtgctgctgatcgaactaatggaggggcaacaccaataagaacaagttctagtttgagtttacataatttacattttttaagtaagaaaaagaaatag

SEQ ID NO: 9229 - DNA, 207 bp, Candida albicans
cttcgttgccgtgtgttcagtcacttaaatcatacatgcaactataaagccagcgagaaaagaagacccttaaaaaatatgagaaaggttaaagccaataattgcattacaaaatctccttattatacttcagtctatttatatattctacttttatctatttctttttcttacttaaaaaatgtaaattatgtaaactcaaactag

SEQ ID NO: 9230 - DNA, 204 bp, Candida albicans
ttacccgtggattatagtacaactttaaagttgaaacaagtacttggttaccatgcctctgaaattgttcccaggctaagccatccgggatttcatgaactaaatttcatgaaattttttcatccaggattatcatctttcttgtgtgcaaataataatcaagttaagattggtttatgtcttgtaaaagctgtatccccttaa

SEQ ID NO: 9231 - DNA, 687 bp, Candida albicans
ctaatgctgtctgccgccggcggtgaagacatcagaggaaagatcgaaggcataccatcagtgaatgaactttaccacaccaagaataaaattgttcccaacggagataattataacaacagaatatcagttgatttatatcctttagactcattcacacccatttcaacggtagtcgattctaaatacaattttaaatttaataacttggaaccaggtgaatatgaattacttgtgaattcgtatgattttggttttgaacaaaatagattcaagataatcgctgatgaggaatcaattgttgcttatgaacatgggattggtcaagaaacttacaataccacctcccttactaatcttaatgaaaaaccattgtctatcaagtatcttgctacaaaagaattttacgaatatcacggcgggagtcttagtgatttgttgatgaatagtccatttggattcatattcaagaacaagtatatgactattgtgtttactgcatgtcttgtaattatggctgccccatacattcttcaagttgttagccccgagtttgctgcggaattgaatcaaattcaaacacaaacagctaaggaaagactaggtgaaaaagttatcgagtcacctgaacctacaattaaatctacaggtgtcaacaaatctcaaggtgctaaaaagagacgatag

SEQ ID NO: 9232 - DNA, 216 bp, Candida albicans
ctcaaaacaccaatcaatggagttatgtttagcgaattacctaatcctacacatatagccaatgccaagataaactggggcacggtgtcgcaattggctaccgccataaacccacttgatatcattacagtaccaacgaccataggtaacatagcacccttaacatcaaataatggaccaactaccatacaattggcaaatgaaatcgctgtataa

SEQ ID NO: 9233 - DNA, 204 bp, Candida albicans
  unsure (92): Identity of nucleotide sequences at the above locations are unknown.
ctcgtattgatagaaaagttctccaacacatcaattcaagttattccgttggtgacagcaagaacgtatccactacaacttacactgcccanaaaatatgagattttcccccatttaatgaatgggttcccaaattatgttaccccaccaagaatccccatccaaaagaaaacaattccgttgcccaggccacttttcgttttt

SEQ ID NO: 9234 - DNA, 258 bp, Candida albicans
tatgaatcccgaattattaaggagttgaaatccgaaccaatgaatttgatattattcatcggaaatataatagtgctagttttgtgtacgattgattttttagtgtgtatatgtacgatgggtaaaaaacaaattattattagtcgtgtgagatttcgactaaaaaagaacaagagaaagaaaaaaaaagaaattttattattgctactatctaaagctcaattgattcacacgactattaacacactttttatttag

SEQ ID NO: 9235 - DNA, 189 bp, Candida albicans
gtaagactgaacccaagaaatagaaaacaacaacaacaaccgcaacaacgcgtttgcattttatctcgtgtacctgaatgtatagtacagatatatgttgttaatcacctcgtactcatagataaacgctcgggattattcaccccaaaatataaattgagtaaatacatacataatttgaaagtatag

SEQ ID NO: 9236 - DNA, 282 bp, Candida albicans
ttaagcacactacgaattatgataataaattcttcttacgaaccaatgctacagcaaccacacaatgacaattcttcatcgtcttctccaccacctccagcaccaccatcttatgcatcacatatactaaatgatattggatcactggcaccaattcgatatattggatcattaatcgaagaagccaatagagaaggtgacagtgacggtggtgacggtaacggtaacggtaataataatattcttgatacgattgaacaagtggaacattttaaatattaa

SEQ ID NO: 9237 - DNA, 225 bp, Candida albicans
aatcccaccagcagtagagataattcgaaaatgatttctgataaacttaatattacacataatgaaaatcctccaactataagccatccatataatattgtcacattagctccatccattaatgagatccataatgttgatgataatccaaatggtacccccattaaagaaaatcctaatccaatgactgatgtaacggttaatttacgttctaaatcttgttaa

SEQ ID NO: 9238 - DNA, 234 bp, Candida albicans
ttggtgattcaacaggaaaagtatatactttataaaagaaacgaatatactaaactaaatggtatttcttcttattgttgttttaattcccgtattgggatccggagaatcgccgctaaatctcgattaggaatcaaatcccgtgccgtggaatgtgcgaaaaatgatctatatttaaataaaataccgatggccctttttcctttccttgcctttctcttctttcccaattaa

SEQ ID NO: 9239 - DNA, 327 bp, Candida albicans
tacagttattctcttaatttagtgagtcttctaacgctagaatcttctacctatactctccacctcataatcgaaccaaccatacagaatacaaccttagtttataaattcttcttgtttatgttgagtggtcaattccgtttttcctgtctatttgtcagagcttgtgcgttgccgaactctcttactgttcttttcttttttctttctctctcatttttctgttcaattttttttttatctcacgagagttactttatttccttaaccaatcatatagcaaccattcccaccctaacaccaccatttaccaagcattattcataa

SEQ ID NO: 9240 - DNA, 189 bp, Candida albicans
atggaaaaagcaaataacaggagggagggggagaaaggatctaagtcaaatgatatttacaagcaaatcttgaaaaagctggaaggaagagggggggaaaaaaaagttagaatgaaacaaattcacaaatatgggaggcccgtaaagtcaattagccataaaatttggattatgaataatgcttggtaa

SEQ ID NO: 9241 - DNA, 201 bp, Candida albicans
tttgttgaaaacctattttttaaggttttcaaatgggaaggatttcatagggaggaaattattgagactaaagttatgttaaagcttctgtttctggaggggtttttgaagaacgaaaaaaagtttttatgggagtttatgttgcatcagacatgggtttcagtgatggagtggcagagcctggtgatggaatcggattaa

SEQ ID NO: 9242 - DNA, 294 bp, Candida albicans
ttagtaagatttttctgttccgcaagattttcttttttttttccgttttgcctttatatctctcaaaatcgtctcaaaaaaatgatccttgatttatttcgtatgtttgaattttataatgatgttagtgaatattatcatatacactctctttgtttacttaaggtagtagtattggattataatgacatatatagtcgccacaatctcttaaaagctattatgttgttcagtaacacctatatatattcaatctttttagtttttaaaaaggtgtcacaatcacttacgtaa

SEQ ID NO: 9243 - DNA, 183 bp, Candida albicans
  unsure (108),(161): Identity of nucleotide sequences at the above locations are unknown.
acagtaacatttcccaaggggttagtgttgcagtcagtgggtattgtgaaaaatgaaacgttattggctgtatcatttgtagctggttatgatgcagtttcttccagnaccgaatatttacacaacggacaggtggtatgtagcttaagccattcacatanacaacctttaccaaatatatga

SEQ ID NO: 9244 - DNA, 753 bp, Candida albicans
ttacaaattgtgtttaatctactgaaatcacaactaaatccccttctctccttctctccttcacatcacatatattattttaagatgcctgacgactctgggtcatcgaatggcagaaacaacagtaatgatttgctgggtggttctgaagaaggttccaacaatagaagaacaaatgaaggtaaccacaatggtcatagcaatcgtaatgatagaacttctgcttcccaaaattcttcttccaatagaagtaattcgaataggctgcatcgtttggactttggcatttttgatagatttatggatacttttttacgaggcagcagacaaagaaaccattctactcctggaccttcaccagtaagaaatgatatcagtgaacaactaacaaacgaaaacaatgcaagagatcaacaacaccaacaccaacaccatggtcaggcacagcaacaccaacagggatctgaacaatcaagtcaacgtgtgctgtctgaaccacctagttccaattcctctacaaataacagagacgaggaatccgatcgtgccataataataactgtcaattacgtattttcggacgaaaatagaccagcagtacctaatagatcagggtcgttaatcatgtctttgccaaacaatgcatcaaatcgtgaacctagtgtgattcaagaatttatccgattggccactcaaatggcatattcatcaattgttactggtctcaatcgtgagagggggactactatataa

SEQ ID NO: 9245 - DNA, 216 bp, Candida albicans
ccagctacaaatgatacagccaataacgtttcatttttcacaatacccactgactgcaacactaaccccttgggaaatgttactgttcaaaacaattttactaatgccccttcaaacgatcaacctacaccacgagtgcattattttggaattaatccgattccatcaccaggctctgccactccatcactgaaacccatgtctgatgcaacataa

SEQ ID NO: 9246 - DNA, 519 bp, Candida albicans
ggcagtatttatatcaacccaaatgaagccaacgttctgcttttctttgaacatttgcaatattttttctttgtaattaccatgacactgaataaatactctcaactagaagaaacaaagataattttcaacagtttgctctcattattacctgaagaatttatcacagagaatgtatcaaagataaagttcgagaatgattccaacaatttgatagttccttgtccattaaaacaaactgaaacaatttcagcattgaaaggtcttgaagcattggttgctttgaaattaactcaagaaagatttgggtctaacgatggtacatgcaaaattgatttagagcatgctttattattcttattttcaacttattgttcttctgttgatggattttttaaaacagataagaaagaggtcttgaagtatttaaaaccaactgatttaaatcaagcacagtcagacccatatcgaagaatgtcagccaatttgtatcgcactaaggagaaagatagactttat

SEQ ID NO: 9247 - DNA, 468 bp, Candida albicans
tcattaagcaagataatacgtacaaccatgacaaactattcaccaggcattcaaaataatgaaaaactaaaagaatttatcgtcaaattctacaaagcatccgataaagcaccgcgttcagatgaacaacatgatccctatttggattttttcaccactaattcccccctagttatgggattgaaaaaagtagagggacatcaagaaattgctcaattacgacaagggatgtgggagaaagttactcatagacatcatgtggtgaacaatgttgctgaaatcaatgaaaaagaaattttgctaaacggatatgttgagtatactttgatcaatgggaagaatgtaaccactgaatgggcaggtcacatgaaacttgaaaacagcactggcgatgaaaatggatataagatgaattattatcaagtttatttggatccaagtgccgcagcaaaagctttgagtgaataa

SEQ ID NO: 9248 - DNA, 183 bp, Candida albicans
ataagtgaaaaatcccagaaaaaaaagaaaaattatagtaataacaataaaagaaccaagataaagtttgaatacccacttatcataaggggcctatgcgttaattttcaaacagtcccaaaaaaaaaaggtaaaactgaaaagttgataaaaaataaatctaaaggggggaggaaggtatga

SEQ ID NO: 9249 - DNA, 219 bp, Candida albicans
tcgatgtggttgataagaaaaaaaaaacatactaatttggttggtgatccttattgtaatagtttatcaaacatgccttggaggaggaggagggggggggagagtgggggattaacaaatgaaaacgaaatgaataaaaaatttttttttaaacttcttgatatgattatgtcggcactaaatagaacattggcatttactgttcacaaccaacaatag

SEQ ID NO: 9250 - DNA, 201 bp, Candida albicans
  unsure (167): Identity of nucleotide sequences at the above locations are unknown.
cagagaacattgttgattgacagttgcaacttttcccttggccaggaatataatcaattggtcaatttgaaagtttattccgaaacaacagcatttaccagaaactaccaatgccacaacaaaatactattttttcattacatcattatcaacatcatcttaatatntaaatatgaattaagaaaaaaacttcaaatctta

SEQ ID NO: 9251 - DNA, 762 bp, Candida albicans
gatgcaaatataccttgtggaatgaatttatcagaattattggattatcttgaagaatctattgctttccccaaactaatagaaccagatgatttccaatataatgatgaaaaatgtttgattgtttttttggttgaattatataagatttttgaaattgaaaaaagttataataatgttactgttgataatctgcttggatttgatcaagtgattacggcaacggttgaaattttcaaattgaaaagtaaatacgaatcagaagctttgaaattatcaaatcaattaaacactttaattaatcaattatcattagatatttctgatttaaagaatgatttcactatggatatattgtcttgtttaaaattattggaagattcaatattggattcaacaaagttgactcctttccaaaatagttttaatcatttgaatgtaaaactcacatcattagtcaatatattacaaagatttcaaaatttccgatttgaaattaaatcagaattggtctatcaaagctatccacaaattattcaaatacttggttcaatcaaaagcatgttacaatcatttggagacattgattatattcctgcaagcaaaacgttaaacatagatcctatttccactaaattagaacaactaataacattagactctttgatcttagcagaaatcagtgaagtgatattaaacacgaacagtgaagaattattcattcaattaagtaaagttttcaacagccgtcgaggatcatga

SEQ ID NO: 9252 - DNA, 222 bp, Candida albicans
atgatccatttttcaatggtgtgggaactgattataactttaatttcgatagcaagaatggttccattcaagatcctttatcgtgtcttcaggatgacaactttgatcttgcatggggcattgggtgatcaaagtcctattggtaatgaaccagaagccgatccaatttcattattaacaacagaagaatctatatatgaatccatggacaaacaacaatga

SEQ ID NO: 9253 - DNA, 216 bp, Candida albicans
tatctgtcattttttatgggaataaggatagttgaaaatggttgtttaattcttggtgtagaatgtattgaactaattggtttctttgtatgggaaaaaaaaggggggtggaggaaggaggagggaggaggcgaattcaattatgaagtagaacgtgtggcaaccaaaaaaaaatataatagagaatcaaacacccttgaatggaaatatgaataa

SEQ ID NO: 9254 - DNA, 195 bp, Candida albicans
tgtttagtgttggagcataaaattataattcaaattctaacccaaaaatggttgattaatgcagttaaaagcaaaacattcaatatgatcagcggtcaaacaaacttgccaaaagaagttgaaactttaacaacaaatacaacaaaaaagaaatgtatgctctcaacagcgatcagtaagtcaaaatactggtaa

SEQ ID NO: 9255 - DNA, 261 bp, Candida albicans
cctaatccatgtattaaatcagtggttcctccagctgatactggagttggtgtcaaaattgaagttgaagaccttgttaaacttgatgtacgagacattgttgttgttgttgttgttgttgatgatgttgttaatggggcaggtgatggcgatggtgatggtgttattttcttaaatgataaagacagaataatttcattcaatttatttttcttgatttgttcattaataatcttagctgtggtttcaaaacttgcataa

SEQ ID NO: 9256 - DNA, 846 bp, Candida albicans
acagacttaccacttctttatttgctctttttcttctttggctataagcatatcataatgtcacccaaatataaaaattattctgtcatcaattatcttgctttcaattatgctggatttgcatgtgttgcaataatagttttcctttcttctactcaaccattttttatcaaagaaatcattggcattgatcccactactgccaccacttccaccacttccactagcaaaaattcaaaagatgggaaaattggacatattgttggaggattagggttcattgatgaattaactgccatgatagtagcaccattattaggagcattgaatgacaatttaaattcaaaacaatataatggatcaaaattaattcaaagtttcagttttattattattgccatttcattatttggatatgctgtatggtgtaaaaatcttgttccaaatatgtttatatttcgaagtatatttgccattggggtaactggatgtatgagtatggttaccgtcatactcaatgaattgacaatatctgattttgagttttggcgttcaaataatcaagtcacttcacaatacattcctttaaatcaagaagaagaaggtgatgatggtaatgatgagcaacaacaacatactagcccagacacattaaagaagaatgggaaatttgctggtttaatgggagtttgtactggtttgggtgccatatactctgtttccgtttttgttacattgccaataaatttgggtatgaaaaacgcttatttggtggtaagggttttgctttactctcctttgcaatataattttccctttttgtataatgtgcaatggcaaagataa

SEQ ID NO: 9257 - DNA, 213 bp, Candida albicans
acaatttggtgcaaaagctttgtcaaaactgtaaagcaattcccattggaatattttatgcaactgtctctattctttgaatttcaaggaaatatgacaccagggtttccaacattcataaccttgaacttatttcctaatccaggaaattgggctgcgcgtttgactatatcagttgaaatcagatacgtaaactttttctcatttttgtag

SEQ ID NO: 9258 - DNA, 216 bp, Candida albicans
tctattccaatatttgaatatgttgtacccacaattcgttacctcctttgttcatttacatcatccattaatgtaatagtccttgttcgtagtattaatggacatgtttcttgtttgggtgtgattagtttatctaccactatccaagatcttcgatttaaaaaattgctattgttattgataattcttcttcaatctaatccatctaagctttaa

SEQ ID NO: 9259 - DNA, 201 bp, Candida albicans
ttaggactattttccctcaaattatctcttacattggttagtttgattagaggagatgagcaagtggtgtggctagttttgaaagattttgcaatttggatgagctgcaattatctgtccattatacgtattaaagtaagcttaaacgagatttcaattcggttcaattcatccactcacgttcaagtaactcaacactga

SEQ ID NO: 9260 - DNA, 1566 bp, Candida albicans
gaaaacattgatgataaaactcggttacgatcaaatagtgtgaaatcagataatattaaagttggagtacgacaacgatcatctactacgttatcattttggtcagttggcaccgataataagagtaataatgataaactgagacggggtagtacatctggtaaagaagtcagtttaccagcatggatgtttcttcgattattaccattttatactgatgataatgttataaccaatgaattacaaagtgttgtgaaaacatctaaagaatttgccaccagaagaccaattttaccaatttgtttaaaaagatatcgattcaattctggggctgcttcagggactcgatcacaaaaaagaataattatcccaccatttattgatttacctcaatttgttgctgatgatattgatgataatagttgttcatttagattaattcttgaaagtgctatatgtcatcgtggggataaaattgaactgggtcatttcattgctgttgttcgtaaacatactaataaaattaatgaaactgaacaagaagcaaataattcaacttggtatctttatgatgatatgaaaaaaaattctcgagttgttgaaaaaacttttacagaaatttttaaagatgaatggccatatatgttattttatcgattagtgagtaatcatgaagttagtggtgcatcatctataaatagtgataataatactaacaacaacaacaacaacaataataataataatattgttgttccacctcaaggttcaaaaggaaattattggttgtcacaggaggaaacatcaccacaaccattggaaaccaacaataatttatcagtgaaaacaccaaccaaaagtattccaattctgaatgtatcaccaatagatcccaaatatattgatattagaaataaatattattggtatttcactgatgatgataaaaattattttaaagaagaatcaataaaattaaaagatggtaattctagttttacattaagtcctcaatttagaagaaatagtcaatggagtgttaattcaaatattagttttgtacaattggataaagataaagataaagaaaaagaaaaagaaaagaaatcatcttccaataataataataatagtagtattcatactatcactagtaaaaattccaactttacaaaatcgaaaattgaaaaaccagatattgatgatagtattactggtgctactaatactactactattacaaaaccatcaaatttgcttaataaagaaaatgaaatcaaatcctctccacattcatcaatttggaaacgagcaattaaattgacaacatcaccaagtgttaaaattgattctactgaatcagtaggagaacttaataaacaaatatctccaattaatttagatacatcaatcaatgatactactactactactactacttcattacctaaaacattaagaaatttagaaaataatcaaaagaaacatcgtcatccattttctcataaaaaatctaaatcaaaaagacaagatgattataaaaaagaacattgtataatgatgtaa

SEQ ID NO: 9261 - DNA, 705 bp, Candida albicans
atgccaagtctaagtgaatttacagaagcgtttctgctctttattggtcgcgtgtgcagcattggtcttggttctcagaagaaatcactattatacaataacgaaatgtccaacttgaacacattgctaattaagattgaggacgaaccattgattgatatcgataaatgcaaaccgttgttaattgatagtattgacaagtttttgcaaatgattatccaacaagaatatgttgatgacaagttgagttggtttgcaataaacttatatcttagtaagtttattaggttggttatatatccagaaatccaaatgctttggccaatattgcttagaaccacagtttttacccacgactttagagtattgcacaaggttattgaatgtgctttgtgtgacaatcccgtcgtatcttggatcagctcaaaaatcttgctaaacatagttcaagtggattacatgttctcgttggtgaaggaatcaataaacactaaggaaaatataaggaagtttaaaaatttgctatggagaaatagtggaataactacgctcacaaatctaatttctttatttgtcaatttgcaacttgaacccgaatttattccaaacttggtcacaccatacattcggtacatccattcagtaaaccccaaattttccgactttatcccgtgtacagttgttttgaaaaaatcaaatcattga

SEQ ID NO: 9262 - DNA, 303 bp, Candida albicans
cattctggctggattcgtttggaactgcctgctcgtgccgaactaggtttatcaaaagttcaacgttttttttttaattgggcaattatacttttcagttacttcatcgaataccatttgtcgacgcaagctttatttattgaacatggaatggaactgaagattaaacattcttcaaattctttctgggataccaatttttacaattggtttatgcatgccacgggtcaacaaacagtttccctgaattttccatctgaaatattggttattccgatagaaactcctctaattgaaatttaa

SEQ ID NO: 9263 - DNA, 222 bp, Candida albicans
ttgagagcccattatatatattttgtgaaagctggtcaaagggtagagtattttaaacgtgtgtgtgttttaaaaaagttttgcaacacagatcgtaatgagaacaggcaagccaaaatgaatgcggaaaaaacagacagaataaacctgtacaataagccagccaaacaacaacatttatgtaatagtcgaacaggccaaatccctttctttcatttttaa

SEQ ID NO: 9264 - DNA, 192 bp, Candida albicans
gatgatgatgatgatgccagaatcttggtgaaaatttttacaaatattggaaattcaattttcgttgtttcaatgattattgcaattattctctattctcaatccatgttgttgattaacgtttccatgatactccctgctgtacaagacttattagacttcatgttgtttcctcacatacccattgtttag

SEQ ID NO: 9265 - DNA, 195 bp, Candida albicans
gacattgataatttgcagcatggtggtagaaacggccaaaagagtcttgatgtagcctatgttttaggagaggggggtggttggtcagtaaaacaccaaagaacaagttttactaagtatgcttgcgatttccggttaaagtttccccagaagaattaccacctctcttatgcaaaaggtttgcattcattgtaa

SEQ ID NO: 9266 - DNA, 204 bp, Candida albicans
attatttatatatctaaaatgccctttaaacaaaattggaaaggggagagaaagaaagagagaagcgtatacggcattataatgaattttagaaatttcagggagataattaataaaaaaaagaagacacaaattttgttaggacaaatgcaaaaaatttttttctttctttttctttttgggaggggggtgatgatggattaa

SEQ ID NO: 9267 - DNA, 258 bp, Candida albicans
tggaaaaaaaaattgattgagcaaattataataaaattaacgagtttgaagaatagacgagatagatcgaaagctcttttggtatttaaaaaattatgtcaagcctatacaagtctacgaatgtcaagaataatccccctgaggatttacaataatcaagtttggggaacagtccctataattttgctgtcatttttgaaccctattctttctcggattgtggaacatccaaatagcgtaatgtttaatatttcttaa

SEQ ID NO: 9268 - DNA, 312 bp, Candida albicans
caatcaatagttaataacaatgccattttaaacaagaactcaaagtcaataactcaaaatttaaatcagatttttagattcaatttactactcacaaaagatttaacatgtcatacatgtcatacatgtataaacagagaattttataataatacagtaaaccttatagtgatgacggactttaattctcatttttatctctcaccagttgtcgttgttgttgttgttcttcttttttttcagagcctcatcttgttttttttgttcaatcttacaagagttgtaagcataataatcttcttcaaaatgtaa

SEQ ID NO: 9269 - DNA, 198 bp, Candida albicans
tcatattattatgcttgtcatactcttaagctagtagatttgtttagtcaacatgttcaattaatggactctgtacatttcatggcttataaacttgtgatcacacgtaatataccctacttgaacaattttggagagtccaatataataacacaaaaaaaactctctgccaatacactatcacaaagtaagaattaa

SEQ ID NO: 9270 - DNA, 183 bp, Candida albicans
tatttcgagttaaattgtttgttttgtagtaaaattggagatatagtgtgggcggggggtgtacttttagatgcgaaaaaaaaagaaaaaaaaaagactttttcaactgcagcagccatcaactccttccaaccaacaactgattctgatcatattattatgcttgtcatactcttaagctag

SEQ ID NO: 9271 - DNA, 1812 bp, Candida albicans
  unsure (550): Identity of nucleotide sequences at the above locations are unknown.
gtaattgggtatttccacgatcaagccattctaaatttgaaatctgtgaaacgcgtattttttcgaagatttaacatgccagttccaactagtactttaattaaaactgaggaagaggaaagagcaatcaggttagcagaacagcaacaagtttgggagagacaaagattggagtttgaagaaagaagaagacgcgcagaatcgcaaagaattggatctcctttcaaacacccatggtggactgcctttactgatgctggtcctgaacctagatgcttagatgaatggttgacagttgagatctccaattcaattagagagaaaccagattggaaaaccaagtacaagaatgaagagattgttactaaatggaaacgagaaattaaagaacaatgtccagacaaaaccaaatatttagatcaaataattgattatgtgtttaaggaattacaatggtatgaagatgtggaaaaggatttaaacacgtttcaaattggttgtgattacagaattgcatactctgatggtgctgtcaatgagactttaaaanagagtttctcaattggagctcaaaaattagtggaatcatttggaagtgacattgactatcatccaggatctcacaatcaagttattgatttagttcatctttctttatacattgttcaatatgataaaacctcagttttgaaaaatggacaattagaaattgtcaaatatggagaacaaattgaacatgcaaaacctggtgttgatcaatatggtgtttctaaacgattccaatggatccctgcacttatgactaaaaattcaaatgggaaatttgagtttggctcttatatcaacaatttacatcctatcaaatataaaagtttgtatgattccattagtgatatttttaatgccgctgttccaggtttgaattgtgtattgaccagatacgcttcgcaagagtttgttcgtattccagttcctagaggcagtgatgcttacactgatgagtaccataaagaacgtgaagaattggatgcgatattggaccgtgaagcagaagaaacaggcaatgattatgattgggaaagaatggaagagtttgaaaaggataaactgaaatatctttgtgaattaattcctgaatgggaacaagctcctgtttttgataaaccaattgatctttccacatttgagaatttaaaagttattgtgaaattgataaatattgaactcacacccgaaataaaccctgtttatgccggtgggtcatggcatgttgaaggtggaatcaacgaagatattattgcaaccgtgttgtattattatgatgttgagaatattactgaatcaagactttccttcagaattggatttgatgatcctaattatgaacaaggcgacgatttttatacagaaacaattttcggaataaaagatgaaaaggttatggttagagaaattggcggaattgaagctaaagaggatagagttgttgtgtttccaaatatgtttcaacatcatgttgatccttttgaattgaaggataaaactaagcctggtcatagaaaaatcctttgttttttcattgttgatccatacaatcataatgtcattagtactgataatgttccacctcaacaaaaagagtggtgggatgattctagtttagattatttgttccctggaaatttgaaacaacaaatcttagacttaaaaggagatgaatcctcttggccaatgactttagaacaagcaaaagaagctagagttgccttgatggatgaaagatctgcaaaaggtgaaggtgatgaattctaa

SEQ ID NO: 9272 - DNA, 267 bp, Candida albicans
  unsure (181): Identity of nucleotide sequences at the above locations are unknown.
tgcattggaaaaactcaaccaaggcgaaaaaaaaccaaacaaattcaaacaaacaacaatatcaataacagagggaaaacacaacaccaccaccactacacactcgtcacaatggtaaaaaacactctgtataagaagcaaaagctatcatcaagaaatcgtattattaaccaagaagtcncattattccctcccaccaaatatgagaaatccaaggcaacattaaaacatttcccatcatcaatcgtcaatggggttcactgctga

SEQ ID NO: 9273 - DNA, 222 bp, Candida albicans
  unsure (107),(197),(204): Identity of nucleotide sequences at the above locations are unknown.
agaagattatatttcataactttcaagtcaataaactgtgcttcatttgttgaaaataatgaattaatgaaaactgtattcaaagtatcaaaattggaattatcganagtaacagacaatgacgatgttgacaaattgaaaaattggaaacaaacgttggaaaatgatattaatgaaattgaaaaaatcagactcanatgtggncaacacaaatattgttag

SEQ ID NO: 9274 - DNA, 525 bp, Candida albicans
atctggattaaacttagaatttcattttatcaaatatcactaccactaccattaccgataataaatatgaaattctttactggtgctactactgctttattattatctgctcaagctttagctgaattaacttcctataaattatatgccaaatctgaaaatactgaagttgatggtaaaggtgtttcaattttacatgaaggtgcaggtatctattttgtctttttaggtactgaaagcattgatgttacttatgatgatgttgaaaagcttttatatgtcccagttagttctgatattcaattcaattttggtactaatgctgatattgtccaattttcagtaacccctccagtttcggttgaaattgctgaagatggatcggtcaattttgaaggatctgatgaccttttcgccgcgcaatacattaatgatccatataactattccaaggattcatatgcagttatccttagaggtaaaccacatgccattccaatcaaacttgttgctaagaagaattag

SEQ ID NO: 9275 - DNA, 189 bp, Candida albicans
tataaccctccagaggtggggatggcacttccaagaaatgcaagacttgtaccaacacaaaggataaaaatggatgccaggatccagccccaaactaaagcagctggtccaccttctaacccaattgataataccgaagatatactaggtaacaaacccatgatggagaaagcaataccaaaaacttga

SEQ ID NO: 9276 - DNA, 219 bp, Candida albicans
ggttttatattgaattttttcttgtttttaattggggggtggtttatgttgtttatagttttagattccattggaaataataataataattacaacaaaaacaaagacttaactaaaaaaattgtgtgggaatgcaaattgctgcaaaatggtgataagttgactgccagattatttatctttgttttattccgttttatccagttctggctcttctaa

SEQ ID NO: 9277 - DNA, 201 bp, Candida albicans
attaaggcagataagtcaatcacatttaaagctgaagacaagagagaagggtcagttgaaatagatcatggtcaagaacaagttctagttgaatcaaagaaagccattgatagtaatgttgaagattctttaaaagatatagataagtttttagaagaagcagatgatgttgattatggtgatatttcaatggatgattga

SEQ ID NO: 9278 - DNA, 249 bp, Candida albicans
tgtgtttcaatactatctgtatatttttttttctcgtcgtatcgtaaatggcagttgacagaactttttccatcaatctcatcgcatttggttgccattaatgaaacaattttaagtcgcgcaaacatgaaaaaattgaaattcaaacttaaacacaatcatcataatagttatctattttatggcttttcgagcctttttttttttcaagtttatcattatgtcattaattctagtaaacttatttaa

SEQ ID NO: 9279 - DNA, 189 bp, Candida albicans
tttcgcttatcttgtttacaaacaaacttgaccatgcatattgacaacaagtccaatgttgccttttcaaaagctgccaataaagtgaatcaaattatttatagaaatattttttctataaaacatcactgtaactttaaattaactacaacatgtatcttgcgtttatgcgttaatatgatcaattaa

SEQ ID NO: 9280 - DNA, 273 bp, Candida albicans
tatgaaagaaggaaaaaaaaaagtaaaaaggaatggatgaatgatagaaaagtaaatcaatacaaccaacaagaaaaaaaaaaagaaagactagcaaacaaagtaaaaaaagtaaagaaggaagaaaaaaaaaatttcgttgattatgtcgaaatccactctctgtatttttttctctctttctctctgactctgttactctctcactctcgctcactcactcactttcccactttgttagttttttttctgctgtctccccacacaatttaa

SEQ ID NO: 9281 - DNA, 222 bp, Candida albicans
ttttttttctgctgtctccccacacaatttaaaattaactggagggagagagggacaaaaaaaaagtttcgtgacctgatggaaagcaaagaaggcaaagaaaaacaatttcttcgtgttaaagtggctaaaaaaattagtattccatcttttgtgcacagccggctcattcactcattcacctactctcactctctctttctttctttctcccctttttga

SEQ ID NO: 9282 - DNA, 336 bp, Candida albicans
aacacaatcatcgccaacaacataatactatcagcaggccattcgcgctacttccatcaagacaaaactttagtaccctccataaagcattcggttcctacttcccataacttccacttgaagtatacccaatatagtgaatgcttcccattaacctaccaactacaacataaaataacgctactaaccattttcatcagttcaaacataattactaaaaatcaaaccaactgtacaataagtttacatattcaatacaatacgtcttctgaatttgtcgaatctaaaacgtcacaacgagggtttgtagaatacttagcattccaagtactataa

SEQ ID NO: 9283 - DNA, 189 bp, Candida albicans
tttgtcaaaaaaaatgagatatcaatggttctcattttaatttacaacggagcatcacggaataatcgccaagtgaatatcggatccgtacttctctatagtttgaggcttaaacttctatatttgcttctttcactagatacaaagaatatggtcatcaatacatgtagatattcaattctttggtaa

SEQ ID NO: 9284 - DNA, 219 bp, Candida albicans
caggaatgtaatctattaaacttgtttgctgacatcctaaacgaaagtcaatatttgggcaattggcctattacttatatcttattaatcaacactagtactctttactttcacatagtcaggtctatattattaggaatatcgctcagacaaactgaacttggggatatactaggcatgaaatcatccaaccaacccatgaaattaattagtatttaa

SEQ ID NO: 9285 - DNA, 258 bp, Candida albicans
tatcaatcctatcattatcttcttggtgtatatgcaaaaaaaagtgtgtaccatggacaattgcaaaaaaccattttcctttctttttctttctctttttatttgaaagattccttttgttttttttctttgctcaatttatcaacaaaggtcaagaatagttttcaacccacacacattatatatagagaaaccctagtcagttcaacagctttcttatatgacatcgaacatcacaaagacaaacaacagcataac

SEQ ID NO: 9286 - DNA, 276 bp, Candida albicans
gcaaagaaaaaaaacaaaaggaatctttcaaataaaaagagaaagaaaaagaaaggaaaatggttttttgcaattgtccatggtacacacttttttttgcatatacaccaagaagataatgataggattgatactatatatatatatataatgttgtgtgttttaatttcatttgagttaagagtattgaatgattcaagaataatattctggtttcatgagtttgcttgctataaaatattcgagaaagaattaacaatacaagtattttcataa

SEQ ID NO: 9287 - DNA, 285 bp, Candida albicans
ctaataatagaaaaagatgggtttgaagtatttgaaaatgatagggaaatattaaaaaaaagaaaccactacaagcaaggttggtggaaatttcgattgatttatatattacagtcaagatttcttttcttgttacaaagaataaaaggatcgcataccgagaatgtatttatgcgtgcactagaaatagtagtagacgatatacaagaaggatctttaatttggttaaacatactgatgctgttaatcgtcttaacttacttaatgtacatcaagaatttttag

SEQ ID NO: 9288 - DNA, 282 bp, Candida albicans
ggaaatattaaaaaaaagaaaccactacaagcaaggttggtggaaatttcgattgatttatatattacagtcaagatttcttttcttgttacaaagaataaaaggatcgcataccgagaatgtatttatgcgtgcactagaaatagtagtagacgatatacaagaaggatctttaatttggttaaacatactgatgctgttaatcgtcttaacttacttaatgtacatcaagaatttttagttttcagtaatttcacctcccatctactactactattataa

SEQ ID NO: 9289 - DNA, 246 bp, Candida albicans
agatattgcttgtttgtttggtgtattactgctactcattgctggtatataactgtggtttttggaagtgactttgtagaaaatgatatatgtgatgttcgttgttgttgtttttggtatcacaaacaaaaaaaaacagacaacccacgaagaaaatcggaaccaagatttttaaaagagcgtgcacgaaaaactagatgtgtgttatacgctatgctgcaccaaaaagtagttcatgctttttag

SEQ ID NO: 9290 - DNA, 192 bp, Candida albicans
  unsure (147),(162): Identity of nucleotide sequences at the above locations are unknown.
tatatggaaagacggaacaaacaaataagtttaagtgtgtgtaaacgtgtgtgtgtacaacgagaaaaaaaacgaaataattccattaataaacaatcttttcaaaacggaattgaatcccctaagatttcccctcctgaaccgacnagatcttttcctccngaacccccatttttttattctaccagttaa

SEQ ID NO: 9291 - DNA, 453 bp, Candida albicans
aaatcttggttccgattttcttcgtgggttgtctgtttttttttgtttgtgataccaaaaacaacaacaacgaacatcacatatatcattttctacaaagtcacttccaaaaaccacagttatataccagcaatgagtagcagtaatacaccaaacaaacaagcaatatcttcaaatgaaagacaatcaataatacgcacaacattaactccaccatcttcaactaccagtggaaatcatcctgatccttcattatcttcatcatctgctacacaacgtaaattatctcatctaaattctcaaatggctcaattaaatgcaaatctatgtgatttcaatgatttattggtgactacatgtagtcaatatcaaagtatagaaaaattagggaaaatccatgcaagtatatttatggctggtcatacagtttttgaagatgaaaatttcaattaa

SEQ ID NO: 9292 - DNA, 258 bp, Candida albicans
aatgtcttcctccttgacttcgcaaaagcaagtgattggctaatggttcaacagtgtgaaaaaccaactattgcttgttttgcaattgctcttgattatattttccaaagtgatcggaccctactccctcatgatagtacaaaatctaaggttagtaccccctgttataagataatttatttcccattctttttattagacaaacccttatcctatatatattgtttaaattcatttttttgttctaacgaatattga

SEQ ID NO: 9293 - DNA, 252 bp, Candida albicans
ttattcattcaactttcaataatggcagctgctacaacgtccttttcgtcgggattcaataataacaacaatgctgatcaatctactgatagttctgctactatcagtaaatcaggtaatgttgccagttttaaaaccacttccactacttcaacctatcaaacaaatttaactgctattgatacttatggtaatgaatttaaagttccagattataccattaaagatattttatccgccattccaactcat

SEQ ID NO: 9294 - DNA, 183 bp, Candida albicans
aattcttggatcaggataagaataatcccgcacatttcaaaaaccttaaaggaaaacgtttgcattcaacgtgttgccgtttcatttctttttgatagcttaatagtgttttttagactgatcaaccatcaaccatcaactatcacccccgtgtcaaaaaaaattatgctattagtcacgtga

SEQ ID NO: 9295 - DNA, 246 bp, Candida albicans
tctgaggaacaaaagaagaacaagccaagagagggcgagtctggttcaatcgccaacaaaggtgatattgacgactttaacaaaaaagttaattctgatataaacaacaaaaccactggtgtcaatggatccacaaataaaccaaaaccacccacacaggcaccaccagaagctcctaagaagaaagtcagtattagggacaacactacattttccttggaaaaacattggtggttgggatgttga

SEQ ID NO: 9296 - DNA, 267 bp, Candida albicans
gatgtttataggaagaaaagaaatttgtccactgcgcacgtccttttttctatgctagtaaccatcaaattttttgtcataccaaatcgtagggagagagagcaagggcgaaaaaaagaacaaaaaaaaattcttgaaccaattgagttttatattatagtaaacatacaccacattaaatcacgtcaaaatggtatgtcgacgataacgtttgaattggaattatcaaataatgagagagcaggggcatacatcgaagtcagatag

SEQ ID NO: 9297 - DNA, 231 bp, Candida albicans
attaacaagatcaagaaagtcatgcaaaatataaccaatgtggcagaaataccatcaacaataaacatcgctataatacatactgtagcaccagcgaaagccgttttgctactgaaatatttgaacgatggtctgaaatttggagctgagcccacttttaataagaaacaagcaatgttagtaactatgaatgtcattaaaaatgccattgttataaatgtggcaatttga

SEQ ID NO: 9298 - DNA, 234 bp, Candida albicans
gctttttttaatttcaatgtttttaaaaaacatgaaattggagtccagcaaacaataaaaatctgtgctaggttatccgtatctcagatggaggagaatttgttaacgccagattcgaatcccaaaagctttataagcttttccattcagtccacagaaaggacgtcaaaagctactcagatgacttcatccaaagaacgcgatacacccgtaaagaatggactgatcccttaa

SEQ ID NO: 9299 - DNA, 243 bp, Candida albicans
tttaccaaactgattcagattagattttgtattctggaagatagttttttttttcgagactctttttttttttcgttgcaagatacatgtattctacaaataaacgaaacacaacaactccaaatacaagtggtgcatttgactactagaatattgatccaatcaatcactgattacgaagttgttatcttattttcaagatataatcattcagctgagtttttttttttagaatttcattaa

SEQ ID NO: 9300 - DNA, 309 bp, Candida albicans
cattacactatgataaaatctgaagttttgagtggatctgcatccaaaactgtgggaaactctatatctaatggtacaacagtactgactcagaatcagggtggaaaacagaatctaatccgtcagcagcagcaacaacaacaacaacaacaacaacaacaacaacaacaacaacaacagcagcagcagcaactcaaacacagaactgctcttcaaaattaccattttgcctcaacttcggaagagatcttaaaaaaatactccaaatatccagcatccatgagtttacatatttttgaaacgcattac

SEQ ID NO: 9301 - DNA, 351 bp, Candida albicans
aatacatgtatcttgcaacgaaaaaaaaaaagagtctcgaaaaaaaaaactatcttccagaatacaaaatctaatctgaatcagtttggtaaattattagaggaacttcttacaataaaaattactttgataacagtatttatttatgggctatatataattcagcttaagcttgcctctgtgttaagacagaactctattgatttaaatagtttgattctatcgctttcattaaacacccataaaccgtatatttcacctaaaagatttcttattatgattaagttgtcattcaattcaacgtccatttccagaatcgaagagtcatctaaaccatttggaaaaaactga

SEQ ID NO: 9302 - DNA, 201 bp, Candida albicans
aaacagtttctcggcaacgatagtgtaaatttagatattcacaaaaataaaattgccgtatctacatacattataagaattcctgtgactgataaaaaatttttcaaattgagaagggctaaatttacgttaaatatcaaagagtggaactgttttatgattaacgactactttataatcttaaagattgaattgaactag

SEQ ID NO: 9303 - DNA, 195 bp, Candida albicans
accgaactgaagtgtttatcaatattgaaagaccaattcatagagtatcagttacaccaagaagcaactaaaaccaatattcattgtaaaacttctgtgcaatttcgcacgaccgtatcagcatacaaaataactcctgcgtatcaaagattgactattccaagcttttggcgtaatcgcactgaactcgtctga

SEQ ID NO: 9304 - DNA, 270 bp, Candida albicans
attgaaatcgttcacattggttcgtttaaagtccatttttgggagtcattatcacggtttaaatttgttattgtcaccaatggagaagtcagtcaattatctgatgttttatttgaattatatctgaattatttcatcaagtatgttgttaaaaatggattgatgcccgtggaattcactgccgagggtgagtatagcaagataaacaatggtaagttcattgaagaaactgataactatttacaatctttatcaatatttcgatcatag

SEQ ID NO: 9305 - DNA, 183 bp, Candida albicans
tcaatttctgatagtatgactttgaatatgtatataaataagaaattcaaaaagaagggtttcttactagagacagagaagaatattgaacattttcaattccttttttttttttggttttgtttgtttggtctttttagtttcccacacacaataaagtttttctacattgatttacaatga

SEQ ID NO: 9306 - DNA, 216 bp, Candida albicans
ggtttggcaaatcttgaaatgggaaagaatttatcccctaatttaacttgtaattccccatcaattttctcaccagtttcaagaatatcttctttcttaccatcagcagacatgaataaatatttgtatattaaaagtaaaccaatgaataataaacagttgaataagaatctattcattaaatccaaaaaaaaggaaaaacttaacaggaattaa

SEQ ID NO: 9307 - DNA, 564 bp, Candida albicans
tcatccatgttactacctaaaagactattgcgactgctaatctatttgatattttttttaacggtctctctatttttgttattacttgcaaacaaacatcaaatcattgagatcaataaatatattccgtttgatatatttggtactgcagcgccattatttttccaaccaccttctgatctgtttattgtggatatatcatttgataattgtttcaagtttagttttaataataagagatgtggattacctgatatcaacaaaggattgttgggtgacaaagcacaatggtatcgattaagaaaagatatatgtctaggatcttcatggagtaaaaaacaatacttgaattataaaaaaataaagcatgataagtatgaagagtatttatcagcgggaaagaagaataataaaaatgttgttgacgaagtcattatagatattgcagttgctgatcccgttaatgacgtgaaaataaagggaaacgaaaaattgaaattacctaaacacattattcaaacttttcataacaaacaggtcctcaccacgggtgaagatcccact

SEQ ID NO: 9308 - DNA, 444 bp, Candida albicans
ttcctgttaagtttttccttttttttggatttaatgaatagattcttattcaactgtttattattcattggtttacttttaatatacaaatatttattcatgtctgctgatggtaagaaagaagatattcttgaaactggtgagaaaattgatggggaattacaagttaaattaggggataaattctttcccatttcaagatttgccaaacctcatgctgttgttcaccctgctgatcaccattcgaaagttgatgccaacaagttccccgatgttgaaccagaacaaaaacaaaaagaggatttaaaagagtttaaccaacaagtcttaaagcctgacattaataaaccaaaggttgatcctaattcatttccagatattgaaccagaggctaaagaaagagaagccaaattagaagctgaaagacttaaaaagagccaataa

SEQ ID NO: 9309 - DNA, 201 bp, Candida albicans
accctacccggctatcctctttgcgaaaatttcaataaaacaggttttctagtggtttacagtatattttacccaacaggtctgaaggagttccccatagaaagctcttttccttgttattatggtatagcaaagagattttcaagtgtctttaatctacacaatcatacactattattaacagagcaggttttaatttga

SEQ ID NO: 9310 - DNA, 1656 bp, Candida albicans
ctctcggacatggtatttcaccgcgtcgtgaaaacttcccctttgagctgcgcaccggcagaatcaaattctaatctgatggtaaaacaaggtgctcctgatatttttactcctttaatgagagttagtccctcaagcaagtcacagagaagaaaacgaaaactttctaccagcagtaatggaagcaaccagagttcatacagccccaccaccaataatgtatcgccaacgatgaagaaatcaagacctgccaaccccaactccaaccaaagtcaaaagcagattgcctacaattacagtataaaccagaacaaaaaccaacatctagtaactccattatcaacatcagaagaaactcgctttttaaatcctgaaagttcctaccaaattaattacaagaccttggataatatgtctatgatcactcaatctcaaggctattacaatactccacctcctacttctactaaacgcaacttttctacaccccacgccaaccaacaacaacaacatctagataagttaccggattctaacattcccacacctcttagtcataacaaacaaactaataatttaaggggctctcctccgttggccaagataaacgaaattagacatgaatccaagaacttgttgcctccagtatcgttaacgagccacagtttaatgaatgagcgcaacaacaacaacaacaacaacgagaccatcacaaagaacatactaagtgaacaagaaattgcagcccaaaacaatgttacttgtgagagtttgtcaagcagtgatgacagagctaatattaattctacgagcagaaaatcatccgacgattttctgttcagattgactattgatgagctgggaaaggcagtgttatccagtgatatttttgctcctattgccagcggcgacaagcacgagatgcagcagcaagaggaaattacatctgagaaaaatgaacagctggttgatgatttttccacagttctaactcattcaaaggtaccgccagtgttgcctcacactaaatcagtaataggaatagagtcgatgcacaacaatgaggtcaaaagcaaagcacctttaagaagacacaattccgatattacaaatttcagttctagtaaagacccagttccccaaatattagcaccaataaatgaagcttccaacaataaccctccatcgaatttcaataatccacaaacccccagagaaacttacgggtatgtttcgactggtcttaccccgttgttcaatttaactcctcaattcaattcattgatgtactcagtgatgaatttgaatgcttctccggcgtataaaaaagcaaacaacccatttttaataaaccaggaattatttaccagcggagacaacgctgccatcgttcaaaggggccaacatttggaagagttagctgagcatccacgtttggaaaaactccacgaaaaatcaaatgccgtaatgatggaagatttagtcgaagagaagaatccaaataatactacaatggatactcatgacaatgacgctcttgttggtgccactcaagatattactggtcatggtaattatctgctggcttcatcatcagaagattcaggggatgcaagacaggccttgaaaaaaatcattcatgtgaaaagaaaataa

SEQ ID NO: 9311 - DNA, 666 bp, Candida albicans
ctttcaatagtatattcttatagtattttgaaagaagagaatcgaaattcattgtttagcagatataggtacgtgctatcatttataatcattttgatttttgttgtggtcattattccagatcgcatgatgttgaattcaatttcaacgatttacgatagaataaaatttgatcatatctatatagtattaacattgatttacgttgtggatgcaataacgaaatttgccttcacgtcagactttacctcaatattgatccaggggatatggacgtataattcaattgttattataatttcgatgtggtttatcatttacagcaaggacactttatttagcattttgaaaataatagagcaagacaatagtcagaatacttcatttgtgacgtcttttattatatcaagcattagccaattggaagaggattatcaattgtgttcacaagggaaaactgctttggagatgtgtttaaaagaaagaaatacggataatttgcaatcatatttcataatccttaaaactatggtcacaaattgctggagtattttaaatttagtttcatttgtattgatcccaactttgatttcatgtatttataacagaaaacagctattaagcaatatcaaacagttcgaggcaaaggcggattctgtagtgtaa

SEQ ID NO: 9312 - DNA, 207 bp, Candida albicans
atcccgttctcttatgcgctttttgcaactaagatatgtaagtatacgttcgctagattttttgaaagaatatacaagtttagaatactagtctcacatctcattttgaattattgttctaatatcatgctatacgagtatgtttatttgactagacttcagtcaacaaataggtcatccccaaagatgtatagtttcctcttatag

SEQ ID NO: 9313 - DNA, 588 bp, Candida albicans
atcgttatatacttacttgaaatgacaacagataaggaaatcattgataataaaacaatacaactactagaattattagacaaatatcaacagttaacaacattaaatcgtgaaaatttcattaatggatttttcaatttaagtcgagctaattttcaaaatgaaaaagaaaaatatggtttagaaaaatatgatttccgatgttataaagcatgtaaaataatagatataaatagtgataatggtagatttgaattgattgatagattattgaagaatgaatcatcaattaatgatgacgagcatgattccccaaatgaagataagaagaaagaatcatcatcaacaacaatgataagaaaccgaaaagacaggaaaacaggaacaatcgccactcatgataaagaaatcgtgaagcaaagcaatgatgatgaagaaacatttaaagatccaattaaacaatttggaacaattgtaccatcagaattatataaatgtcaacaaaattttaataatggattaaatcaattgattgaaattataaatttacaaattcaaatcaaaaaattgattcaagaattaagttaa

SEQ ID NO: 9314 - DNA, 219 bp, Candida albicans
accaagaaatggctgattatttcgaaaattagatcaagcacttaccaagataagggatatttagtgtatgtgtgtgtgtgtctgtgtgtctctgtgatttctccgatttactatgttttaccatgtattatttttgtttttattttgtttattgaaaagtgttattctgaagctcaagtaggtattaagttccatagtattgaatgtcattattattaa

SEQ ID NO: 9315 - DNA, 948 bp, Candida albicans
cgacgttgtcttccacgccgtggtgaagacaaagaaatgactattggaggtcaaagtgactttgatgacgatgacgatgatgatgacgacgatgatgatgatgatgatgatgagaatgctaagaatgagggtgttgatttgtcagacaatgaagaagacgaacatgctatgtctatatatacttcattaaacgagacgcatggttatggctcgacacctttagcacatcagccaccaccaatgcatagtcattctgctgtcacagtaccaactttgggtgagtttcctattatgaaaagtggatatccgctgtttagaggtgcaatgaatagaagtgctgcagccaatcttgctaatgtatttcaaaatcattccattgagctaactggtgaagatcctaataaacatcaacccgagaatataaggtctagggccagagctcatgcttctcttcaaagaatgaggacaagaagacaagcaaaggcaactaggaatgtgctgatactttcacaaagtaatttgcgtctaccaagtttggagccatcaaaccacagaccccaatacactttttctttaacgcctattgcatcaccagcctcaccaggaggtaactcatctaatttgactgctggtatagctgcgactgatgatgtcagtacttcttcggcaaacatagactcggagatgtcacccattggaccacaaatatctgctagtaccggtttagagaagtatcattctggagaaagaaacgattattttggtctggatgatcatttgatggctaccagtgaatcacgtgatttgatttcatggaaagatgggaaaactgtggataataaagacaaattgtataatgagactttagattttgttttgcgccagtccttgaaagatggtgaaattgaaactgacattgaacgatgcgtgggtgttccttcgtcttaa

SEQ ID NO: 9316 - DNA, 186 bp, Candida albicans
gactatttagtatggtggaaatgcaagattagaaatcaactttatcatcttttttttttctcagtgtgtgttagaattactaagttaaatttcgggcctagcctcattctacagaacttcccggttcctcatcgcaaagtcgaggcttttattgcttttggcttacaaaaaaaactgccagtatag

SEQ ID NO: 9317 - DNA, 546 bp, Candida albicans
ccagttatgtacataagagaagattatccccagttatctacaaatgttaaggaaaacaagcgagatttggaatttgttgcaaacaatgtgagatcagcacttacaggaacaaatgggttgtctgaatccaaatctgtgtcaatagatacgagtggtaaaactccaaacaagaatccattgaatactaaactaaaaaaaatcataatcaagttgcagagactacttcctattagaaagttattacaacatgtcaagaaacgaacgttgtcaccaaaagagaaaactttacaagtagacacagattttatcaatacaaatgatatctttgaagttccttcacgtcatgtttgtactacattggcgatcccattatttagtagaaattgtatccgtcccaaatcaactacatgtgtcaggaaaatagtcatggcaaattctcagaactccctattttcaaatcggtcatcattcaagtcgatctttgataaaaaatcaaatatcacaaccaatgcaaccacacccaactcaaacatcataattaactga

SEQ ID NO: 9318 - DNA, 213 bp, Candida albicans
gagacaatacgaatattcctagcaaattataggaataatggtgtttttgtctttgtttataagtatatagcgaaatataattctaaaagctacaaaggatcaattcagttaattatgatgtttgagttgggtgtggttgcattggttgtgatatttgattttttatcaaagatcgacttgaatgatgaccgatttgaaaatagggagttctga

SEQ ID NO: 9319 - DNA, 255 bp, Candida albicans
tttaagatagattatttagaattaagaagcattgataggaaatttggtctttttttttggggcctcgcgttgcaagcggaattctcattccagctttccgagaagagacagagagatagagatagaaaaacaaaaactgtggttgtcgccgcattgggcgagggctggttggtagagaaattgttggtggtggtaaaatctttatgtctgatttgcacgctcttgttatttattgttttctatgctggtatttaa

SEQ ID NO: 9320 - DNA, 228 bp, Candida albicans
ttaagtggaaataaacttgtggtggaaggggagaccagtccttatacaacgaaaaattcttcttttaatgcaagatttcggaaccggaccgacgggcgtgggggagaaagcaacaaacctcaggcgaacttgtatgagtacattactttgttgcaagatatatatagacatcaagaatttcaagcaataccattatgtgatagtgttttgaaaaactatgaatgctaa

SEQ ID NO: 9321 - DNA, 531 bp, Candida albicans
ggcggtcgggcagctccacaacaacaacagcaacgcccaccacttcaatctgcacaaaatactggcggtagtgtttcaagcatgggaagacctgatttgaaaaaatcaatcctttcattatatgcatctccttcatcttccaacagttttatacaacagcgaccacaacaacaacagcaaccacaacaaccacttggcatgaattcattatcaaattcgttgtcgagcttgaatatacaaggtggtaattccaccaccaacaataacaacgtgtaccgttcatcaaccacagtgaacacactagataagcatactcaacgtcatccattagtcaattcagccccatcacttaataacaatcaacccaaacaaaattggaacaatgaatggactaccgatacatttacttcttccccatcaatcccatcatcctcggcatcatcattagctggtacttctaattataagaccacctcgtcattaaacgtcaatgggttagatgacgatttgttcaagaatgtatgggggtga

SEQ ID NO: 9322 - DNA, 207 bp, Candida albicans
agatttggagttgtaaaggggttgggtttacccaaccccgtagaaggatgtgtgtttatagagtatatatatatatatacagaagatgtattggagtttatgaatgtaaataaggtcaatcaatggtcaataacccatatccatacccattaccaacatattctgtattgtttgattagtcgatcaaggaggagtaagatcctttaa

SEQ ID NO: 9323 - DNA, 186 bp, Candida albicans
gagttcaatgtgttttttactattgttggtggtagtgtccactctaccaaaaccttatctatgtcaattgttgaaaatgaaattacacaaatcaacaaaaaggttaactacattttaaatctattgttccgaaagagcattcaattgttgtcaaactgtcacttgaaatacactaaagcaatttag

SEQ ID NO: 9324 - DNA, 510 bp, Candida albicans
tctgctcaagctgccattgtccaatccaaccaggaaccaacaaaggctaaaaaagatgttattgccagagacgttgatggtgctgttggtgttaacattctttctaaaagagaaaataactatgatgctcttgtcaaaaacgatgaattatcaagtattcttccaattctcattagtgcaatttctgctgctttaccagagatcatcaagattgtcagtggtcttttgggagattcctcaactgcatcgtctactggctccttgaatgaacaagagataattggtgatattgtcaatgaagtcaagaaagttcttcctcaagctatctccagtgttcaacaaaatgctggtaacaccaaaagagacaccactacagaacttattcaagcaattattcaagaaggagtcaagcttacccctgaaattatctctttccttcaaaaaattgctcctcaagttattgaagtacttaccaaggaagctcctcaacttcttcaaggttccttttaa

SEQ ID NO: 9325 - DNA, 183 bp, Candida albicans
agttttatgtttgctatttctcagataaaacagtgttcgctgtctattctccaacacttgaatctccattctagaagtgatgatgaaaatatttcatctgtgtcgggcaaaattagtttgaaagacctgctctatagcgagcagtacataaaaattaatttcaattctcgaagttttccttaa

SEQ ID NO: 9326 - DNA, 186 bp, Candida albicans
gtcattcacgagctttattcagtggtggataaagctatgaagtacattagggacattgtgttcactcaacgaatgttaggagtttcctatattcacacttcgaaaaatattgctgacgtgatgaccaaagctaccgaaatggtaatcacttttgacttttcaactttaaaagaaagaagatattaa

SEQ ID NO: 9327 - DNA, 357 bp, Candida albicans
gaaattaaaagtgaatatcaaggaattgccaatttggaaacccaaaccatgagatttaaaggatctcggaacggtttacatttaatgttaataggagaacattttgcaagactgataaatattagctatgttgaaatttatagaacacaagggtatttaagattatccttcccactatcatggggtaaccagctattcctacataggacattcaaatatatattccattatataacctacataagagcaaaatcatcaattcaaaccagtatttctgatactctaagatctattatggagaccaataaaaacgtcggaaattctctttgtttacttttgcaaccaaaggccgaatag

SEQ ID NO: 9328 - DNA, 1038 bp, Candida albicans
  unsure (131): Identity of nucleotide sequences at the above locations are unknown.
atctcatgttcaaataccacaccagccattaaagaggtggcaagttctccattcaggacattcaataaaatgccactttcagaaccaccacaaagtccattttatgtcaagaccccatcatcaatgaccantagcaatcttgggtcaccagtgattaataaactaaaccaagccaacttcaatgccatgaattatcagttgaccaatagtctccatgatttgcatttacagtcgtcgttagactcttcactaatttctttggctcatcagcatcagcatcagcaacaacatatgcatgatgtttatcacaatggtaattttcatattcgtctacctaacatttcccatcaagagagtatatacaatactgaacaacataatattttgaatcaacaaaataactattatgaacgatctcaaaaccatacacaggaactggagaacgggtttatgttgagcacaaattccattgatacaccaaaattgagtccagtgctatcacaatcgatttggaatagtgaaattattcctgagttgccaaaagtagaaaaaagagagaatagatattcgaataaggtaaataatcctgcgttcataccaagtgaacacccagcagaagcaaagaatgcaagtactgacaacaattctcaaagtccaaaaaatacaactctagataacgacgatataccaccaccacaaccacaaaatcaaaatataaagtttcctaaacaagtcaagtataccccacgccataatcactttgttgaggatatgctaaatcatgatttgaccaatcggtatagtgaaggatacagcacgacattctataaacgaaataaacatggatatatgtttataagagaggcaacaaatacattacatgttcatcaaaattcttgggttcaattaaaaattaaacttcctacaacatcatcaacagttacaggaaataaaaacaatagcagttctaaaaagctattaagtaagaaattaaaagtgaatatcaaggaattgccaatttggaaacccaaaccatga

SEQ ID NO: 9329 - DNA, 228 bp, Candida albicans
tttttaggagttataattgggaaattatctcaagttattgtatttgtttcattactgagttattttttaattgaatttttagaaaataaaaatattattcatattccatggaattatttcattactattggtaaagaaaaaattaatttaaaacaattattttttgaaaaaccaagttttaaaatttcatttgttttatcatttattattgctgcttataatgtatag

SEQ ID NO: 9330 - DNA, 186 bp, Candida albicans
attgtaaatcttactaaatctccattgaatcaaattacatgtgttgtgttgtattgtgttgtgttgtgtttattgtttctttttatgtttaatatacaaatcatctataatagtagtaataataattcaaatcaattttcatttttattttctttttatctccctatacattataagcagcaataa

SEQ ID NO: 9331 - DNA, 300 bp, Candida albicans
atcattgtcaatttgatgttagtttattgggttattgtgatgatgttgctagttatattgctaatgaattacgtgaatcttgggaattacctcatcctgattataaaaaaatcccgtggagaaaaaaacggagaaaatttactggttcaattacttgattcaactttaagagaatatctaataagtaataaaaagaatgatttgagtagtgaacgagaacaaaataaaatgggagaagaaaacaggaaagtggaagaaagtggaagacgaccaaacgaaagtggaggtaaaagtggatga

SEQ ID NO: 9332 - DNA, 312 bp, Candida albicans
caattaggtttttttttgaaggagttggagattttaaactatactgaaattgcctcgacaccagtagtgatcatttctcctactctgcaaccattattggagaatctttctcaggaaagcattgctcgtaatattgatagtaccactccaacaacaatagacaacactgtagttgacggaacaacaacaaacgatgcaacatcagtagcttcctcaacttctgatgtagcatatgtttatattggtggtgcaatgggttatccatcaatttctgttgctttaggacttgtatttattgcatacctcgtttag

SEQ ID NO: 9333 - DNA, 570 bp, Candida albicans
gagttgaaagttatacattgtttagttattatatcaggcttttccctttttttttttcttttaatcatcatgttggatagattaaatcggaaacaatcaaaagaaagatttgttaacaagattccaatttcaacaaccaaaatagataaaagtttagagcatacccgcagagatgatgaatcaaacaacgctaaaagaggtgttaatcccgatgaaagttattcttccgatacttcatttacaccaacagtagtttctgggactgaagatgcagcccttacccgaacatcaaccaatcgtcaacgacaaggtaaatcatccttcaagagctttttcagaaccatgagtttaaaggtcaattcaaagacaagaaataaggacaggaaaactaaagaagaattagcagcagaaaaagcgcttgccgaacttagaaatcttcctcggaatcctcttgatcttgaattgaatgaacttcatgttgcactgaattttaatgaagtgagaaaaattattgacgatatatttattgatgaaaaccatgatgctgcttccaaggcaattaaaaattaa

SEQ ID NO: 9334 - DNA, 192 bp, Candida albicans
caacaaatgtcaattcttgaacgtaacagtaataacgggtattatttcttcttcttcttcttcttcttcttcttcttctataatttgtctcattttcacatattcagtttatttttgtcatcaacttatagagttcattttacgttaccatttagccatgaccaaactgtaattatctaccagtctagttga

SEQ ID NO: 9335 - DNA, 315 bp, Candida albicans
agtctgcaagatataaccagcatttacatatggcttaccaccacttatactggtttcgagtttgtgggggggtttatatttaccaatgaaagtgttgataatgaaaatccattcagcacctttgtcatttcggaaatagtggaaactcagggtggttatgaatactataacaatattttgcagctctgtcatagcatctccccacaagcaccggaaatacaaaaaatacaaactactgtcaaaaaaaaaaaagtgtcaagcacaatcaattcaaaaccatatcaatttatatataaagggcagactagttcatga

SEQ ID NO: 9336 - DNA, 825 bp, Candida albicans
  unsure (14): Identity of nucleotide sequences at the above locations are unknown.
gagggattttattntaacccgttcccaattttcaatatttcccttggttattcaaatgttggctcaattggccaaatcaaaactaatgataacaaatcacaacaagaagaacattgttttattgaaattgcatctgattttgaaactttagccattgaaaatgaatctgacattaccatcagagaagaattttatttgaatttatttgaattatccttaccagtttcaaattatgatattaccaccaaatgtttaaaaaatttaactctttcgactaatttcaaaaatttaatgacaaaatttattacgaaaataatttttcaactgaaattagatatcatattcccaccaaataataatgatgatgatttttatggacaacatttttcattaattgattcaataattgttaaagttgcccaagattccaatttatcacaatctttacgagtttatcaatatttgtattcatggagattatttggttgtatggtggcggtggtcaacaacaataagacgctagaattgggtgataaaagaggtgcaattgaagctttatatgaattcattactcgatttagaatagaaaatcctactggtgatgtggaaaggaaagtaaaattgaaaatccttgaaatttatatgataattttgaatttattaaaaagttttgaaaataatcaagatcaatggtttttaaagacaaatagctataaagagacaacaacaacaagaagaagatcaatcgtatctttgaatgatttaaaattggaatacttagaatggttgaaaaatttagatgaagatgtatcaatgtttacatag

SEQ ID NO: 9337 - DNA, 225 bp, Candida albicans
tattactcatataagatcttacttgtcatgtgctgctattcaatatatatattacgcttattttcttgttcacttttaaactttcattcactatttattaaatttagtaatcaaatttttgttgacttttattggatgaaattctcaaatgcagtcgaaacctcttttttgacacaaccaaacaaaaaaaaaatcacacgcgtggataggtttcgtactacttaa

SEQ ID NO: 9338 - DNA, 195 bp, Candida albicans
atatttttatcgctcccaaagagaaagattcccctcctcacattctcctatactatgcaattatttaaaaaagtatccaaagaatctaaaggtaacaaaacttctcgacataatcaacaattgaattcaccagaagatttaactaagaaaaattggttctggatgttaattgccggaatttgctacaacacttga

SEQ ID NO: 9339 - DNA, 195 bp, Candida albicans
cttaagaagtcacataatatcgtttttaaagtggtaactttgctgaatttgagagaaaaaagaaaggttataacgtttcttcacattaagactacaacaattggatttaatcgtttcagttacctactagagatagaacttttaatgactctattaactttaatgggaaatcccaatagacatagaaagttgtga

SEQ ID NO: 9340 - DNA, 222 bp, Candida albicans
tcatttatatcaaccaatgaacgtggtcaatttaaagttgtgttcccctctacttgctatttttggaataaactattaaaggtttgctgttattctctatccataatccctgtaaactttgtttgcatctattgtcacattctatttgatttagagtatttcccttttagttatatgaaaaataaaagtaaaaaaaaaaatttcaaagttaattcaaattaa

SEQ ID NO: 9341 - DNA, 474 bp, Candida albicans
gtttcggcgaacctcatgcacaaaacatttattagtataattcgtaaaacaatttatcaaaactttatagttttaacaaactacaaaaagcttgattgtataatcttgtgccgctttaacaagaaaattaaaacaatgaactatttggaaggggaggtaggacaattaaccttttttttttatttttctaattgtattgtaattgattttgtattctacttcaatttacccttgtttaggaaatgtcacgtttctatagcaaattcctcctcaattgttctatacaaaagagtgctattgtggagaatactcagcagaatattacaaccggacaacttcagtttcaatgcaacctgctatgtttgtgatgtagttgttgtttgtaaggcaaaaggtgttagttcaacaaaatcggctgagctaatattcttagtacttttcacgcaagccattaccaatatgcacaagcaataa

SEQ ID NO: 9342 - DNA, 243 bp, Candida albicans
  unsure (9),(38),(70),(76),(92),(100),(105),(129),(130),(132),(133),(135),(200): Identity of nucleotide sequences at the above locations are unknown.
gtgacaaantcgtcgacgaatctttttttttttttctntttgtattttgttttgggaccaccaccagaanaacctntagaatccattgaagnaaaaacanaaaanggccccgggggggaaaaggggaannanngngaaaaaatttttggggtgaattttcttaaacctcaatcccccccccccccgcacacggggagaanttgggggtggggtttttttaacgacatctgttttttttcttga

SEQ ID NO: 9343 - DNA, 246 bp, Candida albicans
ataaacgaaccaaagtctccagagcttgtgattattgcaaaaagagaaaattcaaatgttcaggagtgtcgccttgtgaattatgcacaaaaaagggaatccaatgtgagtttaatattgttgatagacgtacaatacgacgcaagaataagaaaagaacaatacgaaataaacccgcaactgcaacaagctcaactaccagcaaaatcaaaaaggatgagaatcaaattgataaaactacattga

SEQ ID NO: 9344 - DNA, 474 bp, Candida albicans
gaatcaattccaaagaatattttggtggagaaaaaaaagtgcaaaactgttgtgaaaatttttaaaagatcaaacctaagttcctatatccagactgtattctctatgctagaaacaaagatattaagagtattgcctcaggtgagaagatacctggtaaaacgctttcgatctccctttctgtttcttcctaatgaaacaaagcatatatttgatgaagaaaaactaacaccagaagaaaataaagcagctattccattaaaaccaaattacgacaatttagaaaaaatacatcatgaagtgataaatcctgaagaagtatcagatctcgtggtaaaacttaactcaaatgatattctagtaagcatattgtcgaaagatggatatctatttggtgataaaaattatttacttacaggaacaaataaaccaaccaggttcaaggctacaagtattttgaatagttggtgccga

SEQ ID NO: 9345 - DNA, 1335 bp, Candida albicans
  unsure (29): Identity of nucleotide sequences at the above locations are unknown.
aggctattcactagaaataagtcatcatntaacatgtcaattcatccttttcaaagcgatgatgatagcttaccaaagacactccgagaatttacatctccatctgaatcaagcaagagtactagtggcaataagttgagaattgccaaaaagttgaagtttcccaagaatcaaagcagtcggaaaccagatatgtttttggatactagtagcacaataagcgaagacagttcttcgtttcggaaagtaataattggtgatctgttaaatgagatgactaaaccaagaaagagctcaatgagctcacccatgagtaccacatttcatagtttgtttcatcgatcccatcataatggcagcaaccttcagcaagacaccaacctggctgccactggcacgacacctttgtcgggtaagtttgatgacttctcaaaagcatccaagacaactttatgtctttcctcaaatagctcgaattcaataatcagcaatcctgaactagctcagatatataatttcaccaacccaaatatttcaattgaagatggagaaaccaatttggatcattcaaacagttcctttttggatattcataagaaaatgcttgtgccagcagatctgtttattcagaataagctaaacaagtaccaccaaaccgaagtagggttgggcatatacgaaagtgaattagatcatgacaaagataataagatatactccaacctttatcattatttgaaaccactatttaccccatctttttcaatatccgactctggtcaaaagggtaagaggcgtccaatattgagtactagcgttgaagaaattgcaaattttgtaaaggagaatttttgtttacaccagcccgaccacgataaaagttttagactgaaaacaagatccagtgtatcaagcttgggtcatgaaaaggtagaggattttgattaccgtcagttatcgaatttgtttgaaaaattgatggccttattgagtcataacttgcaaactgccgattcatcgaaagtatctttacaagctttgatattgaacgcatggaaatattataatgcttatgttaggttttatttgctaagtatattccaaccattgcagcttcacttgaatgagttatctatgagaggtcctaatggaagcacagttactagaatagatgaccttctacttgtttcttttcgaaaagtttttattactgaacagggaattggaagtggggatagagagacgtctcaatttttggggaatgctgaaagtgaagatcttacaggaaatggattgttgacttctactttggccgtgttgtcgagtatatcatag

SEQ ID NO: 9346 - DNA, 189 bp, Candida albicans
gtgcctgtaaccatttcaagcaaccaaacatcgttagaggaaaccgtagtggctaaacagaaaatgaacaattatctcttgttatacaataatgccaaatttaccacaaacaaaagacatgcttattattgtctgtacatattttcaaacgcttgtggtggtattgtaatactcttgagattgctatag

SEQ ID NO: 9347 - DNA, 207 bp, Candida albicans
gccttgttgtcagtaggagtagaggcaggtgaagaaagtgttggagatgaagaagatgtggaagcaactgatgaactggtggatgcctttaattttctttcttctagtatactagtatccattattgatgaatcatcgagcacagaaaagcttctcttattggaactagttaccagtgaagtggctgattctggagttggaatataa

SEQ ID NO: 9348 - DNA, 186 bp, Candida albicans
aactggtttgcccacacaaaagtctccttaaacaccataattaaaaatgtccaacagtttttccaaaacaagacaacctcgccttcacaattggcagctgaggttgataacagagagtcaactggatctgctaaagccttgattatatccattataattctaatagccttgggagttggttcgtag

SEQ ID NO: 9349 - DNA, 234 bp, Candida albicans
caacaacaacaacaatactataacaacaacaacaatactataacaacaacaacaacaactataacaaaccattcaatacaattcaacaaattaaaagttactagattaattgtttgtggaaagtttattcaatctggattgtttatatgcattgaaagttatgtttattctgagtctttaaactgtgatcacttcaatttagttagtcaattgataactttttacaatatttaa

SEQ ID NO: 9350 - DNA, 228 bp, Candida albicans
attaactgtatctttgtattatttggtcgacccacaacaataggtaatgaatctataagtcacaaaacaataaaccaagaagttagacatccatacttttggcatttgtttgtaacttgtcagacagccacttatacccacccaattcaaaatcctcctagaaggcacaatgaaaagggtaaagatcatcgctcctttataaatattaaatgcatcacctatgactag

SEQ ID NO: 9351 - DNA, 249 bp, Candida albicans
tacatccaatcgtcaatgatctctgctatttatataatatatttagcagagaaacaagaatcgaacgagttttctcaaattgagttgttagttaaccggagataccaccagacactaccgcacgatgaaattattcttcaaaatttccataatttaatgacgaatttaccatcatctgaacaagtccccgtgctatattatgacaatctttcttcaccaggccggctggaagcaccgaacttgcgtaca

SEQ ID NO: 9352 - DNA, 1269 bp, Candida albicans
gatcatttgaagaagaatgtaaagaaattgatgaatggaaaccaaacaatcaaaaaagacaattttaatgactgcaacgacaacaacaacaacaacaatagcgatattgtggtgaatgattttagtaattataattgtgtcaacaacaacaatattgatgcaaatattgacaacagtgacaatggtgagaatgctattctgatacttcctcaatattcctcaacacttgatccatggaacacaattgatttcacatcaaaattctcaatgtcacacgtgactgaaaaccgatcaacttctgttgattcaaccaaatcagatgtacaactgcaattgtctttaaattatcctttgaaaaacctttccaattcaaattcaaattccaattcaaattcagaatctaacttgaactctaatttaaattccccaattgatattgtcagtggttccggtagcgttagtgtcagtgtcaatagcagtaaaacatcttcacctcggaaacggaaacttgataacaaaaacttttataaagtatcaaaattagatttttccaatttgaatattatttctattccagattatgaatattcctcacaattatcaaatcattcattcagagtccctaatgcttatcaatgtttaatattggaagaaaaattaattgaatcaatcaataattctactacttgccgtgttcaaagaactttatatactagagatggattagataaattagcacgaattcatttccatggagattatgagatttctattaatcctaattttaaaaaaacatcttatgaagcacaatatattttaacaaaattggataaatcaagaaaacctgataatactactcgagcaggattatgtccatattgtgaaaccattgaattttttggacttaaaaattcctcatatggtaatcatttagcttataaacatgggattttaactaatggatgttctgtacctgatcctaaatattatggtaaatataaatttaaaaagggagaatatgatgaaccagaaaagaaaaaacgaagaactaatgctcatatattagaaagagaaggggtattatgtacaaattgttggcaaattcttgaagtaaattgtacttcaagaagttcagtcttgggtcattaccttcgtcattatcgagattctcatgtcggtaataaaaaagaaattaaaattgatgatgaagatcctttagctgggtttgatccaattgtatttgaattcaccaataaatggaaattataa

SEQ ID NO: 9353 - DNA, 255 bp, Candida albicans
tgtatagacaagtcacaattggtgagtttaatttacagagagtatgagagatacactagttttgaaattttgtttaaaagtatgaatcatataaaatcatccctatccattctgaaatcaacaatatcacccatggcatttttcacagacattttattgtcgtttacaacaatgttatttagatttgcaagctcaaataaggcttttaaacattccgataatgtgagtttatggttcaacacccaagaatcataa

SEQ ID NO: 9354 - DNA, 528 bp, Candida albicans
atgatgatgatgaggatatatgtccaatatcaaaagtcaatacatccatttccacaggaaaaagaagaagaaaaaaaagaagaaacaggaaacgtccatcatagaaaacaacattttattggatatgattattatactattcctacaatagaaagcacatcttcatcatcatcatcttcttcttcttcttcatcgcctacttattttgacaatcaaaaccataacaactccacacatcatcatcataatcataatcataatgaagaaaaagattgttttgtaattaatgataataattatttcactacttggtcaatgaatagaaataactctagtagtagtggaactactagtggaactactacaagaacaaattctacttcaacaagacataatagtagtagtggtaatagtagtggtagtagtaataatactagtagaggatcttcaattggatcgatatttatggataattcaattcaatattttaataataaaatgaaaaaattcaaatttggaagtaattaa

SEQ ID NO: 9355 - DNA, 246 bp, Candida albicans
cgatcttcggttatcaatacatacatacatacatatatacgtatacaacagcctacacagcccacacaatccatacatctccgctcatcccgcttatgccgcctgcacttggcccaaatcgtttctagttcccccccccccctctttcatttatttttttttaaaaaaaaaaatccaacggttaacggttatatgtataattacataaccataaccatatcaatagtcaatagcaatagtcaatag

SEQ ID NO: 9356 - DNA, 183 bp, Candida albicans
attaatgaaaagatcagtatcaatgttgaaacttacgattaccatagaaattactctaaattgaaccttgagattgagaaaactaatgttatgaaattactgtttgctaattctgtagaaataattgttcacgcgtcgtctgatttgaattttagcaagtcaagctatcctaaaattaattga

SEQ ID NO: 9357 - DNA, 258 bp, Candida albicans
tcgtcgaattgggtaaaattggaactaacacaggtgttattacttcatatatacgaaaagatttcaaaacttacgaaagtgacaaagattggtatgaaaacaaaacttcgtatatcctgtatgacgactcctatttttcagattgaagccatgaatatacaaaccaactctagagaaaatcaatggctagttacgaatactaaattccattccttttctaagtataattatatatttagttgtttggtaacattataa

SEQ ID NO: 9358 - DNA, 183 bp, Candida albicans
atagttgaattcagttatcttcaactacatctagagggttactttacttatgttgatcgtttcgcagcaaggtcggttctttattcatttatatactgtttatataatataaggtatcacaatcgacttacattactacccaattttattgttataatttggttggtgcagccaaattcatga

SEQ ID NO: 9359 - DNA, 276 bp, Candida albicans
cattgtatcttatctagcaaaccttccaatcttaaaaccctgaaactgtacaagcgatgcataacctcaagtaaagattatattacaataaattccagagtcagttcttctataaataaaagagtagtcaaatttttgtactacatgaatcatactgaacaattcatagtcgcaggctctttttttaaaattcaaataataaaaaatacttataattataaaaactatagaaacaaactaatcaaattaacaacacaccaaattggaggtaattaa

SEQ ID NO: 9360 - DNA, 198 bp, Candida albicans
acaaaaattcggagtcaggaaaacacttacacgataatacaagttaaacctcaatcggtagaaccttcccaacaaaaggattttgaaaacagagcagcagtattcatagcaactaaagaacccatcagccaattagctaacaaaacgaacaaacgaatggaaggttatgattctttcacaaaagatgtttgccaataa

SEQ ID NO: 9361 - DNA, 225 bp, Candida albicans
ctaacaaaacgaacaaacgaatggaaggttatgattctttcacaaaagatgtttgccaataatttgctcgcaacaattgtagaatcactttgttacatcaaaaatgcctttcaagaggcaaaaataataaaggaaggaggcttaaaaaaccttgatggttatattgagctagacgaaaccacaacatttgtctacatttgcctacaattgttgatgaaattatag

SEQ ID NO: 9362 - DNA, 1065 bp, Candida albicans
gagatacgcagacaaatgaaaatttttgaggccctattagagcttcaaaatacgttgttaaagtattatctggcaaccatacagtatctataccacgaattgctaactttatttgaaaataaggtttctattgacgtggaaaaacctgatttggaaagaataagtttttatacgtcgcttattgaaaagtatcaataccaaattatacagttgacggattttaacaagggtcatacaatttacatgactttacaacagattatcaacagtggtatacaagatgtcctcgtcactatcacagctttgcgtaacctggagcaaaaattgatcagagtctcaagtgaagcattattaattcaaccaggaattgaggaaaaattaaaatggatcataaatgaaaacaatcatttacacaattttcaaaatgatcaagataaataccaagctttttttgcgagattgaaaaatgaaataaatgacgttccaccaccacaatatacttgtctgtcgctaaataagtttgtggaagatattgtcaatgaatattctttagatattccggttcttgaaattgtcattgacaaattgaatagaaatcatagcgaggaagagctttacttagaaaagttacagaatactattttgcaacatatcttggaacaagaagttgacacttcaagtgtatccttcacagaacaagaaattaaagttatagatataatggaaatactcactgctcacatagattttttcaaacgattatccaagatgtatattaaatttgacaaattattacttcaaaagttaaggcttgataacttgccagctcctgaatcggttgaaatcaattctcatattgccaaaaaacttgacaattttattgcaaatttagttgccggagggacagtagggttgagcacagaacaaacttatattctggtttttagttttatccaaaatattgcatttcagtttcgaacgtttaatgaaaattatataggatacattcctgcatctagaccagctagatatggatgtcaacgacgggtgaagatcaagcttggt

SEQ ID NO: 9363 - DNA, 294 bp, Candida albicans
ttctgctttagaaatttaagagcatctgttgatcataatggacacaaaaatagatacaaggatcttagatcttttgattgtatctataaaattcgcatgaccaacgaaatgaaaagccgttcattccttgaaataaacaacactttgctaaaaaaagggattaatattcttgactattttgatttaaaaatagtactacagccagttcagagcggcatattagcgaaattaggtgatttccaccataaatggcataatttgcttaaaacaaggggtttgagcgatattggctga

SEQ ID NO: 9364 - DNA, 438 bp, Candida albicans
gtccacataatgcagaaatttattattaattttgcaaatatccattgcgataaatgtgaaggaatcataagaaactttgtgagtcgctattacgaaattagtgatgagaccgatttaaatgcaaacataaagccatctgaggttattttcaaactcgaaaacaatgaagttacgttgtatggtaatgatttaattgatttccatggcgatatcaagagtatcattaaaagtttggggaaatctgggtttgatattttgtcctgggatttacacaatggtgacgaaaccgtgagttcatcacaaattgtcaatactaatatccaaggagccaatgaacctgatggttttatagatattgttggaatgtaccacaaattcattaactcaagacacaaaaagaagcatatttttcaccacgggcctggaaggacagcatgt

SEQ ID NO: 9365 - DNA, 189 bp, Candida albicans
cccgcccgcacatatttaaaaaaagtggaggaaaatttagttgcacaacaatttcagttttttttttgcaataagaacaaaactacacatgtatataagtcctggcaattcctacctatttctcccaggtatagaatagaggaggttatcgatatcactaacaatgtctccttccaaattatcaaatga

SEQ ID NO: 9366 - DNA, 249 bp, Candida albicans
aggaggttatcgatatcactaacaatgtctccttccaaattatcaaatgacgaaactccacctgatttggattttcgattcactggtatcaaacaacggttaattaaatccgagaatgtcaaacaagtcactgctagttggaaaagattattagttgaaataaacaaagagtttacagagattgccaaaataggaccctcatatgttccgaaatgtgtcttcaccacgggcgtggaagatccgcgattg

SEQ ID NO: 9367 - DNA, 288 bp, Candida albicans
gacacaaatgtcaagggtgctgcaggtcatgctcatcacattcaacaacaacaacagcaacaacaacaatctcaacatcaagctcagcaacaaatggcaccaatgccttctcatggtttacctacacattattccaatcctcaaggagctggtaatcctggtgtacctcctcaacaacaaggtcaacatcaacctggtattccattacaaggtggttatagtgatcaatacctgtattttggtaatattcaaaataacaacatacctaatcaacagcaatatcaatga

SEQ ID NO: 9368 - DNA, 201 bp, Candida albicans
gaggtgatattattgccattattcattccctatggaccaaccaaattcaaaaattattcttattctactagaaagctgaacctgactattaggttacaaggaaagaataaggagaatatagagaataacaaaaattggcaactaatatcacagtataataagccagagaaaagtcattttcttatttattcttatttatag

SEQ ID NO: 9369 - DNA, 201 bp, Candida albicans
ataacatttaataataacaacacccctaacgacgaactaataataataataataataaagacaataacaaataatcgatacaatacatttaattattcacctaaatcccctgacctctggccaaacactttatttgtagatgggaggggagcggggggaggaaatgaaaaaccattggcaacgagaaaaagaaaaaaataa

SEQ ID NO: 9370 - DNA, 249 bp, Candida albicans
  unsure (45): Identity of nucleotide sequences at the above locations are unknown.
caaaatctcactcctgtgcctaaacacacacagacccacacgcanacttttttctcagaaacagaaaaaaaaaatttcaagcaaaaattttttccatctagattttctttcttcagaatatcaagtaactttaaagatgcctgtatgtacaataacagtgttataatgatgtctttcagtcttttattgggtgattattataataaatggcagatgagaaatatattggataataaaccttgcaaatga

SEQ ID NO: 9371 - DNA, 186 bp, Candida albicans
aggatagatttttcaagactaggattttactgccactgtacttggaggcaaacaatggcaactttggatgagaataacccttctaaacaaactcatagacattggtccatcgagaatgagataaagctattcagcttattgtgcgattataagcccgctggtaaaaacaaacaaaacaatatttaa

SEQ ID NO: 9372 - DNA, 219 bp, Candida albicans
ctccataacaatggctgcgaaaaaaaaaaagaaactgtctctcaacacaactcaatttcaatcgtgaaaaaattagaattttttcaaaaaataaagttcagcgagttgaatagatccgttattctcttatcaaatatatttccacctacctgttcttttctcaaactaaatgaatacaaaaagaaattggtagaaaaggaaagaataataacgtgttaa

SEQ ID NO: 9373 - DNA, 186 bp, Candida albicans
attctcaggcaacaatttttaaattacatacagaacaataataagaataagaataattacacgtcttggtgtaagattaacccaaagtgggcaaattgtggaagtagaaaaaaaatacaatacaacacaattgagaatacagtttatcacttgcaagatttaacaaagaacaagaagagagagtaa

SEQ ID NO: 9374 - DNA, 183 bp, Candida albicans
aaaattactgaaagtactcaacaattgaaaaaaaatatacatctatacaataaaactgcaaaaagatctaattattattccaacaatcacaatgctagatcgaaatcagagacagtgttaagtgatcatgtggtggatctaatagaaagtaacaaattactctctcttcttgttctttgttaa

SEQ ID NO: 9375 - DNA, 906 bp, Candida albicans
  unsure (890): Identity of nucleotide sequences at the above locations are unknown.
ttgatttaccaaaacaacaactgtttcaacaaagtttttttatttaaaccaacttcaattcgatcattgcatatttttttaaccattctttgtctgtttttcccatctcaacacgttttgtttattcattcattcgttcgcttgttcactagttacttcttagttacactacttaacaccaccatgccaaaaattatttattatgatgtcgatttcattgagtttgataatataataactcaactaattgttgaaacgtgtcaaagtcataatagcttagatattcaccaaataattgattatttccattactgctttgaagtatatgttgtggttaatcaacaatcattacgaatttcctcgcaacgaattgacaccactctcgaaatattagaaagcaaactatttatgtttgagatccctgtatttataaaagatgctattcgagaaatggctagaccaatgattaccgccaaaacttcttttggaatgaatagtgctaacaataatagtaatatctatttacctaatgttaacataatttcagggaaacaatatttgaaactgtttgcaaataacagatataaacgattgattaataatttaatgtctgcaatggacttgcgaaaagtgtactggcatcatttagaaattgaagaaatcgatactttgggattttccatgtatcatgatgaaaaaaaccttatatcgtcatttactgcattgccgcaatttagatttttaaccgttgcattattgaaacacattagatttaatcaatttagattagtcaatgatagtgaaggtaacaaatccaatgaaattagtccaggctggattaatttagatagaggtatgaaaaatcaaccacctattacaattgattattnttcagacacgccctag

SEQ ID NO: 9376 - DNA, 633 bp, Candida albicans
attaccaccaactctaacttttgttctttgaagatgaaaaatctggtaaaagagactacggaactagataacatttcaagagcattggttgaattactcaaaaagaatcatgacagtttcaagtctttgtttaatgttcaacttgatctactaaaactatttgataaacaagtaaacaatttggaggctacagggtattgtgattatgaggtagcatatgcactatacatgatcatcattcaattgatagccgttatgaaggataaatcgaattccaaaactgccgacatatacaacggaatacaacaatctattcgaaagaaagcaagcaactttaaaaaggtgttagggtatttcaaaaatgacgacgatgaaaaggatgaagatccccttattaatagattcaagtctttgagcggagagaaaacacatccagcaaccaagatcaagaaagaattaatataccgcgaatggataacacctgttgaactcgagaggacgcttcgcgagaaacatgtgttgttaatagactatagaccaaagaaggattatttacacaaccatatcaagtttgataatttgataaatatagaaccacgacaaattgaatcattaccagaatcttcaacagat

SEQ ID NO: 9377 - DNA, 330 bp, Candida albicans
  unsure (71),(78): Identity of nucleotide sequences at the above locations are unknown.
aaatttgccattggaataattatgttgttaacaagattggtgatcaatggtggacagaaacaagtggcatnatattcnatattcattcccgtgttagttaattctgtggatggagttgacaatttatatttacatgagaaattgattgtcttggtacggcaaagtgcaagtagctttaaacaagttgtcaacaaatatctcgatgacaaccaaaagaaactaactgaagaaattgttacttcaagtgttgcaaaaaacaccgttgctaaccaatctgttgattcttttgatcaagttccagaaattcaattaaagacatttggtgtatag

SEQ ID NO: 9378 - DNA, 444 bp, Candida albicans
tctaagcgcggatcgtggcagccccgtggtgaagatactccgaacttatcataccttggatggctacaattgataccgattgtactgatggctttagtcacatcaatgttatgttttatcgaacgatcaatttcttcaagaaagttctttgaaagtgagtatcgatatgctaatgatgatatgagaataatgagaaaaacttatgttgatgagttttggaacgataatgccagtgatgatggattctatgtttatacggatggattttacactaggaatggcgacaatgtccagcaacctacttccaatacagctggatcactactatctgaacaccacgacgtcagcatcgtagaaccaagaactttccttgacactgatgattctagacgtggaagcagtccacatgagttcatagaattacaaaatttacgaccagtataa

SEQ ID NO: 9379 - DNA, 354 bp, Candida albicans
ctgctttgttttcttctggtgttagtttttcttcatcaaatatatgctttgtttcatttgggagaaacagaaagggggatcgagagcgttttaccaggtatttccttacctgaggtaatgatcttaatatccttgtttctagcatggaagatacttttcagatataggagcttaggcttggtttttaaaatttttcacagcagttttgtatatttttttctccaccaaaatattcttccgaattgtttctttcaaagttcttgtcaaaaccattttaatatttttacgttaacactcaacagatctgccaataatgactttcaaaagaattactctattgatagaattgtttga

SEQ ID NO: 9380 - DNA, 1263 bp, Candida albicans
aaagtatcttccatgctagaaacaaggatattaagatcattacctcaggtaaggaaatacctggtaaaacgctctcgatccccctttctgtttctcccaaatgaaacaaagcatatatttgatgaagaaaaactaacaccagaagaaaacaaagcagctattccattaaaaccaaattacgacaatttagaaaaaatacaccatgaagttataaatccagaagaagtctcggatctcgtggtaaaacttaactcaaatgatattctagtaagcatattgtcaaaagatggatatttatttggtgataaaaattatttacttacaggaactactaaaccaaccagattcaaagctacaagtattttgaatagttggtgccgaattttcaacaatcaaattaaagacttgaaagaaatttctccaatgcaattctgggatcctgtggtatcacctcaaatcagtaaagctattgaagaatatggagatgattttgaaaaacttttccaagaaacaagggcattgaagaattctaaattgaaaaaacacggagatatcccaccatcagaattagtggacatgattacagtggataatttgtcactttatgttttgaacaacttgagttctattgaatctttagcagcatttgttgggtttatgcgggatcatattgaatattatactgttgaaggtttaagtgagatattagcaaaattgacagatatttgttatagattacatggcgatattgattatgaattatatttatcagtgaagcaaaaacatcctggtgtaattcagaaactaccatccgatactattgataaattggccaacttgttagcctcaaagaattgggagttatccaaggagttgatccaggtgcttatcaagcgagatgtgtgcccttcagaaaccacgatgaatgagtttttactcaattttgttaatagtgaccctgaaacaaaattaaaagagttatcgttcctaaaactggcaattttcagcagaggagtgaacgaattatcattacaaataattttgacaaccataaggaatattcacgaatttagcaaattaatagagttgattaaaagctcaaatcaatgccaattaatcttatcaaaataccagcacatcttgtttgcaactttgagaagagtgtctactaatttgccattgcaaaaagcacaatttattagagtattaactgaaaacaatgttcatgttgacaacgacttaatgagagttttagaaaactga

SEQ ID NO: 9381 - DNA, 615 bp, Candida albicans
gtcaattctttcaaattggtgcatagtttcatgttcttggttctacaacacgaaaagaatgaaatacaaaagactgcattggaatatattagattgcaattgattcatgatctattgttgaaaaacctaggttatggacacataaattatgatattgatgaattgaatgaggtacgaaaatcagtttataccaaatattggctaatgaataatgttgaaacttgctgcattataaacccactaccaacctacatgaacataataacgcaaaatcaaccaacactgcaaatgaaacttcgttgtcatgatcaaacttcccatacaaatttattgaatgccaatcatcatgctaataaagctgttaaaatagagtatattgcaaaatatcagttgtttgattataggattataagagttggaccagaagtggaaatacttaccaaaccaggtttgaaggaccgactaagacgaatggtaacccgaatgaagagtaaatttaagtcacccatctcaccaataaaaaagaagataccagacaaagcaagtaaggggttcaaaacggctcataggaagttcttgagctacgaattgcaacgaataagggcagcgacatag

SEQ ID NO: 9382 - DNA, 279 bp, Candida albicans
  unsure (96): Identity of nucleotide sequences at the above locations are unknown.
ggtcatccaaaaattccatttaaacattcccaaggtgatcgtgatttaaataaaggaaatattatgttaccagtacctacagatgttgaatcaatnatgaatatcggacaaaatatatctgatagttattatgatccatttattaataaattggccaaaaataaacaatatttaggtggtggttggagattacaaaatgttttccaacaagcattagatgaagcatttattggattaggttgtaatatagaactagaaaaagctaccaccatcacttaa

SEQ ID NO: 9383 - DNA, 237 bp, Candida albicans
caaagactaagacgaagaccaaatacaataaattacttaatgttatatgttacacgaaataaactaactaacgccccctcccaaaaaaatattacaatcccctatgtaagaaaagaaagtttttataaaaacaaacagaaggacaaagtatcaaataatacaatgaaccttacttacgaaatagttgtgaaagtattttctttctacctcgcccctttagtattcagccttctctaa

SEQ ID NO: 9384 - DNA, 834 bp, Candida albicans
ttgaggatggcagcatcaccagaaaagagaatagatgccaaatccaatttaaatcaaatcaaatcacaattgtatgagtcaacaactccttcatcaggcggctctacacgtgatataattgaagaacaaaagtttgagaatgatttggactatttattgacaaataaagagaatggaaattatgaggaacaaactgaatttgtttccacgaaatatgacgaggtcataatttcgaaatccacggaaaccaaaaataaatcaaagcccaaaactaagaataaaaagtttactgtggctgatgtaaccaaagatatggaaggtcttgacttctccagtgacgaagatgttgctaatggagacaccattgacaagaataaagaagagaaaccaaacaaactcaagctgcaaaaaagtagatcaagattgaataagaaaaaaagtaaatcaaaacttaacaaaactgttggaaatggttcaccagttgcaaattcagaaaccccaattgattttaatctgcaattagacgcaaacaaagaagcaacaaaaccgaaacctaagaaatcacccaaaaagaaggaaaccgagtctgggcaaccagaagagacccaaggaaacaagacaccaaagaaagtaagatccaaaaaaagtagaaataacctcagacctaaagctcaatcagatgtcaaaccaacggatgctactaaaactaatgaagataagagtataatcaatggcaaaaatgggaatatcaacaaggaaacacccgattcaaaaaataatggcattgaaggaccagaactggtcgatcttcaccacaagctggtgaatccgcgt

SEQ ID NO: 9385 - DNA, 222 bp, Candida albicans
agttctgtatcgctatatgattttatgatcaaattacgcagattcggcattattgggaatttgctatcaacaattacgtttcttaatgccccattaaatcgtagtgaaactttgtacttttgggatgatttttgtggtgtgattgtgtcaattattggaatattggcatcgattatggcaaggaaagatgagacaaacgaacagttgggcaaaatatcctga

SEQ ID NO: 9386 - DNA, 738 bp, Candida albicans
  unsure (58),(90): Identity of nucleotide sequences at the above locations are unknown.
atggagaatggaactcagatatcaatggtgggaactgggctatgttccacctacatanataacccacaatacgatatcattgccaagcanacgactgaattaattatgggtatgcatggccaaggccaaatcaatttccatttattccatagtagtagtgatagtatgggagaacgaatacaaaattttgacaagacaaaattgatcaattatcaaaattataacgcttcgtaccaatcactgtcatataggttaactccaggacactataaattagttgtttcagaatactatagaagcatagggacttatcaactagttcttaattccagtgagccaatcacaatcacaaaaattccaccattcttggggttgtataacatctcaaaatcattcaattgggataacactaatagattcaaactaaaattcgaaactacaggttataattcaaaagtaaagataaagatcgcttatttcaatggagagtcagactttgaattacaaacaagttatcgaccagcaatgagagcttccttattcaactcccaaactaaacaaccaatccaaatcaatgaacaatttaatgattccttatatggagtgtttttacatgagattttaccactgccagaagagtatattttactaattgaaagatttgaaattggatacggaagatgtgtggttgagattggctgcaattttttcaccacggcggctggaaggaacagcgct

SEQ ID NO: 9387 - DNA, 189 bp, Candida albicans
tcctttttggagtgcaaaacatcaagtgaatggaagaaggaggtacacaatggaccattatataactatttagacatggtaggaaatacaacaagtcaggataaaaggaacttcatcaaacttgaaatccatatccaagaaaagagtaaacagagttcttcaccacgggacagccgatccgagttatgt

SEQ ID NO: 9388 - DNA, 261 bp, Candida albicans
actagttgcaacatgtccgaatcagacacttctgaagttgatatttcattaagtcaacaatcacccactcaactgcctcaagtatcacaagatactaaacctaaaaagaaatcagttggattcgctgctgcccctgaagaagatcttaaagaacatcaccaacttttaaaacaaaaggaagagattaaattgaagtcatctccatttcataaaattcccgctgaattggcatatttggaagaacagaaatcccaaaattga

SEQ ID NO: 9389 - DNA, 183 bp, Candida albicans
gggtttttttttttttttgcaagaataaaagatatagagagaaatacaagtaagaatgtagagtttttagctatacaaacaaggaaatacaccaagcaatacaatacactgcggcatatgacctctgacatcttttttttgcagcaaaatgaaattagggctatagccctaacatgtgactaa

SEQ ID NO: 9390 - DNA, 561 bp, Candida albicans
gaatatcgaaagttggttttaattgaaaagtttgattatgacgaatttttccaattaatggaatgggtgttatatttcatgcaagactttttgggaaaggaaaatgttcccctgccagtcaacaacaagaatgagttggtaatcttatttttggacagtctcaaactaatagaacaaaagatatcacaatcacttttgcctagttttgcaaaaatcttgcaaggtctttgtgacgtggtgaacgatggagttaaatctgaaattgatccagaaactgtacaaaagttggatgcttggaataaactgcttaataacgtacacggtacaaagaagatttttgagttgccaccatccttggacgatttattaggattatcgccgtcgcctggtccaatcccagagacaacttccagcaacccaatgaaacatgtcttagatgatgatgatgatgaagaggaagaaggtgttcgtagaaagcagcaccactcgagtgatagtaaaacctatattttgaaaccccataagaattggaggcccgttccttttgggacatgtatttag

SEQ ID NO: 9391 - DNA, 681 bp, Candida albicans
catactctgatcaaattcaattcaaagagaacagtccaaaaaggggagctaaaatatattggaaataaaatgttacaacaaaaacaaatttcaaagatcttacaacaaggattaacgccaataacacttaattccaagtccaactctcaatccgcaacaacaataccaacctctacccactcaatcaagtctatttcgttattatctaaacaagggattccgttaataacagttagctcgaccacagattctgggtccggtatcattgatcaagattataagatatactcgataattgcatacaattcgttaaacaagccaaacgaaaacgacaacgataatgacaatgataatagcaagaacaccaataaattaaagagtaaggagaatgaaacttggactataatacaatttgagccgggattaaaatgcatgattgaacgatgtcttgatatgtatttagtgttatactatgatggtcgagttgacaacaaggatagagacgcgggaactgacaataagaacaataaattagaaggggctgccaacggcgatgccggcaatgtcaagaccaaggaaactagacaactcgaggttgaagtagatgcgtttgtaaaattgaaaatggacggattggtactgagtttacatgacggtttacttggatataataatgaataa

SEQ ID NO: 9392 - DNA, 195 bp, Candida albicans
gtttacatgacggtttacttggatataataatgaataaacggtcatttgttgaacaagaaaataagagtatatatatatgtaaacatttatcaagaatatatgcaaattttgggatatataaaactaagacaacccagattcgacaacaagataaaaagatgctactactggaactactaaacaatcgaaactaa

SEQ ID NO: 9393 - DNA, 186 bp, Candida albicans
attgcatttaattcgagaagaaataagattggattcaacaaaggccaaatgtttaaacaatatcaatttattattatgccaattaactacttggatgggttggccagctccttggatcaagtattattcaatcaagccggagaatatagatccacacactcgattcttactggcattgattcttga

SEQ ID NO: 9394 - DNA, 213 bp, Candida albicans
cccagtaaaagtatgtacataaaaaaaaaaatattaagtatacataatacaaaatatatatataaaataatacatggcaaaactaaaaaaaaaaaggaaattcgggagtttcataaacattactcttcttctgaactttcagacgatgcttcatcttcagaagactcttcttggttaaccactttcataaatccattgtcggacccttgctga

SEQ ID NO: 9395 - DNA, 1194 bp, Candida albicans
gcattggcttacagagagatgtacagaaaaagcattggggaaattagacgtagctcattggaggagagacttaattcttcaatgactaatgattcattaactactggaattagaaatggcgccttcaagtcgagcacaaataggaagttttccacagagttcaatctggttgacaccaaaaaccaacaagacaattctgtaccatcgctaaatcaagaaaatcaattagatgatactcaatcagatagatttgatcaacaatcagtcccgccccttcggaaaagaaaaagttggtttgcaggagttttacgaagacgaaagcctagtttagtaaacgacattcaatcagcgcctcctgtacaacagcaacaacaaaacaataagtctaaaagttggctcttcaaatcaaaggctgaggctgattctacactcgtattgaacacggcacaatattcaaatattcgatctgccgaatcggatcaggctgaattattgtccaccggatcagtagataggaacaacaaatccaattcaattcaatttgaatcaagaaatttagaatacgatgacaccattcctatatttttcggcaaatactctggcagtccaatgtgtacatctatattgagaaatactcaaattgtctattttcaacttagtgcttataatagtttgtatgatttcgatgaagatacttaccatccatggaatatctgggaagtcgacgaggacatgaaaaagttacgtgggactatcgacgggaaggatgatttcacggaatttgctaaagaatttgaatacagccaagttttattgatgagaagctggttagttcccaactatgagatttttaagaatgggtatttgatccaacttaaaatcaaccataaaaaaaatgatacccagaaagccattaatttatatctcagttgttctagagattccatttttaaaaagttaccggaacaaggagttcggattagtgtatgtggaattcgttatttcaagaaaacactgcagctttctgaagtgattttttggatacatccaattaaaaatatgtcttttagcattattgaacaagtagttttgcttttaaaactgtttaaaattaccactagtatccataaaaccattttggtcgatttgaataatggctcaagatccaccatcaaaagtctgtatacatattag

SEQ ID NO: 9396 - DNA, 186 bp, Candida albicans
atgaatagaactcagaaagagacttgtcagatgcttcttgaaatacaaaggaatttactttttataaataatgtaattatttctatacttttgttatcctattattataacctctattctataatacctttaaatattttaaacacaatcccgaccaagaccatggtctataattttggtttttga

SEQ ID NO: 9397 - DNA, 195 bp, Candida albicans
caattgtctttgcacccaattctacaaagggttgacaaattcgacaatcaatctaaatattataatgtaaaatcaataacaataatacttcttcaaatcaatcaagttatggacttacgcttttcttctacatatgaaagttgcaaatatatattacgtagtcaactcacatacttgaaaagatcatcaaaataa

SEQ ID NO: 9398 - DNA, 738 bp, Candida albicans
aaacctatcatcgacatcacgttttctttatatactcttaactgtttatcatcattccatcaaattctggtatcatacaatatgactattaacaattatttccaattgactttttatttggtatctcaatatataaatgagatatatcctacatctgaagggtttaaacaagttcaattcactgatgacactaaacttaaacaagtgaaattgtttaaaggtgaagaacaattattgatattaagttttacagaaatttctgaaactcaatcattagtcaatttattaaatattgttggtagattagataatgctttaattaattgggaatggtttattactgatagcgattataccgttaaattccctattgatgcttcaaaaatccctcaagatttaattgataaatttaaaacaaaatttagattaatcgttgatgatgaaaaagttagttctatatttagtaatacacctaaaggtccaataattgaagaacacactgattcggaaagtattagatctccaactccggaattaccatacaatccagttgcaacaacagcaacagcaacacaaccacaaccgcaaccaccagcagctgcacatccagataattcgatatttacaggatcatctgtttttactacgaaaagacctctggatatgcctgattttgatgatgaatacgaaattcaaaatccgttttacaccgccggatggagcaccgaacttgcgaga

SEQ ID NO: 9399 - DNA, 201 bp, Candida albicans
tatttaaattccttctttaattcgagagaaaatgttatcaccaccaccaccattatatcttgtctcaaaattttaatatttaaaaaatatattttgtcaatagaaaaagacaggcggggcaaacaagcgaaagatttaatcgtcattcagaatgaatcgaaatcaaaattaaaattaaaacatgcaggcgagcataattaa

SEQ ID NO: 9400 - DNA, 255 bp, Candida albicans
aattactacaaaaaaaatttagcagcacataatacaagatcaaaggcggaatcgagaaaatcattttttagttcttgtttatgttttcttattatttgtaattatagtcaggtcaagtcaggccatcaaatgacaagtaacagctgtagtgtattgacaaataggttaatccgccattgttctgtcacctcatggtgtctgagaccaagaaaatcgagatcagattataagtattcgcaacgcctggaaatccag

SEQ ID NO: 9401 - DNA, 207 bp, Candida albicans
cttgccgcggcccagcacggcacaacaagcacacccagccactatgataaagaaaaaataagcacacccagcccgaatttcagattaacggttataaaccttgagcaagtaaattttctttttttttttttctggcaatttcccaaatttggtgaatcatttactgtattagggagagaggggtttacttggttgattgttgcttaa

SEQ ID NO: 9402 - DNA, 240 bp, Candida albicans
  unsure (29): Identity of nucleotide sequences at the above locations are unknown.
tacacctactacctgttgggagggttggnaaacaataaagttgttaagtcgtgtatactgtttaaaaataaaccaattcatgaattttattttgaactcaaaattccggcttcaagttgtctcatcaaccccctttttttttttcccaacccttccttaaaaatggggtttaaaaacaaacccgggaaaaagaaaatattccccccacccaaagagttttccagggctggtttaagggtc

SEQ ID NO: 9403 - DNA, 390 bp, Candida albicans
catttgcgtttttatgacaccgagccgtatacgagtgacaaatttgatgtgtccaggtttgctactttgcaattagctgctgaaaataagaatttattacgagttgctgtattgaatacacgaacccaaatctggagatttatgagatattattatgatgttagtcaagctgtttctgatacaattacttaccagccgtattttaccaattgcagattttcacatattggtgggagtgcatgtattaatggcaaaacaatcaccctagcacaagggttagcaaatattgcgccggaacataaaaaggatatggatgaattgaggaaacagtttcctatagaagagctcctatggggtggatatctacaaatcacatttcctgggttatga

SEQ ID NO: 9404 - DNA, 243 bp, Candida albicans
ttgtttttgatattacgatataactatatatatattcgaagtactatgaaagtccgaagcaagagcaaatgtaatatccgtagttacctagatcttttgagactgtatactcatctctgttttatcctttccaaagacttgtctcatcagatgtctctcgtaaatcaaaacactctaactagcttatatgaatctatttattataataaattgttttgcacttgctttttctcatatatctaa

SEQ ID NO: 9405 - DNA, 297 bp, Candida albicans
attatattgagtgatttggactctttgtcaaataatgctatttctttagcaagctattctgcctcagacatagaatgtttcagcattcaagcgaagacaggcactaaaaaagcggttactattcacttggggtatcgcaaaagtatactttccattgacgtcgatttagatttagctagctatgaaatattagaccaacaattgactgatggaccatttagctccattgcgatatcacctagtggtcaacttatttcattattcaacccaacaattaaaagaaaatatttgtcataa

SEQ ID NO: 9406 - DNA, 243 bp, Candida albicans
ttgtttttaattgactattcccttacctcccttttttatatagaaaaccctttattaataacaatgtctgaattaaaaaacggtacaagtgaacctaaaaaaaatgaaaccactcagctggattctaaaagtaaatccacctcagccaacaaatcatcagtcccaccagcatcattagttccagttcaacctacagcactcacatctcgtgacaagactactcaaagattaattgtcgtttga

SEQ ID NO: 9407 - DNA, 327 bp, Candida albicans
gcaaacacatctattaccatgtccagctcagacgacgattttgatgatgatgaagatgatgttttactacaagattttttacttggaaaaacacagataccagaagtctccatcattctgcaaacccgcaatccacttccagctaaaattcctcaaactcaacaaccaaatactcaagtgaagaaaactattttagatgatgaagtacaagccaaattatttcaagcggacggagagatagcaactttacgtgctcaattgcaacagttgcaaagacagaaacaggaagaagtttcagccctaaaggagtcctatgaatacatttaa

SEQ ID NO: 9408 - DNA, 393 bp, Candida albicans
atacaacaacaacaacaccatcctataatattaacaacaatgagtattgctataacaaaattcttcaataaattgaaaaaagcatataatcttttttattattcgagtccattaccagtattatcaaatggtgaagccatggcttttcattttgtcaatttgacaattctacttataagtgtatattatactatattttatgttcctaaattattaattcaatcaacagaaaagattatatattatttgacgggtcaacaagtttatatatttggattattacaatcgggtttaaaattagttaatcatgctgctactcataataataacgtcaccaatttttcattttcttcttcttcttcttccgcttccttggttaaaaatcaattttaa

SEQ ID NO: 9409 - DNA, 282 bp, Candida albicans
gttataagatctactactattactactattactactactactattccatttgatccggaacaacattattttactgtcagattcataaaaaaaaaaaaaaaatttagatttaccatatcatatggtttgaaactgattaattactcatttgctatcaatctatctatcattactaatacattagttaagacaagcaaaaaaaaaaatggatggatggagcggcttgtctttcctgcagtgcacaacccgcaggaatttgatttctttgtttttggtagttga

SEQ ID NO: 9410 - DNA, 612 bp, Candida albicans
ctaaagacaaatttatatagaaagggtggggaagcaaaaaaaaagtcctttattatgagacaaagaacaaccatttataatccttattctagtcatgatggaatcataactaatcttaatcgaacaaatttccaattatcaagcatacgtaatcatttattcacaattgaaaataaatataccatcaccatcaccaccacacaacctaacaaatcatcattatatctggcaattaaagaattaagaattcaaacgaaattcaataataatgaatcaggtataccaattttttcatttcattataaaccaggacttaatatttatgctgtaccacaatctaatgtcgacaaattagaattttggcaacaagttgaacaattgataatggaattattagggattaaattatcttcacaacaatggattgctaatgttaattctttttattatcatgatattcaacctcaaccattattgaatttgaatttgaatttgaatttgaaagaaggatggaaattcaatttacatcctaaatccaattatgattatatatataatcaagataaaattattattcgggaattgttaacaaatgtgtccgaaatagaattt

SEQ ID NO: 9411 - DNA, 279 bp, Candida albicans
aataaaaaaaaagctaaagcacaaactaaggcggatgatttcttcgccgatgaatctatttctcaaattcaatatacgaactctcaatcacatctgggaagtgtttacaatttgaatcttcatcgtccgataaatattaaactttgtcaacaacaacaccaacaagtgatagcaatattccttgaagaaattgcaatcgatagtgaaaccgatagtgaagagattggaaaagtaacaaatctaactgaactctttttttggattgtattccaaaaatag

SEQ ID NO: 9412 - DNA, 195 bp, Candida albicans
attgtcactgtcagtgagaatcctcggccaaagtcagggttggtaaaaggagcaaggttcacattgtttccaaagccagctcagctgttttgcttttcgaagtctcaacatattaagctagaggcagctaggaagtcatggccagaaggtaacagtcagccccaatacctagtcaaaagtagatacgagttctaa

SEQ ID NO: 9413 - DNA, 318 bp, Candida albicans
agattggcaatatttacttcaagattgataaaagatcttcaatgtaggaatgtaggcacacatagtccccgcccctcaaccaattttacttcagaaagagatttgccttctaattactgttctattactattctattgaatggattctggtgtattgtaaatgttttacaattaccaacgggaattaaacatacatctgttgaatcactcttacaatacattaacaccaccacaactccctttataaaaccctggttgtctcttggatatacttttattctttcaacgttctacaatcctcaattcacccccccttga

SEQ ID NO: 9414 - DNA, 189 bp, Candida albicans
agttgccattttttttgggagtgttttaataaaagtaattctaatgtgataattaattttttatttttacaccagataaggcgggttaaagctccaaggccaaatttttttttttcaggtttatctttgagtattgttatcaccaagagagagaaagagaaaagtgaaccaagttatttttatcaatga

SEQ ID NO: 9415 - DNA, 198 bp, Candida albicans
cttaatgagagattaattaaactgctagctcagagagaaaaatcactgccccccttgccccatacaagaaatgagagatttaaattctcattgaaaaaaaaagaaaaaagtaaaatagaaaatcttgatataatttttccctttaatttttttcagaaaagtaatttattgtcatacatcaacatacatggttggtaa

SEQ ID NO: 9416 - DNA, 249 bp, Candida albicans
ctaatttcatatctctttccatccatccatccatttcaacttatcattattttccacggagtttcagattttagtaatttgatcggagtttttttttctttttttaggtgcgtcaaaattgaaatatcaagattatccatggcaattgtaattgtaattgttaatgatgatgatgaatatgataatttgacaggctatatgtcaataaacaagcaataccttaatgttttatctattttatttttgtga

SEQ ID NO: 9417 - DNA, 201 bp, Candida albicans
atagttgaccaatcggagtggttgctttgtatttttcatcacaatcaaaaaaaaccactttggccaattttgtgtcttgttttattctttgaattgtggggagtggggcatatgcaggctattcggagtaagacattcgaaaaacattatgccccactgccaccaccaccaccaacatcaaccacaacactaaaacaataa

SEQ ID NO: 9418 - DNA, 285 bp, Candida albicans
tgttttatctattttatttttgtgagccaaactttatgtacccgtaaatcaggacgaatggatcaagagttggcttttgtgtcaatggccaaatttcttttcattcatacttttctaatattgttttatatcaagattaagatatatgactcggacaacacaatcggatactattacctctttgattgttgtaattctacatcaagtttttcggggattagcatttatttcatttcatcaagaaaatatttgcaatttttgttaaaaattagttgggccaattga

SEQ ID NO: 9419 - DNA, 213 bp, Candida albicans
tggtttagcaaccaatttttaaaaagttatgcacaaacacaaaatgaaggtagaaacaaaaaaaaagggggggagaagggagctaacccacgatatctaaaaggggaaaaaggatctccgggtggggtaaatatttcaacaaagtgttccaatcatgattcaggatttctaaaggacaatcttcaccacggggctggaaggatccgcgcttag

SEQ ID NO: 9420 - DNA, 216 bp, Candida albicans
aaacaccaacttataggaccaccagatttggatgcttacgattgtaacttatccctaaataatcctttaattcttttccgcttcaataaaccccagttaaacatagttcatatgataaaactccaacaaacagatgagttacaatggtttcaaaatacgataacaaagaatacaaaagaaagttttgaaaaacctatcaaattaataaagtgttga

SEQ ID NO: 9421 - DNA, 225 bp, Candida albicans
agacgatttacgaaaagagcattcaacacaggagatacaatctgtccatgtatgattaagcaagtgtgtattctatgtaatcaaaaagaggcaacgcattataaagaacgaattgacacactagtaaatcaaaaactccgaaaaatacggtttccgggtccacggttccgccttgacgattttagattatccttcttagttacatatttggtttgtttttcctaa

SEQ ID NO: 9422 - DNA, 183 bp, Candida albicans
attatccttcttagttacatatttggtttgtttttcctaaatcgtttttgtccaagtaaacgtagaacaaataataccctagtcattacagttgcattatcgataagaagaatatttcgtaaacagtttaagaaatggttgaaattaaacttgaagattaaagttcctccactaacaatttaa

SEQ ID NO: 9423 - DNA, 213 bp, Candida albicans
aatgatgagggcttagtagaaattacagtaattaatgtgtattattttaaaaaggataggatcgttctttcaagtcacaaactttataaattcaaagtttgtccaccagacaatgatgaggctaacaaagtacacaccataataatgctatttcatcatctttcaaattacaactttttcaatgagcttaaattgttagtggaggaactttaa

SEQ ID NO: 9424 - DNA, 207 bp, Candida albicans
aatttagtccaaggcaagaaaaataatctactaaacctggaggaggagggggaggaggtagggaggagaagcagcacggcgggtgttaaaatctgcaggagagttaagattatcccgctagtcccaaacccacttaccaacccacatgtcctatctcatagatttgatttaataattgataatttattaacaacattattattataa

SEQ ID NO: 9425 - DNA, 210 bp, Candida albicans
tcactttcttcgggtaatgatatttcactttcttcttccagttcctttgattcatcagctaacggggtagaaactggagacgaggtcttgtcgccgaaaattgaaggaccacccgatccaagtttggcaaatcctgagcttgttgatcctgactttgcgaatccagaaaaaggacttccacttgactgggcaaatgcagagcttgcttga

SEQ ID NO: 9426 - DNA, 444 bp, Candida albicans
  unsure (60): Identity of nucleotide sequences at the above locations are unknown.
ccaacttatctacaaaaattcaaaaatgttttgggggaaaaagtgaaactcgaccgtctntacagtcaattgggcatggcagcagaccaaaactctgccaacaaagatgtcctcaaatcccggccattggatttcaaaaacgatttgatgcaaacaaaattgcgtgaaaaactaaacaacgtgagaagcttagaaaagaaagtgttggcgttgttgatgccaataaaagcaaagaattcaatggatgatcaaacaatcgacaacattgaaagaattgtatttcaaatcaatgaacagattttggatcactcagtaggtattgacgatttggcaacacaaatgggagagttagacattgaaggtgacaagaaggttgacgtgttgtcaaattgttcaaagttaaagttgaggcagaaattaagacaaaagtcaattatgttttag

SEQ ID NO: 9427 - DNA, 309 bp, Candida albicans
gctattctcaaccggaaagtacaactagcaatgatcaccccaattacaaaagagtgcatttataaatgggccaacattttaaaagccaaaccaactttaatcaaagatactttttcaattggaaaatacaacaacttaacgaatttgttaaacagtattttgcaaatcaatcatcatccaacagttaacaaatcatggtttcaagggttccactttgtattcaacaatcaattgaatacaaaattacgcagtgacgggtatgacaactatcaagcaccagtgaatgaacaaggtgaacaactatattta

SEQ ID NO: 9428 - DNA, 207 bp, Candida albicans
  unsure (200): Identity of nucleotide sequences at the above locations are unknown.
ttgtactttccggttgagaatagcctacaattggtgtgtggtgagatatgcgttttgcttgctcaaagtagttgtcgctctaaatatgagagcctggtagataaatcacaaccgtgtgcgagaacaatgtctcacgccataaataaaaaaaagtcggcagatagttcaagcatttgtgttcgtctgccagcgtgcgcganacagtaa

SEQ ID NO: 9429 - DNA, 543 bp, Candida albicans
aagaacatacttacaatggattcaattttcccttccaaagttgagtacaaacaaattgatacttttattgctttgtgtgacggacttatttatgataccactgttgacgagatcaaagatgttatagctcctgatttcccacaggaaaagcttcaagaatatgtcaaaacatttaccagaccatcgcaaacaccagggtttagagaagctatttacgacaccatcaattccaacaccacaaatgcgtcaagatcattcggtattttatgtaacattttaggatcaaggatattggcacctacattgaccaactcattgactcctattaaagatatgactttgaaagaacgtgaaactttattggcatcatggcgtgactcccccttggcagccaagagaagattatttagagcaatatgtgccctttctggtacaacaattgttagattggccagtgaattacatcttaaagcaattcatttcccacaaagagatttgcgtgaaactgcttacgaaggtcaagtcatagatccattcaggtac

SEQ ID NO: 9430 - DNA, 189 bp, Candida albicans
gcaccaatataccacatacatattgaacaaggaaacgagaaatatattaatgctgtccttcttcctagccggtcgacaatacaaaacatccaaaccaatgccgcaaaagctttcaatatcccgaaaatacctgtagacaacaatcaagctttcagtcccgttattccaaatgatgcaaaaatagcatga

SEQ ID NO: 9431 - DNA, 279 bp, Candida albicans
cgatcagggtccatgcaaaatcgtggtgttattcctagaaataatggacaagcacctctaccacaaccccaaaatggtgctagaggatttgttagccaacaacagcaacagcaacagcaacagtaccagtattcatacttacctctgggtgcttctggtcaaccaaaacaacagcagcaacaacaaccacaacaacaaccgcaaccgcaccgaggacatcatccttatggtgcacaatatactagccagaatcctaatggccaagctaggtattattaa

SEQ ID NO: 9432 - DNA, 936 bp, Candida albicans
ttaatgaaatttcatatgagattgcaaaaaaaaatttttgttttggaatattatataaaacctgacatatcttcgttttctggaaaatatttattccttcttttttttttattccaatcccatatcaatcaactttttgattacatttactttatacaaaaatatcttatttgctacataatgaaatttttaactgctgcttccttattgactttgtcctcatcagctttggctgccattaaagacattcaattatatgctcaatcttccaacaacgaagtcaacgactttggtatttcctccagacatgaaggtgctgccttgaactacttattcttggctgctccaggtgttgctgaaaacttgaaatatgatgacgaaaccaaaaccgtctatactgaattaaaagctggttcctccactgtcagacaaccattaaacgttggtaatactgttcttcaattgggtggtagtggtgatggtactaaagttgacattgctgaagatggtaccctttcctttgatggttccgactctgttggtgctgccaagaacatcaatgacccatacaactactccaaagattcatatgccgttgttaaaggtggtgatggtgctattccaatcaaacttgttgctaaattcactggtgacgataaagaatctgcttcttcttcttcttcttctgctgctccagaaccaactgcttcttcatctgaagctccaaaggaaactccagtctacagcaacagtactgttaccctttacaccacttactggtcattatctaccaccatcactttgaatgtctgttctgatgtttgtactcccactgtcattgaaacttctgggttcagtccatgtttcttcccgtcaagttccatccaagaatgcttcttccgaaaactgctccaccaaaaaaacactggtgaatcc

SEQ ID NO: 9433 - DNA, 186 bp, Candida albicans
aaagtattccatcatctgtttaacctagtgttttcccgtttgactccacattttctttctgaaaaatctactattctgaatatggtaattcattgtcctaaattggaacaagccacatttgtgccagcaacgcttcttttgcttcgagggggggaactacaaagagcttgctattttcaacactaa

SEQ ID NO: 9434 - DNA, 456 bp, Candida albicans
gtactatgtttctttttaaacttgaactctttctcttattataatctgttgaactattcatctttaaaatcaataatgaagccacctcaaagaaaagaatataatataaagaataacaatcataatcataatcaatcaaaatcaaacaccaacggcaatggcaatggcaatggcaatgctaattccaatacaacaacaattatgaataataatcgaaaatcatcaatgaaaaaatatcgatcaatagctacacaaacattacctaatttatcaacatcattacaattgagtaattataattcacaatataatgatgtcaatgaatataaatattcaaattattcatattattataattcattagatgaattatttttacaatttgaatatgaagatcctgaacttgaatatattgatcaatttattaaagagaaattgaacattacgaataagtaa

SEQ ID NO: 9435 - DNA, 216 bp, Candida albicans
atcaggtcatttttaaatttttttccacttacattgtttttgcggcctaaacctaacaaacaaacaattgataaattctattattcttttttaagcgaaacagtcctttgcctattaggcgcaattatttatttattttttttttatgcccctatgatgaataacctcctctataatctatataaactaatgatcttttcaattgagaatcattga

SEQ ID NO: 9436 - DNA, 198 bp, Candida albicans
tcaaactttttcatatcactaaaagacaacactcgacccaaatatccgagaaattctaatgccgtaccacaagtccaagccacgttaaaccaccaatatcgggatttaatccacattaaacaagcaatgacaaatgttatagcaaataacactaaaaataatatattagccgtacgatttaatcgaggtatatcataa

SEQ ID NO: 9437 - DNA, 192 bp, Candida albicans
actccctttcctatggggctattttgtggttataggtatatttctcttattttgtttattctttcacacgtgtatatatacatatatatatatttacatgttcttgtatctagtgataaatatatttattataattatttaaggaaaatatgtaatagtcaaattacgttaataacttgtatttctaattga

SEQ ID NO: 9438 - DNA, 183 bp, Candida albicans
ttcaggggaaaccggaaaaaccacgggattttcttgttcagaataatttctaataatttttttctgtgggttcaagaaattaataatattattaaaaaaaagactgttaataatatattgttaaccgggattaaattaaattacacgacaaatattatttatttttttgacggtttaggttag

SEQ ID NO: 9439 - DNA, 228 bp, Candida albicans
ttcaaattctcaacagttagtggcaattcaatagctcattggatttttaacacttttattaggattataatgagaacattaacccatgtggagctacaagttcaaatggaatttgggattctccccaataaaagtgtgcaaacacgttattggcaaaatttaacaaataatggggtacaatataaagcaaaagattggaatctgtctaaaagcagaagcaaaccctga

SEQ ID NO: 9440 - DNA, 183 bp, Candida albicans
gaggaagacaccaatacacgtctcttgaagaaagagaaaaagttaaggatgaattggccctgcaagtatccaatcaaattaccaatattcaatctattgtttcaaatagacactgatttgaacgttgttaagaatgatggcatatgtgtgtttgatatagagcagtgtatgttaacaaaataa

SEQ ID NO: 9441 - DNA, 441 bp, Candida albicans
  unsure (292): Identity of nucleotide sequences at the above locations are unknown.
ccaaatcagaacatacttttcttaaaaactattacgttaaatctgataatgaacaattcaaatgattggagtttttcattatgtgatgactctcttgaactatttgatgctatcgaggaagaagtcggtgataatgataccactattcatccaaagagcgacgattctaataatggagataaatgtacaccactgaatcaatataacccctttatacttacaaagatgaattacttcgaaagaaaacaccccaaaacaaaactgaagatgtttgacaagaaaattaaagtcnaggctacagatattttaaagaatattggaagtactccccctgaaaatttgaactgggacttcacatgttcctggattcacagaaaaggtattccaactgaaatattaaaagaaaggtgttgcaatcgagttgtcaattctgaaaattaa

SEQ ID NO: 9442 - DNA, 195 bp, Candida albicans
aaaacaaaagcgaatatagcccatacaatcaacccgatattacaaactaaaccaaaaccatttaaccagaatggcccatgtctgaatttgtttcttttgaataccaagaatactgttggaatcaagtatgaaagtaacaagaaagtaacacaagaaatcaaaatggaattgtacgcagttgaggaacccaaataa

SEQ ID NO: 9443 - DNA, 969 bp, Candida albicans
aaaatcaacgaccggtgccatttccccacttcccaacagcaacagcaaccacagcagcagcagcaacaacaacaaccttttgttggaattcaaccaggacttctgcaggaacaacaaattcaaattatacaagcaaatcaaaagcgaatgcaacaagaattgcaacaaaaaggtggatcattctcccagggaagtccatttcagaaatcacatacacgcggaggaagtggtggtggtgtaggttcccaacaggacacattcaatgttaatccaggaccacctttgagctttagatttggtgccggtagcagtaccatcagcgctagcggaagaagaccattatcaccagcaaagattggtgctgcagctgtagcaaacctagctacaccaaccacaccatatcgcggatcttcgtctacggcatctacaagcactcgtcgaagtgcggcacaccaccgacacagctccttgccacttgatacatctggaatttctcacaggcttagctcagtaactagtggtccagaatcaagtgagctgaacaggggccaaggactacaatcaccattgacaggagccacttcaacattacaagtaaaaccaatacctgcacgaccattacataaacagagtaagctgcaagtgcagccactgcaggaatcaatgacctcatttcagcatgtcattcaatttcatcattggaaaccaacaacgggttcaccaactagtagcagtgttggaggtggaagtccactaaaatctcaaacgtcgtctcataaacggcgcaagtcatcccctagcataccatttcaagagcaacagatattacgaccaacaaaggagaaagaattctatgcagaatcaacaccaaaagtcacatttgaaaacaggaataaagaccaggtcgaaatggatcctgatctttctattgattcttcagttggtgaaaatgacagaactgaaagttga

SEQ ID NO: 9444 - DNA, 465 bp, Candida albicans
tatctgccacagccttttcacctactaatgctacatccaggagttagactcactaaaagagtatacaagcagtcacaaccattgcttagaaagaatgaacatgaaatcttgctcaattattcgaagcgattgataaacactacacgatttcttatcaatttatcgagaaaatcacttatcaaaatattcaaagtgattttcttacagagatccactctaagtacatttgcatttgcttatatttttgaagttctacctaaattattgtcaagtgtaattcatcatttatttcaactaaagttgaaaggtttagggaatgaaactttaaagattttgacagacccattagattcactaagattacctatttttatgactaaactagtagccacattaaatgcgtttaccccaatttacatttcaatactactgccatatattttcaacaataaatggtctttttaa

SEQ ID NO: 9445 - DNA, 255 bp, Candida albicans
ttcaaacatggtactaattttgaatctgttgataaagaaagcgtcttgaatatacttatagatgtcattactgttattgctcgttatagttttatgattgcattaataacaacaattgttgtttcacatcaaccacctcagcatttcatttttatttttatatggttctatttaggttttttatatttggtttcttctctgtttattttttggcatttatttaccaatttgtattatattgaatattttagatag

SEQ ID NO: 9446 - DNA, 234 bp, Candida albicans
aatacatttatcattggtttatttcatagtatagaggccgacatcttatctttttcttatattgttattgttgttgttcattttagtttatgtctctggtttgctaatgatttacattattgtgggaaaaaaaatagaatgaagtccaagcttgttattcttgcttctattactaacattgttttaattaggctgcttgggttaaacttttatcaaaatcattcccaacattag

SEQ ID NO: 9447 - DNA, 198 bp, Candida albicans
atatcaagcattatcaccctgactaaatgctttggtgcaagtatattgttattgtttgatgtttatctagatcaattccctggaattgcaaaagttagtagtaaaaaaaaaaaaggaaaaacatttgtccaaaaattcacgttttcaaaacataccgctacccaagttggaactaaatcacatttgtttaaaacataa

SEQ ID NO: 9448 - DNA, 213 bp, Candida albicans
aaaatttttatgggatgggccacaacaacgacatttgttaaaaagaaaattgaaaatgtcgcactcaacttagtttattttgaacgacaattttgcaataataatcgtaacttaatctctattctcctatttctaaatctctataactatctatctatggctaattccatcccatctctcgaacgtgtctatattaattccaaaattatctaa

SEQ ID NO: 9449 - DNA, 195 bp, Candida albicans
tgtttgcatccgagagttttgatttattcagtgttgttttcattggttgagggcaaaaagttcgcatcgagcagaaaaggtcgtgcccggggcatagtggatagacaacgattactgatgaaccacatgtgctacaaagaccaaactagggccgttttgaagctacaatcatgtagagtattgggtgtgaattag

SEQ ID NO: 9450 - DNA, 198 bp, Candida albicans
tttagacgctggtccgttaatctacctaatagtcatatttcaagtgatattcataaatctataatgaaaatgtgttttagagtaatgtgtttggcagaattagtcgcacttggtattggcgtcatagtcgtctactcggtttgtcttcactcacgggagcgtgaccggatgccaaaattagtggttaagggggggggg

SEQ ID NO: 9451 - DNA, 204 bp, Candida albicans
tatcttttctatctttgtctgagtatttcccgaggatgcggagataagagtacttgtggcgagattgtgcaagattttgtatgggaaaaatcacgtgacacggagacggagttaagggtcgtgtacccgagcccaaaaatacatagtaaatttgttagcgaaacggagattagtttgtgtaatttccgaagtgtgcggaaataa

SEQ ID NO: 9452 - DNA, 189 bp, Candida albicans
  unsure (84),(116),(123),(166),(175): Identity of nucleotide sequences at the above locations are unknown.
attcaattggtagtagtaaaaatagaaaattatgttacaaaagtgggaaagagaattaaaattgaaaatcactcttggttagtntgttctagtgttgttgctgttgctgttgttgntgtgcantacacactgtggatatatgcacaatgcggtaataatgcaaaanataataatnatagggaacattga

SEQ ID NO: 9453 - DNA, 273 bp, Candida albicans
agttgctctacacagttgacaaatcaaaaagacgaaacacagcagttagatataagtatagcaattattcatctctccccacaaaaatttttcactttgatatacgcctcgattgttgctaagttgctgacaatttcacccatcgaagcattctctaattctttatattttcatttattaatattattacataaattatacaatgttcaaatctccgcaatctgtatgttttatatgatatcatccttggaaggcaccagctgcaagacataa

SEQ ID NO: 9454 - DNA, 306 bp, Candida albicans
aactttcttttgtcaacagttgcaaatttgctcacttttatttctactcaacacagtgtttccacagtttcactcacaacccacaccaacagtttgcatttgaactggtacatctattttccaacaactaattatgctaagaaaaaacaaaacaataataattcgagtgctattgatgtttttatctttcaaagttacttttttacgatgcagctttatgctctttttcttggcaactctagccgcaactatattggagaagaagaggctgaaataaaagatgtacagaagagcttgtacgtttga

SEQ ID NO: 9455 - DNA, 192 bp, Candida albicans
gctttccctcgtacttcgaaggaaattcaacaccaacagcatagcctgaataaactatctattattagagcggcatttgatattgatagcaacctacgtttgatgaatgaaaacagactacaaattaatgaccaaaaaactatggtggcatttcggatctccaggtttcttttttgtccagcgttaagttaa

SEQ ID NO: 9456 - DNA, 1014 bp, Candida albicans
  unsure (46): Identity of nucleotide sequences at the above locations are unknown.
gtttggagttttggtaaacgtattcaatcaaagatcaacacaattntgaacaataagttcccaacatctatttctatgaacaagatgcatagaaaatcacaaatgaatgccaatggtgaatttattgttaatgaatttcctcaaccaaaacgtcaaattctgcaacctttaccattgtcataccgtagcacatcatctccagctggtgttggtattgtcatgggaggaatcaataatgccaatgaatattatcctaaagttaatcttcaaaatagaaacttttcgttaccaacaaacttttataatgttaatgccaatgttaacaacaacaacaataacaatattggtgatggcaataatgtcaataatactgttaattccaatgttactactaataataactttaatgtcaacaataaaaataatatgaataattctgtatcatcatttcaatcgggtagtgttagtactggaccctttaataataattctgcatcaaattctttaattaacatgaatggaaacaatcaaggcaatccgccattttttggtgactatgctgttaataatgattacttgacacaacaacaacaacaacagcagcagcaaccaattggagttgcttcatatgccgatgcttctcataaacagcaatcatcgatttcatctatcaatatccaaccaactcataatgctatgggacattacactactagtatggctcaaagctatacaccaccttcaatgcaacaaatgccaccacctggtgtcatgccaaacttttacaatggtggtgctggtttacctcaacagatgtttggtcatcaaggaccacttccaattccccaacaacagcagcagcaacaacaacagcaaccatatcaacagagacaacaaccacagcaacaaaacatagctcaaccaatttacaataatcattcccataacccttcttggtcatcggtttcatcatttggtggaggtaaaactatttacgggtcaaataactggtga

SEQ ID NO: 9457 - DNA, 192 bp, Candida albicans
atggttcttgaacacactccagtcaaggcatcccaaaatcgtatggtatggtcataccctgcagaagctaatatgactgacattgaagaagtagttgtctattggatgggagttttgttaatgagcggagtatatttggacaaagtaataaagaatagttctggtgaaataggagtttcacacattttttag

SEQ ID NO: 9458 - DNA, 228 bp, Candida albicans
aatagcaacgaaaaggaagaaaaggaaaggggaaagaaaaaaaaatgtcctgacagtatcgacctattgtgcgtgagcgagagagaaaaaaaatccggaagagacgttaactatgggagagaagtagaattcaccagaagaaaaaagaatattgtttggtttctctcgaagtcgaagattctatattcttctagaaccttctacacaatgatatacactttaaaataa

SEQ ID NO: 9459 - DNA, 219 bp, Candida albicans
aaggaattgatttatcaagaggaaattttcgtccaacatacagtttcaacggataatttccaaaatggcaagcaagtttttatgtcaagaaaaacggaagagttgagtatcattgaggaagtttcaaaatgtgaatccagacattcaagtgtgctaagtaagttgaattatgttaaaaaggaggcagataccgaagcacaacaacaaaaaactgtgtaa

SEQ ID NO: 9460 - DNA, 750 bp, Candida albicans
gagaaattgaaaactgtgtgtttatgccatatgatgtcagccaaaactgatatcccaaatacctcatcaacatcgccatctccatcaccaacaactgcaaattctacagtaactacagtcacaacttcatcacctatttctgaatccaaacctagacgattacctacttctgaaacttatcactataacgtccaacaccacctacaacattacaaaaacaacaataggttctcaacgcgacaaaatttacaacaattaaaagaacaggtgacatcacagaacaacaacaataataataataatactagtacatccactcctatgtcttataattcaacacctccaacaacaataactaaaacaaacctagacccagtgagttcattcccactttctgtaccaacaacaccaaccacactaacaactaatacaaccactataataaatgataacactaaagacaaagataaccacaacattgacaaagaagaagatgatattcagcaaaaactattattaaaggaacaatctttgaatgatatcaaacttcaatgttcacgtttaatctatgaactagaagggaacaatgaaccagaattaatcatcaagaaatacattcaagatttgaataaatacaatgaattaaaagatttggcattacaattgatcaccttgattgcagaccaacgtaaagtgaaaacttcggatattctacaagaaatgaatattgaaataaataataatgaataa

SEQ ID NO: 9461 - DNA, 1440 bp, Candida albicans
acttacaatatgagtagaggtggcggttataacagctcatataaaggcaaaaggggaggttatcaaggtaattggaataatggacatggcaataataataataataatagtaacaatggtccctataagaaatcactgtccaattataaacgtaatggcaaaccacaaacagatacctacaacggttatcaagggaaaaataacaacaattacaacagcaacggaggtaacaaatggaatagaaataacaattatcaaaataatcaatccccaaattcctattctcgcggaggaaactatagtcccaataataacctgtctattgagccaataattgaagaaaatgtggatgattccaataataacaagattttcaaatatttaaataataatcttaaagattataaaaaatcaattcctcaagaatcagccaatgtacgagaaaatcatattaaaaatcgaataaataatgatattattgttgaatatagagccatatgtcgatttttcttaatgaattttgataaaatagaatttgttgatgttaatcgacattcaattcaaaattatttacaattaattgttgatgaaagacatatagatatggaagagcattttaaacaatttactttattggattatatggtacaaatggtgaaagatgcatttaaattacaaagacatatagtatttgatggagttactgaagaagaatataataaatggaaactggaacaagatgcattggaaaaatcaaaaacaggagcaccaaaaataacatttgctgatgaaccatttgaatttgatgaacaattgattgattttgaagaagcatttgaagaagattttaataaagagaacagcaacggtaatgctaataacggcgacaataatagtaatgataaatcaattgatactaatggtaataaactgggaacaagtataagtgttttacctacagtaattgaagaaaatgaaacagattcatatataccctcaacatcaaagtttaatcaacatcaacaagaacaaaaatcgacagttgaaacatcttgggattcatatagaccatcgactcgtaagacaccagtatcaagtagtaatggtttatttgttagtgattccgaatattcaccacaaacacaaagatcaacatctagtttaccatctcaatctaattcacaacaacaacaacaacaacaacagtcatcatcaccattatcgtcacagaaccaaaacaatcaatacaaccaacagaatctacaatccacatctacagggcgtcaattaccacctacaggaccaaaaaaatatcaaacttcacctccacaatcaaattcttcaaattattcaccatcatcattatcacaaccatcacattatcgtccaacagaacctagatttgaacgacgtataagagattatcaaacagatgaacaa

SEQ ID NO: 9462 - DNA, 216 bp, Candida albicans
atcccgacgtggatgcttccagcgcgtggtgaagatgttgtgtattttccaccaataattgaagttcaccaatgtattattacgttatatatactctataatgtactatatgtttctacttgccctgaccaaccaagaattgtttcactttttatctttgctttgctctctcatgctttcgcatttcgtgttgtggatttcatcttcatacaataa

SEQ ID NO: 9463 - DNA, 186 bp, Candida albicans
aacaaggtaatgattattagtgtatggcatgtgtttatacaattcaactacctaaacccattccatagtatatgtcaagtaaaacccccatcaatacaattggagtgctttatgattttgtgcacgaaaaaaaccgtcccaaaaaagtatgttgaatcaaatgcaacatcaaagatgatgtcgtaa

SEQ ID NO: 9464 - DNA, 204 bp, Candida albicans
gaatgtaattggagttatagaaagaggggggggttggtttgtatgctagtatttcggtgttcaaacaataataataaagtagtagaagaaaaaaagaagatgcagatgttttgtgtcataatgtacacagaattattgtatgaagatgaaatccacaacacgaaatgcgaaagcatgagagagcaaagcaaagataaaaagtga

SEQ ID NO: 9465 - DNA, 267 bp, Candida albicans
ttctctttcacggggaaaacgaacgctttattacatatattgttagacctgcgtcaacatgctagaaacgtttcttattctgtatcctttactaaacatacgaatatagatatctgtcatcgtcactgcagatatcatctaaagtcgtgtgttcaaccatatctatatatccgtgaatttatgtatagcactattagcttgtgtgcatatttagtaagcaaaaaattggccaatcagaggtttccaatttgtcagcaaatactataa

SEQ ID NO: 9466 - DNA, 222 bp, Candida albicans
aattcctgtgtatataaacgtctaaaaatttttaaaaaaaaaatttctcttatatattttcaatcaaactacacaatcaataccaatatcaacaaagtttccaaggcaacaaactacccggtatatattattgacttccaaatctgtaacggtgaggacgctgcagagacgaccagcaactcgccactgcaatcaacaacagtaagaacattgcagatataa

SEQ ID NO: 9467 - DNA, 216 bp, Candida albicans
cctttttttggtataggtaggagtgaaataggatatatacaagcagttcttcagttgtataaagttgggattaatgaatatatattagttgggttattgctgttgaaaaagaaagaaaggaaaaaaaattccatttcagaaggaaatttgacctctatttatagttttttttttttggaatgtatgtccacattattaagaatattgtgtgtgtaa

SEQ ID NO: 9468 - DNA, 222 bp, Candida albicans
agaagtggactgtttgtaatgaaggaaggaaatatttgtttgggaaaaatgaagtttcctaaaccagaagagggggtttgtattttctcccaaaaaacaccttttttgggtggggggagcccccattattttaagggaaaaaggccccgcggtaataaaaggggttttaagaaaatggttgtaaataaaaggggtttaaaaaagagttttgggggtgtttaa

SEQ ID NO: 9469 - DNA, 186 bp, Candida albicans
  unsure (44): Identity of nucleotide sequences at the above locations are unknown.
tttaaaatacctttgttgtccaattcttccttcttttttttaantaattgttatgtttccaaacccttttttgaaaaaaatattgaaaaaaaaagtggtgtcaccacatggtatatgcatgggttaggaattatcacaatcagtagtagtagtagtagtagtatttttattattttttttcaatga

SEQ ID NO: 9470 - DNA, 261 bp, Candida albicans
  unsure (144): Identity of nucleotide sequences at the above locations are unknown.
tactcaccattcatttttaacatcaattatataaaagaaaaggcttggaaagtcacatttattgttgttttgttgaaaaagaaagaaaaaaaagtggtgggaatatggaaaaattttgttttgggtggatttgtttgtttatanttcgttggacgcgagattttgtcggattctggtttttctgacgaaaaatatttgaccaaaaaagacagaaaaatatgggtgtacaaaaccaaatttatgcacacaaaattaaattag

SEQ ID NO: 9471 - DNA, 246 bp, Candida albicans
agtgtgtatagaaaagtaagagatcacaatgctgatatcaatttatttattgattgttcgttctacctaaggattgtcaatttgtcacaaaaaacttactggttttgtgtgttagatagagggaggggaaaaaaaacgtcgtgtcgagttttcgcttccaccaaaatcccttgcaacacaccatccataatgatgtgggtggaagttgttatttgccgcttgaatattacttatttgcagaattag

SEQ ID NO: 9472 - DNA, 240 bp, Candida albicans
ggagatatcaccacaacattgtataaatctttccttttccggaactttattcttttgaactggcattatgtagtgtgtttattaggagaagttatagggagtaagtacaagtattcttatcttaatatcgatcgaagattagtagcacttggtttgctttatagcataaaattttttttatcatcatcacttttagatggggtgcttatatacaggcacataataattttgttttgttaa

SEQ ID NO: 9473 - DNA, 204 bp, Candida albicans
tcattattgaatatatcgtcaacagaggctagtactattggtagtactaataagagcagtagtattattatgaatcagattgaaaaaaaaaaaaataaatggaaagacaattcgagaatgagatcaaagtcaaataattttttttttattgtctccaaatacactactacttggcaacaaaacaagattacaaagtggtcttaa

SEQ ID NO: 9474 - DNA, 204 bp, Candida albicans
atgcaaaaccaactaaaaaaacagtacagtaaaagagacgaacatgataaagacgaactgaaatcaaaatcaaagcaaaacaaaacgaaacgaaacgaaacgtttagactaaaaacccagatgatactatctgacgttatagtacattatacatgttgctgttactattgttgttgttttatagaatttgaaaattatttgtaa

SEQ ID NO: 9475 - DNA, 189 bp, Candida albicans
gtacttttttttttcacagtagaggaaactccattacctttgaaatttttaaatgaggaagttatagttaataatttacggtcatttggcttcaagttttggaagaaacaagcaatacgtgatattaggtttatgaaatcacatgcagttacgacaactactattagctttttattcgcaattgtttaa

SEQ ID NO: 9476 - DNA, 228 bp, Candida albicans
gagttactgccaaaagaaccaatttacctggtttcagaagaggtagaggtagaggtggattcagagccagaggaagaggaagaggtggattcagaggaagaggtagaggcagaggtggttttaattccagaggcactagaaatggtgactctgaacaagctgatggtgatgccgagaatgaggaaaccgattaaggaagatttatcagaaaatatatctattatatag

SEQ ID NO: 9477 - DNA, 243 bp, Candida albicans
ttaaaactagttcttgaaagtcaagatcaaccaaacacctcacctagatgtagtatctacaattactattgtttgaacaacgacaatcgtcttaaaatgttgggtaaaaaatttgcaattggttgcacttcgaaaatctatccaatgtacttagtcttacaaaaatcaagcaacgctatatgtgagttccattaccaactgcataacggtatagacattaagagcagacataatggaagataa

SEQ ID NO: 9478 - DNA, 195 bp, Candida albicans
tttgtaatgaatataaaaatgtatcagttaagtattaataataaagttataattccgagtcacgtgatgctacactttaaaaaaaaatgttttgttataatttcagacgcagacgcgttttcagaatttataaagtttaaatttgttttgaaccaattaacactacctccccttttttttttttcttttctttaa

SEQ ID NO: 9479 - DNA, 216 bp, Candida albicans
ttacgtttaacatggaaatcagaattgccacctccacctggggaatttgctgatgccttaacacgtttgaaatctttgagaattaaacgttttgaatcggcagaatatgaagatatattacgtaatttatgtctaataaaattgaaaatcgccttcaaatcttcatctccatcatcgtcctcatcattgttgtcgttatccccaccatgttcctga

SEQ ID NO: 9480 - DNA, 189 bp, Candida albicans
attatatacaattggattaaaaaccatacagacccagtagaagaagtcaaaagaaccttattgaaacaacaaacgttaatttatattatatccttttgtattattttgacaatgaaaaataaaaaaaaagaagagagacccttccctcgtttaaattatatttcaaccccccctactcatcatccctaa

SEQ ID NO: 9481 - DNA, 1155 bp, Candida albicans
gcgatgggtactttaattgatgatacaaatggattgacaaataccccaattttggcgtcaaaaaataatgttgcaaagtttcaaccctcactaaatgaaaatgaacctaccaccacaaccaccaccacaaccatatcgagagaatctacaattgataaagtaaatgtaccagaagaaaacacctcattgatcattagtcaagaggatctttattcaaccattgatgatgatggcgacaacgataatgaatcaaattctttaaccgctgatactgaagaccacaacaaactcaacctgaaatcagactcttatacttcttatattgaacatgaattagatctaccccaatttgaaagaacaatatttcaacatcatgatattcaaatcaatgtcccggattccaaacatagtttagaggccacagaaactgatatggaaatttctgaaattttgcaattacctaaatcatattttgcttatccaactacaactacatcagaatttaaacatacagatataacaacaacaacaaacttgccagatccagaagttgttgccgctgctgctactgctgcaaaatctgaagaaaaggaagaaaacacaatcccaccaccaccaccacctcaacaacaacaacaactaataccttcttcaggtgccactgaacagaaagttaatccagtgagtcaagcattaaaaatgaatactagtatcaagaaattaaaattggcaacatctaataatgttgatggagccactccacttattatcaatagtcctactgcaaatgaaatcaaattaccaacaaataattcttgggttttacaagattatgaacaattatttggaaccaagaaattccataaagaaattgaattggcaaaatctttacggtttgctgatactacaaatagtgtttgttctgatcttagacatgaaaaattgatttatatttcaactagaataatcaatccagggaaaatcttatcattttatttaaaacatccactactaccaccaccaccttcctcttctaccactactaacaccaaaagagatttatacattgatttgataatgaataataatggctgtaatatattgttacaattgataaaatatattcatgagaatgaaactttactggattcttaa

SEQ ID NO: 9482 - DNA, 246 bp, Candida albicans
aacaacaccaccaacaaatttaaaacgatagaaagaaagaaagaaacaaaatccgcctacgtaatcaatctcacaccgccgacagacactacaacaaaatttatctctaagcgtgaatatcaactttgtttaacaatctactaccaccacccaaagtcaaagtcaaattccaaacctttttattcaactttatttctttttatctttttattagttaaaaactactttcacttactaccaatttga

SEQ ID NO: 9483 - DNA, 294 bp, Candida albicans
gacgatgaatttctagccgccgggtctggtcacgatactggagacgcgtcaaaatcaacagtggtagaaatctttgtatcgccatccatgaaagtcacagtgttttttccggcagtaaaacatttggaatctgccaaatcaactgaagaacctgttccacctacattgaatgtaatgggcaatttgaccgtaccagaaaccctagcatatgataccgaaacactgttcacagtacatgataaggaagaaaatgtcgtaaattcttcaccagcattaaagtcacaagtggcatag

SEQ ID NO: 9484 - DNA, 531 bp, Candida albicans
aacatgttcattattagaagatctcgaggaatactattattggtttcaattgttgttttcaatttgattgtattatcactatttcaattcacccccatagatgattatgtcattggtaataaatatatcgacaatatcaaacaactactaataaattaccaaccagattccccttcatcactatttagttcgtggagtttgagcaatgatgcaggatttgcattatctatgaatcatgataaagaaattgcattccacaaccaagtggcgtcagctgctgataatcatgaatcaactaatgaattatataatcaactcgattcaacaacagttaaagctagtcaattcaacgtcattgatattcctaatgatatccctttggcttatcaaccatttgatccaagattcacattgggcttgattttgaactatattaatgaacaagaaaataaggatctagaattgcctagtttccattggagtgattttgttgatatgtcaccattggaagatcaatttttccaacgatga

SEQ ID NO: 9485 - DNA, 732 bp, Candida albicans
ttgtattgttttcgcccaagtgaacactatatatctaagagtcaaatcaaaatgaatgcaaatcaattgagaatcccaaagacattacattttgctgatgaaatatctcatcttaatagtaatttcattagtgttaactcgtataatcaaaaccctacgtcaacgtcaacgtcaacttcaacactagccaatcctagatcaattaacaagttcattaatagcactcccaagcttcctctagctgttaatcaaaattcaaattcattaatatatgatattattgatttatatttgttacctgacactgcccctgaagaattagatagtaagaccctatctgcaaatgataaacacaatgttcaaccagcattatttgcctcattacataaaggatatcattatttctttggtaatgattatttaccaagtacctgtaattccgtcaatgatgaaaacaccagagtcgtattggatatgaacatgaacatgaatgatgcaaacacagcaatttatcatgacgaaaatattgaaacacaaagtattaatatgtggtttaaaaacaaatcagctggggttttccacaaactaaagagttttggtcatagatcctcctccactactacgaacagaacaaattttaaggctggtgaaacggttgatgaaaaattgaaaagtttgtttagtgagacaaccatagaagagaataatttaaaagaaattgttgaacaacga

SEQ ID NO: 9486 - DNA, 243 bp, Candida albicans
attaatgacctgctagcaaactttcgtgaaatccaatcccttatatatgttaaaagagaaaatataaataggggtagatatttacccctattttttttaattcagaaaaagaaggattattatttggtttttgatttttttatatttgtctttactttataccctcaactacaatctaacacaaaacttcctcccttaccccctttgcttacaattctttttttttcttttagtcttatctaa

SEQ ID NO: 9487 - DNA, 711 bp, Candida albicans
actcagggatcatctgtttatgaaagagttaaacatttagatgaaatgggtttcactcaggttatcaaacaattgattaaatactatactgatcaagcaaatgataatctattcaataagagttctcccgatgaatcaagaatggaaaatgtgtcggtattgtcaaccgtactctttggcaaagggcacgacatattagaaaaattggatactgccttgagacaaataacagcattgttaaacacgaaaaccaacaataataataaaagaggtagagatattggtgttagtggagtagatggtcatcctaataataacaacgacaataacaatgacaattctgggtatatgaatagagagttaagattacaaattgatggtgacaatgttagtatcatcaagaagtattcagatgaagatatagaaaggagggcaaatcagaggcaccaagaaagagaaagaagagataatgacaggtatcaaatatctcaaagacgagaagcgattgattcagaagataatgatgatgacgacgacgacgacgacgaagaaatggaggttgatcaggatcaacaacaagcaggtggtggcgcaggaggtgatgatgacgatggagattttgattatgcggttgaagcaaattatgaagatcgagatgattccgaaagtgaggctagtgatgaaataccagatgaatactggataatgtaa

SEQ ID NO: 9488 - DNA, 306 bp, Candida albicans
  unsure (50): Identity of nucleotide sequences at the above locations are unknown.
acttcatttaatttgtcatccaatcctaatagggtacataacctttcggntacgatatcacaatcatgtaaagcaattatgtcagactttctgggttcatgtttgaaagtaccaactttctccttattcaccaacacccgtaaacatttcttgttcacttcacctggtagtgaagcaaatgggaacacagttaaagaagtacctgccacaatggcgacctttacatcctcgcagtcatcctcccacaaatcaaaaaatttgactggtaaaccttctccaaaaaatacaatatctggtttgacataa

SEQ ID NO: 9489 - DNA, 342 bp, Candida albicans
aaagaaccattaagttttttcattgaacatattgctgaattagatgaagaagacgaagagattgaatctgaggtaacaaatgactctgatgattctgattctgattctgatgaagatgttaatgtcaatgtcaatgaaattaatgaacatttgaaaattatgggagatttaccttttaaaactaggaaaaatcatcatgattatattaaaactccatatcctaaattaattagttttaaagatgttttcaatttaaataaaattaattcaccccaagaagataatgaagaagaagaagaagaagaagaagatttaaagaatcaatttcatagatttaagcta

SEQ ID NO: 9490 - DNA, 261 bp, Candida albicans
aagaataacagcagcaaaaaggaacaaagtggaggtagagggagggagggaagggagacactaaatgaaagaaagaaagggaatttacatttgttatgtaattattcaattcatattgtaattccaggcgggcttatgacatattacctctacaaattctccattgtgaatgagattcaaaccaaaagagggaaaatgtgtgtgtatgtgtgggttatacacccatcctcgcctcgaattgctccacatttcaaagtataa

SEQ ID NO: 9491 - DNA, 294 bp, Candida albicans
aagatgaaatgctaccacataaacgcatcaacacctttatatgatgaagaagttgaagcagaaccagaagggactaggttgtataccgatgctactgaagaaataagaattagtgaaaagaaacgaccaagagaagaatcagatgaaattaaaccaacaccgataattgacaatgctagtagtactactactattacaactattacaaccactacagctgctagtaattctaatgacaatttcaatggtaccaaaaaaattgctttaactacaacttcggataatcaactgtga

SEQ ID NO: 9492 - DNA, 450 bp, Candida albicans
atacttttcaatatcaaaaccaatccttatggtttcaaatcgatgagtcaccataaatttttggattatttcaacccagaacatattgctcaaaaaggtttatttgcttctaatgacttgatactattactacgaatacaaattctcaaatattgtcaaaatgacaaagacaaactaagaacgtatttcaaaaagcacccaaagaccatgaaatttgtcatgacggaaaagtcaacaattttacctctgaaattcaaaggatttagatcaataattgatgatatttcaccattaggaaatttaaattggaaacaaaatagaatagcgagagctagcagggtattgaaaagtttgttattggatacaaaataccaaatgtttattacagccgacgctaaccaatctacccccatgctaaccaaactgccaaaacacgatttttatgaataa

SEQ ID NO: 9493 - DNA, 195 bp, Candida albicans
tggaatgattgtttaattgatgctgttggtcttatgttagttattgaagtggtgttgagcgaccacacattgtctttatacaattgcaacaatgtcaacactatcactactgatgttatcactatggatgaagtaaatgccagattggcagctgcttgtgccctattcactaaattaaacattgttgaagcttga

SEQ ID NO: 9494 - DNA, 1386 bp, Candida albicans
ccgccattgcggtaccttccaggcctgtgtcgtgaagacaatgatattaatgtatcgaattttgaaaattctttaaccacagaaattgatgtacaagaaaataataatggtggtgttattaaaaatcatcatgataatttaagaaaattgccaaagaaaattcaaacaattttaaataataatcctagtttgacattatttaaacaattgaatttttatcaatatcaattatcatgttatcataatattattcctcaaggtgaattaatcaataatcattataataatttattaaatttaaatttattgaaaaattttgaaaatttacaaactattaatgaacaagccactcaagaacatgaattgattgaaagaaaatcgaagaatattttgaatcatagaatgtcattgtgttctttatcaacccctactagtaataatgatcatatgggaagacaattacaatcaagctcaagaagaaatagtagtatatttgaacgaccaaatcgtactgaagaagatgatgattatgatggatatgaagatgatgacgctgatcaagtcagtttatcattgaatgaattgattaatcaagatgaagatattttgattcatagtttaaaacatcaacaacaacggaaattatatcatcaaaataacaccaacaacaacaatgttatccccacttttattgataaattatcaatttggaaaaataaacttttagcatccgcaacaggtaatacaaccaactcaaaaaaaacacataatgctaataaagcttatgaaaatccatttttccttgctaacgaagaggaagatgaattttatgaagttccattagacccatatactaaattattatcactatatcatcatcatcatcaaaaccaaagtcaaggacaaggccatggactacttcttggtcaaaaaggttctgattccaattattattattcaacctatgattcaatcaatgaagaacctcaaccacaacaatcatatttgaaaagaaatgattatcaattattttatgaattcaattatgatcaaaccttatcatatgtttatttcactttgaatatcatttcattatttttatcaggaattcaattaggtatattcatgtcaattcttcaaaaacctgatcttagtggtggtaatgatattgattatcaatttttaattcgtgataatattggattaattgttatattaacgttaggtattataacaagtttaatatttggattgattagtgtcaatttattaattcaacgatttaatcaacctcctttgtttcatgtattgattgtttggggtggattattgattaatttgatttgttgtgtttggagtggagttttattaattggatgtctataa

SEQ ID NO: 9495 - DNA, 195 bp, Candida albicans
ttcatcaaccatgttggaagtgtcgcattaaataaacttatcgccatgtgtgtgtgtgtcgttttttgttttttctcgaaacaatttctgttgttgttgtgtgaaccacctccacttccaccaccagaaaaagataaaaaaatttttcagtcgttgttattgttgttgttaatttttttctgcttctctgtgtaa

SEQ ID NO: 9496 - DNA, 720 bp, Candida albicans
  unsure (713): Identity of nucleotide sequences at the above locations are unknown.
cttcttcctcccccaaaaaaaaacgaaatggcgtcacattcaaattcaaattcaaattctttatttcaaaatgataagaataacaacagtaatagagatatagctatacctacaccaagtaattcatcatcatttcgtaatactaataccaacccaacaccttccattagactgccatcaccttctataaatagttacaacaacaacaacaacaacaatagtgccattcctacaacaaccactagtagatcaataactgggatgtctaacgcttccattaatgattcaggtgattctaacccacaaagttatgatgaacaaatttctcaattaaataatttaaacaataaaaaatcttttgatttgaaaactattagtaaacatttaattaatcaagaagatagtttaaagactcaaggtggtgatatcactagaagattatatcatcagatggaaaacataaccggtaacaataatcataataataataataataacactgatactactggtaatgatttggatgataatgttagtattggaggtaatagtactttccgtgatggaccaccaccaagattaagaactagaagtgcgtcattttcaagttatttagaagaaactagaagaagttcaatggctagtgatatcaatataccggggtggaatcgaacaaaaatttttattaatagagctttacaaaagaatcggcngccacct

SEQ ID NO: 9497 - DNA, 1029 bp, Candida albicans
ggctgcttttccaacaattactatctgccgggctgctgtgtaaaaaaaaagagtattctgatcgatcacggtaaaaataaccaactaaacttatcagagacttttaattccctaaaatcttctccatcgtctacttcatcattatcatctatatccacttcttcttcatcttcatgtcataaaagatcaaaagcagttgatctcaataggaatactagtaacagtcaaaactcatcaatatctacagcaccaaccacagctacagctgctaacactacaccaagaaaaacatcaatcaccataccttccaaacttccaagtctgtggatcccattgagaaatggtaatatcgactattctcgatactacaatactaatcaagaagaagataaccaagaacaacaactacaagatggggaaccattatctgctccaaccaccaataatggtacaacaaagactgcaacagccaatgccaatattatacaagactcttttgaaaccataccttgtttcagttcaacaaccaacacaacaatcacatcatctcgttctaatccaaccaattcaactccaactagcaatgatcctagttttcctaaacaaatgataaattggaatcaatttttacaagaggaaaaagacatgaacgataatctgtctacaattaatgacgatgataaaacattttatatggaacaattaaacttaaacgttggtcaaacgcctaataacaataataataataatcatggcgtttctgaaactgagaatgatttattgccaggtacttcaaaatcactaatagcaaaatatcattatcaattaaattacggtgatgaaaatgagaatgagactaatgatgtgagagaatatgaatatggtggtggtgaaagtagaaaaagaaaaagtagtactactagtgatgatagaagaccaagaagaggaggaggcggaggaggaagtagaacaagtcaagtgtttcgaaacactttgaataagtttacttttaaaccaaaaataaaataa

SEQ ID NO: 9498 - DNA, 264 bp, Candida albicans
cctgaaatttggttgaactgtttgaatcaaaaatttttcaagtatccgtttttaatcaaatcaaatcaaattagtttagacatattattcttcctacattgcggtcgattcaaaaaaattaaatatattactactactaccactataacaacaacaataatacgatacaaacataccagtatgttactcttcattaaagccaaacaaagcaaaaacgaaacccaaaaatgccaacaaattaaatttactgtaaattttctttag

SEQ ID NO: 9499 - DNA, 1068 bp, Candida albicans
aaactcagatccatgtttctgccacatttaaccccgttgtcactgcaacatgaaaaatcaagaaaattttcactagaggaagaagaagaaggagaggaggaggaggtggaggaggaattgacgacctatgacgaaattgaacacaataaaaaattagaaacaaactttccctttcgacaacagtatgacattgacaataaaaattcattacttagccgtgtaaaacacatgcatgtatcatctttgagtggagacaattttcttcgacgacaattgaattatgaagaggaatatggtaacaataacaacacagaacgagaggaaatggttacacaatataataataataataaaagcaatgttgattcatcgaaaaatatactactgaatcaaaactcgtttgaagatatttctcaatgtaatcaggcaaaatcagattccacagatagtctatgtttggaagtggccaaccataataagaataacaatcattttatatctggcaccagcactcccccagacacgatgtataactataatggacttcccatggtctactcatctttggagaataataataaagtacctagaaaacaatttaatttgcacctgcaacaagtcccacctcaattacaagtacaacttccacaatctcataatattcagagatcattattagcaaattcatcagccaccaatttgaatgcttatttacgaggtaatcgaaggtattcatcttctggaaacagtaatcccattaatgatttattgacgagtccaaaattcatcaaatccaataagtttaatagtcctatcccttcatcaacaccaaccacaacggcacagacgtcacccattaccaatggcaaccctgtgatagatcaaaaaaatagattggtcgaccaattttacaattctgggagaattacatcaccaggtagtcgagttgatttgtccaacatgcataaagaagctctgttgatttctccaactcaacaacaatcattttcaaaagtatcaacccccaaatcagaaaggaaattcaattggaaagaaagattcacttga

SEQ ID NO: 9500 - DNA, 246 bp, Candida albicans
aaaaaccattttattacaaattttactgtgaataatttatttattttactattatttatttgtattatatttttatttgatttgatagacagacatttagaaaaacgttcgatccacccatccacctccttccaaataattttgaattatatagttgtggctaatcaattgaaagtacatttcgatcaagtatttattttattcattctagtttctatgtgtatagacctcttttattcattctag

SEQ ID NO: 9501 - DNA, 306 bp, Candida albicans
tatgagtactttacaaaaacctttagtggtgttgaatttgaaaaaaagaacccgacagtaaatctaagaaaaagagagttagatgtcaaatatctagaaccaaagtttttgttcctcgataaagtgttaaacgaaacaaagagaaaactttcagtggtaatgatttttgatgtaacatacatacacaaggcttttggggaatgtttttttggctcttttgtaagtagcaaattacaacacaacgtcaacaacaataataatactggttatcaaacctctttacccccacttattatggacaattaa

SEQ ID NO: 9502 - DNA, 204 bp, Candida albicans
ttccaagatggggaaaagagaaaccgattccgggatttccgggaattggcttgggatactcaaaggaatgaaaataacttgggcattatccaaaatttaacccataaaattaggccaaacaccattgggttaatttgtgaattggccgcaaaattgaagatgaaaaaccttaattggttaattaaaaaattcttgtatttataa

SEQ ID NO: 9503 - DNA, 258 bp, Candida albicans
ggaaaaaataaactaaccattaggaacgagctatacgactttacaacacaaacatttatacttaattacatcacgtcaatagtacaaaacattgatctacgttattcagctttccaatacagaccattattttgttttaaagattcctggaatattgaaaaatcacacacacattacccaattccattgcaacccctattttatgagattgccatagccaccttttcattttattatttttggttaacatatatttga

SEQ ID NO: 9504 - DNA, 189 bp, Candida albicans
atacatctgagttctcgtctgatgaaaatctcaagacaaataactctgagcctcctaagaaagtgtctaaatcttctactgggaaaagaaaataccatcaaaaatcaagaaacggatgctcgacatgcaaaaagagacgcgtcaaatgtgatgaacagagacctgtatgtggcaactgtaccaaattga

SEQ ID NO: 9505 - DNA, 201 bp, Candida albicans
ctgctagtttttaggtctggctgctgccaccactgttctcctacaacaatccgaattcaagaatctaatcaaagaaagtcacagaccagatgcctccgcagcctaagtgccgataactctatgggggctgcacaaccactagttctcatcaacaagcaaattatgccatctatgagtaaaccacaaccagaaactcttcag

SEQ ID NO: 9506 - DNA, 210 bp, Candida albicans
atatatatattcgttctagttttcttgagactacgttcatccatttgctacttttattcttttggaaagtcaattcttatttctttttttttttcctttatttttcacacatatacattagttgttatcaaagtttactccgtcacaccactgtacaggagattagctagaagtatactcatccatcttttctatttatcaatttgctag

SEQ ID NO: 9507 - DNA, 789 bp, Candida albicans
atgtcggataatcgtccaacatatgacacttcatcgtcagatgaagagcctagtaatcactttcacattcaattacctcagcgacaattaaatttacaagaaatcagaaaacaaaatcataaaaagcatgaaaaaccaactattgctaaacaaaccgccagtaacttagccaaggcgaagaagataacaaccggcagcaatcataaatttggtaacagcattaacaacaacaacaacaatgctaacaaacatttggggagttcatctgcagggacgaatagaagaagtctcatctcacctacatcttcaacacatgttagttcagacgacgacgatgatgacgatgacaatgccgctttttatggtgataagcttaacgataacaaaaaattgaatgtttttgctgacacaaaaaacaatttatctcattttcaattcaatgcagatggaattaaacctaaatctttgcatggccaaggtgacgacagtagtgacgatgatggcaataatctagacgaggttgaagatgagacacatagtgactttgctgttttgaatcaaaatcacccaccacaacaatactacgaaacagattcatctgatgaagacgaagaagatgatgacgaagtgccaccaacagttcacaagacatattccaatgcttcatcggggtcctcaagtcccccctccaggaaaaaatctatgagtgagaatactgatacgcgaagcccaataccactcaacgggaagaagattgaaaaactccaatctttctctagaaaactttgg

SEQ ID NO: 9508 - DNA, 225 bp, Candida albicans
caaatggatgaacgtagtctcaagaaaactagaacgaatatatatatttatatatcgaaagggaggttaaacgtaatcattgatgtgtattttatatatagaagtattatgctaactaaaagaaaaaagaaaagaaagaaaaagaggaaaaatgacaaaagagaattttgcgtcactcacacactactaatactaaaagtaaaactagtcacaaaaattaagtga

SEQ ID NO: 9509 - DNA, 258 bp, Candida albicans
acagccttattgttccccatttttttttttcacagatcttctaatgaattctacaaaccttcgccggggtgtataaatacccagcaatctaccgataataaaagaccctatttccctattacccaaattttattaaaagccaagttaacaaaacatacaaaacaatgtcttcatctgcatcaattacatccgatattaaagctcttgaagctagtagtgaaatcgaaaatgttgaaccatataaaacgtgtacgataa

SEQ ID NO: 9510 - DNA, 213 bp, Candida albicans
ctaccttggcagcactcaatccatttagaacagggcagatgttcttttttgaatgaatttagaacaccaagtggcattattttgaaattcccatttacattatccttggtatatttggagggttatacggattcattgtctttaaatttcacatacgagttgttgcattcaggaaaaagtatttgggcaattttgcagtcagagaagttttga

SEQ ID NO: 9511 - DNA, 240 bp, Candida albicans
acagcagaattaagtatactatattttgttacttatacaacttatagtcagtcaactccaacggtatcagctgtagtgcagcagctcgtcaactggacggttgatgtagtggtaacatatgagccttccaagctcaatacacgggttcgattcccgtaccgttcaaactttatttttttcttgttgatcaattatttttgtgacatctatctttcatttttttttttcttgaatgtttag

SEQ ID NO: 9512 - DNA, 252 bp, Candida albicans
gttcctataaaaaattatatggaaaatttcaaaagtcctaatcaattaaaagcctcctggttaaaaaataaggaacatatttttttgaaatgtacccaaggggctttaacattttttaaaatgcactttaaaaatactaaaaaaaatctgttgttttgtgttgttacacttccaaaaaattctgaatcatgggtttgtgttccattcctacaaattccctccctcccccccaaacgaaccccaaactcctcc

SEQ ID NO: 9513 - DNA, 213 bp, Candida albicans
cttaaacttggagacacatcccaagcaataactgtttttgaaaactctttggatttgacttacgtttcaagagatattaagattaatcgatggaagctgaaactaaaccgagctgtttgtaagattgtatttagacaactacgttacttaggcaagtttcaccacgagactcctcgtaatattccaagtttatacttttcgatgatcttttaa

SEQ ID NO: 9514 - DNA, 291 bp, Candida albicans
ttgattaggacttttgaaattttccatataattttttataggaacttattggcatctttatcaacaatacaagacatggttccggcacgtcaaaacgataattctttattacgagaacacaaggtctatcaatgtactgaaaagcaacttccattgtcattttatggagcaaatgtattcataatatttgtcataatcttgttggctggatccacatacaagctaataactatcagcagaagaagaagaagaactttcaatcaagagtttgaaaagacaaacccagtataa

SEQ ID NO: 9515 - DNA, 240 bp, Candida albicans
aaaaaaacaaatcaacaatataaaaatataaataatagattaaaaaatacaaaaaaagaacgcataatagagttattgttatataaaattagtctcctcaagcggttaacaaaattaacgttatcgggtaacaatatggataaccggggcgctattcactactactgttcgggaagttattggagcacaattatgctgaaaagaaacaaatcaatactacaaaaatataaattaaaataa

SEQ ID NO: 9516 - DNA, 315 bp, Candida albicans
ctatatatattgttaacagttttaggaatttggcaaatcggaaacttcacagggttatggttgttgcaacctaacgtattttttgcattcttgcacgacttgttatttgtcacaagatatgtcaaacaatttgaacttccttttggcgccaaatctttttttgcaactttttctttacttcttttgctttacaatcaactttcaaaatccatttcattcattaaggaaccaggaatcttatctttctctaatggaaacttgtcggagcagcattatgtgattaaaaaaaaacaaatcaacaatataaaaatataa

SEQ ID NO: 9517 - DNA, 207 bp, Candida albicans
ttttttttctattatatcggcgtattaagggctaatgggggtgggttatggggaaaaaatttcactattaacactactatactaattgttcgtttaatggtggtactttttctttctacctcggggaaggcaaaggcaaaaataatagaacaaaaaaaaaataaagtcgtgctaatcaaccataattgggcgatattcaggatttga

SEQ ID NO: 9518 - DNA, 273 bp, Candida albicans
gtttttcttctatgtaaaaatggatcagcggaaaagggagatattcaaatatcatggaaactgctaagaggcatcacaaaggggaagtttccaaacgtgaaaggcaaaactaccaaatatttagtgttcattcctttggttgtggtagaatttgtctttttggttctccgttacagcccttttttatttaggattttgcctttcataagtaatttgttaaaaactcctaccggcgtcgctccagcaattagcgtgttaaaacttgctggttag

SEQ ID NO: 9519 - DNA, 222 bp, Candida albicans
actaaattgttaaaaagatggcttgaaagaacaataaaaggaaagaaccctttttgttttaaaaataacaaagcaaactcctttattgttgatttatttagaaaaataaccagcaatgctgttaatgaacaacttcaatttctattgacaaaattatataattactcaaaaattgaatatttgagaaatatacgatttaaattattttacttattaaaatag

SEQ ID NO: 9520 - DNA, 222 bp, Candida albicans
agttgttcattaacagcattgctggttatttttctaaataaatcaacaataaaggagtttgctttgttatttttaaaacaaaaagggttctttccttttattgttctttcaagccatctttttaacaatttagttcaattcataaccaagaagccaagtcaactgttatcaacatcatcatttgacaagcaactttcaaaatatttaaaaaactatttataa

SEQ ID NO: 9521 - DNA, 297 bp, Candida albicans
atcatgaattttcattctacaaaaccattatcctatgattctagtgataatgagatttataatccctttttagtgagtacaaatgaggaaggaagagtatctccaaccattgataaacaacaacaaccagttttaaaacgagctaaatctattgtatcatcaaattcattatcagcatttttcactgatctgaaaagtaagcaacaacaacagcaacaacaaagggatagaaaaagaaataaagacagaagaagtcttcaccacgaggggcgagcatccgcgctagcgatagcggca

SEQ ID NO: 9522 - DNA, 786 bp, Candida albicans
aaaaaatacaccgaatttcaacttcaacttcaacttcaacaccaccatcaacacttagcaccaagtacttcagttgtttttcattcaatatacctattcattgttaagaagaacagcctgtcttgcaccatggttgaacttcaagtaaatactaatcctgatttgaaaagtaaattaattgaagaacaatatttacaagaatcaaataatttaccaatttatttaacaaaaattgaagttgttggtggtgaatcattttctaatcaatttttccaaaatttattgtcaccgattttacaaaatggtgatttaacatttattcaattagttaataaaatcaaatccctgcaactgaaattaattgaaacggggatttttgataaagttgccattcaaatattaccggataatttttattctttatcttctaacaagattaaatcttataataatgaaccttcattactcactaaagtattaattgatttactggcaattaatttaagtaataatcaagggtttttcaattttaataatgaagaatatttaaatttaaaattaaatcatattaatcataatttcaatggtaatggggaattaatatcaattggtgtagattataatccttataagcctttagatcatttaattgctaatgggaaatttatatcatatttgaaaaatcctaaattcaaatttttgattgatttacaattaaatcaagaaaataatgaaacttggcgtcttcatccacggaggctggcaggatcagcgctaagtgaagag

SEQ ID NO: 9523 - DNA, 1827 bp, Candida albicans
  unsure (1783): Identity of nucleotide sequences at the above locations are unknown.
aaaaaacaacaacttacaatggctaatagaaatgatgataaaaagttatcacagaatgaaggacagaactattatcaccaacaaccaacttcacatactatcaaccaatctaatgttgcaccaccaccattaccaccaccacctggcgcgaattttctggtacctggaataaatcaattgccgggacaacagttaccggcgcatttttctctacctcatcaacaacaaacacaaacaccaatatctcaaccacaacccattatacatccattcccacaccagcatcaattactacagcaacaacaacaacagcaacaaccccaccaacaacaatctcaatttcaactactaacacaaccccaccaacaacaacaacaatatccacctcctgaaccattatcgtcaacgtcatcgtatcacaacaacacaaactccaataacattcaatatgtaagactgtttcgaaatcatttgaacccttattatgcagtcaatctaaaatttcttaaagatttgaataccatgacgaaattttggaccaacaatgaaattgaaaatctgagacgattagttaaatttaattttaaaagtgaaggttcaactcaaatggttaattttgaaccaataacacctgaacaatatgataatgtgtcacctatcatttcatgtatttattggaaagaaaaatcacgatatattagtacatcagttgatattattacattattagaatatatggtgaaacaaacatttgatgttgatgaaaaaaatcgtattagaagaaatttacaatcattaaaaccaacaacaatttccagaataaataaaaatgatcgtagattttttgatcttattatgagtatggaaaaccccagacctagaaacattgaaaaagatttaaaagtatttgattggtctgatttaggtagagcagtacagaaagtgatgtcgaaatattatgttgtgccaagtctggctccaacaacatcgtcatcgttttcatcttcatcttcattccaacatccaaatccacaacaaatgcaatcaatgccaggtattgttggtaattcgtcacaacaacaacaacaacaacagccattatctgttccaacaccaacaccattaccaagtggtgtgcctgcagttccagtttatggtatttatactggacgttcttcattcccaattaatcaaaccccaattcattatttaacttctccaattggtaataataataataataataataataataataataccggtggatcattccctaaatcacaagttgcatcaccatcagtacatcagcagcatacatttaatcaacgaccaggaacattttttccatcccacaactattatcaattttttgatcaaccgaaatcacaaccacacttgcagcctttaactagtggtggtggtggtagtggtagtaatactaatgtacttgcatcaccactgcatacttttgaaagttccaatagacaaactttaccgaatgaaagtagtgacaagtatcaagagaatcaaactggtgctataagtggaagtaatgatgattcccgtaaaaccaaatctgacttcaaagagaataacaacaccacaactaagaacgaggagattagtggaactacaaaagaaactgataacaatgatggcagtaatgaagacaacaacaaactttactcgaaccaatatcattcacgaagctcttcttttccccaatctatcaaatcgttagagtcaatttcaagttcaggttcaggttcaggttcaaggnccaaggttcacaatgaaaaatccaccaaaattataaccccacac

SEQ ID NO: 9524 - DNA, 189 bp, Candida albicans
acacaatttcgttttgtatttagacaaggctttttctctttttccttcttacctttatgcattgcattgcatttttttgtcactatttccatgaattttttagtgttaaccacacaaaaatattacgaagtcaaaactaatatatcttattttttagtaactgcttatattaaccctacatgcttataa

SEQ ID NO: 9525 - DNA, 186 bp, Candida albicans
gaaggaaaaagagaaaaagccttgtctaaatacaaaacgaaattgtgtttagagtgtaatgatagaaatgacgtttcatatcaaactttatacttcgtcagtgttgatatagaggttgagaatattttcattcggatcgattttggggatcatgaatttaactgtgaatttgtggaaaaacaataa

SEQ ID NO: 9526 - DNA, 189 bp, Candida albicans
aaatttatcaataaaaaatttagcatccactatctagacagaaaccccaatcagttgttagttggaactatttgctgttatcattttcatgatgcgatagcttcacagtcatatattatattactaagtttgaattgtttcagagaagatgtttatactttactatcttttgcgtgtagtgaaaactaa

SEQ ID NO: 9527 - DNA, 216 bp, Candida albicans
agcaatttttttttgttttacttttgtgttattgttgagcaaaagaaatacaatttgcaatctgtagagcaaaaatttaatgacaatcttcctggcgtaagtttcagaatgaacaccattgatatatttaccagaaagtcatttgtgtttgaagaaactggctatgaaagagatttcgacaatcaaatagtggtgaaaagtatcatagagttatga

SEQ ID NO: 9528 - DNA, 198 bp, Candida albicans
agaatgagctttatttgctgtgatgttaaaaatagaatgtccgtgtttgttgccctgatcttgaaattcaaaaattataaacaaagaggaaaggaccaccaccatactactgaccgtgtaaaaatagtcacaatgcacgcgcttcgtctactacgattcgaaaggtcgaaactctttccaaacaagaacaacttgtaa

SEQ ID NO: 9529 - DNA, 192 bp, Candida albicans
  unsure (65),(87): Identity of nucleotide sequences at the above locations are unknown.
tacttttatatcttttctcctttccgttttattttcaggaacagtctgggctttatgttgcatanaagtaccaaatcgaacgatatnttggatataaacaacactgggttatgtctcgctaacaatttaaaatcctataaagaatgtgttgttaaattaatggaattaaacctactaattattccaaacgga

SEQ ID NO: 9530 - DNA, 183 bp, Candida albicans
aattgttggtctagaattcttcgtgttgcttttagtttcatcacaggttctttgttccgttttttattctataaaccctttttgaacaaagtagtaattatggtgaatgagtataatgcttcttataacctcttatacaacaaatatcgaatggaagaaacagaaacagaaacggaaacgtag

SEQ ID NO: 9531 - DNA, 195 bp, Candida albicans
  unsure (22),(44),(126),(149),(152),(165): Identity of nucleotide sequences at the above locations are unknown.
cccagtgttgtttatatccaanatatcgttcgatttggtacttntatgcaacataaagcccagactgttcctgaaaataaaacggaaaggagaaaagatataaaagtatcaggaactgtaaacatnttcacttcgaacacatttcaagnganagatacttctttnttttatttcgtacccagaaggtacaattga

SEQ ID NO: 9532 - DNA, 186 bp, Candida albicans
acctgttcaaacacagtaaacacatctgcatatcaaagttattcaagagaacatttgattattatgttatatgcaataacgaaacatcgaacttacaatagtaatgtcagactgacaaaaaaaaaaaaaagaaaagctcttactgtttataattattggaatatgcttaagtttatctatgattaa

SEQ ID NO: 9533 - DNA, 315 bp, Candida albicans
cgtcatactcctcaaatcttcaatacaactttatatagcatctcacatattcactatgtactgaacatattcactatactagataatgcttatcccttacttgatcaatgcaagctattcaatacaagagagtaccgagaattactctcttgctggaacattttccaagattcaaagtatttttctgaaaataatattacaaactcaagatcaaaaattagaggtaacatgaatacacaaggaacatataataatggtaaacttttgatcgtacaaccaagtgctgccaaaccaattacaacgtctgtcttcacc

SEQ ID NO: 9534 - DNA, 189 bp, Candida albicans
gctatctcgatacccacgttgtttctgttgaaccaaactataaagtttgtgttaagtacaaataaagataccgacaccggatttagatcagataaatcagtatttgtcgaaagggaaaatttgtccccaccggcgtatattataaacttgtcctattcagcaagattcaatttcggcgatgatgcctga

SEQ ID NO: 9535 - DNA, 195 bp, Candida albicans
aaatcagtatgtactgttagtaagaaatgtgaaggtataatatttacaaatagtaagcaaatatacatttctaaaaatgattataataaacagtctggaaattgcattgtgtatcatccagcagttggtagcgtcatactcctcaaatcttcaatacaactttatatagcatctcacatattcactatgtactga

SEQ ID NO: 9536 - DNA, 573 bp, Candida albicans
  unsure (422): Identity of nucleotide sequences at the above locations are unknown.
gcacctattcaactacagcaaacaccattatccatcatgtatgctaaccaaagattatcaatgtttcaaagtcatattgatcataaacaaaaacgaacaattccatcatttcccttcctgtcaatagaagaacaagaaaactatgaattatcaaagtcattacaacaggctacaccattgaatatcgccaatatgacaattttaccatctccatcaccactggcatccacatcctcattgccgttaatgggctcatgtgtgattggttcgaatggctctacaaaagctgtacaccaacaagaccaacaacaagaacaacaacgaccaactcccccactactgcctcacttgatatctaatcttccgattactccaattacttcaagttcatcaacacctgaactcgatgtagtggatactanattagttttaaatgatgtgctaaaggaattcaacaatggtaaaatattatgtctcagtaaagatgacgatgatggtgaagacgatgaacaaatagactttgacaatgattcactcctttatgatactataaatgagatatctgaacaataa

SEQ ID NO: 9537 - DNA, 204 bp, Candida albicans
ggacgatatcgtctggtagacaaagtaccagcaacatatattattgggcgagattaccatgcgagtaaaactacggattcaaaagatcaagaccaagttgtagatagacaacaaaggagagaaaaaaaaaaactagcaaattgctacaattacataattgctgcgatctttgtgactctttttttttttactacaaatgattag

SEQ ID NO: 9538 - DNA, 819 bp, Candida albicans
acaaacctttattttctgtaccatcactacttacatttatactatttgccacatcagataaaacccagaccagttatgacagtttcagatcctcttgaaaagttacaacaatcattcagatcgattcagtcgacgaattttgacgatgcacaaatgttcacaaactcgattgtgaatgcaccagctataacaacattattgaaggatcccacccatgatgaaagcttactatataagattgtcaaaccaaaaaccaataagggaccaagtaaattagtaagcgcaattgtggaatctgcatctatggatagtaaacccgaaagagtcgatggtaaaatcttatatacccttgaaggtataattagtgacaaacccgaagatgaagattcagaagaagaagatggaagaaatccagtagtaaaattccccaaattaggtcccagaaatgcttattcgagaccttttataaatttaccaaattcagaggatttcaaagaaacattctatcaaatatctcaagtactatcaaaatatccaaacttgattgatgattacccaacgttaataaataaattgaatacatatgaagataattacaggaaactacaaagagatatagagagcttagaagaagagataaaagagctgaaggcgtttcttgaagataattataatgttagctacagtcctaaagttaaaccttcagcatcgtttgatagcgatggttccgatgcacaaatagatattgatgaggccatacggagagaggaagaagagatagaacaactagagttgcaattcaatcaaagagggtattaa

SEQ ID NO: 9539 - DNA, 282 bp, Candida albicans
cattatttttatatttgggatttaaaaaaagggagtaatctgaatattaattgtaaaatgaaaaacgtggtttacactgattctataaatatcaattcttcggttgttgttgttgtatcaagtgtaaaccctttttgtatacaggatttgcgttcatacggaacacacgcaaacgaaaaggggagacggacggaaagcaaacgaactttgatacgtatcacctttttcttctcaccaccaccaacaacaacgttcacccatttcaatagacgaataaactga

SEQ ID NO: 9540 - DNA, 321 bp, Candida albicans
caagccatgtcaaatatggaatcatcccatgtgaataatgtggaatcaccaccagaatatgtatctcaacctccaccaaaatatgtacctcgacagtcatcgtcgtcgtcatcttcaatatcagatcaggaatcagatattcacaatccaccacaaagggccagtgaaaatcaattatcgacttgttgttctgattgttggtgtaattgttttgatagttgttctggcactaattgtactgcttccgataagaatatttgtggcagtatactagttgttttgtgttgtggaagcacaattgggtatgccactaatgcttga

SEQ ID NO: 9541 - DNA, 369 bp, Candida albicans
tgcatgttatactccattttattaaaacattataatagtaggtcattttcttttgatctttgtattcttaaaaaactggtgatatgtatcagaaaaaggaaaatcacacgacacgtcatgaatggatggatggtgcacagccttgctttgtatgcaatactgacatcatcgccacttagtgctactaccaccgaccccaccacaaccaacaaaaccgcaatgacgacccgaaattcaaacgaaaacgtaggcaaaacatcaacaactcaatcgaagaaggaaaaaaaaaataacctaaaaaatatattttgcaaaacaaatatccacattatccattattcgatagctgaatacttggtttttatttga

SEQ ID NO: 9542 - DNA, 210 bp, Candida albicans
aacccttattttgaaacagcacgacatattttattgaatgtacttataaacctagatcagtttattattatcaaccttttccaaattgaattttataagctatctgtagtgcctaagaatgcagacacgttaaccttctcccaacctccatcaccacttcgagtactatttaaattgggtcaagagtatcacaaatttagctggtcataa

SEQ ID NO: 9543 - DNA, 282 bp, Candida albicans
ttttcaatcaagtctaccaaaaatgtcgaattttcttcaatgtcctcaaaatccagtgagattataattagcagcttcacagttttgaattggaacttgtttgaatctaaagctccaataattgccaaagctttggcacatgcagtggaaacagttgtgtctttatttttaaattttgctgctgtgtctaaaatagttcggaccaaacttgttattgccggtgttaaaccgggatctttgaaaagatctttttggcagttgatttggtatttctcaaaatag

SEQ ID NO: 9544 - DNA, 225 bp, Candida albicans
attttttttacttcctttctctttctttctttagagcttagttttatctttcaaaacactgcattatttcaattgattcaaaatggcaactacaggaaaaagacatgcaaaatcacaatcaacatatgtatgtattattataccgtgaacgcaacactttttgttatttttttttttggttcaccccctatctgggatgaacaatttgttgttgctattccctag

SEQ ID NO: 9545 - DNA, 267 bp, Candida albicans
gcgctaattgttgctgggttggggaattcgactaataatgttaggttaagctctattacaggtaacaaaatgtccaatgaaacatgctggacaacacacaaacacgttgtctctcaacattgcttaagagtatttggtatagataatcaaattttcttcaatagagaaattaagaatagaagggaattggggttaaagcttggttctcctatggtcggcctatccagcttagttgttttattgatttcacgccacttatgcctataa

SEQ ID NO: 9546 - DNA, 231 bp, Candida albicans
tattttttacatgccaattcaaaaggtggttggatgttgctcgctttggatatatacaagctcttttattggccaggtactgagatagacattgttagcgggttggcagcctgtcatgataatttaacaatgggattcttccctggacccagtaaccaacaattcaaaaaaaccaaagcgaacaaagaagaagaagaggaagacgaaaaaataatagagcaaaccaaatga

SEQ ID NO: 9547 - DNA, 1203 bp, Candida albicans
ttatattttacaattatggccacaattgatgtagaacaagccattttagatggcaacactcataaatcaattcctttatcagtttacgaatcatcattagcaccaacttatcaatcatcattatcctcattatcctcatcaataattaattcattttcattgaaatcaccaatcgaatttgatccattaattcatttaacttattacgctaatggttctcgagcacaaaaattatatgatcaaactcgaagattgacattggaacaattaggtttaaatcataaacaacaacaatctcaacaaattagtgatattggagtgagtgatccatttcaattatttactgatgaagccatcaccattatgagacaagaagttttacaacgagatacatttatgaaatatgctcgatattcatataattcaacttcaggaatggattgtgttgttcgaggatttgttaaagatggtgatgaaattaattgtccattcacgtatcaagcttggactcattgtaaaactatggaattagttagtaaaatggccggagttgaattagaaattgttatggattatgaaattgctcatactaatatatctatgaaactgaatgatatggttgaagaagaaagaattaaacatcaacgacaattaattgatcaagaatcggctacttctactactactaatggtggtgatgatattccggcagttgtaggatggcattatgatagttatccatttgtttgtgttttgatgctttctgacactacaaatatgattggtggtgaaacttctttacgcatgggtagtggtcataatggtaaagtggctattgttccaagtccaacaaaaggttcagcaaatgttttacaaggaagattgattgaacatattgctccttcacccgtggggatgagtgaaagaattaccatggttacttcttatagagctaaatctcccatgatgaaagatactagtgttttatctactgttaaacccgaagttaattatggatctcgttataatcaattttatggagaatggattgattatagaattaaattaatgcaaaaaaaattggatttaattaatttaaatactaaatgtgatgcaaattctgggaaatttaataaacagaaaactattgaggcattaaaagaagttgaagaatatttgttgaaaacttattctgaaatgtga

SEQ ID NO: 9548 - DNA, 198 bp, Candida albicans
ttgattgatagtattaaaagaaccaaacttcaatttttcaattaccagattccttttttttttcttttcctgttggtagactgtaattgtgcgaaaaagagtgtatgtgtgaatagtgagcggaaagaaaatttttttactagtagtgtagaaaaatcaagaaacatacacgtgcatgttttgccattagggctatag

SEQ ID NO: 9549 - DNA, 237 bp, Candida albicans
ttattttttttttcctttgcctgtttttttttctttagcagtacaacaagaattagggaaggttgtgaaataaccaaagccaatcaaaaatacacgacccctggtccttacatgtcaatttcagtttcatatgtgatacttagaactgacacaggactagtcctttctaatcttctacatctcttaacccatttgtttatacttaatattattttttattttatatattgtacatga

SEQ ID NO: 9550 - DNA, 420 bp, Candida albicans
tttttctacactactagtaaaaaaattttctttccgctcactattcacacatacactctttttcgcacaattacagtctaccaacaggaaaagaaaaaaaaaaggaatctggtaattgaaaaattgaagtttggttcttttaatactatcaatcaactagagtcacagcatgttaattccaaaagaagacagaaagaagatccaccaatacctcttccaaggtatgtaaatatgaattataaactggaacagaatatggcatttcaagggatgcacgataagtcaagagttcatgaaaaagcacagattataacagtcgtaaagaaaaatttcactaccaacaacaataagaagatatcaaagagattcagtaatcactacttacaagaaacatataacatcatggagagtttaatttga

SEQ ID NO: 9551 - DNA, 189 bp, Candida albicans
tgtaaatattatacatatgtttttttgaacttcatacactcccatactaattccttcttaacaaataattttcacgaattgaaagagaaggaaaaagaaggaaaaaaaaaatcctctttctatatagggttatattcaaacattaaatttcaaccaatcaacactgggttaaaccttcacatcatatag

SEQ ID NO: 9552 - DNA, 306 bp, Candida albicans
tttgaaaaaattttttttctcaattttcattttttctttttcttccacgccatggaagacttttacatatacaacctactggacaaggtgatcaactcacttgagttgttgtatttcgattcaaaaacctccgaaagcgtcaaggcagacgaaccaccaaaaacaccacaaccaccccctaatcaacacgacacagaatactataaatcagatttataccgctataacctaaaacgaaaactcaatgatttgccaccagtcaccgaacaacagttcgataaactacttgaaagaagaatccattga

SEQ ID NO: 9553 - DNA, 210 bp, Candida albicans
  unsure (106): Identity of nucleotide sequences at the above locations are unknown.
tttgttttccagggaattttgcttgcatttagaaccacctttttttttgggtgggaaccaatgaattttttgattgacaagttgacagttgttcctgatagaattnttgtagggggggcattgccagatgtttttgggtggtgggaattatggcaccggcaaattgcggctcccattataaataatgtgatttgcggttttgagaagtga

SEQ ID NO: 9554 - DNA, 246 bp, Candida albicans
atagtgttgaattttcccaaaattttttggacatcttcagatgtagtcccagccaagactaaccaagggggggccactggtttaatttacggaagtctaactgccaacaagaacgacttgtacgtgttatcaactccgaattcaaaaatccctcaagatctagctaacactaacaaatgcctaaccaagctgaaccactctaaaactaccccctgctgtaatcaccacaacaagtcaaccatctag

SEQ ID NO: 9555 - DNA, 201 bp, Candida albicans
atatttctcttggaaactacacctgtgaaacagtgtatcactaatttcaatgaatttattaaccgggtgacaaacttaagtaactttacaatctacttggaactctcttcaaatttcaaccactttgagattgaacaactcctagaacctaaattacaattctctcaaataaacagctctctaattgaacaacacaactaa

SEQ ID NO: 9556 - DNA, 231 bp, Candida albicans
ccacggatgtctaacttcaagcgagcacccgagcaaagcgagagtcacacaaacaagtctagatttagccataattttctagccaatagaggccacacacctcgagtgagcaacacttttccagctgccgcaccacaaccgtacggatgctcacctttttttttttttttcttttttggggtgcttgcaccccctttagtccggatgggtgtgagaatgagttgggtgtga

SEQ ID NO: 9557 - DNA, 201 bp, Candida albicans
attctccagagtacacgacccagtttgtattttcggtatttcaaaatttttttttgcccttttttttccttcccttggtttagaggtaagaaaaaaatatataacaacaataaaaccagttttccgtcatctgatgcttaccaacttacatttatcatattgtcgaaattaaatcatcattttaactttcaatttaattag

SEQ ID NO: 9558 - DNA, 660 bp, Candida albicans
ttaatgtcatacaacagtaatacacactatactccaaggtatggtaagaaccattcaaagaagatatatgacagcggtacgggaggcagagaaggagtaactctgcaaggtaatcagagttctagtacatatattggttccgcaggaaaagatcgtgaaacaggtacaagttccttatcatactcctcaagcagacgtgacacttatggtgggtctggctatagatctcgttatgagtcatacacttctaaaaacggttcgtctagtagtaattcttattacaggactggaccaaaaggtggaagtacttattatggatcccgaagccattcaattaatgggcaaagcactactggtggagtaagtggaaatggtagtagtaacataccgaacagaagacgacctggatttgatagatatgattcgtattcaaagtatctggatggaaatgacaagtttatttcgagggctggaaactatagcagcagcagcagaaaaagttcgcatcctacaagtaattatgatgctaaagaagataaaagaaagtcatcctatgtcagtgcgaataatacaagcgaatcgttgaataatccaatgaatagctctgatcaacgaaatttcaaattttcccctcaaagaactagtacaaccagaaaatag

SEQ ID NO: 9559 - DNA, 279 bp, Candida albicans
ttcgataacggagcaactactgaattgtgtaatctagaattgtcaagtccatttgagccaaagtcgtcattgttgctaggagacactgcatcatcccaaacagatgctgtcaattcatcattatccatagtggaagtgaggttttgtatattattgaataaaaagatttggttggctaatttgaatcccaagagtttatttatttctcgtgtccactcaaaaaaaaaaattgataatcattcggttacacatttttttgctttggtgtttagtgaatga

SEQ ID NO: 9560 - DNA, 192 bp, Candida albicans
atcagaaatattctaattgaactgttgtcaagacatacaaaaaaattgtgtaaggatagccaactagttttaagaaatgtgaaatgtgaaaatgactttcaccgaaggaaaaaaaacgtttttctgccacacaaaattagttcagtggtttatatacattttccgaactacattccatatagtaacaattga

SEQ ID NO: 9561 - DNA, 183 bp, Candida albicans
acacaatcatattttaaaagaaaacataatatcaaaacaaacaagcagagattgagccaagagatacaaatcaaacaacaaatcaacgacccacaaattagtattgtagaacagttcacactaatttctcacaacaaaagcatagcaccaaatattgctgccattaacccagcatctccataa

SEQ ID NO: 9562 - DNA, 369 bp, Candida albicans
tactacagtattaaagatcaacaaagtaacaattttatatgtagaatgagggttttccaaattgtatacattttaataatttccaatttgatttatgctacaagtggtggtggcacaagtagtcatcatcacaagaatgataacaatattgctgataatacaaacaataacaacaacaataataataataataataataataatatcactaatgctacaactacaaggacagtcactacttcaactaaaactaaaactcatactggaggtggtgttgctgcaatgggtggtattttaggacaaaatgggtggttttatggagatgctgggttaatggcagcaatatttggtgctatgcttttgttgtga

SEQ ID NO: 9563 - DNA, 183 bp, Candida albicans
gaattaaacccaatacggaaatcaatagaaaaaagaaatgtttattcacattatctttctgcagaaactaagttaaaaaaaagagtagtgcatgacccaatatatatggacattttatttttctttctgtctgttgttgttgttgtcgtcgatgaagacagaagaaaaatttcttatatataa

SEQ ID NO: 9564 - DNA, 723 bp, Candida albicans
ataatggctttgtgttctccaacatttccaagtacttcagctgtcgttgctggtgctgctaccaaacgtggttgttcaacttttaatagtttatacaccacaccaaataaaagaatttgcttgaataataagattagtgcttttggtggtattggttttaaaggattttataattcttctttatcatccgaagaagaagattctgaatctgattccgataatggtgcacaatccccatttgaagctattcaagtcagaaggaaacttattcctacacgaaaatccagtgttgttcttgcagtcactggttcagaaactgagattgaaaatctcgattgcagtacagttcattatactgatagtcaagacgatggtaattgtgataataacaattctattcctattgctgacaggaatgctagaactcgttgctttgaatatttaattggtgccattgatgaagcttgggctagatattgtgatgctactacatcttttgaagatgatgtttttggttccaataaatcaggtactagtacaacaaaaagagcttacaatggaaagctcaacgataataatgatgataacgaggattacgacgacgacgacgacgacgatgatgatgatgaagatgacagtgctgatgaaacttttgataacaatactgacattaccgattcttcacatcgccagagccgatccaaatttaatttgcccgagaga

SEQ ID NO: 9565 - DNA, 195 bp, Candida albicans
aaaaaatttaacatctcgtctaatttattatctttttctggtttctattccatcgtgtatgtaagtgtggtgttatttgtaaaagaagtggtggaattcaaattaggaggatttgaaaaaatttataagaggaaactggaggcggagttcaatttccaagtggagagagagagagagagagagaaagaccaataa

SEQ ID NO: 9566 - DNA, 201 bp, Candida albicans
tcgtgtagttatgctagaaacagcaaagagcaaattaaatactattatctaatatcatattggagaggaaatggcacgtttcgtattcttttcaactactcccccttttctttcttatatcaactaatcttagatttgataaagcaattgtttaatttgattaaacaaaagattcttcagatagaagttgatattttgtag

SEQ ID NO: 9567 - DNA, 780 bp, Candida albicans
cttcattgtggatcaataaatatgaccaacatcataatagaccatcaaagcacattcactgcatatatactagcattatcaatatacttcaaatatcttcatctacggaatttgaaaatcatgattattgaaaatgaaatatcacaatctttagatactaaaccttggtgtggaatatcaactttaaataatttcaagttatctaatcaagatttcattaattatttaatacaatttactattacattagggagtatatcgattcgaccagtttcaccaaatcccgatacgccaataaaagaaatcatgaatactactattgattctagaaattatgtcggtctattatatcatcctattgatttaatgaataagattagatttgccatgtttcgttctggccgtgttctgtttgtgtcaccaaatgtaaatttcaatcaaccaggaccactacatcaaaacttatcaggaattagagtggtcacaactactgctatgagaaattctcacaatatcaattcttttatttatcattcaaatatgattggtacaagatgtcgaaatgggaatttaccatcacaaatattatggttgcccaaattttcctcaggtaatcatatcaattgtactactacaaataacctgcaaataatgttagacttgagtattgaaacatatgcatatattgatttgagttatgcattgaaacaatgtgatatgatacttgacaccatagacaagttaatgggtagttcaattccattaagtaatagattataa

SEQ ID NO: 9568 - DNA, 426 bp, Candida albicans
ggaatagatcttaaaaattgtacaattgtgccaaagaaatcaccaaataatcctaatataccaaaactttctaaaataaatccaataaatgcatatttcaataatattaatagtattccaagaataaaacaaattgttcctcttaattttgttggacgactgaaaaatgcaattgtccgttgtggtccaataattaatgttataccaattataaataatacattaccaagtgctaataatgccgaatcgaaaaatgtcattattccaaatacaaaaaagaaaatccctccagcagtgaaactcactccaaattctaacataaaaaaagaaaaagaacgtattattgttagtaaagccaatttttccaaaaagcaaattcagctcttctggcaaaccaatttaaaacatactttgtctttcagataa

SEQ ID NO: 9569 - DNA, 192 bp, Candida albicans
ttgccaatttatacacgacctggtgttaacacaacgacgcctcagttgcgaaggtcgagaaagaaagaaagaaaaaaaaaaaaaaaaaaatttaaagtaaataaatatcataacagatcattaaatcaaatacatacaaccattaaatcaataggaaagttattaataattaaacatgatttggttatctga

SEQ ID NO: 9570 - DNA, 225 bp, Candida albicans
ctccaacaaaaacaaaacctaattcatgaacaaacttattcagttacccggggttctcccaagccccaaggattcagccaattgtatcagatttcagaaggagatgcaattgattcggaattgcacatgagtgcacacccaccttttattgagaagatcattttcaataatctcctattccctcgaaagatgacttgccaaaacccgattccaaagaatatttga

SEQ ID NO: 9571 - DNA, 231 bp, Candida albicans
tatgaccccttccttcaagaaaaatgtaccccttggaaatttggaaataaaataattattttttttcatgaaccgggaagggaggtaatctcttcaaatggggtgtgtcaaaatcaagacaaagggtatagtttggctaataataataaattcaatgctaatggtggtggcggtaatcaaatatatgggacaagaataaaggttaccacacacaaaagtaaacaaaaataa

SEQ ID NO: 9572 - DNA, 1056 bp, Candida albicans
aacttctgccacgttcgttttatcatttcagaagtttatatcatggagaaactttcaatcgacaacaacaataataacaggagataccagagcaggagatttgatggtattaccattatacgtattgttgttttggtattcatagtcactgtatcgacgtattttgtcaacagctacacatgcaatcaaccacaccataatcactcgaccagaccaagccattatttaccaataaatggcactcatgggttgatgaataatgatgattcattgcataataaaggtgctattggtcattataacaccacagtgtcccttgaaagaagagctgacgaaaacaactcaacaacaaacgggttattccctctgacttcatcgtctacattcatattcactccatcttcatcgtcttcttctacatttcaacaatcaaggtcatctccacaaacaacatctacaagctcatttgttgctacaacatcatcgttccaacaagaaacatcacaaacttcaattcctgacactactacggatttttcttttagctcattttccgaggctcctactacatcaacaactagttctacatcagaatttagtagtacaccacaggaaactagcaacacagtgaccagtacttcttccacgtcaacatcatcatcgtcgtcacctacatcaagtcctgcaacaacatcggcttctcaacatgttactacattcagttctgttgataatgggaagactattgttgtgacgagaacttctgtcatctcgagtctgccaactgcctctaacagcaacaacaataagaacaatgataacggaggaggattatcccatacaaacagaatagttgttggtgtaattgttggggttggtggttctatattaattggtttgttggccgttttattttacttgagaaagagaaacaaccgtgattatgaaggtggatggactttctggagaaagaatgagaaattgggaagtgatgagttcttcaatggtgaattgggtgtcagagacagaaatattaatcaaggatcaaatttttaa

SEQ ID NO: 9573 - DNA, 195 bp, Candida albicans
tcctttttaaccaaccctgaaagaaccaaatcattgaatatcatgaatgccgggttcaccctagacacaggtggaatcgaagagggtcccggcgtagtggcaggagttggtcctggggtaggaataggggtgccaccttttgatgctgaagaagatgacgatgagagttcttgctccttaatgttttgtagttga

SEQ ID NO: 9574 - DNA, 195 bp, Candida albicans
tgttgtatttgtgcttgttccttttcttcttgtcgtttcaatttccgtaaatcgtgtgaaccagatcgattatggtggtttgatgatgatgttgcagaagaaactattccatataatgacgatgtcgtgtttcttcgtttagaaaaatttgacgatgaagaaccatgggtggtggaagacgttgaattccgataa

SEQ ID NO: 9575 - DNA, 297 bp, Candida albicans
gaccaaatgacattaaaaagaacaatatcaagatgctacattgtcaatttaacctttaataccactccaactaacacaactttcaaaaaaattcattcctggtgttgctgttatgaaactcatataaaaattaacaagctaactttaaatccaaatccaataccacaattaagtacgcctcttttttgtcgcttatctccactaccagtagattatacttgtattcaagtacattgggtatttttgtatagtttagaaaccaatattattcaaaaattaaagtttaagaagagataa

SEQ ID NO: 9576 - DNA, 267 bp, Candida albicans
tcatcaccaacatctatatctatatcgatgagggagactacaccattgaagaagagctataaaaagtataagagcactaccagggaagatgatagtgaggtactgggatattacgatcacgaacaacaatacgaagaatacgaggattcattctcgatgagtaagactaccaaatatactttatttacaataattggattgataactttattggccttatatttctttacggttttcctaccggatcgttcattcgtctttacctag

SEQ ID NO: 9577 - DNA, 966 bp, Candida albicans
  unsure (479): Identity of nucleotide sequences at the above locations are unknown.
aatactataattcaagactatttcactagaatacccacacttgctgagaaaattatgtttgccagttatttattacttgttttatggatcatcaggcttgtgccaaccactcacgcccatacaggtaatgatgcggaatatttattaaatactgttttaaaacgtgatgctacttctttatcaagaaatgcttatttagatctggaagcaacctctggtgcaacaaattattgttcagattgtgataatgacgaagtaatcgttacggttgatggtacttctactatttggacaattcttcttgattcaacaatttcaacattggtgactactactagtaccgaaaaaacaacattaacttcttgtggacaatcttgcaccaaaagtaaagatgcttctagtgtttcatcgtcttcagcttcatcatccacttcgagaagcttaatttttagaactagtaccaaaactgttacggacantacaaccttgccaacagttaccgaaattaatacatttactacgaccgactctcatattgtacttgtttacactgatattaattctgaatctactataacaggagactatactttcataaagaacaaaaataccagaactgttataattactgattatgttactagtactgttggtggtgaaactcaaatagtaactcaaacaacaacttctgttgtttatgaactagttgtgacctgcccagatcatgattttgcaaccacattgactggcagtgaaacgtttgtcccaccaacgacagcaccaaaaccagttgagacaccatctccagaaccatcaactacaattttaagtattgaatctggaagttctgtaccgtctgccactacttcagttttggatactagtattactttagaaacaagcagttcttctattgattttctacttcgtcttcacacacgccggtcgaaggacacacgaccgtca

SEQ ID NO: 9578 - DNA, 240 bp, Candida albicans
tcatcagcgacatttaaaatcgcgtctaaaaagtttggtgtacctcctgtggtgataccttttaaacgtggtaatgtcactgttggtggattggaaaaggcagtgaatggtaaggcacggccttggtttatcaattggtgcaaaaacaggaaatttgatctgtcactgaaacaaaaatcagatctcattgcatctactaccataagaataaatttgttgaattgtgggtttccatattga

SEQ ID NO: 9579 - DNA, 195 bp, Candida albicans
tttaacaaattaagtgtttcaaaaaaacggaatgttttgtcagacagatcattagcctccgatggcgatttgggatttctatctttatctttattgagtttgttctgggacattgaggtgattgctgctactagatcaacacctttgtcgtcacacattgaatcagaagtcatttgcgccaacacctcaaagtaa

SEQ ID NO: 9580 - DNA, 252 bp, Candida albicans
  unsure (12),(201): Identity of nucleotide sequences at the above locations are unknown.
tggaaagaatcncaaggggaacctcgaagatacgaaatagacccaactgaattcaatgttcaatggccggttgcacaaattggaagtgtgaaaaaaaaatcctctaagggtctggaaattctctttaataacaggcaacttaccaacggggtttatcttacctggagaccacaaattatccccagtttttgggagagaatngagacacttttgggagaaatatttggcccgggggtagaaaatttgtttgaa

SEQ ID NO: 9581 - DNA, 189 bp, Candida albicans
atttacttaaaaatttatttatcgccactttataaaaaacatatgatactcctctttcattatcttcccattcatttatattatccgccggatcagaccataataaatcattttaataatccaaaatcaggttcatcggatgggacaaactatttttctaatctccaccatagaattgaatactggtga

SEQ ID NO: 9582 - DNA, 324 bp, Candida albicans
cttaatttattattagaactagaactagaactagaactagttatagtatataattcaaaagtttgtataatatatattacctatatgtatatggattttaccaagaaagaactgatctacgaatacaacggtataaatgaatattgtttgagttttctttgtagagagagcccagggctggggcaggacgggacaactgcccacagacgggcgagtttatttacaaataagtacgcactcgcacacggaccaaaaatatctacaaaaatcttgacaacagattcatttcgtgaacaacaagtacaacaacatttcttggtgtaa

SEQ ID NO: 9583 - DNA, 921 bp, Candida albicans
caacagattcatttcgtgaacaacaagtacaacaacatttcttggtgtaaacaagaaagacacctaatatccaataatcaatcaatagtatcagtgtgttttgttattggaggcagtaatttaaaaaaaatgccagaatcatcacaaactgcatcatcatcaacaacagcaggtgcatcagcaacaacaggtacaacaggaataccattaacaaattttaattattattttttacttaaaacggaaaatatcgaaccattaatagatatagtgaatcgaattaataaagaaattaatgataatcaaaatttaattcattcattatgtttacaaattgataatcatggaaaatttcccgataccatagcatcaagtactaataccaacgacaattcttcaacttcaattgatgatccattacgttatttacttgaagagaaatataacataacccggagtccaaatcttagtctgaccaatactactactaatcttgaagattataaacaatcattaatcaatgacataactcaattacgtcaattacaacaaagtaaaaatttaaaaaatcgacaatttttatcaataattgaagattatgaacaagaattaaatacatttatattaccaaatttaagaaatttaataatcaataatttagattcaaataaacatcaaaaatcaaaaaaatcaaaaacatcaaaagatattttattaattagaaaacaatttttcatgattgaaaaattaatttatgaaaaatatgaaaaatatataattcgattatggaaattaattaaatttattaaattattgaataaatttatgattaaattaaaacaacaacaattaaaacaaaaacaattggaaatgattcaagaagttaaagaattgaaattacaattacaagaaatcaaataa

SEQ ID NO: 9584 - DNA, 225 bp, Candida albicans
gttcttagcttcaataaccaaagcaaggtgacaacaatctggccaaatccagaacatcatctaccaaaagctagcactggaaccaaatccaagacatctattaatgcagcaccactgttggataggataaaaccatatgaccaaaacaatgaattgtcacggattgggaacagcgggtataaaagcattatccacagtaccaaagtagtcttaaccaatccataa

SEQ ID NO: 9585 - DNA, 1626 bp, Candida albicans
aacaccaattaccattttcttgaatacttttttcaggctttttcaatggatagcaacaacgacagcaaaacgaaaagacaaaaaacggggaatctttacctgaattatacaatttcttcaaatgatgaaaaaatcgatatcatcactgatatttcgaaattatcacctaaaagttttttcaatgattatatagcaattagaaaacccgtgaaatttgtcaccctttctgatcaacaagttattcaattgaataaatttgaacttgagaatttagttgatacattgaattataatgatgaagaattacaagttgaaaaaaaatatccagctgggtttggatcagggcagacaagaattcaaatgaaattgagtgatttagtaaatgagattaaaaatgggaatgatgaatattatttaactactcaatatgattttgatgatcctgatagggctagtgacgaagaagacgaggacgaaggagaagaagaagagaacggaaacgaagggggagttccatttgatcaattttctgatacttcttctattgatatgaataacctccatgatgattttgaagacattgaagatgattttgatgaatcagcaaatgatgaagtaaacaaccaagacgaaatgacggcagcagaagcagaattcagaattaaagaattatatcaacccccattaaccaatttagtcaatcatccagaaattcttccttattctccatcatttttcaatcttgttcctcaacaaatcaatttatggatgggatcttcttctaccaacaccaatatcaaagaaacacacaataatttcactatagatgaatcaaaaccagatttaggtttaggtaagcaattacctggtgaatcacctagaggaacatctacgggattacatcatgatcatgctgataatttatatatattagtactggggaaaaaacgattcacaattttaagtcctaatgatgccatgaaattatatactgtgggaaatatatataagattttcaacagtgggataattgattatgaaattgatgaaaatgcccctggttggaaacatgttcgtgatgatggggcaatcattgaagaaatcatttattggcaattggataaatccagactgaccaataatgggcatgacaaagaagcagagcaaaaattgttgaatgaattacaagtacatattaaacaacatcaagcacaacaaaaggctttgaaaactacttcgggtattcgtcgtgatccaccaagtttttcaaaaatccctccggcattattacatctcgatgaattaaaagatgaatcaattcgtaagaaaattgaatcttttgcgaataaatttttcccaggggttttacaattgaataaattggaagtatggttgaatcctggtgaaatgctttacttacctgctggttggtttcatgaagtatccagttttggaagtgataacaaggacaatataggaggtgctcacattgcaattaattattggtttatcccaccaaacacaacaaattttgatgattgttatgaagatacttattggaaagaagattgggagaaaaccaaacaagcaatgcagttggttaaagatggtgtggttaatttatag

SEQ ID NO: 9586 - DNA, 195 bp, Candida albicans
aagaagaaaagaaaatgtttgaaattgataaaaatgatttccaaggaaattctgatgattatcaaaaaatattttcagaaaaatatactactaaacattagaaatgaagatgtggatatagatatagatagatatacatatctacttagaatgcaagaagaaataaatattcaagtatttttaagtcttagttaa

SEQ ID NO: 9587 - DNA, 330 bp, Candida albicans
aaaaattctgttgcgtcattcataagtttagctagacgattttgtaacggattaattctgcgaatacatttttccactgcaaaaacttatcgttctaaactaattcaagtctattttaatttacagaaaaatgtggtggtgatggcagaaaggaatttgtttatgcaagttaaaagtttgctaaaaaatgaaaaagtgtcgatcagcaaagagtataatagcaactactacccacatggacataaaattcaattgaagtatcttatttctttcatttgtgacacacttttgaagtcaaaaaagttcagaagtaatacaaaatcaaaatga

SEQ ID NO: 9588 - DNA, 189 bp, Candida albicans
aaatgttcttttcttcttgaagagggtagtaacaacaatagaaagccacataactatatggtgttacgtgatcaaatcccattttataaagatttttcaagtttttctcattttgattttgtattacttctgaacttttttgacttcaaaagtgtgtcacaaatgaaagaaataagatacttcaattga

SEQ ID NO: 9589 - DNA, 243 bp, Candida albicans
tttaaacattttttcatacaaaaactagcagtaaatttttacatgtttgttaacaacgaacttaataacagtaacagttgtattctaataatagctttctacaaatccgaaattgcttcaatcagactcccattagattatttgccagtattagagacgttggtaggggtttgtttgatttttggcccaatctacatctgcatattgcatgaggcagaatacactaacacaattcttcattga

SEQ ID NO: 9590 - DNA, 201 bp, Candida albicans
cactctttaattaagcaaggaacttccagtacttctacactatatatagagagaatgacgttccatatctgcaaaaaatggagttccgattaccacggttcacagacagtgtcaatttatccatcacaagaatacaaagatagtagccatgcattatcaacaaacactctgtttcaagccattgatgctcgccacgaatag

SEQ ID NO: 9591 - DNA, 222 bp, Candida albicans
  unsure (186): Identity of nucleotide sequences at the above locations are unknown.
ttcgttctaaattcagttgggtatggaatatgcaaaccacaacatttgaaaattgaatttatttgttttacaaaagccaacacatttagaattatatttgctttggaaccgtatacggaagttatggataatcacgttatcgtgatatctattattgacaccaccacaatatctattatttctgtnatggattgcggtgccaagatcaaagaatcattttaa

SEQ ID NO: 9592 - DNA, 303 bp, Candida albicans
acgggatctccacctgtgggcaatactgtgcacttaatagtggatagattatctgtgcatggtatggaatataggctagctccgtctttacactcaaataaaactttggagcgatatgtttttagatctgatttcataattaatgacaataaagaatactatgaatgggtaatcaatgatttatacagcagaggggaatcaatcatgaaatggatatctcacaataggaagataaatgttttgggggatttaataatcgtgagaatgcaaacacaaaagatacaaaaaaaattccttcaataa

SEQ ID NO: 9593 - DNA, 297 bp, Candida albicans
atgaaacttaaagtcactgacaccaaagaagttttgtatgtgatgaaatttttttcgtttctttatgaaagaagaagaatgagaaccaagaagaaaaaaattattattagtgttctgaatatgtctgtgtctgtatggagaaaaaagtggtttgagcggatacacactaccttatttacaaagttccgtgataacaataatattattacaagtcaaaatcatataacaatcacaacgactaccaccaaattgaaacttcaattaacattgcataacccctttttagtactcaattag

SEQ ID NO: 9594 - DNA, 183 bp, Candida albicans
gatcgtcgtaaaatgttgtcaaccgcatctttatgcaccatagatttagttgtatctatcgggaaaatcaatacccaactgaacacaccagacatcccaccagccaataacactgaaaatggagaagaaatcgaaggatctttgtttataaaattatttatcgaccatttcatggattcgtaa

SEQ ID NO: 9595 - DNA, 291 bp, Candida albicans
gcatatactttggtaaattcgaatggacaagcaaataaagagacaccaccacctgcaattaaaccagatataaaacaaacaggaatatttcgtaaaaatggatgcgagctttcaatatttttcgtccagggtgtctcatataatagtccatatgtatatggtttcactgtggtaaataaagaaacacttaaagatttagataatgacgttgaaatgattggtgcccaaatacctcggaaaaacccacgtacaccttctttagcatatttctttttaacacaatcaaaataa

SEQ ID NO: 9596 - DNA, 219 bp, Candida albicans
aggaattttcaagccataagttggcgtattattaatgacagcaaaggcatttttttctacagtgtacattatatgattatatatatatattccataataaaaaaacaagttgatgaaacaaagaaacacagaggagataatagttcatataacgaatcaatgaatacttataattcatctctatttacaggctgcgacaaagattatttaaataaataa

SEQ ID NO: 9597 - DNA, 213 bp, Candida albicans
gtttgtgacctccagctttctctctttctccattcacattactggagtatttcattgtactctccatcttacttcatgacttgcttaaacgattactcgcttcgatatgaatgttggatggacgagaaaatgaagaaattcttggttcatttttttcttagtaaaacgttagtcaggccggtagaaaattgtaattctagtggtatgttctga

SEQ ID NO: 9598 - DNA, 198 bp, Candida albicans
ttttcagtattttcttttttttctagttctctttcacattgttttcatgtttcctttgcctgtaacaataggcggatacctctttccactggaaacaacacttacaatggggctaacaccgaaattttattgagcatctacgagaaccagttaaaaacaatagctagaatttacggaaatgataaaaataaaaaataa

SEQ ID NO: 9599 - DNA, 297 bp, Candida albicans
gcgtatcgtccacggcggggtgaagattacttcggaaatgggtataataatgttaatcaaatgtacatgtatatcacaaccattcaattgtccacatttcctacttatgacaggttttttttgttgcataatgcatgtaacaaaccattgcacaagtgtgtgcgaacaacctcgtttatactttccagaaacttgaagaacaaggtggttgaaaaattctgtcaaatttatcttcttccttcccctttggctgaaacgtgtcagtttacttttaaggttgtactggagcagttatga

SEQ ID NO: 9600 - DNA, 192 bp, Candida albicans
ctggaaaataacacaatcttatcagtccaagaatttctttgttcattcttgtacgatgtcaatgcaaaattgcgttatgcaataatagtagaatcgtttgaatatgtcaagaattatatcgttcttataacaaagaatttcatctcttgtaaaaatcataaagacaaagaagaattttcttccaccttttag

SEQ ID NO: 9601 - DNA, 207 bp, Candida albicans
tcattttcgaagtttaaatttttttgtttaatctttcagataaatggtgcactagccaaaacctctggttcaatgacttgcaaacctcgaggtgacaacaaattgagagcgtactatcaattcatgagattacacactacatattcgccttgtgcgtgtttgcctcgtactagatttccaagtttctgtcccttagcgcggctatga

SEQ ID NO: 9602 - DNA, 291 bp, Candida albicans
acatacatttccaataatttctccatattattatttttccggcatattcgattttttgcaactattcgcgatgtacaacaaaacacaaacggaggggagcaaatctgcaagcaacaatacacgggcattaaaaatagtcatcaagaaagttcaaattgtcagttgctacttatccaaaacacaaacccatatgaggaggggaaagtagggattattgaatatcccacactggggttacttcttttcaatatttttgatttacccttggaacacactatcgttttgctttaa

SEQ ID NO: 9603 - DNA, 186 bp, Candida albicans
aatgcacaaatgagtgtaggaaaaatgactgttcaaatctccaaacttttatattttttgcaaattttgagagatccttcttccaaaaagtttaaattaagtttcgaggatactcgatatgaaattattggcatctattcagataaccggaaaatagaatatcattctactattgacaggagttga

SEQ ID NO: 9604 - DNA, 297 bp, Candida albicans
gtaataattatagttatggtaacggttgttctagtcgttacttgtcaacctcggattatcttaattcattccaaactttttcagtttcagttccgatgtattgtgactttattgttgtgcagatacggattaatccaaatagggaaattaattgataaattgcactacaattctaaagtcaaacataaacacaaaacactagataagaaaaaaaaagaaatgttactactatttgaagctagcattgcggttgctattcctcggttgataacttacttaatccgaaaccattgttga

SEQ ID NO: 9605 - DNA, 219 bp, Candida albicans
ttgcaaaaaatcgaatatgccggaaaaataataatatggagaaattattggaaatgtatgtttatggatgactattcgagcttgcagaatcacactagactgcaagatgtactatggatcttgactacaaccaactacaatataaatctcgaattttacgaatttagttgttcaactcctgtcaatagtagaatgatattctattttccggttatctga

SEQ ID NO: 9606 - DNA, 192 bp, Candida albicans
cagcaacaactgctattatgggtatgcgccacagtgagtaataattatagttatggtaacggttgttctagtcgttacttgtcaacctcggattatcttaattcattccaaactttttcagtttcagttccgatgtattgtgactttattgttgtgcagatacggattaatccaaatagggaaattaattga

SEQ ID NO: 9607 - DNA, 783 bp, Candida albicans
ttatttattgtttgcctgtctaatatatacctatacaaactagcatcaatgatacaacaatcgacaaattcactggatgaaacagagagtgtatcaaaacaaccacagcatcaacatcatatatctccaatgaaccaactacaaagtcttaacaaagaagaagtaggtaaaaagtcaagcaaaactgaccacatcaagcagtatatatttaagacagttgaaaatatgccgactcccaaattgatgtggctaattagtccaattgccattgtcatttattccacagcatttaatatagcaagtgaagtcttatattcaaagttcacttataattcctatggtattagtttctttaaaatagcagtgttatttttggatgtatttatatttttagttgtcatttatgaacaattttatttcactaatgatgtccattttactaacaaatggtcgaaatacacttatatattaatttgcgaaattttgaaaaaaatattatggattattttattaatagcttgtgttttccaagtcattgttatatccaccggtaggttgaataacccattaaatattgacaatgattacatgcaatattttgaaatgactcctaatgaaaaaactacttatttcataataaaccttttcagtctaatctttaatggagcagttttaactatttggtggtcaactaacatatcttcagttcattctttatttggtctcattcatttgataaacattttgagccatcggccccacgaactgaaaatccgcgtcgca

SEQ ID NO: 9608 - DNA, 297 bp, Candida albicans
tgctgtggttgttttgatacactctctgtttcatccagtgaatttgtcgattgttgtatcattgatgctagtttgtataggtatatattagacaggcaaacaataaataatcaaagggatttcaataaaattataatacacttcgcaagtaataggggggtatccaatgttatttatattaatcaactaaactataataagattatcttcgttaatttaaaacaaatactgaaaaaaaagatcctgaagaacgttccaattataatatctataattaaacttatagataatgaatga

SEQ ID NO: 9609 - DNA, 192 bp, Candida albicans
gagatttgcaagcaaaaaatatatgacgccttttggtatttagtctcttactggatggctgatacatatgcacaatatattattgttgaaactaaaatggttttaggaaaaccattggtacagtatacgcaaatctttcgaagttgtcctttgggggcggggggtgattatcgcttatattttctgttctag

SEQ ID NO: 9610 - DNA, 342 bp, Candida albicans
caggcaaataatatatccttagatatgtctaagcattcagaagatccaatcaaaggagtaaaagtgcagaagaggaaagttgcttctattgcatctacctcgtcactgacttctacgcatcaacagttaatgaatcaagcaactaaaatgaagagaactaagatcaatgaaatgaaaaaacagaaacaagattttttcaaacgaataaactacagccatttgttgactgttgttgtgctaccactattggcagtcttgtatgtggtcctttgcaaacaaagcattgttcccgagaatgaaagaacgtggtatttcacttgtatatattataacattacaatg

SEQ ID NO: 9611 - DNA, 228 bp, Candida albicans
tataaacatacattaaagaggttaatctggttgctttataggtatcaatttatatacttgactcaactaacaaaatcaaataaaagacacaagcaagatgcaactgatatcacaacaacaagtaccacatcatcctccacctgccaacaaaccacgaccaaacgctgctgctgtcccaaccatttcctatcaaccaacagatattattattccaactcaattatatga

SEQ ID NO: 9612 - DNA, 201 bp, Candida albicans
gtcagagacgagcctgaaccaaacaagtcaaaaggaaatgttccaccagatgagcctgtttccgatggagatgaatccagagaacttgaagacccggacgagtcaaatggccaaattgcttgtgcttggcttatcaaaatggaccctattattagtttcaaattaaccttcattgttgggagaaaaagcgaaaacagatga

SEQ ID NO: 9613 - DNA, 186 bp, Candida albicans
ctgaaatttccgagttgcagatacggaagaccaagatcacagaccgagaataaagatttgattgaacaacagagaaatagacgagcttctggtgccactggaaaattatcaacgtcatctaacaatgactctgatcctgacgcttctacattgggcaagagtgtgaatacacatctctcaacctaa

SEQ ID NO: 9614 - DNA, 258 bp, Candida albicans
ctgcaacattttaccaatactaaaaaatctcaaactttacgtcatataattaattggaaatcaatttccattaagatgaagataattagtagtagaggtatggctgatagagaaatagatacatacattctctctcgatatatatgtgggtgtgtgtctgtgcgtgtacgtgtacgtgtattttttttttggctagtttgtttgttcctgtttttgtgtcatgagggatttttcttgtaccttttttttttcgtttga

SEQ ID NO: 9615 - DNA, 579 bp, Candida albicans
catctaattgatcaaatggaatctacatacacagaaagtacaatttccaaattggaagataaagaggaaacgatcaaatttgatgaatctgaattggaagaacaactgcatcgaggaagagataaaaagagaagattatcatttcattctcgtcattcttcagccagtagacataaaatttttccaatacgtgaatcagttgatcctggttcagtattacctactgttttcagaactatttctcataatattgatattgaaaaaaatcatcaaccaattgattctagcgatgataatgatgataaagttgacaaagctgacgctgctgctaaaaccaaatttagtaattattcatttaatagtgatgatattggtgatattgttgaaaaattcaagactgatttgactaatggattatctgcaagtcaatatcaagaaaacttgaaaacttatggtatcaacaaacaatctaaacctcaatcaggattattgaaaagaatattcatgtatttctttggtggaattggtttgttattattaattggggggtgtataaggttccattggttgggaaacctt

SEQ ID NO: 9616 - DNA, 273 bp, Candida albicans
actaagtcagtgaagaatattctttacatatatatcaacacgtttatgcttaaattaccttaccatacatcaatcaaaactaatacagactataaatggtttgatccggttttgtttgggtctgaggcggaaaaaatgtacactctttttctccccccattgttcgttcatcaatgtgtaagattattgttgttgatctctttatcaaacattctctactattacagggggttgaaaagtaggaaacacacgttacatacaagccatttttag

SEQ ID NO: 9617 - DNA, 189 bp, Candida albicans
  unsure (154): Identity of nucleotide sequences at the above locations are unknown.
tctggtgtttactttctcggcattaggcaataccttctattattaatctactttaatactcaggagttcagcgtcatcttgaaactacataaatctacaaaagagaaaggcgaatacttgcacgaccatcggagcgttgctttaatcggacctntgatcttgccattcggcgctggagatcgcgcgtgc

SEQ ID NO: 9618 - DNA, 195 bp, Candida albicans
cacataactacgtacacaacaacagagcaaccgcagcattcaagtggaactagtatgtgtttaaaaaacagacaaattaatcgggataggaagagatgggaaaggggggtgagagaaaagcaaagaaaaaaaaaagaaaaaaaagaacaaaaatcaaatggtacaaaaaaaaagacacatcttctacacaattaa

SEQ ID NO: 9619 - DNA, 387 bp, Candida albicans
aaaaccattacaccaaatacattatccattcttgaagaatttaataaaagatggaatcaaattgttcaattattaggtattgaacaaggtcaatttatccataaagtaattttaactcatcgttataattcatcaatattttctcgtttattatcaagagttggattagctattattaaaacaactgatgatgccttaaatgggccaatatatgttgctagtgctggtattttacatacacaaaaatcaaattatggagttttaataactattagaggcacagatgagattggtaaagaattacaaattgttgttagatgtactggtggtggagttgcagaagttatttgttctacattaaaagagatttttactggaaaattttaa

SEQ ID NO: 9620 - DNA, 774 bp, Candida albicans
tttcgaaactcctcccctatatatccaataatgaaacagaattatattttactgataattttatgttatcttctcgcgaatgttcattctgctccagcaattatcacagtttggcaaacagttacggatgcacaagtagcagctggtccaactgcagctgctcctgccgctaatgctaatgctaatgctaatgttcaacaagcagctgcagcttctgcttctgctccagctcccgtggcttcacccgctgctcctgccccagtttctagtgcccctcaaagttcaactccttcatctagtggatggttgagtaatttattcaatagtttctttggaggaagtattagtgatagttctagtggcagtgacactgcatccgctgcaccagcatcgacaagtcctcagtcatcatcatcatcttcttcttcttcaggaaacagtttcttatctttcttgagtggattatttggatccggaagctcttcatcaaccccatcttctacttcacaacaacaacaaccacaacaagggtctccagcttctggttctaatagtccaaattcagctcaacctgatgcagcagctgcgtcaaatcccgttccacaaagtaataataatcaaggctctggattaggttctggttttggatctggatttggctccggttctggctctgactctgactctggttctggcttaccatctgcttcatcttccacaatcatccaacaacaaccttcaagctcaaatatcggttcctcctcgactgttcct

SEQ ID NO: 9621 - DNA, 186 bp, Candida albicans
atggggagagttcattgggaaattaaggaacttcccattttattcaagaacacaaatgggggtggaatcatttattccactaaatttgaattccccgtattaaattttaaaaaaccattacaccaaatacattatccattcttgaagaatttaataaaagatggaatcaaattgttcaattattag

SEQ ID NO: 9622 - DNA, 309 bp, Candida albicans
ttactgtcgaacttgttctctaaaccaattgaagaaagtccaagacatttttgccccttggatttattatataccgagactattgaacaaggtttaaatgatttatttgcaccaatctcgcaagatatatatgccaaaattgacaaattgatcccgttaaagaaattgacaacaatctatttcaataaccctgacaatgtgttccaaaaattgaaacaatatcaaaaaattaataacaaaaatgatctaattaagaacttgacatcttatagtgatgtatctcaaaatctatctttagtaatgacctaa

SEQ ID NO: 9623 - DNA, 186 bp, Candida albicans
tttccaatggatttgaaattgccactagatcaagtggatccttggatgatgaatgggcagcatgtgttggatgcgccatcatacggagagagcaagaaagacaaggtattgaacagacagaacaatgtaagagatgctttgaaaactattgctgggatggtaccatctataagggtgagccattag

SEQ ID NO: 9624 - DNA, 189 bp, Candida albicans
atgaattcaaaaacaagaaaggagaaagagaaagaaaaagaagaaaaagaaggggagggaaaaggaagggaaatgaaaaaaggaagggaaagaaaagttataaatatatttttattaaatgaagcaaaagaagaaaatttaaggaaagtggaaagcaattatattcttattattaatttattactgtaa

SEQ ID NO: 9625 - DNA, 195 bp, Candida albicans
ttaatttttttatatcttcatttttattttgtaacttctatcattttttcaatcaagctgtgtttattttggggtataattatactacatcaaagatctagaatttcattatggttaaagagttttgaaaaattctttttttatggaaattgtctttatattaatgatgtcaattctttatctttttacaattaa

SEQ ID NO: 9626 - DNA, 219 bp, Candida albicans
aagtttgacttattttcaattacaaatccatttcttaatctttacaactaccatattttagtccttgcgattaaaatcatcacaatcactaacaacaaaacatccatcaccatcataattaatttttttatatcttcatttttattttgtaacttctatcattttttcaatcaagctgtgtttattttggggtataattatactacatcaaagatctag

SEQ ID NO: 9627 - DNA, 321 bp, Candida albicans
  unsure (12),(31): Identity of nucleotide sequences at the above locations are unknown.
acaatgaggttnctccaaattgtatacattntaatcatctccaatttgatttatgctacaagtggtggtggcacaagtagtcatcatcacaagaatgataacaatattgctgataatacaaacaataacaacaacaacaataataataataataatatcactaatgctacaactacaagaacagtcactacttcaactaaaactaaaactcatactggaggtggtgttgctgcaatgggtggtattttaggacaaaatgggtggttttatggagatgctgggttaatggcagcaatatttggtgctatgcttttgttgtga

SEQ ID NO: 9628 - DNA, 234 bp, Candida albicans
cgtggcgaagattcattgggtttattaccaaacaaaatcagcagtcagttttttccaaatggtttagatgactcttcgattctggaaatggacgttgaattgaatgacaacttaatcataataagaaatcttttaggtgaaatatacggtttatgggtgtttaatgaaagcgatagaatcaaactatttaaatcaatagagttctgtcttaacacagaggcaagcttaagctga

SEQ ID NO: 9629 - DNA, 351 bp, Candida albicans
aatacatgtatcttgcaacgaaaaaaaaaaagagtctcgaaaaaaaaatctatcttccagaatacaaaatctaatctgcgtcagtttggtaagttattagaggaacttcttacaataaaaattactttgataacagtatttatttatgggctatatataattcagcttaagcttgcctctgtgttaagacagaactctattgatttaaatagtttgattctatcgctttcattaaacacccataaaccgtatatttcacctaaaagatttcttattatgattaagttgtcattcaattcaacgtccatttccagaatcgaagagtcatctaaaccatttggaaaaaactga

SEQ ID NO: 9630 - DNA, 294 bp, Candida albicans
agtattagagataagaaacccacgtttttctctaaattcattatcatgtttgctaataaatgtgacatttcttttctgtttgacattgaggagataaatcaatatgatactatttttgattccaatgatattgtatatttaaacaaagaggaaatacaacatttgcctggagatatattttgcaaattatggtcgaagatcagtggtaaagaattggaggggtctattgaagaggatcaagtggaatattgtgtgtatgcttatcatagaaatgtttgggtgaaatcacgttaa

SEQ ID NO: 9631 - DNA, 237 bp, Candida albicans
aacaaacaagcatgtcattttattattttcctgaatttgttatttagtaataactaccgaagccaagttgcaagtgtgcgtttaaaatcaagaattatcgcaagaagtataccaaattacggaacttgggagcataataaagtattagagataagaaacccacgtttttctctaaattcattatcatgtttgctaataaatgtgacatttcttttctgtttgacattgaggagataa

SEQ ID NO: 9632 - DNA, 198 bp, Candida albicans
aaatgtttgggtgaaatcacgttaaccaagttgaaaaactattattttttatcatggtcaccctatcatgatcataaacaattggacaatggatatttgacttaccacgaaccagaagtgtatggaaagaagggaatttttgagaaattgaaaaatggacaagttttggatgagttatatcttgggtgtatttactag

SEQ ID NO: 9633 - DNA, 219 bp, Candida albicans
acgaagaattgtcagagaagaaaattattattagtaagaaataataacaacaataataataataacaaagaagaagaagaaaaacccacacacatacatacatgcaacaaagacaagaccacgtcttatatgtatgaatgtatgtatgtatatgttagtaataaagcttgtgaccaccaatcaataacaacgttcactcccaatttatttttagcataa

SEQ ID NO: 9634 - DNA, 522 bp, Candida albicans
tatggcatactaaataagcatcagaacgaaataatgaaaactcttagaccaatctcaatatttattgtacttcacattatcttttctctttcttcttgggttatagtttctattccctatagagttctcaaaatgtgtattaggttgttcttgttcatgatatatgttttcacaattggtgttttatccaataatagtccaaattcacctccatcattcatgaaacctcttgatcaaaaactattgtttccttatactactattttcagtaaagccattaataatagatcaataattgaatgtatgaaattatcagaatcaacttcatttaaaataaagaattgtaccattaagggagaatctcaatacaccagcaatggtactggtagtaggagtattaaagataaatcatgtttatgttattatattaaattgatacaacaagaatgtgaagaattgaattctgatcaatcttggcaattacaattattacaataccctgaatgtttttctacaggataa

SEQ ID NO: 9635 - DNA, 204 bp, Candida albicans
ttcatatcttttcagatctttattcattcattctttattttttttagttccaaaaagacgatgtccagtgacgtaagtatattagaaaagaaagattttttctttgaaagaagagaaaccaattacatcattcatatactaacaatattgatcccccctaataattttattatttataatagcataaatccaaatttgatttag

SEQ ID NO: 9636 - DNA, 192 bp, Candida albicans
attagggacattttctttttctctattgacgtcattgaaacatcctcggctattttgaacttgcatttgtggctacacccaaaaaatgctccttatctctgtacacgacctagtgccaatatctctttcacacatttattggtatatgtttatgatactaatatcctcaatcaagccaacttctactattag

SEQ ID NO: 9637 - DNA, 201 bp, Candida albicans
gtcacaatggatcaaaaaatcgaaaaagttgcactaccaactcatcaacaaagtagagtgagagagagaaaaaaagacgtcacaatggggaaaatcattaatcttccaactatctttatcttcttagatttggtgcaaataattcttctatttcaaatatcttactcaaccagtattcagatatgccttcacaagaaatag

SEQ ID NO: 9638 - DNA, 1212 bp, Candida albicans
  unsure (966),(1015): Identity of nucleotide sequences at the above locations are unknown.
tcaaatcgtggatttttcaatacagtcaccgattctgaatacgacaaaaaatgggatattagaaattacctttcatctggtttccctgattctagaattgcccatgatgaagatattcacgctactgttcgaatccaaaaattcttccatccacatactttaccaaatgatcttgacggagatctgtggcatctggtcaaggataacaaagaagctcttgatagttttcttgattatgtgcaacagtttcaggattacaccatagaagttaagaataaaatgtacacatactatcggtgtaactactcgcatacaaatagtggtgtttcaactaaaaaagccgattgcaaacataaaattacagtacaaacgcttaaatcggggaagtataaaatcatgtggtatttgaggcacaaccacttgattgatccaataagattagcaatgctgccaaaacaaccattgcctaccattcttccctggccaggattagaaataccaaaaacaccgatgatcgaacttgcacttgaaaataacaaatataaattcgccgacagagcatccaacaaaaaaagtgaggcaaattttgatccagatgtgcttgagactttaaaaaatgtgttattcaatgttaagcgcaggcatgaatttgctgtgttcaaaaagcgttcaacaaactctgagaatagtaaattttgtgatgtgggaaattctacattgaatcctgaatctatgtggtattttggtattattcatttatctgatatcgaacgcattcaaaatacacaaattgtttttctaggttgcaccactattttgagtgaagggttatataacgacaatgttaagttgtatagttttttcaccaaaaatgttataaccggggatgggatatcaataggatatttaatgaccaacacagattctcatgaaccattagcatcttttttgagatgttttgttganaggggaatacaaatcaagaagtttgttactgattattcgcttaaaatantgcaagctatcaatgaaaggtataatgttgggatgccaaaccaaagtcagaatttcaatgctcttattacattctccaccccacaaattttcgaaacgtttgattatcaaattatttccctttataaaaaacccctccccaatgattattatttccccaattattacgaggatttacttttaccaaataattttggt

SEQ ID NO: 9639 - DNA, 273 bp, Candida albicans
agtatcattagcaatatttttttgttaggtacacgttcagcttctccaaggtgtgagagcaaaaaaaaaatcggcaaacagttcaagctattttgtttttcttctcaaactcaaaacacattttttcaaagaattacaattccagtatttgaaaacatgaacttatcctcgagaagaagagattggagagcctctattccagagaaatttagaacggctgaaaaatttcgaaccagtaggattaagccgaaaacacccttgatccgggaatga

SEQ ID NO: 9640 - DNA, 258 bp, Candida albicans
caaaaaaatattgctaatgatactctaatttgcggtccagtagacgggcgacaacaaataagaatggggggcggcccagactttattttgcgtggaggcaaaaaaaatctacaatatgaaatttggtgcgattttttcgttttttggtatttacaactttctagaatctaccaattgcaatctgcaatacatctcaacaaattattggaaggtaagattttccaattctatccccgaaatccattcttttgcttttaa

SEQ ID NO: 9641 - DNA, 420 bp, Candida albicans
ctcgcactatttggtggggtcgagtattgctactactactacctcaacaaccaaatgtattcttcaccccatgtttttgttagtggccattttcaacaaaacaatagtcaaactaaatttatctggttattgtctgaaatttctattattttccaaacaatagacgaaagaacaatctctaattcttacatagcccttgatctctatttagtaaccaatttgatgacgttacatttttctaaaaagacaaaggaatttcatttcatttttttcttttttcttctaccgaatgggctttttgttaattggttagttacttgtaatccgtattccttgtttcaagtgatagagttgagaccgcctgagactaaaaatcccatattacaacgagcagctaaccatgctaactcccattcatag

SEQ ID NO: 9642 - DNA, 195 bp, Candida albicans
gtgtgggacttgtctttttttgctagagaaccgtgtaaacaaaaatatataataaaacctactttggataatgagttgcctttcagtggtatgccttttggcgttgtattttctctacattatttctatttaatgccgcaaccagtcataatattggaatcggatgatgtaatttgtcatcaatggcattgttaa

SEQ ID NO: 9643 - DNA, 573 bp, Candida albicans
acccttacaacattcccaaagattattcagacacatcgaccaagcaaaagtatagttagttctccggggaggccagctacgattaatcacagcaatacggagagtggttcgtttttcagtaaattttccagcttgccgaaaaagacaaacaaaattttgaattctgccaacggtaacaattccagtggtaccgataattcgtcaactacatcgtcgtcttcatctaccgcatcaatatctgtattattgggtcatttgaaacttggcaaagataacaacggtaatcccactgccgcctccacttccaatttgaatggtaatcatgacaaacatataagctcccgttctcataaaatttcacatcagcatctggttcatcgtagccaccaccatcatacaaatcatcacattaaaagaacaggcactttccatggtgtgagtgtgaatgaccctgaatctagtaatagtagtgacgttggaagtgattatcgttcattaaatgcaagtccggtttcaatcaataatgaatcaggtggtacttcgtctttaaaattttggtcaagaaagaagtaa

SEQ ID NO: 9644 - DNA, 1113 bp, Candida albicans
ttgatactaaacaaacaaattggagggcaagagttgtatataacgatgactctagtttcttcacctgatgaatctgttaatgcattaacatcaacatcacctccaacaataacaaccagtacaagcactgcatccactctaacgaatagttcaccgtatccagtttcaccaagaaccaaaaacgccatgccttcatcgattttcacatctttagatcaaactataggaagctcaactgctaccaatagtacttgttcaccaatcacaagaccatcaacaccattattgcccccgttagaagatttagtgaatgattgtttcttacattccatgggtcaattagaagatgaaggcaaaattaaagtagtccaagactttacagactatttaacaaagcaacatacccaagaaaacttgaatttcctagttgatatttatcgttacgaatattattataaattgaaattcgatcagaataataacgaacaagaagcttcaacaaacaactacgtttcaaatggaaccctgaattgtaataataatgaatcagaactaaatctgcgatatcattcgtgttgctcgctcgaatcattgtccaatatgcgtaaaacgcggctgatacagtcggttgatttagatcctcaaaacgcttttgtttctacgattgatgatttagatgattttggaaatgcaaacgagaatatatgggacaatttgaaggacaagtacacttgtagtgacgacgaaaatgacaacaaaagtcaagatcaatctgtcaataatccaaatgatgaacaagatcctgatattattttattaaatgacgaatggaaatatattatgaacacttatatcaaatgtgattcgcccatggagatcaatatatcacaaactttgttcaagcaaattgtccaagagtcagcattctcaagattacaccacccacagacgttaactaaagctagcaaggaagtattgcgaatgttaaatgaaaatggctacgttaatttcaacagccatatgaagaaattactccgaaaacagctgaaaagtcctaccagtagtacaccaatattatcaccaagtacatcaccattacccttacattggtga

SEQ ID NO: 9645 - DNA, 216 bp, Candida albicans
agagaagtaacagcatatctaagaacaagaattaaaccggtacccattaaaacttaccttcaagagaaaccagcgcatagatctgcaaaccgcagtaatagtactagctttgttacagtttccattgacaaccgactatacaaaattgtggtttatgtgtttcaaacagttaaaaccttacgtttggttgaaggatggttgatacgactttactag

SEQ ID NO: 9646 - DNA, 273 bp, Candida albicans
  unsure (262): Identity of nucleotide sequences at the above locations are unknown.
tctaaagatgtgaaaatcgatgaaggcatggcgtttttggttcttggtgaaactggatacggtgaactattcgttagagtggatgcagtgcttgtactggttgttattgttggaggtgatgttgatgttaatgcattaacagattcatcaggtgaagaaactagagtcatcgttatatacaactcttgccctccaatttgtttgtttagtatcaattatccagaacgggttctctatttccttttaacaaaacaaaatcaanttatgaattaa

SEQ ID NO: 9647 - DNA, 753 bp, Candida albicans
cgtagagtgaagactccacggactttaccgaatgaatttaacggaaatctgtggcatctggtcaaagagaacaaagaggattttgataattttattgattatgttcaacaatttcaggattacactatagatgttactacaaggtacacattttatcggtgtaactatacaaatccgaattcaagatcgggttttacaacttccaaatccaattgcccacataaaattacagtacaggcgcttcaatcaggcaagtataaaatcatgtggcatttgaagcataaccacccaattgattcaacaaggttatcaaaaataacaaaacaacaactgcctacaaatcttccttggccaaaattaaaaataccaaaaccattaatattggaactcgaaagcaacaaaagtaaagatactgacgaaccatccaacaggaaaagtaagacaaattttgattcattagttgtttcaagtttaaaaacttgggtaccatatataaacagtattggtgagtttgctgtgttcaaaaaacgttcaattaatactgacaataatgaattcatcgatataggaaattctacactagatcctaactctatgtggtattggggaattatttgttcaactaaatttcaactcatccagaattcacaaattgtatttctaaattgttccagtatttccagtcataaactatatgatgacaatgttatgttgtacagtttttttcacgaaaagtgcttcaaccagggatga

SEQ ID NO: 9648 - DNA, 504 bp, Candida albicans
attgttccagtatttccagtcataaactatatgatgacaatgttatgttgtacagtttttttcacgaaaagtgcttcaaccagggatgatgggacaccaataggatatttaataaccaacacagattcctataaaccattagcttcttttttaagattcttcgttgaaaagaaaatccacatcaagagatttattattgattgctcacttgaacaagtacaagctatcaaagaaggttataatgctgggatatcaaaccaaggcgatcatttcgatgctgctattacattcaatccccaacatcttttcaaagtttttaatgagcaaattaaatcacttttaaaaattgccccatccacaaatgatactaaccatcaatcaaaagatggagagttaatatttcacaaaaataccgattctagctgcaatcaattcaaattaaccgaaggaataacaactgaacaagtacttaataatcaaaagaattggcttttgattatttga

SEQ ID NO: 9649 - DNA, 594 bp, Candida albicans
  unsure (212): Identity of nucleotide sequences at the above locations are unknown.
agaagctcagaatttttagtagaaatggaaaacaaattcaaacattaccatccagagttcatagaatttatccacaagtatttttccgaaactgaccaatattggttagatttttattttgacaaccatacggaaatgattgagaattatgcttataatttcaatgagcaattaagaaccgaatatttccaaccagaaaataaatacagcantaataagataatttctgtgttaattaagaatattccacaacaacaacatcaccaccatcatcaccaccaatcacatatcacagatagggctaaaccacagttgagacacattgatgatgtagatgactccaaggacaaagaattagatatcaacgaatcaaatttcgccaataccaccaacacttcgaataatttgagaaatgtttcaaaagtgaaagaaccaaataaagtatctcaagagttggccttaaaagaaatccatgcttgtcttgcacgcgagaaattgaatcgtcgattccacataaatgagaggaaatatgcaaacaactttgaaccccctaaaccacctctaaatttcccacataatggaattgcttattaa

SEQ ID NO: 9650 - DNA, 255 bp, Candida albicans
  unsure (107),(161),(195),(207),(212),(223),(241): Identity of nucleotide sequences at the above locations are unknown.
atttcccacataatggaattgcttattaataatactaatgattcacaaacaagagccgataatatttcagaaagagaaaacacacaggatgtttacagtaagaaaantattagaaatattaaacaacgggaagagaatagtattagtttggatatagaggntaatagaattaaaattgaagagaagattggccanatggaggcctcntggtnaagccgccggnaagccgccaagatccccnaaagatcgggttaa

SEQ ID NO: 9651 - DNA, 240 bp, Candida albicans
agtatttataatatcgtccattctactgcaaaaaagactattccatgctatactcaaatcaaaaaactgggtacatacttaatgatgatgaataaattcaaaccaagtgtcaccatttttatatggctactcaaaaatgagaatgttggcaaacaaatggaagatagatcaatgtttgaattgcttagacagagattttggctaaaccaccagcagactatgaatgcggaatacaagtga

SEQ ID NO: 9652 - DNA, 219 bp, Candida albicans
gtgtgtttcatgacatgtgtcaagattatccatttgcataaacttatcgaaatattggtattaagaaaaaaaaaaaaggtgaatgcccggccggatttaccaagtactgaaactcatattaggtttggatgtatgataatcgagatatctgataactacagaaaactcatatactacttaagaaatacccgaagtcattttcatattacaatcggatag

SEQ ID NO: 9653 - DNA, 183 bp, Candida albicans
attctgaaactacgaaaattacattggtatttatatatcacagaatttatcaatatatgcaacacattttactcaaaaagaaatgaaatccttaaaaccatcacattatctcaggaacaaacaaacgtagtgaatgaaattgacaaacaatacaaaaataaaatattaaaaaagacaacatga

SEQ ID NO: 9654 - DNA, 207 bp, Candida albicans
aacgagaattattctgttttaggacaaattattattataattagtttatgttacaccccccctcctcctcctcttctcttggtcttcccctgcgtggcccagccttttatatttctactaccaccagcaccagcaaaactatcaattaacacgaccaaccaaccagcaagttctattattattttatttaaaaatgtgttaatttag

SEQ ID NO: 9655 - DNA, 225 bp, Candida albicans
tatttgaaacaggcacactgtaaaaccacacattcccagatattacaaattaggatatactactacgaaatagacgtgtcttttcaagtaagaccttctgggtcttctagtaacgtcaaacgcgtctacttataccatatttcccttactggcaatatgatcggtaaaggaaaaggaaactattcaacacagataagaaagagaaattgcctacatggggtgtga

SEQ ID NO: 9656 - DNA, 1137 bp, Candida albicans
ataccacatgagatgtctaaaccaccacctcaacatcaactgaagaatgctaataattcattatcactgccggtatcagataaacaatctaatgattctcgacaattattattagctcatttatataattatttcaaaactaatggattagaagaaactgctcaagcattattaatagaatgcaataataccattcctaaggctacaacaaattctaaaggttattcattagataatagtggtcctgatcaaaaagatacatttttagatcaatggtgggggttattatggtcaattcaatcatcaattaatcctaatttaaatcaaatgacaaatccttcaggaatattaactcctcaacatcaaatgattgtacaacaaagaatgcttcaacaacaacaacaacaggctcaacagcagcagcaacaggctcaacaacaacaggcccaacaacagcaacaacaacaacaattgttgcaacaacaaagactacagcaacaagcaatgatccaacaacaacatcaacaacaattgattaataatttgagtgctcgtcaacaacaagttggtctatctacaactactaatcaaatgggaccacctggtagtaatagtaataatcttcaatcaaatatgtcaccaaataatgaacaattacaatcacaagcaagattacaacaattgaaattacaatttcaacaacaacaacagcaacaacttcaacaacagcagcaacaattgcaattacagcaacagcaacagcaacaacaacagcaacaacaacaacagcaacaacaacaacaacaacaacaacgtcaacagcaacgtcaacgacaaaagaaattccaacgtcaattactgactctgtctcaaaaactgccagttattaataatggacaaccgcaacaacaactccaacaagatcaacgtcctgcactggcaccacaaaatcaacctactccaggaaacaacaacaacaacaacaataatactaatgctgtatcaccgaaattacatagacaatctgttgatgattatcaaatgaacttattacaaatggaaaatcaaaataattcacaaagacaaaaatatttgaataatcaacaaacacgtaactcacaacaacaacaacaacaa

SEQ ID NO: 9657 - DNA, 216 bp, Candida albicans
atattgtttatactgtattgtagttggttggttgttgttgaactaaatacacttattaacatccgtttaaccgaagggggaaagaaatttacaccaaaacgaggcaacaagaaaaaaaataaaaaaataaaacaacaatcccgaaaatctgggggagaaacaaacaacaacagaatacacacgctaaagaaagaaagaaagaaagaaagaaaatag

SEQ ID NO: 9658 - DNA, 219 bp, Candida albicans
tcaatcaatcaatcaatcaattattgtgccaatcaatttttatatccggcaaatattcttcttcttcttctttttcttcttctatttcggttccacctcacttgtcttcctcttcccccgagttatttattcatatttattaaagttttaattcttcatgttatttaccaattaactattactaggttgtcttattttgtctccttgttctataattga

SEQ ID NO: 9659 - DNA, 258 bp, Candida albicans
ttattttcatgtaataacaattctggttgtttttcttcttcaatttcttgttgttcatcaattgtatgcaatgatgttatggtgattggggtagaattagaacgtacaattgatggcaatggcgactgtgttgttgatgttgttgatgatgttgttgatgatggtggtgggacaatcgataaactcttgaaatttctaggaatagtagcttctatggcaatattattttcttcaatgatttcatcggaatcagaataa

SEQ ID NO: 9660 - DNA, 1116 bp, Candida albicans
ttaaattccttcttttatattttgggattttttacaacaattaccctcttttttcaaatatccaaatctaaatctaaatcttttagattattaacctcttttattaactttactttactttattcacacattgactccactactactactactactatcaccacttctgcaattatgtcgctgctgcaacctcaaatgtcttttgctcaaacttatatattagccagcaaagttagatccacattaactagagaagctcaatctcctaaatcttcattcagaaatttggtggttcaagctaatatgttggataatattatggattatattagtgatgaaactaaaagaagaactagtgaaaaattaacttccaaaaccaacacccagaagagttctagtgggtaccttagtcctgaatcttcaatggttcaatttgctccaactccagttagacaagcttataaaacttcaattactgaatatgaaattgatagtgattcatccgatgatgatgaagaagaagaagaagaagatcatgaagatgataatgaagacgattacttttatgaagatggtcaaaatgattacgatgatcttgatgattatgaagattctgttgttatggaacaagatgaattagctgccattaaaggtgtttactacgaagaagatcaagaagaagaagaagaagacaatttatctgaaacttcatcaatttattctaattcatcagattctgatttagattctgattctgatgaatattatatttattctgattccgatgaaatcattgaagaaaataatattgccatagaagctactattcctagaaatttcaagagtttatcgattgtcccaccaccatcatcaacaacatcatcaacaacatcaacaacacagtcgccattgccatcaattgtacgttctaattctaccccaatcaccataacatcattgcatacaattgatgaacaacaagaaattgaagaagaaaaacaaccagaattgttattacatgaaaataatcaaactatagattggaaattgaaaaatcataatcatccacaaagtttatataaaaatcaaaacatttctttagatcaatttttttaa

SEQ ID NO: 9661 - DNA, 219 bp, Candida albicans
ccaacaattggatttatagctaatgtcatagtaagaggtttccccgttgatgttgatcgagttgaatatcttaatgctgctgataatccaggactcattgttcttgcggcataccatatttctgttcctatcgataccacagaattatcaaatttgggaatcacagcagggttgatattggtaaaattatgtgatgtggcatcaccaagattatattaa

SEQ ID NO: 9662 - DNA, 207 bp, Candida albicans
tatgatgtgaataataaaaaaaaccaactagcaaatgtggataaaaaggggaaacaatctaatacggaaaaagaatttcaactcatcaacggtgatcgctataaacaatgttggttgggaaagattgtaggcaaattatacggttttgataatctacaaactaccaattcaaacttcttggatcttgataagttgatcattcaataa

SEQ ID NO: 9663 - DNA, 198 bp, Candida albicans
tattttaccttttacccctccttaaacaatatggtttcgttatttagagaagatcccaaacatattctgaaaacgatcaatgctcatttgccagttgatccccgttcacttgccaaatcagttccattacctaatactgaagcaccaggattttccccaatttacagaaatggattttccccacgatgcattacttaa

SEQ ID NO: 9664 - DNA, 234 bp, Candida albicans
aactataaaaaaaaaaaagatgttttactaacagaaacaaaaaaagagaatttaatgactatatatagatatatatatacctatatatatgtacatcaaaagagatctaataattgtgtattttccaaccatgtcgattccattggacagatacaaagtacaggtgggacaaaaaaaataataaattttaaatgcaaacctttactttattatttttcggaactaaaatgttaa

SEQ ID NO: 9665 - DNA, 234 bp, Candida albicans
tccatcccattttggggatttagggataaaacaccgctggaagaatttaatataaatattaaaggggaggaattagatttggaagtaccacctccatgtgtttgccatttgccgaatggaagttattataatttggaaatcattatggtgaaaatcaattgttcattatatcgggggaatccaggggccggtaaaaaccgaagcagcaaaacaaatatgccaatatattgctaa

SEQ ID NO: 9666 - DNA, 831 bp, Candida albicans
tgggtgaaccaattgatgaattaccagaaaaacaaacccacctatttgttccccaaatattatacttggtcaataaaacacattatatgtaaattgatcacccatgattcagattggataaaagttaccaattacaaagaagaaaatggtttacccaaagttatgcttaaatatgatgcttcaagtatatttgaaaaatatcctgagataatagaagctagaagagcagtgggtggtcaaccgcaatcaccaggtaagaattatatatgggttccacaatctttagttgaacattataatcctaaattgattgatgaatatattgaatcaacgaaagaaaaagaatatataaagaaatataaatcttcacctcaaaaaacaacattagattcacttgaagtttcaccaataaagaaatcgacattaaggggaccagtaccctttgaattgaaaccaaaatcaccaagaaaattatctcctaataaatcgacttccttgtcacctaggaaacgaagcaaatctgtattattacccggtcaaaaacaactagattttttcttggttaaacagaataataaagaaaatgctatgaagagtatacctgaactaaaacccaatgataaagcaattattgaggacaatccatttttggactcatttaattcaacaaaagaagatgaaagaaataaagataatgaggaagtaatgcaacaagaagaagaaaaatcaaatccaattgaaaagacgattactgaggaatctgacagttcagagttgacgttcccgacatttctgcttgatcggatattccttaaagattcagaatattaa

SEQ ID NO: 9667 - DNA, 219 bp, Candida albicans
tacacaacccgcgaagtgataatcttcaaaagttcttgcaccggtaaattgttaaagtcagggattgctgaggttaaagcattaaaaccaaacccatttgagccgttaattgaattcctgggagaagaaacattggaatcgatagatgttttccgaactgtcgccgtgtctatacttcctcgtatctttgatacctgtagcactgggttcattgtttga

SEQ ID NO: 9668 - DNA, 189 bp, Candida albicans
acgcaccaaaaccatttaccgccttacacgaccacactatttacttgtggtgaaacatactattggttgataatgatgttagcaatgggtttatgtttatttacattctcaaaagcactaaaagcaacctataacttacaacctaacaaagcgtttgaacacatgcttgtcttctataaagccatttaa

SEQ ID NO: 9669 - DNA, 1188 bp, Candida albicans
atcattggtgtcatgatgaaatcaactacaataatggcaaggtctatttcccaagattcacgtcatgaatatccaaattcagatacaaaacttgaacgaactcatttaagtgatgctcaatacattgaacagttattatttgaaaataaagagttgaaagcattagttgatcgacaaaagaaaattattgaaaaattaaataatcaactcaaatcaagcaatggtaataaattgacattggatttgattaataatagaacaccaccactatcacaaaaatcatcacttgataaccctgaaccagaacctgaaccagagcctgagcctgaacttcagacatcaacagccactgaagtttgttttaaacgtgtgtcagctgcattgtctccaactttagtcacaataccaaaatcacctcaacgatccatcagtaatcatagtatgcagttatcaccaactagacaaatactttctgtacaaaggcaagagaatatggcagatgctacttcttctgaccctgtgacacaagatataccattgagatcatctagaagaagacgcaactccaatgaaagtaaatctttggataagaaagcttcatatatttcccttgaatcttctactactccgttacaaatacccaattcaatgtctaatgaaagcaccctgtcatcatcatatcaaacaaatggtaatggaagagcaaatgagtatgcatctattaaatcaccagattttgaagtggacttgggtaacattacgctgaagagtgatactataaataacacttttgatagtaaaatggggatggatactactattggaactgttgattcaattgattctggtaaaattaatgaaacagtggaaagtcaatttagtacaatggaaagtacgaaatcacaacttgatatttctggctcaagtactgctactggaactggaactggaagtagcactcttggtgccgctgcatcatcatcttcaactggggtatcaaaaatatattctcaaagtaaaggaattgctacaagtagtagtagtgtgggctctacttataaatcgtcacgaattaaaccaccaaatttgcaaacgaaacctagtaacagtagtactgttgatctcccacattcacccctactcgataacgactctgggtgcctaccccgttcctcttccaatatctaa

SEQ ID NO: 9670 - DNA, 222 bp, Candida albicans
tcagaaaccaaaacatgtcttcataacaatacttattcaactaaaagttatccccagggtttacaatgttatagcaacggaattcctagccactttttaaccgatattccgctctcaaaatcaatcaatcaaacaatcaaatcaattattagaaaaacaagaaatggactaaaactaaagatgaattatggggcgatttttttttttttcaatttgccgtaa

SEQ ID NO: 9671 - DNA, 201 bp, Candida albicans
caagccacaacaacttttgtcactttttacacgcccacatatatattaccttcatcagcagcagcaattcatcacacacacaaaactaatcttgttaataatttactctctcaatttatactatcacttggacttatcatttcaatttctttatctttatcttcatacatatccttgtgtttcattcaccacattaattaa

SEQ ID NO: 9672 - DNA, 195 bp, Candida albicans
tttttggaacgatatacactacccacacacacacacacacttataagcaataactttccaaagcctaacctatggcttatatatatctgtttagatggtattagtatttggtatattatatactttttgggttttgattctcttatttttctcttctgctggatttcaaaaatgcgtgattttaaatttaattaa

SEQ ID NO: 9673 - DNA, 195 bp, Candida albicans
tttcaacgtcatttgctttcattctatattgggggtcttctcctcctatttttgtgtcctcatcttatgttattattagagagaaagacaaccattgagtttatattgcatcacttgattttgattttccgtgatacaaaaaagggagcagatgcaaaccgtattgttttgtttatttgtataatatgttgctaa

SEQ ID NO: 9674 - DNA, 189 bp, Candida albicans
atctcatctgaccttctttattgtgattgcaaaattaataaagtttgcatgaaaaaaaaaaaaaatgaaaatcagaaaattcttagagaaggcgcagcacatttgatatttgtaaccgttacagtattatcatcaccaccaccaccatttattgttgtacatattgtctccgaaagctctaaaccttga

SEQ ID NO: 9675 - DNA, 252 bp, Candida albicans
caccaccctaagaaaaaaatctgtcacaacaccaatgattttattcacgcaatcttaatcagccatgaaaaatatgaaatgtttcaaatgtgttttaatgttttaaggaaagtatactgttacaatgaagttttctctttgcagtttcactattattattatttgagttctcggtttgtttattctattaataattttgtgccgcatctattgtttagacgagaagtcaatgttaggcattccattcaatga

SEQ ID NO: 9676 - DNA, 504 bp, Candida albicans
gtttcatgtgtttatcggtgttcatcctatgctatattcttcttgaggtttgtatttgggatgctttgttacattccattaaagatccaattgagcaacgatggctataagagttttaaagattactgttgtcacttgattaacggaagtattgctgatgcagttaggttgcaccataaaccaaagaaagtgttgttggagcaaggtatattatcggaagagagaattgctcaattgcctgtgttggaagatcgtccacctcgttataatgactactcaaaaactttttaccgtacagataccagtgccacattggaatcaaatattccattgaattatatgaaagatagatcaaattccaccaataattccagagacgattttggaggccacagtaaccaaaaagtatattcacccattaatgatcaaaataatggaattgggaaacgtctaagtcaattgagagagaatatattgtattgcccacggggcgagatccggtca

SEQ ID NO: 9677 - DNA, 264 bp, Candida albicans
attattggtgtatgtgttgatgttggctctgtttttttttttttgacaacaagatttctataccgtttggagtcgtgcattgctaaactactaaaagatgcaaagcttgttaaacttgttaaacctccacccatattggttattggattgacccataatatgaaagtaaaacaattatttgattttagatcttgttatttagatctcaaattgatacatatttacatgttttcagttaaaatatcaatatacaagcatatgtaa

SEQ ID NO: 9678 - DNA, 237 bp, Candida albicans
cattttaaatcttatccaactgctgttggggctgatgctaaagtggacctcaaaaaaaatcatgccgaatttcctgctcaacttgttccaaatattttaaaccttgtccaactcggtgccggtgctgaaatttctgcttctgctaaaagagaagataccgttgctgctcaaattggtgctaacatcttgaaccttatccaagccgctgttggtgctcaaaccactgttgacttgtaa

SEQ ID NO: 9679 - DNA, 597 bp, Candida albicans
tatcaattcaacacaatgaaattcactcaagtcttcactttaggattatttgctttatccacccaagccgctgctattccacaagaatcaaccaccgaagtcgacaaaagaatcgatgctgatgttgctgctcaacttgctcttaacattttgaaccttattcaacttggtattggagctaatgttaatgttactgctaaaagagacgaatccgctgttaccattgaacaatctaagagacttgatgctgatgttgctgctcaacttgccggtaacatcttgaaccttattcaacttggcgccggtgctgaaatttctgcttctaccaagagagatgaatctgctgttgataccgttgaagaatccaagagacttgatgctgatgttgctgcacaaattgctgctaacattttgaatcttattcaacttggtattggtgctgacgtaaacgtttcttgtaaaagagaagaatacgttgctgctcaaattggtgctaacattttaaatcttatccaactgctgttggggctgatgctaaagtggacctcaaaaaaaatcatgccgaatttcctgctcaacttgttccaaatattttaa

SEQ ID NO: 9680 - DNA, 237 bp, Candida albicans
gctgaccagatggtattttcgatatacgggtctagtggaccaattaaacaatatcatacagctcattcaagtccaataagaggcaactccttagtcactgaaagcatatatggcgtagaatcttcatcatcgaatttaccgcctgtcaaattaacaagccctggcagtaatcaagccaataaaatatcaaatccatttattgacagcagtaataacacttttgatggtacaccttaa

SEQ ID NO: 9681 - DNA, 549 bp, Candida albicans
cctacaaaagatttcattagaataataaatgaaaactgtctacctcgattatcaggatcattaccaccgactccatcaaaagtcaaaagaggtggacaattatatcgatcagatagtttacacgtaatacaaagttcacccccatcaataaataaagcagacaacaatgaaactggtattgaaatagaaaaagattttttaacttttgattatgaaaatcaagatgatatactaaaagctgaagaggtttaccgcaatttatacggaataagtcccaacgagagcacgagtagttcgaaaatgacaggaatatcactttgttcccgttctcttatagcttacaatttatttgcaacaccatgtcagaataacactgaagaatgtggagactcagatgataacctgctactactggaaatcctgaatcaaaagttaaagtcaaaacaatctcaatcgttgctgataataaaacttgacccacaaagtttgaacccgtcagataagaatgtaaatgtatctagtaaaccattgcggttatcaatttgtata

SEQ ID NO: 9682 - DNA, 183 bp, Candida albicans
tgggaggagaaaattaccaggggtgaacccaggcataattgttacgcgggtttgtggagggcatcatttgcatggcatttggcagacccggaattgttatctgataaattacttgcactttggagcaccgaaacattggtacctgataccacagagccagcaacgaagagttctacgcattga

SEQ ID NO: 9683 - DNA, 285 bp, Candida albicans; identical to SEQ ID NO: 7707

SEQ ID NO: 9684 - DNA, 414 bp, Candida albicans
tttttttccggaaatctaataatatcaatgaccagtaatctgccaccacttggttctacaactaacgatcagagactaccccaaagcggagtttcatccatacccacaaataaattgcctttacctaatgccaatgaagattttgccacgggtgtgtcgaatggagatgttgactggctatttcgaggtaaatcaaagaaattggggaaaaagatggctaacaacaatgccaataaggatgaacgaaagaatagtcatggtaacatcaaaaactcggaaaaaactaccgcaaaacccaatgaaactaaacatgagtctaatggtgagaagttagaattcaaagaaacaaaatcagaaaagccaacaaagcatacaacgactgggaacccaaaagcacctaccaatggacaaatc

SEQ ID NO: 9685 - DNA, 510 bp, Candida albicans
tacgagaacttgaatagcatgttgtggacaaacaaatttttacatctagagagggacgaagaagagaacaatttacacctacttaagatcataagtcatctccaacgtaatcatagtcatttgcagttcaacgcctacattcaaattacacagataatacctactaccatggctctaaagaagaatataaatactaaatcaactaataaatcatcttcatcaacatcaaagataaaaaagaaagcagccaacactacatcatcaaaattgaaatcaaaatcaaagtcaacgaaaataaaaatagataagttgaataatgatatttcacaattcacagaagtacagaatttgttagctactaatgataataaacaagcaccaaagaaaacaagagctttagattcaataaaagaggatttacaaaaggatgaagaattgaaaaagaaaaataaactagttgaaaacgatctcaataaacaattggaattattaacggagatggggctataa

SEQ ID NO: 9686 - DNA, 204 bp, Candida albicans
agaaaaatgtgtgctgtcatactttttttgcaacaaattatcgttgaaattgagagaaaaataaatcacacaaggaagctgacattggtgcaacagatccaacatcatcaacaaaaggaagaagctacagataagtattatgacaattttcctagaagtatgaaattaccggttgacaaatatggtagtttaatcccaggatag

SEQ ID NO: 9687 - DNA, 258 bp, Candida albicans
gaaacattcaaccctgattcgttattgtcaattttttttttatggcgttttttaataatattttactatgctaccccccgacaatacgttatgttattattattgaaaacatggtcattgaaatatgtgagtttgtttgaaaacgacaattataccccctttcaaactaaaaactatataaatatggtgagattggaagttattttccaaaattgcagttctttttttttttttggttttgaaacagtaaaaatttaa

SEQ ID NO: 9688 - DNA, 1371 bp, Candida albicans
tcacctattgtatcaactaaacaagttgtttgtttagttaataatattaaagtcgctactgttgattatgataccggtatttgtccatttcaacttccaacaaccctccatccatcatcttcatcttcccaatttatggttgatccatttttcacattccattctcgtgatgattataatgttcaattctattatgctataattaatagtcatagatatactactgatataaaacatggtggatcgataatttctattgctgcgaaattattatatgataaacatacaccaatatatcaagttcatttacataaaattcccaattcaaattcaactgaaatcattaggaaaagatggttatttgccaaaaataaacaaataaaactgctgctgctgtcaaaaattttgctgaagaaagatttggttgatgattttattattgatattgctggatctcgaggaattatgattgataaagtgattctttccgttgttgatgttgatcaaatgacttcttcaattgctactggatcatctaatagtcttactagaactggatttactaatccaagtatgatttcaacaaaaacttccaattctcaatcaatcactacaacaaccaccaaaggttcttctgctactactactacggccactgccactggtgctactgaaactatcaccactaccaagattatcacaattacttcttgcagtaatgatatttgtcatttaaccactgttcctgcaagtttgactactgttacaactaccggcacagtctataccacttatttacctataaattctgtggaaaccgttgtttcaacgaaaatcatcaccattacttcatgcagtaacaacaataacaataatcatgtttgtcatccaactactgttcttgctactccctccacaatgactaaaactattgataatacaataactgaatacattacttattgtcctttaactcaacaaccagaacaactgtcaacaattaatccatatactggtgcaagcgctaccagtgtcaccgcaacaattacatcatgttgggaagaaacttgtcaaacatatattacaactaccgctgctgctgctgctgctgttataattactcaaacagaaattaccacagttgagactgtgacacatgatacaactacttattatgttacttatacaattacatcacaaactagtaatcaagtacatactacaaagattaataatgagggtggtaatacgaatgagttgagttctagtttgcctgcaattacaactactgttgaaggtaggggtattagtaacaaaatagaaaatttgttatcgatgttgataatggttatggtgatgtggtttgtttag

SEQ ID NO: 9689 - DNA, 225 bp, Candida albicans
atgcaactggtgatgaaaaaaaaaaattttgacaacaccagtttagaaaggaaacaaagggaaaataaatataaggagaggcatacaacaaacaatactaaatcaacagaaaaaactgtctatggctgtcgtgggttgattgataatattttttttttactccttctgtttgctttcttcggcacactctcgttcgcggagtgcacaaaatcctcaatcaattaa

SEQ ID NO: 9690 - DNA, 252 bp, Candida albicans
actggtgttgtcaaaatttttttttttcatcaccagttgcatttaccacaatataattcttcaattcggaactacagtaatttagttttcaatgttgtcgtttcatttcaattgaattatatgccggcccggacaggtttttttttatgcaatctagaatctcatgatgtatttcattttcaattgaatcctttattcagaataagagaagggaaaatccaaaatgcttgcaattcaagtgaaaatatgtaa

SEQ ID NO: 9691 - DNA, 240 bp, Candida albicans
tcatgggattgtagaattcattctattgatgataatgatagaaaaatggggttcgaaaagaagaaatcccgatgtataattaaaattgtccaaattttaactttttttttttataacgggttgaaattattacaagttgtggaagtattttttgtttttgggggggaagaacaaccaaaggaagtctattcattatactggaataaagggggggggggggcgaataacaaacgaggttaa

SEQ ID NO: 9692 - DNA, 210 bp, Candida albicans
aacattgttaatcaaaatttatctatcttctactataatcacgttaccattgatttctattcatgtgtaagaataactcatttatccatccatttcctcgaaaccatttataaactagttaattacacaaaattaaatgcccgtcactccccccccccaaaaaaaaatgttactaccaataacgtagattatatctttttgttttggtaa

SEQ ID NO: 9693 - DNA, 204 bp, Candida albicans
  unsure (9),(54),(79),(111),(161),(162),(183): Identity of nucleotide sequences at the above locations are unknown.
caccctatnccattttatcttgtgtgttttgtccgtctaatttatgtttatttntcctgcctatatcgggaacattttnttttcgttttgggtttggcccctaccacaaantattccataattaatcccttaaaatttaattatccgaagtttaatattcnncacaccaaatttcctatcaanaatacaacagctattccttag

SEQ ID NO: 9694 - DNA, 903 bp, Candida albicans
ctccataatttacatatgattcaacaaagctcaaatatggccactacagctgttttcgaagaaactaatactgatttcgatacttcactcatggaattcttttattcaactacttcagaagacgctcttcccgacgttaatgacacctcttcaacaacaataacagaagttgcaaatgaaattccaagtttattctcatactccaataatgatttacacccggaacttgattatgaatcttcgagttggtacgatataactgaatcattgcctcaaaacatacccgacagtaaaagtgaaccaatagctacaaatcctacaaacgtgttgacttcaccattacaagcttttgcagattttaatcatggctcatcaacgggacttacaaccaagcaaccggaattatttcatcataataataatgcaattaatggttcgttcaaaaataatgactatacaactaataaaatcaataccaataccactaccacaacaacaaaacaacgcatttcaaagccttatgaaagatcccctctaatgaaaccatcagttacaattgcatctattgacacaatagctaaactcaaaactaaatccaagagcaattgcaaatcctcctcaatttcaaaacctaaagttagaaatccattttataaaccattcatatcatcatcaatatcatctgagacggcattaaaaaataccaaaataataaactttagagacgaaaacaatgataacagctcttcatttaacttcacggacattgataataaattaacatatgatttgtcaacagaaaccactaattcatcctttccacaaacggttttggaagcactgtttaagaattttgacgatgctttgattttcgattcattatttgatataaatcagatctaa

SEQ ID NO: 9695 - DNA, 480 bp, Candida albicans
aacacactaccattgatgttaattccttttatgcgaaagtcaaatttttattttcgctttttttttttattgtcttgtggcaattttataaaatttgttgttgctcttaaatttttccgttcgcaattaagcaaaagagaaggaaagaaggatgctatgcagcagcaacaacaacaaagagaaaaaaaaaccgtccatctttacccccataatacacacattttatacacagacgaagaacccccccaaaacaaaaagaggggaaatcggaacaacaaacaaaatactagaaagtatcgctcggcgcggtaccacacaatacaatacatgcgccatttaaacaaacattgttgtttagagaatttgggggaaagtagatgtgggcagattaagaatgaagcatttaattctttcttctattgtgagtcaataaataagcataaagaagtacccatttatgcaattccaagtcccaattaa

SEQ ID NO: 9696 - DNA, 264 bp, Candida albicans
aaaaaaagggattatctgctatggtttattaaagaaaagaaaaaagcagaaattatattaatagcaaagattaaagccaaacacttgaataaatatataaatcagattttagcaaatgcaaaggaatacttaaacgaaagtaacaccactccactatgtttattattgaatgttttttttttttccaatttcaaaacaactatgaaaatgaaaatgaaaaaaatctatcaaaataggtggaagaaaaaaaagcttaacaagtag

SEQ ID NO: 9697 - DNA, 213 bp, Candida albicans
atcatctgttcttctgtaagagttaccaagtctatcccaaagagtagtgaattgaccgtaattgtagttgaaatacaagtgatggacagtgtgacaagcggtaccattgacaactgggtcattagaccagtaactaccatcatgaatcatgacagtccaaaagttaacaaaagtgaacaaaaacaagtacaatactttatgcaatgggaataa

SEQ ID NO: 9698 - DNA, 183 bp, Candida albicans
aaaaatgttgaaattataattagaaagaaaaagtgttccaaaccttcaatgtacgtccacctatatacgcaaatggttaagcaatattatgatctgacaaataacaaataccatgtgaaaaatccatatatggagttgtgcttattttttttgtttagtaaaaatagaataccacttccataa

SEQ ID NO: 9699 - DNA, 216 bp, Candida albicans
ttgccatatgtgctgccgacacaaacaattgtgcaagatagtttttcgtttattgcgtcaatagatttggatttgggtgcgtcttttggcagctgtgagtatgtgtttgggctgagtattagaaacttgttaactgatgatgttgtacgtggaataaaagggtatagctccatacacttttctatagcaacatttatttcctgtaagttactttga

SEQ ID NO: 9700 - DNA, 234 bp, Candida albicans
aagatttgttggatctgtgttttgtattctagatcggttaaagatgtttggttaactagtggtagagcaagaattaaatttaacagtagctgtttaggtgttggtagtattcttgcgatatcggaatttgaaatggttgttccggataagattgcattgtttagtttggttaaattttgtggtacacaaatctctgggggcaagtgggtccaatatgtattagtcaattggtaa

SEQ ID NO: 9701 - DNA, 282 bp, Candida albicans
cggatacacaaccaaggaaaatacgtaaagtgtctactcaagagcaaattgaagattatgataaacttcgttcaagaatccaaaatcatttcaaacattcccttaaaggtaaaggatcctctatgctgttgccattatcttgatggaaataaccgatttattttaaaggagttccatcaccaaaaagttaaagatacaagagttcatttagaggattctgaaattttcaaagaagcatcggatttgtctgccttgaattcccctctatatagttttcgatga

SEQ ID NO: 9702 - DNA, 579 bp, Candida albicans
attggtcattcaatgggtggatttgtagctagaattgcggcttcaagacaacaacatgaaagtaatgttgatattattctgacattggcaacaccacattctgatccatttccttggttaccgaaaacatcagatttccctgatgaagtaggattaatatcaatttatctgctggttgatttgatggtacctccactggttgtaactccaaaaagtaaaagtgatcattttttcagtgttgatgcagcaaaattgttgggggtacctatagatcatcaaggaatagtatggtgtggtcaattgagagaaaaattatcagaagcattaattggaataagtggattaaatacattacaagatagaatgaaagtatttaaaaaaatattttctggagatagaaaagaattgggtccaacaccaatatttggattagcaaaattgaaattgaaattattacaaagttgggtacatttattaagtttaacaatatttgcattaaaatggacgataattgtattggcaataattcaattacgtaaagtatatacaaaatttaacaaccctccacccacacactag

SEQ ID NO: 9703 - DNA, 204 bp, Candida albicans
atatgtgtactgttgaggaaagttcgcctggtgtatttgaggttattaaatgtgaagatcatgaacatactcaagtggatcaatctaaagcccatattgcagcttttgaaaagaataagaagaaatagaataggtgggaatcattacgaagatcatgagcatttaagattaaaaaataaatccaattatagacaaaatatgtag

SEQ ID NO: 9704 - DNA, 207 bp, Candida albicans
ctgctgaacgtacgcactgagatttgctacgtcgtgacactagccaaatcacaaatagtttacttaaacaccaacaggctaagaggcatactatcatttgaagtaatgagtagatttagagttggcttacaaaatgaaagtatcatatttgcaacaatcaaattagttagttgttacgttatcaaacctcacgaaggagccaattga

SEQ ID NO: 9705 - DNA, 381 bp, Candida albicans
aatcaagtaatgtcaaatagcccaaatccgaacaatccaaacaatcataatctaaataaatctccaaataatttacccaataataaatttactaatatgctgttttcccaagttcaaacaactttacctcctcagtttaccgagtatccacaacaagctttcgtacaacaaacttatcaacaacaacagcaacaacaacatttgcaagctcaacaagcatttcaacaacaccaacaacttcaacttttgatgcaacaatcagggcaacatcaacatcaataccagccacagccacagcaacaacaacaacaacaacaacctttttctttccactcagcttaccagttctccaacaacaacaggtttatgcccaaccagtga

SEQ ID NO: 9706 - DNA, 195 bp, Candida albicans
ttcttggacatggaagcgttcacaagagtggcaagcggtgccacgataatggcagttattacaccagcccatgtagcatttgaaaacaacttgtataatgcagctaaacaaacagccaacttcaatggcgacgccaaatactcaccaagttgccagcaaaaccaaaaaataatatcaatgtccatagttatatga

SEQ ID NO: 9707 - DNA, 468 bp, Candida albicans
ttttggcaaaaaaattccttgcttacctatttaactagcacgcaattatcaattcgaattgtttttgaaatcagtatttgtaactttgataacgtttcggattgtgtccttattaatcaaagtgtttgtcacatgagatcgttaccacttccacgaatcactcgagcacgaaaatggaagagaatcaagagagcaatcaaaaacttattctccaaagggtatatttccgattatggtgtattttccagaatccaagcaaaccattattctatctccaaaattcgtcgactgaggttttctactcgattagttaaatcaagaaatgatttgaatatcgtaaaacgagcaaacagaggtttcaaactagcaaattatattagtcgtgctagtagaagagtttctgtgtctggcttaaaaagaggcttacgttcaccaaaatcaagaatggacttcaggatcaatttttag

SEQ ID NO: 9708 - DNA, 231 bp, Candida albicans
gagcagaatcaaggtggaatctgtcatgttgggaagatttcctttgttgcagtggctaattttattgatttggagtattggggtggacagcgcaacactgaatgtttagacaaattgcaaaaaccgtttgatccaagatcggagttctggttttgtatttatgatgacgagaactcgaggtgtgcgcttcaaaatgtggaacccatggcattgtttgagtttttgaactaa

SEQ ID NO: 9709 - DNA, 240 bp, Candida albicans
gctttccacactaatcaggaattagcattacctatattcacaacactttccctcaatgcaattcttgatagttataatctctcatgtcaatacttctgcaagaaattagacattggatttattcataatactttcccttactataaatccttcatcacgatacccttccacacaaatactttaaccaagactaagcatgaggtatattcacaacacatcatgctcacaatcacaaactaa

SEQ ID NO: 9710 - DNA, 213 bp, Candida albicans
aagggtgattatacggcgctatcacatcaattgaaacttataggtatcttatgtttgttaagttccgcctggctatcccaaccatctgtagaacaattaagagaatgtttttatgtgtacgtatattactggatcattaggctccctaaatcatttcaacagaaaaaagtgggtgtagacttgtacatacaaagcttatataatatcttatag

SEQ ID NO: 9711 - DNA, 240 bp, Candida albicans
aattttatcagggggatgacaatatcaaaattatcaaataaatcattaacttatcaagaaattttcattaattttatcaaattatttaaaagggcaaaaaatttccgtgattcaatcttatggaaattcttattaggaaaaattgttaaaattaaatatgataataatttaaaatttcattatttaatgttacctcaagaatatagtgaaacaattaatatttggaaatttgtcaaataa

SEQ ID NO: 9712 - DNA, 324 bp, Candida albicans
  unsure (5),(43): Identity of nucleotide sequences at the above locations are unknown.
atagngcgagctttggccttctacggcgcgttgacgacatctnatccagcttcaaaaatcggggtggtttttggtgctaatacgttattacataatattgttggagtagtggcaccagttatgattatgaatttttattctaaaactttgaaaaatggttggcctggtgcagtatttattttatattctttattggtgttgattattataatccttgttgttgttagtaaacgagtattgaaattaaatgtcaatactactgatgagagattaattagaagtaattcttcagtttcattatcaagatctaatgcagctttatag

SEQ ID NO: 9713 - DNA, 690 bp, Candida albicans
aatagttcaaatttggtgaacacatatatttttgaacaaatgtcaagatttaatggagacaaaaaagctcctcattggacagtaagtacaggtgtgtttgatgataaactgaaggaatggaaggacgaggaagaagaatgttttgtacagattaaagagattcctcaacgacgtccaaaaaagtaccgaccaagaaaaaaatatgtacgtccagcgccacccccacaaccacaaaaatgggcaagaccgaattattggagcttttcaagtgaagaagatagtttttccgattggtggtcaagtgactgtagtgagagcgattggtcgagtgatgatggggggaaattatggttcttgggaatgaatgttgctcaaggagaaccagaaacaaaacgaatttcaattattccttctaagaaactagttacaagagtaagtgagcaattttacaacacatacagaagtagctctcccaataatgtcatgaagaaacgaaatctcgatgatagtgatgacaagtattttggatttgattacgagattcaaccttgtataacaaataatcttctgagaaatcacgttacttttaatgtactaaattccagatctgctaaaattaaaatgctaagtaggtgcaaaataaagttattggtttgtttttttgcattacatattttgtttcattcttaa

SEQ ID NO: 9714 - DNA, 690 bp, Candida albicans
atgttaaaactatactttttgttttgtatttttagttttcatttagtcatagcaccgatcccttcaattaacaaacccaacagcacagattccattatcacgcgtccagttaatatcaataatcaacaagatttgcaagatttaacattttttagtcaggttgtcttatctactccaaattgggatcaaaccttaactaaatataaacgtaaaaagagagattacaatgatgattcgctagcactgatggacactcgaaatcttgataataacacgtttcttatgcaaggaggcaaagcaacaagtcccaaatggcatgttggggccggtgtctacttgaacaaagagcgattttcggatacaaaaaagacatacgttaagtatgagagtgattactgttcagaagaggattattctagtgatgagggtggtcgtaaacgaaaatggtttaaacctttttcaattgacttaaatgagaccaaagacatttccatcattcctagctcaagaatattatccgttgataccgaaggtaattttgttaatcataacaaaataacaaacttgacgcttggttatcattctgagaatgtgcagaaggatacatttgaatcttgtggaaattttaaagcgttccaattagtttatattgttgtcatcgtatttgcatactcttttttacacttttaa

SEQ ID NO: 9715 - DNA, 225 bp, Candida albicans
tatattcttcttgagtatcgtctacgacgtcttcttgttggtgtgacattttatcaaatagctggtacagcaaaagaaagtaaattagtaatctgggatgagcttccaaatttttttttctgggttgtaatgattgcggctcaggtagtgtcagctacaagttctgatatcacgccagtaattacccatataggcaagactagtatacaaaagatacctttctag

SEQ ID NO: 9716 - DNA, 183 bp, Candida albicans
agtgatagcaattcaaaaaaagaaacagatataagcaatttcaacaatttgaaaggagtaagaaaagagtgggaagatgaagttgagaagatcgttgttaatttcttgcttttttttttgacttgcttcaacaactattacactactactacactaattaacttaattaacttaattaattaa

SEQ ID NO: 9717 - DNA, 297 bp, Candida albicans
ttatactatacttctggaagggagctttttattttccttccaaataaaattccgccaacatattttgcattcactagcttattggctatttttcatatatttaaatttagtcgaaccccccctggctccctccctccacccacttttctatttttctttgttcacttcttcattttgtcacgttttttttattctaattttatatttattatttttcttcaattaattattgtagagtccttattagaaatggttttggttactcttgtaaaatggttgtcatacttctatggttga

SEQ ID NO: 9718 - DNA, 213 bp, Candida albicans
tatgacaacataataaccccagcaactacttctcctgccacccctgtagaaaaactcaaaaaatatagccatccagcagcaaatccaaatgcgtcgtctataaatcgtgatgaaagtcccgatacaccatcaatcactgaaacaaaagtaaccatttcacagaatgacattattgtacataaaaccaatgtccctactatagtgaaacgctaa

SEQ ID NO: 9719 - DNA, 195 bp, Candida albicans
attcgctgtttggaaggtaaacgagcagaattgcaagtttttgttaacaactatgaatcatcaaactttggaaatcaagattctttgaaagaaattaccaacaatggctataatttatcttgtcaaccaactccgtcggcaaattctttgggtgttgaaatgtcatcatcttctgatacgtttatttcccaataa

SEQ ID NO: 9720 - DNA, 183 bp, Candida albicans
acatgtcacaatgctcttttgagtgcattattcaaaaagtattggttaataatcctttgcaatcttagtctgaccaggtacagaaaatcaggtgggaaaaaaaaaatcatgcataacgcaataattgaatttttgattcggctaaattatactatcatcctgtgtggatatcccgggtattaa

SEQ ID NO: 9721 - DNA, 195 bp, Candida albicans
attcgttgctttcttcggagaattatttctcaaccaaaattatataaaaggattattctgacccgaacaatttgcaattcattttctctttatcattctaattgtcaacatcaacatcaacatcaacaacaacaacaacctcaacaagaagtagctaagacaatgtattcaccacgggggtcgaaggaccgcgtc

SEQ ID NO: 9722 - DNA, 699 bp, Candida albicans
ctgcggcggcgcgttgaaaaccaagaaggtctgcaccatgaaaagcaaaaggaacatgaaagaaagaaacaagaagatcatgaacgtgaaaaggaagatcatgaacatgaaaaagagaaggaacatgaaaaagagaaggaacatgaaaaagagaaagaacatgaaaaagagaaggaacatgaaaaggaaaaggaaaaagaccatggaaaggaaaaagaaaaggaaaaagaacatgaaaaggagaaagaacacggaaagggaaaggaccatggaaaggaaaaggaccatgagaaagaaaaggatcatgagaaagaaaaggatcatgagaaagaaaaggatcatgagaaagaaaaggatcatgagaaagaaaaggatcatgaaaaggaaaaggaaaaggatcatgacaaagagaaacctacagaccatggtaaaaagaaagaacatgatcgtttcaaatatgaagattgtgatgaattttttgaagaccataagaaaggtaaacatggtaatgataagcgtgaatccaaagacaacgatgatgatgaagtcactgcatcaattaaaattggtaaattgaaagggtttcttgaaaaaggtgataaaaataataaaaataatcacgaaaataaaacagttgaagaaattgattgcgaagatcaaaaagaaaataaacgggggttaaaacctgaattcgggtaa

SEQ ID NO: 9723 - DNA, 282 bp, Candida albicans
ttgttatttgattcaaaaaagattataaaaaataaaaaaaaggaaattattgatatatataagtttatacccagaaaaagatatggttttttttttaatttaatatatgttttctatgattttaaagatttgatacaagcactgatttgttgttactactacacggaatttgattgcaaaaaaccaaagacaaagaaagaaagaaagaaaaagaaggataatcaatattataataatggtatcaaaaaacctcaagtcttattaatatactttacctactaa

SEQ ID NO: 9724 - DNA, 225 bp, Candida albicans
gtggaccccaaagtggaacccaaaggtggtaaaggtggaaaaggtgggattgaaaaaccatatgaatctggatctgagtcggaatctgaatctgaatgtgaatgttttgaagaagaagagaaatttaaaaaaggtaaagatggtggtatcaaaggtggatatgcaagaggagatggtaaagatggaaatgcgagcaatcgcaaaagcaaaggtgggaagttttaa

SEQ ID NO: 9725 - DNA, 1650 bp, Candida albicans
accatgacccataagtggaccccaaagtggaacccaaaggtggtaaaggtggaaaaggtgggattgaaaaaccatatgaatctggatctgagtcggaatctgaatctgaatgtgaatgttttgaagaagaagagaaatttaaaaaaggtaaagatggtggtatcaaaggtggatatgcaagaggagatggtaaagatggaaatgcgagcaatcgcaaaagcaaaggtgggaagttttaatttagtatcacaaggaagtgataaacagcaagatgaattgacaattgcaaaattgaaagaaaataaagttgtaaaagaaaatgaactttttggaatgaatgatgagattgaagagttggaaaagcgtgcagggaagttttggaaatggaaaggtgggtctaaaaataaagaatattctggttttaaagaagaagattatattgaagaagacaaagtttctaaaaagaaggtgataaaggacaagttgattggtaaatttaaaaaacagggggataacgagtttggtttgtcggctgatgatgaccctgatgacagggatttggtggatgagttgttgctcagggtgtttaatctgttaaagggttcggggttcattaacgatattattaggatgtctttgactgatccacgtgtgagactgggaatgattgatatgactatacgattattgaatgcagaagtgattccatgggatgatatttttattgctttgaaacggcatggtttggctattgatgtgattaagtttacttttactgatgctcaaacaagagttggattggctgcatttgttattgaattgttgcctgctttggtgacttctggggctcttgacctaagacagattcttgaaacagttccaagacttcaagaggagctgattaaaatgtacaatggtggtaatcggacacataactcaaccgacccggctgacagtggaaacagaaatcatggatttgaagatagtgttggtagtataattgatagtgaaaatcaagctgaaagtggtatcaatgaacatgttatcccaaaaaagaattcatcgtcaataaacccaatttcaaaggaaactcctactccagatgtaccaaaagtgacaattccaagtgaaaagaatagctctgacaattacaatgatcaagtgaaaaatgatgggaaggaatcaaagtcatcgttgaatgataaagaaaaagaaaaaccaatgaacttacctgatgtccctttaattgataatccaaagaactgggatgataagacattggaagaaaaagtggaggaatataaaaaactaaaggagcagtatgatgaagcaaggaggaaactagtgactaatgaaaatctggatttgatacgagatcatacttatttcaataacccggaaaaattgaagaacattaaaccattgtttcccaagactggagtgaagtatactaacaatactagtaatggtactgttggcaatcatgctgctccttatccaagagtgagaatattttatgatggtacttttgttcccaattacccagttgattttaaacctcctattgctggtggtcctctgactaattttgaacctaattccaattcaattaaacctaatgctgaacctactgttggtgttgcaacataa

SEQ ID NO: 9726 - DNA, 216 bp, Candida albicans
tcttttttgaatcaaataacaactagagtatataaactttttaataaagaaaacaaaaatcaaacaaattatcacatacagcaaacaattgtcaatagcaaattttatgttgcaacaccaacagtaggttcagcattaggtttaattgaattggaattaggttcaaaattagtcagaggaccaccagcaataggaggtttaaaatcaactgggtaa

SEQ ID NO: 9727 - DNA, 438 bp, Candida albicans
aacagaaaatgcgatgcacgtaaaaatgaaataatagtagacaaagagggtgaggaatcacgcagagcacccgcagtatcgggaacaaggaacacacaagatagcaacaggagagcaagcacgaagctagaagatgacgtaggaaaaagacaggggaccaacagaattcaaagacaaacaaagccaggacgagaaggaccaggagagcacgacaaaagagatcaaggacaatacaaagagcaggatgataatacaccgaatcgaccaggaagagaaggcaggcaaaagactgaggaaaacgggaacagaaacaaagagcgagccgaaaaaagtacggaagaaaaaagaaggagaagagaaacagaaggcagcgagagaacacgcgaacagaaaaacccgagagaagacaacatacacataatgtgccaaacaccataa

SEQ ID NO: 9728 - DNA, 195 bp, Candida albicans
tcctgtattgtcgattgggtgcaaaatgacgccaagacaagaaaaaaaaagttgacatatttgacaaggggagatgctctcctaatgaagagaatattacatttctttgatgttatctatttgtgtagggctctaaagtggatgtcaacaaacaattctcttatctataaaaatggttttgagttttatatatga

SEQ ID NO: 9729 - DNA, 234 bp, Candida albicans
  unsure (120),(121),(122),(131): Identity of nucleotide sequences at the above locations are unknown.
taccaccacagtttaaaagtaataatcatttcaactcaatatcataagcagttttctagctacgcatatattggtaacccattcttattagcttcatctttcagaacgatgtctgttgtnnngggtcaggnggacattcccatcacaccaaatcttcttggtgacatgaattttactgatttagattatacacgtaattctgaaagcaaattgaaatctatccatgagccataa

SEQ ID NO: 9730 - DNA, 192 bp, Candida albicans
gatatttatgccactgaatatatttataccgatgacaatggtaaattaacaactaccactgttcttgccagtactgtcaccaatccggccgtgttacaaggaactacacctactactaagccatcagctgatccctcaagtagtgatgataacagcaacaaaccatcttcttcaacaacagcaacaagctga

SEQ ID NO: 9731 - DNA, 306 bp, Candida albicans
caactaccactgttcttgccagtactgtcaccaatccggccgtgttacaaggaactacacctactactaagccatcagctgatccctcaagtagtgatgataacagcaacaaaccatcttcttcaacaacagcaacaagctgataatagtgaatcctcaccaactggtttctttacagaaattaaagttgaagttccagaaggtgtttattccacttcaaccaaatatacccatacagtattggatgatggtcaaactgctgctcttgaattagtggtgttatatacagccttttgcgaagtgtaa

SEQ ID NO: 9732 - DNA, 222 bp, Candida albicans
cttcgatatctgctcaaattaattccattcaaccctaaatcaatgtttattcctaataacaacaagaaattaccaccaatgaaaaaattcaatggtgttgataatatttgtcctgatttaccttttgattttagtatggttatcgaaaaagaagtagtatttttcatttttaaacaaccactcaacggaattgcattcttgttaccgaaattaaaaccatag

SEQ ID NO: 9733 - DNA, 993 bp, Candida albicans
ggaaaaacttccaaccttgatgcagatctcaacaaagtgattacaaccactgcaaacacaaattcagatacacatagtatcaataagatttcgaataccattattcgtttcaatgaaactaattctacatttttcataattacagatcccaatggtgattttatatccgactccattgaattgattgaagttgattttggtgattataactatttatcatctaattataatgagtccaaattgataaataccaattctactaacgataatactatcaataacaaatttaatcccaataacaatgaaaccgatggcacttttagcaaaactatcaactatggttttaatttcggtaacaagaatgcaattccgttgagtggttgtttaaaaatgaaaaatactacttctttttcgataaccatactaaaatcaaaaggtaaatcaggacaaatattatcaacaccattgaattttttcattggtggtaatttcttgttgttattaggaataaacattgatttagggttgaatggaattaatttgagcagatatcgaagtcataccattacttgtcgtggtggtactgcttctgttgctgctgctggaattgactttggtgataaactcataaacaaacctgatagaatagaaggtgaaataatacaaatcttacaaccattcaataagaatattatatcattaccaaaatcaaaatatcgcttaattaaaattgaaaaaaaccttattcatcaacaaaatcttgccactaatttcaagaaacttcataaacatatatcatttaaaaagaacaagtcaacggccaaaagttttgttaagtatgaattcaattatgtaactccttggaagaaattgttcaccaatggatttaaaaaagatttaggaataattttgtaccttgatgacgatggtgctaacaataatattccttattgtgaatcaagacctgaatatttacaatgtaatgtgttttaa

SEQ ID NO: 9734 - DNA, 990 bp, Candida albicans
atgagttttttaaggagagataaatctaaagccaactttagagatggttcagctactggattagaggaaccagtttcccccaccactcatttttcacccaatgctccacctccactcgatggcaatcatggggatcattatcatgatccagactccccaagatcttctgttgtgtcattaccgcaactaattcataactcagctacccaccatttaaaagaaaattatcgcgggttccatgccaacaaacgaccaaaaggtattgccaatgttcctccattggctcaacctataaaaccacgatttaaaaagaagagcaattcattattgaataagctaatatattccacaaagaaagaagacgatgaaacagccacaagtgggaaagagtctcgatcgagctctatcatatcggatgaaaaacgcaaaagtgctagcctggcatcgtctggcagttcaagacaaaagtttagattttcttcatttgatagcaatttgtctacatcctctagttctcctcctaaagataaaaaagcactgatttccgacaccgtgtcggattcatcaacggttactgcatccatgtcaaatatgccaacgatatcgattgatcttaatctcgacgaaatgcacgacattatcaagtcacctgaaaccccagccccgactgttggcttaccaacccagaaagcagagaaaaaggcttcaccaacagccatcaaaaactggcaggcccctgaaagttgggatgtgaaggctcctattaaaaaggaagaacctcatgcacctaagattgaagaagttgcagagaatgatgtagcaatagataatgttttggaaaagaaaggattgccggtactatatggtactcaccaggtgccgcatgttacaaattcgaaagacataagttcaagtcacattattcgagtattcaaagaagattacactttcacgacaatcttatgtcccttgggaaacaaccaccagtga

SEQ ID NO: 9735 - DNA, 375 bp, Candida albicans
ggaacgttggggtgtaaaactttctttgcttttctacttgttctgtataatctttcggcggtacgtgtaaaaaagtcaaatttcaccgacaaccttaaaaaacgaattaataaaatattaatttattattatgatcaacacatttttaatctagtgccgattttttattataccaagaagaagaaaaaaaaaaatctcactcactcacgttcaaccttcaaccctcaatctatttttaccatccccctttttctgaactattttcaattcaatcattcatctttgaataatctttttattcttttctgcattattgttattgtttgttgcaattcaattcaattcaatttaaccattcattctcaatttaaatga

SEQ ID NO: 9736 - DNA, 195 bp, Candida albicans
aagacctttgaattatcagcatgcccagattttacatcttatgtgtgtagaatgtacaattttaataattggtctttgttaactgttagcaatgaacaaagcaaacgaaattctacaatctcatttcatacccagttgaacaattctaataaaatgaatctagtctttataccgcctcaaaatttgcataaataa

SEQ ID NO: 9737 - DNA, 189 bp, Candida albicans
aaaatttttctcccttcattccaatttattttcctttctttctttcaaaaggatacattctttcttatatctgatttacaattgaatatgactatacaggatcacaatacaatacatcccaatgttattcaagatgtgtctactgaagctcctggaattgttgctggtgaattaatctgcataacatga

SEQ ID NO: 9738 - DNA, 204 bp, Candida albicans
tgctttgaaaacttcatacatatggatcagtatcaacaccagaaacaacccattattgaaattgatgatcctaatggaagttatgccttacccaaaactcaattatacactgttgttttccagtttatccactggcatctttcttaccaactttggatggaaaccgtggttactacattaattaactttaattgcttcttgaat

SEQ ID NO: 9739 - DNA, 381 bp, Candida albicans
gaaaaagaagaaaaaaaacttcacctaaagaaaaaaaagattgtttcgcccaaatatttgttcattcttttcacgattatggaagaaggagaaggactttttgtacaaagtgatgaggaaagtgattatgatgaacccgcaactaaaagagtcaaaatagaagaagattctgatctcgaactaaatgagtctgattgggaagatgtatttcttgataatattgctgaccctgcaccatcggagttttcaatcacgatacaacagaatgatattgatcatcaaagaaaagaaaggataaaacaactaatcagagagaaacaaaaacgtgttagtattcattacttgagtatggtatccttatataatccatgcaaggtttag

SEQ ID NO: 9740 - DNA, 186 bp, Candida albicans
tatttttgcaattacgatttattgaaaatcattatcgaggctgggtttggtttgacttggcttagtgtgaatatggattataaaaatagaaaaacggggaccagccgcataaacttttatagtttaaaagggctgagagttattcgtttaaaatcttatattgcagcaatcttctttaaactttaa

SEQ ID NO: 9741 - DNA, 213 bp, Candida albicans
aatcttatattgcagcaatcttctttaaactttaatcttaaaaatcaaaatcaaaaaaaagaagcttattgtagagatcttcgttatggtatatggccttgggctgtgctgtgctatgttaagctaggctatgttgtgttgttgttggttcggaggcatgggggggggcgcgctcctccctcccccaaaaatgagaccgaaggaaattattaa

SEQ ID NO: 9742 - DNA, 183 bp, Candida albicans
gacaggacacaggtgcattataacgtgaccaggtttcggaaaaaaaagaaaatgtcaaaaaacggcaaggcagagaggcacacacaaaagcacacaaacccacaaagcccacacatcaccacacatacacgtcaaacgactactaaaaaaaaaaaagataacaaagcccaaaaaaaacaataa

SEQ ID NO: 9743 - DNA, 183 bp, Candida albicans
acagtttcatttttgcttgaaaaaaattatttgccttctttatttttctttattttcatttatttatttcatttttcatttttctatctaaccaaagggattattgttaaaataacaagttcatacatgtcatattatttattgacacataatcataaatcttaccttcaatcagtccattaa

SEQ ID NO: 9744 - DNA, 204 bp, Candida albicans
tttagacgctggtccgttaatctacctaagggtgaaattgcaagtgatattcataaatctacaatggaaatgtattttagagtaatgtgtttggcagaactagtcacacttggtattggtgtcatagtcgttacttggtttgttgtgtcagttgttgcaaattattgtctttctgaaaattggtttagttatagtaagagttga

SEQ ID NO: 9745 - DNA, 234 bp, Candida albicans
attcttagctttgatatccaaagtaaagtgacggcaatctggtcaaaaccagaacagcatctaccaaagctagcacctggaaccaaactcaagacatctattaatgcagcaccaattttggataagatagaaccatacgaccaaaacaacgaattgtcacggattgggaacagctggtatgaaaacattatccgcagtagattagccttgaccaatcttcagcaatttacctga

SEQ ID NO: 9746 - DNA, 228 bp, Candida albicans
tacctattattttctgcacttggagatatcatttttataaatatacagaatggttttgcctatataatatttagtaatttaaatctggctacattggcgctgagagatttgataaatcaagatttttttgacaaaccacttgtattaaattatgctgtcaaggaatgtaaaggtccttctttgttccacctcgagggtgtccggcaccgcgccaatttatgggggatg

SEQ ID NO: 9747 - DNA, 258 bp, Candida albicans
ttaccaacccacaccaaaaataattatccaggacaccaaccaaacatcgaatcaattcttcaaccatcaatgcgtgacggaatcataaaaggcagaccatttttcattttggctgatgaaatcaaagacgggacagcttactatacagtagtttacgggagcggtatgcatgaaactttttcagaagacagacttagaaagttatctcccgaagctattgggaatttcaaacaaagaagaattaatacaaacacttaa

SEQ ID NO: 9748 - DNA, 1056 bp, Candida albicans
gggaacaggaatggggaaaatttaaaagatggggaccacccaccggttaccatatccctcaaaaatttgaaatgtttatcaatcaaatcatacgattttgacagcattcatccttataacttagaattacccgctggattggaacgtttagagctaatgtatttaacctttagcgatggttatttccatttcggtgacaatttacgatatattggtatttatacaccaacactcacatttcatgaagattttcgacttccacaatcagctcaagaattcatattgaatgcggattgtttaacatttgacagactgtacttcttacacaagctaccagaaaatcttgttcgtttgcatttgattgctaataaactatgtgtgatgaggccaataacaaaaaaaattcaatggccctcaatgttgagtagtttatatctcaagggttttgctattaattctgggatactaaaacttttgaatctcagacaaacatgtcttgaagaaattactatctgtggagggtatgtacccatattgagtgaagaaatgtttccagttagtgttaaagaactaactttacaacgaatgggaatccgctccttgtcgtcttcttttaaaagtttaaaaaatctacaaaggctatcattgataagaaataatctcaaagatatatcttctgtcagattaccattggccacattaaaaagtttggatttaagttattctcatgttcctttgttaacaccattcttgattgcttttctgtccgagaagtataaaaatgctgaacttgaggtagacgctagagggaaccaggaaatagacattaacgatgtgctaatggcaatgcaagaatatagaaggctctcggtatgtctcagcatgattaatggtactaggacacaactacccatggatcctacgcgtttggagtttgtatatgagagttttgattcttatcatgaaagatatgaaaatagcgacaatgatccggatgatatggatagtgatgttgaggatgatgatgttgagaggagaagaatggggttacattaa

SEQ ID NO: 9749 - DNA, 201 bp, Candida albicans
tatatcaattgtttcataaactacggtgatactctacttattttgagaggggggggggggactaactctttgtctcatggtttggtcactttatgtggtttattcttccttttatttcccttcgtcgtacctgccttagaagttttcgttaccaacaaattattctttttggcactttcagccaatttccgctccacttga

SEQ ID NO: 9750 - DNA, 195 bp, Candida albicans
cgaatgaatataaaatacttgtattatgtagtgccaataaaagttgaaacggtcgcactactttttagtcctgttggtttgtgcactattttgtgtcagaaactgatctatgaaaatgatggttattatgagaatggaaaacttttccatcacacatcaggtgatgacagaactaaactatattgtatagtataa

SEQ ID NO: 9751 - DNA, 1065 bp, Candida albicans
gaagaaaaaaaagggagttacaacagaaagagattccgcttaatccatcatcaatcaccacaaatgatcacacgaaacatactacgactatcaatcaggaattggaattgtgcccgaccagtcactagctttctaccctgcagacgatttctcaacaccacactaccacgccaactccggggcaggagcaccattaaccaattgatccaatcaaacacacaactgaccatgttccccatccaacgcaataatcggttacccttacgtactatagtcatattaattgttgcgtctagctcactcacaatgttgttgtttgtggcagtgcagtataagaagtttcaggatgaattactaccggacgggaaatcaaggaaacgatcgatattcctcccactatggttcaatggcaatttattataccaaaccacatatggattcccacatggattaaaatactttgacccagagttttacgagtacatcatgactgaagtgcaacaattaaacaaggatggtgaaatacagggccaccatgacaactctgtaaagcaattttgccatgcattacaagagaagaatatcaagtatgccgtgttggaaggtttatcagccaatcgagaaattcgacaaatatttggtcttccattgaccgtggatacacatccaaatagtgatggcgagcttaagatatgggtggaatcaaaatatcccagtgtttccgggttgcaaattgacattacgaaaactgttgacactaatggtagcaacaacagtaaatttgatttccattggattgtgaaacccatcaatgcagtatcagtgatcaacagtgctatgacactgacaggtttgggtttagaccggttggagagttcagaagccaacatcaagacccatgaacaggggagtgggaaagtgcatgaagtaaagatggacaaggagaaagtgaacttgaacaaacaacgagactacgcaattcagttccatggtaaattacatggtgtcagacaagtcaatggtgagagttggatcttcaccccggccctggaaggaaccgcaatt

SEQ ID NO: 9752 - DNA, 240 bp, Candida albicans
tgtataactaagtattgttgtgctttttcgcagtcagcattatcgttgtggtacgagctgggtcagatgtcgcacactgagaaacacgcaaaaaagtataaaatagaattaagaagaaaaaaaagggagttacaacagaaagagattccgcttaatccatcatcaatcaccacaaatgatcacacgaaacatactacgactatcaatcaggaattggaattgtgcccgaccagtcactag

SEQ ID NO: 9753 - DNA, 189 bp, Candida albicans
cccttttcaattgatgcggaacaaagtcacgtccttttgcccagttctttaaaaaataaggaaacctgtatgggtaaaacaggatgtaagatagtgtttattgtttggatgtgtgcttcttggacttctagtcatatgggtcatatcaacgattgtccaatgtttatgtatgggggtcaagtgtattga

SEQ ID NO: 9754 - DNA, 237 bp, Candida albicans
aactggaatcatacatttaggctaattacgatccggaaagaaaatgccggatatgaaaagcagctagttatgaaaaacactgccctcttctggtttgatttgagaaatattgagagctgcttattcattgatttttttcaaaaacaaaacgtcttgaagaaagttttcaaaaaacacgaagtaatattttctgattatctcggacaaggggagcatcccatgtttgttgccctataa

SEQ ID NO: 9755 - DNA, 279 bp, Candida albicans
ccttataatatgttgttcttacttctaataataccattgacgattagctataatccattcaagaccaaatccataactcaagagagattattatgtaagaattgtagtagttatttccctaatcatccaccatggaatttatcatatgctccattcacagtgatttgtcctccaggtgaattaattcgaagcgccaataatgtacgcagcatattgttcaatagtaactcatatatagcagttgttatcttgtcttgtcttgtcttttttttttactaa

SEQ ID NO: 9756 - DNA, 369 bp, Candida albicans
atacaattaatgtctgaacaagaagaagaaacagccctgaagtcacaggaaattgagactccgtctgagtcaattgagaaaaatggacaaaaagaaaacaccaccacggataatactctgaatggaaataaaaaatccgatgattccttacagccagctacagaagaggaattgcaccaaccagaaaacgtagtacaggaaacaactaatattgaatatgtggtagaagatacagttcctacttcggatgacacagattcacctaaaaacaccgagaataataagcctaatactgagacggacaacgccttcaatgccaacattgagggaacaccaagaagtattaactcaccagaatcagatccctga

SEQ ID NO: 9757 - DNA, 189 bp, Candida albicans
aagatacagttcctacttcggatgacacagattcacctaaaaacaccgagaataataagcctaatactgagacggacaacgccttcaatgccaacattgagggaacaccaagaagtattaactcaccagaatcagatccctgacacagtaatcaatccagctgaggatgtatcggttcagagtacccca

SEQ ID NO: 9758 - DNA, 474 bp, Candida albicans
gtgaaaaccgaagtatgttacagtcttcttttgttggtttgtttatttgtttgtttttgtatactaacagaatttgaagctagaagatttcatgaatatcaaaaacggttggagtctaagaattcagcatatctacttgataagaattctacaaagttttatgaagagttgaggcaaagggatttggatgaggaaagaaagattaagctgcaagaagcaattgagcttcaaagattcaagcaattacgagagaggaagaaagcactgtccaaacagacgaaaaatatatctcttggaagtatcagtaagccagcgattctacctaggaagaacctacagaaggcaagagaaaacacattggaaaggcgattgcttgaacaatcttcaaccaaagacgataaggaggaagataacagcgatagtggcaaaaatggtatattgactggatatgaatctagtgaagatgaagattaa

SEQ ID NO: 9759 - DNA, 186 bp, Candida albicans
gtttttagtcaagttgatcacttgacaacaacaagaactcatacatgtaaactctctaataactttttggttgcttatttcgttgtttttgttttttttttggttaccccagaattaaaaaaaatggaacaaagaaagtcaaatccgtcgtcttacagacaacaagaaaaagagcttgtacgttag

SEQ ID NO: 9760 - DNA, 252 bp, Candida albicans
cacgttgataatcaagggaaagaaattgaacgaattaaaattgttgccaaaagaccaacttgtgttacaattggtagtgggattaaaaataatgaaatgtttgtaactacaggacatttgaaattggatgatgaaaaagctacaattgatgctacaaatttagatggtgatttagggggatttctttttaaattaaaagttgataaagatttaaatggacaaaagaagaatatttggggtggtaaagtttaa

SEQ ID NO: 9761 - DNA, 204 bp, Candida albicans
cccaactcgggatgggatgaaccaacaaaaattttgcatttacgcatgtttagggaagacaacgtggacactgtgggattgagagagaaaatcgactacaaaaagaataagaagagtttaaatggtgaagaaattttttttttctcatctctaatttgtgggacgaggagcaccaaaaaaatgagacaaactgatgaaatctaa

SEQ ID NO: 9762 - DNA, 252 bp, Candida albicans
aacagaaagggagtttcgttggaaaaagttttccagtgtcacgagaatcacggtgcacatgatcatgaagaaagtctacttgacattgaacatatcaaatcccgtttgcagaaactatctgttgaacaaatggatggcgtttcccaagatgtttatacagatgcagatgaaattcaccctggaacagaccagacacatgccttgaataacacgtttgacgaattttggaagaatctcttccgtttaacttga

SEQ ID NO: 9763 - DNA, 1014 bp, Candida albicans
gatatcaactgtaataaaaaaaaaagggaacacaactcaacaaataataatacacaagattccgatctatacgatttaccttttcctttaacttacatcatttataaatctatacttcagttcatgctttttcaagtattatttatttatttatttcattctgtctttcattcttttctacatttgtatgcttattttatatttgttttattattacaagttttttttcaactattactttcaaattcaaccattaaactactcaacaggcacgttatccccgctattaactcctccatttgcttcaagaaaatgtctgaatcatctacttcttctattatactacgatgctcagtacctgtgatatcatctgggttacaatcattatgtataacactacaaacaaaatcacatttattacacattcaatatcttcctttggattcaactattccaacaaatagcaacaccaacaataataccaacgatatagatgatcaacaacatgaacaagaacaaaatttacggcgtcaaatacatttaaatcatcaacaacaaaaatataaacgaaatatgtggcttttcgggtttttattatttattatagccaatgttttaggttcaattattcaaattagtactttaccattgattatactatctcctttacaaagtattggattaattttcaattccatattaagttgtttattattacctggcgatcatttcacaaataaattatgggttggtaccgggataatatctttaggagcaataattatagcttataatggtaatgtcaattcaactccatcaaattcacctttaaaaccattgccacctattgaggaacgatttcatttaatcttacaaaaattgattaatccaagttttgtcatttggtttattggaacgtttaccatgatgtggggattattacttgtgaattatatctatttgaataagaaaatccgacaattacaaactcgacaaccattttcaataataact

SEQ ID NO: 9764 - DNA, 198 bp, Candida albicans
atgtgtaataaatgtgattttgtttgtagtgttatacataatgattgtaacccagatgatatcacaggtactgagcatcgtagtataatagaagaagtagatgattcagacattttcttgaagcaaatggaggagttaatagcggggataacgtgcctgttgagtagtttaatggttgaatttgaaagtaatagttga

SEQ ID NO: 9765 - DNA, 243 bp, Candida albicans
cttagcataaaaaatataacgtggtttttaaatgagatcactcacttatttgatgttatacttccattgttgtttccattaaaagcaaaattagtatgtcacgtggacacagtactgattggtagcagcattgaaactcgctctgttttttacacaatacacgactttgttcttcatcatttttttaaaacacaatttgattttgttttggtgggtggtgttgccaaaacttcaatcgtctaa

SEQ ID NO: 9766 - DNA, 333 bp, Candida albicans
cactatagctattacaaactcactactctaatcatggaacaagaattaactcaaattataaacttattaacatcaaatgaactaccgacgacattaactggattggaacaaacccataaattgttgatgagtttattaccatcgattaaacagtatcaaaatttattaacgaataccaataatagtgcattaatgtataatcaacgtcatataaagcaaaatcgagatttacaacaattgatacaatttcaaattttacaagataatttccaatataatgtactacaatatctattaccaattattcagcacgcggctggaaggaaccgaact

SEQ ID NO: 9767 - DNA, 255 bp, Candida albicans
aaaccaagttgcttatacttaatattgttgtttgaatcaaaaaaaaatacaagcagagattttgatatcatatcatcatcatcatcatcatcatttggggaaatagattggaagttgattgtttatgatcttaaccaatttggcaaccctaatgaaagaattgtaatgttttttggtaacttttacacgcctcaaactaactattcatttgacacacaaaaagaaaaactcaaaccaacgaagaatgtggaataa

SEQ ID NO: 9768 - DNA, 273 bp, Candida albicans
aatcaatttaggagagaattaacattagatcaaaaaattgaaattcaaaaacacatacgaaataaattgagaccaagatataaacctaatgagatcaatactactgttagaaatggtgaatttatcacaagtgaagaagattatattaagatcaataaaacaatatcaaggaaaatctataattatatattaaaacaaaaattgggtgaaattgatgaatttttcacaaatgaagacaaactacgaaatttaattgataagtatatagaataa

SEQ ID NO: 9769 - DNA, 1074 bp, Candida albicans
agttgtgagatgggattatttgatttgttaccattcccaagaggaggaggtgtggcagatagtacaactaccacaattccaacatatgattcaactaaagattctataaatttacaagtcaaatcattattatatctattcaaaagattaaaaatttaccaattagcatcatttttaaaccgtgacaataattatgaattgaaatatatcggaaatacaactattgacaacaccaatcctatacatataaaattggacaaaatttataatttggaaagatttttacaaattttaatttatgaagatgaatataaaatattagttgattttacaaaaaataaatttcgatctttatgttttatgacagaatatccttatggtaaagtcttggtgtcaatggcgactggtagtttcccacaatttattgatgaggatgaagatggtgatagtttcgaaaatttcaaatttattttattcccattgaaaaatgttacaattgaacaaatgggacgattgttaaccaaatcggatatttatattgaacataaaaatgtttcaactctgaaacgatacatgattgccatagaatcaattaatgaagtgttagggtttgatggtaataaatctgatattaccatattcgatatcaccataactcaaaaaaaccaaataataaaacaatatttaatcaaattggcaattcaagttcaattgacaagaatatatcaagaatatataaaacaacatccaatagtaataacaggagatcctttcgtgactcctccatcttcaccaactaaaaaacaaagtattctgtcaatttcaccaatgaaaaaaattcgtacattaagaaaatcaatgtcaaatttaaccctcaatggtaatactagtggtgttaattataataaggcaccttcagtaccttcagtaccttcatcaccaacaagattaaggccccaaaaatcaatgagtaaattgaacagtaaaccatcaatactgaaaatgaaattggaagaattatataatcctgtggcatcacctcgtgggatcttcaccacggggctggaaggaacc

SEQ ID NO: 9770 - DNA, 258 bp, Candida albicans
aactggaattatcaggcgtttatatgcatgttctattgtttttgctttgaaaggagtaaagatggaggaagagatattctgtatgcacaattttttaatgttgataagaggataaaaatgaatcttcaagaatttaaacaaggggtgcaaaataaccccatcgattctttgttttgttgtggcgatgctactgataagatggcaaaaagttacatcatcgaagataagatcgaatgtgtggttctatgcacgtcctaa

SEQ ID NO: 9771 - DNA, 186 bp, Candida albicans
aaattagacgattttgcaatgtgctttattgttaatttagatagaacaatagaaatagatggactagacggtgggatttcttatcactatcaccaggtaatacagaaatatcttgtgatttctaagtattttttgaaggagaacaatagtattgggaaagaggaaagaaagaaaaaaataaaataa

SEQ ID NO: 9772 - DNA, 195 bp, Candida albicans
  unsure (187): Identity of nucleotide sequences at the above locations are unknown.
ataaagtcatcacatgtaatgcattatctgatttcatctgaaaaatttaactcctatttgaaagcaaccaaaagtgttgcaaaatgtttaattacaatcgccaggctacattcagatcgaaaacaaatgctatcttcgatcttagttgtcaagatgatgatgttcacaccttggggtcaacattctntactctaa

SEQ ID NO: 9773 - DNA, 240 bp, Candida albicans
  unsure (57),(62),(193): Identity of nucleotide sequences at the above locations are unknown.
ctaagtatgattgtaatcatgcaaaaaccgaagaacccaagtttggactctgtagtnactantggtttggtcaaactaaaattgctctattgttacaccgaatcaatggttctttctcgcagccctgactggtctaaaaagactaactctaaaattaattctattggctgggttcctaacgttaaaagaccanaacttttactttctctttcaactctgaacgtaatgttaaccttttaa

SEQ ID NO: 9774 - DNA, 231 bp, Candida albicans
aggatgccaatgtatgtatatgtatatgtattcgtatttgttgctttttttttctgcatttaccgttctcttgatgagcattatgcatgttcagaaccgcctctttctgaattgaatccagtattgtataattacaagaaccgtaaccatactggatgtaatgacaaagaagcagaagccaagagactcaatttaggaaaacctataacacaaagtagaaactcagtttga

SEQ ID NO: 9775 - DNA, 243 bp, Candida albicans
gtcgtgtgcagaagtcaattgttcgtgattcctttacgccgaaaacttgtgttccatttctttactcatgaatcatccccggaaatttggttagcaatgagtcacatatgtgtagttgaaaacatgcatggtcaaagcataattatcaggaaatttgtaaaatccagtaaaaaaaagaaattagaaaatacaaaatttggttctgcagattttaatgataacccaatatccagtttcacctaa

SEQ ID NO: 9776 - DNA, 192 bp, Candida albicans
tcaacccaagttagatttccctttaaggttaacttggcaatatttcaggttggtaaaaatgtgcttagaatgtctaagaaaagaaataggggcaatgatggggagaaggagaggggggggagagttcacaaatgtgagacccatcacgtatcatctatgtattcaattatggtattttgtgatatcttgtag

SEQ ID NO: 9777 - DNA, 1263 bp, Candida albicans
tgtgaccaagttcgtcccaaatgtgagtattgcgcccataccaatagagaatgtatctatccaagtgatatccccacatcagaaactaatgcagaaaaagactcccccgttgaagacattaggcgagacctaccactaacacaactaacgagtgtgctttcagtatctcaactagaactacgggctttaaagttcttcaatgatataggtaaattgatcgtttcttacaaaaaccagagatacatagataactgggaagctgtcattaacccactactgttccagtcgcctatagttaaaaaaacattattggccacatcatcaatgttgctactgcattttatgaatataaatactgttgattccaaggtattgaccagctcattttccgtcgattcaagtcaagaagcacaggctttttttcaaacaggaacaaaatatctacaggaactgattgacgagagaaagcatttgttacaggataattcaggttttggaattgagagaataattgtaaatgacttgattacttttggttgccttttaatttacaatcacaaacttgtaccgttgatttcagccactggatacgatgtgatttcgatggcaaaggcatacagtgataccagaaaaatgtactctcagctgatgacaggattacgattggagtctttgtttttccccaaatcgaaccccatattgacgtgcccaccagagaccaattattggtttacacgagtgttggaacttgaaatagtggcgtttgtatcgaaaaatgggaacaaatccgctaatatggaagagtatttccaagcacttatggacacatttttactactaaaagatgcctgttatgctatggctatagtgagattcccgtttcctttaattgcatgtctcacaaattttagtgacaagtatagacaattgcttcgtaatggagatgaatttgcatttagactattatttatttactcatgcctctgcgtgatttcccgaatacctttaaacagaaatgataatatttttgtcgattacatatcagaattcaagaatatcatttttagtaaatatggagagtttagttaccctattgatagagaattatatcatttggttatacgaactaattttgttgtcgactttggtgatatgacacgatttcatccattacagcaatgcgagccacttatggatctaagctggttagagcggtacatcgatagtttagaaaagaccaacactttactacaatgcatatga

SEQ ID NO: 9778 - DNA, 225 bp, Candida albicans
aaaatatttaggaacccacccatccactcacccccttcaaaaatagatcaacaagcaagcaagcacaaggttaatggattattattattattattttatgtttttcaccctgtagatcttttctcaattaataatgttcctaggtttcttgtttgcatcgtcaatgcaaaagtgtttatccacaaaatgaatacaacccatagtattgatattatcccaacatga

SEQ ID NO: 9779 - DNA, 369 bp, Candida albicans
gaatcgaaatggaaaaaaaaattcttttcgacaatcaaaaaccttcttaccaaagctataatatacaacaattatttacccatgatgcctaaagtgacgagcatagagaagtttatagagttatcaaccgacttgttagcaaactatccaacaacaacaactttatcaaccacatataccaatgtatctaaaaaatctaaaaaatcaacttcagaatcagcagccacatccaaaccaaaatcaaacaaaatttcaactcatgctgtaagtttcaaactttatgaacctaattctgggaaatgtataagatacaccacaaccaaatgtaaagaattgtcacgattagtacattcattgtcccattattaa

SEQ ID NO: 9780 - DNA, 204 bp, Candida albicans
aaactatcaacctcttcgaaaaaaaagaaactccatcaaacctcttacaccatggtcagttcttcatcatactattggtgttcgtctgccagcgtgcgtgaaacagttatcttgaatgtcacaggtaccagttcactcagtatactaaatgcactgaatgtatctctgttttataggatgatacacagaaatttaaatatctga

SEQ ID NO: 9781 - DNA, 189 bp, Candida albicans
tatactgtcaatggttttagtgaactggtacttaaagaagtagttgatttaggggaaatgattgaagaagaaaaagatgcagatggtttgaatgatttgattattgatctcaacatagtgattggggcaagtgttataaagaaattaaaattgataattggaggcagacaagaaagaaagaaggaatag

SEQ ID NO: 9782 - DNA, 345 bp, Candida albicans
taccaagatcagccaataaggattattgaagaattatcaaatatgatacttgatcgatattcaattagtatttctcgagaaacaaaactttgtgaattgatgttttatgatactgattggttgaatattggtattaataaaaaagaggtcccatcatacactattgatgcattacggaaattgataatttctgatagcagtactagtactagtttggcaaagggagagaaattacgagtgtgtactcgatgtcgagcagtttcacttgtgggagatgtcacaggcttatggactatggtgtttcagcgtacttgtatgtgtggcaatgcatgggtaaatgtataa

SEQ ID NO: 9783 - DNA, 558 bp, Candida albicans
ataaaccttatcatgattgcaaaaaaaaaaagaacttcaatttgtttttcaatttctttccatcaattccttaataagttatataactattccttctttctttcttgtctgcctccaattatcaattttaatttctttataacacttgccccaatcactatgttgagatcaataatcaaatcattcaaaccatctgcatctttttcttcttcaatcatttcccctaaatcaactacttctttaagtaccagttcactaaaaccattgacagtatatcataattcaaacttgttagtgtcacatcagttagttgctaaattgaataatttcaattcaaccacagattctccaactaataataaaataacattcaatttgaaaactaatgaacagttatcggaatccgattataaatttataattgatgaatgcttatatattcatcccgataataaatcactattgttgcaaatattccataataaatatcatatggataaaaaaaaattgattaaagattttactttacatgattcaatctttgaatacacaatttga

SEQ ID NO: 9784 - DNA, 261 bp, Candida albicans
ttggtgtatgaaagagtgatgtggctgtgttcagtgggtgcaatgagtcaaagagtttgtcgcgatgtcaggggggggggcacacttctcggcccatctcatctcttagttcccctctcgttccttctagactcattggctcgaaggaagcaagcaaaaaaaaaaaacctaaccgaagtcaaaaacaaaatggccagtgaaaatattttaaagggaggggaggggagagagaaacagaaagaaaaaggaggagattcttag

SEQ ID NO: 9785 - DNA, 282 bp, Candida albicans
atacacaatttgattaataataataagagctatcctttgattattgattataatcattgtttgattgctaatgatgatgcttcatttgatagaataatgatgaattatttaacctgtggtatacaaaataccaccagtagtaattctacagctgcaagtcatggttttacaaccaatggtagtagtagcagtagtggtaatggcggtaataatagtactggtactgttaaatataacgatttggttcatcctcatatggctgaatttgctgatttgttttaa

SEQ ID NO: 9786 - DNA, 189 bp, Candida albicans
gaaaatgatagtacagattatgctagatgcgattcttgcacggctaatgagaatatcaagattggcttaaatgagtctgacgttagtgtaggtatagtctggttacttagcaggtgtgagaggagacagtcttcagtagtttactgtgacaatgtagcgctatttgatttaaatgattatcatatgtag

SEQ ID NO: 9787 - DNA, 213 bp, Candida albicans
ttcttacaatcgactatatctacaactaacttactctttatccactattactctttaccaatagaacaagcactggaacttcctcttatgaagcgttttatcatcttctatcgaacagtagattctttggcttatttctttacatttagtcgtgtatctccaccgaataatcatttcgtggttgcattttatatgatgaagaagagaacgtaa

SEQ ID NO: 9788 - DNA, 279 bp, Candida albicans
ataaaatatgtcaaaaacacactactaaattgcaaccacaacacgaagaaagataagaccaaattagtggattttaaaaataatacaattgatattattatacgttacattttactttctctttctcttttatatattttagataactttactttttatttggtatatcatttaatactaattttaacttcattgatacaaaaaaaaaattttccatttcgtagttaccgttacaattcaactttgtttgtcgtagttgagaacaatagtttttcttaa

SEQ ID NO: 9789 - DNA, 243 bp, Candida albicans
ggtagcgtgcaaaccgttgctgaaactgcttttgctgcttatgctggtgaatgtcaaggctctggtgcaatctctggtggatcaggttccggttccggttccggatctggatctggatctggtactagtacaattacaactggtggttcctctagtggaggatcttccggtggttcatcccatggttcatcagctggtccatgtaaaaagagaagaagaagaagaagaagatccaactattaa

SEQ ID NO: 9790 - DNA, 183 bp, Candida albicans
ttggatcttcttcttcttcttcttctctttttacatggaccagctgatgaaccatgggatgaaccaccggaagatcctccactagaggaaccaccagttgtaattgtactagtaccagatccagatccagatccggaaccggaaccggaacctgatccaccagagattgcaccagagccttga

SEQ ID NO: 9791 - DNA, 243 bp, Candida albicans
caatacaaaaagagaaaaaattcattgactaaaactttatcaattttgtgtaaagtggagaaatgtggaaaaaaaagaagtggaaaaagaaacccagttgtaaactacatctgtatagaagtgtcacacataaacccaaaccagagaaataccacgggaggcaaagtggattctatttattgtaaatatgataaatatcttgaagaatatgcaagaggagttgacatttttggtatatattaa

SEQ ID NO: 9792 - DNA, 198 bp, Candida albicans
gtcatgtctgccataattcgtcaagccataagaccagctttgagatcagtgtcttccaagagaattgccgtcactgccttacgttataactccactgccgcagaaccagccaaagctccagtcgacgctaagattactaccatagtgggatcaaatttcaactttgactcttttagaaacctcacaattaatcaatga

SEQ ID NO: 9793 - DNA, 198 bp, Candida albicans
ttaaagtgtcataagaatggcgttccaatcaatacatattgtatgattttacaccctatctacatacaaaaattcgtaacgatattttcaaaaacagagacatttgcttatgcatctgagaatactatcaatatttcatacttacccataattcaagccttgagtgaattagatttgtcaagctataatagtagatga

SEQ ID NO: 9794 - DNA, 441 bp, Candida albicans
aaaattatgaatttgacatctatgtgttcaagcatttccattgttagcgactacctgttgccaaccacactgcttagtacttgcaacccccattgctattctttttccatcatcaaagctgattctcaaatacatgatgggaattttgtgaatataaattatctgtgtatgtgtgaaaacacggagatttggcaccattatgaaaattgcaactgttacgatactgatgttaaagaagtatcttcatatgtatgcaattttgcagaaacagcattgtatcttagtggtgattactatgagacgttccttgcaagcaacactgaagatgagtatcaaagtgtatcagaatcaaatgagtatttagatagaatgaaagattatatcactgctggactggtgtcgagaacaacaacctcaaaatttcccagtagcttcttgtga

SEQ ID NO: 9795 - DNA, 198 bp, Candida albicans
aaatcagctaaatgtgccgacattgatgctgatgtcgatttgttaatcgaaaaattcgacgatgtcaaattaggtgaagttgctgataaagttaaagatgctgatgctgcttcagtgaaatctacttttgttgaagttgcaaaggaattggttggagctggttctttagatgcttcctatttgaaatattttaactag

SEQ ID NO: 9796 - DNA, 225 bp, Candida albicans
ttccaattggataaagaaaaggaattagaacaggcattcaaaaaagctttagaaaatcccagaaaaccaaaacctatagaagataagaccactagtggatttttggatatatttggtggaggtggtggtgccggtgttagacagagcattcacattgacagaaattcagatcccaaattgaatgtttggcaagccattaaagatgtttttagtttagggaagtag

SEQ ID NO: 9797 - DNA, 186 bp, Candida albicans
atgtttcataatcagttcgttttgtgtgtacgttatcgaacaaaaaaattagaggcaagtgagaaaccagtagggctaaaaaaaaatctatttttttatttcggacgcgtcgcatccattttagacgtggaaagaaaaaaaaagaaaaaactaagactaaacagtaataataataactaccactag

SEQ ID NO: 9798 - DNA, 216 bp, Candida albicans
ctcacctacccaccactctccccttgttgttattgttcttcatgcataaaaaatagactgacgcgtcatcaaatgaattataattacttattcatagtactaaacttattctatatttggaacttcgtatacttaaacaagaaagtcaaatctggtaaagtgcaccaccactattatgttaaacattttgtgagagttaattacagaaacaattag

SEQ ID NO: 9799 - DNA, 189 bp, Candida albicans
aggcaagaaaaaacgcaaaaacgcaaaaacaatgaagaatctaaacttcaaaacaaaggcagttcattgcatcgtaacttaaaatatgaaataattgtaattactctaattgtttctgtaattaactctcacaaaatgtttaacataatagtggtggtgcactttaccagatttgactttcttgtttaa

SEQ ID NO: 9800 - DNA, 246 bp, Candida albicans
aagtggagacagaatatcaattataactcattttacaattgtattaaaaagccccaccaaacctcggttacggaaagggggggccaacctttaattttttctattctcgattccaagattcaaaatttggatgcaattttacttatacaccatgtgggtgggttaagtatagatttacagatgattctatttcataaaataatatctcaattttcattcttcttttttttttatttttttacttga

SEQ ID NO: 9801 - DNA, 243 bp, Candida albicans
gtaaggatttgggcggacttgctaggagtttattctattattgttttcttgaaggtacattcttattactatgtgccaatttctagatgtaatgttaatcttataaagattacctcttcttctcctcccttccatttctctcatcgttgttgctgcaatgtactcgcctcaactcaaaaaaaaaggaaaacgttttcattccctaaaaacctaaaaaaaagaattttctctcctattttttaa

SEQ ID NO: 9802 - DNA, 204 bp, Candida albicans
ctaattatatgggaccaaacttttttttttcttgtcatatcatcagacgaagtttgtaataaaccaaaaggcgggagagatggcgatgttttaagattgagaaaaaaaaaaaattttcatttattcattttgcaacttgttttgcaaaaaaaaaaaaatttttttgctttttccaattattctagaattctcaattctacatga

SEQ ID NO: 9803 - DNA, 549 bp, Candida albicans
atcatagttataaagactttctctacaaaacaaaattcaaattactcaacaatgaagttcattattatattatttaccttaattctgattgttacagctgctcaaagaatctacaacaaagattacctgtactatggttgtaattcatactgtgataaagccctggatcaagaagatgcatgtggctactatgatgacgatgtttcataccaagactattatggttgtttatgtggaaatgaaatttttttgagcaatttgaaaagctgtgattgttttaccagtatcattgcttctgtatcaaaatcagtttgttcaaaggcaactgaagattcggattggggatattatgatgatagtactctgtcaatcatggactttttcactgctgacaatacaccagcatctaacactggcatgactacacaaactgatggtgctattaatgataaccaaaataccggctctaaaacaagttcaggagctgctaattatttaacaagtttcagtattggtacattttttgtttttgttttaggtttaatttga

SEQ ID NO: 9804 - DNA, 1596 bp, Candida albicans
  unsure (1573): Identity of nucleotide sequences at the above locations are unknown.
attggaattaggtgggggaaaattttaggaacaactgccagcgtcaaacattacgattcagttagtgtaggccattcgaataattcatcttgggataatagaaatgtatctgatctgcgtcgatttgtacgcgatgaatctgtatcgtcaagttctcgaagtgagaggaatgtaccaagatcgagaaatttgcaacactcattgtcgagtcctctcacagtgggcaataatgattcaccaaattcaacaaataattcatctgctggtaatactccttccttgttatatgacaacacaccactattggatgtgctaaagcaaagagaattgagcaaccgttctggaaacagttcgccaacctccttgtatgatagcagcaattcgaatagtatttctcagttgggtgcaccagtaaagccaacattaagagatatatctcgttcgtcagaaatgtctagtgaagaagaaattttcaagactccagttagttcacctgatcaagagctgttcaaagaacccaaagatacaccaaagttagcaccaccatcaccaacgtcgttaaagactgctactccaattgttacaccaccaaacaagatcaatgctttccggccgcctcgaattagtgctggatcgatattagattacaagagactgaatacagacactagtatcagtacaagcactaactccagtagtagtggtgggactagtaatcgaaaaagtcaaataagtttgttaccagagccaacaatagataccgaatcatttgttgaacaatatttccatgattcatcgcctgaactgtaccagttgagtgaaatcatttcgaatttaaattctactccaaccaagactcatcatcagcaacaacaagaacaattagacaaagaccaaattgaacaagaacaaaaagaatactcacgattaatcaatgaaaaacgtcaactgttgcgttctagtagtgctggagctcctgttaaggaacatattatccaggttagtgaagatcaagcaataaagtttattccctcaccaacagattctataacctccacaccaagaagttcacgatactatgatataagctccagcactttcaacaagtttttgaatgataaacaagtggatataccaccaagaggtgatgtcatgattgtcaataataataaaatcagaaagcatcatcgtaacgcctcatctacatcgtcagctggtgatttttttaatccgcaaaagaagacaccagttaatgcatctgcagatccagcaccgcccataacaccaaagagaagtcctatacaagaagtaacgacacctcaaatcacaggtgattctccgccacctccaccaccaattgaaaagtcacctggaatgagagtgaaggggagaccaaagaagaaaagatccaagaaacacggagataaaaaatcagatacagatggtaaagatgaatcgcattcaagtctgaaacacaaaccttctgaaaaggtttctggtaatgctatcggcaagaagaaggaagttgaagagttcactattccaatagcgattcaaacgccaccctataaanagcttccacaacaaccattccta

SEQ ID NO: 9805 - DNA, 240 bp, Candida albicans
gtgacacctgtatttttcaacgataaactgccatatcggggcttacgtgttgttgttttatataacactagcactccacaaatgatatttgctgtggcaaaaagtgccaatgcatgcactaggaaacatgggttgaatgcattatcattgtggggggccattggtcgtagtagtgcgtcgattccacatgatagttttgggtacctgggatccattactgaaaagatattgaaaagataa

SEQ ID NO: 9806 - DNA, 243 bp, Candida albicans
aataaaaagtatttcattttagaccaagatgaattttgttttcaattcttaataaatccccatattcacattagagaatcaattcaactttatttaacagtgttcaataaaccaaacaactacacgagtttttttgtttttcttatttttccgacaaccttctttttttttttcactttcttcacaaataaaaaaaaaagaagacaacacctgctaatagttgtttctagagttagggtttaa

SEQ ID NO: 9807 - DNA, 198 bp, Candida albicans
aaacaagtttataattcaatcaatctacctactaatcaactgaacaatctcctatacaactactttattgaaatcaacttaaagacttttcttttgtggcgacgagaggggactccctttggatgcaattttttttctttctctctctctcttttgcgatttgcagggcagaaaaaattctgcttctcttctatttaa

SEQ ID NO: 9808 - DNA, 876 bp, Candida albicans
acaacaacagcaacacccctccccccccccttctcccatattcatacaatggatgttcgtcgttgtcgtagatgtaaaagaaagcgtcttgatgatgaaccagatgaagttcgtcaatataaaacttgtgccaaatgtcgaattattgaaagaaataaaaagaatctgagaaaacctttagctgaagaaactatgctttatggattaaaacaatttagagaacaacaatcggccgaaaattatatagaagaagaagggttattaaaagatgaatttttcaaaaggtatcataataaaccatttaattatcaagaagaaataacaaaagtgctaaataatccaaactatgttcctccagtacttcataatcataatactgatgaagtggtgacttcatcaaatggtaatactactggtcctaaatatcaaatgacaatgaagacaaataataccactggagttcaaccaccgataaaatctcgcaaacaacaacaacaacctcaacctcaacagcagcaacagcaaacccagcaacatcgtcatcagcaacatcaacatcaacaacaaacacaccaccacaaccagttacaccatcaacaagaaactgttattgttgacgatgaagaagatctttataaaattttatcagaattgggtaatgacgataattctgcaaaaaacgattctaaaataattaaagaaaatttagatccttatgcaaatgataatgtatatgatgatttccaaaaatatttaaccactatacttgaaaaattacattctgacaaagacattaagaatttagtttatttaaaagaattcaacgaagttttatacgtattgaccacgggcaagaaataccgcgtcctttccatc

SEQ ID NO: 9809 - DNA, 243 bp, Candida albicans
aataacgatttgagacccttttgctcttcaatctatcgttctagatggcaaattctagaagaagaagagcgaaaggggaaaaaaaaaaacaagacctttttaaggtggagaccaacggataggtcgtgtcgcgacccattctctaaaaccgaaactggacttattggagtcaatcatcaaatcatgaaggtatgtcataggaaactaagaacattttatacagagagttttctggtgaactaa

SEQ ID NO: 9810 - DNA, 213 bp, Candida albicans
tgggatgattttggagcagcggacgagttaccgccaccatttgtcgttgtggttgatggtgtagacgatgaatgcagttgtggttgtttagatgaagccgagcttgatctaaattttgatgaaagtgaactgaataacccaccttttttgctatttgaacgagaaacattaggcgaggatgagttcagagaatttgaattgtttgataattga

SEQ ID NO: 9811 - DNA, 225 bp, Candida albicans
ttgtattcatactgtggttcatgttcgttgagtaaaactgaacctaatggtaaaatcatatgtctaaagaaaaaacaaaacaaaatggaacatagtgatggttttatattaccaaggcgtacacatattattgttgtaatttctttcggacagggctttaaacaatataaatttattctatcaaacatattgacgcatcattattttatattacacttccaataa

SEQ ID NO: 9812 - DNA, 240 bp, Candida albicans
gttgagattaataacataccaactgatggccagagtataaacgagcatgtacctcgtttaggacaaatctcgttgttaaagcaaacccatcctataaaaaaatcaaattcctctaaatatctcatgcctggaattggtctcccgatgtgtttatttgataattccctgattctgaaacaatatgcgaataacggaaaatatgaaaaattggtgaatgctgactattcaagaacaaactaa

SEQ ID NO: 9813 - DNA, 216 bp, Candida albicans
acattatccattttggaaccacagattgaaacagattattgctatgggtcattcccaagccgaaaaaattaccctgttaaacttttaaaagggtctcatcccccccgaataacactttatgaggtcaattcaactaaaaagggcaattcttcattttcaattaccggaattgggtttccaaaagggtttctttatttaaaaatttccaacacttga

SEQ ID NO: 9814 - DNA, 258 bp, Candida albicans
gttttcgcagtatgttcagtaattgcattcatgggtgaatttattgtcatggatttaactgttgccgttggtataattgtcattggatattttgttgaacaacccgaagatgaaaaagaagatgaagaagatgatgatggtaaacttggtggtaaaggtaatggtttatcaatattactactagcaggaaacttttcaaacacttctattccttttcctttttctcctcctcttcctcctcttcctgattcatcatga

SEQ ID NO: 9815 - DNA, 186 bp, Candida albicans
  unsure (155),(156): Identity of nucleotide sequences at the above locations are unknown.
ttattgatatttgtcattggtaataatgaacaaaaagaaaaagatgatgatgatgataataggtttgaaaaattatccaacaatttatcatcatcattgttgttgttgttgttgttgtcttctttgttttggatttcaagaattgaaccatcagnnatatgttctcaccagcacgatcagtactgc

SEQ ID NO: 9816 - DNA, 1317 bp, Candida albicans
  unsure (9),(10): Identity of nucleotide sequences at the above locations are unknown.
gaacatatnnctgatggttcaattcttgaaatccaaaacaaagaagacaacaacaacaacaacaacaatgatgatgataaattgttggataatttttcaaacctattatcatcatcatcatctttttctttttgttcattattaccaatgacaaatatcaataatcatgaaagaattaattcacttttacaattagattctcaaagattagataatcatcaaagaataaattcaattcaaagtgaacctgaagaaagtatatttgataaaattcctcaacctcaagaacattataatcataatcataatcataatcaacataatcgatattgtagtagttgtactactgctactaatcatagttcaaaaatgaattcaccttcaactacaccattaacaattaattctcatgatgaatcaggaagaggaggaagaggaggagaaaaaggaaaaggaatagaagtgtttgaaaagtttcctgctagtagtaatattgataaaccattacctttaccaccaagtttaccatcatcatcttcttcatcttctttttcatcttcgggttgttcaacaaaatatccaatgacaattataccaacggcaacagttaaatccatgacaataaattcacccatgaatgcaattactgaacatactgcgaaaacttattgttgtaatgatttatcacttttatcatcaccgtcgtctccatctcctcctacaacaaggtcattatccgcttcttcttcttcttcttgttgttgttgttgttgttcttcttcttcttgttgtcgttattgttcatcttcttcaaatgcgtcatttttcgaaatatctatgaataatatcattaatgaattagatgaatttgaatttgccattgatgatgatcatcaacatcatcaacaacaacaaataattgataaaactactactttggataagattgaagttgaagtttatttgaataaaataggtacatgtggtgttgaatccactgatactgatactgatttaattaaatttcaattatttaaacatgatatattatcaattgattatttaaaaaaaattatcagttttaaaatgtataatgattatgaattattaaatcatttcaatttattattaataaagactgataagaacatcttcacaaatgataatgatgaggatgaggatgaggatgagaatgaggatgagaataagttgattttacttgatgatgacaaaattttaacaaattatattaatcaattatcaataattaaattgaatttaattagatcaagagctaaaagagaaactatttcttaa

SEQ ID NO: 9817 - DNA, 279 bp, Candida albicans
tttttatctacagctaacatgaatgataatgttgtgatacttactttgcgggcggctaatcatattactaatgccaaacgagctgattcaaccacatcgactgaggcgatgccaacgttgtctgatcccaacgcttatactacaccatctgtttctgtccctcccaataacaataacccgtatataataagacaatcaaatccagccgggacagttttcattgctggggcgccatggtcgtgtcttatgtgtcgtaggacgtcatatcaaagacgacct

SEQ ID NO: 9818 - DNA, 204 bp, Candida albicans
tgttcttcattattttcctcttcccatggtttaggtatagggctatctgaaaaatgtaccactttgattttcttaaaaaattctaatggcagccagcctttatttgattttttatttatgaatggtaaatattggggttttactacaaaccgctcgtgccattcttcaccaaattccccagttaaaacaccatacacccgatga

SEQ ID NO: 9819 - DNA, 222 bp, Candida albicans
  unsure (32),(38): Identity of nucleotide sequences at the above locations are unknown.
gccacttcggattgtccagcggcttggtcaanattttncccgggacaagaaccaggtgaacaattccgattaaaaggtattcaactggatttagtcggtccagctatgcaaagtatttgcacaatagatttctcttgctccgacggtataggtccacatatcatacaatttattataattttttggacccaattgctgcataatactaagccgttgatatag

SEQ ID NO: 9820 - DNA, 204 bp, Candida albicans
ggctatagacctattgcacgtgcgttagttttaaacctaaaaaaacaattttgtgcagtcgtgcaccatttgtactatttgtctactgtgatagacgcacaaaccttcacagttcacgcacacttttgtcgattctcaaacctctctcacaggcttggtatgaatgaaaaaaattttggtaaaggcgaaaaaaaaaaaaaataa

SEQ ID NO: 9821 - DNA, 222 bp, Candida albicans
aatagaagaagaaaaagagagattattgttttggatattcaactcgttctatttttacatgattaccactttttgttaatagtcagtgatttaaattttaattatatttgttttaaatgggatgtcaaagtttcaagattgatagtttttttttttgggaatttatcatctgttctttttaaccggaaaggaatgatgaaggaaagaacttttcaatggtaa

SEQ ID NO: 9822 - DNA, 189 bp, Candida albicans
gtagtcatgaatttggtgactcaacatatgaaacaccccaagatatctttttctaaacgtgaaaccttttttttattaaacatacaaaaaaatataataagttatcatgaaatttttattattatatatatattaccattgaaaagttctttccttcatcattcctttccggttaaaaagaacagatga

SEQ ID NO: 9823 - DNA, 249 bp, Candida albicans
tggaaacgcggaaaaaagatggcaaaaatttttttgctaacaaattttgttaggcgcgaaaaaaaagatggcaaagattttacaagttgtcaaaaaaagatgacaaaaatttaccaagtttttttggggttttttttatgggtttttagggcttatataggttgtttaggggtgtgggaatatgatgggctgtgtttgggagcaaacggagcactggttgccgagatatgcgcggttaaaggtgggtga

SEQ ID NO: 9824 - DNA, 285 bp, Candida albicans
ggaacttttagctcagaatttttgcaaactcgagcccaaaattttcctctcctcggaaataacttattcccgaaaatggcaaaaaatgtcgtcgcctcaaaaaagatggcaaaaaatccccatacaaaattaaagatgacaaaaaatgtcgcaccaccaaaaaaagatggcaaaaaaaagtcgcacccccaagaaagatggcaaaaatatgtcgcaccaccaaaaaaaagtcgcatagttaaaaaaaagatgacaaaaaaatgtcgtaaaatcggccaaaactga

SEQ ID NO: 9825 - DNA, 198 bp, Candida albicans
cttatatttaatctactacaaactagtcgtttttcaaggaccaacttctatttcaaatatttctacgaccccttaaaattaatcttcattatttatttaagaagacttacaaaagagggttttgattatttttttaacacaattatcaaatctaactttattgttctgactcggttattgttatcctttttgaaataa

SEQ ID NO: 9826 - DNA, 237 bp, Candida albicans
tgtgaagacaagattagattgttgcaattgaaagatgatttgaataaagttacgtttcaagcttattggatgacagggggtgatgggtttgaatggattgaacctgatcaggatccagcagatattcaatggagaaaacatttagaattgtataataaaccagctttgaaacaaggtgaatttggtgctttgggttgggctgatgatttgatacagaaatccacaaaagacgtttag

SEQ ID NO: 9827 - DNA, 288 bp, Candida albicans
ggttgttgttggaacccaccaattggtcgaagtcgagataaggttcgggcgtatttgaaaaacccacaaccaattacaaattgtaaaccgatcatcgagtataatgcaggcaaattatcagatgctggagttaatgggccccatattaaaccaactttgggatttcgtggaattaaggaagctgggtttgggatatatatagttgtagaacctgacggtgatgatgatgaggggggggttggttggttggtgttggagttggtatcctgtttctttttatatccgtaa

SEQ ID NO: 9828 - DNA, 1515 bp, Candida albicans
aaacatgtgaaggatgaggttagaatcagtacttttaaagccttctacaattttttcaaaaaggttatccctaaagatggagataacactaccgaggaagcaatagaatctcgagtcaatgatatggcattggaaattgaaagtataattcatgaaaacttttctggaaaggcttatccaacagaagcaagaaggattttatttgttttgaaaaagcattttatgcaagaaatatttgataggaccattacttttaaggatgttgttcataaaactccccaagaaatcaatgcagatattgctaaaattgaaaaacaaaataaaaaaaacatcaaaaacattattcttacagaaaatgataatacacagattatacgaagaacacacaagggggaaattattaaagagaatgattttgagagatcaaaccaaattgatgagagtattaccacaagaaaagttgatcatcgtcatttttctccagatatagtcccagaatccaactttatatctcatacaaaatctcaaagcaaaagttacaataacttgaatccaagatttgatgaagatgatgaagaagatactgctactcgtgaaaatgaagaacaagaagaagaagaaaaagaagaaggtacaaaagcaacaacagaggtagtggaatcagaaaattccgagaccaaccaacttcaaggtgaaaataagagcacaccgaaatcttcagaatcattaagtgatgttgattcacccaaccacaatgaagctgacgatggtcgtctttattcatttttatctggtgttgataatccagttactggtgaaagaaaagttgaaaacaaacatgtttggtctggtagaatcacatttccagaatttgctacatttaaagccaaaggagaattttatactagcactgattacaatgacaaaccaatggaccacttaataaacaccaccaaagatattttacatttacctgcgtacactattcttggacgactcgatagacatgttgctgataagtatttaccaaaagtaattggatctcgagatttttattttgttcaaattttaaatgatgatgccaatgacgatcaatttcaaaaattgtatcaatatttattgattaaaaataaagtgggtgttttaagtggccaaccatcttttgtaaaagattcttatttgattccaattgatttcagagatgaaaatttacccccatttttaaagaattctcgacgtgatttaagaattgggttgtttgcattatttgtggtaagaaaggattatcaaccaagagcaagaagttttgaaactaatggcaataatcatcatcaacatgcgaaggagaaggagaatgaggaggaggaggaggagaaaggaagaaatcaatctttatctgaagttggtcattttacatctaatggtgtacaatcaattggaaataaacaagaaactcaagatcatagcttggatgatattttaagatcattggaccgcggcggatggacaaacgac

SEQ ID NO: 9829 - DNA, 249 bp, Candida albicans
cgtcaaccatgtttgttcctgttgtatatgatactaagatacaaaactagaaaaagttgttttttcaaaagtgtttttctcagtagtggtagaatctcctcgctctctgccagtatcttaccatacactcactattttttcgcaaagaaatttttttttcggctggaagaaaaagtgtaccatgcaaaatactgcacattaaaagaaagcattagggctacagccctaacttactgcatattgctttaa

SEQ ID NO: 9830 - DNA, 222 bp, Candida albicans
aaatctaacatcattatgcttaatgaattcaaaaaaaaaaaaattagactagacaacaacaacaataacaataaccagagcaagcgatattttatttattcccttttggtttttctttccttaattgctgctttctattgtctccagattaagttatcaactttaattcatcatcatcattattgtcaattaaggttatatttagtaagaaaaaagaaatag

SEQ ID NO: 9831 - DNA, 198 bp, Candida albicans
agcattacttccattattaattatgaaggcttgcataaattccctcaaataatggatgtagttcctgttgttgtttactgtacttcaacatcaaacggaagaatgattataagaaatgccttttcgagtttgcagaattataatcaatcgatagaagaaaaaaaaaatacttctatgacacacatacattgcatatag

SEQ ID NO: 9832 - DNA, 1266 bp, Candida albicans
ttattaattaaattgtcaatgtttcaactactagattatttgtttaccaccgtgacatttatatgtcctggtattctaaccattaaagctttagataaatcagttcaattcaactattccagttatcaattcctattgaattattggctatattttataatattgcagtatatacaacaactatttacatataattccattactttatcaattatcaattattcaatatttgccattaaatgttggttattttatggtaagaataacaatttaaaattaatcaacaagattttgattgataaatctataactagtcgaaatttaaatactattgaaacaaaatttataaatccattgctaaatagaattaatccagaatttgttgaattgaatttccaggtttatcaattaggaacaacttatttaaaaccagtgcccacaagtcaagaagtcaacattgttaatttcataaggggtatttttgatggcattactgctattgttgccgctttttctgatgctgttgtaactgttggtaccggtaatggaggtgttagtggtggtagtgctactaaaagaagagttaaaggctcttcatccagtacagccacgacaaacaatagcaaatcttctccatcatcatcgtcctcaatactaagaaagcttagaaaactgcgtcaaagttcttcaaatcaaactgctaatggcactgtttcgcctgacactcgttcaagaagttcatcgattggtaataatatgaaaaagatatccaattacatggttactcccaattctgtcagttcttcaaatcaatcggtatactcatcaacaagctcaatatcgagtagtaatcgatcaaatcgttcttatccaacatcaccagtaatttcacgtgctacttcaccaccacaacctccttccaaaccatataatagaaatgtatcttcacctccaccatatgatgaaattataaatattcctgaagtcagtttaacaccaccatctcaaactaattatcgtactacaaccaccattaatggtggtggtaatagtagtaatagtagcaggagggtgtctcgatcttcagcaggaagtttagatttggattctacaattatggcatttagacaacaacagcagcagcaacaacaacaacaaagatcagtatcacccacttcctcttctgatggaatgagacgttcaactaattcaatggcaacattacaagaactgttaactgttagacgaagtcacactaatgatatt

SEQ ID NO: 9833 - DNA, 501 bp, Candida albicans
aacgtaatttgcggacctgccggctccgtggtgaagacaaaaattgaaaatgatattcaacaacaacaacaagctgatgtcctgatgattagttttaaagaaatgcttaaatcaacaccaccaccaaataaaataagagatgctgaaaaccaaaaacaatccaatataaaaaaatccgattcattaagaaaacttaaaaatttgacaatggatattgaagcctttttaggtaatttctctttatcttcttcttcaaataaatctccaccaagtcctaaaccttcatcgaaaatattgaaatctccatcaactactcaattagatacttcaattactactgatagatctcacaacaacaataacgatggaacaattacaaaggataaaagactatcgtatagtaaaagatttgtggacttaccttctattagaggttctcctaccccatctaaaagaagtaatattgagaaatcaaaatctatgaaacatttaagaatgtaa

SEQ ID NO: 9834 - DNA, 1473 bp, Candida albicans
gtttgttcaattcattttcaaactttttcttcactcttacttttacttttacttttactactagtttcatttgaatactcccccttatcctatatcaacttttcaaagatggaaaattttgatcaaatacttgatcgttttgaaaaactggaagtttttaactatttgactagtttaagtgcaaaattatctaatgaaaatgaaaccaaatcaattcaagagtccgattatttgatttatttaagtcaattgaatcaacttgtagaaaaagccaatatcaccttagatacaaaaaagaagaaactgactacagaaaccaccaaccccaacaatgaatcaaaacaaactagacaagcaatttcattcaatatttatcgattagtatcaaaaaattatatactggttttacataaaattccatctaaaatttatgatttgggtaatcaattggttaataatttggttattgatgataaaggtgaactttctcctataactcaagtatcaattattattttaattgatttatttgaaaatttccctaattcattggggtcattaatcaatttttcaataacccaattatacaaaatattaaagaaatatcccaacatcaatagtaatttgatttttttgttgaattcaattacaaaaaatgccaccaaattggatattgatgataaaatgcaatccaaactcatgaaaattgtcaccaaagggattatcaatgaaactatatcatataatatggaaattgaatgtacttcaaatgtattaataaagaaaaattatgtgttatgttataaaaatttgttgttattgatggtttcaacaaactatgaaatgcttcttgctgcttcaacatcatcaacttctgctggggcgaaaatgaaaccagaaactattatgaaacaacaacatgattttcaaatgaatttattaactactaatgaaaaaattttcaattattgtttatcaaatttttctaaagaaatcagaattgccatggttgaattattagcaaatttattgattaattttgtccccacagggaaatttaatgccattgaatatcttgtgactctttttcccttgccggaatataatcaatgggattccaatcttttaatgaaagttggtgaaaatggtgaacctatagttgatattagaaaagagaaaaatactttaatgggtcatgatagtgaatctattataaattcaagtttagaattatcattatttcaagctagtgtcacagaaacaattattttttatttacaattggaacaatttcaaaatcttgaatttttatcaaataatttaacgtttattttagaagtgatattagcaaaatttgttgaattaaataatatggaaaatcattttatgaatcaagaatggaataaagttttgaaatattggagtacagttatagaatacattgtgcaagagactggttccgcatcctcatga

SEQ ID NO: 9835 - DNA, 375 bp, Candida albicans
aatacattgtgcaagagactggttccgcatcctcatgaagtgctttgcagttttatttatggtaaatttgtaccggattcaaataatgaagatattttttcacaagatcaacatcaacaacaacaacaacttgttagaactcaaagtttaaacaaacaaagaaaacgggaatcgaaaatattttcatttaaaacaaagcaaagttcgaaaaagaaaaatgtatctaattgggaaattaaaccatatcaaaacccataccaagcctattttttgttgtttataattgatatgttattaccatatggtgtcagttttgagtcgttgaaaaaagatgagaaaccgaccaataaggatcttctcagtaagagtccttaa

SEQ ID NO: 9836 - DNA, 183 bp, Candida albicans
agaccgatgccagattgtaatagaaaagttttagtgccccctaatttcttaacaattgataacataataaagagaaaaagacacgaagagagagagagaagaagaataaacaaacaacaccaaggcgttcatactcattgcttagataaaaaaccaaaagcaaatttctattgtgaggcatag

SEQ ID NO: 9837 - DNA, 231 bp, Candida albicans
ctactacaagtaacttttgtgatattgaatagaacaattcataaggcattagatatatatacaccaaatttatccttctggttatcccctgcctcatctcgtcagattttaagattggtgttttttttctttcgttcctttttttaccgtgtgtattctccttttttaactgtttcaactaaaaattccttattgttggctcgtggtctagtgcctcacattgaactataa

SEQ ID NO: 9838 - DNA, 234 bp, Candida albicans
ggtatattttcattaccaatattgttcgaaggtgaagcagtaaacctttcagttgagtttggtagcacaagatttcggtggtcattatcattcactgaatacgttgatgcctcacgtagatgtacaggtcgtttaagtattgaatctatattatttgaactgctgatggagttggaaattgacggagccttggtagaaggaagtttgaactgttgttgcctcactgggtcatga

SEQ ID NO: 9839 - DNA, 204 bp, Candida albicans
  unsure (115): Identity of nucleotide sequences at the above locations are unknown.
tcagatcccgaaaaaattgacactaaagaaaactttgagagcatcatggaacatgttaacaacactctcatgaggtcatcctatagtaggaaacaacattccgggccagtagccnaacaagatttgaacatcaagtctttaattaacaatcaaccaaagttaaattttagcaacgaatgggacatagtgagtgggatgttgtaa

SEQ ID NO: 9840 - DNA, 237 bp, Candida albicans
ttcagtagatatcattttatttgttgttgttataatcattttatcatatttttattatcattagttttatttactattattatcattattattttcattttttttaattctgacaaaaattatctatattatacagtgatctatttacaatcccttttttgtgttaccgatgtagttgatggcagaaccagctttgaagaactcaacttggtctttagacattgtatgtttagctaa

SEQ ID NO: 9841 - DNA, 366 bp, Candida albicans
  unsure (275): Identity of nucleotide sequences at the above locations are unknown.
attattcagattcatattctcctttgtctttggaaagcttattttctttttgttatttcagttcagttcagtctactgccccttccatttcctctcctttccatgttttcttataatttagagtccaataatgcaggttatttaaatcatcatcatagccgtcaccaccttaacagcaacagcaacagcaacaacaacaacaacaacaataataataactccattgctattagtaacaacaataaagctcatttacaggaacaaaagcagcgacnaagtcaagaacccgaacaaaaccctcgcaatccccagggtttaccagaactaacaattcatccaccaacagcaacattttcaatacttgca

SEQ ID NO: 9842 - DNA, 255 bp, Candida albicans
aataacaaaaagaaaataagctttccaaagacaaaggagaatatgaatctgaataatttaattactattaccccagtactgaaagtggaaaacttaaaattgagaagacaactggaaaatttgtctagctttatatgtgttattgacaagtgtgtgttaaataaagtggataagttgggagcaaagggggcggattggatgtatgtttatagttggataagaaaatgggtgtgtgtatatgtgctggtgggttaa

SEQ ID NO: 9843 - DNA, 216 bp, Candida albicans
gaaaatgggtgtgtgtatatgtgctggtgggttaagtgtgtgggtatgtgtgaattagtaggtaagctgaataatggtgtgggtgtttatttgtacgtttgtacgtttgaatgttgcaattcagttatttatatacagataattaagggaaatatagggtatttatgtacaagatttaaaattcttaaatcttattattattattacaggcagtag

SEQ ID NO: 9844 - DNA, 246 bp, Candida albicans
gagactgattttacttgcaattctagttccatgaagtttctatggtgtgccactctatgcgaatgtctacgtccaaaaaaaaccagcacaaaattttctcatacattaaaatttattcttacttatcatccaccttactctcttctagactacatcaatgaatcaacatattatatacactcgaagatagataacatggtattgataaaaaaatgtactatcctggttctctgtatcaaatattga

SEQ ID NO: 9845 - DNA, 234 bp, Candida albicans
ctccccacatattggcccggtaccgacgagttccgaggtggaacacaagatgatcgtcgtatttctctgttcctgtttttttggtttattgttgctgggtataccgcgtggatgatgaattctggtggtgatggcggtggcggggtgcaaagtttttggaatcgcgatgaacaccacgttttgcaatttccatacaacaactctaaaccgaaacaccagcaacaacaacaataa

SEQ ID NO: 9846 - DNA, 288 bp, Candida albicans
gatacacagagagttttatatctttacattcttaaagttgaaacgcagtttatgatgataaataacacacagtgtgatatgtatcaacaacaaaaaaaggtttgtgagaaaagaaaaagccacaaaagagttactatcttaaaacaaaacaaactaatcccaaagttaatgaagattttcttcagttttgaaaaaaaaaaagaaacaagaaatctaaggaacatgtgggccatcttttggccagctcatctaatcattcaaaattccgataccgtgtctatagtataa

SEQ ID NO: 9847 - DNA, 228 bp, Candida albicans
gtcaagcagataagaggagagaataaattaaacaggggtcgtgtcttagttgagctaatcaaatggtacggcatcaaaattttgttatatacgatggggacaaaatcagccacaaaagctatactcggatggtttatgagaattattattatcgttatcaatattgtcaatcagtctctggcttttattttatcttataatttcaagataagtatcaaattagactag

SEQ ID NO: 9848 - DNA, 231 bp, Candida albicans
aaaaataccaaatttggttgtagaaaccacgaaaaaattaattcggtaaaatattttatcacaaaacaaatgatagatagagtattcttcgttagtggtgggtttgtttttttttttcttgttcacgccataaatacacccacacaatttatgaaagaaggaaagaaagatagaaagcaaaaaacaagtggttgcaaatcacattctactaataataaaataataaattag

SEQ ID NO: 9849 - DNA, 183 bp, Candida albicans
gtaaatttggcaatttttttggtaactaaacttgctttggtttacttttattttgccttgtctatgtctaagtctatgtctatgtctatgtttatgtccgttgcttggttgatatttttagtctcgtgcatgcatactttaagaccaagaaataatgtaaattttcatggacctaattcttaa

SEQ ID NO: 9850 - DNA, 255 bp, Candida albicans
ttatattgtcttcaatctattgtctttctctctattacaccgaagacgaaagtaacaacaacaacaacaacaacaacaacaaccgcctcttactttaaggattctaaggttcctaaaaataattataattggaagaaaggttttttcaggagtgaaaatgtattgtcacattttttgtctcaggttaggttagtttcccttcttcgagtttatccgtttaaaaatttttgtaaaatcttgtttactcttgattaa

SEQ ID NO: 9851 - DNA, 183 bp, Candida albicans
cacaataataagagtagtagtagatattattcaaagtccgtagtgtttgtaaccacaggaagcgagcgagatcaactaaaattcggaattcacaaacaaagaaaaagtgaaatcaattgtattttccaaagatcatcttttctaaaatcttcccatagacttaaaaaaaaaataggcttatga

SEQ ID NO: 9852 - DNA, 273 bp, Candida albicans
aagaagaagagagcaacaaacaattcaaattcggaatcatcatcaaagggaggtggggtggagagtgggggtttaagtcaaataaaagaagaaaatgggatgaatagggggggggggggggaaacaataacagcaccaacaagattcatatacaaaggaatgtcaaaactaaatcaatggttaaaaaaaaaagaaaaatataataactttcttactggggagaagactaaaactgaaatcaaaattaaagcgataaacttaattcatagttaa

SEQ ID NO: 9853 - DNA, 195 bp, Candida albicans
aagaaaggaataagaaaaggggagtatttctggagtgaaaaaaaaaaaattcatttgttgaaaaaagggcaccccagaaggagcgccggaatagcaaaatcacaacctcatgctcgctccggtacaggcaaaaaaaaaattattcaaagtaatctctttctatacatgataaatacaccaacaaaaactacctaa

SEQ ID NO: 9854 - DNA, 192 bp, Candida albicans
ctaaaatcacaatttattggtgtggcatttggaggtaaagcaagagttattttatctttagaattgatccaatcattttccattgaatattctgaagatggttcagtattgatgttgttggctatgatggctgggttggtattgtataaagttgcttcagaagtctttttggaaatcaaatcattcagataa

SEQ ID NO: 9855 - DNA, 1269 bp, Candida albicans
  unsure (1206): Identity of nucleotide sequences at the above locations are unknown.
aatttattttatttcatttcatttatagcatttattctcattcatttatttattacctgcattgataccatcatgattgaatacttacaattaggatctactatagcgactatatcattaagcattgcacttggaacactaacaataatatcgaatcaacaaaatgtatatcatttgatattaacaatcagttcatttattattccattatattcaataattccaatcatttattccaatgctatcactatatcaatacaactaatattttccatattcaatataatatccggtatattattcataatcaatgttcctcataaacaactttattatatcccaatcacaattatatttattgttaatttggtgtttcttatagcttcatttataatgttactactgtggatgatcatactgaaaacaggtttaaataatacaaacgaagaatcagaaatttatctgaatgatttgatttccaaaaagacttctgaagcaactttatacaataccaacccagccatcatagccaacaacatcaatactgaaccatcttcagaatattcaatggaaaatgattggatcaattctaaagataaaataactcttgctttacctccaaatgccacaccaataaattgtgattttagttattatttgggaagtaatgccaattcagtacgcggagatttagataatgcaagaagtatactcatggtcaacctagaggatcaagacaccaaggcaaatcaacaattgaaacgacaacgatggaaatctattcatgatgagaagattatgattgcaaatttgaatcaaaatttattacctggtgttcttaaacagaatatatctgatgattatagcaacacattaactgggttagaaaatataccttctagcacaaatttgaccaccgcaatagtgagaaaaattgacggcacaccaacaaatatccctgaaatcaatatggaagaactcaataatttgcaacagatatctggctacaatattatcgatggaagctccaatttgattgatggatcacaattatttgataaaaaaacgagtatcaagagtgaactttatcaaggagaatatttgttgcctccaaatgaagttgtggaaaatattgatcaattaagtgatattacttccaagagaccttcaattatgaatcgaagtttcagtgaaccttacattatnatgaaaagtggtgcaccttcattatacactttcatttgtcaccacggcgtggaagatccgcag

SEQ ID NO: 9856 - DNA, 228 bp, Candida albicans
agtgataaattgagcacagtttctgatctaatgggtgcaaaacaaaacaaaataaaacaaaacaaagcaaaaaacaaaaaacaaaaaacaaaaaaaaaaatactgttagagataaaacttacaacaacaacaacatgtacagggaatagattaaatatatatgaagaagaagaattttgttggattcaacaattttttcacaaccgcaaactaaagaaaaggaattaa

SEQ ID NO: 9857 - DNA, 192 bp, Candida albicans
cttggtttaccccttggttcatatggacaacataaactcaagattccggcaaaaatgaataatgctcctgagacaaatatgggggctgaagtggttaaatcagcatatatggcaattataggagcaaatactcccataatacgattaaatgaagcggctaaccctattgccgtacctctaatttgtgaataa

SEQ ID NO: 9858 - DNA, 225 bp, Candida albicans
gcatacaatactccatacataatcgttgacatgaatgaaaacatacaattccaagccaaatttgcttttgaagttttcgccgttgttgatccaaataaaaatatcccagttaatattaatgataaaaataatgttcctttgcgacctatttttaattcaactaatattccaccaatcaatgagccagggatacctaaaattgatattattaatgtgtttcgataa

SEQ ID NO: 9859 - DNA, 1164 bp, Candida albicans
tcctatagctttttgcacactttttttataatcatgtcgttcaaagtaaattggaattcattagaaactgaaccgttaacaaattggactaaagaattgttgacatcagcattaaattctggtaaatcaccaaatatactagcatcaaatatcactattaaagatttgaattttggtaaaattgcgcctgattttgaaatattagaaattggtgaattagatcgtgatagatttagaggaatattcaaaattgattatcaaggtgacttccatttaacattacataccaaagttcaagcaaatccgttaaacatttattatcataatagtttagaaaaagaggtttgtaattattcccaagatgaattcattacacctaatttcttattgagtaatgaacaatttgctatccccttggatttgaaattaagtgatattaaaattaatggtattggtataattgtattttccaaatcaaagagattaacattagtgtttagaaatgatccattagattcgataaaagtgagttcaacatttgacaccgttcaagtgttggcaaattttttacaaaaacaaattgaaaatcaaattcgtgatttatttagagaaacgttacctactttgattcatcaattatcattaaagtatgtaagtctcgataataatattaatgagattaagagcaaattatcacaacaagattctgtttcaatgactaataatgaactagcttcaagtttgaaattatttgatgatgaagaaaatgaattcccattgatttattcgagtaagaatttacagaaaaatatgcaattattcaaatcaagagaaacttttagattaagtgcccccaaattcaagaacattgtacaaagaactcgtttagataaattcactaaaagttatccaaatttattaaattcattatatgcaaacaatgctgatcttcaacacagatttgttaataatatcaaccatggccacaacaacaacagtaacaccagctctactggtattcctattgagttattagtaagtcatgatgataaacaacattacggtaaaactgataatttattaaaagatatttcatctattcaagccaacaatttttacaaatatagtaataaagatgcaccagacaaaccagagagaagatga

SEQ ID NO: 9860 - DNA, 1335 bp, Candida albicans
tgggatttatttgttgttcatgttttaagggtaaccttaaatttcactatttttacttatatgcgtttattggatattcatacccttataatcaacacttgggaattgatgtccattgtcttgtttgatttgaattataaaatatcaagccataaacgagatccagtaaaacactattatcagacaattattgatgaatcgattttttactgggaaacgttgctatacattccttggttattttggaaggttttcaatccaagaacgggaacaccagtaggattgtccagatgcagagagtatattcccaaattaaacacaccaaaatcggtagcattgattttacaaattaatcagcctatgttccactcaccaccagaaattccacaaccctatttggatgccgatagaaaaattagaatacctgagaagaaggaagtccaatacgtaattgccataagaaatgaatactttacccaatgcaagtcccatatggcagctgaaagagttcgggttttgcgagagattgggaggtttatcacctggtgttgcttggttccaacaataactgaaatatcgatctatgaaaaaatgggagcttgttgggacggcgatagtagttttattgactcaataaaaaattcaattttggtagaattggtggctttggctaacacttgtgacccagcagagttgaaacagtttagaaaagttttacttcaaattgtagtattagacaagtataccaaggcgacttatgtagtcaatgatgaggattctaatatacccaacatcaatacagatgtgactgttgatgatatattaagtgcttacgaagatcacaaaaaattggtggtgacattgtgtgattaccgagttaaaaccgccaactacgaagtgttggccagtaaagttgttgaaaataatcttcaacctgatgatcctatttttacagaacagatcccaacctcaccagatcttgtttttgctccatccaacgagggacatcagataactagattatgtggttatacgagcatagatcccaacaccgaagccaaggtgaaatcagttttgtacttttcccacataaagtttggatatccttttttctcgcgtgccatgtatcattatgctttggaatttccattcaagcttttagaagaagtacctgagcctgaagaagaagaacatcctactatgatcccaccatctcaagatattgctaaaatatttaagaaaatcagtacttccacattaaagcaaaacgctattacaaatagaatttctcgtgtgcctagtccgcaatcattaatagcaaagagtttggcatag

SEQ ID NO: 9861 - DNA, 630 bp, Candida albicans
  unsure (414),(601): Identity of nucleotide sequences at the above locations are unknown.
tcagtacacgtagaaatagagatagagatggttaatttttcttaccaaaaaaacaaaaatcttgaactaaaaatctaccagcaaactaagtatattcttataacaagtataaatacccatccctgttcatatccaaaattaccgactgatttcatgataaggctgtgcttagttagaattgggaatatcccttctgtaactccttcattacattctacacctttctatacaaagaaactattacacccgttacttatacactcgtcattcatacgaaagttttcgtcatgtcgacccgagtttcaggctgtgccgtctttaaataatgacaaacctttaaaaaatacccagtcatcacagaaaaatgggaacaacgaaaaggataccaatagcaaggaagagcaaaaggtggangacgatgcaacaaacaccgatactttgagttctggaaaagttcttacaaaaagtgttagtaaagatgaaatttttacagaaaatatttgggaatttgggatccttacattgacacttatccaatttacaaacagttgcgtgaagcggaatttactcccgaacaatcagaatcaattatttcataatnagttcacaattaaactccaaatgaactaa

SEQ ID NO: 9862 - DNA, 297 bp, Candida albicans
tttccctatatatatatatataacaccaccactatgtcaacttcaactcaattacaaactctttcaaaagatgaactaatagaaaaagtattagaattggaagcagtactaaatgaatttcaagattcttcaaaagaactagaacgagcattagaagatgaattactcgaattagagaataccaaaactcaactttctgaacaattagatcttaaaaaacaggaattagcacaagcaaataccaaagtcattaatctcacttcggaattaaataatttacacgaatcaaccatataa

SEQ ID NO: 9863 - DNA, 186 bp, Candida albicans
gagaaaacaaaaaatcaaaacaatacaaaaaaaaaaaaacataaacataacaactacaacaatgtttactccatctctctagatcgtttagctttcattttgcgtgatttccctatatatatatatataacaccaccactatgtcaacttcaactcaattacaaactctttcaaaagatgaactaa

SEQ ID NO: 9864 - DNA, 318 bp, Candida albicans
aaaaaaaacacctgtacttgcatactcctacgtttaaccactgacaacatgaatttgattgacttgcctgtacctattaagaagtcgataatcaaatatctaccgcaacaagcactcatcaacctatcattggcaaattttgaattctatcagccatgtttacagcaattgtataagaatatcaccatccaatacaacccaccactcaggcccaacgaaaaagaccgtgaaaaagacttccaagactctacaagaacagttatatacgggttcagcaatccagtcttacacgaccggggctggaagataacgcgctgg

SEQ ID NO: 9865 - DNA, 870 bp, Candida albicans
tttgattgcacccttaacattggaattaagagctttaatacacggcgtttcaaaggaatcaaattcattcatgggaccaatattacgggaaaaccaagccctttgaaaaatgaattggtatcaatattggaaatgcagacgaaccattttgatcaatgcatgaaagcggtggaattaatctcatcgggaaacggatgcgatatgaatcttggtgtcttaaagaacgacgcccaggagttaccagaggtgtttaaagaactaactacaatttatgacattatacttcgaaacgaggaaagatctaaaaagtttttggctacacatatgccaaatattgaaaacatatcagacattgtcaaagaagagttggctgtattccgaaaatttaagacagaagaaattccaaggtatacgtttcttatagcggaatgtgaaaataaactcaaggaatgctcaatgccggtaaaatctgaccaatcaccaagtcaagtgtacacgcagaccttgcaagagttgactgagcattatgttaaatttataaacatttacaagaccaaatatctagcagaactacatcatcaacaatttacgtatccaagaaaatttttaaaaaaactaacagagtttttgaatgaagacatttatagaattcaaatagaggagagtgaaagaagacgccaatggacatctagatatggtgaattcattccatcggagttcaagcttcccggagaacacgaattgccagtcattgtacagattattacagaaggactagaatatatacagaaagaagatggccaagaagaagagcctaacataggaaatgagaaagagttgatggacatgatcaccggatccaacaagtaa

SEQ ID NO: 9866 - DNA, 339 bp, Candida albicans
tggtggcttttggaaaaaacttatttcagttcattgcagacttacccttcattgtatgctttgaatgaaaataaaccgggcgttgttattcaacagatgcatcccaattgggttattggagccatattcaattcaggaacatttaatccaaggtcaaaaactgttgtccccagtggcgatggtatctctccgactttcagctactcaacaacgttacggtactttagaacgagagttgctcaccattgtgtatgtactacagaagtacaaacagtttatgagcagggaagtccaattctataccgaccaccaggcgataacgacaattggctctgctag

SEQ ID NO: 9867 - DNA, 420 bp, Candida albicans
  unsure (399),(401),(402): Identity of nucleotide sequences at the above locations are unknown.
actcatcaattctatctcataatggatgcttggaatagtgcaacaacttttggagcagatggtctactgggattcaacagtcaactcccagacattttaaatttatctgatcctttattggccaagataatcacatccaaaaaggcattacagttattggaatcaaatatagtttctggagtttctgaagatggaggagaaagtaataccaacaatgaaaataaagctattatagaattgttaatgtcggcatgtgatggcgatgttgtcactttagagagcataactagatctaatccacaaattgtcaatcaactatttcctagtgatgaaattggtgcaacagccctggtatatgcttctttcacaacacgcgcgttggcgagcatcgcactgctncnngaaggccaagggggcggg

SEQ ID NO: 9868 - DNA, 1800 bp, Candida albicans
  unsure (1770),(1785),(1790): Identity of nucleotide sequences at the above locations are unknown.
tacaacatgtcatctttaccaaatccaaatccaaatcatttaactccaaattttaatagaagaggtcatagacataaacgatctcaagcaatgtcaggagattttgatgcaataggtttaggattattcaattcaccttcacatttgactactaataacaccactcatgtttcttcattttcttcttcctcaccgcctccaccaccaccaatattttccatgctggatgatttagataaacattatcaatttaataatactgaagattttgccaataatcctaatcaaggctttgcttttcctaatattactaaaagttcaggtaaactcgaatcatattcatcttctgcaccttcaagtggtaaattcaatcaacatatgccatcaaactcattaaactctcctatcagactacatcagaaacgaggattccaaaataatagttaccaccaccaccacaacaacaacaacaacaacaacaacaaccctaatcaacccaagtttttcttaactaatgaaacaacagtaaataaagataatgttccagaagcattaatagatttggacgatatatttaaggctaacttacacattggtgataacaataatactggcagcaatagtggtggttcaatacctaaaactacacatttccataaacgtacagaactggccccagcaaatttctattatgatgatttcttggggtctcctttcattaaagaaaatgccattgaagaagaagaagaaagattagaggtgagttttgaagataatgaggaagaagaagaagacgaagaggaaatagaagatttacgtcttcatattaatgatggatcagatgaagcattaccaccaccttcattttatcaatcagcttctgctaattcatcaaattcaagtttaaaaacgaaaactattgagaaaaccctttccaactcatcatcaagctcattatttgcaacaccaagatcaggagccaaagcaagtagatataaaaatatttatgatcaatcaaaaattatatcaaacgcaatgaaaatttcatcagaaaatgttagtggcattgaacgaaccgtgactcctccattgaatcgcaacaataacaataacaatagcaacaaatatcttaaccattcttcttctttgccctctttaaaggggaaaagatcattctcatatgtccgtcaattacgatatggtgatagcaaaagagttgcatctcctaaaactaatatcactatagatactccacctacaccaccaacggcaacggcaacggcaacggcaacggcaacgacagtgccaacatcggtttcagctgttacagtcctttcttcaataggattatcgggatcaccatcatccaaatcaccggaaactcaattcattttggaattaccttcagcttcaaccccatctacatcagcaacaactttgagtacttctagtaattcagaattaaagaagaatagaaatagtcccgtaagtgtcaattcagaagctttagattcatacacaacttcgagtagtacaaactcgacaatggacattacagcatcaccaaattttacagcagatattacagccaataccactacacctgctattgttgttaccaatgagcaaactcaccttaataaggatccattgtatatcaacacaaatgttagtagtgacaataccacgattgaaaaaagtgcatccacgataacagcatcatcagggaactcgacgccaatggtagaatcttgcccggccgggctggantatcaaacgtgcgtngtggncccttcctgt

SEQ ID NO: 9869 - DNA, 195 bp, Candida albicans
gtttccggtgatttggatgatggtgatcccgataatcctattgaagaaaggactgtaacagctgaaaccgatgttggcactgtcgttgccgttgccgttgccgttgccgttgccgttggtggtgtaggtggagtatctatagtgatattagttttaggagatgcaactcttttgctatcaccatatcgtaattga

SEQ ID NO: 9870 - DNA, 315 bp, Candida albicans
  unsure (130),(176): Identity of nucleotide sequences at the above locations are unknown.
ggaattcccaccatttggttcaacatatcaattgacatacagtgtaaactccatattcacaaaccttacctggtacccaccaccattaccaccatatttgatgatttcaataatagtattgttggtggtnatagtaattctagtaaattgatgcccttgagatttaggaggaggangttgaggaggaggaggaggaaacaccaccattatttaactggtaatgataatgttactagtactactactactactaattcaacaagtgggtttgataattcttctactagtggaagtggtatatggggaccacaataa

SEQ ID NO: 9871 - DNA, 273 bp, Candida albicans
aatcgtagtagcaccacccatgaaccaaaaccagaattagagaaaaccacaacaacaacaacaacaacagaaaaaattttctacacacacaacacacacacagagagagagagagaaagtaaagaagaaaaaaaaaaaaagaaagaaaatttattgttgcctcctcattcatcaaaaattacaactttaatccaaaaaaatttttttactttattaaaaccaaccccattacgaagttctgattttgttttaaatatcatttttcaatattaa

SEQ ID NO: 9872 - DNA, 213 bp, Candida albicans
attaacattcaaccagttaagcgagccaatgtatgcgcaacagttttgaatgaaccatccacattaggatttactaatctacaaatgagtcataagtggtggtttgtaattgtcaagattttattgccccccctgtgttgcagaacgaagggaaagaaaaaaaaaaaagtttctcactcttcacctcggaatgaccagggccgcacatatgta

SEQ ID NO: 9873 - DNA, 249 bp, Candida albicans
gataagataataacaaacaaaatattgtttaatattccaaatatgaaaattgaagcaaatgttcgttgtgtttcagagattatagacatagcaagacaattggtgtttgactatctaagaaagtgtattttttgttttgatcatctgatagataagattgtaaacaaaaagatttatagtgtcatcaccaacgatcaccacattcttaacctaatatttttctcggttttcttgattacattggagtag

SEQ ID NO: 9874 - DNA, 396 bp, Candida albicans
agaacaaatactcaaagttgctccaaacggaaagaatccaaatatcaactgcccaatttacttgatggaggtattgtgggttccggagttcaacaattgaaagtgaaaaattacaacttgccaacaccccagtcaccatgtccggaatgtaagaaaatgtcgccgtgtatacacacggacggagccaaagtcatacaaccttcacaaagggacaataatcatcaacaacagcatcaacaagtgcaccaacagacccagttacgcacgttctcccaaccaaatcgaaactttacagtgaacttgcaacatccatctgacgacagtcttggaaatgaagtaccactatatactacaaatcgagaaaactcaatgccattcagcgaccattggagttag

SEQ ID NO: 9875 - DNA, 354 bp, Candida albicans
aaagtgagaacagagagaaaaaaaaagaaaaatatagaaccatttttttgtttttttatttttaatttggttagttttctttcacaacaacatagttcaaagtactcatatattcatttcacaatgataccaactagaatcttactcaacggtgccaaaaacgttaaaccaaagcttacttacccagttgaattaactccattgtttgctgctgtcggtgttgcccttgtttcagcaacttttttcacttacagacatttcacttacgataaggaattaagattatggaaaaacgctgacttgtccgaattgaacaaagttttggacaaagccgtggaagaagaaaagaaataa

SEQ ID NO: 9876 - DNA, 219 bp, Candida albicans
ctgactgacacgtccacgcgttggttgttaaataaggaattgagagcgctaccattattactaccaattacaaatcaaccagtgtatacaagagaatgtgatagggtgtatactattcacttacaatctttcataatttgtaaacttatatctaataatgactttttaaaatttgtatattctaatgaatcagaatattcaaaaaaaaaaaaaatataa

SEQ ID NO: 9877 - DNA, 276 bp, Candida albicans
tacttaggcacaaaatcaaacttcacaacggcatatcatccccaaagaaatggtaaaattgaaaaagcaaacggatcattaaaaaaaactcaaggtagagaaaagaaaagaaaagtacagaaaacaaaaattgttgagaaatgtgtagaagtatttatatctgttaaatgtaaatggaccgagagaggaggttggaatgtcgaaggagaaaaaaataagggagagcaaatatacacgataactactaccacctttagtataatctcgacattataa

SEQ ID NO: 9878 - DNA, 423 bp, Candida albicans
aaaatcatgtcatttagaactaaagataaaagtgatgatagcagcataataaccaccaattatgcagataaccctaatctatcacccattgaacagaaaatactacaacaatatcaacttatgaataataatcttatcaaagtatcaaatgaattggaactactaactaatacaactgatgagtttggtaaaggtaaaggttcaagcatacacttagttgagaatttaagacaactagagacaaaattggtgtttgtatatacattcttcaaaggagcagtctattctatattgaatgcccaagattatattgcagaacaagaaacaaatggattagaagaaactaatgaagaggaagatggtaatgaagaggatgagagtgggaatgtagaactactgggagtttcagctgacgagaattga

SEQ ID NO: 9879 - DNA, 183 bp, Candida albicans
ctccgtctaaataaggctaggaattattattgcaagataattgttaattttctacactttttctcctacttgttcacatataaaatatgcatttataaactaatagccataaagtatatatttgaggttattagttcacaccgtatcaagccttctattaacctacatactaacaatacatga

SEQ ID NO: 9880 - DNA, 234 bp, Candida albicans
  unsure (197),(199): Identity of nucleotide sequences at the above locations are unknown.
ctgtcaaggaattactgggatatgagcatggtaaacacaaagatagagatttgcacattgtttatgaaaattgatgatggtcaattacaatatggtgacagaaaagattacatctattatccatatagaaatgaaaacagcgaagaagaatgtgcagacgaagatgacgaccatcacgagaaaaagaagagaccacncngacatggtggcaagtctgatgatgacgacgaatga

SEQ ID NO: 9881 - DNA, 315 bp, Candida albicans
ataccaaccaagattctgataagatcgaaaagttttttttatttccattcagtatcaacaaatatttcaatcacatcaacaatgaagttctcacttgctactgctactttaggattaatcgctattgctcaagctaccttgacaccttattctggttattctggctattctggaggcgatgacgataaatatagacatggaaaatctggtattgaaactttgagaggaaaatttgcgttagctgtcaaggaattactgggatatgagcatggtaaacacaaagatagagatttgcacattgtttatgaaaattga

SEQ ID NO: 9882 - DNA, 198 bp, Candida albicans
  unsure (16): Identity of nucleotide sequences at the above locations are unknown.
actttggaatatctanccggtcggggctatatttcaaagagcaatacgaatggtcctacaaatctgacagcagccaccaccaccaccacaacaacaacaacaacagattccatagttcaaggtgcaacagggatgaccacctctgcagcacatgaacctaataaagctgatgtgttattacccccaataagacattaa

SEQ ID NO: 9883 - DNA, 279 bp, Candida albicans
gtgaaaaaacatggtattactatgagaactagagaattagaaattggtaattatgaaccatctcccaagattgaaaaagagggcattaagaaggaagaagaagaagaagaagaagaagaacaggttgtgacttattctaaagaatttccaattgatgaaactccaagttctagattttctagaggattttattattgtacttcatggtattatgttggtgatgacaaaaatccaattataactactgattggactcttgaaatcgttgcaaaaacttaa

SEQ ID NO: 9884 - DNA, 198 bp, Candida albicans
cgtattattatttctctcttctttcttactgtgccattatcatcaaatctaattactttaaatactgtgtcacagaataattcagacattctagattcaaccagtgaaataaagagcaaacctaaaagcagaagaaaacaaagggatttgcaattacaagtttggtaccagaagattgatcagacctctcggttatag

SEQ ID NO: 9885 - DNA, 288 bp, Candida albicans
  unsure (180),(182),(187),(191),(193),(194),(195): Identity of nucleotide sequences at the above locations are unknown.
gaaggggggagcggaacaacggcgggggaacgccaaccccaggaaaagagggaagggaaccaagaaaagaacgaagaaaggaccggaacccagaccaaggggaaagaacaagagcgaagtacgggggaggacagaagagaaagggaagataagacatgggaggagggagtaagaacgaananagatnaganannntacccccccatcaccccatcccctctctgttatatatcggaggaactcttttttatttactccgtgtccactaatctttgtatcacacactga

SEQ ID NO: 9886 - DNA, 342 bp, Candida albicans
ttattgtccacttgttttgttttgaatgtaaaaaaaaaaaaaaagaaaggagttctgggtttgaaattggatgtcggcgaatttataatggaaaggttgttaagtctttcctatataatcaaacaagaaaaagaatttgaagtttggaataacaagatcccccgtcccctgtttaaagattattcctcatttggtcaaaaaaaaaaaaaatattcttatgtaatcaggtcacgtgataaatacaaaatagtttttacaatcaatataattcacaataaatggtataaattaagtactttatatataagtagtacgttctccccctccccccctcctccctga

SEQ ID NO: 9887 - DNA, 435 bp, Candida albicans
ttgccaagctgtctagaaaatgtaatttatttaatatatataaatatagattggttttccgtactttctctaatttcatttactaaaccacttgtcataccaatgtttttaataataccactaataatattttctctgttactgatcgggcaatcattattcatacccaccaccatcaccaccaccaccaccacaacaacaacaacaacaataacgattgaggctgataattcgaatttaataactttactgacaggcccacaattaattgaaaatgaaaattatattaaaataaccaaatcgacagatttgaatcaattatttagaaaatatccacgaggtgagattgtcaatgattttaatgatgttgatgatcttaatgctaggattttcatatttgatatggctaatcttctagaagatttacttgaataa

SEQ ID NO: 9888 - DNA, 297 bp, Candida albicans
tatttatttaaccccaggccaactaacaattcattagaatataaacatttatcaccagaaacaaattataccgtgggacgtgatgaaaatactgatataaaattctggtcacctaaagtatcaagagaattgattgaattaataactggacccaacataggcaatacccaaccaccatcatcgtcatggtcttcctattcaataggtagtgataaaacattattaatcaatagaatatgttgtcgagcgcagaccattataaatgggattattcacgagccgctggggatcgcaagt

SEQ ID NO: 9889 - DNA, 489 bp, Candida albicans
aagacctttggcgaaatcattgagcataatcaccagtataagattccattttacccatttcttaacgaactaatagcttatttgtcttatgatgttattgaagaaaattttcaacagcatattgtaaggaaattgttctataataaaaatgatcaagatctattattgaacaagctgtttatgaatttactggaaattgacccaaataatgatcttcccaaattcaatgtcaatctattaactatcgatgaattagtggaactccatggtacatatattgatagtattatcaatagtagtttattgaatgaaaaattgaaaggcaatgaaacaaatataagttatatcgatcaaatatttaatattttgcagactatcttcaatttcataaatacaagtcaggaattctattccttggtggttacttttggattgctagttagactggacagcaatgcaaacaaaatagaattggaacaagaccaataa

SEQ ID NO: 9890 - DNA, 219 bp, Candida albicans
aggatcttagtaagttgttatgatgtgtatgagttgtatagattaactgttgttatttttcatgttagattggcttgtaaagaattcaatttcgtcgattacagaacaagtggggacatctatgattaccgaccagatctctgttcagctcaaccgttgaattatatcacctatcttcaaacaaccgcggggactaaaattgatgaacaccactcctaa

SEQ ID NO: 9891 - DNA, 243 bp, Candida albicans
aatatgtatactaatttgcaaaacaaatgctggcaaaaaaaaaaacctacagtggtggttataataaattatagatatgaaaaaggagatgcagcaactgttgagaagttgttaattaggaagctttatacagtattactattattattacttgctgcaccacctgatgaaatattaaaaaattgtagtgttgcgtgtgtgtcaggaggcatgcgaaatatggagcgttcttccccgggataa

SEQ ID NO: 9892 - DNA, 186 bp, Candida albicans
gtgcacatttcactgttgcgatttattaagataatttggttaaatcaatgtaaatataatataatatatatatatatatttctaaatatattatgtacttttaatttaaatggtattttaatgaaatttaagaatcgaatcgaaaaaaaaaaagacaaaacaaaacaaaatataaaaaaaacttga

SEQ ID NO: 9893 - DNA, 234 bp, Candida albicans
gttatgaatatttttttttttgaggtttttgacaatatgccctttttttcttgcacaaaattgaaaactagaaatttgacgtcaattaattatgcattcaataacagtgatcatcatcatgctcaaactagaggtggtcatgggcccataaccaaaagaaaagctttgttgttctataactgtcaaaatcaccgttgtcacgattgtacatatatgtacctcttttatgtttga

SEQ ID NO: 9894 - DNA, 225 bp, Candida albicans
aataaagaacaaaaggaaataagaaataataaagcactcatacaactgcatttgaaacaaaattggtatgagttctgtttctttcattactctgtacatttcttgactttattcatttcaatttcttcacatattagttgtagtgaacaattccaaataggtagacatagttatacatattttacatatacattactaagtagtttatttaatcaaaatttataa

SEQ ID NO: 9895 - DNA, 372 bp, Candida albicans
tccattacaatgaccatcgaaactattgacattgatcttttccttggaattgcaaaacttcaccctaatgttattgcacaaatctttggttatttgcctaaatgcttattgccacatttattatatttcccgccaattagagagatcgctgcctcagtaattttgtcagacgtggaaattactgaagatgttgaaaggcatatgtggtttgatggtttccgcctgtgtcagtgcctccgattcaacatcaaactagacaatttgaaacaaggcattgctcaatggaatatatacccgcatacctttcatatggaacacgtggagcaatttgagagagtcttggatactctgtcttcacacagcggtcgctga

SEQ ID NO: 9896 - DNA, 246 bp, Candida albicans
gcagaccccaatactgtagagattgcactaaaatattcgtttttgagtctaactgtacttttaagctccgtgcataagttaaagagaagatctatggagactcatattttccaaactaagtgttcctgttgggtttttaaactaatcattactagttcaagatcaacaattatcagttcaaaagtgactaaaccattaattcaaagcctatcttttttttttttccttattcttattttaatttag

SEQ ID NO: 9897 - DNA, 189 bp, Candida albicans
gcggaattggatcccgaaattgatattttgaacacggaacaggagaattggtggttaaatctagaatgtaaaaaggtaccaaatcttggggtgaatttaacaaaaattcaattttttagcaattatcatgattacccccttaattctgatctatcgtccccttgtctaactaatcgtggtcgtttgtag

SEQ ID NO: 9898 - DNA, 201 bp, Candida albicans
ttcagtgtacttgtacccgtccttaatatgagttccaatattagacgatatcagaacaatattatttttcaattgatccacaaccatcgttttcttttatctatcagtagtaaattgaaaggaggggggatagaaaatgaactagaaaaagaaagtgatgattctaaaaaaaaaatttctcaaatacaaatactaagataa

SEQ ID NO: 9899 - DNA, 228 bp, Candida albicans
acacacaatgactttaacaggagtattcaaataatcttttatgtccaggatgggctggagttatttaaagtctctatctggactgcaaaccctttgttctttgtcctacgagatgatttgtacatattggcaccctgtagagcccctacagaagacatgtcatcaatccctacatcaaaccattactatgcactagacaacagaagcaacatattacaatcatactag

SEQ ID NO: 9900 - DNA, 243 bp, Candida albicans
agcactggtcgtgatataatagctctatttagaagccttgcagagtttacagccaacattattactatgactgtatcaaaatatgtatatataaaccagaaaggtattaaacaattaactagtcaaatgggctttggcgttctttatagaaaaaaaaaaatcgagaggaaaatttctcaccaaaattgttttccattttttgttttgtttgccacaaagtattttatatggtcgtgtaactga

SEQ ID NO: 9901 - DNA, 186 bp, Candida albicans
attactacaataaaacaccagcacaaatccatgccgctagcacctgtaatgtactataaggcattaatacgcaaaatatgtattattcattatactataagaagccaatataagtttctgatttatgctatcgaatcacatacactattatctaatcatagctcagaacatcaaaaggggaattaa

SEQ ID NO: 9902 - DNA, 183 bp, Candida albicans
tatccatacatacatacatgcgctctagactatattaaatacattccgtcccgtcgaatgccgtactccaataagaggacatttgatgcgaatttttttaattccttagacgatgaacaagcaaccacaagcaaacaaggcacaaacccttccattactgttgttgttgttgttacttattag

SEQ ID NO: 9903 - DNA, 378 bp, Candida albicans
gctcaaaaaaaaaagaaaaaaaaaaattctaaagcaaatatgatcccgattcaaccactcatggatttcgatcctttatctctttatactccttcacctcttcaaaatgaagaagtgctgatacctatataccaaggcttgtctgagattaaggaaaatgaaaacctttccgagacactacatgacgattctcatctcgaaccggttcacatattatacttaccgttattgcaattgaaaccaccatatgaagtgctagtctcgattttaaaattgctttccccggaagaaactttcaattttggtggatgtctagaacattttgaaaatacagcaatagactcggataccatttttcagggagaagggtgtaattga

SEQ ID NO: 9904 - DNA, 1431 bp, Candida albicans
agcgacagtgatttatttccagccatgccccaattcacaccaatcacaccgggaattttcaactacaatacatatatggcaactcaatcagtgcaaccaaacaataaatttgaaccactgttgagtacaccaaattctgttaatggtgtttctaattcgccggtacaattttcgcctcctacacaacaatatcctccttcttcttcttcttcatcttctgctcctgcttcaactgttgattctactgttggtgaaaagactggtgcaacaattggtttgggtgtgagtattgaacctgctgtaaagcacaaaaaacagccatcgcctcatcaacaagctgctttacatttccaacaacaattgaataatgaagctgcagctaagacacataagcacagtggcggtagttctactacaaagacaagaactcagctgagtccagaaatgcaaaagttgattgaacaacaaagagaaaagcaacaacaacaattgcttctattacaaaaaggtgaaattcctaaaccaccagaattgaaaccaaagagaaaatccagttgcagacctcataaacaaaagagaagatatattccagaagaagagcaatattatcaacaccaataccaacaccaacacagaagaattgcatctcttcctttgcaaactattcctggcgactctcctacaacaattgaagtctatagtccacaactggaagtatgcaatgacaatagttttggatgcaatactacatcattcattactggtggtaacatcactgccgaggaattgttgagtaatgatccatttgaagtgttggatgatcacaggaataatattttcccagaatttgttgatttggattttgaagatattggtggtgttgattttgaaaattccattgaaagtgttgatgttttaagtttgaacaaaaattcaagttcaacgaatgtttctgtacagcgtccaacattgaaaaagaagaaatctattactccaggtcctgccaaaattgccaaaactttgaaaaaatcttcttcatttagtaatggtagtggtatcagtggttcttcatctccaacattcattataaatccaaagttccaatggacaaagagtcagactacagaacaacaacaaagattgttgaaaaaaaaagtgccatatcaacatgctcattcattacctgatttgagtattcaagaaatgccggtgttcactttaagcaatcattatctgtttgtttatgaaaatgctgattcaatcttacaagatgagaatatcgaggagaattcacaaacatctccacgtaaacagcaacaactacagcaattacaagaacaacaatctcataaagaggttgagttgttgcaaaatcttgaatctggattggtggagttcaaacttgaattgaacaagaataaaatgagttga

SEQ ID NO: 9905 - DNA, 720 bp, Candida albicans
  unsure (620),(690): Identity of nucleotide sequences at the above locations are unknown.
atatacaccaacaaaatagatattatggcagaagtattatcattggttgacctcgagattcctcaagtcactgataagtattataaatttgacacttttaaacatttaatctgtcacttgttcaagaaaaccagcacagaaactgattcaaatgttcctatagtaataatattcccgaccaacaatgatatcccttcgagaaagactcgatctactaccaccaccaccactactactactaataccagcaagttagacaatttgccattcagtgataaatcgttgttgatacaattcttcttcacccatttgaacatattgatgattcaaggagagaattcggatgagggaaagttatatcaagaaataagttcagccaaagaattattgacaaataggatatcacgagttggaaattggacaggaacaactcattttagatactgtcgacatgagaatgattgtggactattgaatcaacattccaaaattgcaggaattatacccacaatgacttacattctcaattgtaatgcaacaagatcagaaattgccactaaccaattgatatatttatatcgactcatgatagaggagattaattttattgaattgttacnagatgcatctacgacaagattatctcagttgtgttatgctgtgggacattggagtttcctgctcataatntatcaaatgaacaattggtttatggtgttt

SEQ ID NO: 9906 - DNA, 237 bp, Candida albicans
tttactcttttggtttacactcttgataagttcgtagtatttgtattattggtattgtttatactttattctctaaatttattgatgggggttgaactgagtggaaaagaagaaaaaaaaatagaaggagaaaaaagaaacgttttttttaatttctttttttttcttcaactgtttgaagttgttgaaagttctccaagttttgtgtcaagtgttgattacgttaaaatatgttga

SEQ ID NO: 9907 - DNA, 186 bp, Candida albicans
tggattggtgacaaatctgtgtatatctttacctcgaggcgaaacgtttcctacggatttatttgccttactctttttaatcctttatttcaactttttcgttttgtttcggtttacaaacaattcaatttaactaatgcaaaactaattattaaacaagataaagaagaaaaaatttcagtttaa

SEQ ID NO: 9908 - DNA, 321 bp, Candida albicans
atttcaaacttcaatttgaatttgaatttttttggcagagtatctttctatacaatcaaactcatttcaaacactacaacacatacacatacacatacacatacacaaacatatattcatataatgcaattcacaactaacttattattatcatctttattattggctactttatttttaagtgattttgtcaatggttcaaaaaactatagacatattaaaagaaatgtagttactgttgttaatggtccaattgatagaactgatacttatgatggtccgatcccaactggttattactacaagcttccattcatcatc

SEQ ID NO: 9909 - DNA, 240 bp, Candida albicans
ggatttgaaattgatgtggaaggttgtgaaaggggtgcaaagagaaatgaccaagtaaaagcatgtagttctgtaaatagttggggtgtctgtaagaagatgtttactgttctaatttacgcaacaagccaattaggacttgactatagttacaacaagatttctgtaaaaagttcatatgaaatttcaacgaaatccaaaccaggaaaaaaaaagaatacctttagctcaaaaaactag

SEQ ID NO: 9910 - DNA, 525 bp, Candida albicans
ttcaaaattgtattgatgtttgtatactggataaacaacttgtgtgagatcattcaatgtatttgctggcggagaaggaggcaaggacgaactttttttccttcatacttttttttttctctctctcttttctttcagtcacattgtctgagtgttaaaggctggcttttctgtgctgaaccttgtggactggtaaacgcacgacatagagtaatatttggagaaaccaaaagaattttgaaaaaccgtggtttgaattcgaccacagattggttggacgacaaaatgcaaagtgtattcatccggacttttgctacctcaagaatagagttccagcggtaccagccgcgttttgttaataccattaaagaaacggtcaaatcggcacaagaaaagtcgtacagtattactagaccattggggttgtcaaaaccagttttgttaaatcataaattgtcagacacatactcattgtccaatatatacgaggagttgtttggtcaaaaatccaaagaaagaagatag

SEQ ID NO: 9911 - DNA, 189 bp, Candida albicans
aaaacaatcatttgcattcttggatatgcaacatttgtgattggcgaagcaaaagactatgcggcttgtgctccacaaggtatcatacaaattatggaagaacaattcttttcacaaaaatgggaggagtcaactcaatgtcaagacattgatttgatgtacggatgtctaacttcttggtgtacatga

SEQ ID NO: 9912 - DNA, 927 bp, Candida albicans
  unsure (790),(892): Identity of nucleotide sequences at the above locations are unknown.
gatattatagatctacaaatgaaaaaccagcgaccgaaaccacgttatttcatgcaagatgatgaccaagccatacacagagaaccaccgcgtcaccttcaactacgagtacgtagttttacagaaccaactccacattgcacagcagacagcacggacaggctagtgcaaacagcccaggagccatcatttattgaagatagtgaagatgaaatacctgtaattttaagttcaatatcaactagtatgcctcgtttcagctccatatataattcattccattcatccttagaaacgagccatttattagtgaatcaacattgtgacgaagaatttcaaatgcataatgaaaactttaatcctcaagattttgctgtgatgtcgcaattgagttaccgtcacgagtgtaatatgtcccagccaatcatgataagcaatgatgattcggatgtgatattgattaatctgacgatagaccaagacgagcatgaacatgaagaatatgattatgaaggtgagagaaatataagtattgaatcagattcaactgaagagtttgataagggaaacattcttttgggactagagagtgcaaaaatcttggcaccaaaagttgaagtaaacttttcacaggaaccaaatgatgatgagattttagaatgctcaacgcaatatggcgaagaagatgatgcgatagtagtagagtccgataatatgaatgtaaccctagaagttgagggacaacagtcggagaaattagcggagggagagagagccaaagttgacccanccatcatagaagatagcgagcaaagcaaaatatcgagcaattaccttcatgaaaccgaaaatgaggagatattagttgaaagctttccaggcgaaaataaanattgtccaagagatccccttggcaaccgaggatga

SEQ ID NO: 9913 - DNA, 204 bp, Candida albicans
gacaaccatttaattgcgcgtgtttacatttctcttttccaattcaatttccaccaaacttttacaaccaaaaattctagaactgtaccaagtcacaatttcttatttaccgttttgcttagacaaatacaaccacaagtgagatattatagatctacaaatgaaaaaccagcgaccgaaaccacgttatttcatgcaagatga

SEQ ID NO: 9914 - DNA, 186 bp, Candida albicans
aaatttatcaactccgaggcattacagaagttatgttatattgatagtatatgcacctgctataatcctacagaaactaatgttaattctgtgtttatcattaataaagggacgaataaaatgctattagttagtttgtatggtctgttgtctcggaccaatacatcgactaaaaaaaaatattaa

SEQ ID NO: 9915 - DNA, 183 bp, Candida albicans
gtgcgggtcctgtctagtcccgtggtgaagaatgatatgtgcaaatgtatgaatgttaataatagtagtatgagcaatgctactcaagctatacgaccacaccgtttgttacaactaccacttttttttttctcaatcatatcactagtgaatcctccaatacctgctatcttagctagttag

SEQ ID NO: 9916 - DNA, 183 bp, Candida albicans
gcgaaaagtatatatattcatatatctatacatatatggattatgagaaacctggagttaatatgcaagttacggacaaaaataaaaaacaatagcggggctgttactacaccatcaatagaccaaaaaacccatgattaccccacttggttaagaagcacccacccaagatgtagattctaa

SEQ ID NO: 9917 - DNA, 411 bp, Candida albicans
cttttacaagaaatggaaaaagctgaagatgctcatgaaaattatgaatttgattattttttaattatatcaagagtttatcaattagttgatccagtggaaagagaagatgaagatcacgaaaaagaatccaatcgtaaaaagaagaacaagaataagaagaagaaattggctaataatgaaccaaaaccaatagaaatggattatttccatcttgaagatcaaattttggaatcaaatactcaatttaaaggaatatttgaatataataatgaaaataaacaagaaacagattcaagaagagtatttactgaatatggtattgatcctaaattaagtttaatcttaattgataaggataatttagctaaatcagtcattgaaatggaacaacaattcccacctccataa

SEQ ID NO: 9918 - DNA, 192 bp, Candida albicans
gaagattcatgcaacatggtagcttctgattttttttgtccctttcaacgtctttctattatgaatctaaatttactattaattactattggatattactatttctacaagtctatatatttaactaagatttatgtttttgtttctggttttggttttgattatgagaagcattactcttcttactgttga

SEQ ID NO: 9919 - DNA, 396 bp, Candida albicans
aattcaaaacattcttcaaatagtgccacaataagttggtgcggaaatggaaaattaatggatttcaatggacttaatatcattcaatatctcaattttggtccagcttatttaatttcaactaatacccatcctaattcttctgaaaataatgttactacaaatccaattcaagcgttgcaaaattataaatcatgtaaaaacttgactattgacggattgaaattattgtattataccaaatgttataatataaaacaatgtcaatttataaggtatcatttatatcaactttatattaaaaattttggttcattaggtcaaaatgtcaatgataaaaatattgaatcttattataaacatttagatcaattattctataaggtttggaaataa

SEQ ID NO: 9920 - DNA, 576 bp, Candida albicans
ccaagcttacaaatgatcttaccagctacaaccgcgacctccttttctgaatcagatcattctagttacttatccaaacgatttaatacgggttctacagcaaatagcaaatttattgttttaggagccatgttaggttcaattgttggtttccttactgtttattatatcttgttagaaatcgcgatgccactttgtaagttatgtgagctgaaaactgataagtcttgtgaacatacttttataaatcgtcaatttgatgaagtcgttgaagaaactctaagtcgtccccactcacaaatgaatacatccaacataaattcaacagcacactcttcctccgcagggcccaataattctcaacaacaagaacataaagaactcacaccagttgtgccagttgcaaaaaatcaatcagaatatcatgatgatttggttcctccatatacgaaagctactacagaagaacaatatatgggaagttttgatactaatggagaatttcatccaacgaaaaatccaaatacattaacaactccaccaccagcacatttaagaaacacgaatgatgtataa

SEQ ID NO: 9921 - DNA, 288 bp, Candida albicans
cccaaggcttttataaatgctaaagccaatccattacctggaatagcatacccaacaatcaattcaactaacacattaagaccaaatccaaacatcgttcttgattgcacagttgttaatggaatcaaaaacacaaagttgattgccaaggcaaagaaaatcccccaaactggtgtttcagcaggatataatttgacacataatatagccaataccaatgaaataacaagaatgataagatatgcccattcaggaacttcaggatatgctctcatcataacactatga

SEQ ID NO: 9922 - DNA, 783 bp, Candida albicans
ttggtgaaattgatatcaccaataattaaatatctttatggtaaagttttatatttacagaaaataaattcaacaaatggatggtttaaatatttaaaattgaaaatattaattcaatggaaatatactattgcatgttttaaaaatgattattcacaaacattatcatcaaacaataacaccaacactaataccattaccaacagttttcaaaatataattataaaaagtttgactactttaatttggccatttttaagttcaaaattaaatgaattattcatatatccaatcttcttactaaacaatccaaaatcttggcttgcaaataataatattaatctcaacattggtgtttttggtttatcaatggataagaaaattttaattggtaatttattaggattaataatgatttctataattaaagaattgataaatttatatttaacaaaattaaaagtttatcaaatgtcaaaaattgaaactttaaattcacaagatagtcaaatattaaaagatgtaacttcaactatattccatccagaaaatatttctatcagtactaacaacaacaacaacaacaataataataataatgctgataatgatatatttcctgatcttaataatatcactactactggtgatgataacgatgatgaagatgaattggatttggtgactgatgatagtgatgaatcatttacaatgcatagacttgttgaattgggattaattgatgaatcagattttaatattcctggtggtttcaatttttga

SEQ ID NO: 9923 - DNA, 255 bp, Candida albicans
acttttaattttgttaaatataaatttatcaattctttaattatagaaatcattattaatcctaataaattaccaattaaaattttcttatccattgataaaccaaaaacaccaatgttgagattaatattattatttgcaagccaagattttggattgtttagtaagaagattggatatatgaataattcatttaattttgaacttaaaaatggccaaattaaagtagtcaaactttttataattatattttga

SEQ ID NO: 9924 - DNA, 456 bp, Candida albicans
ccaactgttgaaacgactactgaatctgtaccagttaaccaacatgttgagaaagaaaatgaaaaagttgaggtaccaccgccactggaacaaccaagttcagaaaagagagaaaaagaagtcaacggatcaattaagaaaccattggaaaatgaaagtaaggttgatattcctcaattctcatcaaatatcacagctcaaaatgaagaagcaaaatctggagaagaaactaaaaaagatacaaccaagacaagtccagcaaaacaaggggaagttaaggaagtaataccatcatctacagaaactgtatcaaaaccagatgttgaaaaagacaataaagagaaagacaaagatgaagatgaagtgatggctgatgaagatgacgtcaaaaaagatgaaaatccagaacctccaatgagaaagattgaagaagatgaaaattatgatgatgaatag

SEQ ID NO: 9925 - DNA, 183 bp, Candida albicans
aataaaactcgaaataaaataaaaatcaaaaaaaagagcaaggaggaaattgtaatgaatatatatgtgaatttcaaaattagatacaatcacaatgaagagggacttttgaacttatcacattcgtttatatttttgaaattagatttcccattatatgttcaatttgtcttcgaccacgag

SEQ ID NO: 9926 - DNA, 183 bp, Candida albicans
tactatacacccgcatttatacctttgatattgtgtgtggctaaaactagtcaaaaacgcttgttgaaagcaggtttgaatggtttgcgggtgaatcaatcacaaatggagagtttgtatttcttgttggggtttctggaatcaagttggtgtctaatgtgtctaacgaacgattgtggttag

SEQ ID NO: 9927 - DNA, 204 bp, Candida albicans
gtgcagtttatcagtaatagtggcttccaactaaccatctaccgacgttttacatcttcaatccctgagttaaatcagatcctatttttattactcttctcctccattgttagtggtgtgggtaattacattatgtacacatggattctccatagactaaagaaaaacgataaaaccacaattctcaatttctgtatttcctaa

SEQ ID NO: 9928 - DNA, 246 bp, Candida albicans
tattattttctaaatcatattactgatgaaatgtctattattgagatttattttaattggaattacccattaaccaatcaagaaacaacattgtatatacctcaaaaagtaataagatctatagttctatgtagaaataaacaacttgtcctatacatatactaccaactaaatataattaaccaaagttctaatattaaaggatatgtattttttatcaatgagtataatgacaaattaatctag

SEQ ID NO: 9929 - DNA, 195 bp, Candida albicans
agacacttataccataataacaagaaaaagagctttctatggagaatttcatcacatatggaaggtaaaacaaactgcaaaccaccagaaaacctgttttattcaaattttcgcaaagacgatcgccgggtagggtctaaatgtcaagttttagttgtttttgttcaaattttcgcaaagatgatcgccgggtag

SEQ ID NO: 9930 - DNA, 189 bp, Candida albicans
agcctacccggctatggtctttgcgaaaatagaaatgaaaaatatggcaagtttacctgtgtgaacactacccggctatcgtctttgcgaaaatttcaattaaaaccatcgaaagcatatggtctgaaccctacccggcgatcatctttgcgaaaatttgaacaaaaacaactaaaacttgacatttag

SEQ ID NO: 9931 - DNA, 933 bp, Candida albicans
atttctttcactcttccaccctcccaattgttacttttcaaaatgatcaccgctatacttttgcttatagcgaaacaagtcactggagttgaacttcaccaccatcataaacatgccagtaatataaccacattatcaattacacccactttggtagctcgagatgccacagaagatgccatgccaacattatcaactggtgaaccaacacttctcataactcatataccagtactgaaaaacccctacatatattcttcaaatttaccttccaatttagtcttcatagtcattggtgctattcttggagccattttattactgattaaattatatcgaataaatgctcattttaaatataatcgaacagccatgaatgaaaaagaaacttattataccaatttaacggaaatattgaatcaaaaaggtactccttattcaagaaattcatcaattttagatctcagtaatagtaataacaacaccactgatttatcaagttcatcaacatcatctaatcaaggtcgttcttatcgtgatagtgttttaggaaataataaaccaatgatgacaaataaaccttcaagaaattcaatgttcattagtcccactatggatcttaaaacttttgaattgccattatatcagaaacaacatagtacttctctggcatcattgatattgagatataataatgatagtagcacgattgtttctacagcgtttgatgagaaaagtagaatcaccaccacatcaaccacagtagatgggaatgagtcttcaattaatgggtctactattaatggatcatatttggaaaatgggaaattggctccaccacctccgaaaagagttgtacgtgcacctagtttatatcttgaagatttattgaatgataaatcaaaagatgataaagaagaagaaggggtatag

SEQ ID NO: 9932 - DNA, 762 bp, Candida albicans
catttccatttatatatccacttcaatatgattagaaattcaattaaatcaattaaactcaattcaattgttgcttcaagaacaaccaccaccacaagattggttcattcttcatcaagaattttagctaaaggtgattcatcaaccattgattcatatagattaccttcacaaacatcaattaatgaatgggaattcaaatatgatttcattcctaaaacttcagaaccaaaagttcctccattgactaaagaagccgttaaacaagatattgctcatgaaaaagccaaatccgtggaaagagaattatttgctaaagaaagtaactcttcaattaaagttgaagctaatgatgctaaagtagtacatggaggtgaaagtgttgctgctgaaccagtattaaaagaagataccggtagtgctccaattgatgtttctacaccaaaatcaaatattaatgtttcttcttctactacttctactaaaccaaagaaatcggccaatcatgataaatacgttcaatcatcaattaatccaaatatcaattctggtaatgtggttaatttaagtgaaggtgaagtcgatcataaaacggaatcggttgataaacaaagtcctgttgttgaagatattgaacatgataatttgacttatcaaggtgaaatcaaaaaggaatcaagtggtgctgggttaggaatctttgccttgttaggtttaggtggtgctggttactattactattcatctacttcgaagaaataa

SEQ ID NO: 9933 - DNA, 234 bp, Candida albicans
atagtggtagtgcgaatcagtccaacaattaatgcctggttacgtaatcaaaaaaagataagctcaaaactattacagtcggaccagaaatgcttcgaaacatgtattaattctataaatgctgataaacatgataagttatttacatctaacattatgactagccctataccccttcttcttctttatcatcttttgatttatcattcaataaatcttcaagatataaactag

SEQ ID NO: 9934 - DNA, 183 bp, Candida albicans
ttagagccgtgggatgtggggttcatttctcaatctgttttaactgtagcagaaaggattgattggtgtagttattctccaaatattgcagcaatccacaaagtggttgtaaaaaagaaaatagatttgaaaaaaagaggaaatttgacaaccagtgccatccatctgaagagaaataaatag

SEQ ID NO: 9935 - DNA, 312 bp, Candida albicans
gatttcttacatcaagcagaatctaattgtcagccatcaatttggtttcacagtaagcaccagtacggcctcgaattgtgtgtgtatataggtgtgtacagagtgataaaatttgttttaaaacataattttgtcactaaatcaccatcaattgttgttttattttttttttcttttttatttttttacaacaccaaaaagaaattggaaagaaaatacaaaactgacacaacactatacaacacaacatttgcagataatgcagtatatatacacatgcaaaagacattcaaaaaatacaccagtaaatga

SEQ ID NO: 9936 - DNA, 213 bp, Candida albicans
atcaaattgtcttcaattaaatttttaataaaattttataattttaattactttctaataagaataagattattgtttttttatttaaccagagttaaaattcctacccaagaatcctacaactttactttatttgtggtttcttcattactttcaattattgccactttcatcagctccttcaataaaccacaaccttcatttgtcatttga

SEQ ID NO: 9937 - DNA, 249 bp, Candida albicans
aacacgtgtataattgttacacaatttaatttaaacagtcttaacaatagggtaaaggaaaaaaaaaaggaatttgttttttacccttgcgaaattttcgagattttaaattttttttctgttttatatttggaaactagaaagagtgatttatattttataatcattttattttcatttgttgttgttcctatttttattaccaaatatccatattatttgaacaaccaggacattctttccaactga

SEQ ID NO: 9938 - DNA, 1143 bp, Candida albicans
aaagtccgttcggaatcaattagagttatccattctttcttggaggcaaaaccaataagggaacttaaaaaatgcgtgttgttcccccgtgtacttggtaagactgatgatcttgatgatgagacggtacgaaacacgaaactaaatgcagagcttttccatacaagcaacgactcagtagaactataccgccaggaaaacaactcttctgatttgttgggcagattatattacgacgactatgattccgattccatgacctcgccgtcaatttcaggtgtcagctcccccatgccattatcaccgatcatgtcacctagtgagagttcagaccagctcagcgtcaaatcaagaccaccgtttctacgcatgaaatcaatggaacgaggcatttcattcgacacttctccccatggccaccagaaatcgtacacccttaaggccaaacatccacttttcaagtttcgtcgtaccaacaaaacatttttggtcggctataacgacgacttggagtccacgaaagctattgagtggttatttgacgaaatgattatcaatggtgacaccatagtggttctacaggtattggacgaaaaacaacacgtatccattgacaaatcgaaggtccagaaaaacttggctaaaatcgagcaaatcaatcaccatttcaagaaagtttgtatcatctacgaagccgccatcggtaaagcaaaaaaggcaatccggtcagccattgacgaatatcgcccatcaatgatggcgattggaacgcaccactacgacggcaaagagcatcaccggtcattcaccaaatcgtcgttgtcaaaacacattttagagtgttcgctagtcccaataatattggtgaaaccaagttaccggtatgtcgagtttttgagagaagaagtcgatggtccgcagtactttgagaattggattaaaaatatcgaccatatcgacaacagagtaataagaaaaaaagttcctttgataagtccgtctgtctccagaaactcttcatatacaaatttggttaatgaagatcgaggtaggggcggtggtgtccacgaccaaattcttaatgaatcgcgttcaaggtcaacctccaaaaatagagtatttgctaggttttttaagaaatag

SEQ ID NO: 9939 - DNA, 348 bp, Candida albicans
ccaactctgacacttcttcttttgaaaaagtccattactttcctggctgcacttgtttctttagtcgcagtagatgctcgttttgatgttgatgacgatgaggaggaagaagctgctggagcagatgaggatgacgaagatgttgttgattttgatgttgttgagccatttgaatttgtttgtttggtctcctttctcattatattagtttcattcgaaggttccaatacttttctagttgtgttcatacttgttggtttcaacactgtggtattattttcagaattggaaggtactttgctagttgcaagtgaaacatttgagtttgatgaattgtatgaactgtag

SEQ ID NO: 9940 - DNA, 705 bp, Candida albicans
gatgataaaagtaataataatgttttatcaatgattttcaataattattccctaagcaatattaaattattttatcaatgtttggtatttcaaggtatttttttagtattattgaaaaatgctttaaatgggaataataattatccgaataataatccgtccacttcattgccaaaatttaaaattaatttagagaaaatttatcaatttctgttacatcaatatcaaacaactttaaataaaatattaaatcatgaagtttgtcgagaattacaggaaaatattacgttattcaaattaattgccaatttatccattgaattcaatcaatatttaattaacccaataactaacaataaccctaaagataaagatttggatttgacagaattaatttatgatttaaaatctaaaatttcttcatcaaattgggatttattattaaattatttctttggttcaaaagataattttgctagatatattgaaaaaatttgggatttatttcaatatttaaagattgatccaacaaccacaacaacaaccagtacagtttctacaactgatataccaataacatcaaagatttatttaaatgatcaattaattgatgatgttatggggaaatttagtggatttaaatttgatgaaaatgtcgttaatgaatatttcaaacattgtgttgaaccaaatatctttgaataa

SEQ ID NO: 9941 - DNA, 291 bp, Candida albicans
aagtataaatttctttcttgccgtttgactttttcattgtattgggtttatcttcttttcttattaataccagttctattatattgtcccttttttttggattatttaataaacgtaccaaccaaaatgcctgttcaacagtctccttcgaataccacgccctcacagcaagagcaatttatattaattgttgcagcaataatattacctccattggctatatttttgagcaaaaagtattctcatattgttatgtcgaatgcgatacattttgtcaatactatagaatag

SEQ ID NO: 9942 - DNA, 603 bp, Candida albicans
tgcggtaccttccagcgcccgtgggctgaaaacaacgatttagtttacttcaaccaagtgtttgatatggcgacaaaacaaacatctgatccagacccagattcatatgttgaaaattctaacaaaactattacattaataactttggacaaaccaccaaacaacgatacaaatgctgtcgacgctcaatttaagaagaaaaagggtaaattaaagcccaaatgggaattgaatgctggtgtttatttggaaaaaaaagttaataaaaaattgttgaaaaaatctaaaaagaaaaactcaaagaaatttggaatcttaactaaagacaatggagatgctgaaagaatcttgatccctgctgaattaatggtttctcgagctactcctggtactcacaatttgttttctcaaaatagttcaaattatccttttcaattgacaaaaatcaatgtaacatcaataagaaaagcacccgtattgtccacttcaattgcccatgaagtttcggacatcaaccatggaatcgtcgagttttcaattgcgagtaaagtctttgataaattttggaatcaaatattttgggcatttctctatattttgtag

SEQ ID NO: 9943 - DNA, 240 bp, Candida albicans
attgctcttgctgtgagggcgtggtattcgaaggagactgttgaacaggcattttggttggtacgtttattaaataatccaaaaaaaagggacaatataatagaactggtattaataagaaaagaagataaacccaatacaatgaaaaagtcaaacggcaagaaagaaatttatacttttaaactttgtaatttcagttctagtattctctactcatatattttttttttgcctcactaa

SEQ ID NO: 9944 - DNA, 573 bp, Candida albicans
atagacaaaaatagtgcgcaatacacgacctatatgatgaaaaaaaaaatctctgccaaaaaaaaaaaccaacaacaacaacaactacaccaaccaaccatgagtgaagttactgaagaagaacgtactcgttatgaggaggaggaggatgttagagatagtccatctgattcgtctgaagaatctgaggatgatgaagaagagatccagaaagtgcgtgaggggttcattgttgatgatgaagaagatgaagtacaaaccaaaaagagaaagtcccataagagaaagagagacaaggagagaccacactacgacgatgcattagatgatgatgatttggagttgttattggaaaatagtggccttaaacgtggcagtctgtcgtctggcaaattcaagcgattaaagagaaaacagattgaagatgatgaagatgagattgagagtcaggaccaccagggcgaacagcagttgagagatatattttctgatgacgaagaggttgaagaagaagcagcgccccgtattatggacgagtttgatgggttttacttacaccacggggctggaagg

SEQ ID NO: 9945 - DNA, 189 bp, Candida albicans
tatagttgtagaaattatgttattttagacaatggggagcaaattaaaaagtgttggtgttctccgagattcgcgcaacaaattccattttttttcttcaatgtcaaggctagagaaattgaaagagaagaggagagaggggcaaaaaccccaacaagagagaaagagtttcaagacaacaccaagtga

SEQ ID NO: 9946 - DNA, 528 bp, Candida albicans
tttattgaactactcattatgaattcaatcaaatcattagtcaattcatttgacaaattctatcccaatagtacttttgacgattcagtgatactgcaaataaatgatataccagaagaagaagaagaggaaggagaagatgatagacaaaaaaccttagtgccgataaaattacaaactgataagtcgttgaccgattcgaaagattcattgtcggaaaaacatacacaacaagtcgaaatagaagaagaggacaacaacgaagaagaagaagaagaagaagaagaagaagaagtagacgaagaagaagaagaggaagcggaagacgacgacgaagattcaataaacttaattgaagaaaagaaaaagctagatattgattcagcaaaatcacatcacgatgaacaatttcgactgcaaacccaccaagatcaacaatcaatattattttttattatcattttcattctacggtgtgtgatttttttacctaacaatttaattataaaaccaattttatatgcatag

SEQ ID NO: 9947 - DNA, 189 bp, Candida albicans
ataataaaaaccgttattcctctcaatactactacttgtttcattttggtatttgtgttttacggggacggacgatggggggggggggggaacataaatgcaattggacaaaaaaaaaaaataaaaattagtttatccatccactcacctttcaaattattgataaaatattcttatacattgttgtaa

SEQ ID NO: 9948 - DNA, 276 bp, Candida albicans
tccccgaatttgcggtggacagtcattcccgaggggaaaataaaggaaagcaaagcaaagcaaagcaaagcaataatacaaatatttttcaagtttttttttttcttttacacgaagagacacaacgatgatgcacatatacattacatgataataaaatcttcgttggtgtctgtctatcatcttacacaattagaaactactattccaaaaaaccttcaagtttttcaatctaaatcagatttagctaatattgacaaggaagtgaaagggtaa

SEQ ID NO: 9949 - DNA, 273 bp, Candida albicans
cacaaagaaatgttcgaacaaaaagaaagaaagagagagtgtgaaacaaaactaaaaactaaaattaaaaatggcaagaaatccctagcacaggcaagtaacaataacagcaagattttcatttgccttctcttctcttcttttattttgttttgttttgtctttaaccgtctgtgcacttttgcatttgaagttaagaaaatattttacttgtctcagaagagtctgggcgatttgttgcattcgtggaggaatgttaacacaattttgtaa

SEQ ID NO: 9950 - DNA, 189 bp, Candida albicans
atggatagctcaaggtggacatctataaatgagagagagagagatggtctaaaaactgttggcatatacaaacccatagacaatccaaattataataatttgggtatatcaatctatatgtacatatatatgtatgggtgtactttatttaactgtatctatttacaatgtatttcatttatattttga

SEQ ID NO: 9951 - DNA, 339 bp, Candida albicans
tccaacgcattaaacaaaacttcgacatttagaaccaatttcccagttaccactataccgttgaatttgttaccagtacaagcacataataacatatcggatatacacttggcagttatctcctcatatccagaaagcgtgacccaacatttcaacaccacttgttcgatttgttgttcaatagacatgagcatggcagaatcaaccgaaatgtggctttcgttgtcatcttttaccaactttaatccattgagaacatcatctggtaaatcaaacaatttttggagaccaactgaatctggagtaatacaaacgttccaaaatttatgtaccatataa

SEQ ID NO: 9952 - DNA, 204 bp, Candida albicans
atatatatacatatatatatgagggttttttttttttttgcaagaataaaagatatagagagaaatacaagtaagcatgtagagtttttagctatacaaccaaggaaatacatcaaacaatacaatacacagcggcatatgacctctgacatcttttttttgcagcaaaatgaaattagggctatagccctaacatgtgactaa

SEQ ID NO: 9953 - DNA, 207 bp, Candida albicans
tgggaggggggggggggggtaagacaaagatggttctggattggctcaagatcgtcaatgaccatcagtcggaggtttactagcttatccgatatccccgctaaagacaataacatgaagaatcaccttatatgcagtcctcagcactacaatcgtaacaatatatattctcccttctttgtcttcaccacggcctggaagatccgc

SEQ ID NO: 9954 - DNA, 306 bp, Candida albicans
ttatttgcagcgattgtactttggacaatctattatatttcaaaatggaacaataatgacagttacagcttttgtgataatgagattattcttaacaacaaaccagcatcacaaattttcccaattttgtgctttcatgtaacatacttattgttattttctagaaaaatacacgttatgctgtcatttgcatctaaggtccacaaaagagatgaggtggcttcaaactgtatcaacagctgtcattttgatgatgcagtagcagattatctgcttcctctcctcaacgcatatggcgaattatga

SEQ ID NO: 9955 - DNA, 240 bp, Candida albicans
attaattttgataatttttgcttatttttatttaacttatcttttcattttatattatccgttttattacaaatttttttttatcctttttcttacactttctattttattttacttttaggattttactttttgattacttttgaatcttataacaagacatcctcaatattaactgttcactgccgttgcatttcatcaaatattagattgaacttctactttatatttaagagataa

SEQ ID NO: 9956 - DNA, 1317 bp, Candida albicans
agttttataaatacatacatgtctaatacagctaataaacccaattatagattcaataatcaagatcaaatacaatccaaagataacaaagaaaatggtcgagttgcaagaacaatgactaaccatcatccatatctactgaaaccatcacaacagagggataaaacatctttaatacccaaaattcctagaaataaacatattcgtcaacaacaatccccaccacaaactgcacaatctccacataaaacttcttatcaagatgatttattttcatttataaattttaatgaatttgaattttctcaacgaggcactttattaaaatcgaaaacaagaacaccaaatcaatttttcttaactaaaaaccccaatcagaataaccccctccttgaatctaattccaaaattcaagataatgatgataatagtgggagtgatactataaatagtaccacaaataataccactaacaataccaatactaataataatatcaccaccaccattaccactaatgattgtagtatattttcaacccttgaaaataacaagaatagaaatgacactactgttgccactagcacaatttacaacattagtaataatgaattagttgatacattatctattgtttcatctaatttgatagttgatgataaatatcgattgaatattatttctgatgatgcttcatatcaaccatcacatgttaacaataataataacattcataatggtacaataactaccaccaccactactactactaccacatcaatagttgaagccactggttgtagtagtagtataattactcctacacaaagtactaaagtggtagtgggaaaaaaattgattgatcgattacatcatagtttgattgattatactagtgatcatgtactgattgaacaaggatctattgattgtagtattgaatcaggggaaaaagattacaattgtaaatttaatactcatcatcactaccaaggagaagaagaagaaagatttggtgacaataaatattatcagaatattattcatcacaatggaaatcaatgtgacaatgtatctccctcaccatcattatcaccaccatcatcttcgtacatgcaagatcaaccatcattagatttattaatattatcaccacaaaaatcaccaacaactaatcaacatcataagaaatataaacgaaaattattaaaaccaaatactacaacaacaacagcaacaggaacaccaaaaatttcaagattatctttattagattcactgcatccaatggattcctatacctacattatccatcca

SEQ ID NO: 9957 - DNA, 282 bp, Candida albicans
aatccaactaaagccgtgacaaataatcctacccacttaacagaacacacacatcctattgaaataccggtcaaaatataccatttgatttccaattttgttagtggagtcttggagttgctaccaacacgggctatggctaaagtgtgtaccttaaccaaacaatacattgttaaaactgtgaaaaatagtagcattgaatccaataaaataaacttggataatgtcaatgacaattgttcaaaaatcaccatgaaagcgatcaaccaacaggtgaactga

SEQ ID NO: 9958 - DNA, 240 bp, Candida albicans
gcttcgacaatattagtaatgaccattggaacaactgccaaggggaaagataaaagattaaataacgataatgctggaaacactaaatcagtggataaacttttatttgaagtccatacaaacacagcaaatgtcgaacaactaactaaaaatggagctaaattccatgtgaaattagatgatgccatgaaaatccccatttttttcaaatttttcaattctttttcatttctaacataa

SEQ ID NO: 9959 - DNA, 192 bp, Candida albicans
  unsure (11): Identity of nucleotide sequences at the above locations are unknown.
gcgcgggatantccagccctttgggcaagatatcgtcatcttccattattctccttatcatcatctaatgaatttacaaccatcacaaacaaccacaataacaacacttcatctcaatatcaaggtttaaataaatggttaagttgtaatacccaacgaagatggttggggtccattatcttctacttataa

SEQ ID NO: 9960 - DNA, 684 bp, Candida albicans
aaccagaagtcaatcatagatacgataatcccaattatgtcaactgaagtcaaccaaacagtctccaaagtgaaaggagccattgaagatgaatcaataacagaacaagaatcaggttttagatatgcagcttatgcaaatagattgagaactattttattggcatcacatcgttacgtagcatacacttcagatatcggagagtctttccgtccggttgctcatccatatttagtgaagtcgggatacgcagtgtcatggctttatattttgggtgatgtctcttacgcttcttggattaccaaaatgaaagccgaaggaagatacgagcctggtttaaaaccttgggacaaggcaccagctcctaatgaaattgcagctaagacatttacgtccactcacagtttggtggactctgattggagatggagtgctttgaagagaggtatatttcagagtattgcgtcaatggggttgcccgcctttacaattcatagttctgtgcgttattcttcgtacttgttcaaaaatagcaaagttccagttctcaagacttatgggccagttgctatcggtttaggtattgttccagttttgccttatatctttgatgaaccagttgaacatgcagttgattgggtctttgagcaaggtgaagatatctaccgtcaaaaatttaaatga

SEQ ID NO: 9961 - DNA, 183 bp, Candida albicans
ttgacttctggtttcagtacaatgttgcccaaaaaaaaaaaagaatgctacaggaaaattcagcatatggtgaaattattaccgaacgagagacatgcatttttgccacaacaaaagaatattattatactacgcccgcacaatagcaacagagaactaaaaaaaagaaagcaccaaaaataa

SEQ ID NO: 9962 - DNA, 225 bp, Candida albicans
aacattgctgacccaataagcccaaattcctcggatgtcgatggaggatcaccaatgaagtctccaatagttaatggcgagagtggtttagagtccccaagcttaagcaatgctgattactctgtggcttcattcagtccaagattccattcttcatttcctcaacctccttatttaccaggaaactccatgatgacaaactccaacgtatcacttgtgtcatag

SEQ ID NO: 9963 - DNA, 726 bp, Candida albicans
agacataagcgtggatccggcgagtggctgagtgtgaagacaaatgctgaagatcacgagctagttgacaggttacttttgggttgctactcggtcttgggtattgatgtgagtaccttgatacaggatgattattcaaaatatcctaatttcaaaattgaattggataaaagaaatccgtgcattgttaatggaaagatagttgtcaatcacttacagaaaagccaggaatcagacgacaaatcatcccaagaacaagaaactagtgtaccaactgactctgataattctttggatttgcaagtggattcaaatatacaaaaggagcaagatgttagtgaaagtaacgaatatgatcaaagtaacatacctgaattgtcagctgattcttctacttccattctggatatcaacactgtggatactgttaataaaaatattgcaactgagataagttctaaaagcaatttaccagaggtggaacagttttgcaaagttaatgatattattgtgactgatactgaatgtgctaaggatgaatctaaagttcagcccacagaagaatttgaaagtgttattcaacgtaatgaaggagggcttggtcttactgttaaacttactccagttaagaatagatcagcgattgagacagtatctcctaaacaagaattcattgttaaaattgtgaagaagaaaccagaggaacaagttcaagaatcttcctcc

SEQ ID NO: 9964 - DNA, 672 bp, Candida albicans
  unsure (667): Identity of nucleotide sequences at the above locations are unknown.
ttacacataataactacaattctttttacaataatgccagttcaacaaagagaccttttttcagatattaacaacatcattagtgccggtgttggtgtcgccaatacagttgcttcagttggtgaacacgtctttgtcactttgacttcagatgctgctggcaattggcataaggccacctccggtgtggtcgtggagttcaatactctcacttccaaaggcgcacaagaattccatgtggtgacaagtttagctgacggaaaattctcaacagtcaccaaaggtgtggtgtcaaattggggcgaatttactagtgagattgaatccaaaaaagattccttaacagctgctgctgccgctgccactgaaagtgccgcttccacaacaggaacagaaaccgtcagtaccgattcagcttctggttcagcttctggttccggttcagcttcagctgcatctaatggttcttcctcaactactgcagcttcctcctcaacccgttcaggaagtgattcttcttcttctactgctacttcaagtagaagctcctcatcatctagctcaaccgcaagtggtaatgctgcaccagcagtttaccaaccaggtagttggaagaaatcagcagttgttggcggtttgattggtttgtcgtttattttgagcttancttga

SEQ ID NO: 9965 - DNA, 213 bp, Candida albicans
aattttcatctgtcaaaaataagaaatagaaaaaaaacaacagcagcagcagcaaatagacaaattgtggtgttatctttgagggaagtgttattgcttatcaaatatattttgttcatttattttttaagagggggccagatttgttatattttgagattgcatgataaaaaaaaatttaatggtggtggtggtggtgggttggtagattga

SEQ ID NO: 9966 - DNA, 210 bp, Candida albicans
tggtggtggtggtggtgggttggtagattgagtggctaccagtggggagaaaaagtgaaaaaaaaaaaagacaaggcaccaaaaaaaggagtagataaactaaatatatcacaaaataaaagattagcatcaactgtggtggtagtaatagtagtaatagtagtagtaatagtagcaattgaaatatcggcgaccaccaaatttcactaa

SEQ ID NO: 9967 - DNA, 582 bp, Candida albicans
aatatattaacgccatcacaattccaacaatgtgtccacttctatgaagctgatcagaagttggaccatgccgagagggttgcattggccacacaattgcaaacgcttgctatgaagacgagtttggcagggtatactacgggtatgctcgggtttttcgctccaacgttttattaccgtgctgttgggcgggttcctactccgttgtttttggtgcaaagaccgtttttgtcgttggtattggggtttgggacgttgttggctgggaataaccttacagcaaagtatttgtatgagaagaaccgcaagcaaggctttgctaaccaaaacataactgatgtttggaagacgatggatttcccgtatctcaatttctttacattgtattatagcagaacgtcgatgttcccgaactttattatgagagacccgagaacatgttcgtaccagctgctcaaacaagagaacctgcatttcactcaagcaatcaagcttgggcatttggatagtgaaggtaaggaacatgtattgtctgtttgggataaggttaggttaaaccatggtggaggtgtttcgaagtag

SEQ ID NO: 9968 - DNA, 672 bp, Candida albicans
ttcgcaaaaatgaaaaaaaaaaatttcgcaccactttcttttctttggttaattatgtctgacaatattttgagagataggttggggccagagaagtttgaaaaggccgttgagttttatgatgcagatcagaagttgactccagaagatagagtacaaatacgtgatgatttgaagctggttttggtgggcgataatcttgcaagttatgggtccggattgatcgggtttctaatgcccactatatatatgaggtttttcaagaaggggctggtcaatgcaaagtcgttttttcagaaaccgttattgtcgggggcaattggggtagccaatatgatggtgacacaccggatttactccaagaagttgtttgatgagaaagttagcctggggttaccggaacgacaattgaatgtatggaaagcaatggaacagcgtctgttgggggtgtatatgttttattatgccaagacggcccaggatccaaagtttaagttggaagatcccagagagtatacggaggagaaccggctcaaagtgagatttgatccagaaaaatataaagaaggtcatcctcacgacgagttatcgacgtgggacaggatccgtctttccaatgggtatgacataactgaagaaaagtcggcctgggacgagattaggagtaaatag

SEQ ID NO: 9969 - DNA, 576 bp, Candida albicans
ctgaagaaaagtcggcctgggacgagattaggagtaaataggtttataaaatgcgaaaaaaaaaaattctcgacaaaaaaacaacacgtagacacccaccaccaagcagttatggacgcatttagtgattcaggagagttgtataccattaggaaccagttttatactaatcagcacaataaggtcaaggcgtactcgcttgatgagttttcacccgaaaatcaattgaaggtgttggagtttcaaatcagatcgacaattgcgttggaacaggatgcctccaagatgattgaggatgggaaaaccaggttccctgagaacgagccattatttcagttgttgagtgcatggaacgacctaaaagattttggcgttgacgattcgacatattttgaggatgtgaagaaagcaagttttgagttacaggcggtgttgacagcattgtatttggtgaagtttgataaagatattgatcaggcaatcacgtttttgagtgattatattgataatgtgaattcgttggccaagtatgccgagtgccacgttttgaattgcgatcgccgaaaagggaatatg

SEQ ID NO: 9970 - DNA, 234 bp, Candida albicans
tcgatgaataagagagttgaaaggaatgtgaagatatcactttttgttgattctatcccaaatttactctcaccaaaaagtttattgccaccaagaaagaaagagagaacaaacaaaaaacagagagcgagaaatcaccaagtcgtgtattcatcagattatcacagactcaatactgctactagacttgaacagttgcaaagtcttaacgttcaacaatacaatgtctactga

SEQ ID NO: 9971 - DNA, 927 bp, Candida albicans
ccaatcactgacgccatacatatcattagtatagttatatacggagcactagagatagcaatggtttcactttctaatttattagtgtgtttgggattagtagtagttccaactacccttgcattttctgatactgcaccaattatcattcattccaacaaccaggatgcgcttgaaagcaaccataaatatatcacaaaatttgttgatgttaaatcaaaagtagatgaaatcattaaggaaagctgtagtgacaaaaacagcaagttatttatttatcaaatcgaggatttaagtattgaatctgattattcttggttgttgaacaaagggagctatcctaatgtattatatcatgaaaaaaatgaagccaactacgattttaatggtaaatgtgaagaaaaggaatctggtacggttcaatttagtgttttgaagactggctcattgcaagagatatacgaaaagcataaagaaaacaaaaacgaggtatttattatccaagtattacctaagttcaccagtggtcattcattaaaggctattaaggaaaaaatgtacaacttatacaatgatgaagatattgtgattagtagcaaaagagataaacaaagtgacaatgaaaatgatgccgaaatcgaacaagaaattgagcgtgattttgaagttgctgaatccttagcttccgaggagtcagaccctgtcagcattttcgatactgataaacaaaataagaatggtacagtagttaaacatgataatttatttacaaagtatcaatttttcacttccggtatttggtcaggaatcatcatttcaggatttttattggttattttgtacaatgctttgagttggctttctagtttggaaatcacttatgcctcgtttgaaaaacaaattgattttgataaaaaaaatgaataa

SEQ ID NO: 9972 - DNA, 384 bp, Candida albicans
aactacaatccaatagtcaatcgtgcacaagtaatgagtgacgaaaatactaaacataaatttctaaatgtgtcacaaccatcaaatcttttaggtggaagttcttcatcaaatagtttgagacgtcctctaaatgacaatactgtgagtgttagtaataaaatgaggaaaactaccagccaaatcccagtagcaaaagatactgtacccacattaaccatttcagagtcaaacaggcttagacaactagtgaatgaaaagaaaatagatttagaacaattgaaactcaatgccacaaccttaagaaatgagttagaaaaacaaacatatgaaaaactttactattcaatccaactaccaaaatctagagaggattttaaatga

SEQ ID NO: 9973 - DNA, 282 bp, Candida albicans
ttgacaccatattttgctcgaacaaaatatcgtatggtgaagaagacaaatattaaggcaattaaaactccaactgctaatgcaagaaaaaatagtactgttgaaggggttgaaccaatggtagtgttttgtgatccaaaatcattggcagtggatgtgggtattgaagaatatgtactttgtgacatggtctctgtcgcttgtagtaatgatgaagacgttggtatcgtcgttgacattgataatgctagattttggtttcgatgtaatgagaagaaatga

SEQ ID NO: 9974 - DNA, 183 bp, Candida albicans
gaatatccgccccgtaaatttaaattgaaattagtttatccccaaaaagcaaaaataggacaagaaaaaaaaaaaatagaaggacaagaaatttctcttggtggtggaagaaaagttcaaagtttttcctttcttaaattaattaataaaaataagaatatatcccatccatttgattgttaa

SEQ ID NO: 9975 - DNA, 969 bp, Candida albicans
gataattatattctattttttttttctaagcagggggagatcattcttgttcatttcttctcattacatcgaaaccaaaatctagcattatcaatgtcaacgacgataccaacgtcttcatcattactacaagcgacagagaccatgtcacaaagtacatattcttcaatacccacatccactgccaatgattttggatcacaaaacactaccattggttcaaccccttcaacagtactattttttcttgcattagcagttggagttttaattgccttaatatttgtcttcttcaccatacgatattttgttcgagcaaaatatggtgtcaattatgttggactcactagaagaggactttatggttataatcatcatgttaatggcaataataacggaaatcaacctccatcatcaaatattgttaatgaacatacatttgcgcaaatatttaccacaacagaagtacaagatcaacttgattatattcgacaacaccattatttacgtggagaaataattgatcgaagattgaatcaggatgatgaggactcatcaaatgatgctgcaagacaaagacaacaacagcgaagacggagaagacaacgaagaagaagaagaggtggaagatttgccagaatgaaaaaattaactgctgaagaagttgaattattattccccaaaaaaacttatcatcaatggcttaatggtgggaaagaagaagatgttgaaaatcgagaagatttattttgtgaagtgaaggaagaggagcaacaccaccatgaagaagatattcaaaatgaaaacaatggtcaatctagtagtgatgataataataataataataatattggtggcactgttgttgatgatgaaaatcacaattgttcttctagtcaaacagaagataacgaatcaacaaatacattctttagatcttcactacgactagctagacccactagattc

SEQ ID NO: 9976 - DNA, 186 bp, Candida albicans
ccgcctactctttatcattttgctaattcaagcatgaggaactatcatgcattgattatctgctttcttgtagttatggacttaattcacagtagaacatctgccactcgattcaacactaacaagctgttccaaacattgacactcaagttcaagacccaccaaacgttgcaccaaaacaagtag

SEQ ID NO: 9977 - DNA, 489 bp, Candida albicans
ccaaatatgaaatctattagctttattcttttcactttcttactttttgttgctccaattttaggtaaaatacaaaatgtttacttatatgttagatctcaaaaccaaactgtcaacgggaatggattgtattctgttaaagaaagaccaggtattaattactttttcttaggtcctcccaatcatgcccaaaaattgatttatgacgatcagaactattatatttatcaacaagttgatccacacacaagatattattttggcattcaaagaaatatcttacagttgtccaaaggtaaccctcaaagagttgtcatgagaagaaatggtgaattgaatttcagaggtgatgataaattgtatgccgttaaaaatattggtgatccaataaactattctaaggatcattatgctgttaaatattatgctaataagaataatgtccccaagcacgcgccgaaagtaactgtttatgctaagaaggcgtga

SEQ ID NO: 9978 - DNA, 372 bp, Candida albicans
ctttacgccacttccaccaaccaagaaatcaacgaacacaagatttcttacagaactgggaaattcccaagttatgatttgtacattgatgatcaaacttcatattaccagtacgatgattttaataaagtcattttttatgataacaaagttaggttttatttaactgtaatcaataacattcttcaattgagtccaaatactccgttgttaatagatattcagtcagatggtaaaatattggatgatacttatgcggtagagacctcaagcattgctcaaacaagtgctaaaaagaattataacatttggtatggtactgatcctccaattgatgcgatcccgttgtctattcatgctagttacctttag

SEQ ID NO: 9979 - DNA, 603 bp, Candida albicans
ttattgaaatcctttgattttattttcacgaaatttgcaaccaactctatatatgccaaacccaactcctatttcttcaaatcaactttaggaatgcaaatacaatatatacaacacactttcctttctatactcataatcattagccattgtttctgtgagttaatatcaatcagcttatatgcaaaatcagacaacagttctataaacgggttaggattattttctttacatgaaggagaagggtacaattatttgtttttaggagaccccaaaaatgctcaaaaactcgtttatgacaccaagatgtatcatgtatttttttactatgtttacttgttcccttactatttgacactggtgaataattttttacaattatcttctgttcattatccttttaaaatcaaaataaagaaaaatggagaccttacatttacttactccgataggttatatgcaatgaagaatgttgatgatccacacaactattcaaatgaatactatgctatatattactaccccaaatctagtattgttccatctcaagctatgaaagtaaccataacaacaagtatgccagctaatcaaacatatagttga

SEQ ID NO: 9980 - DNA, 189 bp, Candida albicans
ttatttaggctggtaatcttttcaaaaataattgttttgctagagtacgttacttttagttccgttagatatgctttatggtttatgcactctatattaggtaattattccaatatgtattcgaaagctatcctcaaatattgtattcagaaggcgatgatatacacatgtattcctaaacagacataa

SEQ ID NO: 9981 - DNA, 294 bp, Candida albicans
gttttaagagaaactatattagaagtttcggcacaaagcaagacaaagtttttttttttctacaacctttcatattcaccaatagtgttattactgccgtggcaaacagagcaaaaaaaaaacagtgaacctattcttgagtttagtagagtttttacactttattacaattattcatatacttcagttactataaatttgacagaatacataaatacagcaaatcatgggagaaagaggtccagatcagtggttggaacagataaaaaattgcatttcattatcagaatctga

SEQ ID NO: 9982 - DNA, 231 bp, Candida albicans
  unsure (124): Identity of nucleotide sequences at the above locations are unknown.
ccacttggtctaaccatacagttccataatgagcatctcaagggccccttgggttataagttaaagatctggcccacctctaattccattcaaataatgctaatctccagagattggttccaantccaattccctttcagtccattgtttaccactcaaatcccttctgttttatatccccaatctctagattcctccctttcttcaccaaatatatttctcctttcctag

SEQ ID NO: 9983 - DNA, 228 bp, Candida albicans
aaacaacaaggactttttaaaagagaaaaaaaaatttgttttgttgttcaagaaatttttttttttttttttcaccactttatctactggtgttggtgctacttgcgcgtcgttgctgttgttcctattaaccgcaaatcaattcaaactttacacaacaacacaactactaaagattactttaataatctctcttatatattgattgattatagtatttacaagtaa

SEQ ID NO: 9984 - DNA, 711 bp, Candida albicans
aaaagaatgttagctcaacctgaattagaaaaattgaaggaaaagaaattaaatgaaaaaatacaatttattgaatctactaaaactgcattagttaatgaatttggatttgactcggaaccatcatcaaaacaattggaagatgcaagtgaacgattatataatatttatcaattacgtgctagtggtcaactgttatcagaagctagaattcaaaccacattcaacactctttatgatttgaaattacaagctcaaaaaaataatattgattctttacctaatttacttaatgaagctaaagaatttattactagaatagattcaattgttggaattgaacctacaggagaacttttcaagaatttaactaaagaagaacaattgaacttacaaaaggaaataagttcagaattggataccctttatcaaactaaagctcttgaaaaagattatagaattgaagctaagaaacttattaataccccaggagtatttgaaccattacaaagagaagaattgatggctaaatatttacctcaagtattaccaatggattatccaggttcagtaattgaaatttctgattctgattctaaaaataaaaataaaaaattatcagaaaatattgttattcaacgtatatttgatgaaacaactagaaaagtcaaacttataggaagaccaaaagaagcctttgcttcagcataa

SEQ ID NO: 9985 - DNA, 1437 bp, Candida albicans
gcggatctattagcccgtggtggacactcttccgatgtcggtttagcagatcgtcacttgaatgtggcaaacgatcatttacacctaaggcgtgaatctttttctcatgaaactaaacccaaaattaaaaagggcagaccaaggaagaagccagcattccatttacaattagataatgtcaaaatatgtgttccaacaataacatcttcacaatcggattcgggaactgattattggaatagaacacctagtggacacgtccgtcgaagacttgcatcttccactatggcaactttggtcaacggatctaattcaaaatccaatgaaagtgatttgaaaattgcagacaaagatttgagttttgctgatcgtaattttgccattcccacatttaacctcaccccttcaatggatcctccaggaaaccccaatgggtattttgaattgaacaccacccctggtgtcaatgggaatcttgaaacctcaggtgggttcttttcaccggccattaatgataattcagttaacaactttaacaaaacctttgaagattatttacaagaagcagagaaattatctgatcataaaggcacaggtgataataataataatggcaacattgctagcatcaatcagagcaatatcgttgatttacaacaaggtaccttggaaactaattttacagaattagatataccacaaagtcagagtatgttcactccattgaattttgattcctcagttggtgacgactttttatcacccgaaaatggaactcagtttgatcgcggccgtttatattcgaatgagatcacactgcaatatttaactgttgggtcaggagacgaggaagatgatcaggggctggatttcagattgcaattgcctgtcttgcagaaaactgtttctggtcaaagtggtcatagtccaggctccgtaggatctgaactggcatattctgtcagcgctggttatactccacctacaatgagcgtcactggtactgccaacactaacacgaacactaccaagcttctgaaaaagagagcttccaagggagctgtttgtagtgtttgtgacaagtatatcagtagggatattgccagacatatgagaattcatgatgaagttggtcgtttccaatgtgtttaccccaaagcaatgtgtaatcacaaaacacaaaatttcaatcgaccttatgactacaaaaagcatttattacatctgcatttcgtatttgatgacccaaaggggaaagctgcaaatacattgactgacaaattacctattatgggatcatgtgaagcatgtggcgctcgtatgattgccaatgattggttggaatcacatattttaacaaaaaacccaaaactcaaatgtccctacagtaaaacaagctacttaatacttcccctgtgcctttttttttcaccataa

SEQ ID NO: 9986 - DNA, 279 bp, Candida albicans
caagaaaagcagacaatcgaaatgaaagagaatcttgaaaaagaaaaggaagaagaaaaagaaaatgattactttaatcaaaaaaaaaaaaagtggggagttttacttgtagaaataaataaatttccatttttaacgaaaaagaaaatgttaggtcaaaatttctccagtcatatttcgattgatgaaattattgaacaagcaaacacaaacaaacaaacgaatatacaccactatcaaccattcccaaatgacttgagcgattttgtgtactactag

SEQ ID NO: 9987 - DNA, 216 bp, Candida albicans
  unsure (202): Identity of nucleotide sequences at the above locations are unknown.
atagggaattcacataattatagtgacgaaagtattcctaaagttcatgatttcatccccgtgttctggatgaattttactttaaatgtaggtaaatattccaacttaattagaggagcggtgaattcgaaacaattcctaagattatggaactaccttatttgtagggtctatggtaatgatttaattagaggcaggcgtnggttattccacgct

SEQ ID NO: 9988 - DNA, 228 bp, Candida albicans
ttgttgaaatccatacaccaaaaactaatctcatttatatttatacatcacaaaccaattcttcgagaagaaaaatcagtaaaaaaaaagtataaaatctttgaagaagctattgtacaaatcgagagttcaaagcaatcaaacaagcaaaaaaaaaagaagaataaaagcaaaatctatatacttcaacctagtcaaagaaaaaaaaaagaacacccacaactgtaa

SEQ ID NO: 9989 - DNA, 318 bp, Candida albicans
aacgtaaaaaaacaaaaaaaaacaaaacaaaaaaaagaccgcaagtatgattacacacttccgatagcaatattacaacgtttagcaacattcacaaaatgcagccacgattatataaaagggcagagcaattcccgaatcctcgaaggttgtcaaatatatccttctggaataaaaaaatttaaaaacaaagataacaaaataactatgttgcgtcaaagtttattcagagcaagagttgcatttcctttaagaacatttacaacaactagaaataaccgaggcatcatcaaagaatccgccaaagttctttttgga

SEQ ID NO: 9990 - DNA, 201 bp, Candida albicans
atagctgatgttgctattgctggtgtggatatgattgctgaattagataatgcggtagtattagtaattccttggggtaatccagaagttgtggccgatgtggtggctgacgtggtggtggttgttgaattagccattctccaagaaaatttgaaacatgaagggtcaatccaaaataaaattcttttctttgatttatga

SEQ ID NO: 9991 - DNA, 282 bp, Candida albicans
tcgcgggaccttccaggccctgtggtggaagaaaatcatcttcaccatcatcttattctccaattaaatctgatctacctaatatttatagtcatctacgatctaatgatagtgaatcgccgccacaaccatcgccgaaacaacaatcttctttatcatcatcatcatcatcatcgtcatcttcaaatactaaatcttccacaactaagaatatttttaaaaaattattacgaattaataaatcatcagataatattgatgaatcaagatcaattgtactga

SEQ ID NO: 9992 - DNA, 432 bp, Candida albicans
tgccattcaagaatattatcttctgatggatgggcaattatatatggcggtggattggcttgtattgatttatattctttatttaaacgtttagttgcttgtcttgatgccatgatacaaaaaaaaagaaggaaaatgctaaatggtgatattaatgtctataagatgtgggtatggaaagaagatattcttggtgattttattattttagttttgataagctcaacacaacaaaaaaagaaaaaaatagaaaggaagagaaaagtaaatttacgttttcagtttttttttttttttttcttcaacaatattaaatatttatatactgtatataaatctacttatttatatatatatatatgtatatatactgtttcatcccccaaaaaattgaacattgggaaaaagaagggtagaaaaatccttttatag

SEQ ID NO: 9993 - DNA, 390 bp, Candida albicans
aaagaccagagaccaaacaaaactttccaattttaccaaccaaattggctaaaggaaatacaaatggagcacctcaaagataacgtagctcggacaaaactatttctctggaaaaaggcaaagactccagaaaaggtggttactccacgtgaacaaactcaaagttatacagtacaggactcaacacctgtgacaattacgggtcacagggaggctccaacaacacctcgtgctgctaatacaacagcaagaaaaacaatgactaccgatgtcctggaaatggataccagtaaacacactatctcctcgaatgatgaagcgtctccgaggaagaaaactaattccacagttcagcgtcttcaccacggggctggcaggatccgcacttaa

SEQ ID NO: 9994 - DNA, 195 bp, Candida albicans
ggttacaatgaacatccactttttcttgtgacatcttgtgggggggcttattcgctgtttatattttgtattaaactgcacgactggatcttcaataaaggaagcaaaagccatttactagttggtatttacgggaatgacaacgaccaaattgttttggtggagttttatgatatttctacaactcagttttga

SEQ ID NO: 9995 - DNA, 225 bp, Candida albicans
cctctgacgactgctttggggtgtttggctttcaccatgttatataatccatctgatgaacggaaatcgggtattcccgcattacatgatattcctgctccagtaagaacagtcattttcttacttttagatataaatttgatcacctcatgtagctttatcgatgtttcagctggcatactagtgcctgaattgtcaagtaagtcaatcagtatcatcgtctaa

SEQ ID NO: 9996 - DNA, 201 bp, Candida albicans
  unsure (6): Identity of nucleotide sequences at the above locations are unknown.
cacaanagttcagatcagcagcaattgaatgaagacaacaccatcaaaaacacattcaaagatatcaattacttaatgttggaacaaaatttgcaattatttgagacatttacaattcaattgtatgtatatttcaagcttaaacatattgctcataattgggcaacagaaatccctgattattcagttcttctaaggtag

SEQ ID NO: 9997 - DNA, 534 bp, Candida albicans
agtctagacttcaaattgttggcagatagatgtttacttgatggatgtattgctttgatcaaaaatcaattatgtgttggattacttttctttctggaattggaaatatgtcttgatcaaattagagcatttacattgaaacacgatgtgaaagaggaactttattgtaacttgtttgatgatgatgatggtgatggcggtggtgtagataataaaagtctttgtaaatcccgtggtatgcataatgacaaagtggttaaaaatattttgaatcaaagtttagattatttcaattatggggcaattaatgaagatgaatatttagaaataaaatcttccattgatgtgttaacaaatttaacaaattttgttgatcgtgtaccaatgtttatcaattatgataccgaattatgttttgctcatttgattttcgatagaatcgggaatagagtgattgttttgatcaaagatggcaaatattatggtgtcttacataaaaaagtacttattgactaccttagaagaactgaataa

SEQ ID NO: 9998 - DNA, 243 bp, Candida albicans
taccgtttttcggaaattggcaaacgggcggaaacaaggttatattttacacgcgcacatgtttccgcggaaaaaaaaaagaggaacttcaatttcttttccgggcattggaaagtgttggaaccaaccatattatctaaaacaagggtagccacacagccaatagggagaccaatttataataactggttcaacaacttgaaatttccttatttgaaatttgaaaccgtaaccccttgttga

SEQ ID NO: 9999 - DNA, 294 bp, Candida albicans
tttggtttcacaaaattgaaatttttgtccattttagtacaagtttcagtacccaatttaggaaattctgtcggaatcggaattgcttttccaccatggaagatgcatgataatacttgtgttatgaatttacccgatcaaattttgatacatgaatttaagaaattgactacatacgtatgtaaggtacacattgtaaatccatttcacaaaaagaccgaagaaggtaggtcatcatttttgacattggatttctggaatataaatacttcaacaaatcacaccaccaaataa

SEQ ID NO: 10000 - DNA, 186 bp, Candida albicans
gtgttgctgatatttcgatatttcattttggccgcagttcaaaaaaaaaatagagatcactctatgctttgcttgtctttgggattaattgatactatcagaaataaagagagaatattgaggggggaaacttcattatatcattcattaaggtttaatttttttttcatattggttataaaatag

SEQ ID NO: 10001 - DNA, 210 bp, Candida albicans
agttgggagcacttgaaaaaaaaaaatgcatcacgagactatacgagcaaattccattggtttaaagaccagagctacaaagagatagactacattgaaaagttgattagattctcttcacttacgaaatatccaaaaattacagaagcacacaaaggggaagagagactagacacatccagcaaaaacaataatagaggatgtgactga

SEQ ID NO: 10002 - DNA, 195 bp, Candida albicans
tccgtggtggaacatcgtgaaataatgaacgagaaggacagggatttgagcgaggaatggaatttaattatcggatattatgaccaattagtaaaacaaaacgcaaaacgcaataaattgtgcgtgtttttcatatacagaattttcttcagtcttttttctttttgtacccaaaataatgataaacaaagatag

SEQ ID NO: 10003 - DNA, 204 bp, Candida albicans
gggttctttggctttgaaattgaaccacatgtctgttttatcataagattgttctatgtcaaagtcttgcttgaagaattttcagggtcgaaaatgaaaatgaaaaaaatgaggcgaaggagggcaaatgcattagcagaatttgagtgtaaaaataatattcaaaattcattagaaaatacttgcttttgtgcaaatttttaa

SEQ ID NO: 10004 - DNA, 918 bp, Candida albicans
agacaaggagatctatcgagtgacgatgaagaggacgaagaggaagaggtaaacagcaaggaaaccaagcaagaatcatcacaaacgataaatattgatgaactaacatcacaagcactagctcaacatcaaaaatctaccgaaatcgagtctgacgatgacgacgacaatgataatgggtctcttgatttatccttaagtgaaacagaagatgcagcaacagcctccacctcatctgctgaacaagattttatcaatttattgaaccaattctctaatcgaatatcaatatatgaaagttgggatttagtcgaagaggaattattaccagaattcactacttatcctgaattttttgccatatcatcgaaactggaacgacaaaaattatttcaaaaatggtgtacccaacaagagccaaagtcaccacaaactaccatcaatgaaggtgctttccctactgttaaattaaactatttgatatttttacaagacttcaaacaagatatcaaacaatcattttatcaatcattttataactcacattatcaaaaattaaatgaattcaatctttcttcacagatgaaagaaaccattttccggaattataaaatcatgcttaatgatttcacaaaatttgctaaaaattataaaaaatcgaatgttggagataatagaaatttaaaagtaatgaaattaaatgaatttttacaaaacaaactacatagtcatatcacaaatactgctgattctggtccatttagtgttgattcaaatttatcggatcttgataattggataaatttattgaatcattatgatatccccacagacatcgcggaaaatgaaataaattttcttgttggtgatgaaaaaagattgaatagttatatagatcaattaaaacccactaaatag

SEQ ID NO: 10005 - DNA, 192 bp, Candida albicans
tcgggtaatgttgttgttgatattaatcctgatttattggcaattaattgtttccagttacgtgataatccaactccaagaggactgaccatccccattcctgtaactactactcgtgtcataattttaatacaaaataaacttggtaagggtgtgagaactaatgttgtctatttagtgggttttaattga

SEQ ID NO: 10006 - DNA, 258 bp, Candida albicans
gtgacacgcacgacgaaatacaactatacaaccaatcaatatcggctgatttctaacgaggctgattttacatacaatctattagaatttgaatctaacaagaatttcggcaaaagggagcaattatatataaatgagaataaattatattgggtttttggaagagaatcacaattgtatcttttggtaccaagcaaccagaccaatattgattatacgacgatgacagccagtattagagaaataacggtcctctaa

SEQ ID NO: 10007 - DNA, 663 bp, Candida albicans
tcaacttcaactatgtttagaaatgttgtaataacggtgaacaacactataaggaaattaaaccaatcatataaatataggggccagtttttacgactacagcacaattcaacaatgctaaatcataataataataatcatcatcatcaatatcgatcaattaccaattctaaaccttcaagtctatcaaaatacccaaaattcaactctacacatggtaaaaactcattatcgaacaaccatatatcatctaaacaattgactaatattagtctagatcaaatactattgaatatttccaaatgtaatgattataatagtttaactaaatacatttctacaattaaccatcaataccttaattctcaaaattcaattctccaactaataaccaaatggatcaaatttaataataaatttaataataaattacctagttttaatgcattaaatgggatttttgaatctttaatacgacgacaacatgaagtcaccactaccaagaatatcaattatgtttcaaatttattaacattatatttatatttatatcgatttaatcatctggcattgaatatactcccattaaatttgatttggatccaatatggtaatcgattaatttataatatttatttcataacatatttggaaaatttattt

SEQ ID NO: 10008 - DNA, 744 bp, Candida albicans
ttcaactccaaagaacatttttttttaggggcgggagggaactcaaatatcaaagtcatctttctccattgcttaaccagtaaaccccccccccaccttcaacaacccactttgtcaatgaataaatatatatcaataactagaagtctagcaactgctgctaaaaaatcaaccaccaccaccaccaccaccactactactactactactactcctatcaacaattctcaaccacaatttaaagttttcgataaatcaacgaaatttttacaacgatcaaaacatgccaaattaactcctgaattatcacgtaaaaaagattatcttcgtgatgaaatagccattaaaactattgaaagattagcatttataactagaccaatggataatttattagattttggtagtaatgccgggaattttttaaatcaattaattaaagattcaaaaattccatcaccaccactagatggtaagaatgatgatatggaagtgaaattaattgaacaattgaataaagataaacaaattgttcgtgataaaattaaaaatttaatcatgtttgatacttctaaagatttattatatcgtgatgtcaatgaaactgatcaaaatggaaattttcctggcaaaatcactcgatgtgttggtaatgatgaagaaacatttaatcatgaaatattcaaaactgataatcaatatgatgccgttatatctaatttaagtttaacattggattattga

SEQ ID NO: 10009 - DNA, 462 bp, Candida albicans
tttaagtttaacattggattattgattaccctaagttctttaaacaatattcatggaattttgaaaagagatggatttttcatggcaactttatttggtggtgatacattatatgaattaagaacttcattacaattggcagaattagaacgtaaaggtggtatatcaccaagagttagtcctttaattcatttaaatgatatagggtccttattaactaaagcaggattctctatgttaacgattgattctgaagatattatagttaatggatatcctaatattattaatgtttgtgaagatttacaaattatgggtgaaaataatggattaataagtcgaaattatttagatagagatgttttaattgctgctgatcaaatttataaaagtcttcatggtgatgaacatggattacctgctactttttcagtaatttttttcattggttggaagaattaa

SEQ ID NO: 10010 - DNA, 189 bp, Candida albicans
  unsure (13),(15),(19),(51),(86),(117): Identity of nucleotide sequences at the above locations are unknown.
ttaaagtttgtcntnatcnagaacgaacaaagaaaacgttccgacagaatntttataagggcacacaagtatttgtcaatgttctntcttttagcctggtgttgtcctatcacctanatctcaagccccctttctaccaaccctcccttaacttttccttttggggtgccccccatttatgataactaa

SEQ ID NO: 10011 - DNA, 228 bp, Candida albicans
attaccatgaaggtttactcactctccaaaaaaacttggatcattattttagtaagacttgtagatcttctcttgtctgcgatatcgactttattgttaaattccaaattgaatatgcatcatgggtatattatattatctaccccacaaatgaatggaaacgataatgtatcaataaattggtatttagttgtcgtctcctccactcaatgtgcaacatctaattag

SEQ ID NO: 10012 - DNA, 441 bp, Candida albicans
atatgcaacagtatgggcatccttattaataagcttttaggagtgtttaaatcctccaagagcaatagcatcaaccacaaccaacaacagcaaagtctggtggatacaagtaatggtaaaactgtttataaaggtggaaatatgactttgaatgctgcaaatagtaacagtattcacaacccacaaccaaccacttacatagaatcccaaaccgaacaatttgattttctgcaactacctcaatatcaaccagcaataagccacccaagaaaaaactcattcaaagggagtggtggtaatcgaagaccatcaagtgattcaatgactacagtgagtacagtcacatcaagaagaagatcaattgaattagtggctcaagaattggagattgaaaatataaaaaattccttacctgaagggtttagagtggatgataattga

SEQ ID NO: 10013 - DNA, 258 bp, Candida albicans
  unsure (5): Identity of nucleotide sequences at the above locations are unknown.
catantgttcacgtgaactctttgttacttccatactatcgtttaaacccccctaattcacattcgcgtgggacgaattatttccttcatattcttcctgccctggcgaatactagtagtaccaagttgtttttttcatttaccccatttgttctttccaaagacccaattccctatttttttttggttatacctctaaataattggatttgttcctcctcccatttctcctctagcgagttgaaacgttctaattaa

SEQ ID NO: 10014 - DNA, 1275 bp, Candida albicans
  unsure (10),(12),(14),(16): Identity of nucleotide sequences at the above locations are unknown.
catactccananangnagactataggagaacacacaataggcgaagatttaataatggatgtcaacgacacatcagatctatctttaagctcaaaaaataaatttgatttgaatcaattcttggtttattcacttaatccactgagcgatgataatcagaaatttgaaattggtcctgctaccgcccaagaaaaaaatgatacttcaattatttatctttcacgacccaataattctggttccaatagatcaacatattctactcaggccccagaagttaccaattcattagacaccaaaagtgtaaatacgaatctgtatcatccatcgttaaacttcccaagtaaagatattgatcaattgtcatacaccacaacttcatcactcagtcaagctagatccaattcagtgtctacagcaatcacaacactaaccactgcatcgtcttgtaaatcacatatatcaccaagtatagctgaaactgtaaatgttgacgttaatcaatttcctcacaatcatcagttggaacaaattgctacctttcaagaacaaacaactgtatgttggtcctctgacaaaatacattttttagatccacttttgattcaagatattgataatattactactaattctttgactcatcaagaaaagattaatgctattggtgctgattatagtcatagatttattgcttttgctagctcaccaccaccacctcaacaacaactccaactgcaactgcaaccgccgccaccaccaccaccggtaccccaacttcaagaccaagatgaaattcaactaaatactgatacaaaacaaagtagtgatacattaacccaggaagactttgatttcaacaaactggaattgttaaataatcaaacaatggagattgctatagagtatcaaacctcagcccatcatttaatagaatatgcaagttccagtagcaatgtacttttgggatatctggaaattgatgttgatgttgatgttgatgttgcagttcctgaaaatgaaagatcaagtttacagcctgcttttgattataagaaaggttgtcccttgtcaagagatagtgacagtacttgtgacgagcttgaaagtttggaaagttcatctaattttatctatgttgaacaatgtaattcattgaatcctcctgaagtatcgtcgtcgccaacaaaaaagtatatattacaaagcaatattccatcttccactattgttgcaggaagaaggaacccaacattttggaaaaccattttttag

SEQ ID NO: 10015 - DNA, 246 bp, Candida albicans
gtagtcatgagggggggattgttttttgtagtatcatttcgacggtttgtgcctgtgataatttactgttgtggaacggaagaaccaaaaaaaaaagttaaattctacagacataaattatccataaataatgagaactttaaccccacatactctactctattaactatttatatatcaattcatttgaatgtaaaaactaatttttgtaacttttatttactactttttcttttccaacattga

SEQ ID NO: 10016 - DNA, 207 bp, Candida albicans
tccacaaaccacttaggaaaattgtttatagttactaaaaatatcctgaaattgatattattgaactttgaaaagacgtttcaacttaatgtagcagcattcttgagtttgttgtttgtaattacgcattacaggtttgaaaaattgtacagcattaaaatcagatatccaatattgaagaaatacccactcttgtatcaattatag

SEQ ID NO: 10017 - DNA, 1302 bp, Candida albicans
ttttttagaaataccagggacccaacctacacatttcacagttgtttttgtttcaaccgacgattctggcccgaaatggacaatatgttggattgtttgaagttgctactaataaaacactatgaatgggtgagtgctgtgataataataacctcgatacttaccgttacgatagaacttcttccgacactcactttggaggcccagtggctccccactgtgtcaggtgtattgcacactagtagtaccattacacagtcgactaaaattggtcttttgactacagtatcattggtcccagttgcggaaactcagttagcttctagaacattttcaattgtgggtcctccaattccagatactacgtcacttgagttagttgttcccacgaaaagtgaaactcgagttgttaccgaaagtactgttgttcctgtgctaccccctaaagttactcattttacaaattcatcgacgagtaataggcgttattcaagtgaatccatggttgatgaagaatttcccagtgagcccttcatgtctgatgaagtatctattgaagtgtatgagtcatatactgatgaatcttgtgttatttctacagatttttcagttgatgttgactattccagtgatcttagtatgaactttcagacatatgacacgcttgacaccactgaaatgtttaacactgttgaaaactttgagacgtacgacacctttggcaccattgagtcatttgatattttcgagacgtctcagacatttgagagttatgagactttcaatgaaactagtgatttgagtatgttttcattaactagtgagctgttttccgatctaccacctcctttggttcaaactgatacgcctgtctcattcaatcctgtgcctagtaggactaacatgagtgagaaaacaattatgtgggaagttactaattcacagggctctattataactgaatctgggattattcttatatctggtgaatatcagactacagtaactacatttctccgagaccttgaccaaatggaaggctatactaaatacactaaaacttgggaggttaccaatagtaatggttctgttgtaactgaatctgggattattgatgaatcgggatcatatcacactaccgtgacaactttcccacagaaagatcaaaattgggaatgggctgctaatacagtagaatatactaaaacttggatagttaccaatgaagatggctctattataactgaatctggtattgttggtgagtctggtttgtatcatatagactctgcccacggaaaa

SEQ ID NO: 10018 - DNA, 183 bp, Candida albicans
ctgagtctaattattgatgatgttgtcgttgtcgttgtcgttgtcgttggaatttttgaagttgttggtaatcaattaagtgatatacttgaatcattgagttactggctgcaatgtctcatttggagtatttctgggcaattgattatgttgttaaaacaaaaagaagacaaattattataa

SEQ ID NO: 10019 - DNA, 585 bp, Candida albicans
aagactaacagcttacagccaaatgatcagccacaaccacaagcatctgtatataatgcaacaccaccaatgtcacatccacctctacatagcttgcctcgaccaaactattatcaacaaccactgcacaatcaacattatttccaaccgatgccaccacatccacagtttgttccaagacaacagcaaccttcatactatcaacagcaaccattgccttatggttcttctccaatgccacaacaagcacctgtgccaatgcagtcatatcatccacatgcaccacctccacaacaaatgcaatatcaacaatacttttctcaacacccaaactcaaacccacatccacatccacatccacatcaacatctacctccaccactttcacataacggtatgatgatgatgcattctccacaacatgcaccaatgcaatccccatcaacaatgggtcctatgaatggaggtggtgcaaacaatgctgtgatgaatatggttccagttggaggaagacacaataaaaaccaaaccaccaataaagccaatttacgtgctgcttttgttgaaggcagttttggtatttaa

SEQ ID NO: 10020 - DNA, 450 bp, Candida albicans
gacccattgttgatggggattgcattggtgcatgttgtggagaatgcatcatcatcataccgttatgtgaaagtggtggaggtagatgttgatgtggatgtggatgtggatgtgggtttgagtttgggtgttgagaaaagtattgttgatattgcatttgttgtggaggtggtgcatgtggatgatatgactgcattggcacaggtgcttgttgtggcattggagaagaaccataaggcaatggttgctgttgatagtatgaaggttgctgttgtcttggaacaaactgtggatgtggtggcatcggttggaaataatgttgattgtgcagtggttgttgataatagtttggtcgaggcaagctatgtagaggtggatgtgacattggtggtgttgcattatatacagatgcttgtggttgtggctgatcatttggctgtaagctgttag

SEQ ID NO: 10021 - DNA, 735 bp, Candida albicans
  unsure (21): Identity of nucleotide sequences at the above locations are unknown.
aacacaaaagggccaggagtnatcgttttggatgcatccaaagaaaccttgataattgtggaacacaaatttgatgaaaaagaaaatatcatatacggaccattcccaacatgtaaagatacagggaaaccattggcattcaaatatggaataaatgaagatataaattgtaccattcaatttacggacgaattgtatcatttatttcaattatatttgcacgaagatgctccgtttagttgcagactaccattatcatctgatgttttactgatcgaaaaaggaggtgcatcaattccattgactttcaacattagaggagcattatcggagtctcacattgatattgaccattcgatgaatgtactcattaccaaaccagctaacaatgatccaaatcagtttacatttgtaagtgctatagcatatggtgccggaacaaatactacaagagcagttattggagaccaagtgacaatgacttttgctgtcagatggttggatcaattatcgccagtgaattcaaacggaggacaaaaattaccatatcaagatgggttttacagatttccaacatcatttgtgccaattagttattcattattctatttctacttattattaacaagttttatatcagggatcgcaatgatagcattttcttataaatggattagtcttaaaatcacaaaacacaaatacatgccagtggatgacgaatcaaaacaagattaa

SEQ ID NO: 10022 - DNA, 1296 bp, Candida albicans
  unsure (1285): Identity of nucleotide sequences at the above locations are unknown.
tttcaaatgacatcttctcaaggcaatgatattttgaaatttcccatccttaatattcaggaggacatggactacccagtcccatttcaagatccttaccaattggcattatttctgcagaacaaacaactattgattgcaaagagaaaactagttgtgatcaaaggatcaatcataatgaaagttctaacatacgaagaagacattgtgacagcaacgtatactcatttctcaaattctcaagaactagaagaggtgttggtcgttagtttgaagaagcatattcatgtatactaccctgatggtaagtcatatgtctgcagtttaccgtttgcattaaaaaacgcattaccctttgaatctggattagtattacaacgagaccaaaatgagtcattaattccccacaacggtgcactctatagcaatacttcacatttgaattcagcagcgattttgaccttggttgaccccatgggcgatttccggattgtagctactgcatcaacatcagtgatttcatcaaaagaagaagtaatgactttcccaagaaaagacatgagtaaagtgtgttccctttgtgttactttcaatgcttcagatgggtctatcagtatatatcacgtcaaagcgcccagccgaactactacgtttggcaaaacacaactggcaaggaatcagaaacgaaggtacggatcaatcacaacacccaatccatcacgtattttggaagaagagaatggaactgagccgttgcactcaatttcactcaatatggaaaagaaaagaacaagcacattattatctgatatctcatctgtgggaagagtgtccagtgactgccacagtttgtcacaagatttttcagggtttaagaaggacatgatactatcaagaatcgagagttttggaaacagattgcaaaaggaccaattgagaattttcaatatctggtttgaagatcaagagggtgttgtaattttcaacagaataaggaaggaatgtgctgttttgatttatagaaacccctcgtttagccgacatctgtcagctttcaaaacttcttgtcttgactgcatccccctaacttccacaaaacatgaagggaatttgatcatattgacagagcaccaaaaattttcaattattaatccatttctcggtgtgaagtcggcttcacatacatttggaaacaaattgaaagtccgttcgttgattgactcatacgattccaaattagctttggttttcaccctcgggaagtcgacgtatccacgcgtctatntgggggggaag

SEQ ID NO: 10023 - DNA, 285 bp, Candida albicans
tttgcctatccaatacaaagaactcacaccaagaagtttgagaaggatatctctacaagtccacatggcataaatcaaatcaaaacttctgaggcccttactatttacagaattttattgttcaatacaaaatacaaagtcacctatatatacctcttttctttttattattcacagtgcacattctgtttattcgatgattctggtaatcaaaccagtaccaacagttttaccaccttctctcaagttgaaacgttggttgacttcctaatggacaagatttga

SEQ ID NO: 10024 - DNA, 201 bp, Candida albicans
tatatactgatagacccatctgaagcattgaaagtaacacaaagggaacacactttactcatgtcttttcttgggaaagtcattacttcttcttttgatgaaatcactgatgttgatgcagtagctacaatccggaaatcgcccatggggtcaaccaaggtcaaaatcgctgctgaattcaaatgtgaagtattgctatag

SEQ ID NO: 10025 - DNA, 195 bp, Candida albicans
ggacaaaaactgaaaaatgataaggcaagacctctggtatcgttatgcatatctaccaaacttgcaccagcaattgaaagagcagatgatgcaaaaacaccacacaagaaacggcaaaccaataatcctccaatatttggagacaaggcacaggggatgttgaaaatgacgtacaaaccgaatgatataaagtaa

SEQ ID NO: 10026 - DNA, 210 bp, Candida albicans
cgcaagcacggcttcttacattatatttaccttctttccatgcttgaaatacccgaggttgttaagaatacatcaaaaataacttcgaaagatatagaaaaaaccaaaaacttatttttgatctgtgaagatggttattgttggtactttattttgttgttcatcacaatttcttatctgtcggatttgacagaaaaaaattcaatttga

SEQ ID NO: 10027 - DNA, 228 bp, Candida albicans
ttcaagattaaatgtttaaaaaataatatggatgtagactttttaaaattatcatggcactacttccagaacaacaataacaacatcaagatagttcatttaaatcaacatatactaaataaatatttgtactatcctgagagtattagtttgacccaaactaccgcacggcggttcaaaccaaaaggcatttttatctattttattttcagactatttttgtattaa

SEQ ID NO: 10028 - DNA, 366 bp, Candida albicans
gatgaaccggcgttattgtcaagcaataaagagcctactagcaatcaagaaaaaagcaattcagatacagttgaaaaattagttgagacaagggctggtactgctcttgatactgagataccagctggaggtctacaaattgctgaaaagaatgtggcacctgaagaagcgtctaataattcggagaaggctcaaattctggcacaacagtcagttgccccacaagttacaaatattactgttgacaaaatctctaataaaactgaggataatagagatgctgtcaaacagactgaactagaacattcagaaaacctttcgacttctcaaactgaactgacccaagcaataactgttgagaaataa

SEQ ID NO: 10029 - DNA, 240 bp, Candida albicans
ttctttgtttttatttttgtttgtttttgttgctttattgatatcgttaaccactttgtttcaaatacaattagtccaatagtgaaagagtggggggtgaattatttgctcactttacagatattcctttttgctagttatttgagttctttcaaatcataccatttacatgttaaggggtgtacaaattttcatataaatatgccagcaaatttccaaatgtcaagaatcaagttttaa

SEQ ID NO: 10030 - DNA, 270 bp, Candida albicans
tctaataagaaccccaaggactccttgtacaaagataatggtcttgctgttttgaacatgacccagattataaatctcaataatattgggaaccccgtgttaccgataacaatcaaaaatgaacaaaggatttgtacaaacgcattctggttgaaagacatcatcgaattggacgttaaagtgagccccaaatcgttgaatgacgactgcagtgtgaaaaacgcccaccaggcgggtgagatggaactgcttatcatcaagtttatatag

SEQ ID NO: 10031 - DNA, 204 bp, Candida albicans
aaatttgttaaaaatccaccgagattggtggttaaatatattagacaccttcggagttatatagagataccggttgagaaggaagaggtatctttaatagaaaggcttacagcatcaggaatcttccttaacagaaaaaagacaacaattgaaagcagctctagcaagtggaaaatcattatcaaaggagcttgccgaagatga

SEQ ID NO: 10032 - DNA, 696 bp, Candida albicans
aatcattctcgagaaagctctggaaggagaagtacctcgtctgggaacattaacagtggaggaggactcaagggaatattaagaaaaatgtcattagttgattatactccagttgattcaacaaaccaagatatttcccatagtgatacctttttaggtcgtgttttgaattttgggactaatcaggggttgagcggtggtggtttagcaccaggtgcttcaagagtaattagagaagaagatgagggagagtggaaccttgatgaagagagaagggtgggctttgcagcacatgaaaatgaccgtgatgcctttgaaatgcaaccattgaattatgaggatttaagtgaagaggcaaaacaattgatacaacaacatgttcccggtgctggcgctagtaacttagatcattctcaacaatcgagtgctgctcctagcactgaaatcactcctagtcaaagtccaaaccagcatttactcaatgaaaagtcaaacaataatgaaaacaaccaacaatcaactacagtggaatcatcatcgtcgacgtcatctccaggagaagacgaggagctagcacgtagacgcgcctcagaagcacgcaaaaaagctgaaaacccattttatacaccaaatccagatttatttttaacgtggaacaaatgccgacaatcaagagcttcaccaagcacccaatga

SEQ ID NO: 10033 - DNA, 333 bp, Candida albicans
  unsure (247): Identity of nucleotide sequences at the above locations are unknown.
tgtttgaataatttcaagcaagacaagacgttgccaatatccgaggcagaaagaatttgttcaaaagaaatcaactctatcaatgcattagtgaattcttctacagataatgaagtcgggttgacaaaaaagattgagaatttatcgttacaagttcattccattattgaagatagtggaaaggagaagacaccaaaattgactgctgtggaacagttagaattggaaaaacgattaagcaaattanagaactggttacagcgtgaagacaagtctattgaaattttaaaagacaaacttactaattcattaaaattaataggtgacaaatag

SEQ ID NO: 10034 - DNA, 246 bp, Candida albicans
ataatgactcaagtttactgtgtggttattgttaatactattttaatgtatatacatactgggtggtggttacagcagctcattaagataaaaataaactatggcttgagctggatgtttatcaccgaggaatttacaaattttttttttttttttgctctcaaattgataaggcaaagagaattttttcttcatttcatatctttgtcaattgatgaatttgcttgttgtttatctctcttttaa

SEQ ID NO: 10035 - DNA, 774 bp, Candida albicans
  unsure (93),(215): Identity of nucleotide sequences at the above locations are unknown.
acattcttgaaattaaacccaaattcatgtacaacaacaacaaccacaattattagtaatagtggtagtaccatgacggccacggccacggcnatggccaacaccaccataaccaagccgaaaaagaaaatgataaataataccaatacaatcgataatcaaaatcataaaaataacaccaacaagctactatctgaactcaaaccacccaacantacattaaatcgtacatcaaatctaagattaaatcgaaatatgacgatgacaggaataaatcatgataatatatctataaatggcagtataataaatgaaggatatgaaaaggatgaacaattgactggagcattactttatataattagtgaatatccccaagaagaggaagaggaccaagaagaagaaaaacaagaaaaagaggaaggggttaccaagtcacaacaaaatcaaattattaaatcaaaagagacattatcatcatcatcatcatcacatggtgataatcgattaattggaaaattagaagaaagttcaaatgatggtgatgatgaacaaagtaattctaatttacatagtctagagagttctaatgaacaacaacaacaaaaggatattactaccgtggcggagggagctgaaattgaaattgaaattgaaactgagaaagaaaaagaagaagatttttatcatgataataatgatagtaatactagtttagaaaatttttatggacttgacaatgaatttttattcaatagtataaccattaaatga

SEQ ID NO: 10036 - DNA, 927 bp, Candida albicans
ccaactaactacgctttaaaaatgtcaattaaaattgatcatattctcaaatctagtaaagaactttatccacgaataatagaagaattatctagtcaattcaccaagaaatatgataagaataccaaaacatttgcacaattgaatacttggaaagaagatgaattgaccaacacattattgaaacgatatcaagaaacagaaactacatggataactaaagatgaattgattaatttacttgattggaaactagccaaagggaaatttagaccaatgttacccaaattaatcaaatctaatgataatatagacgtggaagaaataacaaaacaagggtatcaatacttgttggattattttaaattacacactagtaatgacaaacaaaaacaacaaccaaaactattggataaattttggggtgaagctaatgatcaagataaaattgaatattcagaaataataaagaaaagttttgaaaaatttactttattaaaaggtgttggtcctgccatggcaagtcttttagccaatcttttaatcaaaataaatccatatttgacaccaccatttttcagtgatgaaagtttttcattttattatatggaatcatttcgaccaggtgaaaaaattaaatataatatgaaagaatatattgaagaattattaccagtttatttggaaattatatctcaatatccagatgtgactatgaatacattggaaagaggaggttgggcattaaaaaattatcaaatccaaagaaatgaaaaattagccaatattgaaattgaatatattactactactactacagataatgatgataatgaagaagaagatattaataggttgaaattagatcataaaccagatttgaaattagttgcttcaacaccaagaagaaagaaacaaaaaaagtga

SEQ ID NO: 10037 - DNA, 2151 bp, Candida albicans
atgcaatcgtcggacgtcccagccccgatggtagaaaaatatgtgacttattctttggtaaaagaattaattgaggtggaaatcgaaaaacgaggacagattaccgagaacacaataaaaagtttgagatcctccataaacaagctctatcatatgaatagaattgtctattctatacaacaaccatatttagttttaggagataacatagtacaagaaatcatgagtacccacaaggataaagtgcaatcaattaagcaaagtagttcgggaaagggaagcagctcttcatcttcaacacccttaacttctcgctcaaatacactgaaagagctgagtgaaaccaatacggaagctacaattttttcgtcattgacaaagacctcatttgaaaaggataacgataacgagaatgatgttgaagatcttgatggtgatattgttgcggcttccagtggtgttgatgcgttcagattaagtgagagctcgaaaactaaattaactgaggcagaagagtacttgttaaagaaattcaatcaagaagttcttgaatcagaaaatgtatctacgattcttagtagtttaacccccaatacattcaaatcatatgctaccgatatgaaaagattcatcaggttttgtgctcgtcatgggaaaaccgatagtgttattgatgaagatattttaaacaaatttttagctttatcagttgataaaagtaagaagagcaattcaaagaaattaagaactagcttattaaaattacatcaacttaattgtgaagcgtacaatcttgattattctgaaggtgacatcgtgtttttaatcaacaaatatttggacagttcgggtaatcaagatgagtatttgccaccaactgatacgggtaatcaaatggacttgatagccaaattggaagaaatgtatatatccaccaacgagtttgatggatttaccgaagctaataaaattttgcacaaaaatgagtttaagcgctatgcgttattttgttccggacaaggtttgcaacattttcatgttactggtgaaacggtgacacaatttttcatcaccgagattgtcagtcaagattcaaatatcccggtgaaaaaattacggaaaattttgaaacgattattaattttacataaattaaatgctgaaatttttgttgattatccattagtggtagaaggattagaaactgttgaggaatttttaactagtcataaaacgagaccaggttttaaccccagtggatccagcagcactgaggctgccagtagcagtagtggtggaactggtgcaaatacatattctggtgctacatcgtcaatctcgtctttaacagcaaatgttccacctttattttttaacgatcaaggtggcacaggaaatttgttgtcatcggaacaagcaagtggcagtagtggtggtgataatttcaaagacaaccctgcccacgttagactgccactttcaaacgaagccttagaaaatgaaatgttgcaactcgaacccatcccaccttttgaaaaggtagacaagagttcaaaagctattggaggacccattgaggagagtggcgacgatgatgacgatgacgacgatgatgatgatgtagtcgatgttcatgcaagcgaatttcctccagcagttaatttaaaccctgaagatgactctggaaataaagatgaagaagaaagtgaagagtctcattatcattctaagcgtcaaaaaatagagatcttaccagatacaaacgatcttattcctgcatttgtcatgaatagcaatataactaccgtcacccaattggctgaagaatggactttgattgtcaaacggaccaaaaaatggggtcttggttggatcaaaaatcaattggattttcaaatatataccagcaggaaagtgattattgattttattgaacaacttttaccagaattgagtgaagacaatagcaataaaccaatcattgaagtcgatgaggactatatttatgatattgtcaaagtgtttgaccagtacatgcttagaaaagaaatggggttaaatgatttagttagaaagattgaggcaaacccaatctattccaaaaaggaattcttaagaatattgactaggagaaaaaccaccagatcataa

SEQ ID NO: 10038 - DNA, 1281 bp, Candida albicans
atattcaaacggctatattgtgggtttcctccttccttccttccttccttcttctttcttttattttttaaattgctttgttttttttggggagtgttttctttaataattagttatcatcttcctatgtaccaatcaatgacagttccaccatttagaccctatggaggagatgatatacgagttgtgagtgatctctcgagatttgattatcaacctgatcaaaaaataaggtcaagaaaccccactccaccaagcacaatcaatgataatgtttcctccagcaaattaacattagatactataatcccgttatattcttccaaaatagatgaacgacccaaatatagtccactaaggcaacaagaagatagatcaacacagtacccatcacctccaatacaagtaaaagaagaaccaactataactattcctaaaagagaaaagaaaaaagttcgatattcaattggtgtacaagttcctcaagataatggtggtattcccatgaaaaacaacccagcaccaccaccaccagtgccagcaccagcaccagccccacctcctccaccaccaaaagatattgctccacgactgatgccatatcctcaagatattaataatgccaataacttacctcccatgccacaaccaacaagtcaactatatcctcaacaacagttacctccattaccgtataaagacagttccagtataacgtcaccgcaaaagcgattagaaaagaaattaatcaaacaagttatgaatcgtcccgtaattcaatttaaagccgatagatttggacaaaactatgaaggagaatatttcaccatcagtgccaattttgttatatatgtatttgaagtttgttgtagtgttgttgagattgtattaagttctatattattgcaacgagatcaagacattggtgttggatattatcgatattttttggccgatggaataatatcattaattgtttcccttttatttgcgttacaagtgattaattatgaaatacgaaatgggatattttattgcttggtgagcactatttgtaaatttgtttcatttatatttataattagtcacatttttcctcataatacttatgccactcatgaaatatggcaaatgagacgtggagttggtgctattattatcatttccacgtttttatgggttacaaatatgacaatgtttgtcactacactatatatatcgagattagatttacttgaagaattaaattttgattatagtgaagtaaataaaactaaatag

SEQ ID NO: 10039 - DNA, 531 bp, Candida albicans
acaatgagatttaattactttacaattcttgttttgatcaatgctttggttcttccacctgaatggcccaatattgttaaaccaacattattttcacttaaagaaacaaaactgaaactattaacatccttacaatcattaatgccccaaaacattcctgattataatgtatctatttccagtttttcagcaattgattctatcaataataatggtccacaacaaaaccatattgatttacaaacagacaattcagataccacttccttgatgtttattcctcgagaattgattaatcccaccatgtttaaaaccttaggtcttgctaatttattctccaactggcatggttttggtgataatagtaatgggaaaacttcatcagatttattatccaagagtcgttggttaaatctaactgcttttgatcgattattaataccagaatcatttaaaacatttttcatttttaatacattaggaaccactacatctacatctacaccaacaatgatttcaccatcttcgaca

SEQ ID NO: 10040 - DNA, 267 bp, Candida albicans
atagagaagaaaacaaacaatgaaaaaaaatcgcaaaggaaaatcaagtttttatgtttcttcttcatctctttaaacattacggctacaatggggttgtatgctagatggatggctcttccatcaaaggtcagatattatgttgggttttcaacaattggatttgcattgataggagattacgtgacatcaagaattaatgacgaagttcaagcaagaaaagaaattgaagagtcttcatcttctccacaatcgacaaaccaataa

SEQ ID NO: 10041 - DNA, 276 bp, Candida albicans
gaaaggcacacacaagaagattatcgtactgattctcaacaacaacaacaacaacaatcatttgaattgatttataaaaactatcctattaatgatattttggatattatagaattagaccccatgacttcaaaatatcaatggtgtttattaattattactccattgaaaagaatacgattttgttgtcatgatgaagaagatatgatgaaatggttttcagcacttaaagcagtggttgttactcaaaaaaagaaacaaaaagaaatgagttaa

SEQ ID NO: 10042 - DNA, 222 bp, Candida albicans
ttgctagtatatttgaaagcactacagtatagtatgtcagaatcagatcatttaaactctactaataatacaggaaacactttcattagtctagatcaagccagtacaataatggcagatcaaactcaaggagctaacccacaacaacagcctagtcttcttgacactaaaaaaaaagagataaaaaacaatttcagccaatcacatgtactacatttgtaa

SEQ ID NO: 10043 - DNA, 240 bp, Candida albicans
ttaagtgattggtttcatggagacaagcaatccttactacaacatgagaaactttatttgaaatatggtgctgctgcaattagtggtgcaattcacgagctccactctggcattccgatcttcacagaaacaagacataaaaaaaataaagaaaatgatcacccaattcaaactatttccgaaaatttactctacacaatatcaattcaaccttgtttgtgtaataagcagctgaagtaa

SEQ ID NO: 10044 - DNA, 279 bp, Candida albicans
gctttccacactaatcaagaattagcattagctatattacaacaagacgaagacacaggtggtatcggtgataataaaaaggatatcatgtcattggttaagggtacaaacaagagctattttgctgaattaattggaaactatcaggatattttcgaaagtgagttagatcagaagccacccctgcgtgggagctgggatccaaaaattgaggtggtaccccatattagtcctccagctacaaaacaatacccattgtcggtgccagaacaagaataa

SEQ ID NO: 10045 - DNA, 795 bp, Candida albicans
cagataatattgtatcaactcagcctgacatcgttgagtctatactggattctgagtctgaaattgaaatcattgaaagaccacgtttgcaggtactacggtccgtttatgagaatggtacttcctacaaatcaaactagacaagaattaacaatgcctaaatgtcttgaaaataacaaaatatcagaaaatgaagaatatgagtcagaagtagtagaaagcgattcgacaccaataataacccctgttgtaacacctacaaagaaaccccacatttttccaacgaatgaacccgccataccaatagcattgagaagcacaccgaataaaataaaaaataacgtggatagaatttttggcagtccttcaccaataaaattggtactagaaagccccctcaaaaagcacataaatatcgaattttccgatagtgaatccatttattcaacagcagtatcacagtttggcacaccaaaacaaacaacgtcttttctgccagaagttttaactcagaaagtcggatcaccaccacttgatgcttgtagtgattctgggcctacaggcgttgtttcttccatgccttataagaaacctcattcaactaaaaggttgagaacaacaactttggaaatatctgccgccttaagagtgaaaaattacactgatcctaaaaataacataactgtgaaaaagtttggtgaagaaataaagagagaattcattgatctagataatgagattcccgattcagaaagcctggtcttcaccacggcactggccggtccgacgcttaat

SEQ ID NO: 10046 - DNA, 1167 bp, Candida albicans
atcatcatatacacggtagtatatgccttccaaatggcaactgagtacggtgacgatgatggcggattgtattttcattccacccaaatgcaatctatacacgaatcactacaacaagaagaaaaccaacgactatatttacaaacttccatcaaaaaactagaaagtttcaaacacgtcaataacgattcatcaaacaattcaaattcaggtgcagtttcagtagttcaaattaagaaaaaggcagccaccaagaaacgtaaactaatggcacgtaagccaaatgtgaaaaaaccaaagtccctgagtgaagctgttagacaagcgtttgaaaaagataaatttgcttactttacaaataatcaagccaaaattgacgattttctaccaggcaaatcaacatcaaccgaacccagtacaagcaaccaaggatcactaataagttcggacgagtggaactacatcaaacaaatctatttacaaaaaccaaccaagaataagactactttgaaaagtataagaaagagaataaagcaatatgaaaatagtggtactgggatgtgggaaatagcagcattgaatgtggatgtttcactaaacgatgaggatattcaacacttgtatgccttggacgaagaacagatggtttctgacgacaattcatctactgaagacgacaccgatccaactcagaatgacgggttgatattaactctatcacaaaattgttctactcaacgcgacatatgtcatcacgaaaaagatgatcaaaaatacattctaattgattcttcgatttgtgaaacccatcagcaagataaaagtcttgaacgtcatagccagaaagattcagataatggaaacactattccggatcaaaactcggcaataacaataggcgaaatggaatcaactgctgcccatgaagtggaagaaatatttagtaccccttcttatgtcccttccaataaattgaatgctgatcaagatagatccgatgaatcagaatcctcaattataatgttagcagataatattgtatcaactcagcctgacatcgttgagtctatactggattctgagtctgaaattgaaatcattgaaagaccacgtttgcaggtactacggtccgtttatgagaatggtacttcctacaaatcaaactag

SEQ ID NO: 10047 - DNA, 558 bp, Candida albicans
ttgctgcatgaccaaataaatgtggtcgagtgtttccaaacctttggagagggtgtcatggaactgggtatgttcagtagtataatatccagtgcatgtaacaataaaatgagtttacgcactacttatccacttgactacacactcagtatcaacaataaaaatttttttctctacattttttttttctttcccccgcctcctttttccattctcacaatatatattttttttaattgtttacttctacttttttttttttcttttgctcttttccatcaaacacagttcatcatgtcgtcaccgaatacaggcaagagcttgtttaatacgtttacgaggaatttgaaaatggtcttgtccaacgaatcgttaccgcatgtaagtgataacgagaatgattccaagagtcccatgagcacgtctccaccgcagaatatacctataccacaaaacccatcgttatttcacaatccccatcaacaaccatcgacaccgtcgggcaatagttatttgaatgctgtgcatagcggtattggccctgttcgatcaaactca

SEQ ID NO: 10048 - DNA, 225 bp, Candida albicans
ataattttcttttattgtattaatattgtgttacttttgtatttcttattgttaacaaactttcatttcagagaaaaaaaaaatggaagggatacagaccaccaaattaattttcatatacgaacattctcaacacttgaattgctaaatcttatagcttattttcacatgaccttgcaattcaacaaaggaaaggacgtacaagtatactctataattaggtga

SEQ ID NO: 10049 - DNA, 201 bp, Candida albicans
agtgctataattattgtttttcttctgttccaatttactttttttttgatctattatgatgtagctaacagagtgggaattggtaacctatttataatttacaaaatctgttttggtaacccctcaaaagacacattatatacgagacttaatcacgtagatacagaaagagtgacacgactatgtcccttaagccaatag

SEQ ID NO: 10050 - DNA, 240 bp, Candida albicans
atggtttggaaaagaaaatatacgatatcactatctaagtgctcaaaagggaacggaagttgtggtaaatcttttctttgtaaccaaattgttctatatcacattctagatttaaaggttacacaaaataaacaatctctgtcagtcacgcgagtctcgatgatacttaacaacaacactatacgagtagatcaaacacaaattaaggaaggggtgcggatagtttcgttcatttattga

SEQ ID NO: 10051 - DNA, 189 bp, Candida albicans
aatttccctctgaaacgaacaaagcactattatgaaaagtacaaaaactttagatattatgaacaaaatgttggtgtaactttccttgcacaaatatcaatttgggagagtggttcggcgtttttacaagatggcgtacatcaaatacgacgagttcttgatataagttcttcctgggtattaatttag

SEQ ID NO: 10052 - DNA, 198 bp, Candida albicans
ttaattgttcactgcattaagtatggtaagcatttattggccctattgtcgcagattattggatgggctcataaattttcgtgtttcaaatttgttaacccttctgaggtatacgaaacaaattattcgtctaaaacaatactgatgttaaggctattgttgaacaagaatgaagtgtacatttatacttggtactga

SEQ ID NO: 10053 - DNA, 249 bp, Candida albicans
ttaattttagtaagaaataatgtacaaaatactgttaaaaaagaataccaacaaaatacaaaacgattacaagatcaaaatacaaccacacgtatactactaaaaagatacttgctaggaaatcaattacctactaaagtcggcgaagaacattttggtgttagtatatattatatttccaagataaagtctgggtttggtctttttacgtgtcagtggggttgtacgaaaacagaaatattcttgtaa

SEQ ID NO: 10054 - DNA, 936 bp, Candida albicans
actcaagttcggatcggcccagtccccagtggtgaagacaaaattaatttattagaagaatgtgaatcgtttattgctggtacaataaatccatttttcaaacaaaatgaccgattatgggatttaatgtatgatttggataataatgaatttattttaagttcacaattaccgggtgatgacattgaatttaaaaattcaattatatcagaagacgccaaatttttatctaatttacaattatcattattcaactataacgatgatttgacaacaatacaattaattttcagacgacatattaatgaaatcattcgaattttattaagttcgaaaaactttaatagtaatttggcaccaacaagtcaagatttgattttattattagatggaatcggttattattgggccagtgatacaaataaattattagagatttcttgttatcaattaatttcgaaaaaattccattttttattatataatgggaaattgatttataatttattattacccaatttatctaatgaattgaatttaatgattgatttacattatcatttacaaagtttaaataatccagcatccaattctagaattaatgaacgagagatttggtttaatatattgaaattcttgattagtgggaaatcattagaaatatttttattaataacgtatttaatccccccaaattcatcttcgagtttacaatcatcatctgttcatggagggaatttaactatatttgataaaaataagggtattgaattattattgttgaatttattcaatcaagatgatcaagttaaatcaaatgtcattatgattttacaagaattacaggataatttcttgtgtagttggtgtcttgataaatttttgaaatcaaatttaatttatgaacttgcgttttctgatttaatcgatgaataa

SEQ ID NO: 10055 - DNA, 189 bp, Candida albicans
ccattatttgaagagttttgcacgaccaaacaggttcaatttcgaaacgaagctggaacaaaaaaaaaaaattataggctgacattatttaattttcaaactccgttatattacaatatatccaaaagaatactatattactacataatttatttacaaccaagtgaaaaactatactatacattctaa

SEQ ID NO: 10056 - DNA, 477 bp, Candida albicans
tttatttacaaccaagtgaaaaactatactatacattctaaaagaaagaataccctattgacaaacatgttaaatatagcaaaatcaactgaatctcgtaataccatccttagaaaattaggaatatttggatcaatagccattggattattcatcattggtaaaaaacatattgcttatcaaaaaaaccatcgtcatgaattagaatccgattctagtacattatcatcaagacatcaagatgaagaatttggttatgtttcttcaagaccaggattccctttgactaatccaaatttagattattcttcacctgatcgtaaatcagaatatgttggttctggtgatgcatttagtacaagacgtccaggtgatagattatcattatggaatatggttaaaatgagatggttccctgatgaagttgaagaaagtaagtattatacccctagtcgaagtgataaacttgataaataa

SEQ ID NO: 10057 - DNA, 195 bp, Candida albicans
gaatttaattgtgattcaaatgaagatgaagatgaagaagaagagacagaggaagaatctattaatggaagtactgtcattgctaatgatactagcagtggtgatttgagttggataggatattattgggtatttatatatattgacaactcttctttttatggagttaagattgaaaaaaagatcatattttaa

SEQ ID NO: 10058 - DNA, 312 bp, Candida albicans
  unsure (281): Identity of nucleotide sequences at the above locations are unknown.
gtattaaaccttagacacacttattgtaaacggctatcaataaattacattggttctggattgaaaatagaaacccgatatttacttacaaataatgtgtttttcctcacaccgggtattttatttgtgtattcttggcaagaagccaacgtcaactcttcaaatccactaataataactaatacaacacatatagttatgacaaaaataacaaacaaatataagtatatgtatgtatgtatatataaatataaatgtataaccagaaagaaagaaagtanaaaaaaaaaaaatcaaacaaaactaagataa

SEQ ID NO: 10059 - DNA, 222 bp, Candida albicans
  unsure (79): Identity of nucleotide sequences at the above locations are unknown.
cgatcttttgacggtgggcggggggacttttcttcatttggtttcaacgttttctgcttttctatttgttacaacgaanaaagaaaactaaatcaatttccatttccaattccaattaacatccaacaacttttatttaaaacaattattaataaaataaaactaattagattacagttgaagtatttaaatttactcctgacacccttaaccagaggataa

SEQ ID NO: 10060 - DNA, 807 bp, Candida albicans
tctacttggagggaaaacaaaaagccagataagtttatgaaatcacatagtttgccattaacagttgagaattttctattaacatttaaagaatattttactgtttggctcaatcaaatcttgtattacaatcatgtctatgaacaattaacttttgatcaattcaaatcgtttgatttaatcatatataaaaaccgtaaccctcaattacaaggttatattgaacaattaattgttaatgttataaaccaactaataatcaatcaaaaacagtcacagtcaaagcaaaggcaaaaacaaaagaaacaacaagaaacattcaatggattgtatggtattaattgtttggtttatcattcaacgaacaatacagtagtcagacaatacaccattaattttcatgagtttattataaatttgaatgagacgataaacgaattgaagcttcatgataaggatgaagacaattcagccattataaatattgagagtttaaattgggatgaaatttatactcaatatagcactattttgtttcatcatattcagcagttgaaaattcatgaaaagagcttgatcgaagagagacagcaagaccttgaagttgatgacttgtttttcaaaatcacagttgacgttgatcaactgttatacattaataattatggtaattgggtgagattgaaacgtgatggcaatagagacaatgatagtagagataacgagacacaatgtatttttgaacctattggagatgttaatcttgaacttttgaatttcaactgttacaacaaagtttttacctaa

SEQ ID NO: 10061 - DNA, 207 bp, Candida albicans
gggtgtatatgtaaatatgtatgtatatgtaggtgtacgtcaaagaaaatattagatattttttgtttagagatttcatctgtcaaaaaaaaaaaaatgtgtgttgtggaattagggcgtcaattattatccattattactaattatttacatttaatttttttggcgatcccttttttccgcttatttgttgtcatactattttaa

SEQ ID NO: 10062 - DNA, 462 bp, Candida albicans
catcaactaattaaatcaacaaaaataacaatgaaattttccttaactttattgactgctactattgccactattgttgctgctgctcctgctcaatacactggtcaagccattgacagtaaccaagttgttgaaatcccagaatctgccgttgaagcctacttcccaatagatgatgaattaactcctgtctttggagaaattgataacaaaccagttattttaattgttaatggtactactcttacctctggtgctaacaatgaaaaaagagaagctaagtctaaaggtggtttcagactcaccaatttcggatactttgaacctggtaaaagagatgctaacgccgatgctggatttagacttactaactttggttattttgaaccaggtaaaagagatgccaatgctgaagccggttttagacttaccaattttggttattttgaacctggtaaataa

SEQ ID NO: 10063 - DNA, 201 bp, Candida albicans
ataaaatgtaaagtaaaattgaggtcaaataaaattagttacaaattgaagatagacgataattatcatcagacttatcacttatgttatataagagtggaattgaccgacttaactaaaagtaaacaaagacatcttgggagagtgaataatttaagaagtactaagatacatatctcgttgacaaggcgttacatctaa

SEQ ID NO: 10064 - DNA, 216 bp, Candida albicans
aaaattatacaccaaaataattcgagtgaacaaacagtatacctcatcccattttctccacccttattaaaatgtaccatcaaatctaattatattcattatctttttgctacactttcttatttcttaggtattgtaattacttatgtgatcagaaaatatttgatgctacaaattcacgtgactgatatgataaaaacccactgcatcacgtga

SEQ ID NO: 10065 - DNA, 576 bp, Candida albicans
  unsure (541),(542),(543),(558),(563),(564): Identity of nucleotide sequences at the above locations are unknown.
agaacaattatcagaaacatgtcggcatttctactagttaacgaacacgcaaacgcacaagtaatcaaaaagaaaaaagtaaagaatgctaccccaacatcttcaaccaagtcaattatatcaggatcagatgtaagcagtcgtcataggaagaaagtgtttgatatcaacaaaaatcgctatgtggacacagttagctcattcgacatgtcagtaggcgatattggagaagaaagaaatgacctgtcacacaacagtagtaatgggaaccaccacagtgtctccaacacgaaaccatttttcccacctgaagagtatactatattaagacatacatattttgacgaaatcaagaacaacaacaattctttcgattgcaatagtatccaagcactactactgagcaaccagttttggaataacgtataccaagaaatgaaagatgatagtctacagtcaactttcgattactttcccttactccctaacagagcaattctttcccagttttaccagaccgttataaacaagatcttgaagnnnatcttcaaagcgccntaccnnaaaatcccaccc

SEQ ID NO: 10066 - DNA, 210 bp, Candida albicans
ctattgcctaaagaaagccttaaatggtataaggtgctttactttttaacttctggctcatcatctttgccacccgcctctacactttcttttagattatcctataaaagtacaaggttagcagaaatatatatatatagattagcttttcaactaaagcttatctttgacttcccaaagagaaaaaaagacccaaccaacagtcactaa

SEQ ID NO: 10067 - DNA, 186 bp, Candida albicans
  unsure (5): Identity of nucleotide sequences at the above locations are unknown.
gcccntataattcttcttcgcaagtggggcaatgtgcgtgtatgtggggaggtgcgaaaaaaagaattgattaaggcgggatttggcatgacaccgaaatacacacataaagaaattgcctcacagcattcgacattgataattcttggtgtaatttcaagcattttttatttcatctctgtgtaa

SEQ ID NO: 10068 - DNA, 828 bp, Candida albicans
attcaaatcaataacaacttgtgtcaactattaaccatgtcattagataatgagcatgatcaattcatggataatttaaaaccagcggttccatcatcatcatcatcattatcatcgctggatttatcacaagctgaaaaagaattaaatcaattacaacaagataaacaaaacttgatgatacaacaaaatcaacaatatttagaatcattatttcaagatcataaacatcaaccaattaaaattagaaatgtacaaatcaccaatggtcaattatatagagatgaatttttaaaatatcaatttcgaaatttacttaatggagaaatcatgagtttgggtaattatgttaaaaatgtgaatcaaatatccaaagatttaataaattccggtataattgataatttacaagttgtgaataatttagttaatccaccaatgttttccaagagtcaagcatatcatgttgtccccgttttcaatattgttccactgaaaagatttttcgctaaaacggggactaatataggtaatggagaaggagatggatatatacaatttcaatttaaaaatttatttggtggtggagaaaatttaatatttgatgctataacggggacgaaaactaaatcatcatatttacttaattataatcaacccattggtaataatttacaatatatgaatgagaatttattattaataaacactagaaatttagattggttacaatcaaatgtccctactcgaggaatgattaataaattatatacccgatttcatggtgatattacatgcttaaatcatgaaattatattggaaaataat

SEQ ID NO: 10069 - DNA, 213 bp, Candida albicans
tttgaattatcatattgcaactggggggatgtgtatattttgatgcaaaaaaaaaaaaatacgaatggtttagtatttacacacacacgcacacacacacacgcagaaaaagaagtagccaagtcgtgccggaacaaaacttatttttctctgggtgctacaaatttttcacatcaagaaacttcttttcaatccataaattcaaatcaataa

SEQ ID NO: 10070 - DNA, 207 bp, Candida albicans
ttcagatcattcaacaatatatcacttgtgattcctagccacatgttttccgggacagtttcaaagtctattatgaatggattgtatttatattttgctttaatcctctggtcaaaagaagacaattcgaaaaccaaatgggacaagatcctaccagtcccttcagtcttcacttcgaaggtgcacagatcgccacaatattctcca

SEQ ID NO: 10071 - DNA, 240 bp, Candida albicans
tacaacaacaattggaaagacgaagttattggtagctacggattcggattctcatctcttccagtttattataaaccctgccttcatttatctacaaacagagtaatcaaagcagaagcgaacacgactttttttttattaacttaccaccatgtcattgatcaggaaaagggtatgttgaaattgaatataacgtgtaaaacatttgtaacctatttttggcttaacaatccattgtga

SEQ ID NO: 10072 - DNA, 1452 bp, Candida albicans
aatattgtttttaaaaacaaagagttttatttatttgtgatgcctcaaagaattatgctgcagtttatgccaatatccaagagtacagacatagatttgaatgcacacgaagactcaagtaatcttgataattctggttccaccacaaagacttcaggacatgaaattgttaacatttctaaagtacctaataatgggaacgaacattctgaatatgaagtaaatggggtaaatggactttcaatcttagaacattcttcacctgaacctaaaaggaaaacaacaacttaccaagagcgtgtttcttatattcctaatcatgattttactggcaataaaagttcaatttttgaaagttctcctcaaccatctattccaaatacattcaaatataaatcacatcctaatgccaaggcgaaagcattaggaagcacccaaataactgaggaaacttcacaagaacaacaagaacaaaatggagacgttcaaccaccattatccacaaaacaaacccccaagaacaataataaagaaaacactactcccagatggatgccaccagtactagatgaaaaatggaatgttcaagatttagaagacattaaatttactccatcaatgccctcaatacaaccacaacatcatcaacaaccactatccaaccaatcaagaggaggtattagcccaagtcctttccaggattttgagattcatactggagatacaatgatccacaatagtaatgttcaatcagtggagacaccaggatatagacgtgcacgtcaagattatgaaaagcaaaagggccccgatatgttgaaatcaatatttcctactgttggtggtggtagtggtggtagtggtggtggtgctggacccgacgagaccaacacaaaagatcattcgacttcatctactatatctagtatgtttggtactatacaaaaacgacctgaagaaattaaacaacaaatggaaaccataaatgaaatgaaaaatatgaaaaacccagaatctccattaaagttatatggaccaaaatataatacttatactagaaatcaattagctggacttgtggaaaatttaaaatccaataaaaatactccggcacaaaatcaaaaccagaatcagaataaaaatcaaaaccaaaatcaaaatcaagcaacgagcacaccatcacctaattcagtattatctaaaccacctgctttaaatcttaattcaaaaatagtgaatacaccacctaaaaacattaagtcattcaccaaaactggtgcttatgatgaaaaatcatatcttaaaaatgccgaaaacatttttccaatcttaaaggtaaaggatttaagatcaataacaacaaccacaaccataataatggtgttagagttgtatcacaggcgacaaacacatctactcccaagaagaaaattagtcatggtgaatccatca

SEQ ID NO: 10073 - DNA, 213 bp, Candida albicans
  unsure (149): Identity of nucleotide sequences at the above locations are unknown.
tctgaacaaaagattttcgaatatggttttaaagaccgattggatgattttatgaatgtccccgagccagtaaccttgggggtgaagtattggattccgtttaaatcaccattatttttgcatctgctaggatcgtcccattcaattcntaatgcaacagtgtttgttccccaaacaggtaggttaccaatatacctaatggtgcccaaatag

SEQ ID NO: 10074 - DNA, 246 bp, Candida albicans
cgaaataggtcacttgatattagtttactaacgcaagatttagaattacaagaaattgtgactactcccacaaatgaagagttggacaatttgatagaagtatatacgaagaagatagaaaacttaagtttggagttggaaaagtgtcgatacaatacctctgtgactggcgatcaaaatgaattaaaaaagtatgtggtgcaactaaccaaagcaagaaaggaacgaatcatcatggtatgttaa

SEQ ID NO: 10075 - DNA, 210 bp, Candida albicans
agcaaaaagccacaatgcttagagttgaagcggaaatcttcaaaccgattctatcaaaataggagaaaggaaacgagttcttttcttcaatcatctattatgtattactcctttccatttgacgttctttatgttgtttgcgaagctcggttgagaattggtgctacacaaatgaaagcatttaacaatattattattacatattattga

SEQ ID NO: 10076 - DNA, 186 bp, Candida albicans
aaaataaatgcaaaactttctacctggctttgtagttatagttcacaacaaggctgtagatataacaaacaatttagtacaactaccgtcttagatgtagtcacatccttacaatctacaaatattcaagcaaggaaactcgaactctgtatacgaatacacagtaattcgttgcaaaagtgttaa

SEQ ID NO: 10077 - DNA, 240 bp, Candida albicans
ataccaagacctttaacgatacgagttatctcctatttttcaattacacggaaattgaataacaggcgtcccagttatactacatcatctcgagcatcaaatctaactattatcaaaaaaccaacaagaataaatagtttaattagtttggacgacaacactaataacacacatgggtttaagatccatttacaatatgagtttgagatttgtttcggtattgaacagatttctctttag

SEQ ID NO: 10078 - DNA, 195 bp, Candida albicans
actagtttcagtggatgtagaaaccaatttcgagatttacaagcaataaaattatttgtacagccacatcaattatttgaatgtgttatctatatcttatgtccgatggaagtgcaccataatgaatctttttcacaaagttattcattggtatttgaaaagacttccatttttttttcttgtcgttttttatga

SEQ ID NO: 10079 - DNA, 183 bp, Candida albicans
ttggcaaatatgttacccagtgaagcaccatttgcaattgttgaacttccgaatgatgacatatggatgaacaaaacaaaaaatgatgtatgtgttgatgaaatgcaaaaaaaaaagaaaataaaatatatttggatactccttttttcaaaatttgggacgattgatataaatcagacttaa

SEQ ID NO: 10080 - DNA, 186 bp, Candida albicans
actttcgagagtaaaactgatgcacatatcccagcactgccagatcctaattctaaaatggtgaacgtttttgataattggaacggacattcaggtgaaattaaccaatcaatgaaaaaaatagaagattgcccacatataaaccctgttgtattcgacaacagccgtagaaagactattccccca

SEQ ID NO: 10081 - DNA, 204 bp, Candida albicans
aagaaaaaagagcatttcgccaactttagagatcattctagtttctggaatgcagctgatataaatatagtaaaagaaaatattaataaccttatcaattctttaaaatacagtaaactacataaccattctttagatcatcacttaacaaatgatcaggtacattatatagtgatagttccccgctttgaacaacttcggtaa

SEQ ID NO: 10082 - DNA, 180 bp, Candida albicans
  unsure (9),(16),(62),(135),(159),(160),(162): Identity of nucleotide sequences at the above locations are unknown.
tacattttnataattncccaactatataaacaagcttatttccaagaaatttattttccttnattccaattgaatattttatttttagataattatattattctatataactttatttcatcaagagcttttttncatcgtcacgaatcggcaaatccnncncttgtgtgttccccggag

SEQ ID NO: 10083 - DNA, 315 bp, Candida albicans
agcgcgtgtccttccatccccgtggtgaagaaaagcacagttgcaacagctgctgcatctgcacctgcacctgcacctacggtatcgagaccagtggggcatccagggaatgaatctactttaagaattcatagacctggtggacatccaggatttgagtccacgttgacagttcataaaccaactgtcactaatagaaatgaaaatcgtaaattcagtcctgttcccaaccccactgcacaagataattccaagaaaagaacaaatgaaggtcaacatcaaagaccccaaattaaaaaacctaaagatagttag

SEQ ID NO: 10084 - DNA, 210 bp, Candida albicans
tttgcaattagattatgtatacagataaatatgattgttaaccgagttaaccttactttatacaatgaaggatcatgtttaacctatatttattttggcatcacacattattctctttcctcctcccccactttttcgaactatgaaaagtttcccgctgtacagatcggagctaatcaaaattctattttaatttttgttgaccagtga

SEQ ID NO: 10085 - DNA, 216 bp, Candida albicans
attcccgaattcatattatcatttgttcttttagattttttgaaagatgattctaatcaattaaagcaaaaaaatatacaaaacttttccaatttcaagagtttgaagtatttggattgggctaactacaaagaaatggaaactttaaaaaagagagaaaaaaaaacagaaaacatgaaatggatcttacacttgggtatttatataaaaaagtaa

SEQ ID NO: 10086 - DNA, 402 bp, Candida albicans
  unsure (20): Identity of nucleotide sequences at the above locations are unknown.
tccacaacccaaaggatccnggaaaaaatccaaaaacttatgcgacttcagtcgtatattcagctttcactcgttccatatcatctctacccgatgatattggaaccatacttacagggtatatatattggctacatggaggacgctaagaaaagtccagccaatgggagagagtatagctatgttgacgtcttgatcgcatttgtcaaggggtctcaattggaagtagctaatgcaaatgcacaggtcgagttgtttaatatattgccagttccagggcagacagtcggtgatttcatcgatgccatccaaggaaaatacaggcaattaaagcaatataataatgtgttcgtctcagttcgagcacatgtattcacacactgccacaaatattttatatga

SEQ ID NO: 10087 - DNA, 213 bp, Candida albicans
ggatataagaatagttatacaagaaatatgcaaaaaaaaacgaaagtcggagggaataagggaggtttatatagtgaagaaatttgtttgtcagcatttgttgcaaacacatttaacacattatttttggtgtacgtagttagagattcatgtggagaatatgcaggttgtggatacaattcacgaccttctatttccttagtgataggttaa

SEQ ID NO: 10088 - DNA, 216 bp, Candida albicans
  unsure (55): Identity of nucleotide sequences at the above locations are unknown.
acagcaaatactgtcgttaataggaatcagaggcagaaagggaaagagagagaanataaaaaaggacacatttacacgtacacccttaacttgaaggaaaaaaacaaaacaagagagactaagaatagagaccaagaaaatacttttcaacaacgaaagattgagatattggtgattttcacaaaccaaaaaaaaaatacacaacttgtatattaa

SEQ ID NO: 10089 - DNA, 246 bp, Candida albicans
aaaggtcatgaatctattagtcaaatttcaaatcctgtcgttgtttggtattcgctaagaaatattaattatatgtgtgtgttatgtttcaaattgatagagtcaagtgcattttctgtttttaattttagttgttcaagaaccgccggatccaagtcatttcagaatttagcttcctacctggttaaacactccggctcatataaaatatttgtggcagtgtgtgaatacatgtgctcgaactga

SEQ ID NO: 10090 - DNA, 183 bp, Candida albicans
ttcctattaacgacagtatttgctgttcaaaatgagaaatctacttgtaaacgatataataataataataacaagagtgtaacaacacttgagttactaggctgtcaaatttttccacaagtttcacaacattatatttatatcattattcaattatttctagacattttatatatttcatga

SEQ ID NO: 10091 - DNA, 189 bp, Candida albicans
tcacttacggatcaagtgatagccgtattgaaagaagccagcataaccatgccagatggtgttccagttgactacgttgctgaaaacttgagtattactaaagaggaaagtcagttccaacttttaaaattgaatgatgaaggtaaagcttatgctggttatgatgacaacagttatcttgtgatttga

SEQ ID NO: 10092 - DNA, 225 bp, Candida albicans
gggaagagagaaattaagaagcaccaaaaagaatgggacagaacccgaagaaatttatcaattctcaacaagaaattagaaagagttagaatcttctttcataatttcaattcttattcttgtattatcaacacacaacacaccattatggttattttaaacttatttttgaatacgtttttatttgccggtgttaatactatagataacattatttattcctag

SEQ ID NO: 10093 - DNA, 288 bp, Candida albicans
aaaagcgaagaacatggggtgcattttttaggcaccatacttgttgatgttatttcaacaatacaactctggagcagcaatgaaatacccgattgtttgaaaatagaacaaacaattaagcaatacacagcatcattgttttttcttaatgcagagcaggatctagtaatagtaagagttagccaattattagatcctacagaaaatggaacgatgaggttgactaatggaaatatggcaagcggtgaaatggttcaggaaaaagataaaattaaacgcctgaactaa

SEQ ID NO: 10094 - DNA, 267 bp, Candida albicans
ccgatgaccgttatggaaactgataatgggtggcgcttagtagtcgtaatagtattattacaattatgcacccccccccccccccccccattggcagcaaacatttgtttacacgagatacaaagtaatagaaacccagccaaggaagaaaatcaaattcggttatcgagtaagaaaatagaaataaattcacacaagaaaaaaagaaggaatagcataacgaagatttattactaccaccacaacaacactaacgatagtaaatga

SEQ ID NO: 10095 - DNA, 237 bp, Candida albicans
ttttcttccttggctgggtttctattactttgtatctcgtgtaaacaaatgtttgctgccaatgggggggggggggggggggtgcataattgtaataatactattacgactactaagcgccacccattatcagtttccataacggtcatcggtcatttctatgtgacccgatctctttcgcaacgtacagcatgtttcagctttctaccgcccgcctggaggatatacatcggcggg

SEQ ID NO: 10096 - DNA, 1605 bp, Candida albicans
caaactattgtattttgcctccttaatactactgccggtgaaatgaagtcaacaactgccgctaatgttgatttttttgaaaacctaacaagtcttccgctggatattattgctagaatcattgcttacttgcctaggtgcattttaccagaaatattgtcttttgcacggattagagatattgttgcttctgaaattttgtcagccgtagacatcactgattggacaaggaattgttataaaaacaatgccgctagaactagagcctcccattgtatttgtaatgtgtttaccataaaaccaaagaactttaaattagcaatggaccaatggcatatgcatcctaaactactcaagattggggatttctctacatttcaatatattttggagactgatccagaaattctacacaaagctatacatcttcatggacgttttcatccggaaaatatcgatgatccaaacccatctttcgagttactcataaattctggtactaggtttgattctttattctcgtcatcttttggaaatgtgcattcattacccgctattaccaaaaatctccagttatcttctaccatattggaagattacaatattggtggactaaaaaaattgtctttggatatgacactccattctgaaacggaagttccatacaatttgtattctaatatggaggaattgcacttattattgtgttacccgactaatatgatcttgcctaaaaaattacgtaaactaatcgtcgacacatcacacgaaaatagggtagcttttgcaccacaagcattgttcaatttagaatatataaagtatttccagtcatgtatgaagtctttaaatgaaaccagattagttaccccgaatttaaaactgttatacctttcatgttgtcataaattttcagatttcggaagtttgaaacgattaaaacatcttcaagatttaaaaatatatgattgtatttacccaattgatttgtttaacggcaaggctttttctgagttaagaaggtttgaatatacagcttcatctattgatggaaaattgccaaattttgaagttccagaaacttttaagaatttaaccttgacttttcctgcaaatttaaaagtgttatcgatcaacaatgcaatgtttatgaagatcaatttaaacactttaaaacttcctacttcattgacaaatctaaagctttcaaatacacccttaagtgaaggatatttgtattttccagaaaatttaagatttatagagattgacgtgccaaaagtatcatttaaaagtgattttcagcttcccagagcggccgtacaagtgaccatagaggccgatattattatttttgaagggactgattttatctataacttaccagagaagctatcacatttgaccttgaaggctggctttaagggagcaatagtgcctttaactcagaaagtcaaatggccctcactgatgaaatacttttatttaaagaatttttatactgatgaagagcaattaagattgttaaatttgaaagaatcaaaccttcaaacgattgagatttttagaggtagagttaagaaattgcctgatgatttattccca

SEQ ID NO: 10097 - DNA, 411 bp, Candida albicans
atccgaaaaggctatgttcgtgtacacttgttctttttttttgagttgagagaacagccaccaaagaaaatctatatagaatcaattcaatactctcttcaatactttacaagcattaatagcacaaaccattcattgataatgtcatcttcccttggagctccatataacgagtatgcccgtttatacgatgttggatcatctccagtcgaatccagtccatctacaacctatacaaccgtgtttacagtgttattattattacttgcattcggatctctatccatggccttgttaagtgacgtgaaactgaaaagcgctgtcagctacacactccatgcaattgttgcttctatatcgattggtttatctgcaatttatgtgtctaattatgttggtgtttatatttag

SEQ ID NO: 10098 - DNA, 216 bp, Candida albicans
aggtgctatattacaagtgtttgttttacagagagctttgtcaacattgatttgatggagacgagtgatagaaagaagattatcccattggtttatattttgctagtaggtgctggacaagcaatagttttagggtcaaaatataaagttgtctgtctttttttgactcaagaaatattgtatagattgagacatgattgtataactccatattga

SEQ ID NO: 10099 - DNA, 312 bp, Candida albicans
ctgcaagtaataagaatattcaatttagtaagacgcgaggcgaggcgaggcgaaggcgaggtaaaaattgtgtgtgtgtgtatatgtgcgtgtgtgaaccaaaacgttttaaactttctcattggaaaagtatatactcttactcatacattatacatttatactcctacttacatttatatatattcaaagttagtaacatcattgacgataagggatcatcttacaagtaacttaataactaatctacaaatctactcatttacatatatgtatttattaaccttttttaatacaaatttcattttatag

SEQ ID NO: 10100 - DNA, 729 bp, Candida albicans
tcaaatatggaacgacgaataagatttcgacgactgtttcaagattcatctgaccaacaataccaacaaccacaacaacaaggattgggagtatcacgacgatcaactctgaatagatttgattctccaacttcattaacacctactaatactttacaaacaactgttgatcctataattattactagagccatccatgactataatgacgatgacgaggataacaacacaatctatgcaacaacaacacaaccattacatcgatcaaatactacaacttatacatcacatttcactcgaccgaaagtaacaacaatattaagtttaccacaaaaattattacaatggatatattccatatcattgattttaatcttattattattattattagtcatcagtgttactattcttgatgttgttattcaaacattacaatcaccatctgatctggctcttaaaacttttacagtattaggagcatgtggatttttcatattcatttcgataattatttattttgttcgactttatcaattacgagtttctattaataatattcctaataaatcattatatatcccatttgaaaatgattttgctaataaagcaatcttccattatatcgatgataaattaaaatattgtcatgaaattaaatttaaaagtggtccactacaaaatgccattcttcaaccacggcggctggaaggatcacgctcgggtgat

SEQ ID NO: 10101 - DNA, 363 bp, Candida albicans
aaatatattttgaaatttatttttaaatcatataatatattacttctaactactgctctttatttaatttcattaattatacataatgaacaagtaatcaaccaaatactaacaagtataatcccaatttttttattaatttgccaatcatgtttagggacaatatacattaaaaaacataaagttgcaaacaatgataaacaaataataatcaacgtatttgtcaacttcatttcaagtttcttatcattaccgtctctaattatcatcccacttaatcctgatgaacaaatagctaataatggaccaccaaaacaagcagtgaatgccattataggtttccccatcatggcaatagtataa

SEQ ID NO: 10102 - DNA, 987 bp, Candida albicans
  unsure (187): Identity of nucleotide sequences at the above locations are unknown.
agtgtttttgatagaatatttaatttgttaaataactattatctattccttgcagtactcatgtattcaagggcaaggccaacaaaaagaaagcgaagagtgaaagaaaaaaaaaaaaaaattcttcctcttgatctacagttaacttcccataatcaaccaccaccaccaccaccaccaccacgantaatgagtttaataacaaagacgataatttttaaaagaactttaaccaccaagttttctactgaagaagccaaaaaacaagctgctgcacaattagccatacaatcacttaaagattttggttcattactttcaaattcatccgaagatactcaaccaatcgatacccaaccaatatataataatcccgaattatttgcttcattaagtttattacatcaaggacaagtgattaaagaattacaagataaatttgataaagattggttgaaattaactttaaaagataaaaaattgagttattatattgcttatggaaattggggagttcgagaaaaatttataaattggaataatccaaatgaaccaccattagatttaccatttaaattaccaacaacaaccattataaaatcaagaaatcctgctgatgatgttaaaacgaaaacgataattaaaaaattacctatggtgaatttaaatgaaactgaagttagaaaagaacaatttgatattaaaagaatggatggtgttacgaaatttttcatatatttgatgatatttatgtcattattggctattgctcgtgataaaaatattggagaaaatgggaaacctgaacaaataattatagaagataaatatgaaatacaacgacaagaaaggttgaagaagaaggaagaagaagaagaagaagaagaagaaaaagagaaggaaagacttcgaattgaattagaagaaaaacgacaatttgaacttgctaaaaagaataaaaaatggtattatttatggttgaaatag

SEQ ID NO: 10103 - DNA, 237 bp, Candida albicans
caacaacagttaataagaagaaggaaaaactgtctctctattgaaatgcgcaattattcattcataactctttctttctttctacatttttttactcaatttaacttaaacctaacaaccattttgatatttgcagatttttcttggtattatttttgtatccttcaatcaatcaatgaaaatgttaaacgaaaaactaaactaataaatacttttatttcttctttaatctattaa

SEQ ID NO: 10104 - DNA, 207 bp, Candida albicans
  unsure (187): Identity of nucleotide sequences at the above locations are unknown.
gatccgatattcgcgcagggcagagttcaaaaaccctatggatcaaacaaagaggtggaaggaagagaaaagagtgttttatttgttgtccgggagaggggagaattgaaaaggggaggaataccctatgaagaaagaaaggggagggaaaaaggctcccccccccccgccccccgcaaattaaggnaaaactcacacaataattga

SEQ ID NO: 10105 - DNA, 258 bp, Candida albicans
aaaaagggaacccaaattgagttatttgtgttaactaagtcgattgatgcgaggataaattatgctttcatccactcaccacctcatcactcacccagagaacccacccactcgactgtcacagataacaacatagataccagtttattgctcttattgcaagcaaacctgaaatttgaaattgtgactaaaaacaataggaataggaatacagaagcaaaaaaaaaaaaaaaaaattgcaaaacaaaggaacaataa

SEQ ID NO: 10106 - DNA, 297 bp, Candida albicans
ttcaagtaccagttactgtttgagagtatatatattacattattcgttggagtggccaatttcgctttagttcacatccagttgatcccatttttcacacccacacatttttttatcaaaatcacctcattcatagtgtatttttgtatacattataaaacaaagaaaccgaagaaaaaaaaaaagagatcccaacatatatataaatatttttcaaatcccagattatttacgataaaaacttcatttttatatcaaccatataatagtttcttttttcaattcaacacttcataa

SEQ ID NO: 10107 - DNA, 363 bp, Candida albicans
tatagagtatgcaaaacaatcccctttcttgcatttaatgagcatgatttatgtttgtgtaacaaaattgaaaatcggaatgagatgagttttagcagtggaaaatttttatttgtatttttattttttttttttttcaagaatacttcttgcagtaatcaacgaaagtatataacaaaacaacaaactatgagtaaagataaaaaggaacataaggataagaaaagaaagcatgataacgaagatgttgaaatagcagactctaagaaacaaagaaagttagagacacaagaaaagaaagataaaaaggatataaaagacaagaaggaaaagaaggaaaagaaggaaaagaaacataaatag

SEQ ID NO: 10108 - DNA, 258 bp, Candida albicans
ccattttttcatgcttcagattcaacacgtaattcaaaaagccttcatttcaatatttcaaataccgtacaaaatattaccaataatgatgtaaacccgcttaataatttgacccaatcggtatctacacaccagtgtttaattattacttgccagaaaaattctattatccagaactttttactctacaagaagatttcaaattaccttataatattaactagtaatacatatacacaaagaacaaataaactctag

SEQ ID NO: 10109 - DNA, 195 bp, Candida albicans
tgtggatatatcaaagataatgaactgcttgaactcaatgaaaaagatggggcaactaatgtagaaaaactagatgaagccgaaatatcactttcgtcactgaatggcagagatgatgagtcagaattcaaactagaagatgaatcgaaactgctctcttcactctcgggaatgtggacggagcccgcacataga

SEQ ID NO: 10110 - DNA, 273 bp, Candida albicans
gatgtagccaatgaccacaagttggagactattacgtggtcatttactattaaactagatgggtgcaattttgttatcagaaaactatatatagtaaccccaagttaccattctaacacaaatttctctaccacaattaaaattaataatactttaatcaataataggattaggtttgagcgtatcaatagatttccagattttcaattgcgtttgcccgtaacagcttgtataaatgcgtctgccaaggtttggaaaacggaatgtgtttga

SEQ ID NO: 10111 - DNA, 345 bp, Candida albicans
ttgcaaatggcatatggaatcagattaattggaggtataattaccttatatttattctatgtttggacatttgtatgtccgttgactacaattgacactgaatctaccaattcattaacacccatcaatcatcatttttgttcattgagtaataaatacatcaaacctcaattttatccaatatatcaagcccacattaatcccgttttaattaatttagatgaatctttacatgttggtgaaaatatcgataaatcaattgaaataatccataatttcaatcatcaatatcaaataagtgattcttaccatcgggcgtcttcaccagaagctgcggatcaacgt

SEQ ID NO: 10112 - DNA, 225 bp, Candida albicans
accggtggtgaggctaattacgcagataacgtaaactctggacatttttttttacttcaaagttttattaactcacagataggaataatccgggcacgctggcaatctgtcttatacggaggatgtggtgtgatctataaaggcatcaaatcattggcgaaaacaaagaagaaacccatccgaaaatatcctggcaacagttcaagttcactgttactgttgtaa

SEQ ID NO: 10113 - DNA, 351 bp, Candida albicans
ctttatagttatcttcttaaaattctttccatggtctttacagttaacgaaactgattttttcatcaagctagcagaacttccatcagaggttactactttgatagttggtttcttaccaaaatgtatgttaccagagctattgtacttcccgccaattagagagattgttgcaggtatgatatgtttagatgtaaatattattgctgaaagtgaaagagacaaagctattgatgaaccatgtattgaatactcgaaatgcacttgcaaacaattcctaatcacacttgatgatttgaggaaaggtattcgtcaatgcaatatatttccgagatccattgatattagatag

SEQ ID NO: 10114 - DNA, 1851 bp, Candida albicans
ggaaaggtattcgtcaatgcaatatatttccgagatccattgatattagatagcgcggcacaattgagaagtgtcgtgaacactttccccgaacttttaatggatgctctgagtattaattgttttttcgatgggaaagaattttggtcccggtaccctgaaaactcgttaaggctatttctgggctccaaaattaagcttgattttttgagtttatcaaatttttcgaatccactcacaattcttcctgttgttaaaagaattaaattattgaatactgtattaacaagttatgaaatccctggtgtaaagaagatggatatcaacttggcacctactggtgtggaagaccaaatatacaccttttcttctgacttgaaggaattacaaatcaaaactaaacggtcgatcaaagtgagtttacctccgaacttatggaaactcgtgataggtacacatctgagttcagtggattttgtatctgaagaattgcttaatctaaaggttttatcactttcgttgccaaacattgaattttttcacgaaactggaatagttgctccaaatttgacaaagctagtcttgactaattgtggaaatttgtccaattatgatgaattacgacaattccatcatttaaaacacttattggttgaaaattctagttatcccatagatttgtttagtgaagactctttccccaagctagacaaattggaataccgtggatgttacatgccaaatttagaaggatctagtaacacattattaaagtttcctacaaaattgaaggagttaaaaattgaaaaggctggctttgaaaaggttgatttcagcaatttggtactccccaccggattacagattttaaatcttcgcggtatatcctttaatggtggatatttgagtgatggtttacggagagtttatatccgtacttcaaaagttacattgaaaagcaactttagaatccctcatacggttgaaaatattcttttggaggctaattatttaattttacatggtttgaattttatgtgtcatttgtcaaccaatctccaacagttacacttgattgctaatgatctggggaaaatacaccctaccactaaaatggttgcatggccgctgtcgttgaatgatttcgtttttcagaatttaaacattgattatcgaacattagagttgttgaacttgaaagaatctagacttgagaaaatcgatattcagaaaggtaatatcaaaacgttaaatgcggacttatttcctgctagtgtgaaagatctttctttgaggggaatggggatccagcaattgtcggactcgtttgaaaatttggaaaatttacaaaagttatcattagctggaaatgaattgagagaattaacttctgttaaattgccaatggcaacattagaatttttagatgttagacattgcaaccttcgttttatatctccatttttggtttcaatgattgataaaaagaataaaaaggctaaactcagagtcgaagctacaggaaattggaatgttagtgtcgtcgatatcaggagagcattgaaagcatccaaaggactttcattatatctcagcaagctagatgaagatttggtagaaatatcgaagcgttcttctcgtttgcattttaatggtgaactccttgatacgtatattaaaaaacccaaaacggacaatttctacaatggtagtgactccaatttggatgaacaatctgacgttggtgtaatgaaatcattatcttccgagcaattccctgttgctaaccaacaacgacgtaatcgtaatcgcaaaaaacaatcttttgatgtaaggaccttccttccatag

SEQ ID NO: 10115 - DNA, 222 bp, Candida albicans
tcagcttctgataaagaaaaaaaaattgcggctatttttttttttttttcacggcaacgtaaaaatctaattttattctcaggtcccacactcacaagaagaattatgactcataattttcaatactcaaaattatataatcaattggaaatttcctacaaattgaaattcttaagtcagtcatacacactcatttactcactcactttcacaatattttga

SEQ ID NO: 10116 - DNA, 216 bp, Candida albicans
caagtgaaacattcaactttaaaatttgcaatacagacacttctaattacacactatctaacattagaaaagatttcacgtgttttcgaagttttttcaatatataagaaaacgcatgaaagcatagaagtgaaatatgtttatgtgtttatattactctatgcaatgaataagttgaatcatagagagattaattatatgctaactaaaaagtag

SEQ ID NO: 10117 - DNA, 222 bp, Candida albicans
tttccagtttcgttattattttttttagaagttattaaagaatttggattattacttttaaacattttatcaagacctgaggatgttttttacgagacttggatatttccggcacgtgattgtcgtggtgggtcgagtgagcgagtgagtgagtgtacaacattttacactgtgacaataaacaataaatcagggcgtaaagacacgcacaaaagatcttaa

SEQ ID NO: 10118 - DNA, 183 bp, Candida albicans
cttcacgttagtcctggtcgccggctgttggacacccttagaaaattctcttggaatcatttaactatttttaactctggctggaattatttttcctttcaagtgaacttgtcaatattctgtctggctaatcttacatttacttccaaacaatatttagttcatagtttcaggaaatgttga

SEQ ID NO: 10119 - DNA, 282 bp, Candida albicans
  unsure (239),(242),(245),(248),(249),(259),(265): Identity of nucleotide sequences at the above locations are unknown.
aaaattaaattaaccttggagaagaagaagaagaagaaggagaaaaaaatctcattaaaagacaaagacaaagagaaaaatgaaccaccaccaccaccaaaagaaaaatccattgaacaaaactcttttaataaacaaaatcatcataaaacaatgcatatgattcaacgagtttcaagtattggattaagaacattaagatcatcaaatattggttcaattagatggccgaaccattnttnccntcnntggaacagcnactcgnatagattaatgcgaact

SEQ ID NO: 10120 - DNA, 198 bp, Candida albicans
ttagctccccgcgggactcgaacccgcgaccctgagcttgcttgtcatggtattaatttacacaagacaccggaggcccaaatgctaaccaactgcaccaggggagcatatactacgttgtcacgtgacacgttgctgtctagagaccataatcataaccactgcgctatgtcagtgatatcactcaaaaaaatttga

SEQ ID NO: 10121 - DNA, 216 bp, Candida albicans
ggctatagccctaatgtactgtatatgcagtatcagaaatacttttgttacgcacagtttgtcttaccaaatacattatatatatatatttttttttttttgagtagaggagctacactagaccacagtgcgaaaaattcatctctctatacacttactcaatttgaagatattcaaatttttttcaaaaaaaaattccttttggatcgatactag

SEQ ID NO: 10122 - DNA, 186 bp, Candida albicans
tggttatattttttgaaaacagattttattgatattaattgtagttatatattagattgtcgtgcgacacagacacagacacatacggagattagtgtagaaactgctggtggtagtggctgcggcagcagcggggaccgggaccgcaaggtattttcttggtgtcatcatcgttgtagagaatga

SEQ ID NO: 10123 - DNA, 294 bp, Candida albicans
tcttcttctggttatggatcatcacatactggtacagctgctggtgctggtgctggtgcaggatacggtgctgccaccactggtagtggacatggcgattccagttatggtcaaacttctactgggcatggtacccactcttctggcagccatcaaggacttagttccaaattcaaaacaggtgttgaccatcttgatgctaagattgcacaattaccagaacatttgcaaaaggaagcacacaaagaattcgaaagaggttacaacgatgctaagaaatcatttaaatcttaa

SEQ ID NO: 10124 - DNA, 186 bp, Candida albicans
aaacatcaaggacaagaaaaaggccatcgattaaatttaccacattttaaaaaagattttttcactattatttctatatatagtcaacgatttccttcaaatgtacattttttgatattttttttgttttctttcttttacgttttggttctagtattcttttcttaccagttctttaaactttaa

SEQ ID NO: 10125 - DNA, 231 bp, Candida albicans
  unsure (52): Identity of nucleotide sequences at the above locations are unknown.
cccggggcaggaccaattttcaccgcatcaccaccagttttttttattgaantgataactttcaaagaaccagacacctctggagaacaaaccagcagcgatcaagtacaagatacaagtggagatgatcaagaagatttgcatcgacatattggaaccaaagtagtacaacaaggcacccactgcaagaccacaaattataccaacaataactgggattgggaaagatga

SEQ ID NO: 10126 - DNA, 201 bp, Candida albicans
  unsure (152): Identity of nucleotide sequences at the above locations are unknown.
agtgttgaccaaagaaaaaaaaaaaatttttcatccccaaaaagggttatgattccaagaaataaaccgccgatggaaaatccgtgggttccttactcctttgaattgaatccgggaaaaaaaaaaaaagaagaacccctgaattggagaanaatttttaccccggataaaaaacgctgcgataaatttccatttatccgg

SEQ ID NO: 10127 - DNA, 219 bp, Candida albicans
cttaaaagtgacaagacgttcaccggattgagtgagactagcaataacaacaacaacaccaatggtatcaattttgttgacgattttcatgtggggaatgaatttggagatatagattttgaacatcattattctcaagatcaccaccaacaacaacaaaaaaatgataacaacaatggcaacactaatttagacagttttattgattttgaaaattaa

SEQ ID NO: 10128 - DNA, 378 bp, Candida albicans
catcatatcttatcattaactaaattatcaattatcatgtttcttcataatttattaaataaacatcatcaacataatcaaccacatcacccacaccatcaccatcatcgtcaacatcatcatcatgatatgaaacataatatttactcaaattattatcctggtcatacttatgctgctactgctcctcctccaggtagtccaccaccagaatatgggttcaatcattcaccatttaatgcccatcatcattatcatcataatcataatcgtcgtcattcatttggtcctcatcatgaacatggccattttgatgggccaatgggatcacatggccaccaccaccatgaacatcatggacctcatcatcatcgttga

SEQ ID NO: 10129 - DNA, 243 bp, Candida albicans
cctttctcaaataaaatccaaattaattttgaaaaaaccaaaaatttaaaatcaaatgaaataccttttgaagtactaacttatttgcaacctaatagaatcaacgatgatgatgaggtccatgatgttcatggtggtggtggccatgtgatcccattggcccatcaaaatggccatgttcatgatgaggaccaaatgaatgacgacgattatgattatgatgataatgatgatgggcattaa

SEQ ID NO: 10130 - DNA, 195 bp, Candida albicans
tccgagttcttccattttcaaactattcaagaacaagactgcttgttatgtttaagcaacaattatttcatgtcactacgtaattgttttaactatttacattcagtattattaagtaatctcgccatttattgtgtttggctagcccaatttaatttccagacacagattttactactattaaaacaaaagtaa

SEQ ID NO: 10131 - DNA, 195 bp, Candida albicans
ttgtatattggtagtggtggttacccgagcagcaatagaagacactcactgatgaagaggagaagattaaaaaaacaaagcagccgacactgtagagaaaaagggttgtcttggagaaagaacaataatgacatcaatgataatgggtattgttttgagttgaaaaatatgattctacttaaaagaatagaatga

SEQ ID NO: 10132 - DNA, 726 bp, Candida albicans
aagactatacgaccaatgcatcaacgtaatcaccactcgatattattaacacttttactttatctccaatcaatagttgccctagcacgaattattgatccagaatttgggacctacctgaatcctaatcctcggaagtatccacaatgtcaagccaatgatttagtaaaattgtcatcatgttgtaatgagttgttacacaaattggaccagtgtaaatcagacgatttggcttgtgagtgttgtgcattacaactgattgatcgagactgttatcatttgtgtcctggtaatccactgacaaactttttaacggttttactacaagattgtgctcaattaagcgagataaatgcttgtgcattaccattcaaaaagacagatgatttgctcgttgacaaaaagaagggaactccaaattccaaatccgcagttcaagcgttagaagctgacgaaaagtatgatgctagtctcaagagtaaagtgcataacaaggttgatgagatcaagagccacgtcaaacaagaccaattcctcaagaagaaaatcaagttgcttatcgataaagacgaaacatttgcaattcaaaaccactcaaataattctaataacaccatttcggcaaaatcagaaagtggatcagtgtgtttaacctcatcgtacttaaacagtccaataattatactttgtgctattctaacaggaactcttttcgctatgtattaa

SEQ ID NO: 10133 - DNA, 828 bp, Candida albicans
gcaattacgcggtccgatcaatttttgagggtactcaaggggacaggcattgaactagacgagatttatacactacatgctatagtagcagagaattccccagttactataactagcaagttgaggattgcgtttgctgaagattatttaacgccaaacgattcggctctcatatttcctgaagtaaacgaagcggtgttgcacaaaagacggaaactagatcaagattcaaaacagagagatcacaaggggtttagatttgttaatttcgacaaattacaagggataggtgccgctagttacaaggacgcagaacccaaacaaccttcttctacaatgattttgacagactggaacagtgaaggaagaggctaccgaccagttttgggattatcaccactcacagtaaccagtgtagcaggcaagaatttcaaaaatcctacaaacagagaagcgattgaactaattgggtatctgatacttcgtgaacttctgtttaaatgggcaatgaccaatttgaaaatcaagccaattgatatagtaaaaggttttctcgccagtgttcgatcaacaaagctcatggaacaaagcacagcaggatatacaaagctagatttgatccatgctgtccaggcatatgtggggctaaaatacttggaggaaaatacaattgatggaattgcaaaatggtataaaactagactagaaacaagagatttgaatttttatttcgataaagatacttggataactaaacaaaaacctgacttagaatcgccatttcttaaccgcggggaaggccgaccgcgcttgatataccccccctcc

SEQ ID NO: 10134 - DNA, 1017 bp, Candida albicans
gtttttttttcctctccatcacttagtacttcaaagccaatgtttttcaggctacatccggttaaacgaagaaatggtctacgacagttgtggcaacatagtaatgtggcattagagacattgcctgctatagcaagacgtaccaacgaatacctatgtaaattggaaaatcaccccctaaaatcttttgcatcattaggtagagtgataaagtttcagaatgccaccaagaggagaattgatgtatcacgaaacttggacctagagatccagtcagcttttaatcaagttattaaactacgtcattggttcagtaacaaaaaagttctcgaaagtacagtggacttgataaatagagattggggtcaaatattaatcatgaaggtccaactagaccaggtattcacttccgatcatgtaccaacggcaacagaacaggaagaaatcgacaagctaatacacaacgtagtgaaaaagatctttgatttcaacctagattttggcatgaaactagacaagttgtatccaccagtcataaaatattatcaaacagacgattctacaaactatgttcaagcaaccttaaaattgcaaaccctgcaactcacaaaaccaaactgcaatgtacaaacaatttccaaaaaattccagaacctccacaagttagcgtcatcgagaacaaccagccggctagcttcgtatggctgtttgaacaaaacttcatcaggtgtgagtcaacagataattttatcgaaagtactacaagcgaggatttgtaatcgtatcaaacaaacaatcacaaatcgtggtaaagtaaaaattctcggtggaaaaccaatggcgtccgctacaattttgcaagtgggcgaagaatccagagtgtcgattaaaaccaatgtgtttcttgaaaaatacacactgaaacatccctcgatttattacaagcgtgatttaagtgaaatgagcaattacgcggtccgatcaatttttgagggtactcaaggggacaggcattga

SEQ ID NO: 10135 - DNA, 192 bp, Candida albicans
ccgatacctaaagtggtacccgatgaagaaccagaattaccagcagaattacctgatcctgaaccagagcctaaacccgaaccatcaattgggtttaaagaaacagacccggaagcagaagcagcagctgatgctttaccaccatcactaccaccaccaaacaagaatccaaataaaccttcagctgaataa

SEQ ID NO: 10136 - DNA, 1182 bp, Candida albicans
cttattaatacccttttcttactcgttgcctttgtttctttgctggtcaaacaaatttattattatacccataccctactttatacccactttatacccaccacaacatatctatacacaatggtttctgcatcaactatcaaagtcttaccacctgctaatggaaaaaaattatggagagttagaaaatcaactccaaacactcatcaacgtagcaatagcttaccaggaaataaatctacaacttccccaatactgctgaaatctaacagatcatgttctacttcatcaattgcatctaccactgctactgccaacaataataccaacaattcatcaccaatgcaaagctcatcaattgaatgtttaaacaattcattgaaaattgttgctgctgcttcaaaattcactatcaaaagaccacctttgagaagaccaaaaaacaaaccaggtaaaccaaaggattttgtttttgttgatttatcaccagttcaatctgatatttcaagtgaatctgaatctaacactgctactattactgtttccaaatcaagaagatctagcaatagtggaagttctgttactaaagctaatttaattaatgtgccggttcttcctactaatgttgcaccagctactccaatgactacttctaattcaataaattcaatcaatgagtacgatatctatggcaaaactcaagtaaatgatgcttatgctgccgctgctgctgccccaatggaaccactgttatccaatgatggatttggattaccatcaccagttgaatcattagatgatttcttgattagtgaatttgatttatgggaaaatgaagtgaattggcaatcaatgattccaaacactcaacaacaacaaccacagcaacaacaggctactagtcctgctgtgtcgcctatacttcctactgaaagtcaacaacaaggacaatatcaagaatattttgatattgtgctgattgtacaacaacaacaagaacaaatacagaaattacaacaacaattacaacaaataacaaaaaccaacagtgataatggtaatactttagcacaagttgatatgatcaattcattaattaacaatgctaacagtataccaataacggctagtactgctgctactactgctacaactaatggatttatggactttgtgttttag

SEQ ID NO: 10137 - DNA, 225 bp, Candida albicans
tcaattttcgtgaaagttgcatatattttttcaggtccctattattttgttactcttgataaacccccgaaaaacaacgccaagccaacatattattattatcgtcaaaaaaaaaaaattttctgtttaactaaaatgaattgtaaatataattcgcacaataaaaagaaaatgcaaaacaataatggaacttcttcttcttcacatttacacaataacaattaa

SEQ ID NO: 10138 - DNA, 192 bp, Candida albicans
attctgaagttttttttttgtattctgtctttttcttctttcttcatcaacttattcattcatctatatatccttatttataagaataattatattcaattaatacatttagaggagagatcaatagataaagaacaaaagaaagtattcaaaacacgttttttcaaatatgcctgtcacagaaatagataa

SEQ ID NO: 10139 - DNA, 186 bp, Candida albicans
cagagatgtggatttgcgcctatattcaatgagtacccagtgcaaaaaagaactcagaatcacctgttgttgttgcttttacgtttcagcaacaaacatcaaaatgaaacttggaacagtttaacgtgtatgtataacatattaggtaattcagagatgaatacttggaataggattgctgggtag

SEQ ID NO: 10140 - DNA, 186 bp, Candida albicans
gaggagtcttacagctttcattactatgtgatctataaaacgaggttcgagaagcgatacaatctttatatacaacaaatcaactctaaaatgcagatctatttcttaaatcaatcaatttttctcaatatcattaacacttttgttcaattttctgtctcaccacggggctggaaggatccgcgc

SEQ ID NO: 10141 - DNA, 234 bp, Candida albicans
atattagaaatgataaatttggatgtgaaagaatataatgcagcacaacaagaaattgacaaatcaaatgtgtttgaaataattaaaaattatatgatgagtaatggtggtgttaacaatcataataataacaatatatttgcaaatttgcaaagaaatttattggaattgaatgaaaaggataataaagatcatttgttcactttaattaatcttgaaaacgattttatgtga

SEQ ID NO: 10142 - DNA, 363 bp, Candida albicans
tttcaggtccaatctgtgtgcatcttcactatactgtttgcaatgtcaaataatcaaagctattccttaaaaaaccaactttacaaagccaaaggtgaagttttaaaattacaaagaattttgagaacctctcaaaacgaggtggacagattgaatgataatttggatagggtatatgatgaaaaacatgatgtgatagatgacttggagtcattgaaaagacggtatgaagaacttaaaaggaactatgaaaaaatttcccgacagaaagaattttatcaacgatgttaccagaactgtgaggcggttttgaataatgatgggagtgccagaaagaaccaatcattcaagggggtcttttag

SEQ ID NO: 10143 - DNA, 537 bp, Candida albicans
ctgaacgccggggtggtcatgaaactgtttggggtcgggaatatgaaggtgaactcgttgagggtgtcgtatcctgagccgctgcattgtcggttttgtgggagtgctgcgatctcatcgttcagtgtggtgtatgagattgagggggtggtagtggttcacacgttcagggtagataagaaagcaatatgcttgagagttgagagagatcccagggaaatccgatgtgttgggtttggtggtgcacaggagaaggtcgactggtatgagaatgttgttgggtatgaagtaacctctgtcaatctgatgatcggggtggtacagaagagtagtgggttacgaaaccgaaaggttagacaacccaaggagtatgagcttatggtggttagtttggggagtggcaaagccgagtattacgagtataacgttgatggtgtgttgtggggggttgagcggtaccgccacaattcggtgatactcaaccaggggagaagaatggaggttgtgtatgtagggaatagcaagctagttgattaa

SEQ ID NO: 10144 - DNA, 450 bp, Candida albicans
tttgaaatatatggactaaagataccaaaatttatcaataaaattcaaccaccaaaacaaggagacaaccaccaacaaattgtgccatggtataaatttttgatgcaccaaaacgacgaattggacaaggcactctcggcaacaagagtgcctccaactcatctaaaaacagccattaaggcttggatagagttaaataaaccagaaactcgaacccccgagaatgatctttacactacaattgacgaatcatactcaccgaccaaaaattacatatccaaggatttcgcaccatcaacagatactaaatactacaactccagttccaaaaaactgcaacttgcaaaaagggaggtactaacaccactgggttggacagaaagactagatattagtactgaacaatggaaaagcacattggaaaaattacaacaaaatggtcaaaaataa

SEQ ID NO: 10145 - DNA, 219 bp, Candida albicans
gcggtttttgcgaggaaaaagctgtccgtcttgttgaataggaaagaagaagtttttgaaaaatttgtgatttcttttcggggggtttacgtcctttttatattaaggagtgaacccttagacgcgtatgtaaaagtaacacatattatatcaatcatatccaatgtgcacgtactctggcctcagttattgtgttgtagagtatcatcacgccactga

SEQ ID NO: 10146 - DNA, 195 bp, Candida albicans
ataccctttttgacgtccctgtcgtctacaacaactacttctgtagccttcatatatactacactagagcaaatagagacacattatcagccttacttaactaatataatgtttattagatcaacattagtacagacacgtattagccgggatattagtgtcgtagaaagatacttaacagccgagcatttataa

SEQ ID NO: 10147 - DNA, 192 bp, Candida albicans
ttgctagtatatttgaaagcactacagtatagtatgtcagaatcagatcatttaaactctactaataatacaggaaacactttcattagtctagatcaagccagtacaataatggcagatcaaactcaaggagctaacccacaacattttgtagtcgtaaacttgaaattcaaagagaagggggggaattaa

SEQ ID NO: 10148 - DNA, 207 bp, Candida albicans
gagatgtcaaaaaaaaaaaattacaaatccagtttagaaggggttataacaaagttgcaaatggaatgcgataaccgaatgagaattactgattatcattataaaaatggaaatctgcaattaaattattcatatttacttatttctgattcaagtaatttattagaaattcttaaatcctgtactaaatcatcccacaatcgataa

SEQ ID NO: 10149 - DNA, 273 bp, Candida albicans
aaacgagataactattccaactttcgagatggaatggcttgcaacaaaatcatggaatcatggaatctatttgttgatgtatgtattttgcatttattagaagaaaaaaaaggagaatttattaacattaatgtttgcttgtctgttaatcatcaatttagagatcaagaggatcaaaaaactggtatcaagtggtgtagctttggtatattgttttcaaaattcattcatgaaaggcttttgcaacaggtgagtttcataaaccttctataa

SEQ ID NO: 10150 - DNA, 210 bp, Candida albicans
tttttatcatcaaatttcaataaactagtttacaaatttacaatggaaagtggtagattatccaattatttagaggcagcatacatcccaccacaaaagcctaccataaagcaagaggttccttcgtatcatccatgcttaattgttcaagataagcaaactgacgtaacaaaattgaaaccttgcggttgtgccgatacttattgtgtg

SEQ ID NO: 10151 - DNA, 237 bp, Candida albicans
ttgaagtctcctgtacaagtattggtgtttgtggccattgtggtgtttaacaaattgagatttgattctaatcaatatacaaaagtggtggttgaacaaatggatttgaaagtgaatcaaacgcttgcacaaatcaacagtccacaattgtcacaattgtaccagaatgctcgagcaggtgcattaaagtacctctcgttgatcaaattgcccaaagaaagtggtaaaaagaagtaa

SEQ ID NO: 10152 - DNA, 528 bp, Candida albicans
tcgattggtattgatgcagcattttgttccgttgaattattatcagaattaccaaaatataaccaattgggattattttcatgtactgacattaatgtctgtgacattgccctatttgccattttggtgtttttgaaaattgatcgatcagatacaacattattatttttgaggaaaggtttaagtattttgaaaatcatgtcggatggaagtgctagtggtaaactggcattacaaagatttcgaaaattggataaattagtatgtgatctcactgaattggatgatatggatacagatttaaatccacataatgttttgggtcatgaatctgcatcaaaagcattccccatggacactagcaatcaagatgcagttttggaatttggaaatttaccttatgtagattccagtgcaaatttaggtgggtatatgaatactcaacagtatttctttgacgatatggataatatattgatgtcggtagatgatgatattttcaatctccagaaatggctggatatatag

SEQ ID NO: 10153 - DNA, 204 bp, Candida albicans
ttcttctcttcttctctttctcttctctttctttctttttattccatatatcattacaactataacccactgaattctacatcgaacaagagaaacctttttttttttttttcaaacttgaacaaagaaaagaaaaagaaaaagaaaaagcaatcacagcttattaacgattcgtgtttaaataatcaattgaaaggaaaatag

SEQ ID NO: 10154 - DNA, 201 bp, Candida albicans
tattacttctatgaaaaggttgaatccgagatcaaaattcatcttttcatatactctggagaaaaaaaaaaaagtaattgtagtaagaatgacaagtatcagttgagaaaaaaagtaacaaagagaaagctcggaggaggctccccaaaggttttatcaccaatggtggtaccactaacccaagaacagaaaaagcattga

SEQ ID NO: 10155 - DNA, 237 bp, Candida albicans
  unsure (4),(21),(31): Identity of nucleotide sequences at the above locations are unknown.
ggtnctggaccaagaagaaanaagttgaaantaataagggataatttaatttcaaatgaaaatgaaaatggcaactcacccattaaagaagaagaagaaagaagacattgtttaaccaccaccaccgaaaaaaagaaaaaaatgaaacagacacactacactacactaataaataaacaagtaaataaagggagtaatgtaagggacacgacccggaaaaagaaagagggcaactaa

SEQ ID NO: 10156 - DNA, 222 bp, Candida albicans
gatattctttttaatttgggtaatcataatttgaaaaacagagacttagcaggttggttttatactattcaaattcaaaaaagggataacaaacttaatattttgggttttgataaaaacgtggttattaataatatctttgaactccacttttttgccattaagaagatcatatgtgaagtgaagttagaattattcccctcttcctctttagttgtataa

SEQ ID NO: 10157 - DNA, 360 bp, Candida albicans
  unsure (159),(355),(356),(357),(359),(360): Identity of nucleotide sequences at the above locations are unknown.
ttattctattgggctttaataaatgagagcagatcgtgtgaaaaacacctggctaaaaaacctcattccagtggcaacttgtccgagtggttaaggagaaagattagaaatcttttgggctttgcccgcgcaggttcgagtcctgcagttgtcgttatnttttttacatacgacctagcttactttgttaatgtttttttttttctttctctcgtacataaataccatttcactttcacagagctttgtactttacactcctcagttcgtagtttgatttttgttttgttgttttctttaacttatcagcctactaactgtcaatgcttcaatactcatactacagacaatcatnnntnn

SEQ ID NO: 10158 - DNA, 417 bp, Candida albicans
  unsure (131): Identity of nucleotide sequences at the above locations are unknown.
aaattgatagccatggccaagtattgtgccaacgaacaagggtatgcagtcaaaaaattgacaaaagttcatggaccagattttttgggtgctccaatgtacttagtttggcttgttttgttggtcaatgnttatgatccgactattttgagaaagttatttgccaacgacgccttattcaacaagttaattggatatttaccagggtggacatttgctctttaccgtgatatggaaaaaaacgcccacagacatataattggactcgctattgctcatttaggggaaatcttgttttttacaaaaggttaccttgctaaatacagagctccagagaatcaaagatggatttggtatgttatgaatttttttgaaggtttcccagtgatgcttagacttagaagagcaactaaatag

SEQ ID NO: 10159 - DNA, 183 bp, Candida albicans
cgtggtcgaagatcgaagcttgctccaatacaatttgtcttagcaattgattctttgtatgatcacaaatgcatgcaggcagtggataactgtagtcagtcaatgaccattgagaaagaattcaacgacgtagtgtatttactcttgttttattttagtcctattcactggatcttgatgtag

SEQ ID NO: 10160 - DNA, 198 bp, Candida albicans
tgtagacaacaattgattcgtaaaaagccatttgatctcgtttcaagtattcagagaactaaaaagagtaacaccaaagacaatatccattataactgtgctaaaagccacgtattaaatgcaaccaaattcattctattattttgggtacatacacacatatatatatatttgtatatacttaacatcaaccattaa

SEQ ID NO: 10161 - DNA, 255 bp, Candida albicans
acaaattctttaatagaaaaggaaagcaaaaagaaaaaaaaggaaaaaaatcaactgtggaaaaaaaaaatccaggtgttgcttaacactggaaacgaactaaaaaaagggcaattggaggacaagaaatgcacaaaaaaaacagatcaggacggcgacgacaaacactatcaccaccaccccgacatggacagcgcaaaaaaacaggacggagggcaaaaaaaatatgttgtaagaatattggttgcagaataa

SEQ ID NO: 10162 - DNA, 186 bp, Candida albicans
ttggatgtagtttcaggagagttgctagatcgattgatgtgggaaagtgatttatctgagtttgctgtctctgtgtcgacattttccgcttctgtagaagctaaagatgaaggtatggttgcttcattatccatcattatgaattataatcctttacttgaccaaatgaagcttatgctatgttaa

SEQ ID NO: 10163 - DNA, 249 bp, Candida albicans
gaatatagtattcaatataaagaaaaggaaatgaaaatagaaaaagtggcaactggtaatggagaggaagtcggggggaagaaacaaacgatcaaacgaactaacagcagaaaaaaaaaaatggcaaaccaaatttcacaatctacatggaaaaaaaaaagcattgaaaatcaagcttcttggaaaaaaacgacaaactgtgatgcagaatggctcagacacctcagtctattgattttgaaaaaataa

SEQ ID NO: 10164 - DNA, 267 bp, Candida albicans
catttttcaactctttctttcaacattctttccattcaagaaaacatggctgataaaattaaagaaaaaaaccaatatcatttattgaaatcaaaatatcctggtgttggggatccagatactacaagagaagagtttttaaccaccatacacaatgatacagtcggtgcattggctcatcaccatcatctacttttatacaattcactaataacaaatgaacatccgtatcaattaaaacaaaagtttatacgaaaactaaaataa

SEQ ID NO: 10165 - DNA, 312 bp, Candida albicans
ttccatattcataaattgtttggcagaattcttgccaatgtgttcatttgggatttctttcttgttccaggggtgtttttattgttattcaatgattgggctattggattcactaatgcctatcttatgtttgccttggcttttgggcaattgtcaactaaagtctttgctcttcaatggatctttgcctttgttattgctggtattttaacagtttggagttttatcgctttggttgttggtggtgtcagagaggtttctgatgaaagagcaccattattggttgaagtccaagaaactgtcaccgaataa

SEQ ID NO: 10166 - DNA, 207 bp, Candida albicans
cagtttggagttttatcgctttggttgttggtggtgtcagagaggtttctgatgaaagagcaccattattggttgaagtccaagaaactgtcaccgaataatctaaccaaaacacttgaaaaaaaagacattagctacgcgggtgtttcttattatgttttatgttctgtttattttagttttcgtataaacttttgttttaattga

SEQ ID NO: 10167 - DNA, 246 bp, Candida albicans
ttgggtgtgagcggtttaaatatctgcaaaatgagaactgttatcttattatatgcaagactatcattagtcagccagccaaaaccgcttttattttgtgtcagtttatcttacagacgcttagctttatttggtgaaactaaaaatcccaaagaaagtaattttgccgaacggttaattcagacaaagattttaagcctttcggtggtggtagtagcaaagaggggacagaaaaaaaaaaggtag

SEQ ID NO: 10168 - DNA, 183 bp, Candida albicans
tcactgtggaaggtattagttttgtcattcggggggctaacatttgaaagacatccaactatctctaaccccatagaagaactgttgtcattgcagatatgtgttataaatcagaaatatatatatatgtatataagttcatttatttatatatcacttttgcataaatatctagtgacctaa

SEQ ID NO: 10169 - DNA, 444 bp, Candida albicans
acatttaaaattttggcaccaactaataatgataaggcaatgattactcgaattttgaaattaagattatttttcggccaaatggttttaaataatgatttcaacataaatgattcactattttcgctactactactaccactactagtagtatcattatcttgtattggtggttttaccttgggtggaggtttcagtaatgttttgggtgttgtctttgaagtcgaagtcgaagtcgaagtcgattttaatgatgatgatgatgaagttgatttgaaattagaagttgatttattagtgaaatatctaatacttgatattttaattgatctagaaataggaaaactaaaaggtattggtgatataaacctcacgggagatggttttatcaatttaacatttctaataaacatctatgatattgtgtgtgtctgtgtatgttga

SEQ ID NO: 10170 - DNA, 375 bp, Candida albicans
gtacttggaactgaagaaacaaaagttgagaacgaggaaaaaaaaaaatgtcatgagtggcaaccactacttagtcaacatcaaatcaatagtaccataatgtcagacgccaccaaactagattctaaaccatctactacaatccctctgaaacatacatcaggtctcactgaagaagaaaaaaatgttatcaagacattagaagaggatgatgaatttgaagattttccagaagatgattctaaatggtcaagtaatagtaccaataaattgagtgaacaaaatttatgggaagaagattgggatgatgatgatggtcaagatgaagtgtttaataaattaagagttcttaaccgccgatgcaaaaatacttgt

SEQ ID NO: 10171 - DNA, 366 bp, Candida albicans
aatcgcggtcaattacattcccggaacgtcttggactacttggatacaacaatggaaaatgaggaaaatgaggaaaatgaggaaaacgaggaaaacgaggaaaatatttaccgaaggagtaattatattacaagcattgaaagaggagaagtgaacgccccaaacagaaacaataccgaacatcacaaaaaaaaaaaaagacaacagctaaaattttttggtcagaacacaactttggaagaaagaaaaaaaccggaaaaaagaaattcatctaaaacacatacacaatatatatatatatatataaatatatccatatacatatgctttaatttaaccttcccgcctttcttttcttctttttga

SEQ ID NO: 10172 - DNA, 210 bp, Candida albicans
aaactacacttcatcatggctggagttagacaattaagaataatagcattaacggcctttgtccttggtttaatttttactttacataaagttggatccaacgctgcatccttggttcatgcacaagcatcagaccaacaaccaaacaaacataacaccaaaagtactacatataccgccactaatgacgaatcagttgccaatctcatt

SEQ ID NO: 10173 - DNA, 237 bp, Candida albicans
tgttttttcttcccatttcttaggtccaataaaagagacatattaaagtttcaattgaaaattgtacctgcaaggggggagagtggaagcagttccgaagcactttctggtctgatcattcttgtatttttttgtttttgcataaattcttggtggaatgcgtaccacgccgcccaaaaaaaatctaatctattcataagttctcttcatatttcaataactacaaataaatactga

SEQ ID NO: 10174 - DNA, 219 bp, Candida albicans
ttggtcaatgaagcatttagtagttcaatgcttgtagcaataggaggtactgtgagtggatcagagaaatttgataaacttaatgaatcaaacttgatattcaaatccaaaaagaatttaaagaaaggttctggatttgggccctcatcccctgcaaatgaaccattgatactctgggctttgaataatagttcagggaagtcatcacatacattttga

SEQ ID NO: 10175 - DNA, 369 bp, Candida albicans
aacaatgcaccttttcgtttgatatcaccattcgtggtttcaatgtttgaggaaaagaataaaaatgttaagctaagagtcaatgctacagggaacttgaatttgaatgtttttgatgtaaggagagcattgaaagcatcaaaaggactctcattaaatgttaacaattttgataaaaatttgatagaggtttcgaagcgttctactcgtttgtgttgtgagtatgagcttcctgatccttattttaaagaatctgaaatggaagaggaggtggtgctggtttccgactatgattcagacgatctctataatggaagtggatttgatccggatgaagaatatatggggatcatagttttaagtaaataa

SEQ ID NO: 10176 - DNA, 273 bp, Candida albicans
atcctgacgcttaattacacagttcgggggacgaccatgaatatgtttgtactagaaagtgttgaactcgaagctactaaactggtgtcaactaaaaagttggatattgtctctgtcaccagcgaccccctgtcaattacaaactcagaaataaagtttatctatgaagaaccaatggaggtatcacaagtcattcaatcacacatttccagtatgcatttcccacgaggaaaaagcgttcaagtcgcttgctataatgagttgcggaaatga

SEQ ID NO: 10177 - DNA, 336 bp, Candida albicans
ctttgttttagtatacgctatattctactggggataagttctattaatttgaaacatcaccagaatatcaggacgttcgtttggctttatattactagtcctaataataagtgcagttacttttgtgttgatccactattccgtaaatcaagaccaaggacctttttttttttagctgataattatacatatcgttcaattttgtttttagattgtatgcataaatcaatctccactaatagtaataatagtagcggtggtggttgtgataatttgattggttatttatttcttgttttttttaactcattatacagatgttgtaacattttttga

SEQ ID NO: 10178 - DNA, 225 bp, Candida albicans
  unsure (163),(168),(171),(175),(176),(177),(179),(180),(185): Identity of nucleotide sequences at the above locations are unknown.
agtatcttttttgtaccttcttcaagtttcatacataaaataataatattgatagttacagataagtattataaagacgagagtatgccgatgcctaatctctctctagagaaagcaatagaaataagtggtaagcattttaatattcaaattgggggaaatnattanttngaannntnnagatnagaattcgaaagagccttgaatttatttctgaaaaaattt

SEQ ID NO: 10179 - DNA, 246 bp, Candida albicans
gtgggtgttggacaacaacaacaacaacgacaacaacaactgagaagaaaaaaaaaggcggtgaagatcccaatttacttttttccttctaaaccatttgccaaattttactgctgtccagattcaattcaattcaatttgattcaatcaaaagtgtttctcttcttcctttttaatatatcatttttgaatcaatacaaccaaccaatcatattttcaatctttcaatatttctatcttctataa

SEQ ID NO: 10180 - DNA, 201 bp, Candida albicans
ataggggttattagcagaaagaccacagaagagagagtaaacaagacaatgacgagcttagttaagacacctcaacaacactactctcatcggtattattattctacatacttaaatgaatcaatacaactcgtaggatactgccctatgcaccccacacttcttggtgaacccttttctgggttatcgttttttctgtag

SEQ ID NO: 10181 - DNA, 600 bp, Candida albicans
ctaatttcaaagagaaaactgtggattacagatatacatttatttaagtcatttttcttattaatttatagctcctggtggttggcagtcaaatacctaaaattatttttccctcccattttaaataaaaaaaaaagccatagtagtaatacttacaagaaaaagatggaagaaatatttaaattaacaatggatgaaccatttgaaaactcaactcatatttcatcaacatctcaaatactacaagattgtttactgattattgaatcaccttctcacgattcttataaatcttctgattcaaatagtccagtatcaacaaaaagtaataattatagtgatcatccagatatactatatttccaaaaaatcaaacagaagaatcatttcaagtttcataaatcaaaatttcaagcaaagtggaatattgataaagtgaatagttccaaaatgaattcaaattttgatccttacgatttaagctcacttttagcgaggttgaaatcatttaattccttaaattggaaatcgatagacgactcgtctataaatgagttgaaatgtgccataaatggatggaaatgtgtatcgtttgggtaa

SEQ ID NO: 10182 - DNA, 1044 bp, Candida albicans
  unsure (223): Identity of nucleotide sequences at the above locations are unknown.
atggatggaaatgtgtatcgtttgggtaaaaggaaaattaaaaaccatttgttgtgtacatattgtaatcaacaattgattctaaaatttgaatctaatgatttgcacaatggacattccactattgtggacacaccatttgatttccaatatttaagtgcgaaaacatttgatgaatcatttcaaaaaaaattagttgagttatatacaaagcagattgganatactggacatggacccaattgtttatggaaaaattttgaaacaccaattgaagaagtataccatttaagacaatatttacctaataccaatcaatttttaattcaagaatattgcaagaatttaaagaatttaattgacaatacattaattttacaagaatattctgatacttttacaagtgagtttctccaactgcaagtaaataatgatgattttattcacgtttccaatgaatggttaatggcgaaatttttccgagacaataaagagaattttagtgctgggttggcatacaatataccttcttggatataccaactagcattgcatggctgggctttaaatgttcaaagctatgctagagacataatattagtaatgagttgtaatatgtgcaatcaaagagtgtttttaaattctgaccactcttcaaatcatcaagaatgttcaacacatttgaaattatcactgtctaaaatcttgactccagtgaaatatgccatgtcaggtacccaaaataatgataatactgagtttgatacaatagtagaatcgaaatttgatccacggactcaacacaaaccttggtgtgcctacttgcacaataacttaccggcatatttctaccaaatgttagttcaatcaaaaactaatataggtcctgttggagaatacatctatgatagcagcttgatggatatagatacgtcaattgattcaaatcaaccaccaaccagaaaaagaaaaaatagttttacggttaatgaaggtttagaaagattaagtaaactacggaaattatatttaatagatgaatag

SEQ ID NO: 10183 - DNA, 207 bp, Candida albicans
tcttgtaggaaattcactcaagtaacttatttgtttgaaagatacctcggttccacaattaaaccaccttacaattattgttttaaattaacaatactttgtcaaccacagaatctagtctcattctctgctgttcctgacatcatcgtcatatcatacagattatttattgacaacgaaaccaaacgaaagatagaggcacgatga

SEQ ID NO: 10184 - DNA, 207 bp, Candida albicans
  unsure (108): Identity of nucleotide sequences at the above locations are unknown.
ggattgccaacggctgagaggaggaggagaatgactcatgtacggtaccgattagggccaccggataagccaatcaatgcgcaagattcggacgcagaaagaaagcanagacaaaagttaaaaaaatttactgcgaggaatttaatgccgagaaaggccccccaaaaaaagaaacgtgaaaaaaagaatgtacaagcaaagcaatga

SEQ ID NO: 10185 - DNA, 246 bp, Candida albicans
  unsure (239): Identity of nucleotide sequences at the above locations are unknown.
tttcttttcaatattgtgaaattttctttgcttttcggtttatcggttttgcaatttatatttattataaatttgtatttaaatagattgatatccctcccaacttcttcttgcttcttacttcttcctgttgatcctccttttctagataatctttcttccctttcacttactaactattcattaaagaattacttatctttcaatcttctaatagtcaactcatctcatctgatctncaattga

SEQ ID NO: 10186 - DNA, 261 bp, Candida albicans
  unsure (110): Identity of nucleotide sequences at the above locations are unknown.
attggattaaatatcattttgaaggaggttaaacaacaaatcctttcagttatgggaaccataggaaatttcccacaatgtatctgtattttactgaattaccaacgttntatgcgatttttgcataaacatggacgttcagaggaattgtatatcaaatcccacgatcaaacgcaggctaacagcaaattaaatgctcaacccattcgcatagacgattcatctgatccatcacctacaagtttgattatttttatttag

SEQ ID NO: 10187 - DNA, 630 bp, Candida albicans
cacaaatcccctgatttatcagaagattattttggtcaaaattcaatcaaatcaccagcattgaatccagaaaatacaaattcagcaaaatacaagaccaagttcaaacctcatttatcgaaattggatactacggattttaatagaaatttcgtcgatgaaggtttaaaactggatcatgattataaacaactgcaaaacgaagaagaaaaccaaggattaggaatcaaatccaaacaagttaatggtaaaagtgatttacatactgttgattcaaacaaaaaacaagagagtactgctgcaaagaaaaagagttccttggggccctcattttctgggttatctgctgccaataggaccaaatttctcaattctaaaagttataaggaattattggaaaactattgctttttttcctcaaacactgctagtggtgttgatactgctagtataggctctaatggtcaaccaagggtcaacaataataatggtggcagtagaaatagcagcagtagtagcaatagtagttcagaaagcaacaatggtaatagtagtagtactagtggtgatgaaaatagtaaaattgcaagagagaattcattcacgatttcatcgtttttgggaacatga

SEQ ID NO: 10188 - DNA, 192 bp, Candida albicans
gccttcatagatgataataaaagcttttttttttttttcaacaaaaagtcgtgcgacatacacaaactgaaaattttccagcaaactttgccattgtcgaaaccaacatcagaagaagaagaaaaaaaaacaacttctgaatctataaacaacatctcccctttttcttctcatcccctattgcagtcttaa

SEQ ID NO: 10189 - DNA, 204 bp, Candida albicans
cccatgcacatggacctaaatgattatgatgttagtatgaaatgcaatcaaaaaccccaaaaaactagttatatacataccccaagaatatccaaaggcaccagcgaaaatccaaatttagaacaataccccccatccgggcacctttatgaactaccaatgttgtcatctatacctcccagtatactggcactctacaaatga

SEQ ID NO: 10190 - DNA, 234 bp, Candida albicans
agaaacatcttcatttcatttttcatttatatcaacagatattacaagtttgggattttccttcatttcttccttccttctatatcgttcagtttcttatttgttaaagcttctactatttattttttttttgaagctaagcataaaactatctttatctacattaggttagatatccactcctttaaatttcacttcaacacacattcagtgtatcgatctccaatagattag

SEQ ID NO: 10191 - DNA, 237 bp, Candida albicans
gtgagtgttaaaaaatcaaggagggagagggagtgtgtgtttagtttgagtgaattgaggcgacccaaatgtacattaaccacttggccaaaaaaaaaaaaaagagaagaagaaagaagaatgcgtgtattttttactaaatccattttgtatttctttgattttgtgctcacgtacacgcatggtcttaaaccgcgcaaaataaaatgtcttcaacaagcgatggcaggtcattgt

SEQ ID NO: 10192 - DNA, 198 bp, Candida albicans
ctagtttttagacaattgctatcacactataactatttaggaataatgttaactactactactacccacctaccaatcaccctttccctgcatgtaacaataattgtggtagttggtattttatacttggagagaagggaagagaagggaagggaagtatcggcatcggttattaacgaaatgaaaattattgtttaa

SEQ ID NO: 10193 - DNA, 231 bp, Candida albicans
ttgataatattaaacaataaattaaaaacgtttatggctgtgctattattatctttttcactttttctggtattcttccatcttctatctaatgtaatctatactactactgaaggaagtgaattaaaaactattatttttccactatttgcatcgagtttagtagttctcttgtgtgttaaaatataccaagaaggctatgacgacaataactttttgacttttgtctaa

SEQ ID NO: 10194 - DNA, 201 bp, Candida albicans
ctcctaatttcttattgtgttccattgcttaatgtttgtagtttatataaatatattgtgtttatgaggaaattggtattaaagaaatcatttattgaccgacttaaagtcaaccatgactctgaatcagaatttgtgagtaaaaaaattttttttttttgggttgttgttgtgcttgttgtgattgttgctggtgtgtga

SEQ ID NO: 10195 - DNA, 246 bp, Candida albicans
cttcattatgaccagtcgtttggattgctagctagtaagaacacaccagaaaaagaaaatagtaccaatttcaaatattttgctgacctctttttttcaattaaactttgtagaatttttagtataaaatatactcgagggttcaaacataagaaagttttgcaaatactgacatttctcgggtttaatgatttgtacgacactgctatttttaaccaggcattttcatcgaataccagaagatga

SEQ ID NO: 10196 - DNA, 219 bp, Candida albicans
aaatcgatcgcagttccgctaatagttttaggaatattcacagagtttaaggtaactgtgtcggcattatttttcactccatttgaaagtggtgatgctttgaacacacttgatgtctccacgtttgtggttggtgatgaaattggtcaagacaatcttagttcgtattttcccttgtcattaataaaattgtttacagacttcttatcgtcattataa

SEQ ID NO: 10197 - DNA, 285 bp, Candida albicans
caggaagaaagtgacaacacttggaagttgaagaatagaaagaaaaaaggaacaactaaaaatctaaaaaaggtttatagattttattttatgcaattttttttttggggagattacgtatacttgatgatctattatatactttattattggatcaattatagtgtcagagttgcaaaaattgtatacattatatgtgactacgcaattggcaaaggtggaaaaaaaaaattgcaaaaaaaaaagcccaaaaagaaaaataaaaagaaactcataattcagtga

SEQ ID NO: 10198 - DNA, 240 bp, Candida albicans
atctctacaaccttatatccaagaatacttgtatgtttcaatttattatcacaaattacaaaattaaaaaaaaatatcttaaaatcttatttcattaaattatgcacaaaaagtcgacctttcttctttctttaccttactcatgttaatattctaatctatttagtaatggaaaaactccaaggaactgttaaatgcacattatcatcgtcatcaatgaatttactgatggcactatag

SEQ ID NO: 10199 - DNA, 627 bp, Candida albicans
aatatcaataatttccaccatcatgttattgcatcagcttatttattaaatcaagtgttaacaccacaaaatattgaatttgaaataattccatcaaataataccaatttatctgatattaatcaattaccggtattaatcgataatgaaaccaaagagaaatataatggatataatgaaatcataagatttattgaatctaaatatttttcaacgtcaacaaagttatcattagtatcatatttacctagtgattcgttgaaaacaacaaaagaaaagttaattaataaaggattaataaatttattaattaataaatttgaatatattaatcaatataatttatatttaaataataaaaattatgaaaattatactagaaaattattttcttcttatttaccattcccaatgatgtataatcaaccatcgaaatattatgctcaagctcaagaacaagtcaagatattaggtttatcaaaacaaaaagttagttttttcgattttacaactggaaataatgaacaaggatcaatagatgtggccccaacggagttaatcaatgacgaagatgatgaagagggagacgaagacgaagacggagctaatgtcgccattagttcataa

SEQ ID NO: 10200 - DNA, 210 bp, Candida albicans
catgaaagacaattattaaagaaatcaaaatcaaaacaagtattaaaagaatcaagaaattctatgaaatgtttgattttaattactcaatatattgaaagatttaaaacaattttccaacatcaacaaagagacagtgacgaagaatttggatttatatttgataatcaaatcttcaccacgggactgaccggtaccgcgctgaaagtg

SEQ ID NO: 10201 - DNA, 246 bp, Candida albicans
  unsure (160): Identity of nucleotide sequences at the above locations are unknown.
cagtcagataaatatacaacttcatttttaactcttcttcatcgagtcaaacacttccatcccatagcagtcccaaaaatgtcatcttatgaatttcctatagtactggtgaaaaacttaccttataatacgtcaaactcttctttatatgaatttttcnggcaaatatggctacataaatcaaattcgaataaactcatcacaaccaggaacttgttttataatttaccaggactcttcacacgg

SEQ ID NO: 10202 - DNA, 228 bp, Candida albicans
acaattgttggattatttgggatttgttttgtattatttgtggagtttgaaatggttgtatcttatagtgtactaatgagattgattaaattgtgtaagaaaatagttgtaaaagaaaatagatttagtaaaaatcccagcgctagaaaactactgaaaaatttgctaagacaaataattttgtatggcaaaaattatttccgcacccttcggaaattacaaaactaa

SEQ ID NO: 10203 - DNA, 273 bp, Candida albicans
accataaaatgggaattaccatcaagtcaatcccgagttcttagcttcaataaccaaagcaaggtgacaacaatctggccgaatccagaacgtcatctaccaaaagctagcacctggaaccaaattcaaacatctattaatgcagcatcaaagttggataagatagaaccatacgcccaaaacaatgaattgtcatggattgggaacagcgggtataaaagcattatccacagtaccaaagtagtcttgatcaatcttcagcaatttgcctga

SEQ ID NO: 10204 - DNA, 690 bp, Candida albicans
ttaataattaatacaatgtccacagcaacagctttagaaactacaaatgcagaaaagaaatttgtgaatacatatctagaattgatgcaattatcgaagaatgaatcgttagataaattcaattcaactcaagactacaacaacttatcatcattaggcccaagtttacctaaatgtaattataaattcccagaaccacaaaatgtaacaaaggcagcagaatctacagtaactttgaagtttaaatcaattaaaccaccattcaagtttcaaactgaattgtccaacattcctgttaatttcaccatctacaaggtgaaagcccaattgattgaatcattggaaattttacacaatgctggggtcacggcaaaagatttgaaattgatgatcaaatcaaaagttgctcaagatgctgcagctttgtcatctttagtaaatacagaagaaccaattagttttaattgtatggtatcagctccaagtggtggaaaacctgctgccgccacctcaaagaccgatgaaggtgatcctgaacttgaagctgtttccgatcctgtatctacaactgctaccactagtagtatatctgaagctggttggaataaaatatatgaaattatattacaagatataaaagacgctggtaaagctaaggaattattggctaaattgaagcaaagtgtataa

SEQ ID NO: 10205 - DNA, 189 bp, Candida albicans
agactggacatccataccgcagtagattacctcaatgcttattggacaggagaagaaggaaaaaaaaaaagaataatttctagtgcggttgctgttgctgttgctgctgctgccaccatcgccccccctttttttttttctgcgtgcatctctctcccttcccgcccccaacaaaaatacatgaattga

SEQ ID NO: 10206 - DNA, 213 bp, Candida albicans
agaagctgctatttcttacaaagaagctccaaaaggttctgcttaagtttaaatgaaaaaagaaaaatttggatgaaaaattattattctaaatttaaacgaattctagccacatttaagaaaaatataagtaaatataaaaaagtcattaatgaaatagaaatgaaattaatagttattctacacttagtaactagtaaatataatttataa

SEQ ID NO: 10207 - DNA, 207 bp, Candida albicans
ttcaattgttggttgttgttgttgttgttgatgagaaagaaagggaaagcaatttacttgagagtcagagatagaaagagagacagagatagaaaaaaaatttttccttccttccttttttactcctgtatttgtgtacaacgaaaaaaatttctaacaaaatatttaatgtttcagtttattaagcaatttctcttacttttataa

SEQ ID NO: 10208 - DNA, 261 bp, Candida albicans
ttcttaattgttgcacgacaaactaaacaaaagagagacacattcactcactcacggcacacacgcacgcacgacaacccctccccccctttcagattaatagacaagtatagagagagagagagagacagagttaacgctaactactactacttcacttacttccttctacttactacttactacttcacttacttacttacttactggcaaaacaaaagaaaattctttttcccaactaattataatcaattacaacca

SEQ ID NO: 10209 - DNA, 288 bp, Candida albicans
agcttgagaatgagaatgagaatgagaagagaagaaccaaagaaaacaaaactaaaagaaaacaatgaaacacgtccgaaaaaaaaagaaagatttcgcataaataaatcaccaacatcaaacttagaagcaattcttaatcttgaaaaaaaaaaaaataaattaaaaggaagaattccttctctttgttctgcgattatttctttaagaaacgtctttgataaacccagcgatgagttcgacagaggctgtatgttcgtttattataatttttatttttatatttag

SEQ ID NO: 10210 - DNA, 324 bp, Candida albicans
atcaaaaatgatgccaatacagataacaggtttccttttccagttcagttgacattacaccaacatcatttgcaggtaatgagatacttgaatgacaatggaatattgcaagacaaagcaccgttgccgcagttccgagaatttccggaacaatcgcttattttatccgcgttatttctacacaaggctgacattaaggttttaacttatcgtaccatacccaggaaaaattttctaaattgggtgcgagaaacctccgggtttaacagatcgaaaaagttccaatcgccagagatgaatccgatttcgcagcagagtctgtaa

SEQ ID NO: 10211 - DNA, 198 bp, Candida albicans
gaacaaagaaatcttgttgatccgagggaccagaaatttatttcttgtcctcctcctcctcctccttcccacttctcaactttctcttttttctttaaattaaatagatatttgaatttagtgaatgtaaaaatcttggaaggatacttacttaagctgaatttagttgaaattttgaaactattcattggtaattag

SEQ ID NO: 10212 - DNA, 198 bp, Candida albicans
ttaccaatgaatagtttcaaaatttcaactaaattcagcttaagtaagtatccttccaagatttttacattcactaaattcaaatatctatttaatttaaagaaaaaagagaaagttgagaagtgggaaggaggaggaggaggaggacaagaaataaatttctggtccctcggatcaacaagatttctttgttcttaa

SEQ ID NO: 10213 - DNA, 183 bp, Candida albicans
  unsure (5),(53): Identity of nucleotide sequences at the above locations are unknown.
acttnggaaaagaaaggaaatatgcggtttattcgttctcccaagttgtttcnggggccttcaattaaaaaatttaacagtcgaacagagaagtatagaattcagttgagacaaatatttatttttggtatgttaaagaactttaccagagagagagagatcataaattccacaattatataa

SEQ ID NO: 10214 - DNA, 558 bp, Candida albicans
tttaaattagccatgtccgcactcaaattagccgtcccagaagttccaaaagctcctgaactcattccagttttcactttcaatcttaaattggcatctgatccagcatccatttatgtcaacaatgaaagtgacaaaacattgaacttggctacaattgctaacggtgaagttaaaactgttccaaacaagttgggtctcgaattggacatccattcaatttatggtaccgacgatttgaacattaaaaattccgtttcaactgcatcattagattgcaaattatacgggaagacagctaatggcagcggtgttttcatctactacccaggtaaagttcaattggatgaaacttccatctccgttttcacaaagaaaaccaaagaagctgcaattgaagatagttatgttacctgtaacccaactttctatttcgatgataaagttgaagacaaatacaaatgggttttgaaggaaaacttctttgctagaggaagattcggtagagatgaagacgacgttttgtatgtccaatactacgtttacgttgttcgttag

SEQ ID NO: 10215 - DNA, 213 bp, Candida albicans
agaagattgacagttttccattggagcgcaattcttgatttagattttattgaggatccacatttttacgttatctgtcgtgtaatcaacaacagactaaaaaaaaaaatacttgaaaaaaaaacgcaaacgattaattatttatggtgccgtttgtccaaaggtgttctacatttttcaatatacgtgattatcatttatctatgtgtataa

SEQ ID NO: 10216 - DNA, 249 bp, Candida albicans
acttttttaactagttttttaggtaaaattttaacgaaaaataaagaaaatatgaaatatgatttgttaatagaaccaacatataaaaagataaatattccattacttgaaaattatttctttaccatattctatcaatacagatttccatctaatttcttcatacggtcgttcaattcaaataattttcaaagatttttatcacgtgatcacacatatacattctccactctggttactggtttttga

SEQ ID NO: 10217 - DNA, 204 bp, Candida albicans
aaaactgcgggaataagaactcaagttccggtaataaagtgttggtgtatagctaaccaggcaattcgcgggaataaagagaccccgaaaaaagtttattcccgtgatttagtcttggtgttgctgctacaccaagaagttattctcactaattacggaaataaccgtttagttttccaaatggttattaagttatatcgataa

SEQ ID NO: 10218 - DNA, 234 bp, Candida albicans
  unsure (53): Identity of nucleotide sequences at the above locations are unknown.
agaaaaccattttcccggttgggttattcaagggggagatttcattcaatttnggtcccaatgttcaggataaagggttttaaagggttggtagggattaaatggggtaattattcaaccggggggttttataaaggtaggaaaaagcccccaacaaccgtggagattaatctaccaactaatatcaaccgtggttgggttatcggtacaataatatcatcagggggttgttaa

SEQ ID NO: 10219 - DNA, 192 bp, Candida albicans
tacacgaccaggactttttatgttcttagtgcaaactatacacaacaattctttactctttacgctttaattttctatacttttagtagtaagtattacttaaattacaaatacaactacttgaacatttactcactccttcattgtttgaattgggtaatggttttaataaaatcttcaccttgttgttga

SEQ ID NO: 10220 - DNA, 663 bp, Candida albicans
taccaagagatcaattggtcaccacaatacagattcacaagcttttcaactattataatgtatgacacagctcaatacgacaaatatcaattaactcctcaattcatatatattcaacaattactccgttatatcagtttaaaacatggcatgaaaatagtgtcattgcgaaatatggtagacgctttaaccattggaaatatcgagcaattattattgactttggactccatatcaccaattccaatacttgattcgaagggagtagaaatagctgttcaaactaatgatattgatagaactgaaagtaatggtcatgaagcaagccataataaatctcaaatcaatttgtatataccatacacatgggactcttggaataaaatagttgttcaagggaaatcaatagttttaccaaacactgatgaaataataattagaaatgaatcaagattggaagaattggatagtaattatgaaaagtcgttgagtagggagtccaagaataatgttaatggtggtacaatcgtcgatttgttattacctcaggattatttgcaaacgagaaataaaaataaaccaaaaattgaactgcttcctaattcaacatattcattaagtgatatgttaagagaaattgttcaaccttctgttttagaataa

SEQ ID NO: 10221 - DNA, 222 bp, Candida albicans
aaaatatcgagaatgagaccatttattacaacacttgtggttcaagtatttactcctaaacaagtcgcctacacgttctatgcttcaaattccatagcatcttttatgacaccaattatagcactagtttggattttatcattaccaccttttgaaataccatattctatatcacttaaacctttcaaaatttctaatcttgttttcggtttcaatttataa

SEQ ID NO: 10222 - DNA, 222 bp, Candida albicans
atatgcggaaagaattacaatactagtattaaattatactataacaaaacggttactaatagcattcttgtcaattcatataagatacttactgacctacgtaggactttggaggaagtctctaagaatatacaaactctaggtgttctactgtcgaagtcctacagccgattagtattttctaaaacactatataaaaccaccttaaatcacgtgacatag

SEQ ID NO: 10223 - DNA, 189 bp, Candida albicans
gtgggttgtgcgaccatggtagtgtattgttggccaaatggggtcagtaaaagtgaaaatatggccgactgtaatagaaggaaggatattatgacgaatgcttcgtgttttctttcaagtaccatgtcagatgtcaataggctcgtcgatacaatcataaatctttcacttaactacaaactggaataa

SEQ ID NO: 10224 - DNA, 243 bp, Candida albicans
atgtttcccgtttctcttaactccgtttcaaattcccggggacttaccaatttgggaaaacacatgtttagatttgaagagaataagttcagtagtactaattcaacaaatacaaccctactcaatcatcaaagattagtatgcactgtaggtgaattgttaaggacaattcatacctcggaatactgggtagtgccaggaatcaaagtctatacggaagcccaggggctgccgaaacattga

SEQ ID NO: 10225 - DNA, 204 bp, Candida albicans
aaacacaaacaatcccgattaattacacattcatttaagtcaacgtttttatccgaaaacaacaataatgattttcaattttcaatttgcaatgaccctatttatctatacttccctttcaattcaatttatttaacaattgcagcgtgtgcattgttatatatagacaatcgatggcacatttcggacgtatatgtccaataa

SEQ ID NO: 10226 - DNA, 183 bp, Candida albicans
gcttttttgacccattcaggttcatcctcttcactttcactctcatatacatcttcaacctcattatttgtctctagaaatgtattattcctcttgaaagttcgtaaccatgtcattgatgaacatattatagataaagttttacctgttccagtgggactctcaaatagtcctattttatag

SEQ ID NO: 10227 - DNA, 663 bp, Candida albicans
aagaaatggcgatttgatagtaatcaaaacaggaccaaaaaaattcatgtcactttccaaccaaaaatatccaccatcgcgttccaacaagtagaaaaacgacaacaacaacaacaactacaacaacaacaacaacaaccaatatatattcatcactcgattcgaccaacaatgtcattgatcaatccaatcaaagtaaaacgtgtgaatttggcttatagtcaaaatagtccaattgaatggtctgacaacttacaattgtctttaaatctgtacactgatttgactgtattggatcctaaattgccagattaccatctgataatcactgacaaagatgataaaactgtattagatgctaaggaattattttctgaaacgattcttttacataatgaatcaattagtttactaccgttagggagatttaataaaatcattattactgatactgatgaaggattgaatcttgttgcttctgaaccaaacatagtattgcaacaatggacacccaattgtgaaacaactagagacaatttacttggagttttatttaattctggtgaattactaatattaagtaggaaaaatgtccaacttctgaattatgttataagaattaatgtgttcaatatattggttgaaaaatataatatccaatgt

SEQ ID NO: 10228 - DNA, 240 bp, Candida albicans
ttactatcaaatcgccatttcttttacaactatccacatatgtacttatttctttatcccttaaaactttcgtctagattgaaagtggtgttatttcttcgtgctggagaattcaatctgatctcctatttctcccaattttttacaaaaatcttgataatttatattagaaaaaacaaacaactatatatggtgataagaactatttactcctctaatctccttttttatttttactga

SEQ ID NO: 10229 - DNA, 192 bp, Candida albicans
aagcttgtaaagtgttttgctactttctcttgccacttgtttccacataatcaaggtttatcatttgtaacctttagtaagattagtttagacggatggagagggggaaaattttctattttgactaaccgttcgtatggaaggtatatgattctctcttgcattttccaaatcattctttctgatacataa

SEQ ID NO: 10230 - DNA, 258 bp, Candida albicans
aacagccataacaacaaagatattttacaaaaaataactactatcacaatgtttacgacacttctttcatctactgtgcgttcaaatcaattaaagccattgacatctaccctttccaccactattccatcaataacatctattcccactgtatcctatttgtcaccgtcaccaataaactataaaaccatcacctcgacaagaactaaagagaatgttcatgaattgacgacattccttaaccttaattggtcgtaa

SEQ ID NO: 10231 - DNA, 201 bp, Candida albicans
cttaaattttcatcaactacctcagccccaaatgaaaaaatttgggtattgaatcctcgaaccaagaagcatttttatttaccatggaaaaccttaattcctttaatgaacttggaaacccataatgaagagcatctaatttgggttaagaaacaacaaacgggtggggaaacaaaaaggctaaaatttgttattggctaa

SEQ ID NO: 10232 - DNA, 189 bp, Candida albicans
tataaaatcaaaggtaactatttagtatcagaacaaccttataatctcagctatcggtataaagtgagggcaatctacaccatcatcccggaaatacatccaaatcaaaacgacaaatcaacaccaggttcttttcttttttttgttttaaaacactttattatattaattataactttagttgactga

SEQ ID NO: 10233 - DNA, 261 bp, Candida albicans
atcagaagtataaaagcaattgtagtaagtggcaatggtaatgactgtgaatcatttttgtacacgttatgtcactttaaccacaactacaacaataatctcttgattctcctttcattacgatgccagcaagatatcaatgatgccattaacttaaatactacttactactatactattaccgttactaacgaatattcctggttaattcttaagcgtgtattattactcaacaataaacatagttatagttcttattga

SEQ ID NO: 10234 - DNA, 255 bp, Candida albicans
  unsure (118): Identity of nucleotide sequences at the above locations are unknown.
gaaatgtttaaaataggttcatttgctgatgttgaagtggtggaagtgttggaagtgtttatggctgatttagataaagatgataatgcagaagcggcagtagtgatgggagcactantgttgttgttgttggttgccgtaccggtagttgtagtcgtagtcgttgtcgaggagatattcgatgaattctccagtacgggtagtgtcccattgtctcgtgtattagtggaggtggaagattttttatttgtgtaa

SEQ ID NO: 10235 - DNA, 204 bp, Candida albicans
actttaaatttaaataataatcttactatgatgtgtgtgttatgggagaattggggaagaaattgtggattgcaaaaatttctcttctcctctttgaatgactcaagtaaatatcaattatccttaaactatcttaaacagtttaaccatcattatgaacttgcttatccaatactagtcttgttagtaagcaatgaatattaa

SEQ ID NO: 10236 - DNA, 255 bp, Candida albicans
ttaattgaaagtaacggaaatacgttaaacagctacttgcctaattgggtcattttaaaaatcacgaaccaaagagaactagctaatagaaatgaagttttatatataattacgaactacaattttgttaatttgcttctacgagagcaggggagggggggacgaggaggcttatattcttattcaatcaagcgagtaactttttacgttcatttcttatatgtcttcaccacgcggctagaaggacccgagctt

SEQ ID NO: 10237 - DNA, 258 bp, Candida albicans
ccaataacttccaagatagttccacaagctaaacaaatagtaaaatactttgtttttgttgagaacccaatgcccaaaaggcaaattaacgtaactccaaacatggcagcaaaaaatgcattaaatggtactgaaagattaatagcatataaattagccttccattctaattgttttaaacttaatgtggcattcaccattgctgacgtgacctcagggaagtcttgtgtggcagtggcagttgccaaatactgttga

SEQ ID NO: 10238 - DNA, 321 bp, Candida albicans
attacagtgcggaaaaggaaatctctatcttgctcaaggtattttaaatttatgattaaaaagtccgtagaacccgtcaccctggcaaattacaataaacctaaagcaaaaaactgccatgtaaatgttgttaggccattacttattgtaaaattttgtcaaaactcaatatatggtgtgtataatttcaacaaaaattgtgaaaaaaatgtgactaaaaatatactgactgccacgcgctaccaccatagtttggacatcacttacaaatatttactcaaccttgcaacactccttgtgtatacctgtaaagtttattag

SEQ ID NO: 10239 - DNA, 258 bp, Candida albicans
tattttgaattagctttggcttactccactcgaggactaaatgaagttatagatgataatattgttttggcttactatttgagaatgattattcctagtccaatggtttctctttttgaaattcaaaaagtgaaatatttctcccccacttttttttttagtgtttttagtgcttttagtttctggagtcacccaattactacattacaggtaattaattgctcaggtttacaaccaaataccaggctagtgttttag

SEQ ID NO: 10240 - DNA, 207 bp, Candida albicans
atggtacagctgccatcaccacagtccgaacataaccagcaaatgcctgatgccatacccaaactggaaacagattataacggtctaacaaaaaatctgaaagaagccaatgaactgctactgaattcaaacaataaacaaccaacacagtttcccatcaaaaatgtactctcagcaaagaaacaccaccaacacaagcaatactaa

SEQ ID NO: 10241 - DNA, 264 bp, Candida albicans
caccttcaatcaaattttcaaagtgtgatagaattattatttttatgtgatcttttttgtaattcttccctacaattacgagaagtgtggatggattttagtatacatcacaacttaataaacagccctgacaggctgagttgtgtgtctatgtctattcggatagtctcaacatttgactatattatacatctatatcaatacatttacttgttgttgaatattaaacaaataatggccacatcgtatctgtcttttctgtaa

SEQ ID NO: 10242 - DNA, 294 bp, Candida albicans
gagggaaaaaaaaaatcccaagacttgactacttttgtaatcttctttttcaattacacattactctcaattgtcacaatgattccaaaagtaaatagatggaaaatcgggttgatatctggtgctgtggtggttggtgctggctatcttattcttaagacattcccccatatttttgcaaaggaagaagacgacgatgaaagtgataatgtcgttgtgcacagagaagtagatgagaatcctaataagccaatcgaattgtttgaatcagaagaaacttttgaaaagagctag

SEQ ID NO: 10243 - DNA, 213 bp, Candida albicans
gtagcacctaaaaagattgtagcacttaaacaaacgatcataactaaaatcccccaaattgctaaaaataatccaccatatttacaaaatttttgtaaattatttaatgaagtattaccgtcgataggtttaattaataaatatccaaataacccaggtaatataaatgaaattgatgttgaaccagtggaaccaacaaatgccaaaacatga

SEQ ID NO: 10244 - DNA, 198 bp, Candida albicans
tctcctcaacattattcgtttacttgtttgtggcccaacactcaatttggtagtgtctcgttcattaatgttacccaactagaatttatgcaaaccactttaaatatgggtatttttctccgaataatccagaatgacgcaatagaggaaaaagctagaatcagtttccgcaacctacagaaaggttatgtattttga

SEQ ID NO: 10245 - DNA, 297 bp, Candida albicans
tttaatcgcagtgatcttcgtgctgatttgtatgttgctattctatccgatttcttacctgatatcactgtcatgatatctgggtcttcgtcatcagaagagtctgacagtaatgaaattatcgacacattatcaggcatatatggcattgtagggggtagcctgactttaaaagtatttgataaagaagttaagtgcttgagtaggaaatctttaagaagcagatcccctaacaatttttttttttggtttcatctaccgcgtcgtgtttatcaatttttttcttcacctccataa

SEQ ID NO: 10246 - DNA, 1686 bp, Candida albicans
aaccaaaaaaaaaaattgttaggggatctgcttcttaaagatttcctactcaagcacttaacttctttatcaaatacttttaaagtcaggctaccccctacaatgccatatatgcctgataatgtgtcgataatttcattactgtcagactcttctgatgacgaagacccagatatcatgacagtgatatcaggtaagaaatcggatagaatagcaacatacaaatcagcacgaagatcactgcgattaaactatattaataacaacaacacaataacgaaaaacacatattcccagcaaccatttgattcaaaaaaaccatttgatattaaaataccatcagtgtttaaatatgaagcaaataaaatacacaagataaatactagaaatgaaaatattaaacaagaaatcaacaaagaagaacaagaattgaaagaaaaatacgaaaaattacaacagatcaaagcaagattagtgatggaattaaatgataatggatcagatgggcttctcaaatatgatgccaatgagaattcgctgtatattgatagtcttataagacaggaaatcaatgatatggataaagttaggaggaatttctattttttaaaaaatgtggaagaaatgatatttgattttggtggaaactttgattatatcccccaatcgttattatttttgattgctagagaccctataacagcttataataccagtacaattataaaatccgatttaagaaaatttattatgagagcattgagtactgtgttaaatccacagcatttaatatcgataattgagatgattaaaaatatcgagcagaatgtttttacatttgacgaattagttgactttacgaataaatttggaggagaaaccaaattacttcacgaaaataaaatgccattgaagatcaatatgtttaataatcatttacgaatgcaattattgagactaacattactattcaatggctatttgattggagataatgatgaacagaatctagcaggttttttgaaattgtttttctatattgtctcggattacaatgccaataaaagggaatatactacattagaatacttcacagtgagtattttcactcaattagtcaagaaatatcacaagcccgataataatgaatttgttttactattattcaaatacatatcggggattgaaacatctaactatggaaatgctcaagaaaccgatactacaaaaagtttcgaactttgtttcaattttgtgaggttgttgaatgtcgcctttactcgtaacaatgatactaacattactgatatcatctataaattgaatattatactgatctcgaacgcaagttcccttgatcgatctatacctgaggttgtgaatgagcttgtttcatacatcaaattaacagatattgatttgaaattctgttacaaaatcaaagcattaatttttatacttaatgggaattatatggtgaatcaaactcgagatacacttaaccaaatcaaggaagatattatggaattgaaaaaaatattttattcatccatgaaaaaattaacaactgcaactgaaaatcttgatttagtgatgatggttcaagatgcttttcatcaattagagtatttgaataatatgatagaaagttttcaacacgaggatttattttataatgatatatag

SEQ ID NO: 10247 - DNA, 501 bp, Candida albicans
atattggcaaccatgtcacaaacaacaacaagacctagaagaaaggcaacaataaataagtcgtataacgactcagttgatttaaacagtttggattacgattcactgaactccgtctcaactgcaaattcaacccaactgtctggttctacaacatctggttcaagaagaaaaaatcaaacttcaacttccagcggtaataatggtagaaaaacatcggcagaaactaacaagtcaaccaccaatggtaacaacattaacaacagcactaacggaaacctagctttactgaatttgcctaataattggcaatcttcccctcgactagaagattatttttcgttcaaactagatttaagtgacgcatacatagatattgattcgcaaacattattctgtccaaatcaatttcctacaaacaacaccaatctgaatagccgtcgtaaaaataacgttgcaccattcagtctcatcttcaccagccggacaaggatatcgtag

SEQ ID NO: 10248 - DNA, 204 bp, Candida albicans
cacgcggatattccatttcgtggtcaagaggcttattctatatggtgttggcgtatgtgtatcaaatgggttgatttataccacaagtgctcaataactatcgcagacatattgccatttttagccgaacagagtgtctccttattttttgaaaaattacaagtagcctctgctagcaatacatcagcatatagaatgaagtag

SEQ ID NO: 10249 - DNA, 198 bp, Candida albicans
aaaattttaagtcaatttagaaggctaataaacaacaaagtaagaataagagatgaggttgtgtttgcattgagtagattatcgtctaaaaatataaaagggagggagtcaaatcgaactggtaaaaggctagcaagtcacttttttttttctttgtttcaattttggaagacagattatttattaagttgcatatag

SEQ ID NO: 10250 - DNA, 249 bp, Candida albicans
cgcagtcatttgttaacagtaattcatattttgtgcatttctgcagtaccactttattcatctagatctttctggcaatttccatttgtcgtgttcttacgaactgaacattaccataccaacactttcatttattggttatatcagattgtcgaatcagctttgggtattaatgaagatcaactgaatacaattggtaatgtttttaagaagaagatttgccggagtcaatattatagaaaattttaa

SEQ ID NO: 10251 - DNA, 309 bp, Candida albicans
tatttccctatgtataactgccaaaaatatccacataaaactatattacaaaaaatcaagcacaaccacaacaattccaataacaacaacaatccagaatattggcatgtattttttaacgaggcttttctaaatttctacttcattctatatgctgatgtattgctagcagaggctacttgtaatttttcaaaaaataaggagacactctgttcggctaaaaatggcaatatgtctgcgatagttattgagcacttgtggtataaatcaacccatttgatacacatacgccaacaccatatagaataa

SEQ ID NO: 10252 - DNA, 207 bp, Candida albicans
ttatttttggcactacatcgaactccagcttcaatttccttaaattcattaattagaggaacaaattcatcagaattagtcgactttaaattggatttagatttaggaaataaatcagatttattggcacataatataatgggtaaattaactcccatggatcgaaataatggcatccaatgtaatgaaattcgttcatatgtataa

SEQ ID NO: 10253 - DNA, 204 bp, Candida albicans
gtgaatactaagggaataaatgggatcgatacactcaaaaaaaagaaaaacaatatcttgcatgaatttgcttggccctgtgtgttcatttgcaacttttgtgtaccaaataaaaagaaagacggaatggtccaatcttatatcttgcatgagataagtatctctacactgttacgtaaaagaaataccatttgtgtgtattaa

SEQ ID NO: 10254 - DNA, 210 bp, Candida albicans
aatgcctttttaatacttaaagagaaaagaggtactaaccagttattaataggcgggcaagcattttatcccttaccaagtttaccaagtttgggcaatggcagtggccaccatccacatgggttcaacatcccatcgatcaatcctgcaagtgatcagatacagatgggacaagtatgtattttgaaaccagcttttggtgttatttaa

SEQ ID NO: 10255 - DNA, 261 bp, Candida albicans
caacatctttggattgaacttctccaagttaataaccacaatcaaacacaaccacacttagtctggtcttcatatcttataaactggagtaatattaatttattattatttacttcaaaacaagcaagtgaagcaggatatttattcttttttttgattaatcacaattcagagtttttgaaatactttaaaaaagcaactgatacagttttaaatacaaatcacattttcaatctcctcccccgttcaaaaagattttga

SEQ ID NO: 10256 - DNA, 270 bp, Candida albicans
atacaaatcacattttcaatctcctcccccgttcaaaaagattttgaaagagtcttaatgtcgaatcatcaggaaccttggaacaaccaacagcgaccacttggccagcctttcaagtatgtttctatattttgtattgtaaatccccatcgatttgtttggtatactgacatcatactgtttttttttagtcgtcaacatcccccagtattaccaccaccagcaacgttggagcaaggtatgtttttgaaatgcctttttaatacttaa

SEQ ID NO: 10257 - DNA, 228 bp, Candida albicans
aattttattttcatatcaagaaagaaggcgaaaaagaaaaaaaagtttaagcaaaggacaaaaaccattaccatgaaagggcggaagggttgggcaaatagaatatccggtaaggcaaagaaaaagaaaaaaagaagtaatacaaaaggcattgtgaattatcggttcgaccagcctattatagcaatacctgacactacccacttactacgccatacgatgggataa

SEQ ID NO: 10258 - DNA, 183 bp, Candida albicans
caatacctgacactacccacttactacgccatacgatgggataaattatgtgtgatatttgctcagtgttattgtcttcgtgtaaaaatttttaaaattatatcacagtacatcaaacaattgcaacacaattgtggtgattcaatttttatcaaagccctttttttatatttctctatttag

SEQ ID NO: 10259 - DNA, 183 bp, Candida albicans
tgcaacgagtcggatgatggaacaaaaaaaaaatttgttaaacttgctatcattattcaaatcggtccgcatccgttttgtcttgctttatttgttaagttgttcaatcatatcaccatttgtaatctacttttgctattgatactgatttcttctacaacaagtttacatgctgtagtgtag

SEQ ID NO: 10260 - DNA, 1875 bp, Candida albicans
cctcttgttgacttgttccccaccttccttccccaaactttttgggaaaaaaaaaaaaaaaaaaaaaaaaaaaaaaaaaaaattattatgactacgaacggtactaatggttttgattttgctgataaaggtgatcatccgcctcggcagtctcaagagaatccccctgggaattttcaagagctgccgttagatggtggtcaaattcggaaatcatcgtcgaacgatggtgtttccaacaacgtcgaattcaatacaaatacaaatgcgcacgagtcgtgggctgactaccctgaatcagaccagatggatactgattcatctgaatactatacagaagatgaaaacgaagaaggaaagatccccaaaggtccataccatcaatttcaaaatgctaataaatttacttactttacaccagaaactgcaacaacattagttgctcctaacaacaatacacaaaacactacaactgaacaagacaatatgtccaaaacttatgcctctgtggcagctacattcaaaacaaacttggccaagagccaagataaacaagaggaacttagaatgtccaattttaaggtccctcaaaaagcctttgacgacttaaaaagacacaatgatgcggtatttcctgaagaggtcatgacatctgatctctcaaccattattaacaaatatggacatgaaaaggttttggacaccattgagaacacgctaattactactgcgcaaaacttagaaggatatttgagtgaatatcctgagaatgttatgagaaaggcattcaaatatttcacattgaaactctctattgaggataaacaaacaagagacgtctgtgaagaaatattagggataagagaggaattgatgtacatccaacgaattttagattttaatataatggacaaagtaatgtgcttcatgccatttacgtttgaacaaatggaaggtaaactttcatcagaaaaggcgaaagtaagaaccatagtggaaaatctcgaattggatttcgatggtacagtggaacatatcaaaattgatagtgccaaacgaaacagacaattggtggcctttaaagtgccaatacactgtcgtagtttagcagaaaggtatttccgacaaatatttttacataaagaagatgttatagtacaacaatatgcgcctattattgagaaggttcagcttgggagaaagggcaaaactgaagaaaataaccatcaacttttaacagaatatgtttgttatttcatagttgatctcttttcgggacaagttccaaaaagaagaatcaaaatcgataatacaaagaataagccctcctcatatgaacaatgtacatcaagagttttatctaattgcaaatactgtgaatactgcagatctatgacccatactaaatatcattgtcctttgataaaaccatgcaccaactgtggtgtaaaaggacataagacaacgagctgtaaaaaagctctgtctaccaacactctggttctaaaaagaccagaaaccaaaccaaacttcccaattttaccacctaaggtggttaacaaaactacgagtgatgattctcaaagaaagggaagtatagcaaaaactacttctcatacaaaaggagataatacagaaaagatggttacaccatctgctcaaaatgaaaatactaccttacaggaatcaatacctgtgacaattacgggtcacagggaagctccaacaacacctcctgtggctgatacaacagccaaaaaaacaatgactactggcgtcctggaaatggataccagtaaacacacaatatcctcaaacgacgaagcgtcaccgaaggaaaaaattaaatgtgaaggaaaagcccagcaatcctga

SEQ ID NO: 10261 - DNA, 183 bp, Candida albicans
gaactcctacatgtttgcttttccttgttaaagattgattttcccgttatttataatactaaaacaaaaactgataaaaacactagaaaaaaaaaaaaaaaaaaaaagagaaagacaacaaattcatattcatacatacatacttacacccattatttaattactgtgaatgaagagaaatga

SEQ ID NO: 10262 - DNA, 273 bp, Candida albicans
  unsure (258): Identity of nucleotide sequences at the above locations are unknown.
atgaagagaaatgaatcctatattaacagtttaacaataggctccaaaaacattggcagccatcaatccactgatttcaagaaattacttgatatattccttaaactaataggtgaacacctgatgattgacatttggtttatccaagaaatcagatttgtatctcaggaacaatttaattatatcaacaaaatattaaaacaacacaatgcacagcttagaatgcatcattttgaagatctaacgggttttcttatncattcgccacatgct

SEQ ID NO: 10263 - DNA, 555 bp, Candida albicans
gcatcattcaaaagatattcatggtttaatagccaagaaagtttatcaatcaaaggtaaactgcaggtgaaagagtgtgacccaacagatgacaatgataaatataacacatcattagatcaagatttattagatgaaatcaatcaaattcctgatgattttgattttgatcaaaaaccaccagaaactgaaaaatataaacggttatcacaagaacgtagtgggttttatcgatataattcatataatagaaaaccgaaaaaaactgtcatatcaaatcaatttttatcaaataaaattgaaacattaaacaaaaccgtcacattttataaaagctcatcaccttcatcgtcgatttttgattatagaagtcgcagtgtaagtagaggtcattatacacggtatatgaactcatttgcttcggtaagtgaagaagtgaatgaagaggatgaaaatttagaggaaaatgaaggtggtggagatgaaaattatagtgaattgattaaagaagtgaatggtgattatagtttccggtttcaggtcatcccgagctag

SEQ ID NO: 10264 - DNA, 201 bp, Candida albicans
cgtattttatatttatcacatacacaacttttgtcttttcttttatttttttttttttttttgagtcaagataagggtagagatcaaaccaatcaaatagcattctccctttgtgtttatgggaactttattttattgttatgtttagtctttcaattagagattaaatatcaacaaccttattttattgtgttgaattaa

SEQ ID NO: 10265 - DNA, 195 bp, Candida albicans
cgtttaggttttgttgtagtgtctgcagacgatggagttgtatttgttgttgccgacgtgtggatgccagggttctcattattggtggtgtttgtagatatattggtagttgttggggtagcactcgatgaaggtgaagatggtgaaggcgaaggtgattcagtattagatagattactttccatatttgaatga

SEQ ID NO: 10266 - DNA, 225 bp, Candida albicans
  unsure (100): Identity of nucleotide sequences at the above locations are unknown.
aaggtttttcgtagtagtaataaggattggaatttttctaataaattcaaaaatgaggaaattattttcacacttgagtacattagaccaaccttggganttgcccttcatggcagaccgacaatgagacatttaattgatatagaacattggcacccacattcatcagcgtcacgaacactgctgaatggctttccactgactagtgtcgactatgaattatag

SEQ ID NO: 10267 - DNA, 267 bp, Candida albicans
aatttagggtgcagggaatacagaaaagcagcaacaacccctctctcgttgttgtgtttgtatgtgtctatgcctcctcatcatcaaattagacacatgacacaaaagcactctactggccaactttctctcctattactaaaaatagtaggtagcaactattacaaaactattctctcatttgcatgtgcgattattgtattattaaaccaatattttcattcggcatttctacatgtcaatgctcccttcgtcaaagatagatag

SEQ ID NO: 10268 - DNA, 273 bp, Candida albicans
cgttttcaatcctgtcagctgctgtcagctgctgtcacaattgttcattttttgtgtttttgttgggtattggtttctctcgtgtttctcgtgaatctattgaatgtgctaaaaatagaagttatttttattttatccaagcgtgacgatgtgaagttggaaaatagcccagcaatctacactaattatcacaatcattatattgaatctgctgtgaaaggactggacttgaatttaacaagtactcaaagaagaatgatatatgaaatttag

SEQ ID NO: 10269 - DNA, 237 bp, Candida albicans
aaaatttggggttttattagtttttggtatatttctagtgaaattaattcacaccaaaacaaaatcctgtcgggaattgatcatttttgtatctgggacttttacaggggaggtttatatggtcatagcaaattcagtaaactttcgggaggtagtagtatgagaataataatacaaattgttcatactaaacaatccaaggatcctggctgtctttctacccaaattcaactttag

SEQ ID NO: 10270 - DNA, 219 bp, Candida albicans
ttaaagataagcgtaatacttttgatatctctatatgctaccactacacgatcccaaaatgttgtgatatttcaatcgccatttaaatcttgttcattaacaccatgtggtatcacaataacaaatgactcaatgtgtaatttaaattataaattgataatcctattaatcacatatgaaagctcaaccttggttaaagcaaccacaacctataaataa

SEQ ID NO: 10271 - DNA, 267 bp, Candida albicans
attaatttcactagaaatataccaaaaactaataaaaccccaaattttctactcaataatcaattaatatctaaaactcaaaccaagactttaatgccggatgggtatttttatggcaaaccctttattattacatcacgcacgctcaatggtagacaacctttttatactatctgttatgcaaatggtaaatgtgaaaatgttacagaagacacaattagacatcatgctccacaagcagtcagaaaatataggttacggaattga

SEQ ID NO: 10272 - DNA, 189 bp, Candida albicans
catacaatgtctgatggatacatgaatggtatgcggtttaatattgctacgtgtactactcgatcaggagtgttttactatgtcatttgttacgaaaatgggatgcaggaaactatgagtgaagcgaagcttagatattatgatccccagtcaattagtaaattcaataaacgaattaataaaaagtga

SEQ ID NO: 10273 - DNA, 468 bp, Candida albicans
ttattttggcccattcaatgggtggtttcaattgcctatctactagggtggcattatcttgatcggggcttcaataatctaacattggttacaaagggtcaaccattgcttggaaatgaaaattttgtaagttggggagataaagtgttagcgagtgtgaatgaagctacacataacgagtttaaaaggacatttttgagagttattcataagaatgatgttatcacgactttacccagggatcaaaatatatttaatcgatattctcaatttaataatcaaatatatttgaattgttctgagacagatacgagaccaactattaacgaagttattgattgttatgatggatccaataatcaatgcattgccaaagatttcccttttttgatgtttgaaagacgtaattatttacaaatacacatcaattatttcagacaaatggggttatgtggaatattgaattga

SEQ ID NO: 10274 - DNA, 483 bp, Candida albicans
caaatgtatttagggttggtcttatcgttatttgtttcccaaattttgcatctaataagcgctcatcccatcaacgacgacaattcgatattcatagataaccgcgaccccaccacaccaattgactccgagatctattccaatctatatacatatgcacatttaatcgatatatcatattgtatttctgaagtaaacagaatagaagaaccatttaaatgtaatttgaattgtgaaaagagatttcctaacatttccttggtttatcagttttatttcgacgactcggttacaggctacattgccaaaacaacatcaaacatctttatatataatgaaacaattgcagaagacaaaaaaacaattattgttgcacttcgagggacaagatcgatatttgacactttaactgatttaaaagttgatatgataccatattcgaatactgggactaaactaccgctttgtggattcgaatgttaa

SEQ ID NO: 10275 - DNA, 348 bp, Candida albicans
aatatggcacaagttatttggaattcacacattgatgtttacaataaagatgttataccaatcaatatagctaaaaatattgccaaatatttaccgattcaagatatattatcattttcacaagtttctaagaattgccatttagcagttactgatcctaaattatgggtttcaatgttgaaaggaatgggggtatggcaagaagctaaactattgactaaacaagatataaaatctaatcaaaaaagtaatacccctgggggctatctaaacgatccattaacatgtatggattatatttatcgatctaataaaaatgctaaatatcaagtgattaaaatttatagg

SEQ ID NO: 10276 - DNA, 270 bp, Candida albicans
ccgtgtttggtcgtattgccgttgctaaatattataattggattctcaataccaatacaaaattggtcaaatttggtagtaggtatctttatccaattatatctagatgccacagtttttttttgttttagaaaaagaacattatcttatgagtttgtggggagaatgggattgatatttgcaactattattatccgtttatttgtttcattgttctattttaatatagcccttaaaggagatacttttatcctaagatctatcttataa

SEQ ID NO: 10277 - DNA, 198 bp, Candida albicans
aatcaaaactacacagaaatagggtcttttacggatactaatttacgaaatcaattaactttacaaattgaaattacttatagctatgtgttttttcccaataaggagatgaggtttttaaaaatttggttcaaaagtgtttttagggttcagatatctcaactcaatagccgtgtttggtcgtattgccgttgctaa

SEQ ID NO: 10278 - DNA, 195 bp, Candida albicans
caattacgaaagggagtaagcaggagaagccaggcaagttcggtcctagatgcaggacatgtggttggtctccgtgtgatctgcctaaataggaaatacgtaaacaataagaatcaattctttttttttagagattcagaacaaaaaaaagaatttccttcacaacctaaaaatagtaataataacaaacaataa

SEQ ID NO: 10279 - DNA, 192 bp, Candida albicans
aagcaaagagaaaacacaaaacaagcgaagtttacattaaaatcatcccttaattggccccaaaaggttaacaaagcttgtcattccgttattactaatcacagaattttattagcagctcgaagaacacgcaaattcgaaatcagttctcattatgggtcaaaaaaggaacagaatttcaaaggtttgtga

SEQ ID NO: 10280 - DNA, 246 bp, Candida albicans
tatgtggtggtggtggtgaacgaaaatgttaggaccaaccgaccgaccgaccgaccaaaagtcttgactaaccaacaaaaaaaaaaaaatgtgagtaaagagcaatgcaatggaaaaatggaaaaattatatccaacgtacatttataatcaactatttatctctcctccctcccccccgtcgcaaaaaaatttactttcctttctttcttttccttttcttcttcttctttcctttctttattaa

SEQ ID NO: 10281 - DNA, 198 bp, Candida albicans
aaactaaccaaagcagaacaaaccaaaactacagaccaatacgaagtaaaacaacgtaaacattcaacaaaaaatcaaaccaggaaaagaagccattttttgagagtatggtcgaatatgaaagcattgcaagacattacagaacaaggaatgagctacttcaagtattgcaggaggacaagaaccgaacaaatttaa

SEQ ID NO: 10282 - DNA, 462 bp, Candida albicans
aaacagtatcttaatttcacacccacttcttttgaacagcctcagccattcactcccattcattccaagtataaaaacatagaagagcccatcaaaaggtttctctctttttcatttccctctactttctttccatacgtttcaatatctcagttcatgaaaaccttgttaatattccttgcttttttatcaagcatttttgcttccttgataggattgacgccacccagcaaagactcattttattcacctcccgttgggtttgcaagtgctaagccaggtgatatcttagaaattagaaacactcccagtgctcctagtagtttatatttacccattgttgttaaaaacgcttggcaacttttaatcagatccgaagatcttttggaaatccaaatgcttttgttgctagttcttcacccacgggcgctggaaaatccgcaaattgcgttaggacacacc

SEQ ID NO: 10283 - DNA, 201 bp, Candida albicans
tcatttttcttctatgattacgatgaaatcactctttcaaagaaatataatgtccaagcccaatgggaggagggaaatttgtctctttttgatgaattgagtcttaattttgttcgtactaattttttaaactatataaacacttttatatatttaagtatttactggttaatgttatatactattatccaaagtttctaa

SEQ ID NO: 10284 - DNA, 1674 bp, Candida albicans
  unsure (759): Identity of nucleotide sequences at the above locations are unknown.
tacttactaacaattgcttttccatttagacaacgaaatgtacaaacttctcaattgaatatcaatcaaaaaccaacaacttcttccgcacaatcaacaactgataggaaaattaaaaaagattcacgaatacgaggatcgggttcaagaaatgtaaaggcaaatcatttaaatatcgacccatccgagaataaacgattagtttctcaactttcatcggcattaactaaagatggtgatttagaattatctcgatcaagtagaagaaaatcatctatactaccttataaaattatcgaacgtccaaaaatatctcggaagtcaactacaaaacgggttagctttaaagagaaatcacaaccacgaccacaacaagaagaagctaaaatcgaagtagactccatatcaaatttacaagatttcaatgatgaagaaaatctcgaatattcacaatcaaatataactgaagattcacttataccatcatttcaaccacaaattggaaaactgaaaaggaaaaaaccatcgagtggaaagaaatcaaaaattgctctggataataattccaatctaccgagtgaatctattttaaaaaatacaaacaaactaaattcaaacatttccaaagcaaaatcgaaaatagatactctacaatcaagaccaattaaaagacatactgtatctaaaactgcccttgctgatagtccgagaagttcgattatggaaacaagtctatttggagatactgaaagtgaaatntcaattgctcatgacaacactaaaaacacactcaaagcattgaaaaaagtaccatctagatcaaaaaaatcatcaaattcagttgaatcttcacttatttcagagtcaataacaaaacaaaaagaatcggtgcagccatcaccaacaattccaaaagaatccagtgttgaaacaatattaagcgaagaatctgaagatgacactgatgataatgaaagtgacaacgaaatcaagcatgacgacaacgcctatgatccagattatggcagaccaattatatcgcgtagaaaaggaaaaggaaaaggaaaaggattacctattatttcatctcgaagaaaaagagcgctaccattatttgataataatgctaaccatggtaatgggaaaactagaaagacgttaacaattgattatccaagccttgtaaatgcagcaaatactcgtggacgagtacaacgggcgagaatgttagatgttttacgatatttggtatcatcatttgatcctgaagttcctgataatagattacatttacatcaacgatttcaaaaacatttactttcaagtattgataatgttagagatgcagcaacgtcggtagaagatgtagcgaaaaatattgcctcagttcaaaaagcgaaaaagcaattaagacaaatgatcttggatttaagaaaagatcatactgatataggtaatcaattaaatgaattacgtcttcaagtaacaaacaaaaaattggaaacagaacgtttggatgtaatatataatcaattacgagaagttaaggcttacactgagaatcctaataacaatatcagtactaaaggtaatttaagttatactgttcatatggtacttgcatcattacaaaaaaattgccaatcatacttcggggattactcctacacttga

SEQ ID NO: 10285 - DNA, 231 bp, Candida albicans
ccacttctactaatacaaagtatcgctttggtggtagagtctgaacgacttgtctcggtactgcaatgtaaagactcggacaacactacaacttatcaagcttgtccaaacagagataatgacctatttaaccaatttgggacgaaagttgctatttctggtaagccagctcatgcacaatttcataagttactttctcactcttttattttttcccatgatatcatttaa

SEQ ID NO: 10286 - DNA, 426 bp, Candida albicans
ttttttttttctggggcatacttccagtttctcttttttcctccccacattcaatacccatactgcataaattatacaaactcattactagtaatggttgggagaatcggtactaaacctaagaaaaaaaaaaccttaccgaaatctaccccacctactaaacagcacttaatggagtacaccagatcagtccggatatcaattattttccgcaaaaacgatatgttatcttggtacaccaatttacaaaatgcatgcttggattcacccacttccttctccaccatacaatttggatgctctaactatattttatactctattgagttgaacggatattttatctttgattgtcagtgttatatttccactacagtttcttataacaagagatattacgttatgaattttaaagtttattcctaa

SEQ ID NO: 10287 - DNA, 1251 bp, Candida albicans
tttactgtattctttgtatttattatatccattataataccttataaatttttcaaagtctccaacaacatgacaagcttacgtaaagcctcattttttgaaagatatcaaatatgccgtactgaaaacaagtattatctgaattttaatataactgttgaataccctttccctataacaaaagccaaattatcccgagccttatcacacttaattaaagataatccaattttaggttgcaatttctttggtagcactgacaatgattatagagattatgtattgaagagtatccccattacatttgactctgttgttgagtatactgaatatgatgtcaatccagaattttttgaatttttgaacactatttattttgaaatgaattgtaccaaacctttatggaaattatttataaaagacagtagaataactatttgttgtaaccatgcttactttgatggtaatggtgaagcattcttccataaagaattatttcgattattactagataccagtgatgatgttgaatttcaaaatgttttgagtaaagaagtggattcattgtctgaatcagtaactgaggtttgttccttatacaaaacaccaatatggtttttaataagaggagctttgcaattatggttaccaaattggatgagaaagttagtggcttacttcacttatccaaacatcaataaatacccaatgtttcaaaataaacccatatcgttgaatcaacatacaaactttagtgtgattaatttgaataatgatatagtgtcaaaaatgttagccattaccagatctacatcaacaaagttaacgccatggctcattaccattgccttacaaacatttcaagaatttcaccctaataggtctatgtctatagcgattccattaaatggtacaaggtattatgatttggatatgtttcaggttgccgtggctgaaagtagtatagatatcgaaccaatcaccaatccaattgctaccacaaattacattacaaaacgtttacaacgtgatcttgactctcgtcatccattctattttgttggacttttgaaatacattaatattggggaaatttcccggtttcttaaatcaaagataggtacacataaacggtcaaccatggagatttcgaatgttgggaaaatgccattaccatgttggtgcagtcgaaataatgggttcctgtctcatttacaattcaatgtggtttcatcacctcaaggaatgaac

SEQ ID NO: 10288 - DNA, 210 bp, Candida albicans
tccgtagtttcagatttgctagtaattatcagactaaggtacttttttaagttgaaggcattggttagtgagataaatgacattgtaattgccgctatgtcagaaaagtttgttctatctttattattttcatctttgttaagtaaaatctttcatcacttcaaaggctgcttttttttggttgcaattttgatgcgaaatttttactaa

SEQ ID NO: 10289 - DNA, 216 bp, Candida albicans
gacagtttatgtgcgctaagaagggaagccaaagaaagagaacaagaagaagaacaagtagattcacactgcagtattgacacacactatttacaacaacaacaacaacagcatcaacgccaaaaaaaaaatttacgcactttcaatatttcggacgaaatttttcttttcttttgttcttcttggaaatttcttcttcttcttcttgaatcttaa

SEQ ID NO: 10290 - DNA, 243 bp, Candida albicans
gtaaaacgccctgaccaatcaaacaattataatgtcatgccaactgaaataacagcgcacagatatatattaatttatgcatcatcaccgccaccaccaccattatcactatcactatcactgccactgcccacttgccaaatttatttttcaaccagcatcattcttaaatatggttttctatttttacgtgcaccaatacaaatattttttattttattgattgctattaatagattctga

SEQ ID NO: 10291 - DNA, 210 bp, Candida albicans
atatttttgttcatacgcgttttgcttttcaacaaacacacaaaagaagaggaatacaaaaaagtaaaatcacattatatcaataacaaacattatttatctatttatctagcagcagcagtacctgtagttgattggaacataggagcatttggcacaccagaggcgttcttcaaatcttggtttgattgttgtgaggtttgcccttga

SEQ ID NO: 10292 - DNA, 189 bp, Candida albicans
atattggttgtaaaaaaaacaaatttagggagtaaatttccaatcagaaaaaaatacgcaaataacttcaaaaaaaaacaaagaaaagaaacaagacaactcaaatatccagagaatgagaaaaaaagggagtgggaagaggaacaaaaaaaaaataacaatgtgtgtgtgtgtgtccgtgatgaataa

SEQ ID NO: 10293 - DNA, 204 bp, Candida albicans
agatcaattattatggatattcccttgaaatcaaaaccaaaggtatctacagtgaacctacttgcagattccaaatttgaaatagggtcaaccacaaattcatcagccccattggatatagacaacaatgacaaagatgaaccatctcaattgaaccctaattatctttcttcaaccacggggctggaaggttccgcgattggc

SEQ ID NO: 10294 - DNA, 210 bp, Candida albicans
  unsure (12),(13),(14),(45): Identity of nucleotide sequences at the above locations are unknown.
gagtttcaacgnnnttcattggttggaaatttattaaaacttaancgctacttgtccgaaatttctacattgaaagaagttagagagagaaagaaaaaaaataatcaaaatcttccaaccaacacaaattcttacaaccatttttacaaccacatcttcaatagcaatatccacatatacacacatacacacaatgtcatcagttgctaa

SEQ ID NO: 10295 - DNA, 510 bp, Candida albicans
atcaatataattatcaatctcttggatttgaacaattcaatcaaccagacaagtctccacccccagatacaaggtaataaccaaccatatggcaagactggcaaaaataccaagactaatatccagtttaacaatgatgataatgatgatgattctacaaaaacccacggctattataatttattattaactttagtgaagaaaattaatcgtaaatataattgcttggtggttttaacatcatatgatattgaatttgatagtggattagtaggatcatatttatataatcctaatcatgaattacaaagatatacaaaattacctattccatttatcactagatttacatcaactatacatattagtaatgatgctaatgtcatacatgttttaaataattctactactgctactgctgccacttatcccacatctgataagatagaacagaataaacggaaacacatttcacatcctaaatggcaaatgatttcaaaaaatttataa

SEQ ID NO: 10296 - DNA, 240 bp, Candida albicans
  unsure (27),(28),(29),(51): Identity of nucleotide sequences at the above locations are unknown.
gttttaataaatttccaaccaatgaannncgttgaaactcttacacacacnattttcccatttttttatccatttctacacgacatagattttattactgctactactaataccactgtttcacgtgacactattcttctatacccccctggtcctttctattcttcttcttcaaggggtcgtcctcgtcctcgtcctcgtcctcgttgttgtcttcaaattagtttgatttccgcgtaa

SEQ ID NO: 10297 - DNA, 534 bp, Candida albicans
  unsure (14): Identity of nucleotide sequences at the above locations are unknown.
ccccccacaccccntatatttatgaaacaatcgaaattacttgattatcatgtttctaaatcaacaaaaattgaattaagattatttgaaaatacattgaatttttctaataatgattatggattgattttatatcccaatagaaaaacattccgacagcatatccttccacaattgaataataataataataatactaatgctactgattctatattggtgatatcttgtatggataatgaacttttaagaaataattttataaattttgttccatgtaagaattatcctcaattgattaaaattttacaagatttatataattgtaatgaaaattcaccatattttgataatgctacaactacaacgacaacgacaatacaaatattagataaacatattaattatatattaattcataatatttcatcattcttttatgatcttcaaatagtagatcaatataattatcaatctcttggatttgaacaattcaatcaaccagacaagtctccacccccagatacaaggtaa

SEQ ID NO: 10298 - DNA, 219 bp, Candida albicans
aaaaacacgacacgacacgacactcgatatacaagaaatgccaccaagaaatggaggggaagggggaggaaggaaggagtggatgataaactgcaaatattaatcattgctttcaagaaaaatgccacctatgttttcataggcccaatgattgaaaatggaacggcacaaaatgaaaagcggagcatcaagtacaacccaaccccgtatagatcgtaa

SEQ ID NO: 10299 - DNA, 222 bp, Candida albicans
cccgcgcctaactcaagcttggatcctgcagcctgtcggttaagacaaaagaatgacgtaagagaagtggaattgttggtagtgataatgacgagggaagatgaatattgggaatatattgactatgatgataacgatgatgaatactatggttatagtgatgatggagatagtgacggatatattgaagagatttatcaagtaatctccgaaaataagtga

SEQ ID NO: 10300 - DNA, 342 bp, Candida albicans
tcacgtggaacgatatcaacaccacctttgtaccctcctgcttcgttttcatggatttcgtccttaattttttcaatgagaatacgagcgttcttcttaaaagactttgggtcacgtttgattataccaccacaaatttctgataccgtggtagctattgtatggtatgtattattgaacacaaactcgaaaaagtcatcgcggaattacttgaataagtcatctgaaattgattcaaacatgatgtataaaaattttggtaatgaaactgcaagggcgctctccaagcccatgcttatttctggatctggtaagttctctaaaagcaaggttaatcgctga

SEQ ID NO: 10301 - DNA, 192 bp, Candida albicans
ataaataatagaataatcattgatatgtcttatacttcgaccaatactttgattgactgctcgtcatgcaaagattatcataataatttacgtgatatttctttagcatcagtagtggtaccaccatgggacaactcagatgtctcaatatactttcttttggtcagcatttctccggaatatgcgatatga

SEQ ID NO: 10302 - DNA, 252 bp, Candida albicans
agatcgtggttccttccgccgccgtgtgtgaagacctacccaggaatcacaaccactgacagtgagttaaccgataaactaatcaataatgatgaattgagtaaatctttgaaagaatctttacttattgataatagattggcgaaaatacctttaccagaaaaagtaattgatgcagggatatttttgaaacgagaaagtcgattggctgatgaagacgattttgatgattatcattctaaaggatggtaa

SEQ ID NO: 10303 - DNA, 201 bp, Candida albicans
agtcgtcccggagttgtatttccagccgggacacgcgagacggggctggccccagaacataatggaacccatctcgaaacaaaaaaatacaacaaagaaaaagtgaaaaaccaattacacacaaattttaccacatatacattactttttattttattttcattaatatatgaatgtcaactaaaagagaagaccatttga

SEQ ID NO: 10304 - DNA, 984 bp, Candida albicans
gtggggccatgcggatctccaggcgtggtgaaaatggaagtcaaaaagaaccccatttatcaagaagttgtacagattgtggaatcattaggcttagattcgtttaaattagaagttccagaagaatcaagttccaataaaaccacaactgaaaccacgacgaaggcagaaccaattgttacaacaccaacaacagctaaaagagtatcatccacacctgtaccaaaattaaccaagacagagaggagactatcactcgatttaatgcatccaagaccctcatttggactaaaccaagaatcacaattggtaaaacctccgatagcaagcactaccaatattcatgtacatgcccaacaagaaacagcatcacacttcaacccgtcagtaagacagccttcaaagaaaaaattcacatttcataaatcaaagtttacaatatcaacaaatagacagcagcaacagcaacaacaaactaacactgcacctcgacaacggagaacatcaactgtggatgaacaactaccattatatataagaaacctattgaccaagaatcgaccgcgacaaacaatcacccctaaaccatcgaaacaccactttattcaaaatgcgtcaccagccaattcatcacctcgaggaagttataagagatcctctcgtatacaaaatctattgaccaattcacagtcattatatgtacattcgaaagacccagcaaatagtgccgaaacaagtacacccacaagcaatgatacagatttacaattgcgatattattcagatgaacttgatgacgaggataatagagaatatatactgcctgatctgttgacacgttatttcggagttcatgaagatcacgaaatagaagaagatacagatgaagacgcagatgatgattccgaagaagaagaggaagaagaggaaaatgattttgttaatgttggtgatgatcacgatgattatttatttaaaatataa

SEQ ID NO: 10305 - DNA, 207 bp, Candida albicans
attgtttctcactctataactctaattttcctgatgaatgataatgaatattcatacatgaataatgaaattgcacttgttggtgcagttttcaatacacttattccaaaacctttatataaaccaaaaacaccttcattctttagtatggttacaaatatatgcagagctgtatacggtcttccatggaccacagaacacatttga

SEQ ID NO: 10306 - DNA, 189 bp, Candida albicans
tatcatctaccatttatcacttcaacttcaccaagagctatgataatggatattcaaaaacacccattgataccgagacatgctttcattactttgagaaacaattttaacgccatcgataatgttttatccttacattatactaatcacacatcaaatccaacttcaccacgggaagaagatccgcgt

SEQ ID NO: 10307 - DNA, 522 bp, Candida albicans
tccaatcaagatcatcaaccaaacaactatacaactatggactctgttgaaattgatcaaattaataatattgaaaaggagatagatgaaatcaaagctgatatagcattaatagaaaaagatctaacatcaaatcaattgcaaaaacaacagttacaagaagagattgaagctttggtattagagcaacaaaaacaggctcaagacaaaacaaaggaatcgcctgtccccagtggtcctgatgatatggatattgaaatacctgaaattataaaacataattattttgatcctagtatccaaaaatatttccaacaatcaacttctccatcaaaccaactgtctcttcctgaaaatgccacaactaaaattgcatcatctcaattaaagcctatcaatgacttggaattgaaagaaaatgtgctatatgaaaatattttccggaatgtttggtataactgcattccggacgaactcaatacttgttttgacgagcgaccggaaagtcgattttcgggaaga

SEQ ID NO: 10308 - DNA, 957 bp, Candida albicans
aggctcaaagacccaatgaacgtgataatatttgttaaaaattggttacttgaaattagcgattctatcattccatttgttatatttgatagtttgatgaatttatacaatcaagagaacgttgcagcggccgatttaatcaagcttctttccactattcctagaagtaatttggcgtcattaatttatgttattgaatattttggtaatttatttgcccttggtagtattccgaattatgaaatttcagatgaattaccagaagaatcattattggagtcaatagaagaagccagcattgttcaagtttccaatgaattgaattcaatggatactattggatctatacctattatgcatttgattttaagaccatcaacttcaaaaaattctactgggtttaaaccaccattggataaatataaacgtataatggttgatattttgaaacttgatgtgcggactgaattattgaaacatttgattgaacatgaaattaattataaatctaaaaaagaagccgaaaaattacaagttaaaaagattccagtaccagtaccagtaccagtaccagtatcagaatcagaatctcctcaaactccaccacaggcaaaagtggattccattgatagaagtacgccagcgattgtacatccacaaccaactcaaccaaacaagcaaaaacgtccagaaagtgcagaattcactttgagaccttttaggacaagaccaacaccggttccaagcccccaatcatcacctaagcgtggcgcatttccaacttttactggctcattgagctctggagcttcaacaactaaactgccaactccaccactatcacaacctacaacaactaaccaattattgccacctgcttcacatcatactaatcgtggacgtactttgagtaactcatttattacccctagaattgagattgaatttgaaaactag

SEQ ID NO: 10309 - DNA, 213 bp, Candida albicans
tacaattattatttatggccgttgatcattaaacttgtcataggtactttttcaacttttttcaattttttgaccctgaataaaaatattccccctacaccatttgttaaacctcatttttatacttcaaataccccttttatttctctcataaaatctctaatatcaatccacctatggcggaaccatattattccccccccttcatcataa

SEQ ID NO: 10310 - DNA, 282 bp, Candida albicans
  unsure (28),(138): Identity of nucleotide sequences at the above locations are unknown.
ttaagtatggggtcgattccctatattntaaaccaaacaattaaaatcattgaagagagaagccatgatatttttgaagtttttagaaaattatggatgcaaccaattgaatatcaagttcaatggagaataaagcangacattatccaacttgttgctgattatacaccagatttgaaaacgatattttccaataaatatttgattgagcaagaattttccaatcaagtgttgaaacatttaaaggctcaaagacccaatgaacgtgataatatttgttaa

SEQ ID NO: 10311 - DNA, 771 bp, Candida albicans
tattctaacccccttgaatctatgctgtcaaaatctagatcttacgtttcaattgcttgtgataattgtcgtaaacgtagaaggaaatgtaatggagaacttccctgtcattattgttcagggaaaaacaaaccatgtgtatatgacaagaccaaagataaacgaagacgacgagtagatttagtttatgttgattatttagaacacaagtataacaatctactcaattttgtcaaaagaatacgatcaactactaaagatgaacgattacgtgctcaatgtaatgaaatgttggctaataatgatcccaaattcattgataataaagatcttggattatcaaatgatgagctgacccataacaatcaatccgacaaacaacaaaaggagatcattcaattggataaccctatggatgagttggtgtctatgaaatgggaattgaaatttgatgaatctggcaatacaaaattcttgggtcctccagttcgacaagttgaccgatgtttggtcaaagacagtatggtaggcatggaagaacccgacagagtatcctattttaatgaaacagtattggcagacacagaattcatgaaagaactaataagcacattttttcaaaatttgttgccatttaatttagtacttgaagagatcaatgttgacgagattactcgagaaatcacatcaatgacagataaacgtagggtgttacgaagcagtgagtggttaacatttattagcattggctattttagcatatggaaatag

SEQ ID NO: 10312 - DNA, 231 bp, Candida albicans
caacaaaaactttatatttcaacaacggcggcgattctcgaattgtggacacctctctactccggtatctccgccttatactccataaggtttatctattttcatgccagatttgttcaactaggtttatggtattcttttttttttactttatacattgcgcatctgcaagttagatcatcaagaataaacacaatagacaattatttagaattatttagggtcttttga

SEQ ID NO: 10313 - DNA, 189 bp, Candida albicans
caaatattgattccccacagtatggttacgaaactattgatttgtattaaattaattatgttgtctttgattagcaatgtatttcatatgaaattgtcactctcaatattggccccctttcgcttaaggaaaatcgttgtcaaatttattaaagaaaattatgcttatgaaagataccctcgatcttaa

SEQ ID NO: 10314 - DNA, 1413 bp, Candida albicans
aatatataccctgatggtgaactttggattagtaaattattcattaattggcaaaataaactaaatcaacctacaaccactatcaaaataatggaatatcttaaactgacagattcaactttgatttcatattatttccaaaaacatttacctgattctaatgatttacaagaattaaaccttgatagtagtctcaaatttattttacaaatattagatcattatcaaatgactgataataattttgtgattctttggttatttaattataagtttatcaacaaattacaatcatgtattggtatcattcaaaattcaactaaatttgacatcataaccaagtttaatctattaaattgcaaagtatcatttatcatgagtttgaattatttgaactttataattacacaacagattctacaaaacaagtttaatgataaattgcctgattgtgttgttcaacattttaaattgtttcaattacctcctttatctaaatcaaatgattttgtcatcaaaaatgaaaacaacgatattaataaaccaccacaattggcttcgttagataaaattttcacaatgattgaacagaatgattgctatcaaagtttgattatgattcaatttcaaatattggttttgattaacaaattgatgcttgatgaatgtaaatcaattgaatatatcaacaatcaacagcttgttagtattgctgataagacgggagacattgatcaaaaatcattatcatatttattacaagagaaaattgtcttatcctatcttgaattatttatggtcagtttgatcagcccattgttgatgattaatagatttaatcaaaaagcttcaacttcttcgtcaacaaataatgaaacccaattagttaaacatttccattcaaacttgattttccagatctttaataaaattttgaatttaaattataaatcattacccaggaataaaatttggatttgtttaatcaatataatcaatgatatttgttatacagatttacgttatattgaattgttcattgaattatttgaatatcaattatcccatcaaatcaacacccataacaacaaacaaagcaatacagataaagaaaagacagattatttaaaagatgatttaatcaatagtggtttgaaattttttattgaaactttcaaaccaaatcatacatggaatgttgcgtatagtgacaagcccagcgatcaagatagtagatcaaaccaacatcaacaacaggggcacgcagagggtggaaacactcagttataccaaataaaccttgatgattacaaatttatatatactggggataattataataggtttagcacgtttaatgtttatcccattcacaataatttcaccaatactaattcaatgcgaagcaagtag

SEQ ID NO: 10315 - DNA, 198 bp, Candida albicans
ccagtcaaaacggcacatataccaccaaaaccaccagcggcaaaggatttgacattatctgccaaagctgaatcaacgtcgtccatgttttctgttttgtctaaattttatgtttatatctatatctatgaaaaatcaaaagggaaaattggtctttttgaaaaaaaaaacgagaatgaattgaatattttcctttaa

SEQ ID NO: 10316 - DNA, 204 bp, Candida albicans
catatccaacctgtcaagtcctcgtacttttcagtacatttcaaacttcatgtgaattacttattcacacgacatgttcttacaaaagaagacgaagggaacaaaaaaaaaatttcagacactaagattgtgggatctactatggagttcccgaccaagatctctaaacgcataatgttaggagtcaatataacaaaaccataa

SEQ ID NO: 10317 - DNA, 807 bp, Candida albicans
atactaaaatcgcgttctgtatttttttttttggttgagggaggccaacatttttacagccaaaggtttgttgcaattatatatgaactcattaacaccatgtcattatccatccgattgcttgaaaactactaccaaatacagtatagttacttgtgtacaaatcctcaacttttaaatactgcaacacctagcgctaattttgtaatacatgtggatatactgattaacaacaatacattaactacaaaaacttttgattcacaattaataacaggattagctagtaggtttgtaaaattttgggaattattggaatatgacgtaaacttaaacatatcagatgattctagtcactcatttaatatgggtttaaaatgcaagatatttgaattgtatgcccccactaattgtttactttccctaaacttaaaattgtctattcttacacaagaaaataccattcacttagaagatatgtgtaccaatttcaactacttattatcatcctggaatcttttcatggaaacacaagctccgtttgttttttcagtgatcggtcgacagtatgcgaaaaccaacattttctggtataggagagttcgaagagatgtattgaaatatgactcaatggatttagacaaagtgcttatattgttggaggataaaatctctcacaactttacagttcaacaattgttgctacaaaatgttaaattacaatcagttttagaatctacgtcaccagtatcacgcaagagaggcagcggtgctatcaaatcttaccctgttgtcttaatagaatga

SEQ ID NO: 10318 - DNA, 198 bp, Candida albicans
aagaagaattcaagaatttcaaagatgcaggtcttcaccacggggctggaaggatccccgcttcacgcccaatcccccgaccacggaaccccaccgatcaccaaagaccccccacaccaaatgcggagacaacccggcggacccccggcacacacggacacagcgcaacaaggtccagcgcgacaccgcgaaagaggg

SEQ ID NO: 10319 - DNA, 351 bp, Candida albicans
cgaaaattcttctacttattttcttcttgtttctactgccccataaaagaaaatttttcattcttttttttatttaacaaatatccttttttattttatctttctctctttttctatttgatatataaagaagttgtttttttattttattttattatcaattctattagatatataattaattcaaaagatttgtgtttcatcatcattatctactcacccactcacccacctacctacgaaaaacaatctttatctctctacttacccactacttcttctccctcccttatcctttatcccttatcgacctactttttccttgaatttacaatagaccgttatcaataa

SEQ ID NO: 10320 - DNA, 183 bp, Candida albicans
aaggaaaaaaatttttggaattgtcacgacggtattgtattttttaggattttccatttagtacattttttgttttcccgttcagaaccaaaaaatcaatttggagacactcatacaattggtgaatcaattaatatatctttcaacaaaacatttaggagattaccattagttaatatttga

SEQ ID NO: 10321 - DNA, 201 bp, Candida albicans
attatgaataatgaattgaccaattggacacggcgacagcattcattttgttggagtaatgctgtcccctatcttacaatgcaagtatcgtactatcaaaatgcaaaagctcacccaaaagtattaaaaagaatttcaaaacacgcagatcaatgtcgattaaagatgcctaaaaaaaaggggatagaaaaagaaaaatag

SEQ ID NO: 10322 - DNA, 186 bp, Candida albicans
ttgtggttttctaatttgactttaacctcatctaagttttgcgcaatactgtctgatgtggcattagtttctggactattggctaacgatatgtcgttagatgaagaagtgaaatcatcattagagaaaatgttaacaccttcaaaaattgaattgaagttaataggatttggtggttggctataa

SEQ ID NO: 10323 - DNA, 192 bp, Candida albicans
gtgtttctaaggtttggtatttatattgtgtttataaaaaaaaaaaagtgtatatctaagatttcttgggagatgttattttatagagaaaaaactacaccaaaaaaaatagcactactaattctatcatgttgcacctcaagacacaattttccttttctcacaccacaaaacacaatcaatgttgtttaa

SEQ ID NO: 10324 - DNA, 285 bp, Candida albicans
atggaaaatattgggccaaatagactgtcggcccgtcaatatctattgataaccttcctcattacatttgttgtttccatttcaacatatctatattgtgctgattatgtatcatacaacatttggaattcagtaacctcaaaatccaacaaaccatacatatctataaagacattagacttgaatgatacccaaatcgacgatcttaaacgtttagggttaactccaaagaaatcagttgagatagtgaaaccagataacagcaaacaaaccatccatggaaga

SEQ ID NO: 10325 - DNA, 270 bp, Candida albicans
gctctggataccacctcacaaaaaagtgatactggctctaacaccaaatcttctggtggatcgagtgacacaaaaagtgtatggatcgctactacaggttctgattttgcttctcaatcaaattccgattcaagctcaactgcttcacgcaatagctcatcgagtgcttcacgacaagctgttataataggtagcaaagaccttacgtggaaaaagacgttattatgtggtggggttatcggtgttagtttgttgctaaatttattgtag

SEQ ID NO: 10326 - DNA, 216 bp, Candida albicans
aaccgaaacaagagccaaatacccaacgaaccacagcaccacccaaaaaaaaaaacaaaaggcctgatcaaaaagggggcgaaggtttttagacggaagaaagaaagaaacaacaacaacaaaacaccaccaccccttcctaaaatggaaattaaaatcgacaacaatagtgttcctcaagtttattactgtccactgttaaaatcatcatggtag

SEQ ID NO: 10327 - DNA, 183 bp, Candida albicans
aatcatcatggtagttattcttatactggcaatttaaactttgtcatcaatcaacaaacccaaccccctacaactgtggcaatttcgtattgtaaaaaaagaacaagtatgaaatctctgtttttcagggcttttcattcacggtgtttttttttttttcaagctaagcctcacggacaataa

SEQ ID NO: 10328 - DNA, 195 bp, Candida albicans
agtgagctgattaccagctgggcttaccttgttccagtattatttaggcatttgattgtttttccatttgaaggcacggcacaaaaaaaatatatcaaattacacaaacttgctgaaatttattttattgtaccaattgtttttcggagtaattccgaaactaaaatacaagttcgtgttatccgtaacgaataa

SEQ ID NO: 10329 - DNA, 258 bp, Candida albicans
aaggagaatgctgagacgatattaacctccatgaaatcaaaaggcaagaaaagttacaaaacacctgaggggagaagactaatatccgtttccggaaaccaaaatcaacaggaaacctcagcaaggaaaacgaggacagggaagaaaaaccatagaatagaattattcgttacggataacacgaacttgtattttagtttcggaattactccgaaaaacaattggtacaataaaataaatttcagcaagtttgtgtaa

SEQ ID NO: 10330 - DNA, 201 bp, Candida albicans
ataaacggagggagggtatcttcaactgtcattcgatttatattcttacgccaaaattcagtcaacaatgacgcactactatatcacttcttgaagaaggaggtctttaatatgagacactcagaatggcaagttgagtttgagtattatgaggttatgaaatgtattcagttctcgattctaatcctttatttatattga

SEQ ID NO: 10331 - DNA, 597 bp, Candida albicans
tcctcaagtatgaaattctacaaaatcgcttcttttgcctttctcgctttgttatcacaagctgctgttgctcaatatgatttagaaaccaaaaaagatgttgtcgctgccaatgctgatggtactgttggtttcaacttagttggtaaaagagaagtttctgaaggagaaatttctaaaagatttgctgaactcctcctcattccagttattttggttgctatcaaacacgctttaccagaaattatcaagattgccagtgcccttttggaacacttacctgatagtggaagcgtcagtgtcaatgctaccttacttgctgaaatcagtgccggtcatgaaccagatttgattaatcaaatcgttaatcaaatttcaagcaatcttcctcaagctattactactgttcaacaacaacaaggccaacaacaatctcaaaaggttaagagagacactattggtgacattgttaacgaaatcattgctgaaggtgaagttcttgttccagaagttgttgctttccttgaaagagttcttccagaagttgttgatgctctcttaagacttgctccagcacttctcggtggtcttgcttag

SEQ ID NO: 10332 - DNA, 216 bp, Candida albicans
caacaacaattttgcagctctgttgtgttactttttattaataccgctatttttttacttcagttcttagattattattttagattcttttttggtttagcacggtctgaactctttttatttctttatctgcatacttgtttcggtgaatcttttttttatatcaatatatatttattattcaaaattcacctcaaaaaagttcttcatttctag

SEQ ID NO: 10333 - DNA, 246 bp, Candida albicans
catatttcaactttaaaaacaaaaatgctgctacataataatgatgccacagaatatggtgtgtgttgtaatcacaatgaacaaaatagagaaatagttctgcactatctccttcatgcaatacatatttgtggattcaactggttttcattggagcatgattttaaacggttgtggttgaactttattgttctatgctacttggctgtaatagaagaatttggtgtgcaattaacaaagcattaa

SEQ ID NO: 10334 - DNA, 420 bp, Candida albicans
ttactaccaaccataatgataacgaccagtttgaaacgatcaagatctttattgaataaggtgttacctatcgatattgaaggtgataaacattcttctccttcagtagtaacgaggagttctccaattctaaatcatgattcagagtctttacacctgaataaaagcctagtttccaaaaattcaaataaaaagacatctaaatcaccaagtaggcaaggatctaataataaaaatactaagaaaactaacgggcataaaaagcgtcgcaattccagttaccagaaagaaagaacggaaaaatcagagctttcacaatcaaaaagaggatcagatatactcgatcaaagaagtaaattagattggattttaatcgtggctatagggtctttgattcttcttatatacattttgaattga

SEQ ID NO: 10335 - DNA, 372 bp, Candida albicans
  unsure (164),(242),(309): Identity of nucleotide sequences at the above locations are unknown.
cacatccacccaccaagattacacaactacaatctatcagacacatctagcaaaatgagacaatttcaaatcatattaatttcccttgttgtttccataataagatgtgttgttgcagatgttgacatcacatcaccaaagagtggagaaacttattctggtanttctggatcagcaagtatcaagattacctgtgatgattcagacgatccagactcaccgaaatctttggataatgccanatggtacacaattcctttatgtactggacctacttcgtatggggattccactgtttggatccattantcaaaaaccaaacttttccggttaatccaaaacggtttccattgcccgaaactcagtacccaa

SEQ ID NO: 10336 - DNA, 207 bp, Candida albicans
cgttgtagaactactggaaaggagaacactatttacaccttcaaactctcaaaacaattaatactattattaaaacagaataaacaacaactaaaagctacatatatccttagtttgctttattgcaacaaagcagtcttcaatatttcctctccacttcctttctattcaaataatgaagatgaaaataacaaattatctaaataa

SEQ ID NO: 10337 - DNA, 834 bp, Candida albicans
  unsure (47): Identity of nucleotide sequences at the above locations are unknown.
gatcacttagtacaagtaataacaggccggcaggttcaccaacaacnacaacaacagaaaaaggctcattctcccactcttagtaggataacccagaagttacttatggtgcaagaggaagaaacaccttctcttgctcaaaaatcagcttcagcagcaactaaattatcagcctcacaaagatttcaacaacgtgtcagggaagctgccaagaatggtgatcttgtcacgcagaaaaaggaaactttcacttctgttacttttgatcctaatgatacttccaaattatcaatacgtaaatattctgaaattcccacatcaccagaaacagaagtgcaagcgaaagaggaagagccagtaccagttaaagttgcagttgcaccacaaagaagaactagagatcaagtcacccgtcataatactcaacgtaatagtcatataccaatgccaaagaatactgatacaaaatcttcaaacagttcaattgatcaaaagagtagcagtagcaataatagtactggaagtgttagtaactcaacttcaaccaccactaccacaaccacaatttccaaaaaagttagatttacaggagttccagaatggacagaagctgaagatgccccaacaaaatattctcatgctattttaagaaattttgctgtattccgacaccctataaagactgttaaagctcataattccaagagtgatcaattattacacgaggaaagtatgtcttttaaaacatcaacggttgttgttgatgataatgaggtgatgattgcacctaaacccaaatcaggattttctagaatcaaaagtagactaatatga

SEQ ID NO: 10338 - DNA, 186 bp, Candida albicans
tattatcgattacgtgatgattgttttaaaaatgggggtcaatcagttattatagctattgttaataatgggattatgaattttatatcattatcatcaggtcaatttgactcattacaaaatgtgaaaactcgattaaatgaaatatatcctaaaaaaattcattcaattatatacaatgaatga

SEQ ID NO: 10339 - DNA, 1515 bp, Candida albicans
tatcatcagcggaaaacagatgaaaattttaacttcccaataaatgaaggctttaacgacttgatcagaaggtttttacaattacctactataacaagggaattgatttccgttcatccttattttattgctcttcttcgatttccagcaattgatgcctcgttttatcatcgaatactcgatccaaactatttaaaaattaattgggatgccacagaatttgtcttgaaaagaagtttcattattcctgaaggtggtgaataccgaaatcaagtcaaagggacacccctacctactggtggcagaatccggccacctgcttcaatacaagcacaaaatgatatgtttgttcaaatcatgaatagctccaataatggtaatggtaatatgaatggtcagaattggccaaatggacctgtcccgccaccagttgcaccagctgtcctggttccaacggttaacggagttcaaaacattcagaatgttgccaatctccaaaatgatccaaataatggatccttggttaaattaccactttccactcaattgttctctgaaggtatcccagctcattcacggcttacaaaatttttcttcccagatgcattacctgatgatttaactgtcgatagtgttgaacaggaaatgagtgtcgaggaattcaaattgtgttttgccagtagttgcaaatattatcgatggggggtatatagaacacccaatttcgtctatttagattgtacaataggtaaactacattttacaccagaatttccaaatgaaaatttaaatccaggatgtccagcacaaatcaaattaaaagtcgaaaacaatagaataaaaatgacatatttgtttcatcataatcattcatttttgaaatgtgaaaaagataatgttcctactttaaaaaaagatcctgtgcgagcttggttaattgaacaagcattacaagggaaagattgggcatgggtcaaagccaataaagaaggtattaatattgctggagatgttgaagacattgatttaagtaaaagaatcaatcgaaaactttattttcaaatttgtcgtttacttggagcggaaacaccacctgatgaacccgatgaatcagaagagagtgccccagaatctgtgtcgccatcaactacagcaaacgatcaacgtgaaagtggctatatgtttgatgatgaaactcatggtttagttcaaaataatagttatgatttcccaactaacgattttcatcatggattaagtgaatcatccccagctaattttgatattccaaattttggtcaatcggatgatgatgatgaagtacaagcagagactgaggcaaacaacagaagagctttaaaagcagaatgtgaaggaattttaaagtatgttgaatcaaccatggaaagtgcattcgaaatgttgcccgtgcaaaggttacacgacttgaaggaatttatgaaaaatacagcaaagcaaatggaacaagagtttctgtcgaaccattcaacgtga

SEQ ID NO: 10340 - DNA, 1614 bp, Candida albicans
atcatccataaggagagagcaaggcttggcagtcaccacgatactttatttaagaaatttgctttgtattgtacaatgtctgaagtccctaatcaagagtctccgagttcatcgatattcaaacaatcgaatgcttcaacatcaacaaaagtatacggtgctccatctagttcacaaattgctaatgtcgacttctacaccttgagaaaattaaatacgaatacttcgttttcgtcaaacctaactaactcaaccactaaaacaagcaatgctttatccaggctattcactagaaataagtcatcatctaacatttcaattcatccctcttcaagcgacgatgatagctcaccaaagacacttcgggaatctacatctccatctgaatcaagcaagagtgttagtggcaataagttgagaattgccaaaaagttgaagtttcccaagaatcaaagcagtcggaaaccagatttgtttttggatactagtagcacaataagcgaagacagttcttcgtttcggaaagtaataattggtaatctgttaaatgagatgactaaaccaagaaagagctcaatgagctcacccatgagtaccacatttcatagtttgtttcatcgatcccatcataatagcagcaaccttccacaagacaccaactacgttgcgactggcacgacacctttgtccggtaagtttgatgatttgtcaaaatcatccaagacaactttatgtctttcctcaaatagctcgaattcaataatcagcaatcctgaactagctcagatatataatttcaccaacccaaatatttcaattgaagatggagaaaccaatatggataatacaaatagttcctttttggatattcataagaaaatgcttgtaccagcagatctgtttattcagaataagctaaacaagtaccaccaaaccgaagtagggttgggcatatacgaaagtgaattagatcatgacaacgataataagatatattccaacctttatcattacttgaaaccactatttaccccatcttttacaatatctgactctggtcaaaagggtaagatgcgtccaatattgggtgctagtgttgaagaaattgcaaatttcgtaaaggagagtttttgtttacaccagcccaatcacgaaagaagttttagactgaagacaagatccagtgtatccagcttggatcgtgaaaaggtagaggattttgattaccgtcagttatcgaatttgtttgaaaaattgatggccttattgagtcataacttgcaaactgccgattcatcggaagtatctttacaagctttgatattgaacgcatggaaatattataatacttatgttaggttttatttgctaagtatatttcaaccattacaacttcacttgaacgagctatctatgagaaatcataatggaagcaaaattatcagaatagacgaccttctacttgtttcttttcgaaaagtttttattactgaacagggaattggaagtggggatagagagacatctcaatttttggggaatgctgaaagtgaagatcttacaggaaatggattgttgacttctactttggccgtgttgtcgagtatatcatag

SEQ ID NO: 10341 - DNA, 261 bp, Candida albicans
caagacaacaattattcatttctaaaatacagttttttaattagggaagaagaatgttattactacaaaaaaacaagtttaaactattggattaaaattatggcatcatcgtcgtcaacaacattaaagcaaaaaccaaaaaacaaccaaaactcaaattctaaaacttacaatgtccaaattttgcccatatactttctattgttcttcaaacaaaaacaagtacaaatgattagtaaaattatcatacaatatttatct

SEQ ID NO: 10342 - DNA, 396 bp, Candida albicans
gtgaaagagggagaaggtgggggtgcaaaaaataatgaaacgaatttcatattttcaccatttagtgttccattaagacttgttgttgggggaggtggggggggggggggggttaagacaggattcaaaattttaagtcaaaccataaatatttctattgtgaatgagttgttggtgagatttcaaatagtcaatattttgttaacaaagagggggccctattataagttatactgtattctgttgcacgaaaacaattatataatatattttttgcaatcaaatcagaacaccattacacgaaacaactttatctcctacagtacttacaagaatttttttagtatttatgccattcattttgggaaatatctattatacaggagagagctgtaa

SEQ ID NO: 10343 - DNA, 189 bp, Candida albicans
actttaaaaaaaatggaacgaccaggaagatctagatatcgttatatatcactaatgataatcttttaccagtcagctttgacagcttggcaagaagaacaaaataaactttgttactgtcctacaacaaagttaataataataattaacaaacaagaatctaatgaatctaataattcactgtcataa

SEQ ID NO: 10344 - DNA, 276 bp, Candida albicans
atttttatatatttcttgttggggattaattatttggcgtctccttcttttaccccccttttttttacacacagtcacacacattctccttttttttggcttagccttctagttggacttacaatctacattaacaggaaacatttcccgattgaacaaactacaagaatatatttgataatcgaggaaatttatttattccaaccatatatcaaaagaatactgatatataataatcaaaagagagacagagagctagttgatatcacaacttag

SEQ ID NO: 10345 - DNA, 183 bp, Candida albicans
aactacaaaagggtgcttaaaattagaaatttcaagcaaatagtcgatgcacataaaaacaaaacaatacaacagcaacattttacaatgaagtttcatctcaataaacctgtaacaaatatgttcttagatgacatttgtaagagtatagatgtgttcatccttttgtatactcttatttag

SEQ ID NO: 10346 - DNA, 198 bp, Candida albicans
tatttttttttcagatcgtttaaacaattggacaatgtagtttcaaaatttgttaaatttttattagtttttagttctaaggggggcgcgggaatattattcgactattctctaatttataaatcacaagagacgacaactatgatgatgacaacaatagcaacgcctatttggtcaccccctgtcgttgttgattga

SEQ ID NO: 10347 - DNA, 249 bp, Candida albicans
tacataaggatagaactagaacgtcaacaaccaaaaagtaaaaaaaaatttaattatcaaaatataaaacccacaacatcatcaaccaaaaaaaaaaaatctcaagcagcgaaaatctccataaaacaaaaaaaaacccaaaacacttccagcaagaacacaattttatttattattcatacatttatcccaggtcatattcattttctcttttttttaacccctaaattatacttataccatcactag

SEQ ID NO: 10348 - DNA, 261 bp, Candida albicans
cccctaaattatacttataccatcactagtcattatgaaagaaaggaaaaccagaagaagtcatacaaattcaagagatggtatgttgttcctatatcttttaaattttttttttgcagaaatcaagaaacttggcaagcattacggcttaagaaaaaaaaaaaaacggcaaataacaataacttatcaacactttgtacgatcccaacagccaatgatcaatctagaaaatcaataatgcttttgcttcgaatgatttag

SEQ ID NO: 10349 - DNA, 363 bp, Candida albicans
caaagacttaaaagcgggtggactcatttcaaaatggttttatttccaacaataaacagacttgccaatcctaataatgcaggcgggctcaccggtagtagaagacgaaggttatttgtcccaccatcgacacagtacccacttttcatatacggcgatggcgatgaccaacgttcatttttgtcaaacatagaagttggatcacaaatatatagcccagaagacgaccatagtgatgttgcaagcgttagcacttcgcgatctttgccatcgactttgagttcagtgcagaccgctgatgaccaagaatcattccacgactggttgcatgaagagcatcgaccgagcatatccggtttttga

SEQ ID NO: 10350 - DNA, 345 bp, Candida albicans
gtgaccactcgtggcgtgtcgtttagaattcgggtaatgagaacctggttggtccattcagtatataatcacatagttctgaccacagagacagattcaagtatacatgagatgatgttgttaatagtagcgctcaatatttctgttattaatacttacacgactcacgcaactaataaccaaaaaataatgttcctgttctacatcacttcttctagttcactagcaagaaaaaagactaagcaaagagagagctattgtctgcaatatagacataccacaaggtttaacaaagacttaaaagcgggtggactcatttcaaaatggttttatttccaacaataa

SEQ ID NO: 10351 - DNA, 249 bp, Candida albicans
ttgctctttattaacattatgaaggtgtggagggagagggagggggaggggtggtgcgagggcgaaaaagaaaattgcgcaaaatcgactaaaaaaaaattagttggtggtggtaggctcgtattaaaaaaaaactatgtgataggagcaaattatgtgattttgtatgctaatttatatttcaaaagactgaagtttgatccgagaaagcaagcaatcaagtattatacgaaggtgaaattacaataa

SEQ ID NO: 10352 - DNA, 189 bp, Candida albicans
  unsure (168): Identity of nucleotide sequences at the above locations are unknown.
ccactcgctactgatactattcacaatcttaaagtacgacctcatattaagtatattgcttttagtaatctcttaattgatacagtagatttccattttgatatgatgtcactttacattataagggtgtcatttgacatacatacattcaaatcagtcccatttatntttttttgcgtgcgcccagag

SEQ ID NO: 10353 - DNA, 252 bp, Candida albicans
attgactgtaaatattatggatcaagagaagagcttcaattgaaaaaaaaaaaaagaaagagagaaaaaaaaaatactcataatcaattaaattttgtaccacatctaattttttttatttttttcatttttcaagattccttcctcttgttattactttcatataaatcagttagcttttcatccctatttttttggaattcctatttattatctcattatgacattcgttccaagaaaaacatttcctaa

SEQ ID NO: 10354 - DNA, 276 bp, Candida albicans
cgcggatgcttgtcgcctcgtggtgaagacttatatgacaattcaggacttttaacactgaatgatctagatatcgatacaaaaaacaaattggatttgaaaaaattgaagcaatacaaacttttgcaaagaagattgaaaaaagaaaaagaattgaaagaagtagagtctataatgagcaaaaacttggagaaaatgaaaaagggtaacaaaaagaaggttgtcgactcaaatgggaaagtgcatttcaagtggaagaacgagagaaaacgctga

SEQ ID NO: 10355 - DNA, 246 bp, Candida albicans
ggtgggtcccaagacgactcattggtagattggtttaagaaatactctttgttatgggatctggatactctaatcgtccaattaggtggtaagcctgttgatgtcgatgccatgatgatatactactgcaaaaagaatcaagctaaactgatgacaaataatacaacaaaaggcaacaacgaaaatcttgtgttgatgaagaatatagaaaaagagagaagttttggtaaatgtacactaccttaa

SEQ ID NO: 10356 - DNA, 390 bp, Candida albicans
ctattgggtttacactatagtgagatattttgtatcatgttttctactgctcggaaaggcgttatttcaagtacgggtaagtatagacccaaactataccacggcatcactattttgaacattaacaaatcttttttttcgaaaattgcgctcacacacgacatggtaggcaaaaccccaaattccgtgaacaaaaatacaaatagacacattttccctttccataaaatatccaactcaggtttttcttcaggtggacaaaaactaagctattcaaaaatgtgccatcattccagatcttcagacaactctgcttctgttgtcaatcaagaaagagaagttttaccaacaaacgtcaagccattgcattatgacttaaccattgaacca

SEQ ID NO: 10357 - DNA, 234 bp, Candida albicans
ctgcacctgcagctgcagctgcatcagcaaataacattaacctccgagaaatatatgagagacctatatatatataaaaaaaaaagtccaaatttaaagctaaaatcaaattctaaaacccaaaagccaaatctcgaatcaaatcaaggagttaaacaaataaacatgtcaaaaaaaaatccacaatctaatatccattttatcaccgaaacaatcaaaacaagtaaactttaa

SEQ ID NO: 10358 - DNA, 327 bp, Candida albicans
agactagaagtactaacaatatcaaactttaacactattttacttattattctttattgtttgctgtggtggttatttcttgacacacactcacacacattactaccattggttggttctgttcatatatgtgacatatcacaacaacaacaacaatcccgattattccttttatcctttaattatatgagtaatagagatcaccagtctcatattctccgggttcatccatcaatccttttagttagtttagtgtctactgttttactacattcactacattgttttaatgctttagttttacttttcatttataattataacaaa

SEQ ID NO: 10359 - DNA, 198 bp, Candida albicans
gttgctgttttcatctaccaaaaagaactaatcaaaaatcgaaatcaaaattgcagcaatttaatttataattacaaaacattttttaggtcctttttatatgacgttctttttgttatttcatataaatgggtaactgaggctgaaaaaattaacctacatacacaaataatagaagattgtctctgtacgtcttaa

SEQ ID NO: 10360 - DNA, 192 bp, Candida albicans
agtgacacaaaacccccccatttagtgattgagttattccacaaacaaacaaataatacaaactcttctacttcaagaagaaaccaaatcaaccaatcaaccaaattaaacaatagaaatttcaattttttgactcaaaacatcaaaaaaaaccaaaattttaataatcatatgaaaaaaattaaagactag

SEQ ID NO: 10361 - DNA, 258 bp, Candida albicans
tgtgtgaaaaagaatctttattttgaaagggatagcaattgtataaaaaaacacaatatttattcattattattgatcgaattgagtttattatttcattgttttatgattggctttaattcatcattctccgttttttttgtcaatatagctttttacatcagtttgaaggtatttatttttgttttgacccgtgccaaatcattaggaacttatcggaagattatatatgtaagaagagttattttgaaaagataa

SEQ ID NO: 10362 - DNA, 267 bp, Candida albicans
attttagcttgcggctcttcgcaccccgtggtgaagaggactaaagataaaaaatcaattaattatattgatactagtaaaatcaatgaaaaattgaatcaatttagattagacggtggaaagaatagtgccaatactaataatagtagtggtggtaagaatttccgtcctggttttacaagaaatgaatcaaatggtcaacaaggtattttatttgaagcatttaatttcccatcagtggctcctccaccaccaccatattgttaa

SEQ ID NO: 10363 - DNA, 186 bp, Candida albicans
ccaccgagtactctaacacactcttaccaagatcgattacaaactacaaataaattttcatgttattatagatacaaattagttaatatattaattattaagtattatctctataaagaaaagaaaaaaagaaaaattaccgattcaaaccccattatatttttttacagttttctatattattaa

SEQ ID NO: 10364 - DNA, 240 bp, Candida albicans
gctttgcagttaattaagaaaaaaaaaagtttatcactaaaactaaaacacattactactagaatcagaaacattcgtattatcttttttttttttttttgtatccttctgaggtataaactttatatgttttctagttggaatatggaattgggtatacataataatgctgatatgtttacttatgtctctactttttacattacaaaaccacaattgaaatcacttaacaataactag

SEQ ID NO: 10365 - DNA, 495 bp, Candida albicans
accttaacaaaccataaaaacactcttaacaaactaatagatattgctattcccctgtctcacccatcaacaatgtcaacttcaattttccgtacattaaagaatatttattcatcaggtttaaaaagagccgcatggcaaattcatcatcacaacgataccaaacgaggttggttagttggaatagatgattttggtaataaatattatgaaactgatgccccagaagaaatccatttacgtacaagatgggttgaatattctcaatggaatcaagatatgtcacaagtagaaccaggttggcattattggttaggttatggtaccaatactccacctaatgccttgattggtgatgctaaaacaacgagagcttatcctttaccagctcatcataaaccaaatttaactaatactccaggtgcttatgtttgttataatactgctaaaccaaaattcaaatcttggactcctgaagtgaaagaaagagcttaa

SEQ ID NO: 10366 - DNA, 225 bp, Candida albicans
acaaatcaagaattaatacaagcacctcttagtccagaccaccacacaatgctgactaaacacactcaagagcttgaaaacttgcgaaaattaagagcaacactagaagcaataaaagaatcaaccgataaaatgttacaagatattacaacaatatacaaggataacaacccccaattattacaaaactctaaagatttccaaagggccttaaatgatttatga

SEQ ID NO: 10367 - DNA, 282 bp, Candida albicans
tatttttgcgtgcttgttttttcgttatttttcgtaatttccagtttttctagatttccgttatcacaccttgaagtttcaccaattgaattagagttgatgaaattattaagccttgaaagggaagggagatgggaaggcggcttgaatgaaattctgaccacatttcacgtgttgagtgaatttttgtttttatcaatacatgtttcttttttaacaattggtattattattacaattatttctactaaaactcatttagtttattgttctatgttctaa

SEQ ID NO: 10368 - DNA, 222 bp, Candida albicans
aatagtaatagtaatagtaatagtatgaacaacagagtgataggaaaaaacaacaacattcccaactacaatgaaatatcgtttctattctataatatatcgaacgtattatattcattactaatattgatagcaactataccaaagaaaaaaaaaaatgataattgctatacaacaaacgtgcccatccattatcctaataacaataaaactaaaaattaa

SEQ ID NO: 10369 - DNA, 1218 bp, Candida albicans
tcgtcccgcattaccttaagctcgggtcctggcaggcccgtggtgaagacatctagaaaacttgaattaattaaacgattaattctgtataattttggaaatgtgattaatggaattggtgaatttattaaacagaataaaatttttaatgataatgaattgttaataactttatttcaaacatgtttgaaattgaaagataaagtttctcaagagatttttgctaccgatgattcattattcctaacgatttacgaatccaatcgtaatacagaatggattgtggcatatttgaattatttaatcagtgttgaacaatatgaaaaagttatcactataattgattctaggattggtcattttaatttacctgaatcattaggtcatttattattagaagctgatttacatattgaggatttaaataaatttcaaactgattttaaaaatttgaatcttactcctactaataaactatatgaattatgtttgaaatatgatttaaaatctggagagttatcagctaaacaaatcattgacaaatattccaaatttgccgccgccaccgccgccgccaataataatggtttaattgaattacaagaattgatatctttttgtcatgtattatgttctttacaatcatcagaatccattaccaatccttatagaactacaaagttcgagtcagtcaacattttagcaacttcattattaacaacacgaaattttgatgaaatgaaaacaattattgattttaatgatatcaaaattgaaccatcaaaattatttgatgaaatgatttccattctaattgaattgtcatcatataatcagagcagtgaatcccaattattgatgatgaataaattcattgatacaattaaattatgtaaatatttacgattgaaatctgtttcaatggagaattttttgaaaatcattagatttttaaccgagatcaaatctgatcttttaacagttatattaaatcgattcataaataataataataatggtcatgatgatgcagatgataatgttggaagttttgcggatattgttatgttttatttcattgaagttgatttattcaattataaatcaaaattaatcgttttgaaagaattattgaatagtatgaaaaaattgggtgataattttaatgttttgaagattaatgaattttgtcaatctaatggaattaggttttcttga

SEQ ID NO: 10370 - DNA, 918 bp, Candida albicans
tctagcattttcaatctaaaaatggaacaatctcaaggaaacattgccaactccccaccaacttccgaaattcctcagagaccgattatattgtctccaccaccattggaccaaaactcattgaatcaatcgttcaataatttgccgacatctgttcctcaaggtcatgccaatagacaacaaagtgttgggtacaatttgcaacatgaatttgaaacattgactgctaatttagatttggacttgaatagttccacgagaaatattactcagagtgctccacctaatcaacaacaacagcaacaatctcaattgcaagcaacggattcacaactattgaccaccactgctgatttgaacaccaaaccggctcattcggtcaaaccgacgttggctgctccagctgcttcaagatatggatcgcatttaggctctgatttattaggtaaatccactagctctttacttggtgataacaacccagtttctccaatccagaaattttcttcaatcaatactcaattggatagtttgttgaacaacaatatttctggtgccaaaagtaaaactggaaccaattcaccatttttatcaaatgctgggttatccaatagaccacaatcggtcaatgattttagtaatattttcaatcgccaagaccaacaacaacaacaacaatctcaaacatttctgagttttactactcaacagcaaagccaaaaccaaaatcaaaatcaaaatcaatcaaacttttatctggacttgatagtattcagcaactggattgaaaatttgaatcctcaagataacctcacaatgattgattatttatgctctaatttgccacttgacatattattgaactttaaattccaaattaagatttggcatttgcaaggaaggttcacctccaaaatc

SEQ ID NO: 10371 - DNA, 276 bp, Candida albicans
aaaaaaaaagatcaaaaaaaaaatgccttgaaaaaatggctacgtaccgattattccaaaagtattaagaatttccgcgctagagaaatacttaagggaatggcattatcacgaagggatataaggagtccatgtaaattactttcattctacaaaaaaaaaaaatataccgtatacactagtgtactaaggatacaactatatcataatttgaaacatcagcaaaagctcaattatttcttcaaaatcgtaatcacatcttcatcttccaattga

SEQ ID NO: 10372 - DNA, 768 bp, Candida albicans
  unsure (635): Identity of nucleotide sequences at the above locations are unknown.
ccccgcctaatacgtgaagcgcggatcctgccagccccgtgggtgaagatagaatgcaacgaagtgtttactactaacatgtcaaaatttgatgcttatacaaaagatcgtaccacattatatcaaagtatcagattgagtgaaaaacaatttcgaagtcatttattgagtaatataagagcaatgtatattgatccaataattgcttgtttaggcttactttataaacaagaatataccaatatcaatgaatttaaatcaacaacatcaataaaatgtgggtttagttatattgccaaatctgctgaacaagatgaaattaagaatttgaaagaatcatcaattatattggtttataataaaaaatatcatttattagtgattaaattgaatcatacaagttatagaccaagtgagattatttatcccaatgaatttaaacaaaaagttgctagtgtgtttggattactacagatggaagaatattcaccagaatcaacggcaatcttccaaaatattaatcttgattataatgcaataactggtggacttgtatatgataaattggtttctgtgtctcatacgtatagtgaagaattgcaaaaatttttaaagggtttggataaggatgtgtntattgctgattttgtcaattatgaaaaagtttttaaacttgatgaagaaaatggtgtcaatgatgatgatgatgatatggacgttgatgaagacaaaccagaaaatacagaagaagacagccacaacaactag

SEQ ID NO: 10373 - DNA, 240 bp, Candida albicans
cattactgtgctgaattgcttccctccagtggttatgctaaacattaccagaacttgaaagacactgattactctagcgttcagaattcaattcgcagggatcgagccggacactttgctcttaaattttcaacaaacagcaggtacgcgaacagcacgcttccgctaaaagccatcacagccaacaattggcaaaataattttttcctatataataagacttgtacatatttacattaa

SEQ ID NO: 10374 - DNA, 207 bp, Candida albicans
aaaactgttttgattggaattactagattttatcatggcaaaagtgttcaacatgcagagattgtgcaaacagaagtagtgttcgaaatgcaaaaaattcaaacacaaggaaaagcaaaactgagtgaaaaaaaaaaaaagagaacgatatctcaccataacagtttgcatgtagttacaatctttccaagcttgaagaaatattaa

SEQ ID NO: 10375 - DNA, 291 bp, Candida albicans
cggaaatatatattcaagtccaggcctaacaccaggatggttgaacaggaatcagacccagaactgcttgagccaagctatttcttaatgaaagctagaacaaaatatttacaaaatccagacaacatgatagtcgggtgtcagaaaacattttcaaatgaattttttaaccatagaaaacaagctgcaaatcttgcgtataaaatatttgaagatggtgttgaggatgacgagagtgatttagatatcgtttctaagtatgtgacaccttctgatgtaatgacagcttag

SEQ ID NO: 10376 - DNA, 195 bp, Candida albicans
  unsure (137): Identity of nucleotide sequences at the above locations are unknown.
aatagcaatggcaataaattaattctattcaaaaataaaaagaacgttttcaaaaaaaaaattagaagaattaagataaagtctgtctcgattgtgtcgttattattgtcgttgtcgttcttgctgttgggtccccnagaacaaaataaccccccgcaatggattaaaataaataaaggggagatttttttttga

SEQ ID NO: 10377 - DNA, 552 bp, Candida albicans
acttcaaacatgtcaggtttgaaaaatagaaaatccactattaataaggaccaaaatgcaaaaaaaacatcttcatcgaaagttgccgataagaatgaattgaaagatccggtagaaacaacttcatttgacactgaagacaaaatcacaaaaccaattttacaagatgaacctcaaaaacatcatcaccaccatcaccctcatcatgaacacgaccacgacaacgacaacgaccacgaccacgatgacaaagaatcaacatcaatgtcaagaaccgattcacttcaaaaaaagactcatagtaaaaaattaaagcatcatcagaaaaagaaattgtcagaatcaagacgagttatgtttatatttggtgcattgattggattaatattagcagcattgttcaccaccaattctgaatcatttactaaagatcttgataaattggtcaatcttgatcaatttagtgatattttcgatgattggaaagatttgaaaaatctgaaaggattattagttcttacacgccagaggcgccaaggtaacgcgggcagg

SEQ ID NO: 10378 - DNA, 291 bp, Candida albicans
ttaggattggaaagagcttctggaagccatttattagagttcattataagaactatggaagacgaacaaagatacctcataagagatgtatgtgattacgttccaaatttaaccatcaaaaaataccaaaagaagcatttgtcatattttcatggctttcgttcattttttaaagggagagatttgaacgaggttgctaaattcattcgtcttcctcaagatccaaatgaatccccacaagaatcgtggcccgaaagaattaatacccttgtctttgatgtgttatcctag

SEQ ID NO: 10379 - DNA, 354 bp, Candida albicans
tcaggaccattaaatctttataatttaatgattacaacaggatatgtggttccagaatacctcgcaagaaatgaattgaataaactcacttattctcctcgtatgaatttttcacgattccaacgtaaagtgacggaggttacatcattagcaaggagaagtaattatcctgttaaagatagagatgttgtaatgacaataattggtaatatgcataaatcaccatctacagtagaaattgctttaactgcttatagattaaagaaatatgaaagcttgctggttttttttgtatttcttaaaaaaactagagaatacggaacaagtgcaacagtacttagtgttattcaatag

SEQ ID NO: 10380 - DNA, 189 bp, Candida albicans
ataggaattgagccgagggaggcgagagtaagaaatctcactttgttacgtctttttttgttttctcccttcccaactggattatcatttattagtaatactgataagcaaaatatcaaaaattatacatatatatatacatatccacaacaacaaacattgatagaccttgctattatttcaatttaa

SEQ ID NO: 10381 - DNA, 1638 bp, Candida albicans
acgtcgtcgtcgtcgtcatcgctgcttcaaccacaacgcgccacggtaacacgatcaatgttcacgtctaatatcccatcgatttcatcaccaataaatgaagaaccttattctgatgatcctgattacaacgctcatgaagataatttccaaaatgacgatgaagtttccagtggtggtaattcatcggtgacatcaccatacactccacaacaaccaccttataaaccacctacaccaacacaattacctgatgatctcgatagcattcgaagccatactattcaaagttctaaattaagtgacaatcatggattagtttgtataaatgaatgttgtcgtaccacaagttcgatcaattggagatattttgaaaccgaatatagaccagaatattccaaattactcacggctcataaatttgacaagagaaattatgaaggcatgttgggtccattatgtaatgcatgctttttgttttataaaaataaaggattcatgagacctgaacatgttgtgaggaaatatattcatcaacaacgttatactgctaaattacgtaagaaacaaaaggaagatgaactgaatcgaactactttagatgcaattgctatgaaaaaatttgtctctgggacttcggtatcgttgaacgctggatcttcacctgctgctagtttcccggcacctagtcataccccatcagctataaatcaagtaattcaaaacaaagcgttgacgtcacatggaaacaacaacaataacttcagctatgatccaactccaccggggttcacgccagattatagtgatttactacatcaaatcaatgtttatggtggtccatcaacggatattgatccattacctggtgccactccgccaatggtggctactaaatccaatacgagagtaataaatgttgatgttggagattctgaagtggaagagtataaaaaggccaccaaattaaacacaagaattattggtgtacctgtagaaagcaatattgataacgtcaacgataacgatgatgataacaataaggaaaacttacctcctaaaatcaacaaaactactcgtaatgattatgatgctatgattaattcattccaagaaaataataatgattggatgtgctttttttcatcacccaaaaatcatgttattagtccaaattcaaagactccagtggataaccctaatgaaattcaaaatcaggggcaaaatagaaaatcaccattaaagaatgttactcaaaaaactattgttaatatgccttcatcaccatatcaatcaacattagatgcaccatctgaagatgatcatgatcatgaacatgaacatgaacatgaaaatgatcaacaacaacaaaatgttttaaatgatgaaataagtaaaatgattaatatgagtccgtttaaatcgtcacctaatcgtgccaatagattggatacaggtaatctgattatgtctaatcaaaataaagatgatgataaaaagaatcaagcatcaactccaaatacagaattctattctaatgatgatgatgaaggtcaacataatgaaggacataaaaatattacaaaaagtggtccttcaatcttggagaaggaaaatcaatcagtctcacaacattaa

SEQ ID NO: 10382 - DNA, 897 bp, Candida albicans
aatagaggatttcaaatcaaactatcaaggatgctttgtaaccaagctttaataagaaatacaccacgctttgtaagatgtttatctagaggtgccaccggcgctccaataataacatcgaagaaagagatattggataaacaaaaaaccaaacctagcccatcagaagtgaaaccagtttcccgccgattaaagagtgcttctaaaaagaaacaggaaaaaacgaaaattacaagcaagtatcttccgttatcagcattaccacatttccccaatcccgaagaagctagaatgggaagacctcgtggaatcgatttccaaataccaaaggaatctcttaaactgtcagaagtgaaaatatctaaagaatttgacaaggaagcacgcgaccttgctggtaaaattgagagtttttcccaaaaggaagctgacgaccaagcattaattgccatttctaaagaaataggaaaatacttggaacccgagctaaatagaatgtatcctagtaaggaacacccaatgagaaaatcattatccggtatgagtaagataaatcccacgttagataaaatcgaagatagctatttgtgggagattttacctccaaaaaagctgtttggtataccgccatatcaacgaggtgatcctttaggattcaaggaatgggaaaacaaacttattgagaaagaagaaaagaaacagttagaagatgaagcttacaagaaaaagtatgggaagatgatggcagaagtaagtgatgctgattcatttattacgtcaaaacgcggtgcacgaaagagaataaatagaaaattacttaaaaactataagaagttggaaaaagatgctaaactccctgcaaaagacaaattagttatagaggtcataaaattgtga

SEQ ID NO: 10383 - DNA, 204 bp, Candida albicans
ttaaaattttttttcattagtattctctttattttttgcctttatatgagtgtattgttgaagtgcgtgattaaagaatcagtccagcatacaaattcctaccccaaatcttgttccatcttcttgttatatcgactggaagaattaaataaaatagaggatttcaaatcaaactatcaaggatgctttgtaaccaagctttaa

SEQ ID NO: 10384 - DNA, 210 bp, Candida albicans
tggcataggagttttctgataagagaatataaagaagactttatcttttttttagttttccatttattgtcttttaatttttttttaaggccctatggatcaattctagatcattttatttttttttttgctggcttattcaactattgtactataattatcttaattaaggatcaaaaacttcaaaccctttattcaaaattagtatag

SEQ ID NO: 10385 - DNA, 672 bp, Candida albicans
agaagaagaagaagaagaagaagaaaaaaaaactattttgtcatgctgacgctggttaacaaaagttggaaatcactttattcctataagaccggcaagatatatttacatttgaaaaacaatgagttggtatctttaaacttttcaattactaataaaaatatcacaaattattccaataatcaacgaataaatacactcactgctcctccacccaattcgacattgtttttaatggaagatgagttgtacgctttaactccggtgtcttctagtaataaagacttgtgtggtaatggacaaatttcacttgcaaagtataaggatgacaatacatggacgtcagattctgatatcaaattgaactttgatgacatcatagacgcatctttctatcaatatcaaacagtgttgactagttccaacagcaatcatactatttacatatatggtggtatatgcagtgaatctaaatacgtcacaaatcggttattgtcactaaatctcaacaccgggaaagtcagcaatatatccacttccaccaaaccacaaccattttatggtgcttgtaacatattagctcccaatcctcaggaacaactaataataggagggaaactgaatctggggtggctaaacatgtatcaattggcaatcttcaccacgggatga

SEQ ID NO: 10386 - DNA, 183 bp, Candida albicans
agagttgaaagcacaagagtcctaaagtgcttgcgtgtgtgggtcctaactagaatcataacaacaatgagaaaccactcgctgctactgcataataattatagaagaagtattcacatatttatatcagaagtttgtatatttttaagctatatggaaattcagttgtttatgttgacgtag

SEQ ID NO: 10387 - DNA, 180 bp, Candida albicans
agatgggaaaccgtaagtaactattttgggtgtttaattaaaggagtattgttaactaacattcaatttagatgccgtacttgtaattccttactagatttccagtttgcaagtggtaaaatcaagaaatcaccagtgactccagcatcgattttcaccacggatggcaggaacgcgctt

SEQ ID NO: 10388 - DNA, 183 bp, Candida albicans
ggagatatgttagagtacggtgaaaaaaaaaatgtagggattagaaatattcggaaaaatagcgaattcaaggtgcgcgattacaaaaagccttttggcttacaaattcatgatgctaaagtgtttacaaaagtataccttatactacgtcaacataaacaactgaatttccatatagcttaa

SEQ ID NO: 10389 - DNA, 2358 bp, Candida albicans
  unsure (34),(718): Identity of nucleotide sequences at the above locations are unknown.
aataataataataataatacacccccacctacgngaccacgacataaaagactcaattcaaatactaatggtcattctaattctcataataatactactactactactacaagaagattacaatcttcaagtccctatataaataattctaaaccaaatactcctaatttaaactccactacgactaaaactttagaatcacctgcattaaccacttcacatcaacagcaacagcaacttcatgcccactcaaaacgacataatccaaaacaaacttctaataacggcaacaccacaacatggaatttagataatataatttcgcaatataatagtataggaaagttacctccattattatcacctactttgcctgattcatttggtgatatctcagtagaacttgataatgatgatataccaattattggaactaatgagattatacctgatgataatgataacgacaacactaaaaagttatcggcaccaaaaccaacatatccaatgcaaagtaaaagaatgatcaatgatgttaatagtgatatgaatagttctgatgatgatgatgacgatgatgtaccaatacggcgactcaaacatcgccgattttccaatgatgacaaaagtttaaccaaacctaaacaaaaagaggataggaaagttgatgaaatgcctttatcaatgctttctccaactttacctttaatgtttcganatctcgatcatgattatagcactatgaaaaaagtgaatgccctgccatcactttcaacaacttctaccaacaatggacatagtgctcccattaataatagttcaaaatcaacatcaacatcaacaaatggttcagcaccatcatttttcaatattcaaaccaaagtggggacatttaaatggattgataaatctaatgatccaaataaaccaaagttcatactacgaatgacagttaataataaaatgaaatataagaaatatttcaataaaataactagtcctctgcaattaactggatttaaaatcagttcatcaaaagattatattaatgatgaaggtagtaatgatggtgatgaagaggaaggaaacgaaggagaagaagaagaagaagaagaagatgatgatgatgaaggagtgttagacgatgaagacgacgacgacggcgacgatgaaataaagaaattgattagtaaaccaaataaaagtcaaatagattttcagaaaaagagagataaaactaaacaaatgataaggcaattaaaagaagaaagtgaatccctttccaaaaataatcaattgcaagaacaacaaattcttgaaaaagagaaaatgttgaaggaattaaaggcaatattagctcaaaaaaatgaaacattaaaacacttagaacaaaagttgaatttgaaaaatcaagaacagcctagttccaatcctaaatctgataccaaatctgattctagatccaataataatgaatcaccaaggcggagtacaatttctgatgaaatgaggagacgtgaattacataaattaactgaagatataatgagaaaacaatctactcaatcttcaaaaaaagagccccaatcacatccccaatcccaatcatattcatttaaaagaattgatataaataaatttattattacaccaacaaattttgaaaaatcatttacaaatttaaccaattcacaacgtgaagatattaaatttgatttacaaaataaaaaatcccattggtttcaattatccaaaataacccaacaaaaatccgatgaatattttaataatcttaatatcactcctcatattaccatcaataccacaagaaatcctcatataattgatgatttaatcttatcaatgattattcaaattgattcatttttattacgtatggtatctaatgattttgatgaacgaagtaaaatcatttctggagtattaccaagtgaaagatcatggaaattattagatcaagatattgaaaatttcatcaccaaaatcgataatcatttaaaattacaacataaacaatcattattaccacctaatcgaatgtttggtgatttttgtacgattataaattgtataatgtttcaaactcgagcattaattatgaaaagaataaattcaatattaacatcagttatacaactgtatattgataaacgaaatcatgaattaaatttaaaaattattgaattacaacaattatcaattaataataatttaaaaattattgaatttttcatgaattcaaatccaagttatttaaatgatataatccccattaaatttcctaaaagttgggggaaaaaatgtgtaaattttacaatttgttcaacaacgatataa

SEQ ID NO: 10390 - DNA, 789 bp, Candida albicans
gtatccagagacatttcccaaaccagtgaaagacaccctttattgttaataacaatgctgaagcgaggcattaaggcggacaccccgattgaagtctcagctgcctccctcagagccagaattaataatcaaaatagtcacctcaaagataatgctacacgagtcacaaaacctactcagcaaaaacaaatggtcactcgttcacaaacaaaagcgttacaagcacaattaaacaaccaacttcatgctaatactacagtcaccgagccagatgcacaactggaggaaataccagttgttgacactacaattctggaggaacaatctgttgaacatgtatcagacagtgaagttcaagaggtcgcagacgaatttatccaacaaaatcttttacaagttgcagagcctttactgttacccgtggaaggtcaaacaccaccaccacagcaaagtcaatcaaaccagtcatcacctactattgacacaaatattacacaatcatcagttgaagttccacttcaatacaaagtcgaaaaacgtccccgttcaattagactttcaaaatttagcgttactcacgatcaaatcgatgacatattacaaactattctcaatcaagacttaagttgccacatatcctttgccactttgttaagaatagtacctcgattccgcaaattagtacaaagctcactacaagcacacttaataccgcgtttcggcccaccaaacgccaagctaatcaaaccaatcacagttagtgatctggaaccatatatccctagtgta

SEQ ID NO: 10391 - DNA, 195 bp, Candida albicans
ctcccaaatgataatgattcactattatatctctctttcattctcttgattggactagataaatcagacattccgccgaaacaaaaactggaaaccgctagccgctatcacaaaatattgaaactaatggcgtttatgggattgctaatacattttcaaaaggatcttaattcgaataaacaattgttggattaa

SEQ ID NO: 10392 - DNA, 183 bp, Candida albicans
tcaaatacatcaccgaatacatcttcatcgctagcattatcactgatggaagtcatgtttctaaaatttcatgaatggtcaattttcaaatgttgtaaaaaccttcttgcttcactaaaatttcttagacgattgttcccatattatactgtaacaggtttgacagtttccaacacaatttga

SEQ ID NO: 10393 - DNA, 225 bp, Candida albicans
atttttagctttgatatccaaagtaaagtgacggcaatctggtcaaaaccagaacagcatctaccaaagctagcacctgtaaccaaacccaagacatctattaatgcagcaccaaagttggataggataaaaccatacggccacaacaatggattgtcatggattgagaacagctggtataaaagcatgatccacagtaccaaagtagtcttaaccaatccatag

SEQ ID NO: 10394 - DNA, 249 bp, Candida albicans
tggtcttttttctttaatttaccacctaacttaaagagagccataaattattatccaaattttgaagtgaggggggggtggaggttagttgataaacaaaccggtgaagaaaaatttatattaaaaatttcttctcgtgggaaaaattcacaagaaacaacaaaattgaggagaaaaacaaaaaaatgttggacaattttttttggaagttatacagttgtcaataaggaaagtgggaggtttttttga

SEQ ID NO: 10395 - DNA, 198 bp, Candida albicans
acggagaaatttcgcaagtggacgtctttaatcctttcaaaacccccaactggagtaaagaaagagtcaaaaaaaaagaaatttacagcacaagaacgagaacaaagtgcaacttctatttcttgtcaatacgacgacgaaccaaaagccaataatacaaattcaccatacattaaaatattacaaatattaacctaa

SEQ ID NO: 10396 - DNA, 231 bp, Candida albicans
atttctttttttttgactctttctttactccagttgggggttttgaaaggattaaagacgtccacttgcgaaatttctccgtctaagttcgcagtttcgcctacaaaaagtaaacaacaaactcaagaacaagagaaaaaaaagttacataggtgtttaaaactacagcaatcaaataacaataatttcttcatatataagtatcgatttcatttccattttttttcttaa

SEQ ID NO: 10397 - DNA, 606 bp, Candida albicans
aagatgctgccaacagccgaacaacccatttcaccattagatgagaacccattggatgaaaatgttaataatctgaaactaaaagcttcttctggcaatgacaaggaggatggtagttacaatttgaaagcagtacagcaagatggaaccattgacgataacgatgctttacgaaaactgctggatatagacagaatttttcgatctgtccatagtggaccaattctcccagaacataggtctccttccccaaatactcgtgacgactcatcacaagtaattggtaatcctctttcattttattattccaatgacgataaggagtcccgatatgatgaggatagatcccagggacaactgcttggaaaaagcaagtatccagaagacgaacaacaacttcccaaccgctttaaacttgtggatgatgaagatataaacaaagctccaccgagaaaggagtcgtcaagacctacacattctcgttcggcaactttgagtggttttatgcagtcaagaattttagggagatcaacgtccactaatcaagaaatgccaaatactgagcccgaatttgcaaatttacaggatgccttgcaccctagataa

SEQ ID NO: 10398 - DNA, 216 bp, Candida albicans
gacagcactaagagtggcagatttataaagacattgcgtcgtttcaatagaagaaagactaaagataagcgacaaagcaccatgactgccgagtttgatgagcttaatgacgagtctgaaaatgccactatcgaaagggcagaaaagttactagcaggtatgtccactgggtgctcctgcaatcaatttaatggcctcgtgtctattagaagatga

SEQ ID NO: 10399 - DNA, 192 bp, Candida albicans
atcccacaaggtaatttcaacccaaatgttataaatgttaaaaatactttaacaacaaatgcaaataaaagtgacgccaactcgtttaacaattgtttttctgtctgtggacacaatgaccgatctaattctcctccactacatggtgttgctaagtctaataccaattctgccgaggcttgcttcgtataa

SEQ ID NO: 10400 - DNA, 186 bp, Candida albicans
aaattcaaaacgtgtcaaagaggagttaaaaatgaaacaactttaaaaagtttgactcaaaaaagttggaaaagaaaaagggagatcaaccatcatctggggaaacaatctaaagacaataaaatttggactcttcaacacgaaccaccaacatcgtcattttattcgcgtgtcgtgtctgaatga

SEQ ID NO: 10401 - DNA, 288 bp, Candida albicans
ttcggtgatatcgcttggacgtattcccaaatgtacacaaaaatgtatagtcattctacttacttactactaccaatagaatcaattgtaaaagtcatcatcaccaacaaccaactaaaacaaaccacattgtgcataattcttctttcttcgtcacgtcacgtcacatcacaattaattgtaattcttcttcttgccgttacatggaacaatccggaacaactttttatagttaatgaacaagaaccaccatatagaaatactttgttgtttattacaattgactaa

SEQ ID NO: 10402 - DNA, 231 bp, Candida albicans
ctatgtaagtcactcactagatttttttttgttcaatcggcaataaggaactgttgttggttgagaagaagaagaagaagaagaggtcacttaattcttctatttatcagaacctcatctttatattttaaacaggtaaacagattaattaagattttaagtaaagaaaatttgagcgtattgtatagtatagtgttgtttgagttgttgttatatcttagtcaattgtaa

SEQ ID NO: 10403 - DNA, 189 bp, Candida albicans
aaaggaggctccaaaaaatttgaagctgagttattaaaggtggctgtaattttattaaacgaacaaggttgtatcggtatgcatacatacatattacctaactcgatattagctcgacttaacacctgtcaatcaatttattgtttaacgtacaaagaagtagtagagaagtgcgagaaaaaaaagtaa

SEQ ID NO: 10404 - DNA, 210 bp, Candida albicans
tatcggggagtttttctttttgcacaaaacttaacaattttgtcgatatgtctaaaatgcaactctttaggtagtacttttactatatcccaagtgacaagtcttagtacctataacttgggttacgctctatgttatgctaatttactgaataacgatcgactttgttggagcaaaactcagatgaatactatccatccaaaaaaatag

SEQ ID NO: 10405 - DNA, 516 bp, Candida albicans
ccatcagttttattagtttacacgaaatttcgacttaatttttcaatgtttccaccaataaaattatctttaaattggtggcttatttttgaatatgacttaatcacgactgaccttgccaagaaaacagagagttgtggagtctcttactcattttcgttggaaaatccacttatttcattgttacaattactcatcctattgtataattcaagttatatgacaccacttgacattttcattgaaaatatgtatccaacaattaactactatctatttgccaacttcaactttgaggttgatatttccttatcatgcatgaaaattagtcaatttttttttcacccccacatatcaaaaatcatgtcgtcttctattgtacggcatccaagaaaaaagaagcgccaaaattacagggcgcgatatgccgaaaccaaatttatcatttaccacctgtttagaaagaacaatgaaatggattaccacacttctacaacaatagaagcaccacagtaa

SEQ ID NO: 10406 - DNA, 249 bp, Candida albicans
cggagccaccaatcaatagttctctattttagagatatttatccaagattacacaaagccactccgaactttgtgcatcttagtccgaaactgaacaaaacaatccaaaattctgatgtacggaaaattggtctgagccccacaactgttgataatacatatacttcacttcacttcaccacaccacacccacagtcaatctattctctttttttttaccccaccccacccccacccccacaagagtag

SEQ ID NO: 10407 - DNA, 291 bp, Candida albicans
agaatcattttcaaagaattagataaatcatccttgtacatactgtttattcctccaaaaaaaggatacttgattaaaacaaataacaatttgattggtaagctgataattgcaaatattgcccttaaagaaatcataatgaacagtaatatagaccttgtatatataaatgaacttttaatgatccactattggagaaactctgggtctgtttacattcaaactgaggacaaatgccagttaatttataataaaattacaagacacccattttgctttttctatgcttga

SEQ ID NO: 10408 - DNA, 294 bp, Candida albicans
aaaaggagtaaatgcattgacaaatttgtattcagaacgtatccgtttacggacatcactaggtttccttttatgttgttattgttagaaaaaaagggcgataaatttagtttgctatatggtgaaaaaagacatactgtgacattattggttaaggaattgattagtggtggttggtggtcttttatatttttttttttttgcaatcagaaaactttggttactatattaaataaaatgaggcgtattttaggggtttgtatggagattcacgtcaagttgggacaaacttaa

SEQ ID NO: 10409 - DNA, 630 bp, Candida albicans
caacataaaaggaaacctagtgatgtccgtaaacggatacgttctgaatacaaatttgtcaatgcatttactccttttttattgaatcaacaactgtacgaccaagacgaacaccggcggctattttctcaattgcctaaattacctccacaattaggacaaagtattcttgaattcattgataatgcccctgtatcaataacaacaataacgacacccacaatagaaatatgtcaactgagaaacgatcttggagaaaatatacctgtaaaacctaaatcttcggcccgtaaaaaacctagtttgaaacaggcacatttcaaaattttatctcgtcgttgttgtcgcccccacaaaaatagtaacaccaccagcgccaccaccaccaacaacaacaacgacgatgaagaggacaattatcaaattagaagttcatcatctataccaagtgatgatactgaagaaattcaagttcaattagtgtataataaatccaatactccaaaatatcttggtcaattcattaatgtatatctggataatcgattaaaacgtcaatgtaaatcatgtcctgccatgtatactgatttgaaaggatttaatcgacattatgaaagcaaacatttataa

SEQ ID NO: 10410 - DNA, 186 bp, Candida albicans
tgcaaaaaaagattggcaagaatagagaaatttggagttgaattgggaacagcattggctagagaaattggattagtggataattccttatcaaacaacaaatttaatcatcataaacgtaataataaacgtggattcaagggtaataaaggtagaaaaggcgggtttagaaagaatcgtaattag

SEQ ID NO: 10411 - DNA, 321 bp, Candida albicans
gatcaccgtcaactaattttcatcgccaaccaattttttttttttgctcaacatccacgacagcaatttaaagcagcatcacattttaataacagatttcataatctaatgtcaacactttatcatgcaataatgtatactgatcttaagcactctctgccatttcttaatgccattacaactagtaattacttatcacaagatttcgtaacagagagaaccatcaccaatagaaaaaaacgggaccacaaaacaaaaaattgtttagtaaaaaaaaacttcgcctatttttttcttcttcctttcttttctctttgttag

SEQ ID NO: 10412 - DNA, 405 bp, Candida albicans
ttatttattgatcgaatttcattaacaaaatcaactattggtgtaataaaaaaattagaagaagcaattaaattaattgaatcaaataacaataacaataacactgccactggtagtggtggtggagttcgtgattcaacaaatattaatggattattgaatgaggctaaatcattattatataaacctacaagacgtgcattagagcaaattaaaaatggtgataacaccaataacactgctagtaataatagtactactggtgatgatgtcaatgatggtggtagtaaaataaattcaacaacaactggtggtagcacaactattgatgttgaattacaagatgatagttttaaaccattatcattaaaaactcctcaaacttttaaaatttgggcaccataa

SEQ ID NO: 10413 - DNA, 183 bp, Candida albicans
ggggggagggggatcaattttttatcagttgatttaaatcaattggaattaagacaatatttcctctttaattttcccagaatgataattgagaacatgttcagtttgggtaataataataacgatataatcaattcatttatatatttatatatttatatttataaaacatctttttgttga

SEQ ID NO: 10414 - DNA, 231 bp, Candida albicans
ggtactatgatagaaagtataacaacattgaacgaaaacaataagatttatctatctattgattacaaatttctttcttttgtttttattttgtttaacttatttatttatagatatatcaataatacaaacatatatataataacattatactactccttctcaatctccacccccccccctcttattaccttatggtgcccaaattttaaaagtttgaggagtttttaa

SEQ ID NO: 10415 - DNA, 363 bp, Candida albicans
tacaagctagtttgtattatttttgtttttgaagcttttgtatataaattgttcaatcgaatctggaactgtaaaaaaaaaactaaagagcattttcttctgtcacaagttttcttacaattccatttttttgttctaattcttcttctacagacatattacggtttcaaaaggggttgtagtggaccaggtaccatatcaattactaaaaatagaagaaatcaaataggtatcaagataaaacaaaacgaaagtaagcaaataaatgcccaaagacccacttcttacaacaacaaaactttggcgttgcaaaaattttggactgttttaaattttaattgtttgttatttcacctgatatag

SEQ ID NO: 10416 - DNA, 216 bp, Candida albicans
ctggagctgattcattggcaatggaagcagctggattttcaccaatggataattcctctactttcttttcaacggacatttgtgttggtaattgaaatctataataaaagattaagagttttcggaatgaaaaattataaaggaagaaaaaaatttcaagacgaaaaaaatatgagtgtgtgtgtttgctcacagttatattatggagtgacttaa

SEQ ID NO: 10417 - DNA, 222 bp, Candida albicans
tatcaaaccataacctcatttaaaaaaactaacaagacgctaacggttatatattctgaatctgttttgctctactggtgtttaatagctatttttactgctgtaattgttagtgagtcactactgagcaacaagagaaatcgtaaacagaaaattttattgttacaaagaagagtagcatttggtgagaggggtagtttcttttgctggctcgaatactaa

SEQ ID NO: 10418 - DNA, 198 bp, Candida albicans
caaaagtggagaacaataacattatcaacaagtactttttacattaaaagcttttttttttcaatatcaagttatgtgatgaggagagatgataaactaaaagtggcaccagatccattttgccagaatcaatctattttgggtaaacatttgcacaattttgattatttattatttcaggatttgcaaaaaatatga

SEQ ID NO: 10419 - DNA, 213 bp, Candida albicans
ttgcgccaaacgaataccccgcttgaccctttcgtcagtcccattggagccgtaatcccaaaccaagtttatctctacttagggaacttgttcattagatcaagagtagacctgtttaggttgttggttagtagcattggttcagcagtatactttggtactaatcgtgtaacttacagctttggttcagattgtaaattgagggtacattaa

SEQ ID NO: 10420 - DNA, 246 bp, Candida albicans
  unsure (239): Identity of nucleotide sequences at the above locations are unknown.
ataaatgaaatgcaagacaaaagtggagaagtccgaatcgaaaagaataaatgggcggaacaaaaaacaaggggtaaagaaagcaacagagaaaatatcaatatttgcgagtctgcactaataaattggagtaatgactccctgtttctcatattgatattagggcttgagagaaggagaagatgtacagtaaatcatcataatgttagatatagatgtagggatgttgatgagatttngtgttaa

SEQ ID NO: 10421 - DNA, 213 bp, Candida albicans
  unsure (62): Identity of nucleotide sequences at the above locations are unknown.
tcctctgaaatatgtgtagattgtgtgtgcataattgacgaaagagaattaatgttacggtnatgcacacaaacacaaaaggaatcactcaaacgtttgtcggaaaataaactaacaattggagcggaaaaaaaactgaagttcaaaaccaatactgtaattgcaaaaaaaaatagaataggctcactcacacaacaacagcatgtaatctga

SEQ ID NO: 10422 - DNA, 405 bp, Candida albicans
  unsure (301): Identity of nucleotide sequences at the above locations are unknown.
atatttcaattacccatcctatttaggcaagataaacaaaatactaaaataagaactaaatttaattgcactactaaaaatatattaatatcaagaagaagcctttacgcaaatcttgttttgttaaggataagaagaggcaattgttctcagattacatgctgttgttgtgtgagtgagcctattctatttttttttgcaattacagtattggttttgaacttcagttttttttccgctccaattgttagtttattttccgacaaacgtttgagtgattccttttgtgtttgtgtgcatnaccgtaacattaattctctttcgtcaattatgcacacacaatctacacatatttcagaggattatcctcccaaacgccttattaatatttggactgggttgtag

SEQ ID NO: 10423 - DNA, 192 bp, Candida albicans
catgatgatcgcgtaaggcccaataatgtggttttcgcatacaatcttttaaaacagacaaacaatctagttcttggtgtatatcgagtgttagtggggattattgtaagtgaccaattgaacaacaacgaaataaagaaagagaaaaaaaaaagaattgaaaaaaagcaaaggaaaagagattgtacatag

SEQ ID NO: 10424 - DNA, 183 bp, Candida albicans
ctatgtgtatgtgtatttaaatttaaatttatatctaaaagtaaactgagtgtaataaatgattattatgaaatcaaccccaactccttaccaattcctcccttccccataaaatatgttgaaaaaaaaaaacttaattctacacttgatcttcaccacgggccgccaggaccgccatacggc

SEQ ID NO: 10425 - DNA, 315 bp, Candida albicans
tcaagaactttaggtgtaagagatgttggactgagtgttgatgttaaatcaatgggcacttctgctataagtaaacaaaatttccaagggagacatataaaatttgatgataataaagatggagatgaaaagaaggatgatggaaacaagaatgatttgaagaaatctaaaaataaaaaatcaaatggtactggtagtagtaaatctaatctgaaactgaaactgaaactgaaactgaaactaaacgtcaaggaatctaaaataactaaaccaaaatcaaataaaaaatcatctacaaaaaataagaataaatag

SEQ ID NO: 10426 - DNA, 216 bp, Candida albicans
gcattataccaagcaacaaaagcagtaattaaaccaaacactccaccggcttttttaattgccactttaccagtaaaatcagaaattgccaataataaaaatgtaatacttaaaaagaaaaatattaaaaagaatgccacagtagatttgacggttaaaagcatcaagaaaaatgtgaaaataaaccaaccaattaaaaatatccccacagcataa

SEQ ID NO: 10427 - DNA, 219 bp, Candida albicans
gtttggtctttaccattcgaatgcattttctatacaattgaagaacatctctttgtaatccagatagtcttgccattatggttaagttttgaagtatttgattttttgatttatattattgacaaggattcagatatcaggttggtaaaactatgtacaagtagtatcctggcagaggggttgacggtagggttgttacaccagacaaatttgaaatga

SEQ ID NO: 10428 - DNA, 276 bp, Candida albicans
tataaatcaaaaaatcaaatacttcaaaacttaaccataatggcaagactatctggattacaaagagatgttcttcaattgtatagaaaatgcattcgaatggtaaagaccaaacctaccgatactcacgaacattggagaaatttcattcatgaagaatttgccaaatatcaacatttacccaaaaaacaatttaataccattgaatacttgatccgtaatggacatagaaaactagaaatgtatctgaatccacaactaaaagatattcattaa

SEQ ID NO: 10429 - DNA, 186 bp, Candida albicans
ttaaattcatattctaatcctaatataaacacaaaaaaaaagagagagaaaaaaaatagaagcaaaactaattgtacaaaggatataagaaattcttctttgatgtattattttagtaaagttatcgtaattgaaattttatttttcacaaaagattacaaacttaaaattgccataataggttaa

SEQ ID NO: 10430 - DNA, 195 bp, Candida albicans
atggctccctcatcgtttgatcttgaatttaattcagatttacaaaacaaggataatagccctcaaccttcttcatccaatagactaacagctttagaattcaacagcgaaaacgaaaacgaaagcaaaaacgacaacaacaatagcagcctcccgtcatctctggatacaatagaaatgcaacctttggataaa

SEQ ID NO: 10431 - DNA, 237 bp, Candida albicans
cgtttacagccttgtatcgtcaaattcttatttaactttactcaagatttattctacccaaacgttttggttggcttaaggtcgaatggagacccattccttaatcaaactatcgtaagttgtaccttgttctgtattaaaacgttgatatcagatcatttgaagaagaaagcaagagaatattgtaagttaacctattatggcaattttaagtttgtaatcttttgtgaaaaataa

SEQ ID NO: 10432 - DNA, 189 bp, Candida albicans
tatcaaataacaagtgacaactctccagttagctcctattatttgcatcgaccaaatctagaagatcttactagaacatcgaaagttggagtgaccatttgctatgtcagagtccaaagatcaatcaacagactcaaccggttcacctggtctccaatcacgtggggagcctcaaccgccaagttttag

SEQ ID NO: 10433 - DNA, 552 bp, Candida albicans
  unsure (59): Identity of nucleotide sequences at the above locations are unknown.
agggaggaacgagagaaattaattgctcaaaaatcacatgactcgaattcaactaatantactgaacaagcaacacaaaagactaaaacagaaatcgttggaacagttaagaaaatcatacatttaatatccaatttccgtccttcatctttgggtgatacttcagtgactaatggtttgagtcccgtttcatctaatggatctcaatctaatcaagattttgaattaaagaatgccataagagatattattatgagtttaccacaatcattacaacaacaacaacaactgggcccaccatcaaattcacaagatgatgtgatattcaaatttgcaaaagaatcacttgtgatgattagtaaattaacacaaatattcactgaaaaattggatcaagtagagcattgggtaaatggagatgaagaacaagaacaaaaattacaactgcaactgcaactgccagaaggactagaaaagcaacaagaagatgaaagagaagaagaaaacttagcagctgaaactaaacgaatgaaactagatggtagtgtgtag

SEQ ID NO: 10434 - DNA, 1239 bp, Candida albicans
tacagaccctatttattattgataatgaatagtgacaataaccctacacgggaacctgggttcaaaagaaggaagattgaaccggaaattaggaacaacaatagcccacaacaagcaacatcaaaccctggaagtaacgatcaagttatagaaatattatcagacgaagaaacagcgccaccactacaatcaaccaataccgtcgttcatttggatacagaactggaggactctagtttaagtgatatagactatcgtgatgatgataataacggtgacgcaaacaatgacgtgcaaatcgtaagtgtaaacactgcaaatccaactccattaagtactccactgtcgaatttaaatcacagtggcgttcccacaaacacaagcaccaccaacaacaacaacaacaataacagaaatggtgaggacagggacgaggacgacgatgatttgcaaatattaggagttcgaaatatatatgatccaaataatggacgtctactgacaccagtgggtgatattccatttgttagagaggataatgattatacaattgttgaagacgctccaagaagaaacctaaatccagcaatcgcgagggcaatacggagaatattggatatggaacgtcgatatccattaccatctcaagaacaaattcgacaaattcttatggagaaccgaccatggatgcaagtttctcaatcggaatttcgtgatagaagggtgacctttgataattctgcaggaggaggaggagaagaaggtggtggtggtggtggtgaatcacaaccacgaccacaaaactatcatgaggcactacaagaaagtgcccgtcgtgctctagcagaactagctgcaatgagagaagcagcagaaagagcagagagagaaaattcatccagacaaggagaaaatagttttggatttggaactcctagacgatcatatgtggaattaactgaaaatgaaacatcacagcctgttgcagttccccttcctcgtcaacgatctgtgcattttactgaagaggcactacggagaggaaacggtggaccgacttttagtgagagtcgggatgggaatataattaggagagaaagacgtcaaccagttcgttatacagattccccacagtttcttcataatcttcccctttctgggttgcggttgtccatcgagttcctcctgaatttaccgttccctgggaaatacattcccatgatgtggggatttgccctt

SEQ ID NO: 10435 - DNA, 258 bp, Candida albicans
tggccaaggatgccacttgcacagcataatgcaatattgtttctttcaactgaacaatttcctgtgtttgtaatgttgggtttgcaggaagtcaattcatcaactatagtgtcgattttattgatatcaccattccttaaggcatcaagtaatttcaatctaagtaaggatgcacttagttggggtgaatcattcatgattttagctgtttattctaaagttgttagtgttttatcagtaatttattatggtttttga

SEQ ID NO: 10436 - DNA, 282 bp, Candida albicans
aattttttttatttttctcttcatttttttttctggcaaattttttttccttctacttctacaccattgcctccaatgctttccacaaccatttatcgtcgttcattttctgtcctttcccgatcaagagctaaaagaagttttactccatctgacagttcagtcgaatcagatgaaatcgtaagtgaaaacaacccttggtctcctaccttagaagatgatccagtttacgtacaagaacgcaacaaatttcgtaagacgaaattgccagaacagtatatg

SEQ ID NO: 10437 - DNA, 225 bp, Candida albicans
gtaatttatttaattagtaaaaatacacactatgtaaatgacgtatttactagacaaaaacaagtagaaacatatctcgaaaaaaaggaaaaaaatattgaacattgttgcgtatttgaaatcaaggaaagaaatacaacaacaacaagagtgaccgcgtcaacagcttaccagcctcctaataaaaactttctaaggtcgtctggggtaattttatctttttga

SEQ ID NO: 10438 - DNA, 300 bp, Candida albicans
tcaacaccatacactcataccacaatatactacaaaatgccaagactaaagcgagcattattatcaccaaaattgtttgttaaatctatactattgttcaccatcgtttatacaatatacctatccacttcaaccagtacatcagtgtatctaagcaccactcaatccaaactaaatatatatacaaaccaactatatcaaaagattaatcttcaattcaatcaatggtattataatatcttagtttatgattataatttgtttggtcttcacacaggccggaaggaaggaccaacgtcg

SEQ ID NO: 10439 - DNA, 219 bp, Candida albicans
tacatgtttataaatatatatatatcattctgtttgtcttatattaatttatacaacatccaaattataaagaatccaagcaatatcattcctactatccgagtaagactagcatttctattcataactgttcttaattctccagaagtttgtttaaccagcaccattaaagaattgaaattatcattcaatgaatctagtagggagttttcttgttga

SEQ ID NO: 10440 - DNA, 216 bp, Candida albicans
ccgacgatcgaggtgttgatattattgcctcttttaagtaaatctactaatcaatcactgcagtccgttttaagtaatacaacatcaacaattttagttgaaactcagttcgtctcttctttttttaagggaccgcggaaaggaggggagcggagccagcaatatctagaagtccaatcatatgctaagcataagcacaattgtggtttcatttga

SEQ ID NO: 10441 - DNA, 201 bp, Candida albicans
ttgtttatttcgattctctattataaatcgtgcatgttaaatccgccattggaaccttatcatgatcaactaaccttcttcaacaatagaccagaaacaaggaacttagagttagcattgtcatcttttaggtattcgcgtctttcgtatcatttgactttaaccttttggtaccaaaagttaagtaaagttttcatttag

SEQ ID NO: 10442 - DNA, 207 bp, Candida albicans
tcacataacttcccatactggggacttgttcctacattgtttgatatcaataacaaaaaaaagcactcatacacaaattatgtgctacttgcttccgttgccctttttgattctttttatatatattttttattgtttttacaaaaatttagtcttttttcttcttttttaaccgaatatccccaattattttactttataaagtga

SEQ ID NO: 10443 - DNA, 195 bp, Candida albicans
ctcttgggaggagtaggaaggagttgttgtgatagttcggtggtgggaaaaaacagcggggcagcatctcggatcctaggccaagagagtggaagtggagttgatcaggcgagacagaaggaaagtccaacgaaaaaaagattaagcggtagtagaatccaccatacacttctatttcgccaggcgatacgatag

SEQ ID NO: 10444 - DNA, 183 bp, Candida albicans
gcgtttgttttttttttagttgtctattcagtagttttaccaagcggtcaaataaaaatatatggtgctaataaatcttactctctttgttcatgttttgattttgtattgggtcttccgtgcatgaatggagaaatgacaggcgtgtttacgttagctttgattatttacaattcttggtga

SEQ ID NO: 10445 - DNA, 1302 bp, Candida albicans
ttccatgtgaatataatgcacgaagaaattgatcacactctaacgtcatcttctactactggatctgcgtcatttaataaacgaagcaactttcagtttacttacgattcagagacccatttacttttgctcatccataaatacaaagaggacattttcactagaggcaacatcatcaaaacatgggaaaaagtgttacaagaatttaatgagcgatgtcattctaatatagtgcaaagcaggacaataaaccatcgttttcagatgttaaaaaagaatttggagaaccggttgaaacacgataatcaacttctagatcaagtggtgttgaatgaaaatgaaaaactcttggtcgatatcttggagtacatgtacaaaaatagtcacactgaagtcagcccatattcattaggcggtagtagtaataatagcaatattgccgctaatacacaaattgatagcttatatgctcaacaaaatcctacagccccaatagacaacccgttagctattgccgatatgtcgcaaataagtcccaatacttatgaacacaaattgaatcgggacagagcgcaatatttgatgtcacagggcttcgatcactcaatacaccaccaattccagaatagtatggatttttcgaatacaattcgccaacatcaattagctccgtcgtcagggaactcgctgcttggtgcaaataagaatattgtttctggctatgtaccttctcttgaacaaccagaattaattaatacgtcaaatcaaattggacatccagaagaaacaatgttacagccgcatcctaataatccagcttctagtcatattatctacaaacaaccagaaattaatatgtctacttctgaatcacccaatctacaacacaacagtcaacaccaaccgagacattcaaatagttcaactccaatgggaagcctggcatcaactctgcatcatcaacaacaacagcaactgagccacgacacaaagcaaaattttggtaacaatatctctcctagcattcaatacaataataatactaacaccagaacgattgattttgcttatcgacaggaccagaaccagaaccagaatcagaacccacagcagcatcaatatcaaacccaaccgcagcaagataataccaccgcgtctctactaaaacaattgatcgtttctcaaacccaagttacacattcgattaatgcacttcgcgaggatttactggatttcaaaagagaaacaaatcaaagaatcgacaggttaactagtgactattccttgcaacagaataactga

SEQ ID NO: 10446 - DNA, 195 bp, Candida albicans
aacagatgtttaaaggaataccgtcgttatatatattcctctgaaaaaaaaaagccatatgcatatatatatgtatgtgtgtttaacgtttctggaatgtggttttgtgctactaagagttcaataaatgatatgcggtttgaaccgcattggattagacatgttggtcatagtatttatttttatttttgctga

SEQ ID NO: 10447 - DNA, 861 bp, Candida albicans
tcttacaagttaaaacgatcaagtcgtgtgaagtcgacagaaatacacacacagagaaaaaaaattgaaaggaaaaaaaaaaattccaacaaaaatttttctatttacaaagcagtcgttggacttcaatttccatatcccactgatttttcaaccaaagtacaaacaattatggaatcaccattagctactacattaggtactcgaatgagtgcttatttaatcacatcaaatgatttcaaaaaacaacgacaaaaaatcaataaacaaatcaaaaatttacgtcatgaattgaatttaattaatcatgatagtaaaaaatataaagttgtcaaattcactaaagatcaatatcaatcaaataaaaattatggattaatttatttattattagcagaaagagattttttgtatggattagaaatgaaaaatattttagaaattgatgatattaaactgaaactgaaactgaaactgaacctgaacctgaaactacacaagaattataaaaaattattaattacgaaatttaaacgatcattgatacatgctaaagaattattagatttaactaatgaggaatcaattaatgatattaaagtagaattatttgtttatacggcattaattattggtcaattatcaattgttaaaaaaaattgggaaaaaacccttcatgctttttcaatagctaaatgtggtttagattatttatacaacacacataacaataataataataataataataataatggtgaagatgaaaacaatgatgatgatgaagaagaagctgattcatttaacaaaacattatttaatgaattaattgaaacattagttgatccatcattaaattag

SEQ ID NO: 10448 - DNA, 264 bp, Candida albicans
aaaacagtcttaaatggaaagggcactaagatgaccggttgtgtaaattttactctcgccaatagcttgacgctcgccaactcgttaggattaatagaacagacaagcaacacggtaatagctttggctgccgcacaaagaagaaaaagaagaaaaggaaagaaaaagttgaaaaagatttatggtggtgaaaattttttttatactttttccaatgggcatcacagtaagttgtcacgtgatacgtgctttaacaaaaaataa

SEQ ID NO: 10449 - DNA, 195 bp, Candida albicans
attctacaaatgtgtttagttgttaagttctccactgtatcggctattagagcagtatctgcattattaatactgactcattttcctactacaaccggttcaggcgaaaaaaacacaccaaaccaaaattttattcacctttttttttttctcgctatcgttggtcttcaccgcgcggatggaaggactcatgtc

SEQ ID NO: 10450 - DNA, 279 bp, Candida albicans
aaagtctgtttgttggttaaagtcatgtccaatgaaccatcccttttaacaaatcgaggattggaatcatcttcaggggataaatcatctttggactccccacgacgcacttcaaagtcgattttgaaaggtgccttagcagcaagtgctgttgctactagcgataataacgcaacagaattgagtctcatatatgtggaaaaaaaaaaaaaagaaaagaaatcagatggaaagaatatatctatagcaattgtttgtgaagaaaaaaatcaacactaa

SEQ ID NO: 10451 - DNA, 270 bp, Candida albicans
aacacgtttagaaagtcaattttcagtttcaattctaaaaaattatatttttctttcaagtttcacaataacatatacgtaatgacagagaaagatgaaggaaaacgtcttcaattgagtttagataaacttggtgattgggagaaagagatgagtcaagtggaaagagaagccgagatctatagaatcaaaaagacacaaccaatgtatgccaaaagacgttctatcttgaacgacattccaaatcttcaaccgccgccgcaatcatca

SEQ ID NO: 10452 - DNA, 192 bp, Candida albicans
ttaatatattacagaaaaaaacatatgtttgctgtttcaagcaatcaatggtttagatggctaattgaggttgcaaagaaaaggaaacaaagtgtggtgttgatgatgggttctgaaaattgtcttgaatacaaaaaaaaaaacctaagtcacgtgcaaaaattatcaatgcatactatgcagtacttgtga

SEQ ID NO: 10453 - DNA, 210 bp, Candida albicans
aactttctagcaaagagaaacatcatgggtttatttggtggtacgaaaaagaaagaagtatctagaagcttgtcttcatcgtgttcgtcgaagaactcggcggctttttcaaactttgatgaaaaacaagagtatctaaaacgatgttcatccaaatcaagagataaaaagaaagctcctcagtgtgtaagttttagtataaaaaagtaa

SEQ ID NO: 10454 - DNA, 1836 bp, Candida albicans
  unsure (1782): Identity of nucleotide sequences at the above locations are unknown.
ataatattttgttttcctaatgttaaaccatttacatcaaatttgatgaatattgataataatacttttgatgaattagtttcaagttatttcaccattgatcaaataatcgatagaactgctgatgctaaattgtatatgggtgataacaataaacccattgaattaatgttgatagatcttgctggtaccgggatttataattcattagcaattttatcaattgattataatgatgatgatgatgatgatgctgatgttgatgttgaaatttctcgttcattaatgtatccaccatttagaatcaatgaattatcattattaaatacttctaattcaattatacttaaatatattgattttttatcatcaccaacaacaagaacaaccaccaccaccaccactactactactactactacagaaaacgttataactatccattgtgatgatactgaattaatacaaatatgggtactgaatttatcaaaaattttccccattcaacgtaacaactttactaccactactactactcctggtgatgataaatttttacttgattctcatcattcaagtccaattaatatgactggattaggtattaatgtgatatctgattctgaacttaaacaaaatatgtcatccctagaagaagaagaagaagaaagcattagtactccttcaacaccagaaagaaggacaattccattcagagaattgattgatagtcctacacctacaccacttaaaaaaaataacccatcatcaaatgatgaagaggaagaagaaattaacgaaattgtggataattctggttcaacatctaattcttcaataacaagtaatgacgatgataaccaggtcaacaacaacaacaataaagtcaaattacaatcacaatatgatcgtactgttccattaattaaaaaaacattatcttataatcatcaattagatgaagatgaagataacgatgatgaaaaatattttcaaatcattaatcgaaagaaaatatctgatgaattttcttgtcatgatgatcaaattgaaaatagaccaaaatcatctcgtggtgaagttttaacctataatgaaaatgataatgaaccatcacctataggtagtgaacaaccatcagatagtggtgaagaagacgaagatttaatatcaactaaagaaattcaattgattgaaccaaatgttccatatcataaaccatctttagctaattctgctcctgaattgaatttgaaatcaaaacaaactccagtggaacagaatactactactaccactaccaccaccaccaccaaattgtatcaactttctactggttcagcagttgatattaataattttggtaaaaattataaaccatcatttattcaacctattcataataatgattccatgaattcattgatatcatctaataaaagtaataaacaaaaattaaagaaaagaagatcattttttgatttatttaaaagatcatctaagttgaatcttattgatgatactccaggttttgaaaatattccaactatcactacaacaacagctactaccactactactaataaacctgaaaagcatgaaactatcagtcgtactgttatagaagaagaagaaaatgctgattctaaaccaattagtaaacctagttctgcattacctagtccatttgctttaccttcatctacttcaacttattttttcaaacaatataaagaaaatggatcttcatcaattagtttaaataaaactcgtgcaacaatntcattagtatcaccaccagaacaacaacaacaactaataatagaagaagatgaa

SEQ ID NO: 10455 - DNA, 186 bp, Candida albicans
aatggaatggaatggaatggaattagatggatggggggggcgggggggggaggtatattgagtaaatcaattaagaaaaagaaagtaattataaaattgttgaaaaataaaaatgaagataaaaatgaaaatagacataacaaaaggaaatatattatattgaccaggcggctggaagtacggcat

SEQ ID NO: 10456 - DNA, 237 bp, Candida albicans
gcttgttgtggctgttgttgtactgttgttgcacctccaaataatcctcccgtcgaagtggaattagaggttgcgttggcatttgtcttggctccaaataacccacctgtcgatgctgcaccacctccaaacaagccacctccaacattagaagtttgttgttggccaccaaataacccaccacccagtgaagcagttgttccaggtttggctccaaataagccgccccctaattga

SEQ ID NO: 10457 - DNA, 246 bp, Candida albicans
aaagaagcaacttcttgtagagaaaaaaaaatggaacttttgacgaccacgatgaaggctgcaaagaaagtagactcattaaaatatcttacttttcgtgacaccttattttgttcattgatacatttctgcttatttactcactgttgtaactctgaaactttaaggcattgtagttctaggaaggtatattggcattatgctcaacactggtcagtagatggtggtagccagacaatagattaa

SEQ ID NO: 10458 - DNA, 900 bp, Candida albicans
ccagaaaaagacacggaaaattttaaagagaccaaaattagacccagaagtggccatgcacaatttttgcaaagctacagcaaaatcatcagcattgataatacaactagtggaaaattacatcatactatacgcattaccagcgggagagctgagctgcatggtctaacacatacatgttttatgggaacattgatcattggattatcactcttgtacctcgaggataacggatatactttgaaggatggatattcatcatgcaaacaaatgagctatttgaattcagctaaaaagatttttgaatactacagccaaacaaatccaatatcatctagattttataatattgtcgaacaaatgcagcttgcgttaatgaataaatttaatcttgatatggatggcaatagaataaatataaagaagcaaccacaacagaaacatgaaaatggggccagttcaacaactacaaatgaaacaaccattcctactgaaagctttggcgttggaactacagatattccatttaacgaagattatgacaattttattgacaattttggtaacttgttgccaacaaccaccaatcagcaacattcgacaaacaataacatgccattctttatgacagcacaaccatatcagaatactcccagcgcgtattcaaatgtctcagaagagcttgggaatcaccaacagcaacaagcttacccacaacaatcctcacaattaccggaccatgtacaacaaaaccaatatttatctcagtttctgcctactctagactccaacaatctagtttctggtcatacctcattggggtctaaaaatcaatctgaatctttagatgcttttatgtataatgttggtttgaacgatatattatataacaccaaatag

SEQ ID NO: 10459 - DNA, 183 bp, Candida albicans
tatttaaaacacatcttttgtttttttttttattcttcttctacttccaatctgtcattctgttctgttgcagagacaagaaaaaaaactacagaggtagaaacagaaaattctcacagttctaacaaaaagataaaattgcaaaacatcgcaaggcattttaattgtttgtattatcaataa

SEQ ID NO: 10460 - DNA, 201 bp, Candida albicans
atgttaaagcttacttttgggtgcaaatatagtaaaaggaatctgtttgttgttttaaaaactattacagaaaaaactaacgaaaatataaaaaaacacaatgaagaactgaaatacatcatcatcaaattaatctttctttttttttttactttaaaggtggcaagacgttgtcaacaaagtatgagtgtcctgaagtga

SEQ ID NO: 10461 - DNA, 207 bp, Candida albicans
caacgtcttgccacctttaaagtaaaaaaaaaaagaaagattaatttgatgatgatgtatttcagttcttcattgtgtttttttatattttcgttagttttttctgtaatagtttttaaaacaacaaacagattccttttactatatttgcacccaaaagtaagctttaacatttatgatgaacaaagatctgcattattcgtgtag

SEQ ID NO: 10462 - DNA, 210 bp, Candida albicans
tcatattatcaacaaggtcctcctcctccacaaggtggttactatcatcaaggtcctccaccacaacaatattatcaacaaccacaaccaatgtacgttcaacaacaaccacaaaaaagcagtggtggatgttgttcagccttttgtggtacttgttgtgctatcttatgttgttgctgtgctgaagattgtgccgaagctatttgttaa

SEQ ID NO: 10463 - DNA, 387 bp, Candida albicans
attaggttttcttttttgtttctaagtattcatttaggaaacaacataacaaaatattcagtgtcatcaattatgattacaactacaacaactacagcaacatcacagattggtgatttgaatgaaataccgaacttgaaaccaccaagagaaacatttgttgatcaaccgaaaagtccggaggatgttaatttagaagaattaatttatgatttacaaaatggtaccaaaaacgtcaataacttgcatttataccattcaatatttattttatccaaaacattacaatttattgttaaattactggaacatcctaatttgtataatgaatttagatggcaacaattgaatagattggggatcaatgaagatgatcttatggaataa

SEQ ID NO: 10464 - DNA, 552 bp, Candida albicans
gaaccgggaaacattaatgagaataacgaaaggaatgataatgctagtagcacgttatttcaaccacaaccactgcatatgaccaaagatactgattttgccaatgaaatgagtaatattcgatcaaatacgccgtcattatccccgccaccattgaaaatggccaaatttcataaaaactcgatcattaatgataacaagtattatgatgaacttgaaacatctatagaggcaaggattgttgatgatgttgaagttgatcgagatagttctataagatcacctgatgatatctcaaccctaaatataccttcacctacaaatgagtttgaatctgtaattgatgaaaatatcgatgacattaaatattttagtgataataataataacgacaacaacaacaataatgatgaaccacctccatatatccccattgaacaattagttgaatcaacaaccattacaaatcaaacatataatgatgaacaaatcaatgaaatttatatcaataagttaaaattcttcaccacggggctggaaggtccgcgattg

SEQ ID NO: 10465 - DNA, 192 bp, Candida albicans
accagactgttgaaaaaaatgacttttttacggagatttgaatttactctccctgtgaataatttagttactccaaaatgtgtgttaggtaagtggtacgttccacagattataaagttcgggagaattttcaatgtttctttccctcctttttccttggatttgtttctgttcaattttacccattgttga

SEQ ID NO: 10466 - DNA, 219 bp, Candida albicans
aagaatgtattaccttttgttttttgtttttttaactatgccaacatcatcatacttttttgcactttcaaaattagaagctacaatgtttacgcaaaatccatagcaatcaaaaatttctttgtacaaatgtccacattcattgtgtctagaaagggaaaagaaaaaaaactagaacaaattaaattatacagatgcatgcacataccaaatgaataa

SEQ ID NO: 10467 - DNA, 216 bp, Candida albicans
gatactttggtatcagaatttaagggtaaatcagataaagtgcgttttgcagaaacatgccataacacaaataatacacaacatgatggtaagaatctttccatcgccaccgataacaagcgaggaaagtctgtagccctattagggttaacatctactggcggatcagttgccaaacatatagtccaaaagcctacgacacttattgtccaataa

SEQ ID NO: 10468 - DNA, 219 bp, Candida albicans
atagatccacttggatgcaaacttggcttaaacagagaggaaaccaatgatggacggccacggccacggccaccactttttaacttgcaaatggcaccagattttgagtttggcttcgttacctgtagtgacgatgacgatgatgatcccacaatgcgcttgccaaagctacctgctttaaatttttgcaagttgctcaatacaaaatcagctcgttga

SEQ ID NO: 10469 - DNA, 405 bp, Candida albicans
  unsure (219): Identity of nucleotide sequences at the above locations are unknown.
attcattccgtcacatttttaggtctattacgagatgttattcccaatgccaatatccgagttctcaagctgcataatttgcaagagtttataattggaagatacaatttgccacgaaccgaagaaatggagagatattatcaattagaattgaaagaaaagggtcgaggagagaaattccataattataggtatccacgggatgttgcatattgtcanatgttacagactcttattgatgaacaaggtttgcatacccctgggctagtggcacctatttgggatgaatctttgattaaaaagagaagtgaaactagagctgagaaaaacgcacgattaaagaatgtggttgagcatgttaaacgtttaagagcagaaggaaaagacttttctttgttagagtag

SEQ ID NO: 10470 - DNA, 198 bp, Candida albicans
attggatatgcccgcggcctagtatggaccattttgttgattgagttgaaacccccccccccccacaatggaatattattaaggcgaaggtcagcatcattaaggcgtgaacttactagaaatagttgttactctgattgttccgatggtagtagacagcctatctatctaacatataaactttttttgattgattga

SEQ ID NO: 10471 - DNA, 969 bp, Candida albicans
aacaagtatattataatgcctgcatctacgtttaccataacttccacaaaaccaatatccccacgaccaacaagtataaagacagccaccactaccactactacaactgccactacaactatcacacctgatctttattacaatagtctcacaccaacaccaagatttacaccattcagtctagaacaatttggatttgaagaatatgatgaaaatgaaagtatagtatctgatgttgatttattattactagaacaacaagattttattcctagtacacagccacctcatcaaccacatacatcaaaatatcatactattgtcaatacaatttcaccacacaagatactatcgcaatattttgctaccgaattattttatgccaataatttacttcaaatttccaatcatttcatcaatcgagaatttgattcatttaataatgatttaattttaaatcctaatatccctaaaaccaatcatttagaattgatcaatcaattaaccataatgtataatgaaaccatgaaattggttgaaactattgaacaatttaatcaggaattagatgatataattgttgataattatacgattcataatttacaaaatttaaaaatgagttataatgaaaaattggatattcatttgaatgtccccgttcatgaaattgttgataagataattgatggattatatcaatataatttaactgtggaagatttattagaagatgaacaagaaaaagaaaaagaaaaagaagtagtagaagtagaagaagaattaagcaatgaggataaaaaatcaattgataaaattaaaacttatcacgataaaattttgtcaatattgaatttacaagatgaaaaatttacaattgaaaaagttgaaaaatttcataatatattgcaatatgaaattattgaaaataaagaatggcaatcagttgttaaattgtgtccattataa

SEQ ID NO: 10472 - DNA, 228 bp, Candida albicans
ttacgaaaagttgttgtaacccccgttttcttaattctcaattatcttctcattactcataatcattcattcaatatatgcaaatataacaatctatatatacatatatatatatatatatatgctttgtccgatttgacgacaagaattatcccttataatggacacaatttaacaactgattgccattctttattttcaataatttcatattgcaatatattatga

SEQ ID NO: 10473 - DNA, 225 bp, Candida albicans
caaacgtttgagccatatattacttgttttatatttatttttcttgacccatggggacaggctaacccagacgaaaaagacgtgcaggagaaagaagatagacgcagtggggggggggggggtgaaaggaaaaaaaaaaatgacaaaggacacgaaaaaaaaaaaggcggagggaagggaggggaagaagaacacaacaagattgagactaagttcgtaatttaa

SEQ ID NO: 10474 - DNA, 291 bp, Candida albicans
tcgctaaatacaaaatttcccagattgtatcttcccgatgaacatgcaaggcaagttatcatagtcaccacaaatccaataagtgagatccaaaggccagatgtaacgatatgcggcaagtacctaccccaaatattaaaaactgaaagtgccaagtttatcgcttcaaaggtaacaaatgagtgccatcttttgatttcaaatgatgggttgttgagcacgtacagagaaagaattgagtttgcgagggaagaactgaccgacgcacaggtgaaaacgcatccaaagtaa

SEQ ID NO: 10475 - DNA, 318 bp, Candida albicans
ataataatgattgcaccacctgaaccaatacttgtaccgaaagaagccgagactcctacccaagaacaagtcaatgagaaactgacagcgaaaagtgaccaccacccaaaattcttttctaatgatggttcagcttgcgactctttactgtcaacgctatgttccaaactttcagctttgttttcatacttggtatccattttcaaattaatgagagaaaagaaaattgaaagagaagttaaaaaaatcttactcaaggaggtttatataagttttgaactcatgcaaaatgcatggctcagttcggctaatacatag

SEQ ID NO: 10476 - DNA, 240 bp, Candida albicans
ctaattgataaaaaatcaaaacaaatgagacagagagacaaacccataagaaaatttaaaacctttgaaagaaaaatctctgcacaaaaaaaaaccccttcaactaattacaacctactcttactcttcctaatagtctttttccaattgagttttataaaagtattgaaatcaaaaagttcatttagtcattcctttattcattcattcattcatttatacttgtatatcatattttaa

SEQ ID NO: 10477 - DNA, 960 bp, Candida albicans
actatgaatggtagttcaaataatgataacgaagttatagttctaacgcaagatattacctatcctccagttacgccaagtaaacaacaaccgttgtcgaataataattcaccaacacctagcttcaagtctcctaaacggaacaacacattatctccattacggaaaaaacaacaacaacaacaacaacaatcaaaatcggtagcattgtcgtcatcatcgtcgtctagagagaatatatcgagaagtaatacatcttcaacttctgcactatctcaaggtcatcaagtttctgaagaagagtttaaatcactacaaagaagttttgctgattcattgttgaatttaaataatcttgaaaatgagaatcaaagattacaacatgacttgactattaaaaatactcaattagagaatcaacttgaacgaattaaatttctagagcaaagcatgaaagaagcagagatggaaaccctacagaatcaagatattcttaataaacaagttgagatgtataaggagatgattgataaattacaaacgaaaatagttgaattgaatgaagagttggaaaagaaactgccacttgaaactattgatgctctgttgtttaaaaaatatgaaaaattggttcgtgattataaaatactcgatagtcaatttgaagtagaaagaaattccaaattggttttgattgatcaaattgaatttcttctgcgcaaaaatgaagagttgataaagcaaattggagttcccattgaagacagtgataatgaaagtgatgctaatgttgattatttagctgatcttactgataatgtgacccatacaatgaatgagttgactgatgatgaacatgagcaagaacaagaagcatcagttatttctcctggactaaatatttatcatggaattgcctatcaatcgtcttcacacacgccgctgcaaggtccatcgcta

SEQ ID NO: 10478 - DNA, 237 bp, Candida albicans
ggggacgtatgcaatgcatcgacgcaaaagtactactcctttttttttttgcttcgcttgcctcgcctgacaaacctagttaaaggtggatacatttgtatggttttaaacttctctagattggaaccaaaaagcttaaaaaatacagcagcaagaacaatgaaccctgcacttttgatgcatacatatttcacctcatcaaaatggacaggaatgaaatttgtagaccacgactaa

SEQ ID NO: 10479 - DNA, 231 bp, Candida albicans
tttgattatggttcacagaacattagagctcagttctactccttattgaaggccctaaagttttctcttaattcaaaagctttattttgtgaatctggtctgcaaagatcagttaaagctctttttttagtactgttgttgttagtcagcagatacaaaatgtacgagaaaagagtattagctagtgttgctttttttagattctacattcactggtgtctacatttgtaa

SEQ ID NO: 10480 - DNA, 297 bp, Candida albicans
aaaaaaaatcaggccactttttttctttttgaaagttttattgtgatcttaatgttatttaatcatctttgcgtcaacaatccttttccccttctcttgctttccctcttcctccttcaatcaaacaataacaatgtttgtagtagcagtagtaatagtcgttgtcgtgtttgtttttgcttagttgggataagctttcctagtcagcttgagtgtctttgtttgtcttgtttggcttctacatcttattattcaaagaatttaattgtgcctaacaacaccaacactgaaggctag

SEQ ID NO: 10481 - DNA, 318 bp, Candida albicans
  unsure (300): Identity of nucleotide sequences at the above locations are unknown.
acagtttcatcaataacaccatcaattatcaagttgttgtcgttgttgttgttttcattttcgtcattattaataaattggtcagaaatatcatccatgataacttcttgggctaattcttcacccaagttgaaccaatttttccaaaatccaaaagaagttggtaatgcattgattgatacaattattgataaagaagtagttaaagttaaaaatttcatcttctttttgaaaaaagttcagagctttttttttaaactaaaggaaaatgataagataaataaaatagatgttggtganagatataaagatttaatt

SEQ ID NO: 10482 - DNA, 192 bp, Candida albicans
caaaaaattagaggaaagctggccacttatttaggtgcagaggggaataggaaaattaacgaccagaatcgtcaacgtgataatatatatatagatagattggcatggcatttgataaagcagatgttctataatgtttcccagcctccaggatccaatacgctttctaaacttcttactatacaattttga

SEQ ID NO: 10483 - DNA, 708 bp, Candida albicans
ttttcaatgaatagtgatatcgatatccataacaacaattctaccaattttttcaatttgaatatcaaaaaaatcattggtacttcagctaaaaaccctcatcaattctttatacaagatgatttaatagcttatactgccagtggaggagttgttgtttgtaccattgatattgaaactaatgaagtaatagctcaacgattcttttgtgccaatattagttataccaaccacagtaaccacaacagcaacaataacaataacaacaatggtttgaagaaaagaagatcaataataggaagtggtacttcttcagctaatgcatatttaaatatgattaaaagttatgattattcagaaaaagaattgaaacgagatttatatggttatccgattaattcagaaccaatggaaatttttggtacttcaattgaaaattttgatgataattatactagcaacaacaatgatgttaatggtagtactaataatggcaccagtggtaatatatcaccatcgaaattaaaagataaagttagatcaatcaattgtattactatatcatcagataaaaaattattggccattggagaaattggttatcaaccaagaatattaattttttcattagcagcaaattccagtgataatcctatttggtcaatttatgaacattcatttggaataacttttcacacaagcctctag

SEQ ID NO: 10484 - DNA, 267 bp, Candida albicans
agacatttggatttggtatcaaatgattctgaaacacaattgcataacgataaagaatatgaaattgatttagaagcccttcgtgaaaaattaaagaaaactactgttgagccaaagattaaggataaggaagcaaagtcaaagaaaaaactgaaaaaactgaaaaagacctcagaagaaggtaaatcaacgacaacagaatccaatggtgttgaaccattgaaaccaaaaaaagtaaaaaagaagaaagcaatcatattagaataa

SEQ ID NO: 10485 - DNA, 255 bp, Candida albicans
atagatttgttcaaagacattacaattgaatccaaagcacatgctgcatatcaaagaagtataaatgaacaacttaataggcaaactggctcaatttctagacatgtaaattctatgagcaccacctttaattcccatacaaaaacggccttttttgttgtagcatctccaatcattcgcctacctcaatcaccatctgtgcgtataataaacatttgtcttggcttcaaaacggtattagtttggtctttgtaa

SEQ ID NO: 10486 - DNA, 192 bp, Candida albicans
cgctacaaaaatcaaactagtgccgatttatacctttttcttatgagtgctaaccatgcaagaactgttagaaacgaaatacaactgctatctgtggaacaaaaaaggccgttttggccatacttaagaatcactcgtatttttattttgactactgctcgaccaatagaggcgttacaaagaccaaactaa

SEQ ID NO: 10487 - DNA, 762 bp, Candida albicans
ttctttctatttatttcttgtatcatcattaaccacaactacatatatccatatatatcacaacaaatgctgacaacaaagtttaatagcatttctcctattgaattattggaaataatatcttcctatgatatccaggatgaaattaaattgtcacatatacaaaatttgaaaactcatattaagaaagataccattgatttaagaaatgtaccaatttatttacaaataattactaaaggattggagattactcgtttaaatatttcttctgtcagttttaattcgctttcttaccttatcaagagaataagtgttcaagataaatcaggtaacattttaaaagaagaatgctttttaattttaccaattttaatcaacaaattaggaaatgcatcatcaccagctggcaccaacctggccaagaaatcactagaagactattggttatcgagtcctattgaagtcgaggatgcattgacggagattgcttttgaaaacccaaatactaaaattaccattgaaaccatcgattggatgacccaaattttgaaaaatataagtgccaaattcaatgtaccgaaattcttaccaaagattttgcactcaattgaaattaatccccataatgaggagattattgtttctactaaagagttactttctatttaccttgaaaaaaatccatccgctatagaagggttcaaaaagcaaatagaatcacacctgttagcacaagcaaccaaagacaaacttttaggt

SEQ ID NO: 10488 - DNA, 186 bp, Candida albicans
acgtgtatattcttgcggttgataataactcgttgcccattgatgattgttgataattgtaagtctatatgtttgattatcggaaaattgacaaatgcaaaaaaaaaaaagaaaaataaaaagaaaacccgagaagaacgctctagaaaaaatagtaaaataacccccgccccgaacaactggtga

SEQ ID NO: 10489 - DNA, 195 bp, Candida albicans
agagtgagtgagagagccacgcacaaggaaaaaaaaaaatctggactgttaaggaaaaggtcgtgtattacgttacaagccgagttcatagcaaaggtgaataatgtgatgatgttgtattctaaagcctacactagttggaatcaaataataaagccaagttgggccctcatttataagcagacactcaactga

SEQ ID NO: 10490 - DNA, 207 bp, Candida albicans
attaggcccaggataattaaccgagatggtaccctcaaatttcaaaccagtgttcaacttgtggaattatacaaaaatctattaaagaatgacgaagtgaccataacagaggaattggcaaatgctgcttattttaacggaatgagtgaattagagggtattatagaaaaagataaacagatgtttgaagatactctcaatagttga

SEQ ID NO: 10491 - DNA, 642 bp, Candida albicans
accactaattccccaaaaattttatattctggtattcaactatttaatcatcaatattgtgcaattaccaccatggaagaaacaattgatagaattccaaaattgaaaaagaacatcactgagttgcgaccagagattgttgacaagatggaaagaagagctaacctaagtatactggacacttttgcatctagtaacatatattcaggaaccattacttctgctaaatcaatcaatgtcgtacgttttattgatcaaagtaagggcaacgattcattccgcgatggcaacgttttttgcaaccaagtagaagttttcaaatcaacaattcaaaatggtttgcgttcaatatgtgaatgtttgaaaataaatccagatgcacatatctcagaacaagaagttgtttgtgttattataagtggtattaaagctttacagttgaaatattctctggaacttaaaaccaatactcaattgaaaaatgataatgaaacattgataattgctgtgaacaaccaaaaagctgatgcggaacatattgccaatgaaaataaagaaattaaaagacaaaaccatgatatatataaaactgtcacaatgttggatcgggatattcaccaggcggctggaaggaaccacgct

SEQ ID NO: 10492 - DNA, 627 bp, Candida albicans
ggttttttttggggggggggttttccaagttgggcaggaacagcattagttgcaggattagtgtttttgatctgctggtatagaagaaagaagcaagatgaatacgatgacgacgttgatgatcaatttacactttctggacctaaacaagaaatggaacaacatccatattcaacgataggtggtggcggcgctggtggcggtggaggagcagcaatgttggatcctaatccatttttaattgctggtggctataataattttgatacatctcaacaacaaaccccacgacaacaaattatatcaaatggaactgtcaccggatcaggcggttatggacacaatcataaaataagttctagtggaaccagtggtgatggcaatcactcatttggatctcaaactgataccgaatttgcattctatgattatagcaactccaacaataacaacaataacaataataccactagccccaatatcaataacaacaataacaatgctaataatggacttttgcatacagattcgccgaatccagaatttggtagacgaagattgagtaatggatcattacctgatatgattgctcgaaatcctggatctttgaaagtggtcaataattga

SEQ ID NO: 10493 - DNA, 231 bp, Candida albicans
ccgattattaagagttttttttgtttacccgtttccatagcacaaaatcaaagaccacaaaacaaaagaaatgccacaatcacgattttaaattctgtttccagtttgtttgcttgtttttctacctgtgcttcttcttctctattgacacgacttccttcttctttattgattcactcagccactacagccaccaccactatcaccatagcgactaccgccaaacattga

SEQ ID NO: 10494 - DNA, 234 bp, Candida albicans
cgtagaatgttccaaactgacctcttaaacctcaaatttttaaaaagaaaaagtatcaaagaaaagttttctggtgaaaatttttcactgctcgtcgttgacaacatcagaagatttctgctagaattgtcgtgtaaaatgctcactattttactccacagcgaacaaatgattgatatcttgaacaattatcataaattgataaatacttctgaaatcagaatcactgactaa

SEQ ID NO: 10495 - DNA, 204 bp, Candida albicans
tttatcacgtgcgtagaatataatttattggaacaccaaaggagtgaaattagtgggaaagagagaaagaaagaaaggggggggagtgtaggcgggcaagaagggaagaagttggaaggaaagaaaaaacaaatgaggcgatatttggcaggaaagaaaacaaaaatatggaagtggaatacgccgagaaaaaaaaaagaatag

SEQ ID NO: 10496 - DNA, 279 bp, Candida albicans
aacagattgattctattgttcttctttttgatattacacaattttcaattccatcattctaaactgataaacccaatacttatttgtttcccccctttttttttgtttgtttttggcctttccccaattttgtgggaaatagattgttatatatatatacatacatatattaatcaattggaaattcctcctataaacttttccagttttccaatttttcatattaactatctgtctattattttaataatagcttggaatttttgttattttgattaa

SEQ ID NO: 10497 - DNA, 1023 bp, Candida albicans
ctctcaagagtccacgtctccaggagaaggccgattcaatttccactcaagttgcccaaacccgaaccaaaaccaaaactagaaccaaaactgaagccagtttcgaaacgtgtatcaccacctgttgccaaatcagcaacatcctcaaaacaatacaaaacaatcaaaccaaatgttcaaaagggaaatactccgccaacgagaacagctatttcaactgaccaggttaaaaaatttcaaaccaattttcatttaaacccagtcaccaatcaaacctcaccaagcaaaacatcaatcacatctattatcaatattgatgatgaaccgatacctgcaccggtatctacaccaacttcagcaaacaacagtcccgggaataccaatacgaatgcaacgaaaagaaagagagcaaatgttaaattatttgatcccaaaaaacgtcaagcagtatcttctatcacaacgggagaaactacagcaaccaccaaaaagaaaagtcccgagaggcaggataggtctgctagtcaagtaaaacttgcccagaaatcttcttctactacaacgggaggtctacaaaaatcacctttgctagagaagaaagcagataaaactgcttcgggaaattcatcgagcctaaagaaacagctgtcgagtttaggtgctataactgataaaaatgattctccagttcccgttaagttgtctgctccatcagtaatagatctattgaacgatgattccgagccagaaacatctcaaaccgatgacaaacaatcagcgcaagggaataacaacgataaaaaaatagagggtaacaaagaaccaaaacaagaagaaactcaaatttctaaaaaagaggaaaagccaactcccagagaaaaggagaaggagaaggagaagccagaaccaccaataattgcattaaatattccattattgaatcctaaagatccacaacctggtaaagctgaagtaatagtgaatgttcttaaacttgccgaagaaaaatacgctgggggataa

SEQ ID NO: 10498 - DNA, 195 bp, Candida albicans
gagatgatagcttatgtctttcgcaagttaatttctgttttatttttctgttgttcagacatgcacgcactcccctcatccccaaaccaatcaattgaacagcttaccttatgtgcagtaaaaaacgatgttaaaaaaaattcaagtttaaaaaagagagaagaaaacaatatgcaacaaccaataccaatttga

SEQ ID NO: 10499 - DNA, 414 bp, Candida albicans
agacctgggatagtgaatcaattgcaaataccactaacaacacaattaggtgtaacctgcagcaaattcataaaaccaccatcaccaaattccaactacacaagcttacttaagcaaactcagcagcatttccaatttgaactacttttgtttagtaaaagtggcatagaaatgctattgttgtttttttattttgttgcacatcaggtaggcttagaagaattagttgaaatttgttgtaaaacaggatctgcgatattttatgtgcagtccgttcaaattcaattcagagagttcgacgaatcctttatcattgctattctattattctctgttctctattacttttcttataacaactatcagacttttactattattattatatacagatcattagcctcgaatctatag

SEQ ID NO: 10500 - DNA, 201 bp, Candida albicans
  unsure (34): Identity of nucleotide sequences at the above locations are unknown.
caaaacctaaacgagagagattcccgcaaaaaanaaagaaaggactatgctaataacgtgatgcaattattattacactatatactgctcccaaacaatttttataatttaccaaaaacccaccaaattcattatcacctatatactcgtagaataataaagagatctaaacttgctaccttgcttaccactcatctgtaa

SEQ ID NO: 10501 - DNA, 207 bp, Candida albicans
attatctttacaattgcatcaaatgcatttttggacaacgagccgtctctattgaaaactgatgtggcagtgttatttgttgctgttgctgttgtagaagtgttggaaacggatgtggtgttggctgttgttgtcgatgataatgacgaaggcagtaattgggatacaccattgttatctgattgtgtattggagctccccgcttga

SEQ ID NO: 10502 - DNA, 375 bp, Candida albicans
cctacctgtcattttttattattaaatcatttacttgtttttttttgttgtttccattgtacattaatatccatactcattactacaatggctgattcaacttttgatgagttctttgacaatgatttgtattcagctccaacttcaatcaataattctaagaatcatgttaaaaatgttagaaattcaattcaaatcaaacattcaaagtcatcaaggtcgttaaatgaattcacaaaagatataccaccttcggcaaccaccagtaattcaactaccaaatctaatacacagacgaacccttcttctttcaaaagtccgaggaatacatcccgtagtatcttcactacagagagacaggatccgcgcatagta

SEQ ID NO: 10503 - DNA, 627 bp, Candida albicans
attaccaagaacaagttggcagtcgatacctgtctattaaggcagaagcccgatgaaaagtatgattctattgcaaaggagggtactcagcaatacgatacagctgtgcagaatgctcaagaacaatacaagcaggcacaagaacatgtatctaaatttgccgatgacgttgggtctcaggctactcaaactcataaaaaacttgaaaaggattatgtgacttataaatccaagatcttttctttccttactaacgtctaccgtggtataatgtatcgtctttcgatattcaatagcaatgcctatgatgctgcaaaatcgacaggagacgtaataaataatcagtggaatagcgttgttcgtacttactccaacgccgatttgaaagcctatctcagatcatttggttatagctacgattggttgtcagctttaaacagacgtgaattgttgagtttggcaactttccaaaacaaattattcagtggatatgacaacttgcaaaactgggaaaaatctgttggtgaagttttaaatgatgctagtgatgaattgaaaattaaattgggattgaaaaaagaacccaaaagcttgattgcaaaattgaagtctgtagttggtttttag

SEQ ID NO: 10504 - DNA, 231 bp, Candida albicans
agagtggtgaaagttatacaagaattggaattgttggagaaattacacgaacataatgagatatcattcaataagtttgaaaaagttgttgattattgtaaagacaagttagaacaacatgaattaatcatgaataataacgaagccggctctggtgttacatcgtcaataagtgacttgatcactgtggattattctaaatactctatagccaatacaacttctatatag

SEQ ID NO: 10505 - DNA, 216 bp, Candida albicans
cacaaaaaccaaaaaaaaaaatggaaaaatagcgcagcacaccaagaagtagaaaaaagcccacaacaacaactttggcgtacagaaataaaagcaaactcttatgaccactatacactctttttctgttctttgtcttttcaagattataccaagagatctgaattcagtttaaatattcttcaaaatctattccaaggaggggattactactaa

SEQ ID NO: 10506 - DNA, 237 bp, Candida albicans
aggttagtaattgaaaaattttcaattagggttttcccagccgaatggaaattaaaattttgggattatcaattcagggaaaccaggatttgtaaagggttaattgaagggaataccatattcaaaatttttttaaaaaattcaatggaatattcgggattcaaaaccccattaattaattaccattggaattcccattatggacataaacattctcttgggaaatggatcttgtaa

SEQ ID NO: 10507 - DNA, 1062 bp, Candida albicans
ttgaaaagacaatgtattgggttcaataatgataaacagatcattgttacggcatgggactcattaagcaatgatatcaatgtttattgtattgaaatcaattggggtttccttgttgaatctgccaagagacaaaaattagatcaacattatcatactccaaaggaagcacaaaaaccacctcgattgactttaaagaaattgcaccaaatgaaaccaatccaatgttttaaagaagaagatggtgaatcgcaatcacaactggtggtgcctgaaatggggaaattaaaagttgaagaactttcttcaattgatattatatcgagtaatcctgatcccaaatcgggtttaagtatcttgattacatatgggtcatctatcatatatcgatatgcattagaaaagtccgattcatctaataccactagtggtggtgaaacgtcgaaaaatcctatatcacaagcattttataatttaggagtagaaaagaaaatcgattggaaaggtgatgattcatctgttagattagtatttaaagataaattgatgagaaggggacaaattgaatcgatcatcaatgggtttttagatttaagttttttaatcatttataaggacggtactgttgatgtcgttgatacaacctcatggcaaattgtcaacaatagtaaaaacaacaatagtgtaaccggggatgaaatggagctagacaataatgattacccacctaaattaatttcaaatctttttgatcaaggatttcaatttccaaaaatttcccataaaaaccgattagtgttggcaatatctcctactatgtcttctattgtatacactgaaatctatggagaaacggtcaatttgcaattaaaaccattggaaagaattgataattttggcaccaattctcatgatttgtattatacatcagtggcatttgcccatcgctatgcatttgcattgtataccagtacgtgttcagatgatttattattattaatccaatcagaaatcaaccgaataaaagatgcagtagatgggagataccattactcgaaataa

SEQ ID NO: 10508 - DNA, 270 bp, Candida albicans
atgggagataccattactcgaaataaattaggtaaacaattatgtgatctggtgattattgaatgtcacaacgcaattaatttccatttggatactattaccaaagaatcacttgataaattattatccaacaatgcatcattacaaaaattgttatcattacaactaattcttggtgaatttcaacaactgtcacattttcccaataactatgttgttccagatattgcttggatagtatggaatcttccaaatgccgtttggggataa

SEQ ID NO: 10509 - DNA, 273 bp, Candida albicans
  unsure (195): Identity of nucleotide sequences at the above locations are unknown.
ttaagttatccttgttttgagggggaatccataatggtattctcgtatccaatcacacgtcagtatttactaataccaagctctcgtcctaacctaatttctctcagaaaaaaaaagttagtgtgtgtcaataggtacacgtaccataaaggctcattgaaaaaaatttttcttcttgttaaagttgaaaactanattgttttgttttccattgatattacaacaccagcccaagtcggaagaatatcaacacatatcatgagtaccaaagga

SEQ ID NO: 10510 - DNA, 183 bp, Candida albicans
acgggaagcccctgtattttcaatctctacatagatcccaagcaattatcaactggattattgatatctgttgttggtagtgggtttttttttgcatctataggattacgttgtataatgtatattactttgaatcaacatatatatttaaaccaatcatttatctcttttgatgatgcataa

SEQ ID NO: 10511 - DNA, 411 bp, Candida albicans
ataatggtgaaacagtacattccggaagaagctgagttaaatccagaattatatgggttaaggaggtcacatcgtgaaagacgcggtcctgcaattgtggaatccgattcagaggaagatgttgcaccatctagaaaaaagaaaaaggttcaagatgattacgaggatggcatttcgatggacgaagatgaaaatgacgagtttggtgacgatgatgacgacgatgatgatatctattatgatggtagttttggtgctggtaagaaaatgaaatccaaaccaaaaacttcaaaaaaacaaagggttaaattaccatgccaagaaaaactaacaatcgccttcgcctccacaaaactctatatttcttccaaaacacacaagcatgttaattattctattgaattcgaataa

SEQ ID NO: 10512 - DNA, 195 bp, Candida albicans
gtttttttaaatacaaagactacaagcgctatcaagtactcagttttgcctactgttcttgtggtttattttgttttggctagaagattactcattcatctactacccaacaatgccaatactcctctttctcgctggctttgcattgggtctctatcaaatattgtaagaaataattgtttttttttatcttaa

SEQ ID NO: 10513 - DNA, 186 bp, Candida albicans
  unsure (10),(123),(132),(145): Identity of nucleotide sequences at the above locations are unknown.
atagatcatntagctatatcgccttatcattcttcgtacaagaattatacacaaataccaccaccacaccacccagaaattttacacgtgttttctaaattattactttccgtggccaatcanattgaaatntttctggttcganacggcagtgcctcaaacattatagtagcaagtattgcctaa

SEQ ID NO: 10514 - DNA, 270 bp, Candida albicans
tacgcggatttcggcccgtggggaaaacatcaggtttgtgaccttgattatctaaattgttcaggcatttttgatttcaattgtccagcagtttatggaattgaattatctggagttcgacaatcatttaatatttgtgtatctggtttagaaagcaaaaaacaagggatattaattgaattatctggagttcgacaatcatttaaaatttgtgtatctggtttagaaagcaaaaaacaagggatattaattaaacactctcaaaactaa

SEQ ID NO: 10515 - DNA, 183 bp, Candida albicans
tcacgcttctgcactgtctctgctgaaaatccaagccttgtctacctgatgcagcatataggcagcacagaaatgtcaagaaaaacagaccaacatcagggccagcaacctaaagctcacaaagaagaattgttagacaagaaaaaaaaaaagagggggtgtaaactcgaaacagcaacataa

SEQ ID NO: 10516 - DNA, 183 bp, Candida albicans
ggggacagactttccagattcgaaactgttctcctttttgaattttatttcaaactagcacaaaataatacctcctcatacatccatataattcataactacaagcaacttggacaattattattaatgaaagtagccaaaaaacccacctttacatatcattgcaagagaattagttactag

SEQ ID NO: 10517 - DNA, 210 bp, Candida albicans
caaataattcgatatgagaaagataattgtgagaatgaaattcatgttcaagttaaaagtggttttgaaaagggtataaaaagtaatgaaattgttatttgttacttgaaggaaacagagtcttctaaaaattcaaggttgagtcagatatacgcggatatatatatatatatatatatcgatgaacatgttgatcatcgtctcaattaa

SEQ ID NO: 10518 - DNA, 255 bp, Candida albicans
atacattttattatcaaatcaaccaatcaatctagaattgaaaaatttgaaaaaataaaaataaatccctcaaatttaattgtttttttgataaaacatgaactgattgggtttagtatatcaattatgcatattggactgattgaaacagtaaagaagataaaacggtttggacatcacgtagttgttgccttagttaatcttgctgccatcacttatcttattaggtgccaccagttgatgtttcaatcatag

SEQ ID NO: 10519 - DNA, 456 bp, Candida albicans
  unsure (94): Identity of nucleotide sequences at the above locations are unknown.
atgaaattcaaattcttatcaaatggcagtttttttggtgcattcagtcgatcccattggaaagttgtaattcttcatattagattccttattngtcatgttattgaatccaaaggggttgggaccccgccagaaagtataacttggattagaggggccattaataaagaattccttgctggtaaagtagatgttcccaaaggtgaacatttacttaatgttgaacttcctgatgaaaccattgatattattcaaaattttactactgaaagaactaaagcatttattgaggctagaaataatcttccagaagttaaattgaataataataaagaagcaattgctaaagaacaatttcaaaatttgattgatcttaaatttgatcaagttaatggatatttcattgaagatagagttgataattatgaagctttgcaaaaattggcaaaattataa

SEQ ID NO: 10520 - DNA, 246 bp, Candida albicans
atagagtatattgaagttacccagaacgagagcattgaatgggaagggaagcttttaaaagtgaactccggaaagaaagtaattcaattgaaagtgtattttttccccaattgccaaatttgtaaattagagatagcccatgaagttagaacttacaaaacaaccattttacatgaattgagtgatcaacaaacaagacaccaagggtcaatttataacttcattttttttaaagggtcattatag

SEQ ID NO: 10521 - DNA, 231 bp, Candida albicans
gcaatgatgtcgaagaggatgctgctccttcagctccatccagagaagttgtcaagaagaacacttcttctaagaaatcagatgctgctccagcttcagctgacccagccaaggctaagaagaaagaagtcaccaactggtaacgaagctgctttgaaaaacaagaacttcaacaaagatgttgctccacctcaatccactggctaccaaacactccaagaaaccatttga

SEQ ID NO: 10522 - DNA, 243 bp, Candida albicans
gtcatagtgtatatatatatggaaataggaatgacgaaaaaaaaaaataagaataattctagtatgatatgtattgatatttcgatcatatctaacagtagtatatacaaaagattatctttaaaaaccaaggagttgaaaaaaaaatattgcagcttctgtggctcgaacacagtacctccagatttcaggtttgaaattcttcagtctgacgctctcccagatgagctaaagctgcaataa

SEQ ID NO: 10523 - DNA, 240 bp, Candida albicans
tttaaatattttgctaatcctgattatgactcattgactgtttacattattaaactaagcagattaatttcaagttaccccatacattccccgcgattagtgtcgactatacgaagaaacattttaaatatgagtaaatattattgtccagacactgttcttagtcattatcttgccagatttgtatgctttaaaagagtatatacaaacaacagaaaagatgtcgtcttgtttccataa

SEQ ID NO: 10524 - DNA, 1005 bp, Candida albicans
agacaacggagaccaacagcagaatcacaaacatttgatatcaattcaagtccaattaaagactcaagaactgccacaactaaaactagaactccatcagtggtttctacgccttcacaaactccagctcgtacacctaccccgacatcaacttcagtcactacccctaatcacctaatttcaatcataccagtatcaaaagaactatctcgaatgacaaacgaaatgaaacaaatgatagattcaatgaagaagtacaatgaaggttatgttgttcccactacttcttcaacccctgttagtactaatacagaaaaactttttaataggaaacatatcaatggtgatcaaggaggatcgaaaaataataatagtaccggtggtagtgtcagtgttaactcgattaagcacaatttggagattgaaaatcgatggtataaaaatatgtacgttgtgagtgatagattgaattttatgaaagaagtttacaaggcagtaaataaattaaaagagaagaaaatcgctgcagaagctgcagctgccactactagtactaccactgctgatgacactacatctactactgttcctgctgctactacggcagaaacggcaactactaccagtattaccactcccactagtaacaatgataatataaacaacactgatcatgataaagaattgaaagtaaaggagaaaattaagttaatgatgatgatgggaagtagtagtccagtgaagaatgaaagagaggaatatactgacaatggactgagtcctgtaaagctgtcagcattggaaaataatgatagttttgggaaaaactataatgatgaggatggggatgacgatgaggaagacaatgaagatgaagatgaagatgatggggatgatagtgaagaaagaatgggatttgatagtaatagtcgtcgtcgtaaacgtcggcatcgttctaatggtgagagcagcaatggtgacattgttgatatcaagggtgtataa

SEQ ID NO: 10525 - DNA, 315 bp, Candida albicans
agaaaccattttgaaaccattcatatacatatacatacatttaagacaagacataaaatcatgaaaccagttgtatcgacatttcaagcttattgttgttttattacttcatcattcgccatagttatattatcagtcattggttatcttttccagaccaatagtgagtcatttatgggttcaataaatgatcctgaagatggtaaagccgtggctaaaactgttttcagtgctgtttttgtatatttggctttctttgccttttgtggattacaaattttattgattcaacgacaaagcagtatacaattataa

SEQ ID NO: 10526 - DNA, 258 bp, Candida albicans
aatggtagttttgaaatagggtttgtatccaacaggaagagtgtaagacgtgtttcagtttatccaccagcaaatagcaaccaattctgcttagtagtacacgactattacacgaatcatctaatagaagctgattcctctaactctacgtacaattccacctctaatgagatagaaacagcaaggaatcaaggcggtgttaattttttaattacaggcaggaaaaattacaacaaccatctatgcgggagtcattaa

SEQ ID NO: 10527 - DNA, 933 bp, Candida albicans
cgcttagtaaataaggctccacaagcacgagaagatgaattatttggaacatcgatcccacgtcctatgggggtacccaaatctgatagtgttggacaaaatatgactgctggtttagattcaaagagtgaattgccagtgatgttgtttaaagttcaagatagagatattcaaagagattctaaattttttgataattccaattctcatggtcaacgtaaaagtggtggtggtgatggaggtgttggcggcgaagatgaaaaccagagtttaagtgggtgtgatagtgagagtgccgggaatattcgtgaaagtgtgagcggcagtgtcagtgggagtggaagtggtagtggcaatggtagcggtactagaagtggatgtagtagtcgaggtcgacttacaattggatccttatcagaagcaggaaattctagtcgaagttcaggtagttctatcaaacaaattataagcaggcattttagatctattggtgagagtttaaacacagacgaaaaacagccacaaccagaatcaaactcacaagatccatcacaacaacaacctttgcgtagtcttaacttagtcaaggattcaccaccaatattatttgatgaaaaaaatcatattatcatgccatcatccaaatttgatcaagaaagtcaacaagaacccacgaaacaaaccatagattatccatggatcaattggagtttattaatgttattgggattaattgttccaccattatattttgttatacctatagggttaatggatagagattatcttggattaagatatgccaataaaccatcgaaaaaattcacaacaacacaaaaaatcattagtttaatacttggtatattatggttattgattgtgttagctatgattggtgttggtataggacttggagtaacaagagagagttga

SEQ ID NO: 10528 - DNA, 195 bp, Candida albicans
tattggaacaagaacataagttcattttcgagaatgctagagttaaagagtaaaaggaggttgcaaaaccaagttaattattttttgtcaatagatatccgttattatttcctttcattttcgttcattttcgttcattttcgttcattttcgttcattttcgaagcttatatatatagagtatatttacgttaa

SEQ ID NO: 10529 - DNA, 192 bp, Candida albicans
ttttccccacgtctctcttgccccgccctcaaggtggccctggctcttattcacgataataatccatcaactttgaaggtatatgcttattacttagctatatcaatggtgtcctcgaaccagagcgctcctacctacaaaagagagacgaaatttctattaaccatatttaacaaaattaattattactaa

SEQ ID NO: 10530 - DNA, 663 bp, Candida albicans
  unsure (118): Identity of nucleotide sequences at the above locations are unknown.
gaagccaagacattaccacgtttacaaaccaacgacccaaaccacaatttcagtaagtctgctctaccggtaatgcatcctgggccaactgtggaaattcgtgaattcacaaatatanatgctgtaccaaatgtattgccagcttccaagaatgaaaatgaaaaagaggaactgaccaaggatacttcttctgatggtggctgtaccggtaatccaggaacatgtcgtcaatgtcaaatggacccaatgtctacattattttgtactactgttgccagtcgaagtacaaaatcagattccgtttcttcaacaagacaatcaatatcaagaacaaactctaaaacatcaatatcgattgattctttgaataaccctcaaagtccaatacctcctccattattagcaaacaataaaactggtggctccaatgcaccaacaccaacaccagcaccttcaacaccatcccactcttcgtcggttctgagcaatagtggtattttcattccatgtgcagatgcttataagactttgtctcgtcataaaaagttcaactctgttgatttcacgactttagttggtaaattaacaacaagaggaatgcaagtcgaggtacaatcagtagccaacgtgttacgagaattagatagaagagcatataattag

SEQ ID NO: 10531 - DNA, 183 bp, Candida albicans
atttgtagcatcattgtgctgcaacttatcgccctacaattgctattcctgtataattatcttgaggcggtcaccacaatttgcatccaaaaaactcagaaaaagggatgcaatagtgacacaatactaaagatttacaatcaactaacatattggcttaggcaaattgctcacaccccgtag

SEQ ID NO: 10532 - DNA, 390 bp, Candida albicans
aaaaatcaaccacctattagaattgataatgctattgaaattttccaagatactaatttaaccaatggattttgtgtttatagaaataatggtaaggtcacaataaattctcaatcattaatgggtactaaagttgatttaagagattataaatttaaatttgatgaacgattcccgactgagaataaattcttgaatggttcattacaaagtctgcaacaagaacgtcaccaccaccctagaaagtcattatctatcataccatccctcaataataactaccattaccgtgtttataaaaagagtaataattcaattcataaagtgactaaacccgataattacaaaaagaaagatatatcaacatcaaaagtttctgttaaagtttag

SEQ ID NO: 10533 - DNA, 339 bp, Candida albicans
aatagattgtttaaatctatccgtgataacatccttgtggagattaaagtccgaggcattcacatctattatacaaacattcagatagaaaataatagattcttagatgaaaaacttattttcagttatttaattcattttgcagctattgccacatataggaaaaaaaagaacacttttagttgctttgttttatctttcaacaatataaaatataataatttcaacttagttcaaaagaatgagttcgttttttttagattgcaatgcttgatgaaccatgttattgtttttagtcacattaatcataaaaatagatttatcattactctttgttga

SEQ ID NO: 10534 - DNA, 201 bp, Candida albicans
tgctatttgtgtacgtgtaaggtgcaattattatatgagcttgagattttatttatagagaagtcaaatagaaaaaccctgccacccccaataaatatcatagtacttttgaacaaacttgtaagaaaaagtttaaatcccgataagggggatattactattattataaacacatccactaacatcagcaataataattag

SEQ ID NO: 10535 - DNA, 237 bp, Candida albicans
atgacttcattagctatattaccacagttaaagagaaccatcactgacattatggacgaagaattatatcaatcaccttcgtctccaaattctatgacgagtttccctagtggtacaggaaatttgatgagtaatacaaatcacaacacttttaatcaatccaataatacaccattcaatatgaactacaatcacatttccaacagaaattccataaactcatcgcccaattcttaa

SEQ ID NO: 10536 - DNA, 216 bp, Candida albicans
tattgttgttgtttgctgtctcggagtataacttccgttaacatgcagcaagtataccttgatattaatttgttggtggtgcaaataagaaaatacttactatccgcttcccgcacttgcatctggaatttttgcgatgaagaagcgctaattattattgctgatgttagtggatgtgtttataataatagtaatatcccccttatcgggatttaa

SEQ ID NO: 10537 - DNA, 222 bp, Candida albicans
tatgggatgattatattacaagtaatatatgtatttaatgttgacatcatgagagtgattaagatagaatatggtgagaaccgacagaagaaaaaaaatatggtgagttacaaattagggcaagtgcggcttttcttttttcgccaaataggcacgataaaaagcaaggagacgaaagggagtgaatataataattgcagccataatgaactctctcgttga

SEQ ID NO: 10538 - DNA, 1206 bp, Candida albicans
  unsure (1176): Identity of nucleotide sequences at the above locations are unknown.
atttgcgaagtggtgatatatctgccgaggcccttccaatatttatgtaacgatgatcgcacgacaattattttgacagaaaagacgacgatgaactttgctagtagtttgagctcagtactctacactgaatgggactcgttagctaaaaaaagaggaggcggagagtctgaagacggtattgctgtgcccatagataaaaatatttcgttgaaaaattggacaaaggaagtagagttaacaggtacagagttgacagagtttcaagaaaaggtggctcagaaaagaaaagaaaaattattagccaaagtgagagatcaaaagaatcagaatattttaagtgccgataccgtagattcagaagactcttctgatgacgatgacgagggagacaatgaagcagaaaagcaaaaaggcaatacttctagtaacttgctaatcaagcaataccagaatatcaatgtcgcagattctaatgttgctcctaacgaagtcaaccctcttgctactcatgaagcattcatcacagatcatattaaacaaagcttggaaaagaacttacccatcgatttgaagataactcacaaattgagacctagacaagcgacgttcccatactttgccactgcgcacaagcaaaaatttgatgattatggagaagtgatcaagattgaagattaccaaagacatgatgaagtttcacacagtaaaattataatggaaggcaaacgaaaatttgatgaaaaaagaaccgccaacaatagaagaaacaagaatcaaaacaaacaacaggcaaacaaattgacgccacaggaacaagttaatcgaaaattgcttcagaaatacctagacacattgtctaatcctaagaaaagagtcggcttaaattatggaacaaagaagaagagtgaaacacaaaagttgaaagttagatgtggattgtcatttgtggatttatcaggacaagtagatttacgttcattgggtattattgtacaagcattgaaaccttacaatttgatattattacctgattatacaccactgcagaacttgactcgtgtacaagagttttttgccaatcaacaaaatgagcaattgcaggagcaaacaaaaaagaatttagctcagtcgtcgaggtatttatctcttgtatcgataagagatggtctttcncagtgccatgtcgccttattcaagtggtaa

SEQ ID NO: 10539 - DNA, 360 bp, Candida albicans
gggaaatcgttaataaggatcccccggttgtttgaaaagatggaatacgaatacacaggaggagtacatggtaaagaaacaccattgggaagaactttcaagtatataaagagaggtattaccatactgaggtccgaaaagggaaccgcgcagagattgagaagagatacaattaatgatcaattccaggaacatattcttgttggtgaattacgacaacagatgatcaaggaaggtgaatatacatttgcacgatactccttagacggaataaacacaactcacgagatttcaggagtaacacaagctgacacattattaaagtaccatacaagggttagtgtagctttgaatccttaa

SEQ ID NO: 10540 - DNA, 210 bp, Candida albicans
ttagacagtaatgttaggcaggtgaatctattattactgcattatttaattatcttgttgattgtattcacatcggatttactatatgaactggtgggtttaatttttagctcactaattttgcaaatttttagaaaaatggcaaaaaataatgagccaccaatatttcaacaacagaaaataagtagctaccaattaaatactagttaa

SEQ ID NO: 10541 - DNA, 357 bp, Candida albicans
ccccaaacacccaaaatggcattcccacttgaccaatctgatctaatacgtcatttacgaaccacttacttggtcttgaatgaagattcggattatgcgagaagaattataaagcattccctgttgccaatccctagtaatgaaaacactccaagaaccccattttctgagtccccaccaatcacttttgagattgctagacatattcaaaaatcggttcataatggattaagatacgatgacccatatagctctcaacccaattttagtacatctcctggcaagggttccaaaaaaaggggaaaaaaaaatgccagaaaacgggtcaagtacctaagaatccaaaactataaatga

SEQ ID NO: 10542 - DNA, 252 bp, Candida albicans
gaagcagtaggtgaaaaagtacaatcaatgaaaagcactgcccaattgaatactcaaaataagcctgctctttcatttgggtcaatttgtgctcaaattggcaacaattctaagcaaatttcatgttcaaatcactacaacaaaatatggtttgatagttcattacatcatcaacaatccattgatagtttatatccatctcttccttttaaattgttcttcatcaacagtaaaattcacctacctctttga

SEQ ID NO: 10543 - DNA, 204 bp, Candida albicans
tattactattactataaacattttaacatttttgtacccatggaaaatgttggggaacaacctacctctttaatatattacgattatcattatccttcctttattcgaaaaaaaatttcacttgttccaaatgggttaactaaatactttttgaattatgtttgttccatattcaacaattgccttaaaacccctattgtttga

SEQ ID NO: 10544 - DNA, 219 bp, Candida albicans
agtttcaaaaataaatcaaagttctcttgttgtcaatacaaagatttacttttaaagtttgtaatatttgttcacagaagagagtattatcgagaactatctgtaaccaaaattaaagacaggctttccaatgcttatctcatttctttgttatttcttaaaattacacgatttttgttcaaagacaagttttttgcagtttcaataacgcaagtgtaa

SEQ ID NO: 10545 - DNA, 315 bp, Candida albicans
caatggcaatatcaatttcaaagcaaccataatacccactataacaatggtcacaatatttgtggagagataaataggggttgcatgaagaaggggaatgcattacaaagagtaattctgtttcaagcacaagtaattaatacaggacaaatgaatatgaagtgggaggtgatatcacaatccttttataataataatgataatagtaatttcattgtacgtgacaaccttgtattaatactatgttacataaggatgaatatttttggtgtaataaattgttgtttcaatttgattctttattctgtttgttaa

SEQ ID NO: 10546 - DNA, 297 bp, Candida albicans
aagataatatataatcaggataaaagaacttttttggttaaagaaaattacagggacggtaaatcattcttcttccctataaaccaaaaatcttatatgtcccaagttaacttattagaattccaagattatttactttacagtgaatcattaaacattttaattgaaagcgagtttagctcaatgtctttagacacaactgcttttcagccatcaccaacaaaagcaccagaagcctccatggatctgggtacaattcccaaaagatctccagcaagatttcttcaccacgggtag

SEQ ID NO: 10547 - DNA, 213 bp, Candida albicans
gaacaagaagccattgatgagacgacggaagatgctgatatgggagtgctggggatgaagacggagatgagatgtcgatttccaatcagatccgattttgatgttgtggaagagtttgatagtgatgcagcaccttcaagtgatgatgatgaagaaatggctgatagcaaggaaaccgatgacagaccacctaagaaaaaggccaagaattag

SEQ ID NO: 10548 - DNA, 198 bp, Candida albicans
ttcctctttttatcggacattgtggtagtgaagagcaattttcttgaacttgaaatgcagatcacaacctattctaccattgctctacaagaaaaaaaaagtcttttacagggtgcctgtttgcaggtgtatctactgttgttgctgtcaaattcagctaatgtttatttaatggtcacaatggatatgtatttgtag

SEQ ID NO: 10549 - DNA, 225 bp, Candida albicans
caactaatgataatgaggtcccctgttaccttagtaaaatataacaattacttgaatagggaaagtaatagaggaagaataaaaacaatgtataagtcaaaaaagagattacaaaattcaaaactttttaccagaaataggatagatatatatatgggagatattcagtctttacgatattggggaattacttgtgactttgctggtccattgacccaattttga

SEQ ID NO: 10550 - DNA, 213 bp, Candida albicans
  unsure (167): Identity of nucleotide sequences at the above locations are unknown.
gcaagattaatagccacagtaaatgggaagaagattataaatagagtgggaacaacgacaattgccctttgcaaccaaataataggtgaatacttttattcaaaaaacaaactgttacaaaatacaaaaattgagagttgtacaacatattctgagggtgaattganaaaacaatacgaacctcagtatccgtggaacttcccgcctctctaa

SEQ ID NO: 10551 - DNA, 210 bp, Candida albicans
  unsure (146): Identity of nucleotide sequences at the above locations are unknown.
aaaatttcttatcaagaaaatttggtaccaccaccaccaccacaacaacaaccactagtactggtaataacaattatggatatggttatcatgcagcttatggttataatgttgccaataacttttaatgatacccctcacacgantacattttttttaacgtcaatattacaaatcccctcccccccccatgaaagacaatacatataa

SEQ ID NO: 10552 - DNA, 189 bp, Candida albicans
ctgcaaaaaaaaaaaaaatttatagcaacaaaatgcaactatttgattggagtgaggaggaggaggaggaggagtgttttttttttacaaaaaactggtcgtgcacaaatttcaaaaactccacactatcaaatcaatcaatcaatcaatcagcgtaaattgaggtcgtgtgttgtggtaataaattga

SEQ ID NO: 10553 - DNA, 186 bp, Candida albicans
aatccaatacttaaaaaaatgatgatagctgcaaaaaaaaaaaaaatttatagcaacaaaatgcaactatttgattggagtgaggaggaggaggaggaggagtgttttttttttacaaaaaactggtcgtgcacaaatttcaaaaactccacactatcaaatcaatcaatcaatcaatcagcgtaa

SEQ ID NO: 10554 - DNA, 666 bp, Candida albicans
  unsure (660): Identity of nucleotide sequences at the above locations are unknown.
agcttttctgaaatctttgggagtaatcaaaatgacgaaattggaaattttcacaacaagaaaaaaaaaattaatttagtacccacacaaaaaaaaatggagaataacgactccctttacttcacgaatctcaaacaccgacaacaacaacaaccactactactactactcaccgggttaatacaaataatgacttccgataaaccatctttccataaagaaggaaaatcaactatcaaaatagtccacgacaataataaaaataacaacactaaacaacataaacgacccatcaccccaaaagatatctcatcccaatcacagaaagttaaagattcaccatttgttgaagaattagtattgacgggtcgaccaaattggaaaaaagctccccaacaaatcaaacaacgatataaaggaatttatttaattttattatcaataccaataatggggataactacttttgaaattattagaagactcgaagggaaatcaactaaaaaaattcaacaaggtgaaagattatcgaatggaataaatcgagaatttgatgaacaagaaaaaattaaagttgaaaaagaatctataatgtataaaatatttggtaaagaattttttttggatggatttactagtaaaacaataaagagtactctngaatag

SEQ ID NO: 10555 - DNA, 603 bp, Candida albicans
caacagttaaataaattggtttgtttcgaccacgcgcatttcctttctcgccttaccccagactcagacttagtatatatcgcgacagatttccctcgcttcctccctcccagaatggccctccgaaattatttatatgctaaacacgatcatgatacatcaatagatattaaaataaataaagataacagtctaatgtccaatataacagaaaaagtatctccttcatctccttctccttccgatccatccgattcacagaaacaacaacgatcaccaatgcaaatacaacaatcaagaagaagaataattcgaatcgttcataaaaaatcatcaaataaattaaagttaaatcccctggttaattctatagaaaaattaactaataatattgaaaatgttcatattgaaaaaaagaaaaaggaaaattgtttaaatgattgtaatttatgtgattgtaaaaatgaaaccaatgataatgaaaaagataatccattgattcaagttgaagttgataatagagttaatagtggtggtgttggtgatggtggacataatgaaattgttagtaacaatgaaattgattttacttcttcactctaa

SEQ ID NO: 10556 - DNA, 345 bp, Candida albicans
ccccagccttctttttccgtcgtcagcactaacaaaaattcaaggagattagtgaccattttttgctatctttttgttttctattctcctctttttatcagctctccttttactacttattccggaatcatgaaagactatttagccatgtttcaagcctattctcatcaaatatctaaactgaaatcacatttctttccttccttccttcaaattaacttaataaagactgtatataggtggataattaatttattttcttttttcacaatccaatccctgtggtacacgacctatcctgaaaatactttgaatttctttttcctttgttgtgcggttttttag

SEQ ID NO: 10557 - DNA, 252 bp, Candida albicans
tcaaagcgcaattactgcagtgaaattaaattatgtttatctttcagtaaacgtgatccaagatctgttattcttgttgtggaagctcgtgtgtcaattaataagatcattatctggtcacacaatggtaaatgctctccaagaaaattgaagacagacaagaacaataaaattgattctgccgtgccccacgtgtcatttgttatccctccacacattattaggtttctaatcaagttttccccgttataa

SEQ ID NO: 10558 - DNA, 282 bp, Candida albicans
tgctgtagctattgtatagtgtttaatcttttttttttttgttttttgtttatatatatgtgtgtgttgtattcctctaatgtatacttctatcaatttatgaaatcatcgttatcaattttgcgttctgatatttctccagttttttatggtttgcaaaacagaggaggagagaagtcaagaatgaaagggaagacaaaaaaattttctattttttctcgttatcaaacttttcagattagcttaacccaaccattccaacaatgtctgatattgaattag

SEQ ID NO: 10559 - DNA, 198 bp, Candida albicans
gtaaagaaagcagaaagtgtaaaaatgttactcagtatttttcttttggtttttgtacactattgttatcaatttgctgctactacgactgctactacttttaccactaacaatcaactcgaacaaggctcggaattaaaagataatcaaatggtcatgcgacgcaacggaaaacacaggacaattttttttttttga

SEQ ID NO: 10560 - DNA, 261 bp, Candida albicans
cctattaccggcaatagctttgcatattttttacacccgaaacatcattggctaatcattagattatacggcattgatacttacttacttacaaactcatcacgttccatggatattggtttccaaataacaatactttatgtacgatttgtggtacaaaccccgaaatttttttttctagcatcttctatggatgcactttttttctccccctatttacgttttgatgtaggctttgctgtaaataccgagcatacgtaa

SEQ ID NO: 10561 - DNA, 255 bp, Candida albicans
  unsure (51),(52): Identity of nucleotide sequences at the above locations are unknown.
tctcggtatttaacgtttatcataagtcatttgtggaaagaagatgaattnntcattttcagacgcatgaaaaataatgataaaggtgggataactcctaacccaatggccactgtccataatgctcgtagatgtttttcagtagaaatccaaattaaaacaaatgggacaaaagctgaaacaacgaaacccagatcaatcatggcattagtaaaccaactgaaatatctgtttcttttacctggtggtaattga

SEQ ID NO: 10562 - DNA, 261 bp, Candida albicans
  unsure (23),(24): Identity of nucleotide sequences at the above locations are unknown.
tacaaaagagatacaaagggaannaaaatttgtatggtggtggaaattttgttgattaaggaacaacaggagataacaataagtttgaggaatgaatacgataaacaaaatatggataatttggttaatatagatcctgattatagtttctttggtgctggtaataacgacaaggaggatgatttggaaagtacagtaactactagtgtttctcaaagtcaaacacaatcttttaatgatttgattggtttacagttttaa

SEQ ID NO: 10563 - DNA, 207 bp, Candida albicans
ggggaacaaagaaggaaaaaaaaaaaagaatatagatacaatatggtagctatcaattcattattatttgctgccatcacgttggtttcttcagctcaagctaccgacaccttgacaatttaccacaacaataaatttgccgtgcaagcatgtaaaggtttaattggtaaaactgcagtccttattgtcttcacccacgggagctag

SEQ ID NO: 10564 - DNA, 195 bp, Candida albicans
atagaagagggaaaaaccctcctagtagtactaactagcaaatgttcatgtgataacaacaaacataatactacagaagatttgaagacctttctttttcttttaattaatgtggaaatatttcacagccaaaacttaaaaatactattggaacttttgttgttgaaaaaaaaaaaaacatttgcaaaaatttaa

SEQ ID NO: 10565 - DNA, 330 bp, Candida albicans
gaagaagaagaagagggggaggaagaaggtgatgatgacgaagaagaagaaaacaccaaagataagagtaatggtaaggaagacattgatagaaataaagattctaaagaggacaacagcaatgcaaactcaactcaagctgtaaaaaataagctggaaacaaaactaaaggaaaatgaacattcagatgaaaaatcagatcccaccaaggaaaactctaaagacgggaaagtttcaaaagaaaatactactaatgcaaatgattcaattaacgaaaaactaactacagatgatgagccaattgttcccacaaccaaatctgatgaataa

SEQ ID NO: 10566 - DNA, 213 bp, Candida albicans
tccggccagctgcgcgttgaaaatacaggtctggtgctaggggtcagtgatatcgatacatgggatatactaccagaacacaaaaatttagatgcatatgaaaaagatggtttcagattttggacggatcacaattcaggtcctagtaaaatgaaagatcacaatagtgtacaatatttaaatgacattaaaacccatttattgtctctataa

SEQ ID NO: 10567 - DNA, 300 bp, Candida albicans
cgacaactgcaggactcgaacctgcgcgggcaaagcccaaaagatttcaagtctttctccttaaccgctcggacaagttgcctaattttctgtaaaacaattgacatgcattttctactgagtacacatttcagtataattaattcaaaagacacgctgttggttgctggtaatgctttaatggatcagtttagctctaccccaatacctacattatatgaaaataaacaaaatttgttgttttctctctgtcttggctgggatgatagtgctactcatatcgtagatacacaaagttga

SEQ ID NO: 10568 - DNA, 1014 bp, Candida albicans
  unsure (116): Identity of nucleotide sequences at the above locations are unknown.
aaaaaaatttttttcccccccttttgggaaataactttcaattttttaataattaccaatttttttatttcgatgttatattccttccataaaatgatctggcacttggctggacngatcttcttcttttccacattgatcagtggattttatttcagttttttaaccttaggtataacccaagccaaaggtgaaatattatttgatatggtcaaaatattttttggattcactccctcagtatggaataattgggaaaattacaacttgttgggaaaatttactctaatgggttatttgtttttaattcagtttattgtcggtacgatactagcaatttgtttgagtggtgtatttgcaaaggtaagagatagcaatcaggaagaattcaactattttaaaacaaccaatttgatactatatttcaaaatggcaaggttgaataatctgaataattggactaacagtttcttgcatatttttaaaatacccattatagttatcctttttggatatgagctaataaaatctaaaagtttccacaaacaaatttcgtcagaattgaagaatttcacttttttgaaacaagatgaagataatatacaggggactgggcatgaggttgatggcgaaagtaatataatgggacgaagcactaaaagaagattgagccgtcgttataacaaatatcaatcgttgagtacattaaatgggggcaatatacgcacagcctcgacagactcttttttcattaatgagttactaaacaagagatatggcgggaaaatagaaaaggtacgaacaaataccagcgaaagagtaatatccagaaaatttcttcaacaaccatttgctgtaccaagacaaccacaaccacaggcacaacaccaacagccattgcaaaatattcaaaccctgaggcaacagtcaccaccatcaattatatcctcatctccacattctaacagacacaacaacaataataattttggtacagtcaccgacaatatttag

SEQ ID NO: 10569 - DNA, 234 bp, Candida albicans
acaagattgaacaatcttgagaataacattgcaaaacgtacattaatgtctactagtgtagatgataacaaatcaattatgatgtacaatattaatgaaatagagaataatgatagtaatgaagaaatcctgatcaattcgcaagaaatggatagcccagaagatgagttcgaatccagcaaagataacacaatggaggatattgaccagtatgatagtgacgaaactttttga

SEQ ID NO: 10570 - DNA, 375 bp, Candida albicans
agaaaaggatctgtcccacaatcaccaattagaccacaatcacctgcagaaacaagaattctcaatgagacgaggatccctgttttcaaaagaaagagtggatcaaagccatcagtggcatcagcccctgcaccagcaacaacatcatctacttcttcattttcatcatcttcttcttctacaccagaagttggtcccgctacttctccaacaaaaccacaagcaccaccacaatacatgaataaacatgatttcatgcatagaagtttatttcgaagaagaggatcaaatgcaaccgatacatcatcagtaagttcagtgtcttcaagattgaaacgaacttcaagaatattcaattggataagaaacaaataa

SEQ ID NO: 10571 - DNA, 225 bp, Candida albicans
gtaaacgaaaatattcacaaagataattccttatttatgactattgttattgtaaaaatgtgttacttctcttgtaattcaacgtacatgaaccatgtatcaattttgacaataaaggacgacctggctttaaaacacaagtgtaagcgaagagtgagaagaaagaaaaaacaaacaaagacaatcaatagccaatttgagaacagaacaatagaattttcttaa

SEQ ID NO: 10572 - DNA, 231 bp, Candida albicans
tattataatttatttcgtatctgtaaaataatgataactgtaatggttaagtatatttttaactcgaatttttttagtctaacaaaaccattgagaaaatgtttttttagattgaaatttggtacgaaattaggtttaaaattagccttatataaaaatttggaaatgatgatgatgatgattataccctcttgtggtggcacagtttcaaaagtgaacgcctgtgaataa

SEQ ID NO: 10573 - DNA, 297 bp, Candida albicans
aaaaaagcttgtggtagagttatttgttattcacatacatatgtcacatcatcgctagagtttttttttttcatttattttttttactccctaaattctgttaacagtggcatagtttctaagtttccaatgtaccatgtattatgtcaattttttagaaaaaggtccaacggaatacaaacaatacataaatcaacgacaacaaggaggcaaaaaaaaggaagagtgagaaaaaaagtcaaattaaaacaaaatacaaaccttaagtctatgttgttgttgatattgggtaattaa

SEQ ID NO: 10574 - DNA, 195 bp, Candida albicans
attcaaaatgttatttctagaatgttaaaaccacaaactaaaattttagaccgaacgaactcagtctcccctcctccaacaccaccagttggggagagaaaaaaaataccgaaaaagagaaatggtgataatttaacccattatacgtggagatttggctatgctgctttagttggctcatttggaaattcataa

SEQ ID NO: 10575 - DNA, 297 bp, Candida albicans
  unsure (270): Identity of nucleotide sequences at the above locations are unknown.
aatactttttcagaaacttttcagattaatcaatttaattcagttattgctccaaccaacataaagatgtcatcacaagccgattatgataaaagattggcagaagaagttggcagtttatcgacacgattagttacagctgttaacaaacaagttgaattagaggaaacgatattagaattgcgtaaacaggtttctgccctcaaactaaagaatgagcaattgaaccaaagcgatattaaactaaaaacccttttgcccccatatttntacacgccggactgcccatacggcgat

SEQ ID NO: 10576 - DNA, 258 bp, Candida albicans
tccattagaatcattttaaatgatgataaatctataatctgccaaaaaaaagttaatgttagaacgatgcctctaatacgaaacatatgcatttttttctgttcacctcatatccattataagggagtagaaatgttttcaaaaatatcagtgaaacgacctatcatcaactctcatcaatcaacgtttccaaataaaaaatgtacacatgaaaacgtgactcctctttcttatttgtacaaaaagagggaccgataa

SEQ ID NO: 10577 - DNA, 246 bp, Candida albicans
atgtatcaaattatgttcacttatttcattgttgtagaaacagaactgaataacacaaaagagataacaccaagtattattgttaatattgtctcatttagttttgtcattcttgtgttgggaggtattctgttagcatgctttgtcgctaccaattctcaaaccaacttttgttcaggtgattttttctgttgttgtggccaatttttttttaggtggaaaaataagcagatgagaaattgttaa

SEQ ID NO: 10578 - DNA, 192 bp, Candida albicans
atttggtcatgttaccagaatgttttaattcaccttatgccgtataccaatttagaaattatgctgaagacatcccccaggggacaaactactcaattgttgtcaagtttggcacaaaaatataaaatatactttatagggggctcgattccagagaaaggcgagaatgataaaattacaatacatcgttga

SEQ ID NO: 10579 - DNA, 207 bp, Candida albicans
agagccaaatttgagtaccagtatatttggtatgagaaatgcttttacaatggggaatggtctggctggtgtgggtgttgtgctttcttccatatttatgttgctccaaatcatcaacagaaaaaagctgaacccgtcacaagatgtataaaacaactagatatcaagagaatatttaagcacttaatttataatttaatagaataa

SEQ ID NO: 10580 - DNA, 243 bp, Candida albicans
attaacaaactgacaaatttttgcgcccagtatatttgcccaactggacgagttcccattattactatgccaatgaaaaatgccatcatagcaagaaacattactactgctgatggtactttcattaacaatatagcaccaccaattgcagcaacaactcccattggtccacatggaatcatctttacaccagacatcactgcattgtcattgtcaaccacaagtgaccatctaagtgtatag

SEQ ID NO: 10581 - DNA, 777 bp, Candida albicans
aaagttacagaatatggaggtaaaaaatattcagttttgtcaaatgaaagtattgagatagataatttacataataaaagaaaatggaatgaaatatatggtgataataaacaggaccaaaatgatgatgatgaggatgacgaagaggatgacgaattagagtatgatgaagataaagaagaacatccattgaaaaaatctcgaattattgaattattatcacctttaaatcatccttcagaaataatatcccatccagcgatttctaagacatataaactgcaaacattatcgaaacttgccagtgaattgattgatttgattgaaatagagcaaactaatttgaattggttgaataaattattacaagtgttgaatggtgaagattggttttacttgttagaagagaatttgggtttaaaagattatgatcatggtttggatgaagataagaagaaaaaaattgaagaaaaagaaaataataataaagacaatacggttgttgaggatgaatttgaagatgaagaagaaaataaggctgatccgttttttgccttgccgactgcattaaaacgatatgaaacttatcaacagaatttagaatctagtgatccactcaaggaagaacttataaattatcttcaagttagtattcaacgtcaacatgaatacattaagaatttgattctgttaaggaatggtttggttagagcagatagactaaagagtgatttgtacaaatggggtaaagaaatgtacgaaaagaacagtagttaa

SEQ ID NO: 10582 - DNA, 264 bp, Candida albicans
  unsure (236): Identity of nucleotide sequences at the above locations are unknown.
cagtttgtttttatagaaataaaaaatcttgttatatattggaactatataataataataataaaaaaaaataaacaatataaacaatatatatatagtcttaaagaatcactgaattataaattaaggcggaaacaagcaaacgttgccaagaatttatgttgctctttgaataaaagtttcttttccccctattatcatcattctagccgccgggctggaaataatcgtcgggngggagggggggaaaaaaaaaaggaagga

SEQ ID NO: 10583 - DNA, 384 bp, Candida albicans
atagaatatactgaatactcttgttttttctggactgaggttcttttaatgaccaatgttaatttgataaccatagccatagccataatatatttcagtatagtaattgtggctattgtaatccctaaatcaacatacaatataacttatcaaggcataaatgatattgttcgatatggtaaacaaatgtatgaatttaatgttattggtggtccttataagactaatgtaaattattattatgattctaatgggttatattttattaaaccaaatcaacacttacaccatgatagtgatgacagtgatgatatggttgaagtgttaagtcgtgatgaacttggattacaattgaatgaaatgtataacagtttgtttttatag

SEQ ID NO: 10584 - DNA, 264 bp, Candida albicans
gttgtatcaaacccttgtaatcaaatttatacttggaataccctttgcttcaacaatcacattttacatcaaatgaatctatattggttattctttaaatccccttcttccccttataataacacacaaactaccaaccaaactacaattgaaagaagtctatcaataacaaatcaatcagtcaccactaacaacaatgttgatagtagtgaatgtttaggttcaaccagtatgggtagtcattcatggcaaactatgagataa

SEQ ID NO: 10585 - DNA, 186 bp, Candida albicans
ttaaaaataactgtgtctcctggtcttcttcttcttcttatcaagacattcctcgaagttgaacattacttctacaaccacaccgtattatcgttaaaaaaaagcttaatcgataaagttatctggattgtgatgcgtattagtagatacaaatgcgtgactgggttatgttattttgaaaaatga

SEQ ID NO: 10586 - DNA, 345 bp, Candida albicans
actacacgctctataaacaataaagaaaaatataagaaatccatagacaaagacaaagacaaacgaaaagatgttcatgtcgctctttgtttaaatgatgtgataaatgtgtctatttatattttgaacgttttgaaattacacaaaacttggccgtacaattcatattttttggtcttacagttccagttttgggttcattttgatggtagactgattttgagagacattcactggtttctaaagattctccaatctgatttaccattgagttacagtgattctccagttaagagcttcctcagttcacagatccatcaagaaaaatctacttccatctcatag

SEQ ID NO: 10587 - DNA, 183 bp, Candida albicans
ttaactcttaagaataactcagtagcactgcatacattccaacagtctctatatttcaacaataatgtatacgacgtctacagtacaaggcacgagatagatttaccgtcaccatattctgattctccaacctatatccactatatacaaggtctaatttctaaaaatctactctatctatag

SEQ ID NO: 10588 - DNA, 186 bp, Candida albicans
actttgtcgtggttattattgatgaagatactaaactctttctcgtgggaaattttttgtcaatttttcagctcgttatatacaggaaataaggaatttttcaaattggtctatgacaacaacaatcattcatattcaactattactatctaccaactacatatatggagagagagagcagcttaa

SEQ ID NO: 10589 - DNA, 192 bp, Candida albicans
aataataaattgtatttcttttttaatttgaatcaaaatagatgtaatgtgatgaaaagaaaaacaattccatctatccgaggatactggattttaaagtcctgcatgaaactcaggatcagtggaagattgcgagtgaaaaataaaaaaaagaaaaaaaaatctggggaaaagagtaaagtattatcttga

SEQ ID NO: 10590 - DNA, 237 bp, Candida albicans
ttttgtcggtattatatttttctaatttattttcttagttatgcctcggagttttgtgctctatttcgatgtcggccccgtcgaacaaaagaaaaaaaaggattgaaaggattgagttgttcacatgatatttccccaataaactctggacacactttaacagtcagcttttctactcaatcctatacttattctacaggtgaagagtcacttctatatatatataaatcaatatag

SEQ ID NO: 10591 - DNA, 189 bp, Candida albicans
ttgtttgaaattcatctttacatcaattgctcttcatcattattaaacaattacttgattaatggaccgaatatcggatgtttttattatagtttttcactgtttattttttcaaagtttgaggaaacccaatttcctaaaatgggtttcgccgaaactaactgggtacacgtctttcaaattaaataa

SEQ ID NO: 10592 - DNA, 312 bp, Candida albicans
catattgaattaaatccaaattgtgaagttaatttgccattgccgttaccttctaatggtggtggtggtggtgataataataataataataataatactaaaaatggttccaatggggattcactgattgatgaagaacaagaccaagaccaagaattagaattagaagaagctccttcacaaattgataggaaattatttttagcagctgttggtcaagttagagaagttttacatatttatggtattaattcagttactatacaacctgaatttctgaatagtaaaaaagtgtgtcgtctgattttctaa

SEQ ID NO: 10593 - DNA, 198 bp, Candida albicans
ttgttgttgttgttatggctactaccaccagataataagctaccaaccaatccagcagcaccagatccagatccagatccattgtggtgtttattggaaccagtaacactagacacaacttggttcatgatgaatgattggacaccaccaccaccacttccatggttcttggaaccagtagcactcgaaattgcttga

SEQ ID NO: 10594 - DNA, 774 bp, Candida albicans
aagatcgtcgcatttttagatgcaatttatgagtctcgatgtcagttttttatgaggagtgatattgagatagattatcttttcttcccggacgttttaaattcagataataaagagttgatggattatgtgaaaagtattcaacccgaaagtggaaatgagaatatcatggaagttcaagatgaggaaatgtttgctcgtacatcaatagatatgaataacccataccgtccaaatatttctacttacgatcaatcgtataccaagtcatttgatgatttcaagtcagcacagaaagagaacataaacaacgaatatatgaacaccagagcctttacaggtgacgatgaaaaatttgcattcaaacgagctgtttctagagtaaaggaaatggttgcttctgaaacctggagacttaatgatcggtgggtgccattggatcatactatgagaccatgggagtcaccaactgcaggtaacaacaataaggcgaagaattcagactatttggttacagacgaaaaccaaaagctagacaaattattggaggaaaagggtattaaaaatattacattggagatagctgagtcattaccacgggaatattctcggggccaaggggttctgtttagactattaaattctaggattgctccgatttttgatagtttgcaacattattgggctatagggaaatggtctcctgaaaacggaaaaaggttaaaagattccattgccagaagttggataagatcaagtgttcgaaagaaataa

SEQ ID NO: 10595 - DNA, 501 bp, Candida albicans
ttaacaatctacccaaaccagtttcaaatgtctaatgataacacagtacaggtcaataaaccagaaaccttagcatcaattcttgagtatttgcaacaggaaagtatctttagtgcagaggacaaatgcagtcaagatgagatactaaaagattgtccacaattctttgtaaacgatccaagcaaaaaacttaattggcaacagttggcagaatgttttgaggatgtctttacaaagtatactgcagaaacctgtgagttgaaagaacaaattgaagagctagttcaagtacgtcccatttcattttcccattattggcatttaaatccattactaacgcttatttgttctcctaatagaaacgaaaaacactatttgaaagttatgaaaagctcgatcaggaaagagctaaagctcggtaagtttaaacgacttctggtcaatcttagttttcttttttcacatattaacagtataatcttagtattgaaaaatcattga

SEQ ID NO: 10596 - DNA, 525 bp, Candida albicans
  unsure (505): Identity of nucleotide sequences at the above locations are unknown.
ccaaccatcgtctatatcatgtcttttaataccccatttagtgaagatttagaaagaacagctacaaatgattcccatagatacaaagactatccggaatttgacagtttatccacaagcatagagaagcagttacattatatcaattcggaactcttatcatctatacgtctggatttagcaaaattcgaaaaggataaaaccgatactagtttgtctgaaagtttaagtggccagtttagaaaaaccaccgatgcatttaaaaaagtgaataagtttgttaaactgttgaatgcatctatagtgacaacagaacgagaacacgaggacgtggaaacaataaactatctcaaacaaaaggaagcgatccaaataaaactaataagagacagtttggctaatttcaataattttcaaaagagatttgaattatgtcaaacgacccagttgcccgaagacgggaccaacttactggagaccgaacctggattcttcacaacgcccntagcagatccatgtcgcaaa

SEQ ID NO: 10597 - DNA, 195 bp, Candida albicans
acatatacgagtcagcacacagctagatatagattaatactatttacattaactctatacgaatatttacaaattaaaagacgaaaagcaaaaagaacggactccttaattcttagaaaatgggaaaccataacaactaagcaaggttttggcgtggttgtcagtttgtgcggtagttttaaaagtaatttgtaa

SEQ ID NO: 10598 - DNA, 441 bp, Candida albicans
aatttgcagctcagctttcaaatactaatctacatttcattctttcctattcatttcctattcagttttttaaattctatcaataataataataataataagctatatatactacaagtgatcatgtctgctacttttataattccacagtccattagagaaatctcagctaattcaactacaataaatgaaacaacatctaatccaacgtcaaacactccttcaaccacttatactgaattgcctgcacaaggataccttgctagaatttccaacttgcctgcagtatctgccataaatgggatgaaatcttctttccctgttgttaaaatattcacatctaatgctgttcccgttttggttgccagacaagaacgtaagaaaaaagaagaaatggaacgattggctgaatatcaaaaaaaattaaacatgccgcaatag

SEQ ID NO: 10599 - DNA, 183 bp, Candida albicans
tattcagccaatcgttccatttcttcttttttcttacgttcttgtctggcaaccaaaacgggaacagcattagatgtgaatattttaacaacagggaaagaagatttcatcccatttatggcagatactgcaggcaagttggaaattctagcaaggtatccttgtgcaggcaattcagtataa

SEQ ID NO: 10600 - DNA, 336 bp, Candida albicans
ctttggtacaaattaaagaagcaagctcaagctgctatttatcatcagatcatgttaaggacattattattattattagtattgtcatttcctctagcattttcattacctgatcaatctcaatcttgtgtcaccaatatgaatattccctttacaggatataaaattgaataccaactaaatctccagagatttgaaggaagttatcatttactttattgtaacgataataaattattatatgatgtcaatttaaataattcaattccttggacattacctattaattttagttcattatttttcaaccacggggctggcaggatccgcgcttag

SEQ ID NO: 10601 - DNA, 183 bp, Candida albicans
acaagtaaaattccaaatgaaatcaatgctcctaataatgaaattaaataccatacaaatccaacatcaggtaaaattccaaaatatgataatgtaaataaaaaaaatcctaataatgttaatacattaccaacaaaccaaccaaattgtaatgtctggacggttttaagtaatttatcttga

SEQ ID NO: 10602 - DNA, 255 bp, Candida albicans
aggaggctaagaaagaagaagcagcaaaagaagaaccaaaaaaagaggagaaaaaggaaggaattgaagaagcacttaaagaggaaagttaaagaagaacttaaagaggaaccaaaggaagaacttttagaagaacttaaagaggaacctaaagaagaaccaaaatttgccgttccaccaccaccaccaaggaaagctggtagattaaagagattaaagagagctattaaagatggtcttgatgaatttgattga

SEQ ID NO: 10603 - DNA, 186 bp, Candida albicans
agactttctcgtgatattttcgatgatgacgtggaagaagaagacgaaaaagaagaagaagacgaaaaagaagaagaaggaatgctattggctggtttaagttctgttagatgctttttatctttgggtgcatatttcaaatttataattatcatggttaaattatggaaaatttcacaacaataa

SEQ ID NO: 10604 - DNA, 183 bp, Candida albicans
ttgaagaccaaccaagcaaaacaattattgcaaaaagaaaaagaaaatagaataaactattgcaaaatcgttagacataaaaaaaaaacaatagaaatattgataaaaaaaaagcaagagccattcacttgtatttatatgattcgatcaattacaaataatctcagttgttgtgaagaataa

SEQ ID NO: 10605 - DNA, 216 bp, Candida albicans
aaaatacacatcagtctatatcattcgccgccagagtctgtatttgtgttgggtgggagtatattgcttaaccgccgtctctacttgttaacagaacatatatgttttgctctaacacaccctttggatacaattgagttcaagagctttgagtttgcaactaatccattttctgttttttactacaaaataatagcgaatatatcaaaaaactga

SEQ ID NO: 10606 - DNA, 279 bp, Candida albicans
ttgttttgcttggttggtcttcaattattacatgaaaatatgaataacaccaagaattcagaaaaccacacttcatcagttgatgatacgataggtacaattcttccttcttattccatgtttacatctacaattggtatgaatgtaaatgtccctgaagataattatcagagatacactgatgcagaacccccttcctacaatcaagaagatttaaacaccgttgagtctagctctgtttcagtctcgtcttcaccaagcggctggaaggacaacgtc

SEQ ID NO: 10607 - DNA, 228 bp, Candida albicans
agtaataaaacaatcaaaaaacaatggtttgatttttacgacaataacatatacaagtactacaatatttgggaattgtgtacgaataaaattaatacaatcgaaaaaatcataacaatagaaaataagcttcgaacacaatttccttccttttcggcactaagaacaaatgtacgagagaaagcattgttacaaaaaaccaataagcctagaaatttgattatgtaa

SEQ ID NO: 10608 - DNA, 291 bp, Candida albicans
agaattggtagcaaccttgatggcaaatttagaaccaaaagtttaacagtgattgcaacagaaaacaatactgctgtaccaatatttattaaaccaccatcaccaaattatcaaatgaagtcttacataatcaaatttctaggcttattggttttttgtaacaatgctttctctcgtacatttgttcttagtgccgaaaaggaaggaaattgtgttcgaagcttattttctattgttatgattttttcgattgtattaattttattcgtacacaattcccaaatattgtag

SEQ ID NO: 10609 - DNA, 231 bp, Candida albicans
  unsure (198),(217),(226): Identity of nucleotide sequences at the above locations are unknown.
acaccatttgttgttgtccaggaagtgttgaagaaagaaaactttgttgctggggattattgggttgttggaacatcagttgcatacctgggttgtaactcatcatgtgttgtgatacagatgggttcatctcaaaaggcatatacccattataatgatgtgaatactcttgtggttgttgctgtgatctttcttctnggccatcttccatatcgtntgatctatngataa

SEQ ID NO: 10610 - DNA, 225 bp, Candida albicans
tgtgtccaattcaaatctttcccccaaaaaaaaaaaatacaattcagaaaaatacgcgttttaaacataaaacaattatattacaaataccctaaatcaaaaagcatcaactctaagaaaacaacgaaacctgtacaccataataaactttttgatgtaataatgtttagaaaagatgttaaagatttatctttagaattttgtcaccatgttgtgaatatgtaa

SEQ ID NO: 10611 - DNA, 255 bp, Candida albicans
aatgacgccaaacaggagggaaaaaaaatttttttttttttaatactttacaaccaaaactttaacatttcacaatcaaagatcaaattagttttaccacctcaacttgaattaactcaattacaacttcctaattgtaatagtcaccaaacgacacatctatcattgtttgtattagaggaagagaaaccaaccaaccaaccagacaaagtaaaaaagaaaaggtttagtgtaaatttcttcaatagtaattga

SEQ ID NO: 10612 - DNA, 255 bp, Candida albicans
agatgtcaatgtatcccacaattttatttaaaatgtctttcttctcttcaccaacaatcaatcactcattcattcattcaaatagtcattcattcctttattaccgactattattcattcctttattaccgactatcattcattcctttattaccgactatcattcactcctttataactaatccaaagttaagctcaaccaacaatgttcttgaaaaatatcttgagtgttcttgcttttgctttattaattga

SEQ ID NO: 10613 - DNA, 204 bp, Candida albicans
aattctattgatggtgaaagatcttcaattgtgacacacacacattcacacaagatgacagttacaaatttagtgagatctaaaaaaggatctggatttttttttatgtttcaatttgcaacgtatcgggatttccagatttatcgaatcaccgtcacctctttagttgttttgttcttaatattctggtgtgttgttccgtaa

SEQ ID NO: 10614 - DNA, 192 bp, Candida albicans
tttatcataatgcatttactaaaaacacaccattcagaatcaacttcaattagctcatgttcattatttttgaaatacgagactgagttttctacaaacgcaatcaagtttcttcacattaaccacagaataaacaaggcaaaatttacacatgctcccaaatgtaaatcgctatactctattttgctataa

SEQ ID NO: 10615 - DNA, 192 bp, Candida albicans
gaaattcatgtagataatgaaaaaaaaaatgcttcaagtagtttggtcagacattattgttattctttagaacaacaattcttggtgctacgtttttgcttctttttttcagcattcaaacacaaaaaacacacacagccacaagatattaaagttaaattctgcaatatccttatagtgacccccctttga

SEQ ID NO: 10616 - DNA, 453 bp, Candida albicans
acaaaaccaaaaaaacaatctataattatctacaatatgaagtactttacaattgcaactgtattaaccttggcatcatctgctttagctgctatcagagatgttcaattgtttgctcaatcttcaaatgaagaaattaacaatcttggtcttatttctagacgtgaaggtgctggtgtcaactacttgtttttagctagtggtgctgaaactttgaaatttgatgatgaaacttttacaattttcagtgaattgcaaacaggttcaactactgctagacaactgttggttgtttctggtggtgttgttcaattgagtgttagtggtcaaccacttcatgttgaaatcgccgaagatggaagtgttaagtttgctggttctgattctgttgctgctgccaaaaatatcaatgacccatacaattattctaagcgattcatttggcgttgttaa

SEQ ID NO: 10617 - DNA, 384 bp, Candida albicans
tttatatttatcaggatgaactttgaaccaatagattatttactgaccttaaatcttgatttctccaacactgttccatcaacagaggtttcaccacaaattgatcaacaagaattggatttattcactcaagcagccaacgatgatttcttttcattagatgtatttggcaatggtgatattgttcccatcaaacaacaagaatcagtgaaacatgacattcattctacatttgacttaccaaaatctgtttctcgtcctatcaaaaaggaaactgctagtgcttcagcagctgatgataaaagaaaaagaaatactgctgccagtgctagatttagaattaaaaagaagatgaaggaacaagaaatggaaagaagagcataa

SEQ ID NO: 10618 - DNA, 183 bp, Candida albicans
ttgttgcccatgcatgtccttccagcccgcggtgaagactggttaattatgatatgccaactgataaatatggcaaaccagatccatcaacttatttgcatagaattggtacaactggtagatttggtagagttggggtatctatttcatttattcatgatagaagatcatatgacattttga

SEQ ID NO: 10619 - DNA, 192 bp, Candida albicans
gattcaagatttgtttcgaacttagttgcccgtcttatttgttcaatcgatagctacatctgtctatgttctgtttattttaggaatactactaactatttatatttgttgggtcatgatttttataaaactcataacattactgttgctttgatagtcgttacatatgttttttttctattattattatag

SEQ ID NO: 10620 - DNA, 297 bp, Candida albicans
ttacgctgttccttcgaccccggcctggtgaagactatagtatctatgattcccaacctcattcaatatctattctttgaaacaccaatcaaaaaaatggtacttaaatatcctgatttaccagaagatgaaattgttgctattattggatttgatttcattggagattgttatattttgcattttgaacataataatgggaaaagaagttgggcaacaataaatgatgcacaaaaattggcaccagaaatggttagagaatatattcgacaaccaggtcataaaagtatacgttaa

SEQ ID NO: 10621 - DNA, 756 bp, Candida albicans
aaatatccattgagtaataaattgactactaaaaaaacattaagatgtttagattgtaataatttagtgttttcaccaataattgaaaatattccaccaacggtaaataaagctgccgttaaattcaatgccattgattatttaccaactataagtatgtcgaaaatattaaatgatcaatcaaattggaaaacccatcaagtaatgcttttacatttcattaaccccttgaaaaccaaagttcacattaatgttagtattcctagttcattacaaatcaaacatactaccgaaaacaccaacctagcgataaccacaacacccatacctacaaccacaatcaaattaactattcttagaaatgaattcactttgggtggtaatactcccggcacaaatgtagttaaaaccattccaacggcattgttaacaaccaacacctcgatttcaaaatcagaattaatacttcggaaaggtgattcaatgtataaacaaccaccatcatcaattgaagaaattgaagagaatttagatgattatattgaaaaaggaataaattggtgtagtattcctataattattaagtttcgaaataataaatctcaatttaaattgccagaaaatttcctgttcaaattaccaatttatgttaatttgaaaagtgatatcatacctatatcattagctaaaattagtgatagattttctttaggatattggaatgtaattgaattaaataatataaatataacttag

SEQ ID NO: 10622 - DNA, 708 bp, Candida albicans
aaaataatatgtcataacaaaactatctatttcacattcacaataccccctatcaatctatacataatgccaatccataatgatcctgagaatgataatgaattaatcaatcaatctattcctgtgacaaccattgctagactattcaaagaattatcttttaaagatccccagaccagaatcaccttgagtacattagaattgtcatcggaatatattaaactattcatcaatgaagccattattcgagcaaatgaagagcgtatagatgaaggtgacacattagtacaaatagatggtattgataatgtgacatccacagcaaaaaataatcaagagactcaatatcctacaatagatgagattgaagattctatgagaattgatgatgatgacgatagtaataatattaatattggtactgttaatgaagatgatgatgatgaattgattgatgatgattatttccaagatgaatcagatacacaaagacaattacgtcaagcaatggatgctgtgaatgatacaactcggaataataatcataacaataatagaaataggactactactactactactaataataataataataataataataataataataataataataacactgataataatcatgctgataatattttagattcaagacatctagcgaaaattgctgggattttaaccctagatttttag

SEQ ID NO: 10623 - DNA, 186 bp, Candida albicans
tacttgttatattcaactgatcttaaaacaaaaattaaagaaagaaatcgtagtcttttcaggattaatatttggtcacgtgattatgttgtggtcaccaactctacttttttgggtttgataaacctactgtttgaacattttattaattgtaataatagttattgttctagtgtgtggggataa

SEQ ID NO: 10624 - DNA, 351 bp, Candida albicans
aaatttagcaacaattgtttgagaaaaagatttgctataatattctttactaacttaacttctgatgtgaccagaaatatcactattggggaagctaagcacagaaacataaatctgatatatacaagcaaactccagaattttgtcgatacatctcatacaccaaaatccgagacttctgataacaaaaaatgtggagaatgtaaacaaaaccttatctcctccatctttattttctggccacaaatgatcaatcggcatttagctaaacgaacagtactggggttatactgtttcaactatctgaataatcagactgtgcttttgcacccacaattggtcaaaacataa

SEQ ID NO: 10625 - DNA, 270 bp, Candida albicans
cactttattaattccattccggaatatcaaaatctagtaccatcaaacaataacactgctatcaattacccacctccaccacaaccaccacctccaccaccacagccacctccacctccgcagccaccgccactactactaccacctccacagccaccaacgccactactgctaccacaacccaccaccattaatgccaccgcagcttcctaccagtactattaccttgttcatctctactaccacccgtacataaacccaccacattaa

SEQ ID NO: 10626 - DNA, 186 bp, Candida albicans
tatatatttgagtcaagttatgctcttatctacttagcaggtattctcttttttacggatgaaggattatttggcaaaaatgataagctaaataatattacaaaaacaagtcaattcaattctgtagtaagtttggcatatgcacttaaactgttgactattcatgctggatgtagcaattgttag

SEQ ID NO: 10627 - DNA, 294 bp, Candida albicans
caagattatattactgacaaacatgacttggaaataaatattaataatatccatttggatgtgacaacgagtaacttatttggtcaaacaaaatccactaaaactttattacacaatgtgactgcatcttttcaagcaaataaagttaatgtaataatgggaccctcatgtagtgggaaaacaacacttctcaattatttgtcaaacagactttcacgaaattccaaatttatagcactgggatcaattcgtttaaatggtaatccagggatattgtgggattcgactttctga

SEQ ID NO: 10628 - DNA, 225 bp, Candida albicans
gtaaaaatactattgacaaaaatccctaatgattcaccacagttgatagaaacaaacccagtaccaaacattgcaaaaaacatttgtggcgttctgggtaatccacaagcaaaaacaatcaaagccgcaaaaaagaagcatggaataacttctgttggtaattcgttgattaaatatgataacccaaactcagtaaccccatatattccatcacggtattcttga

SEQ ID NO: 10629 - DNA, 228 bp, Candida albicans
atcgtgggggaaagtaaaatacattattttgttttaccaaagtacactactaacgaaaattttcaggtttttttgccatttcggtttgacttttttttgaatgcgttcaaatttaaacctctctcaacaaatagcaacctttttcaattgatattatatatatatatcacattttattttaactacttagatcaaaaacaatatataaccccaaaatggatcaattaa

SEQ ID NO: 10630 - DNA, 1806 bp, Candida albicans
ggattgaaagaaaaaaaaaagatcaaaacaaaacaatccaaaaacatagacataatcaattctaatccatcaacagcttcatttttttctatgtcagaacaagtaaagatcaatccagatttactgattatactagttggttcagtaataaataaatgtatcagtgaatacaaaggtgattataaggattgtaaggcattattcccattaaacaaattcattcttgatttgaataatcttactcaagaatatactacgaaattccctaatattgatattcacttccctcaaatagatattaaattactttcatttataatcacaaagactttatatcataaatttgttactgtgacccaagatcatgtaattattgatgtactacctcatgcctatgagaattatttgaaaaatattgttgctacttcaactttacgatatgctaagtatttattgaaaagtgctaaagatttatatgaattagaacaaaagaaattaagaaaagagaaaggcggggtgtcactacagggaaatgcacccaaagaaacaattccaacattgcaacaacaatcagcaacaccaaatgaaaagcaagaggtagtagtaccaccacaagtgaaagcgcaaccaccaaattctacaaatactttgaaagtcaacgttgcagagaataaggtagatacaataaaggaaagtaaacctatttcaaacgtacctgaaccaacgaaagttcaaccaaaacctcaaaatagtgataacaaagattctactgtgtccgagaaacctagtccaaatgagtccacatccctattggtaacgaaagagaaaagtgaagagaaagttgttgatgaagatcaaacaatggaatcttctgaagatcaaaagaatgaggagcaagatctagaagaatctaaagagttgtctaatacagatactgacaagatggatattgatgagcctcaaaaaccaattgatgataaaacatctgagaaagttgaggaggaaatcaatcaagatcaagatcaagaaatgtccgatgagggcgaggaagaaagtgctggtgtggaagagcaaccaaaaacactagaatctactactgaaccactggatgaagagaaagttgcagaaaatgaaaatggagtggaagtaccatcagatgagagtaaacaagatgaagttgctttggaagaaaaacagacagatgaggaagccgaaaagccgatagagagtattgaagaaaatgatgagaagaacaaggagagcgtaataattgaagaagatagggaagaggaaatcctgaaaaccaaggagtcagaacaagagcaagaagacaaggatgaggaaagggaaatcggaagaactgaacaagatgaatctgatgaaaaagtggaagaaactggaaagaccgaagaagaaactaacaaagaagaagatgctcatcaaccatcttcacctgaagaagaatctccatctatagaagaaattccattaaaacatgaactggatgctgatattgaagctataccgggaagtgacagttcaaaagaagcaacaccagaagtcaaacagtcaccaaaaattagtgatgatcaaggctcacaagaatcacctgagaaatctcacgatgatgtaccatcaccaccaccaccgccatttacttcatcttcagcatctcgtaaacgtgctcgttctcgttctccattgcctgttccagctcagcagcataaacgattccaaaacattgctatcaatttacttaattccattcaagaacatcgattttcttcaccattcttcaacccgtaa

SEQ ID NO: 10631 - DNA, 252 bp, Candida albicans
tcacctttgtattcactgatacatttatttattactgaaccaactagtataatcagtaaatctggattgatctttacttgttctgacatagaaaaaaatgaagctgttgatggattagaattgattatgtctatgtttttggattgttttgttttgatcttttttttttctttcaatcctcaacccaagcaaaaaaaaaaatttcaacaaataattgaaacatgggggggggacattattcatcaccaataa

SEQ ID NO: 10632 - DNA, 186 bp, Candida albicans
ttggtgtctatatcaacaaatttcaaccaaatactttgtattcctattcttatttttattcatatagttttcattttattttattcttttgtttttagagattcatcaccatattcccttattttggaccttgttgcatcaataaagcactataataatatgagtttatttgttagtataatctga

SEQ ID NO: 10633 - DNA, 288 bp, Candida albicans
aggataatagtgttagttaagtcactagcaacagctaaatatgatatttcttatactatcgaatgtctcccaacttccttattgcagggattggttggaaatcctacatattcgtttcaatgggataatattaactggatagcaaccacaataacagtaaaaaaaaaaactagaccaaactttgatttcccgcatcatgtgagttgtatcaaaacatggtacccctctaagaaactatttcatatgaatctacgtttaattggatacacagagttttactatgtctag

SEQ ID NO: 10634 - DNA, 273 bp, Candida albicans
ctcattgaaaaccagatccgtcgccaccattgggaatgggatgtcaaaatttttggtgtaactagaatgttgattcaatttggtttaaaactgatctctttttttttttttttggctcgcttctccaaaatcgagcaaagaatatcggagggcgcgttgataatagatgcagcttggccgaaggaaaaaaatagagaggaccgaaaaaaaaaaaataacgtaaacatgtctgcttgtctaataatcatacaaccacattttaatcccatttga

SEQ ID NO: 10635 - DNA, 258 bp, Candida albicans
catttatttaataaaagaaagaaatgtcctgaagatggttggcaatgtttgccttgtaaaactagaggacaagaatgtatttggccccatggtccaccaaacattagtaccaccactcatcaaacaaacctaccccactcaaatattagtatgtgtgtaataactagagcagaaaacacaaaagatgaagatataccagaagcaatggatgacattggtcatttaaatgcaaacgttatagttccttcttctcaataa

SEQ ID NO: 10636 - DNA, 243 bp, Candida albicans
aaaagggagatgaatcaaatgtatcaaaaaaaaaataaatttcaggaaactgatataagattttcgtgtgaaattctggtcatcatcatcagcagtagtgatgatgataaaattagttcacccgtatttactgcttacggaataataaatgaatgtgcacttttttttccgcatttattagattgtaagccgcacatcgtactgagagatctgatatggaatgtaaccaacccattaggataa

SEQ ID NO: 10637 - DNA, 255 bp, Candida albicans
accttaacagaactatcttctttctctcacatcaagactctcgaatgcatatcatatagcacaacagatcaaacaatcaagatgccaacaaaactttcaaataaatatcacgatgaaattgaacaaaacggtttcactgtcgttagaaactttctcctgccccaagaaattgaaaaatacactaaagcatctgaagctttagttccatatgcgttttcactcacggcagctggcaggacccgaagcttaatgtga

SEQ ID NO: 10638 - DNA, 867 bp, Candida albicans
ttatattatccttctttaataacaatgagtaacgaatcatctttaaaagcttcaatcagaaaaataaatgacaatgccgtcacaattagcactcctcacactgtattccgaatcctcaattttggtgcaagaatgagtttgatcaattttgatggcaacgttataatttattcaccaatgaagtatgaccaagaagtatttgataaggcaatcaaagttttgtttgaaaatcaagagaacccacagtatgaagtcaagtatgttattgctgctaatgatgaacataatttatgggctcatgtctacaaagaaaaatttggtagtaaaatcattgatggagaaaattgcaaattgaaaagcaattgtaaagctgatcatgttgtaacttcaaaaatctataacaaggtcatcaaagggtcaatgtggcaagacgagttgaacgtttctgatccatttatgcaaagtttggaattaattggtttggggaatcatgtgattcatgatcttgaattgtttgatacaaccagcaaaacattatacgttggtgattctatttacaatttaggtgttcctggtacaacttcaggaaatgttattttggaacagtattcaccagaattgggttatgccaaagggtataatccacatggatggttttcattcttgacaagatatttgcaaccagattcaatcatatgtcgttaccttgccaattatgctgctggaactaaaactaaagaagggaaggaggcaattcagactgtttataattgggattttgacaagttggttatgattcatggaaatgtaattgaaaaggatgggaaagatgcctggaaaaagttatttgctagctcccttgtttag

SEQ ID NO: 10639 - DNA, 840 bp, Candida albicans
tcaatttcattaatcatgggttatccatcaccattgaaagtggtcactaaaaagatttcaccaaatgttttaactgtatcttcccctttttcaattttgaataaattgaatgttggtgcaagaatggtaattttccattatcatggagacattattatttggtcaccattgccttatgataaagaaattttagaaaatgccattgccgaattaactactgaagaatataccctgaaatacatatttgtgatcaatattgaacataatttatgtgctgaaaaatataaacaaatctatcccaatgttaaattaattggaccagaaaatactgcaagatgtgaaatcaatattccgttgactgaagataatgcattaaagattattaaaggtaatgatggttggggtgatttgggaatttctgatgataaatctattattgataattttgaattgatttataataatgctcataagaatagagaattggtgatttatgaaaaaaatgataaacttcttttattggcagatatgattatgaatttggggattcgtggaactactactggtgaacatgtattggaacaatattctccagaattaggatttcctaaaggtttcaatcctcatggtggttggtcatttttatcaagatatcttcaaccaaacagtgttgttggtaaatttcttatgaatagattacaaaagactagacaaacaccagaaaaaactaaaaaagtgatggaattgattaattcatgggattacactactatcattatggttcatggggatttgataactaaagaagccaaaagaacgctttctgatgtacatttgtag

SEQ ID NO: 10640 - DNA, 222 bp, Candida albicans
catatatttattaatagacattgtccaactacccatccaggtctcaatactgcgtttaagatggaaacctataaggttgtccctaaaaacagatattgtcgtcattttgcaaaaatcgtacgtcaagagaaaccagtagaaaagcaagattcttcttcttggtttggattcaagaaggaaacaaaggaagttaaagaaacaaaacccaatcccggtggtgaa

SEQ ID NO: 10641 - DNA, 279 bp, Candida albicans
aagagaagtcaatttcttttattaacaaacttcttcttcttcttggtggtgcggaattatttaaccaaattaagtaatctcgcggttaatcttgaaatttctttttgcgcttcattttatatagaaacaaaaaagaaaaattccgccttgccaaagaaaaaggagaagagggttagtaaatactttcatttgactctgttatcctccttttatttctttaacagtctcagaatcgatctattcttagtcatggatgaattcaattgtacgggtctttga

SEQ ID NO: 10642 - DNA, 213 bp, Candida albicans
agaatcacgtttttgtcttttattaggactaattgtcattgtcgagagagaatagtggatgataatgatggaaaaacaacaatactgaataaactgtttagatttgaaggagaaggatttatgacatgtttatatagttggatttccaaaataacgaaatttcaatcaacaatttgtaataatgaaaaaataccacacaatcaaaaatgctag

SEQ ID NO: 10643 - DNA, 201 bp, Candida albicans
ccgcgagattacttaatttggttaaataattccgcaccaccaagaagaagaagaagtttgttaataaaagaaattgacttctcttctatttgttcgtcttattgtttggttaattcgcattttcaacgaatggtaaaaaaaatggtaaaaaaaaagttaatcagtcatccatccaacgttgttctcctttataaaccctaa

SEQ ID NO: 10644 - DNA, 348 bp, Candida albicans
aaagtctgcaggtttctttttgtatgtacaaaatctttacttcttcacattcattatagatccaataaatatttagtaattatgtttatgagaaagttaacggtaagtttcaaatacagattttatagtcatgttttgtttaagtcacgtgaatgtagttacttgcaacacagaatatgtagtatgaacttgaaattctataaaccggtactaggtttttttggagtggtgataagttatggtatttattataaatatttgtattttttgttgaatacagtagaacactacggtattggtttggttaattcgtttaatcaaaggggtccccaacatttggttgacaaa

SEQ ID NO: 10645 - DNA, 465 bp, Candida albicans
  unsure (139): Identity of nucleotide sequences at the above locations are unknown.
aaaacaatggtaacgtcacatactggagaacaattgtcctactcagtattaagaagcaaccttgcgttctcgataattacaatccatggttgtaaaatattgcctgctaaattaataaatccaaagatcccagcttatntacccgaaattcaacacctggtctcgattatattagaagaactaagtctatacattcctcaagataactactcatcgtcaatttgtattgccagtttattcttttgcggagtagccataattaacaagcctcaacaagatttattgtgttataaattgtctaacttgaaaaataatctttcgcaaatagttgctgacaacttgatatcaattttgaaaaagtgttgggacagagaaacaacagagcgggctatttttggtgataaatgttacaaatgctttgatacaatatttgatcgagaaatcctcgaaagtgtcgccttttga

SEQ ID NO: 10646 - DNA, 204 bp, Candida albicans
aaaagtgttgggacagagaaacaacagagcgggctatttttggtgataaatgttacaaatgctttgatacaatatttgatcgagaaatcctcgaaagtgtcgccttttgagttgtatatgtatgcatttgtatattgttttgcaaaagtctataaaatttatacttgtttttcaacccaacatacttctttttcttcctcttaa

SEQ ID NO: 10647 - DNA, 1008 bp, Candida albicans
  unsure (993): Identity of nucleotide sequences at the above locations are unknown.
gaaacaaggaatatgtcagataatagtaacagttctggtggctctaccatcccatcattgtgttatgtgattccaccatatttgttgaattcgaattatggatcaaacttacaaaaacaattatttgccaaaaaccaacaaatgggattacttaatgttattctgactgattccaaaaattactacaatcatttcaaagaacaacaacaagatcaaggagaaggtaataataaacgcaaacggaaattcaccaaagatccttatttgaatgaaattataaaaatgaaattaatttataaattgagtatccttggagttcttggtgacaacccaatggaatttcttaatggtaatgataatgatgactacatttatgatatgtttgatacttttaaacgtcgattaattagtagcgatgacaatgacgatgataatggtgatagtaattctagagatgaatctaaaattggtgatggaagtgatagtggtgatgtgcagttgatgctagttgatgctcttcgaagaaacaacaaggatgacagcaataattataaattaccgaaatcggtatttagtaatgggaataacaaaattggagaagttgaatttaatcaattgagtggtataccatcgcaatataaaaagtatcttagtatgtccttaaaagatttgattttactgaccaattgtcacatcaatgatagatacaactacccaccaagttttattgattttggtaatgatgagtttttcaattataccttgccaattacttggattccattaatacccaatcgttatttgagtcatttagaaaaacattataatttagtaatccaagatgatcaagggttttctaatatcaaaatgtcaatagatacttctcccaattctgcatcatcatctggtgctaaaaatggtgatggttccaatttgtatcaacatgatgaaagccatgacgacattcctattgatatatttgcccaacagaanaaaagatccagttcg

SEQ ID NO: 10648 - DNA, 237 bp, Candida albicans
acagaattggtctttttcaacattacctcattgtgtgtgtgtgtgtgtctgaccctattgatgaattgtgggggtgttgaatttaaatgtaaacgtaaatctagaattaatgggaattatattacatcagatcttaattgctatagtttctttactgagcactgccatgaaaaagctttttctaaccaaaaggttatgttaattttgtggagaagagattttgatattgtattataa

SEQ ID NO: 10649 - DNA, 219 bp, Candida albicans
aagaagaatagttttgttgtttgttgtttgttgtttaaaataaaaaaaaaaaagaaaataaaatttcacgcgtcaattccaaacacgcgtgaaataaaaaaaaaaagagaaaaaaaaaaaaaaaactacacaacattgtcatgcgcttccgacattatttttgcatgttcacaacattatccattacacgtccccccccccccccccctctcaatttaa

SEQ ID NO: 10650 - DNA, 192 bp, Candida albicans
  unsure (64): Identity of nucleotide sequences at the above locations are unknown.
accaaacggtttaaaaaaagacgacttaatggggttataaattgtaaatcgaaaaagacagatnagaattctgaaggtgtttctctttacggattagccccagacttggacttgttcatagaaatcaactctcttcttctctggattgtcaattttgtgggcacaatagtaccgaatctcatcaaccattga

SEQ ID NO: 10651 - DNA, 393 bp, Candida albicans
ctaaccatttggatggataatatggttagtattctggaaaatttcactaattcgttcccacgtaatattactgctttgaactcccaaaaaaggggtatgccactacaagaaacatcaccaaacataataaacaaatcaccgataaaacaacaaccagtttcagtgatttcatcaaagaaaaggttagcagggagccctgtatctttacaacgcgaatctgtgcggttgaaagtcaataaaccagaatctactccaacagattttgatagtacatttggaaccactgaagctgaaatcgaattaaattatagaaattggttgctagaaaggcggttacagcaagctaatgaaatgaaagattttctaatactagagcaagaagtatcgatatag

SEQ ID NO: 10652 - DNA, 543 bp, Candida albicans
tatatcgctatgcttttcaaatccgtattacttagcacactaatagccgttcaagctttggcagagaacctggctcatcaagaaatcgttactgttactaaaactacacatataagcaacccttgcttagaaaactatgctaaaaagttattaccaaacaacccaactggattaactactggtatacctatagtgatagtttacgcaccacaacaaccagacaaccaagtaaagcaatcagaactgctacaaccaacacaactgtcaaaagcacaacaacaacaacaaatacaagggtcatctgtaccagcttccatacatgataccccaactccaactgatcatactaaaattactgtcacgagcactaccatatgcaaccaaaaggtgtgcactgtaaaaactttttccaccataatttctcacagtgagtctcctactactactactactaccaccaaaccaaacaaaatgaagaaaagtctattgctgatacaaagtctttcactcacaaagccctccccagctccaatggtgctgtga

SEQ ID NO: 10653 - DNA, 192 bp, Candida albicans
acgataaacaatcgacttaattgtaaattaacaataccattccaaatcgttcagcattatagttttatagcttgtgtaacacaaataattatattgcgagattatcttaaacaatataccaagttatacaatgaaatacaaaaaaaaaagcaaaaaacttttccggaattagaagatccagcatcagattga

SEQ ID NO: 10654 - DNA, 294 bp, Candida albicans
ttgctagcagtttcgtcactagaccctgtttcaacactttctgaacttgaactggagtcggcttccgagcttaaactggagctaagttcaacagaactggaagaactgtggctaagtgagctatcagatgttgttgcagatactaattcagaagactctgtagtagatgcgattgatgaggaatttaaaaatgaagtgctagataacaatttggaactcgatttttcaagtaccatagaggattcttctgaagaatttctcatagtacttgacacccgcgatgagtttgtgtag

SEQ ID NO: 10655 - DNA, 963 bp, Candida albicans
ccagctatggatttttcagatagggcaccattatcactagatagggatagagtaacctgcttgcttttgattaatactcacttgataaaaaaatgttgtaatatatataataccatgctaaataatcaacaattgatgcaacaaatgacaccagaaaatagggccatgttatcaaatgtatacaataattatattagaagactccaatgcaacttggctactttgaactatttatatgaaaaataccattcgacacagcatctgcctgtggcagccaaggcaagtttccctatgatattgtctgcccctccagatatgcctgaattgaatcaattatattcaaagcttcaagagttgtatcccgaggcagtgcaatattttaaaattaaatttgaagagagtagaaagcagcaggcatttccggcaccacagcaaaatcaacctccgccacaacaacattcacttcatcaacaactcccacctcaaccgcaaccgcaatcccaaccttcacttcaacaacagcaaggacttcaactcccttctaatgttccgtctcaacctgtgcaacaacaaagtttccgccaactatctacaggttcagaatcaggtcctcaaattatacctcaaagagctccaccaccaccacagcaacaacaaccgccgccaataccaccacagcagcaactccaacaacaatttcaacagcagcttcaacaacaacagctcccgcaacagcctcaacaacttcaacaacctcaacagcctcagcaatcacaatcttttgacgacttgcttttaacagatgggtttaacccatccagtgacagtcttggtggaacaggtcctggtgattttaaccctaactacaataatggttcgttccagttgtctacactttcccctcaacagatattacaacaggccaatgagaatacgcctatatctcaagatttcttattttga

SEQ ID NO: 10656 - DNA, 243 bp, Candida albicans
tttagaatcgaagaaatcagtaattttttgagtgtggttaagcaacaacacaaatcaatagtggatgtattaccatctgcaaaggtcgacgagactgatcattacaaaagagacccttccccaccaccaaagtacgacaagaatggtaacagaactaataccagagaaaggagagttacagaggcattggaaaaggaaagacacgcgctagtcttcaccacggcgtggcagatccgagcttaa

SEQ ID NO: 10657 - DNA, 348 bp, Candida albicans
  unsure (84): Identity of nucleotide sequences at the above locations are unknown.
gcttgtcccctaataataacagatgagacaactgacgacattatttatcatctcttaaagtcgcattttagggctatagccctnaacttgggcaagaagaaaaaaccattgttgcgcatatacacgaccacattactaagcatttcctttccttttgccattttccattttgtctggtgttgcgttttctcacacattgacaaaaaaaaactggattttcaaaaaaatctctttcctgacctatacttaaccaaagtaaagaaggtatgtttcaatagactaccgtatagtattgttaatatttatgaagaaatgggagagattaatgagataatgttactggattga

SEQ ID NO: 10658 - DNA, 471 bp, Candida albicans
atggatcaagataacgaaattgatagattacgtgaaactgaattatggaacaacaacaacaatattagtaatactgcttctgatcctaatgatttaactttgccgtcatcaataactgcatttgatcctattcaacaacaagaattagaacaattacaagctttacttgatccatcatcatcattatctcacaatgaagaacaacaacaacaacaacaaggacaacaacaccacttaaaaaataatgagacgtctcaatgttggattagagcattaatatttattggttattgtatatcaacagtatttttttcaatacatttatggattcaatattttttcgtcaaatatacttatgatgatcaaacagcagtgaatatgttgaattatgtgactgcagctcaagaacaagcgattgatgaatatctgagaaagacagagaggcggaggagtagagaaagtgatcaataa

SEQ ID NO: 10659 - DNA, 195 bp, Candida albicans
cgacgacgacgacgcggcttatcaagatctctaacggatattacacaatcaaccaatgaccatctttttgcaactattacaaatttccttacaattaatatcttaaagttactattaattagttgtcattatttaaataaaaaaataataataatagtaatgtccaatattaaaaagaaagacacattacaataa

SEQ ID NO: 10660 - DNA, 252 bp, Candida albicans
aactcctgctgctgctgctgctgcactgctagaaaaactactcagttaggaaatgaattccaacaaatgaaagtaaagttcgttataagatttactgagacacacttttactgcaattattattatctaattgatcaacgaataacacacttttctactaataatttaaacagaaaagttatttatttattaaatacatctctaattaaaattaggcagagtattggtagtttgggaattgttgcaagttag

SEQ ID NO: 10661 - DNA, 237 bp, Candida albicans
gtgttacctgtaattacagtcaaagaaggaaaagaaagaaaagaaagaaagaaagaaaagaaggaaagaaagatacaacggagtgttattttttttttttcaatgtatgtgtgtcgtggtggtggtaagaagtgtgtgtgtgtgttgtccggaattgaagacaacaacactaaaaaaattttgtctcctaatttatttttagtgtgtgccaaatttgtttctcaacgtgtcttttga

SEQ ID NO: 10662 - DNA, 261 bp, Candida albicans
  unsure (114): Identity of nucleotide sequences at the above locations are unknown.
ttcaaacttttagagatgaattatctgttcaatttacaagtgtattgggaattggtctggattaaagtttttgtatttgttgctaattcattattacaatatggagaagatatngtatcggaatttagttcattgagtgaagatgctattccaccattgaatattcaaagagaaagaatgctttctattgatacattacctactcctttctcttccattacaaaaagaagaacaaccaaaggtagaagaagaaaagtttga

SEQ ID NO: 10663 - DNA, 1752 bp, Candida albicans
cacgaaggaggatataccaatatggattcacataataacattgaccaatctgtatcagaattgcttctggatccagcatcagtacaacagctgtataattcacaactacgaggtccagaattcgatcaacaacgacagatccgcaatcaggtgctgccatttaataagatgactgacaccatagataatgacaatatacctctatcgagtgactatgacaagctatatcaacagttcagtattccatctcaacaacaatatgaaaataattctgataatgtatacaaaacaaataatgatttggcagcattggcatcaccattaaatatggatcttgatttggctccatcagaccagcaacaacaaccgcaacaatcacagcagcaatttttaaacgatttctccaatttgcaacctcatttaaataattcacaagaacaagttcagctaaacggtttgacaagtaatatcctatctaatccacagattacggttaatatgccgggggcttatcatcagaattataattgtgaccagatggaaattgacgactcaccccctttcacaattgaactggacttatattttgagcaacagacagataataattcaatagtaaccagtaatcgggtacacaaccaaccagacgtcgagtctatgttcaataaccaattatcagtgcccagtctacagcgtacggaattactgccacagcaacatgaaacaaatgtgacaactggtcgtccccaagaatctgcatttggctcatttgataacaattcgcgtgtctcgtcattcgcaaatgtaaataatgccggtacaaatttgtttgtcaacggaaaagatttgtactttgatgatgaaagccatcaccgaactgggagattacggaatggctctattgacagttattatgctgctaatgtaatcaaccatcaattacatttgcaacaacaaacacaggcccaggcccaagcccatcagcaacaacaacaacaactgcaacagcaacactctccacaggaccttgcatcccacactagtttaccaagcaaatcaatatataatgaattatcaccattgacaaccaccacctcaagagcttcttcaattcagtctggtcagccatcatttttttctgcgcaacaatatttcagcagaaactcaatggatcaagtgccctcctcattacaccgtccgtcttttgatttgtataatcatcgtccatcaatagatagtcaacattcgcaacaactgcagcagagaaatgcccgttatacaagtttcacaagttcaataagtaatattttaccatttatgagtgaaaagaacaccaaccacaataataggtctccacctacaccccctacttccatttcgtcaccacagaatttgttaagctccaatcaatcaaggcatttgattagaagtatatttaagaccaatccaacccctattgtatctgatgcaggtaattctaatggtaacattgttaatggtggatcaggaacaatcgatgctgaaaatttgcctgacgctccatatgcaagtggtactattaatgattctgagtttttaattttgtcaagtccgactaaagaagaaccagaagatgaattaatgcaaccaaaaaaagttaaaaaaccgaaaagaagtttgtttacacgattcaagacaccagttaaacaggagcaaccggatctggaaatggccgtgtccgctcctgtagacgtgctcaatagaccaacaggc

SEQ ID NO: 10664 - DNA, 213 bp, Candida albicans
ctatcacgaaacaacaaccaacgggcactacgtagaaaccacacttacactagaatcaatcctcttttgtttatatgtttcatacaatcaaacttaaacaatagaaagtatttggagtattgtttaccaattgtaagtacaattcattttttttattattttaacaatgtgaataatcaatatccaaaacaccagtttacttatatcccatga

SEQ ID NO: 10665 - DNA, 285 bp, Candida albicans
cgatggaagcgcgcgcgtatgtcaatttcctgtcacgacgtcacttcctgtcaagttcaattgtggagtgggccacttatgctaatgaagttaatgtataagactaagctcaacgggaataaccatgagccattagcaccaccatcaactgagtggactgaatctttagcaggtgaggtacaaaaaaaggtccatagagttgcaaataacctggttgatttagtgtacattctattcatttctgtttgtcatgacaatcataccaataataaattacgagaataa

SEQ ID NO: 10666 - DNA, 204 bp, Candida albicans
  unsure (7): Identity of nucleotide sequences at the above locations are unknown.
agaagtntaagtaaagttgataagatcattcatccaaattatttagtcaatattattaatcatatatcatcaaagggggataccgaaaccgtgtttaaagcatatcgaattgatgattattcattagataaagtcaataaaaatacaaatttagaattaggatactcgacaaattcgaaatttattaatggtatgcaaatataa

SEQ ID NO: 10667 - DNA, 183 bp, Candida albicans
aaatgctacttaaaaactggaaaaaaagaaaacgctattagactaaaagataatacaaaatgggcatatatttgccaattaaaattaaaaaaatcaaaagtagacctttcaattactgttgggagctttgttgttgttgttgttgttgttgaagcatcaaatttacccatggttgacgtctga

SEQ ID NO: 10668 - DNA, 243 bp, Candida albicans
caacaactgtttagtatatatttacataaaaagataaaaatggccaattcagatgatgatgatgcttttctttattcagatgaagagcaagaagttgaaaaacaaggaccaaaagttaaaagagtaaagtttgctgatgaagaaagcaacaaggaggaagataaaactaatgaaaaagagcaacaacaacagaaacaagcagcatcaaatcttaacgaccgccgtagaagattcatctcatgg

SEQ ID NO: 10669 - DNA, 186 bp, Candida albicans
  unsure (19): Identity of nucleotide sequences at the above locations are unknown.
gcatcgcgcgactttccanggcctgtggtggcaaaacatggtatgaattacaaacaaaaaaggaaaattgtattgttgtgttataatttattgatgactgtactcaataatttatctattgtgtcttgtcccgttaccccggagttttatatatatttttttttgggttcattcagttttaggtaa

SEQ ID NO: 10670 - DNA, 189 bp, Candida albicans
tttaccccagaaaaaataataatattactactactactgttgtttttcatatgcccacccaattgtattctctcttctgaaaaaaaaaatttatctagtaacttacaattgaaatttgacccgaaatcaaaaaaaattgtatataaacaagaacaatccagtcttttttgtagagtcggaattttttaa

SEQ ID NO: 10671 - DNA, 678 bp, Candida albicans
agaatgaatagtatagtgatccttggggtaaagaagttggaactccatgttgcagaggatcaagaggaaagactcacattttctgccgatttagaagatttaataatctatagtaatcggtcaattcaaatgaccttacctcccaatttgcggaagttggacatatccgcatttaatagtctggtaaactttatatcccagcaaatggttaatttagagaatttactgcttacattgccaaatattcaaacttttaatgcgacaggcattacagctccaaatttaaaaactttatttttacagtgtgacctgatgaataatcttgatgatttacggcaatttcagcgtttgaacaaattagttcttaaaggtttctattatcccattggtttgtttaatgaaggatctttccctgaattagaaaagtttcggtgttgggaatgtttttttccggattcagaagattttgacaattcactgttaacctttcctccaaatttgaaagaattagaaataaatgtcatccgttttcaaaatgtcaatattagtagttcggtttttccttccacattaacacgtttaactcttgctaatttctcatttaattatgattatttgggtgataacttgcagtatattgatgttcgtacttctaaacttgtatttaaaagtgatttg

SEQ ID NO: 10672 - DNA, 495 bp, Candida albicans
aaacaggacactcccaccaccatcatcgccactcctgaaatctttaacacccccttctttgattcatttttattttatcttttcagtttcaaattatactacaaaaactttttttttatcagtatcatcatgttggacgaattatcatacaaggttttaactaatctagagacgagttatgaaagaaaacaaccgttggggtcaaaattgatcgataggtatactttaaccattgaccaatcaactgttgcccaacaatcatattttgaacaaatcattcccgcaatcaatcgaatattgatgaattcagaagctcatgtaattgatcctgatgatgtgttaattcgattattaccggaaattttaagccatttaagttttgaacaaattttgatgtattatcccaatgatatcattttacactttttatttgaggaaaaattagagaatgtcagtgtaatatgtcttgaaataatgttattgaatctccagtaa

SEQ ID NO: 10673 - DNA, 228 bp, Candida albicans
ttcaacgctgaacacaattacaattctgtgatatctggggttatattatctctccactatataaatgacctaaattcctcttttgcatccaaaaaaattttcttttcttttcacttttcttcttttttttttccatctatatatcaatatatttttattaattatttaaatcaattgtttgttcacattcctaggttgttgactgctttattcaattcatattgttaa

SEQ ID NO: 10674 - DNA, 324 bp, Candida albicans
attatgatgtcgcaagctactcctagtgctactcccgtgagaaatgccgatggacaaaagaaaggcaagaagcttccattaattgttgatgttgcaattggtaataatggtaagcaactttaccaggtacacgaatcttccaagatggtaagaaaggaaatgccaagatctaccaattttgctttgaatgatgacatttctgatgaagggttttttataagccaaataaatgaacaaagaactcccattagaaagactttgggtactttgtctccatctagtctcaaccaaaagagaatccgccatgatgtgtactaccaatga

SEQ ID NO: 10675 - DNA, 192 bp, Candida albicans
gtacatggatatatccccgtgatttcttccaatttgatttttatttattttcaatttaatcaattcacatcaattagtttatatttactattaatacctcacaccaactcacacgattcccactccaatctagctgccgcttgttttaatttgtatccgctagttttttattatttttgtttttttcattga

SEQ ID NO: 10676 - DNA, 219 bp, Candida albicans
ataaaaatcaaattggaagaaatcacggggatatatccatgtacttatatattattttcaagaattaaaattaagggaagtcaaggtccctgtctaattcatattttgtatttgatgttgtttgtatttgaggtgcatttttttttttactctctctttatttttttttctttacttcatttaacttattctgcttcttggtttttgtcgcctttgtaa

SEQ ID NO: 10677 - DNA, 189 bp, Candida albicans
gtgtcattttcatattttgacagctacaggcggaatattttagtgataaaaaaaagaaattggtggttgcacaattcgctaaaccaaaatacaaccaaaaatcgttctaatttaactaagattctacataagtactatttacgcgatgagtttggtcatcccaaccttatggaaggcggtttcaattaa

SEQ ID NO: 10678 - DNA, 237 bp, Candida albicans
ctaactaaccaactattacatcttctacatcaccacttctctcctttttttgttccaataccctccaaaaaaaaaaaagacatagctcaaaatcacgaaatccctcccattttcaaaacaaatttggaattccatccattaatcaaaatcaccaaagagaaagaagaattagaggaaaaaattttctgtttttctttcttttttaattttttgtttgcttctgtacttttactttga

SEQ ID NO: 10679 - DNA, 204 bp, Candida albicans
gaccaagaagtcgacataaaagaggcggggtggacaggacaggacggaggtaacaaaaaacgggcgataaaaaaagggactcgggaaaaaaagaataaggaagaggaagagcaaagggaaggaaggaacggaagtttgtctaattatataaaaatgataaacaaatcaaaacaaagaaagaaagagagaggttttgtgatataa

SEQ ID NO: 10680 - DNA, 273 bp, Candida albicans
agaatacaagacgtcgatcaattcatgccaagaataatatcaaagatcgtggtcagtcccccccagaccaaatcgggtaatttcaaattatatataattaccaattgtatgaataataataataataataatgataatagagattccttattttcttttttctctctctctgtttgcttaacgaaaagtagatcaaattgtcctcaatacatgtcaattagattattattatcatttgaaaccacaccacaatttgaggaatctcaatattag

SEQ ID NO: 10681 - DNA, 186 bp, Candida albicans
tggtcaacctcctttttgcttttgtacattagttattatttctacttaaaaccaaacaaaaacttatataatcaatcaagagtattttctttgatacaatgcatcatttgtttttctattttgtggcttacaaatgaaaatgaaaacgaaaaagaaaaagaaaaaaagaaggtcaatataatataa

SEQ ID NO: 10682 - DNA, 186 bp, Candida albicans
ggacaatttgatctacttttcgttaagcaaacagagagagagaaaaaagaaaataaggaatctctattatcattattattattattattattcatacaattggtaattatatataatttgaaattacccgatttggtctgggggggactgaccacgatctttgatattattcttggcatgaattga

SEQ ID NO: 10683 - DNA, 189 bp, Candida albicans
attaaaagaacgtctcatgattggtttttgttttttcttctatgtattacaaaatgcttgaatttgataggccagtttctgaatgccgcaacttcctattttggtggattgaccccggggaaaaaagaacatagaggattgcaacaacaccaagaagaaataatcttcaccacacggctggaaggaccc

SEQ ID NO: 10684 - DNA, 195 bp, Candida albicans
tcccgtagagtgaagacaaatggacctgaaaaaaaaaagaagacaaaaattttccgcgacttcggaaaaaaaaaattctgtcaaaaaaacaccagcgaaaaagaaacttcggttatggatggagggagaaaggacctaaaaaaaaaaaagaatgttcatgaaagtcatctttgcaaagggggcttaaataaatag

SEQ ID NO: 10685 - DNA, 216 bp, Candida albicans
catagccccacccgaaaacggctatattcaacaatttttttcttgtatgctaagtgttacacttttttgtttgctcgcgtgagtgtgttggcgttttttcaggggtacatgtcgtttactttcaaacaaccatctatggaacacaaaatgccaggacacccacaattactgaaagattgtttgtcaatatctaccgagttgtctctaaatagatag

SEQ ID NO: 10686 - DNA, 909 bp, Candida albicans
gaagtacatcataaaccaaccacaatcatgaaactagaaatgagttcatatttgcacaaagttcccaacaccggtatcacaaatctatcaaacctgaaactgatattcttcataatgttctgtgcaacactactatttattataacatcgagtcgatatttgactggatcagagtctctcggacaaataccaagtgaaattccaaaatcgtcggagcaattgaatgaagagctctcacaacaaatcaattctaaattacacaaattggcatcatttgataagttcaattcattcccattgctaaataaacatatgaaagatgatatttatgggtcaatgacattagaaacttttactgatccacttccgtaccttgagaattacaatgaagaagagtattcacaacagaactatcctatttgttcggaaaagttaatgtttccaagtaaaatcaaactcacaaaacaacagtatttactagcagatttgcaacagtttttgggagttttgaataatatgagaccttatcacgatatggttgaaaaggccaaagcatattttatctctgatttacgagaagaaaagaaatggttcagatttgctggatcatcaatatggctaccacaatttcaatgccattacatggttagtcgttatttatattcacctaatggagtggcaaatcacgcatttgccagttttttgtatatccagttgtttgattctgattggaaagaactaccatcacatacaacattggatatcccgtttgaacgaacagaagcgaactgtatattcgagattttcaagccaaaacagaaatatgcaaactttcgaaattcaacataccctcaaatcttgcgtattccgtttgattatgaattgcccatagaaacaaaaaaatattag

SEQ ID NO: 10687 - DNA, 1074 bp, Candida albicans
tatggtccggaagatccaagaatattattacgatcgaatccgttggggtttgatgaacctttgattgtatttaatatgaaggggttaaagttaaccaagcgagtaatgtattcttatctaccattttcaaacactttgaaacttttgaaaaaaagacgagagccttttgctaatatagaaaagaattggactcctttcaaaagtgtggcacagccaagtaaaacccaaacgactatacattttatttattcgatgatcccgttagaagtattagcatgcgatattgattcaggactttgtgatattttacaaaagccagctaaacatgactttaattatgttggtggattacgaggcggaactcagttggtttcattgcctttgaatgaaactatccctagtgaaattagagccaagttgccaataccaaaaaacaggcaagtttatattgggtgggctagaactcacttgaacaattgcggatgtggtgattcaatgtatcgaccaaactttataactttggttgaagactacgatgatgtaactgataagtattactacaagattggagatatttccggatattttgattttgccgcaaagatcgaaccttggtccaaacaagttttggacgaagaaggaaatttatacgaaaaggctgaacagtgccaaggacgaaatgtacttatacccaattccattgcttattgggatgttggatcaattaaacttgcgggtactgaatatcagaaacacgatttcaaagacatgttttccagtggaaaagtgtcagattttaatgccaatgaaatcgtctttaatgattatatgggcgtaacattatcttcagcagatagagatgtgagcattgttcatgtgaaaggattattaaactatattttacaattgcccagtttagttgatgactcattggttattaacaaagaatggacattccaaaagaaagggcatgatttaaatgttaggtgtgctatgattgctagtaaagagtactgtaaatcttatgcaataaaacaaggagtgaagatagatgaaaaatctgaggaaacctga

SEQ ID NO: 10688 - DNA, 216 bp, Candida albicans
ataatgcctactaaaacggccctcttaattagctttgtattttcctcctttttttataaattaatgccaagccatttttatttcttacagatacgtatacaatccttacatctgtctatattattggatattcaaagggttactatgtatgcaatgttgttaatttctagagtgaaatggcacaaaatcttttgcagagatgaattagccaattag

SEQ ID NO: 10689 - DNA, 183 bp, Candida albicans
attaatggatatggtggattatatcaaagtttacaaatgtacaaggaggaaaaattaggccatgccttaggtttggttcatttcagtctcttatctttacaaagtaaacaagctgtcattacagagtctacaaaatcaaccaaaaatataattcgcaatgtgagaatgaaattcaacaagtaa

SEQ ID NO: 10690 - DNA, 240 bp, Candida albicans
attctcaatgacttgaattatctgtttgatcaattgatcaaagtaaatctcaagtttactaaagaaaacaacaatttgaaatttgatactatagttaaatggctggatatatatgttgacagcaaatggcccactggctgtcctatccccatttctgaaattaaaccctatgatccccacccaaaccaagaagtaactgaagtaaaactagattataccggtcgcggagcatactactaa

SEQ ID NO: 10691 - DNA, 204 bp, Candida albicans
attttcttcatggtcatacaacaaatccataacaaaccaccatcccatctagtaatcaacgcccctttaaactatgcaagttatatgaaaattgaatcaagtaatatacaaagaaacatgaaacctaataaagaaaaaaataataaacacatgtctatacagttaaatatctgctttttattgttattgttgttgtcgttgtag

SEQ ID NO: 10692 - DNA, 234 bp, Candida albicans
acaatatctcttgtttatgaaacaagcaattacaacaatacaacaaaaaagaaatatatcatacaacatttaataaattatatagaaacaaaacaaaacaaaacaaaatacacaattaaatataaatcacgaagaactaaaaaagaaaatacaataataataataaaaaaacaccaaatcaattatgaacaagatgaaccaaagcttcatcatcatttacaatcgaaccaataa

SEQ ID NO: 10693 - DNA, 183 bp, Candida albicans
gttgaaactctaatacaagcctcatacaattatgtaatccattatgatgataacaataataatcgaaacgaatggaatcgaaacaaaaaaagaatcacaaaaataaaaatcacccaaaaaaaaataatgagaaacgatttgcaagattacactcttttctgtactcagataattaaatcatag

SEQ ID NO: 10694 - DNA, 321 bp, Candida albicans
ggggcaaccacaactacaccaacagccattgcaaggggcaattaccagttcagtagttccaccaactgttcaatatttcattatcatcacctaatgctcaatatgccatgccagttaccacaacaaacaataggcacttttgttccacttatttcacaaacatttggtgtttcgtacacgcataatacccaacacccttcaggtaatatggatcttatgatgctttcttctatgaataccggatatggaaatatcacgaataatcaagattatcaatttggtaatataggatacacagaaggatttactagtgagttttag

SEQ ID NO: 10695 - DNA, 504 bp, Candida albicans
  unsure (413): Identity of nucleotide sequences at the above locations are unknown.
ttacatccaaatatgaataaacttcccaaaggatggaattttaccatagtggacgacaatgccgatctgaccaactcagaaaacatacaaggaaaaagaccaagaaggtcaagaactagtgtacaaaggagtgacggggcttctccaattatccgagacaatatagtcttaataagaactgacgataatgaggaattcaaagtgggcgatactatagagataactcaaggaaaagggccggaggatccaaccactgaatacggccttataacagaaataaagttgggaaatagtgagtttattgaagtcatcgttgattggtttatacggtcatccgaaatagttggtatgcccaatgaattttttgcagacaatgaattgttgttaactccgtttagaagtgaggtgaaatntattgattttattagacccatcaatgttctatctgaaagccaatttgcggatgtggtaataaacgagtctatttcccatcccacgttttag

SEQ ID NO: 10696 - DNA, 198 bp, Candida albicans
aattccatcctttgggaagtttattcatatttggatgtaactaaggttgtgttgagattgtaccgatcagaaaaaactggcacggttttgtttgttaatctgaatcaaaccaagttgtctgcgttgtttttttttggttctgtttttggcattctaccactgttaattatacttcgcacagaattgaattatttgtaa

SEQ ID NO: 10697 - DNA, 294 bp, Candida albicans
  unsure (21): Identity of nucleotide sequences at the above locations are unknown.
actcaccattattacgtattntgtgacctttctataccaagaaaagtggaaaacataggcttatcattaaagatcaagtattttcagggaacagtaaatgatgattttgacgatggagttacatatggacaagaaccagaaccagaaagagatagagatagagccaattatgctgaaaccgattacagtaatagttccgaagatgaatctaaagagccaccatttaaaaaacatgcatttgatgaagaacttggtcctacacaactcaacaataaacctaaatcaatattttga

SEQ ID NO: 10698 - DNA, 186 bp, Candida albicans
aaagtattctcggcaacaggttatgaaaaaagcaagaaacatattacgtcagattttgtactccatatagatatagatatatatattctaacacagccattaattaattttgttgaaattttcgttcattcattcattttttcattcattcattctttctttaatacagacaatctcaaaccatga

SEQ ID NO: 10699 - DNA, 189 bp, Candida albicans
ataaatgccgggaaatcatttaactttaaactctcccggatatgtatacaatgctatttgttccccccccgacatgaaggactaataccttatttacatcatacccccggtttagtaattcccccctatatgttggggtctggtttgggcataacagctacttataatttaaagtgtttggttcccccc

SEQ ID NO: 10700 - DNA, 228 bp, Candida albicans
gacaggtgggggtgtttgctaatgattgcgagaacagaagaaaaaaaatactgtgctttcagatactactactttttcttaacaacaaggacaactaagcaatcacgattaattatatcattgtacaatttcaacatagagaactacttgataaagactgatcaatattctactataccaatttattttttttttcaaattatttatagaaataatcaccgcttttag

SEQ ID NO: 10701 - DNA, 387 bp, Candida albicans
ttctgttatatctactcaaaaaaggaaataagtcaaaaacctaactataccaaaactccctcctttaccttgatgccacctaaacgaaaccaaaaaagtaagctttcactttcaaagacatttgagcaagttgatgaagaaatcgaagatgaaatttttgagacatactcggaactattaggtgatgaagtagagaatcaagatgtcactttaagtcaactaccacaaatactcagtgatttgagaattcccaaatgctttactaaagatatcgaaaagtgtattgactactactacgattttatcaaagacaaagatgtacatttagatcctttgaatacgcgtcagcaaaataccttcgcaatgatattttcaacagccgccgga

SEQ ID NO: 10702 - DNA, 198 bp, Candida albicans
cccttctgtcacacacaattattaaagttgtggggagagaaaaaaaatgaatgtgaaaaatcaactttagcttcaaaagaggtgaacccaaatttcgtcattattattatcccgacgttactggacaatagagttacaaaaacccaactgccacagcaactcaacttacagtatggcattcttattgtaataaaatga

SEQ ID NO: 10703 - DNA, 342 bp, Candida albicans
aacaatagaaataatgccgatttggcatttcatactgaaaataatgggaattcaattaaaaatgggaaaagcatgaatagaactggaagtcttttaagaaataataccatcaatgctaatgctactgcaaaagccagaaagcaagctgctaaagaaataaaagaagcaaaatcagatccgattgccagtaaaacatctaaagaagatataattttaagaatattaattgcaagaggtaaaagaaattatgtttgtcaaagattaaatcaaagagcaaaattggcttatagtatggccacggaaagaatggctagagcagcagcagaaagaagattcaattga

SEQ ID NO: 10704 - DNA, 243 bp, Candida albicans
gccttttgtgtactaagaaaaatgtcgttgaatactaagccaatgactatttttctggcaaatgtcgtgtcgcaaaaaaacaaaaatttgagtgtcgcttttcaaaatggtccaataagaagaatacaaattcttgttatatcaaatatcaacaatttgatgggaattttggatatactaggtattatgaggaaaacaggttgctatacttggtgtaaagatttagtattaaggtggttgtaa

SEQ ID NO: 10705 - DNA, 204 bp, Candida albicans
gggttttttgaattcaaaacacgaagtcctgctttgaacaaggaaaactgtcttgagggtgtacagttatgtaataagatcgaagagacccaaccaattgatagttgtattgtatttgggagaagatatgactcatggcccttacatatagtacagatttttaatgtgaaatattttcttggagtcggaacacccgacggctga

SEQ ID NO: 10706 - DNA, 1980 bp, Candida albicans
cttaatgataatattaaaagatataacacagtttcattcactactttagcatttttcataataatcatgtcgaatactgagtatatatcagattcggaggatgattcactacgaggggaattattagtagataagaataaatttaccaatattttatcaacactatctcccagtaaacaagaactaacgagacaacgactagaaacattaacaaatatatcgtatgtgaatatagaaaatagcacctgtagtcctcgactagggcataaccaaaacagcgagacaaggaataccattaacaacttaatcgaggatagtgacgacgattcagattcaaacccaattgatcttattaaaaatctaccgagaagatcagctaacgagatagaacaacgagagcatagcacttcacaacatcaaagtcaagacaatgcaataacacaaaacattgttggcaatacagttgtacctgaagaccaagaaaacgaaaatcatttgcaatcatatttgaataccacgaactcatatgtcacatggtcaggtagaagtttaaggaaaagaaattttgctagtacacatccctatttagcagaccaagcccattatttgggtctttcagatattgattatttaaatgaaatctacgaagagaatgaccataatctagagaaggtggtgaaatatttaaattataactatgaaagactaaaaaaaaggtatccaaaggatgaaaagtttaggagtaagaatttttacactataattagtcgacaatcacatttggctagcgaaaaagagcttcaagaagagcaaagaaatggggactctgggtctttgccaaatattgacgaagaatttgaggatgaagatgaagaagggaataaagaatttaccatcgaccctttagatgatttgaattcacaaacctatgaaactgacgaatcaagccacgagcctgatgactttttgcaaccagtcaaacatcaccgattggttataccagacgatgatgatgaagatgataactttgacaccaatagcaacttctatagtagaaatgttgctaatgaggaaagtggaagtggttctgattctgattcgagcaaatctgatgtttacgttagagtgggtggcaggtttagaaaggaaaggaatgcattaaaaggggttctccctgaatcagctaaaagattatcgatatatcagccaaagtccaaagggccgtctagccggcatttgcagaaaccacatccggttctggagcacagaaagggaatagcattgagaaaacgaactaaacgaaaaatttctgaacgagacgatttcactgggtttgtggatgataccataacttatgacaccaataatgaactttatcacgaattgtacgaccagcctatcgttatcgaagaaccgactccagcattgaattaccctagttttgaaagtgttacgaacttttcagaaagttcagcctcagaagatgaaggtgagcagatgaattatgagagtgatttagatatatttgatgttgggccaccccaggcagatattacaggtgttgatgaagagaccggaaaactagatgagaatggggatttagatgaacctctggattacgaagttcgtgaaggtgactacataaaccacatgctagcaactgcacctaaacgcaaaaccacggcaccaaagagacaaagtgctagcgccactactatgggtacttctggcaatagaacgtataaatcacaaaaccgttccatagatggaatgttgtcacgacccaaaaaggctcatagttataataccaagagagacgttagacgttcagattcaagtacagtctcggtaattaacaggtcaactccaaattcaagacgacagcgaaaacctagaactgcaagagctgcatctgatgagtcttacagcaggcttccagtgaaacgaattacttctcttcgagacctaaacacccgttaa

SEQ ID NO: 10707 - DNA, 258 bp, Candida albicans
acactgcaactttatacatttacgttaatgatttacaaggtgctaataatatctacacgaatagtgaggtgttttctcctatacggtttttgtttctgcaaatatcatctcaactctccaaataaagactacctcaaatatatagctcaactatatcaatccaaaaagcttaataaccgcttaaacaattctcaagtaattcagaacagtcaagaggttaggaaaacatgtatgacctacttttatgctcatttatga

SEQ ID NO: 10708 - DNA, 294 bp, Candida albicans
cttcgacttgatagctttaaaaaattctctggagaatgcttgattacaaatagctggaaaaaaaatgaaattccaagcgaggtgaaatcaaatcaaattcgacgtaaaaccgtaaataattatgcattatcacacccaaatcagtttattgtcttggagctttttatcgccaagagagcaacgtttggtgatataaacaataaggacacgaatacaatgggaacacgaatacaattaaaactgctcaaaatgatagtattcaacttggcaccaggaaacacaagtctatgttaa

SEQ ID NO: 10709 - DNA, 189 bp, Candida albicans
tgtaaaaatagccacaggagaggggtgaaaattcagccaaggttagtatcttggtttgattcagatttaaatctttctatgattatgcaaaacggcacattatctactttggttgatttgtttcatctcggatataaacaatatagatacatatccgatataactatcaaccggaaatatactaaatga

SEQ ID NO: 10710 - DNA, 204 bp, Candida albicans
tatttttcaagaattttgctcgacaaagaaatgaaaaaaagagccaaccattgtttttttggagttatgttggttatgaacactgcaactttatacatttacgttaatgatttacaaggtgctaataatatctacacgaatagtgaggtgttttctcctatacggtttttgtttctgcaaatatcatctcaactctccaaataa

SEQ ID NO: 10711 - DNA, 282 bp, Candida albicans
tttgatgtctatttaaaattctctctcagtattgtaatttggggttatattgttaaatcagtctccttagacgtttctgttacttttggagaagttggttcgaagcccagctttacacgcctttccctttctttattatggtactcatttgctgaatttctacttaattatgctcatgatttgtgttctgtgaataaacgatattttttgggatgctcgtctaattactataaccagggaatcataaatgagcataaaagtaggtcatacatgttttcctaa

SEQ ID NO: 10712 - DNA, 306 bp, Candida albicans
atgagtacagtagccctgttgaacaaagtctgtgataacttaattatgggtgaactcaaggggacagtgtctttgtctatcatccgatccttaatcaagtctattactgaatatcaattatttggacacctgtttataaattactatccaatctatgttctttcaattctttccttcaatattttgccaataagaccaaacataatccaaatatacataccagtgaattctaaattgtttggtgaaacatccatttttgatctatttcaaattgtattttcttttagtagtagtagcagtaattga

SEQ ID NO: 10713 - DNA, 249 bp, Candida albicans
cgaagaacgctccaacaatcagatatcattaccgtacggtgcggtgcggcatgggcggaggggacccaacaggacacggaaacggacacgggcacgacgagagccctctcaacacgtataaaattatcacaaggtaaacaaaacaaaacaaagaaaggaaaaaaaaaaggggaacgagaaacaattgtaacaatgtacacgactaataaaaatttcaaaaaaaaaaaaaaaaaaaaatctccaaattga

SEQ ID NO: 10714 - DNA, 213 bp, Candida albicans
ttaatttttgggggaaggggtttaaggaaccatttaaccaaaacaggcaaaacgccctttttttaccaatttaataatttattaaattttagaaccccttctttatttaaacaaaaattaagttattcatcgagaataaccaatttgatacgaagaaattttgttcaaacattacaagataaagtggattttctgaaaagcaaacagaagtaa

SEQ ID NO: 10715 - DNA, 228 bp, Candida albicans
ccaatgatattcatggatttccttctatcgatgttctcatggttaaaccttgcaagtggaggattcgaaggagatttaatggagatcaagtgggacaaggtagtggggggtagtaatttgccatcatggctttatgcttctgattatcgtccttttttccagatgggtaattctaattcacgagttgttaattgcaacaacattattactcttctgttgtttgcttaa

SEQ ID NO: 10716 - DNA, 183 bp, Candida albicans
aaaaaaaattatgctaaaaactaccttaccttaaaaccgtttcgaaaatttaatgccaatagcgatggcattttcgaaactatgccatcatcgatatatgtacaaggattttcttcctgtgaactgaaaagaatccctcaatcacaagtactggattcatctaactttgctacctgtatatga

SEQ ID NO: 10717 - DNA, 219 bp, Candida albicans
gaaattctttttgataacagtaccgaaaaaagaaacaaaaataacaattactattggagtcacgtgaatcggtcttgtttctttttttttttattgtggaggagtcacaagagaacaaataagaacgaagaagaaccagttagaatgatcaagaagagtctagaaataacttttctggtaattcaatctgctcaacgtattagccattcagtgatgtga

SEQ ID NO: 10718 - DNA, 276 bp, Candida albicans
aatcaacccaaaaaaaacacacatttaactgcctatacaacgcaaacctattcaaaacaagctgtagcaccccctttcaggcttagtctatgtctagaaccgattagtgtgctgttatctccagatctccattgtcctttgttgagtaaaactagattaaaatactacttcaacacggctcattgctatcaagacttacactgctctctgatgtaccgatgtccaactgctgtccttattacgcgtgatactgcaaaaatcggcgttccattataa

SEQ ID NO: 10719 - DNA, 198 bp, Candida albicans
aagggggtgctacagcttgttttgaataggtttgcgttgtataggcagttaaatgtgtgttttttttgggttgattttacgaaaaaatcagctgaaaaaaattcattgaacgaggtgatcgtgaaaattgtgatatacaaaaaacttaaaacacaatggaaaagcttcagaatggccagaaggaggtgtctaaattga

SEQ ID NO: 10720 - DNA, 690 bp, Candida albicans
gacgcggcacttccatcctcgtggtggcgagcttgctttcaaaatggattggagaatcggcaagaattactttctgatttagatattgatccaactattcaagtacctactactaatactactagtaccactacgttcccaagacaagtttcacagccgcagccacaacacatacctgtaagtagtctgaaatttattccaccaacttccaaccaaggaatgcaaaactataggaagtacccacaccagcagataccagaagtgcaaagatccagtacgaatacactgatagtgaaacctattgataaattagaatctttagaaaatgattcacacaagaaaccgtcattattgtctaatcctgcagtgacttcacaattaacttcgattatcagttcattaacatcccgtattaatagtggcgagttatcggacgctaatatattgcaagttattcgacaaatgacagatgtgttggcttccggtggctctttggcgctgttcttaaagaaacctacttcaattcaggatgtgatagtgacgtacagagatggtgtgagacaaaaaatgttgaaaagtttatatttgaccaaaaactttcttgaccaaaaactacccatcactgaaaatgaagtgaaacaaaaagccattaaattgatatcttcaccacgccgcggaaggtccgaatag

SEQ ID NO: 10721 - DNA, 204 bp, Candida albicans
tgtaatgggggtggtgatatagttaatagttggaaacccgttacaaaaaaacccctggacccaaaattacttacagaggagtatatccttgaacaaagacgtctcagggaactacgtaaggaaaagatacgtcaacagaaggaagcattaggtttgatacctcctccagaaaaagaaaagtttttgaaacgaccaatgctataa

SEQ ID NO: 10722 - DNA, 351 bp, Candida albicans
tattttaaagatttatataaaaattcaaataaaggaataagaggtagaggtaaagctcataaagaagataatcaaggcaattcaaatgggaaacaatcaggtactatgggacaaatttgctggttacaagtttataaccataaccataaccaccactaccaccaccaccgcaaccaccacaatttactaatggtcaatcaagaggacaattttccggttagaaaaaaaatgcaaggtttatacatatatgttttatgctattatgtcaaatttctaaaactttttgatgattttcaagctatttttttattattattaccactattaatgttgatggtttttttttattag

SEQ ID NO: 10723 - DNA, 222 bp, Candida albicans
ttttcaagctatttttttattattattaccactattaatgttgatggtttttttttattagtgtttgctcatattttgaatgagtttctttttttttatttaacttcatttcaagtttactattattttgttttgttttataattgtattatttctgtttatttagtttatgctagttatcaaaaaaaattttacatatatatttactattggagaaattaa

SEQ ID NO: 10724 - DNA, 246 bp, Candida albicans
ttattaatccttattataattactattacaatgtttactagaacttattctcaatctactaaaactgctttccaaaaagctgccattaaaaaatcaattccaagaccaactactcctggtaaaataattgtcaataaatggcaaccaagtaatggcaattcattcagatcatttgctgaatatcgtattaaagtaactaatcaatcaccattggctattgctgctaaaaatcaacttgccaaataa

SEQ ID NO: 10725 - DNA, 213 bp, Candida albicans
agtattagccgccaacctatttgtgtttgtgaacaaatgatttttagccgcccattaggcacatcaaagacagaaagacacaacaactgtaaagcaaaacttaagtttagcacttatatcatggctggagaaacaacagaattggcgattatttcaagaactactcataataatataatggttattgattttaagttacagcgtttggcgtga

SEQ ID NO: 10726 - DNA, 216 bp, Candida albicans
tctttttcaccacatgtgcctttttttttgcaatctctttttttcattcatccttttgttttacttcaacttgcatatgcaaatccggagcaacggacaagaaaggaaaaaaaaggcaaagacaaagacaaagacaaagatctcttacttgttcttactattattattactactactgttgcttatggttacattatcatactgagacatacttga

SEQ ID NO: 10727 - DNA, 888 bp, Candida albicans
tcccatagattatcagatgttggaaacatcattatcaagtatattcaaacatctataaagaatacgatatcatttcccatcataacatcaaagtcaatttttataatcataccattggaacacatggtacaaaattacaacttcaacaataatggtaatacgggtaaaacttctatagtgacaccagcatattcattgaattatatggatggtggatttgatttacatcttttaaatgccatattattaggaacaaatcatacatttaaacaacttgaaaatataattcaaaatcatcaattacaaaaatttcaaggttatttagttcctaaccaaacatataaaataaatttacccgatttaactggatttgaatataaatcatctctagtttatcagaattggaatttaatagaaatcattgagattccaaccatggttgtcccagaaaaaatccattcaatatcacatttatttgattgtatatggaatttaatgaataatattgattttaccaaagaagaagaagaaaaagaagaagaaaaagaagaagaagaaggagaagaagaaaatatattggtattaccaggtattggaactggttatggtaatttaaatgaatatgaatcgactaaaataatgttatttgccatttttttatataatttgtcattaagaggaaaaaccaccccaacaacgaggttggatcaattaaaaaaatctttattaatattgtttttctttaataaagattataggaaacttgaaaatcttaatgatattgaagaattagaaactaatgtaattagtgaatatgggaaaaatttaaatcttgttaatgaaaccgttatggaattggaagaagtttttaaatgtattagatggtga

SEQ ID NO: 10728 - DNA, 690 bp, Candida albicans
tatctgaataattatcgtggtattggtggtggtggttatcgtggcagccgaggacgagtgtcacgaggtaataattattatggcaatagctatcgaggtggatctagtagaggaggtggaggatattataagagttataacaacaactattatggcggaagaggtggaggacaccgatcatattctaattatcatgatcaaggaaatgatacagcaggttcgtcaacaacgtcatcacaaaatggagaatacgaatctcaagataatacacaagaaactgaacattcatattcatcacgacctcatatttctggattccatcgtggttcatatcgaggtgggtttagaggaagttatcgaggacgtggcggtggcagtttcaataatggattagcagcaacagcatcaccaacgacaacacgtcattataaagatataataaatgaaaataaattgaaaaatttcaataatccatggataaatattatgagaattgaagatgaaccaactcaaaataaattagaaaaaagttataacgatatgactgaattggattctagtatacttgaattacaaaaatcaaaactaaaattggaaatgtcaatgtcattaattgaaaaacaaatagataaagaagggttacatgtagaattaacaaatgaaaaactagaagaatttgcttatttgtaa

SEQ ID NO: 10729 - DNA, 435 bp, Candida albicans
ctatatcaccagggaaattgtctttaccgacatgaagactgggaggatattccttcattggtagaacctggtcactcagtatttgttattgtaggtgaacatgaatgctttagagatgatgttttggaatggtgtcattttgctttgaaatctcctttaacttcacaaagagatgattctagaggtgtctttaacccaaagattcatgagtacatcagaaatggtaatgattttgcttatgttgaagtggtggtggagccatggggtgttcacgactcagtattgtattttgaaaacacaataatttccaaggttaagaaaaatccaaaattgaaggtaaacttattaaatagccatgaatactttggattcatcaaacttgtaaacttcttgaataacgtacttccgggaagttcacaaacaaaatttgtataa

SEQ ID NO: 10730 - DNA, 246 bp, Candida albicans
tacttagtttacgtaatggatgattataataatggttttgctgcagtgacgatacttgtgattgatgatgatgatgatgatgatgatgttgtggttgattatgtatatatgatggttgtggaggaggtagagggaaaaaatcatcaattaattggttttggttttggttttggttttggttttggtgttgattctgatttatatgaattccatttattttattataatttccatgatttgatgtag

SEQ ID NO: 10731 - DNA, 195 bp, Candida albicans
agggagagggaggggggaggggggaggaggtccaattcatcatcatcatcatcatcatcatcatcatcatctcgtcatttttgtgattttgttaaattcgcacaaccgcttaatataatgagaatccactgggggggagagattaacttgattctttataataataatattgacatcgtttacttatgtaaatga

SEQ ID NO: 10732 - DNA, 930 bp, Candida albicans
tatagacacaatatgaatttcgataggtttaatcctctatcgaattatttatattcttctggtaataaaaattcatcttccccagcaacaaaaacagcaaaacagggttcagaattgacagtgccgacagaatcaacacatcataatgttgttgacgaccacgacgaccttggaggtgaaatgagtgattggggcattgaagaatcaactcaaacaactaatattaaatctattaacaatttgaatagtaataataataataataatatcactcatggattattatcatcaccttcaattacatcaaattctacaactacatcaaatcatggaaattataataaaataaatggaattcatataaatcagaatcaacaccaaaaccaaaaccaaaaccaaaaccaaaaccaattaattgatgattttttccctctacctcctccacaaccatcatatatacataatcaaccacaacatcatcatcatcatcatcatcatcaatcacaagtatcgtcactgcagcaaaaccattattataatcatccattacgtaaactaagtactacgctgctgctgcaaccaatttcaacaccaataggacctgaatctgaatctgaacctgatttcaaatattattatgacacactcatagataatcaaatatcatttaatactgaaaattttagtaaatttattaaacgatatttatcattagaaaataaattgaatgaattttgggaaaaatttaaatataatttaattttatcaaatttattagaagattcaatggtattatctaaaaatgaaactaatctcaataatctagagcaaaacaataataatactagccctgataaggggttgcaaaggtttaatggcaattcattcatttactcaattaattcttcacaccgcctgacaggagcattt

SEQ ID NO: 10733 - DNA, 243 bp, Candida albicans
tccatttctaaatcaccattgctttcgttatcattaattaaattgaatattgtcgaacttgatctagattttgaacctgttgctgaacctgttgctgaaccaattgatgaatttggagaatccataaaattaaaattatcaattgcaaatgttgatgatgatataccagaagttgtgtttgtgtttgtgtttgggtttgggtttatattcattgaatcacccattacagaaatcactgcttga

SEQ ID NO: 10734 - DNA, 270 bp, Candida albicans
gaaatgaacacgactgttaagattgtgaaaaaaaaaatgagactacaaaaccgcaatttacaatcacgcaccgttaataagaaaaaaggggatgctagaatgagtataatatatagttgcaaaaacaccctcagtttgcccaaaaaatgttacatgaaaaagccttacactagaaatataccattgttgattgtaggagctaaatatgcggcttttcaattaatttttggtcttgacattcctttttttttggtggtagggttcatttga

SEQ ID NO: 10735 - DNA, 291 bp, Candida albicans
gaaaaccctaaccttcttctagctcatttaaaatcaaacaatatcatggctcctaaaagaaaatcagtaaaaggtggtgttgaacctaagaataaaaaagtgaagactgcaatccaccaaaaagaacccaatactttattgtctttggaggaactaaccaacttgagtaaagaaattgacgaatcacttaaatttaacaacttggttccattattagaacaattcaaattgataaaaacaaaattgattgaaagtatacaccctgatgttgaaagtaccgtccgtaaacta

SEQ ID NO: 10736 - DNA, 183 bp, Candida albicans
ggccaaagggtaaaactctgtattgaagtaaattttgaatttgggaatggtaataaatttgttcattggtttataattaatgaccatgcgggaccaattttgtctgagtatgaatctactattgaagatttctactcaactactaactccacgtttatttacactagacttagtgggtcttaa

SEQ ID NO: 10737 - DNA, 294 bp, Candida albicans
aaagatgacagcaacaactatctcctcataatggtcttgccccccctttttttagctttgatgtgtaccttattaaagaataaaaagaggtgctctgagtacattttatccatgtttagtgttcatttttaccatctatacacactaacactagagttcacagaaattcgtatttgcaaccacactaatcttaatgtgagagttggtcacacacgcaaccaacctaaactaaaaaaaaaacaaaggatcccacaaaaacctataattagcaacatctcaaaagtaaacaaatga

SEQ ID NO: 10738 - DNA, 585 bp, Candida albicans
aaggagacccatatttccaatcaattcgaatcaaatttcccatctccatcaatcaatcaactaacaaacaaacaaatcaatatgaaattcgctactattacctcaattgctatcgtcgctcttgctcaatctgctactgccttaagaacagtcactttgaaaacttttggttatccaccaccacaatatccagaagtcactggtaaatcagtttcggcatggcatgaaggtgcaggtatcaattatcttcttattgctgaaccagctactaaattcacttatgatgaagaatccaaacatttatattttgaaggtggtcaaggtcctaatggtccattgaaatggtatttcactattggtgatggtgaaccaggtattttacaagctaacccaactgatcatccaaccgaaatcactattgataatttaggttttattacttttgaaggatcttataatgttaaaggagttaaaaatattgatgatccttataattattctaaagatcattatgttttggctaaatatgataaagaagctccttctgatgctgtaccagtctttttccaagccattgatgcttag

SEQ ID NO: 10739 - DNA, 198 bp, Candida albicans
tttctgattttaaagttgcttactctgattgccatttccaatgtatttctaaacggggaatcaatggaaaaatccgcatacttgaaaattgttaatataaacaaattgttagtttctgattcagtgcttgaagatattatatttaaaaatagtgtgaaaaactgccattgttccaacattcgaattcccaggctatga

SEQ ID NO: 10740 - DNA, 324 bp, Candida albicans
tctgtttgtaggtactcaacaacaagtaccgtggtagaagggtcggcttattcgtcagtgcccacaattcatatctttcaaattgacgagccaaaatacgttccacttgttcctcactttctggggttttggtctggtgataagcaaacactttaccacatattaagtaatattgatgatgcaaaaaagatacaggcaatttttccagtaagtcttccaaaactttcaaaaccaaatcggcagcctcgtcaaatctgtgttcacgtgacattacaagtagtacaattaaatagtagcaaaatttaccaacggaagtttggttga

SEQ ID NO: 10741 - DNA, 297 bp, Candida albicans
acaaaaagatccaatattttctttatcaattattacaaaatattctattactttactttacgattagctgcatggaaagacaataaccaagtaatctatttgccaagctatcctgtgtcgataagaattataactctatcaactcaatcgataaagtacttgattcagatgtactactatcaaaatgctacaaaatcattcaaattggaagaaaaaagttctgaaatcgagtacactactatgaaattttgtgtaatgatagattatgcgccagtcggtaattcaaattcatcgtga

SEQ ID NO: 10742 - DNA, 207 bp, Candida albicans
  unsure (162): Identity of nucleotide sequences at the above locations are unknown.
ttttttaataacaaattgaacacatttacaaaaaaaaaagccagcaaagtcagccacagagaaagaagtttcaaagaggactatgattacgatttgattaaatcttggcgtggtttaacaattacagtgaaaattgacaccctaagttttaaccatcttgtngctctaaaactaaatagacttgacatagacacccaaaaatactaa

SEQ ID NO: 10743 - DNA, 369 bp, Candida albicans
ttcctaaaactatactatcttaattcttgcaccatgagaaacacgctaattaaaagatctattataacccccaaaagattccataccatcaagttacctcatcaaatcaatcaagatccagtgaaaccccgtctatctcaattttctcatgcattgtacaatacattgatgatttcattatcgacttttttcctattcaacattgtttataataatttgcaatatcaagaaatagagcaggagttgaaattgaaatcaacaactttggaaaatcaaattcaaactatagtggatgaaaaggacaaacaattgaaacaagaacaagaaagcagtaataaacgttggatacataaattgaaattttggtaa

SEQ ID NO: 10744 - DNA, 216 bp, Candida albicans
agagcaagcttaatagacttgattgttattgcagagaggagatgttgtaacggaatgtatgaaagtgggagatgtccaagaattaatctagattataaagagattgggttcatattttttattttactgatatttctttatgatcgttgcttattgtattctattttctactctctttttttttgttcatgtaaactcagttttttttttgaatag

SEQ ID NO: 10745 - DNA, 198 bp, Candida albicans
ggagaaggtgcaagcattaaaacaggtttacaaatgcaagaagcttattgttggtcgagacagattagactaagtgagaggggttataccaaaattggaaggcttcgaaatctttttggatatgtatccggaatggagagaaactgttgttttgattcaagtttccagtccaagatactcacactccgccaatgttga

SEQ ID NO: 10746 - DNA, 210 bp, Candida albicans
ctgttttttgagccagacaaccaactttcaagaataaaacgaaaacaaccaaaaaaaatatcaccaatcaacttgatattgttattgttatccaataatcaattgaattcagagtcttctatcatagtcttcaagagtagatttcgaactacaataactaaccatagattgaccacaaacgaaacacagacggcaacactttttgtttag

SEQ ID NO: 10747 - DNA, 192 bp, Candida albicans
attgaccacaaacgaaacacagacggcaacactttttgtttagcggcaaccaaaagaaatattacattctacacgactcctcaagtaccgcgattgtcacacaatagcgataatactaccaccggaacaccatcatttaatacataccacacgtttaaacaatttggtttgtttttttttagcaacttttaa

SEQ ID NO: 10748 - DNA, 297 bp, Candida albicans
attttccaaacggtatggaagacgtcaaggatgccaaagagtcaaattcatgcaacaaaagaatattttctagttttagatcacgatggattaccaagtttttatgaagaaacgctgtggtcacaatcaattcacacactattcgtttcaaaaattgccagtactggatggtatcatggtgaccttgttgatggttgtgatgatgatgatgatggtgatggttatgaagataatgatgtttgctattgtttttttgcaagaaatgaagcaagttccccccattacaatgattcataa

SEQ ID NO: 10749 - DNA, 243 bp, Candida albicans
tctaagattagtctagtaatatatcttgttcctatcttctccttattctcaatacatacttgttttttgaccaccaccacaaagaggcatgttttaatgatatttaaggtaccctttgatgaaactgaaaaagtagtcctcggcttagactactggtataaaagaactgaaaacaaaaaaaaaaataatgacaaaataacttttaatgattttgaaaagttttggaaaagacgaacaggttga

SEQ ID NO: 10750 - DNA, 333 bp, Candida albicans
gagacaactttaataactatttccaaatttaacctcatttccttttactatggttatctttccttcactactatcatcttcttttttcactttggtttttccagctcttgcatttccaatttaaaaatccaattttgtgtaaaaaaacaaatcaatcagctaaaaaaaattttgtgtatcactttcaagtctgttttaattttacttcaactaattaacaatactattatcactagtacaatcagaactgctacaatcagaaagaacaagattattatctataaatttaatcatttaaatctcaattttttctccctctcttataagaaatga

SEQ ID NO: 10751 - DNA, 294 bp, Candida albicans
ctgtataggttttttcttactgatgataaattgccaatattggaaagagttttgattttaaaccatcaaaacctaggttccctccccatctttctctcccccgtatctcatcttaacgcatgcaaaagctatgaaagttcccaagcacttagtcaaaaggtaacaaaaacatatgaatgtttaaaccaaagcgctagcagatgtctgacttctattggtcttgctgaaactgcggttgtttatactcggaagcttttaaacttattcctaatacaccatgatgaaagcatagta

SEQ ID NO: 10752 - DNA, 198 bp, Candida albicans
aaaaaaaaacgagggttatgtatgtatgtatcgtatgtctgtgaatatgtatttgcgaattttgttggtcctgtacctgtggctaaggttacacaaatcaatcaacaaaagtttaattttaaaaattttgtcaataagaaaaattacactcaaacagtaaattacacaaaaagtaaattacacaaacataaacaataa

SEQ ID NO: 10753 - DNA, 906 bp, Candida albicans
aacgatggactgatggcagattatggtcggcctcgaaagtctacaatggaaatttcttggtctataaacaatggaataaaaagactaaacgggaaccaagaagaagaggaatcaggtggccaagcattagttaaacaatcattttcggtggtaactaaagaccatcaaagattccatttaattagttattatgaaaacgttcctggatcatttagaccaaaactggcttcaaaccaaacaacaacgacagtaaatataccaagtcacgattccaagttcaaccaattagacctttcaaatgctatatatcctgacagtttattgaatagcatttacaagagaaaacaccaacaacaacagaataaacaacacccacagcagcaaactgaacaacttcgtcaacagagttactcaccagcaatactacccaacagcaacaacaacccagtatccctagaatctaatcctggtgctggtatcagttccaacttgtattcactcatgaatcaaacttcaactcattatacaccaccatcctccagcttgtcaagctcttccctttcttcaaattcttcaaattcttcaaattcttcaaattcttcatctggcagtataaattcacaactaacgactcaatcttcatcaccattatcgataccgtcactacacattaaatctgcaggttattttacttcttctggacctaatcataatacttttacattacaaaaagctggccctcagaatcgtcagcaacgtgccaatcatccattaactttacagccattatctaaaatctcccaactctcacaaacaccgacatcaggaaacaacaataatactggtattaccaacgattatgatagtcgtaccgttagtgcattgaataagacctggttaaaatag

SEQ ID NO: 10754 - DNA, 279 bp, Candida albicans
agagagatagagagagatttccaattaagcagcagtaataacagccactatcttcatacacgtgctctagtttttatttttgttcttttttccgcaatggacttacatttacgtacaagaaatttatttattaaccacaccactactactgctcccacgacctctccctcctttcatgagtttgtttctgttttctatattccgcctctggtctttagtgagatgagatactctttatatttatgtcaattatttatatggtacaagtcagtagaataa

SEQ ID NO: 10755 - DNA, 198 bp, Candida albicans
gaaacgtgggccctcctcctcctccctcgtgctcttgatatcactgaaattcacactactagttttactatgttaacactaaaaaaaaaaaggcaaaacattttaaagagaggtgtcatttgtgataccatattgtacactttattgatgccggctttttcaatttaccaagaaaattatattgacagttctgattga

SEQ ID NO: 10756 - DNA, 189 bp, Candida albicans
tctttacaatcaataataatacttaatggtaagaccacatcagctagcgaaacatacaccatttacgacttaagagaacttttttttctttctttctctctttattttgtggttgcaacaaacaatactacaactaaaatgcaagatgtaaaaattttattatgcgcacataatgtcaatttagtatga

SEQ ID NO: 10757 - DNA, 375 bp, Candida albicans
tacctttctgtgaagatactacacatatacatattctatttcaataacatgcaagatttaccaccaatcggaggatacgagcctatccaatggaaaagaaatattccttctagaggattcagtggtactgtttacttttggggaatacttgggttaatgtcctttggattctacaaatactacaaggctgcagatgagcaacgtgaattcactagagagagaaattgggccagatttcatttggaacctttgttaattgctgaagaagatagaaatgtggctagaagatattttgcagaattgaaacgtagagaactagttaaagaaagcatgagtcccgaaaacagagagaagttcgaaagaagacatatataa

SEQ ID NO: 10758 - DNA, 246 bp, Candida albicans
ccctgtggaggactgaatcttaaatactcttttgctgcacatgtcacaggtgcatctactaatcccactgacaacatcaccgacactaaatatgtgaatgggctgcatctgtacatgaatacccagaagcctggtaactgctcctttgtcactaacacaccacaaaaggccaaacacattgtgaaaagtaaaacagacaaattagcagcattatcatcaatctccaaaaatgaaatacacaactga

SEQ ID NO: 10759 - DNA, 225 bp, Candida albicans
gtaaaattaaagtgggtgttaaatatgatgagtaacttcttgagtgtaatgtgggaaagaaaaaaaaaaaagacagagaataaaaaaaaattcttgaaaaaaaaaaaatgtctctcaaatgacgcgactcatgcgacatttattttgaaatctgtgcgtgtttttttggctatacattttcattcacttttagaattcgtcttaatgttttactttatcaaatag

SEQ ID NO: 10760 - DNA, 186 bp, Candida albicans
acaaattcaaagttgacatatacatataacaatcataattctatccatatacaatttagtacgatatttctttcagtaattgcttatttgtttcctcttcttattggtggtgaaacaaataaaagaaaaaaaaaccttagggctaacttcttagtgttttttttttgcaacaccacatcaccataa

SEQ ID NO: 10761 - DNA, 570 bp, Candida albicans
ttgtataagctcccaatgattgaattggtttctaattctaaccatgattggttatcatgttatataattaaacttattatcactagtcaagaagaattggatttggaaatcaatcaattcttaacaacaacgattgtcaattcacaattaacattattaataatactccaccatgaagaagaagaaggggataacgatagtattaccgatttacaacttttaaattatttacaatttgaaatttataaacaaataggtaatgatataattgtatcgattatgacaataactcaagattctaatttatcggtaatgttgtcgtctcaattgaaacaaattgatgatatagttaaagatattctgaaattggatttatctattgctttggatgttgtaaatgaagagaaattgatatttttaatgttgaatatacctaatttattaccatatttagaagagcaacaaggatatgatgaaatttctattgaagaactttttgaaaatttcgttaaacatcataattccatcaaaaaaatcatgttatcaaatgaactaaaagaatatacgtag

SEQ ID NO: 10762 - DNA, 261 bp, Candida albicans
aattggaagctaaaactatacaagcaaaacaagcacctgacatctaatatttctattaaactacaaccaaataatgctattggtgcatcaaatacgttagtaaagcctgacttaaggcaaaaaaaaaataatataccaaaacaaacccttttccagttgttattattaaaagtatttttgtgtagactcatttccctttttccatcgtcaatgtactttttttattattttgggtgcatggttagtaactttagtagttaa

SEQ ID NO: 10763 - DNA, 822 bp, Candida albicans
gtagaaaacattgaagtgccccgtatcccaccattacatattcaacatcaattggcttccaaacaaaatcaggaccaaaaccaatcacaaaaccgttacgagcaatcttcaatgacaagcatacatacaaatgacaacagctcatcagttaacaattctccaaacacgatgatgatcaagcaagagcattccacttttcaaccacaacatagtaatgaaggtagtagtgcatatcatccagttgatcaacaaaatcatcaacagcaacaacagcctcagcaacagcaacagcctcagcaaccaatgactagatccatttgtaccaggtgtaaaaaaggatttgaccaaccaataatttatccaaaatcaagcaattctaccaatggtaacaacagcaatggacaaaattcgtcatcaatacctccgcctgagccaagaactttcaaactatgtgatcattgtcgtaaattacaacgtcaacggtcgagaagatggcagaaaaaaactaaggatagagaaggagtatgtcgcagatgtgggtcagaaataccattggcagaaagaagatttgttttgtgtcctagttgtcgggaaaatttacgtgtgcgaaaagctagtcgggcagcccaagggagatgtgttcattgttcggggccattggatgcatctattttatccaaagataacgaaggtaacaataatggtgatgagcagaataataagtcaaacgaagatcaaaataacgagctgagaaggaggaagccaagaaaagcctgcacgaggtgccagtcacaaagtttgtcaaagatgtcgagaaaatga

SEQ ID NO: 10764 - DNA, 282 bp, Candida albicans
tttccttttggaaaatatcaaaccaacaataagatttcaataaaaaacaacaaacccaaacagaagaaaacaaaagaaaataaaacatttgtggctagtataagtcaacttcaattgggtcaagtagtggataagatagaaggagatcgagataacttactttctaatatctacacctccacaaatattcaacactgtttgctctcttttctgtttcgtttagtgtatgtgtacccatcacgccaattccataatgtatctacaccaatattcaacgtatag

SEQ ID NO: 10765 - DNA, 753 bp, Candida albicans
gaaggaggaagccaagaaaagcctgcacgaggtgccagtcacaaagtttgtcaaagatgtcgagaaaatgataaaatccgaagagcaaatttggaaaaaatgggtaactgtaatcgatgtgctaaggcattagatcccaatgaatatggtagaaataaagtttgttttaattgtcgaactaaaaagaaaagatcacctcctgaaaatgtgacaaatactgatgaagtgagaacttcgccaattcaaaaccaatatggaatgaacatgtcgcatcaatacattcaaccacctccaccgcctccaccacctttaatgacaggtcatcaccagtttcaacctcaaccacatatgatgggtcatgaacaaatgaatacgttcacaacaatgtcaaactctggtgtagctggtattcagcaaccaaacaatggtatggtagtaggtgatcaacagcaacaacaacaacaacataatggctcaatgcaattacaacctacgtactatcaatcatatgtccaaatgccacctccactacaacttcagcaacaacagcaacagcagcagcagcattattcactcgacggaattccccagcagccacattctgcgcctacaagttcatttccacctccaccgcctccaccattgcagttgaatcagcatcaggggcttcaacaatatagtcatgctcaacaacaacagcagcagcagcaccaacagcaacaaccataccaccaagagtatccaaacaattaa

SEQ ID NO: 10766 - DNA, 513 bp, Candida albicans
agcaaaaaaaaaaaatatcaacacaaattatttgccccatatttgcggcctctgacagatacaacaaccacggaaactcgctttatgctctcgacttgtttaataaggaattgtgtttttataagaccaagattatctgtaatttgctttaaggcaatcagataccagtccaagaagctggatttccttgattataccaaaattaatgatcctaaattgagagaaatcatcgagggatccaattttggaactgaagcgattttgaaaaagcaacgtgaagatcaggacaagaagaaaaaaatggagcaagaaagaaagaggttagaacaagaacgtgaagtggatagaagacgtgaagaaaagcctgcaaaagaggaatctgaaagtaacaagactgacaatgacaacgaagcaaaccaacacaccgacgataagcttgccaaagtcaatgaaaaattggactctagttcttcagtcttcaccgccggaatagaaggaacgcgcttaattata

SEQ ID NO: 10767 - DNA, 261 bp, Candida albicans
ttcttattaggagtcaacgccgagccgccaaatggtattttttggcctatcggtcccttattgggtgagagaaaaaaaaaaaggcgttatgaatttatttgtcgcatgaagcaaaaaaaaaaaatatcaacacaaattatttgccccatatttgcggcctctgacagatacaacaaccacggaaactcgctttatgctctcgacttgtttaataaggaattgtgtttttataagaccaagattatctgtaatttgctttaa

SEQ ID NO: 10768 - DNA, 294 bp, Candida albicans
agaaccacgaaagacgaccacgtgaaacatcttaatccacaaagaagaaataaatatcctactggttatagatctagaagaaagaatgaggggaatgacgatgatcaagaagatttgtttgctgataaattaaagggtgaaagacaaagtagaagtaataatagaaacattgttgtcgggggtgatgatgatgaagaagacttgtttgctgataaattgaaacaatctaaaagagatagatcgagatcaccaatgagaattgatagcgaagacgtatcatatagacaaagatga

SEQ ID NO: 10769 - DNA, 297 bp, Candida albicans
tgttataagatagtgatttatattgaaaacacccttaaaaaaatcaaccacccatctaaccgtcgaattggaaatgtcaatttagttagcatcgaaaatcaacaaagacatggggaatcatttacatataaaataatgagagagaattacaaactgctacgttatgttttgttcattatgtcttgttcattatgtcttgttcattatgtcaaaaaatctatagttacctacctctacatcaatttatggtctgaaatactaacattttttttatttatagtgaaaaatgaagattga

SEQ ID NO: 10770 - DNA, 204 bp, Candida albicans
atattattggctatctcccatgccaacttacttttgataatttgttccccattgccagaacacatacagcagatttcgcaatcatcaagcttctttcgggctatagctgctccaataactccagcacatcctatcctaccaggtagtctgaaaaaattccctcctgatgatgttacaattgtcgtctcgttgtcagatatatga

SEQ ID NO: 10771 - DNA, 609 bp, Candida albicans
atatatccactattgaaaaactggttcccacatatagtggatgacgatttggtatcggaaaattcaaggaaaatatatgacatgtacaaagacaagattttccaaggtgattattcaacacattgtgccataccccatgagatttctgatactattggcatcactcatatatctgacaacgagacgacaattgtaacatcatcaggagggaattttttcagactacctggtaggataggatgtgctggagttattggagcagctatagcccgaaagaagcttgatgattgcgaaatctgctgtatgtgttctggcaatggggaacaaattatcaaaagtaagttggcatgggagatagccaataatatttacaatgttgctggtgatgagtatggtaaatatcttgaaagaaaagtatatgaattgaaccccaagttttacgttggctttatcattattctaaactaccaatcacgggtccagctactatatggacacaccacaccaacattctactttggcttccggtcaccaaaccaaacaagggtcattctaagtagttcagataaattgggacactttacatttggagagtacagtctccattaa

SEQ ID NO: 10772 - DNA, 207 bp, Candida albicans
aataaatctcaaggctgtgatcttctcaactgtgtgattctcataacatattcgtctgtgataagatactgccttaagcacttaggagaatcagcttttctttatgagaatgcttttagtcttaaactcaaacattctgttttccaacaccaaactaattgtcaaaataaaaaaaaaaagatgatccatacatctttagtattgtaa

SEQ ID NO: 10773 - DNA, 201 bp, Candida albicans
tcacccgccatggcggctccttccaggcccgtggtgaaaattgaatacgaagttccacttgttattggtggtggtgcaggtgctggagcaagtgtaggtttcaacttcttcacaggcgttgatgttgaagatgccgatgacgcactgttattgttttggtccccaattgctgccactgtcactactgatggctttatttga

SEQ ID NO: 10774 - DNA, 183 bp, Candida albicans
gaaaggatcataagattatttgagtttcaaaccagtttgatacatttttcattagaatatagatttaaagttccgtccatttgtttattgagtcgtacattttcaaaagatgaatttcaacaagtttctaatcataatttcgtgttatttggcatgtgtatttgcattggcaaatcaaaatga

SEQ ID NO: 10775 - DNA, 417 bp, Candida albicans
gtcgtacattttcaaaagatgaatttcaacaagtttctaatcataatttcgtgttatttggcatgtgtatttgcattggcaaatcaaaatgatggtggtgatgacgattcgaaaaccaaaaagacaactacatgggtatgggttacaactactattggtggtcaacttgcaacaatatctacagcttactctcaaaagtttataagtacccatagtagtgaagatgctaaatcggtggccagcggagagatcgggttgggttctttgagtggaagtgttggtggtattaaaacatatagtcaaacaactattaccaatgctaacatagccccaagcaataacaatgttttcctcggcattgagagtttgtacacaggcattgttggtggtattgttttgattttaggtttattataa

SEQ ID NO: 10776 - DNA, 255 bp, Candida albicans
atcattctccaggaacgtattagtccaatcaaaggaggaattaacgatacatcacgacaagaagctagtaaaaaatgttgtcgtgcattcaaaaactttaaacctagctgtttaatggatgaccgtttgatattcccacctcgtaatgtagaattagatgcattaccattactgctgttgttcccattacggttatcgttgtttctattactagtattgccattgttgttgttattgttaataagtgcatcgtaa

SEQ ID NO: 10777 - DNA, 243 bp, Candida albicans
tcatcatcgatttggtgtgactctaaagtatttgaaaatcgcgaccctagtgacgacgaaagcaatgtacttataaacaccataattatttgtatacatgtatatgaaggagttcagaagggggttaaacttcaaaggttgatctttgataattgtggtaaagataacaaaaatagacaaggggtcaattggtcaattggtcaatatgtaagaattttttttttttttttcttttttttctaa

SEQ ID NO: 10778 - DNA, 759 bp, Candida albicans
ttacataatcacatcacactatacctaaaaatttttttttttaacgttttcattattatatgttacacaactattctaagatacctttcaatagacaacaccgaattctgtgggaatatgatacgactaataagatggaacaacgtacaaagtttagtgtttaaacggtgcttatttgtgccgagcaacagtcttaccaataaacgaaagagaagaatacctccatcgaaacccagatcatcgaataggaaagatggagatatcgagccatatagaatgactgatcagaatcagacaccaaataccggttctatagcaagattacctgccgaggtcaagaaagaattaaaagatcttcggagttttacaaaagtcatcgcacaacatctaaaaccagaacaggaaaatgattcattaacatcggctgaaaaaccatatacatcccaattacctcccatagatatagaagaagccaccgatgatattttcggagaaatttcaggtactaaaaaattgtcggcaaatgcagtgccaccaccacctccaccacctggtttagatatccccgatgaaatcaaagaacgtttagggttattatcagaaattttagtgccagcgaaaaccagtaataacaagttacccgagaaacaggtggaaaataattggaaattattattatcacaactagatcaagctggaggtttatctgggttatctaaacgaagtgtttataaattattccctgaaaatcccacctaa

SEQ ID NO: 10779 - DNA, 201 bp, Candida albicans
gccagacttttttgcaactcattaaatggaccaaataaagaaaggcgtgaaaacgtttatcagattgaattgcagcatcaaattaaaagcaacaaatcaaaatggcaaaatacacgacaaaaatttgtttcaaaaccggtgttgctcctaaccatttatagtgacaacgcaaacggaatttatcaacatgcatgcaatttg

SEQ ID NO: 10780 - DNA, 234 bp, Candida albicans
acgttttcacgcctttctttatttggtccatttaatgagttgcaaaaaagtctggctcacaacattggagttaatatacattattttcaccaaaaagatattaatcaaattaataagatattggatattaaatggtatcccctttttttagtttggtatttaaagattagggcagtatgtagaaagaaaaaacggttcctgacacaaatctgcctcaaaaagctcaatgcttag

SEQ ID NO: 10781 - DNA, 315 bp, Candida albicans
aatatcatacattcaaatggtaagctcgaatatgatttatgggaattcaaaaactatataaagatgcctatggatcctacaattttcttcaaacgttttaattctcttcaccaacaatcaatcaatcatccattcattcaaatagtcattcattcctttgttaccgactataattcattcctttattaccgactatcattcattcctttattaccgactatcattcactcctttataactaatctaaagttaagctcaaccaacaatgttcttgaaaaatatcttgagtgttcttgctttcgctttattaattga

SEQ ID NO: 10782 - DNA, 201 bp, Candida albicans
gtcttctctctttactttatcttatttttttttattttagattgcctttatatattattgatactagtaatacaaatttatacacaacttaaatttttcttatttaaatatattcatgctgtcattctttttccagaaaccgagaaagaatcaaactctatttttattgttttcctttctctatttcaatttattattacg

SEQ ID NO: 10783 - DNA, 186 bp, Candida albicans
gtattaaagcaagctctctgcacacgaccttttatagcaacaccagtgaagagcaacaagagtttgatgtcccatagtaaattaaatcaacagattcttttcaatatcagtttgtcgtcattaatgcccaaacaatgtgtagctgactcaataataattcttagagccgtattcttattgaagtaa

SEQ ID NO: 10784 - DNA, 702 bp, Candida albicans
tataaaacttatttgaaattagtcccactttccatcatggacacagatacgattgcatattttgatagtaaacttgataaagttacctcacagttgaacattgacaatgataaaattgttgatttacaacaagaaatcgttttattgaaacaatacattgattatcaaaattcaaaaatcgaaaaggtaacctctttaattggtaatttattggagaaaaagtcacaagatgaggctgttttaaacacaatacaagcacttcaagaagatgtcgatgttggagatcttcaaagacaagtggatcaattaacatctcatcattcacttggacaatcacaacaacaacaacaacaacaccaattactcaactcccagcatcgccagcaacctcgtcaaccaaatgagcaacaatcacttcaacatcaccaacagccacatcaacaacatcaacaacaacatttacaccaacaccaaaaccagcatcagcagcaacattcacaaagaccttctcacatgctgcaggacatttccactcaattagagagtaatatggatccagctttacaccaggtggctgttgcaactgctgctgttcaacaagcacaggctcattcacaatcaaatgaaccacttggtatggcatctctgtcccagcaaagagtgagtaaaccaaccaagaaacaatccagaaaaaaagtctga

SEQ ID NO: 10785 - DNA, 258 bp, Candida albicans
gaaagatatatttcgaaaagagaaagtaaaaaaaaaaaaaaatcccaatggttgaagttcggggcagcaaaagtgaaaatttttatattcgtgagaagaaaaaaaatgatggaactttatggaaaaaaaagtattagcatcggtgccaagttcattagacctggtgcattttacacgaccactctcaattccgatccgtttaagctggacagtcaaaatgaaaaaacagtgtcacgtgcgtacagagttgggttttga

SEQ ID NO: 10786 - DNA, 225 bp, Candida albicans
caaaaatggggagaaagtggtgactttccaaccttgaacttaaaacaaataaaggtacattcagggatgattcacgagaaactttcaatttttattgctcatacgtttgataaagtgataaatcaacatcaattaattaaattaattattgcaaatcaaaacgaaacgaaacaaaaaaataataaatcttatttccatatgtccataaaacaaagtagccaataa

SEQ ID NO: 10787 - DNA, 219 bp, Candida albicans
gtcatcataggtaaacgacggccgaggaatgagtttgaccacaagaagaaagtggctgatacaacaagaccagaatgccacgcggaccaagaaacaggggcaagaagaggcgaccaaaagggaaggggtgttaaaaatataatcatgccattactgacaattaaagacgacagttttgcattttgttttgctcaggtacatatgactcgtgctaaaggt

SEQ ID NO: 10788 - DNA, 195 bp, Candida albicans
tcaatttgctgtggtttggcatcttgcgccaatcaattagtttgtttgaataatcaccgagggcaatcagtaaaatcaacagaaagcagcaacttgcaactattcttggttgctctcaacgaaaacaataccttattgtgtagtattttcttacatatttctgttggaaaatatagatatttggtccttacatga

SEQ ID NO: 10789 - DNA, 261 bp, Candida albicans
aaaccaagagataaaaagtcgtgtaaaaatgtacagatttgggaattattacactcacaaagagagaaaataatgttgttgtcattctctctctgtcacctgatttctcctgatttcgttcaaccaccaccaaaaagtttttatttaaaagattcacaaattttctatttcttggcctctatttcttattactcttttttttttgataatataaagcaaccttcaatttcgaaaattagttctccgaattgggtaggctaa

SEQ ID NO: 10790 - DNA, 198 bp, Candida albicans
acagcaagagagaaaaaaaaaattttcgtttgtatgttttacgagttgcctagctttgttcgtcagtattcatcataccaggaaagaaaattgatcaagaacgatgagcatctactcaagatccgtgtcactagtcaggtgctactcttcggctcagacagcgatgaagaaacccttccaaggtccactctttcttaa

SEQ ID NO: 10791 - DNA, 252 bp, Candida albicans
tcatccaacactttatcaaatttcaattggttgctgaaatctttgtatttggttaaaagaactgacaatataccgtatccgttgaaactttcaaattctttttctaatcgccaattattagacaataatgttagcaatagggataacacggtatatactatggaatcacgaagtttagaatttgtgatttcgagtgatgtttctagaattcgtaatacaacggatgatccaccaataacattaaatgcttga

SEQ ID NO: 10792 - DNA, 483 bp, Candida albicans
  unsure (8),(13),(26),(32),(41),(89),(119): Identity of nucleotide sequences at the above locations are unknown.
gatttaanggatnaaggaacagaganacgganaggggaacnagaacaggaacaggaacaggaacaggaacaggaacaagagcaagagcnagagccagatcaagagccagatcaagaacnagagccagatcaagagccagatcaagatcaagatcaagagccagatcaagagccagatcaagatcaagagcagaatgaaacaataaaaaaatctagaccattcgatgaactcaaaccatcaactagtgaaacaaataaccaacaacaaacaactcagttcaactttgatgatgaagataatgattacgattatgaagcagaagtagaagattccaatattcgcaaacaaagattactttcaaaagaaaataacagcaataaattggtgcatattaaaagcaatggtcgccaagaagtcacttcatcaccagtaccaattgaaactgatggtgacactgatgtaactgattccaattcaacatag

SEQ ID NO: 10793 - DNA, 198 bp, Candida albicans
tgtcgttttgcagtctgtaacaaaaaaaaaattaaccacgacaatataacaagcagtcgtagaatgtcgcaatattatttgcctgccccctcctattcactcactcactccataaatcgtaaaataaacatcagaagaataacatccactgacgaccaagaagaccaaaaacaaattttcaacgaaataaaaatttaa

SEQ ID NO: 10794 - DNA, 192 bp, Candida albicans
taccagcaaaaccaatacattatgacattagggttcgataaattcataagcaaggtcagcactcatagacgtcaatctgaaccatcaatcttggaaatcgcagccaccaattctcaaaataaatcgagaaagctaagtatggataatggtcatggttatgttcgtgaatcactaataatcatcatcatttaa

SEQ ID NO: 10795 - DNA, 282 bp, Candida albicans
ggcatatttgtagattctgcttgtcccagttgttctctaaaagtaccatctttcaatattaatcgtattttcactacacaaagggcagaatacttgttttcatctttattttcccgtttggttaaattacaatccaaaattgtcgttgaccatccatcaaatccaaatacttcattagctaaattatataatatatttcgagaaaaattggttagattatctcgtgatccaaatgattggaatgtatctctagaatgttgcattttttctaatttcatttga

SEQ ID NO: 10796 - DNA, 237 bp, Candida albicans
tacggggaaaaaggagattcaaaacaaaagggtggaagcaattcggaattccaaaggcgggaacggaggtttaggtataaacacccaatgggccaaggaaaggggaaacaaggattgttcgatcgaaagggtggaatctggggtggtaaaggatggatcccaatagtggaacatccaactgtagaaaactccaaatggaatattagggttccccacaaatggtgtcaccagtggtaa

SEQ ID NO: 10797 - DNA, 186 bp, Candida albicans
gtggaggaatcgcacataacaatgttgcgaaacgtgacttgttgcttggcaaatattaaaataaaccacactcattcaccatttagtacgtatcaattaaagagaataaacttttatgcaattagtttaaattcaaaatataatgacagatcattcgatttgatcattaaatctaaagttgtctaa

SEQ ID NO: 10798 - DNA, 201 bp, Candida albicans
ttgtacaataaagcgtttcacacattgaacacacacatacacatttctttaagatcacaatcagttttacaattgattaaatacagtataacaagaggtagagaaagttatggatttgcgttttgtaatataagattgctaacaattgttaggatagatcatactaactacaaatggtgtaaatttcaagatgtgaaataa

SEQ ID NO: 10799 - DNA, 249 bp, Candida albicans
  unsure (107),(197): Identity of nucleotide sequences at the above locations are unknown.
attgtcttccccgaattaacaacaataacaatccacaccgagaaaaacttaatgccgcccataaatgcatccatattatcttccggtaaagcccggaatgcaaatantaacagaactggcttacaaaaaatcaaaactgatatgtttaatttaaattctattccaactgttcatgggttaacattccctttgaacancgccccaattttggcgcaatccaacaacatccccggagaattattcctccat

SEQ ID NO: 10800 - DNA, 219 bp, Candida albicans
aaacaattacgtgtgaaataccaaaaaatggaaagcttgaaattatcaattagggaaataaataaacaaaaaataacaaagaagagtaaagtagaagattgttatttagtcaatgatgaaatagagcataagatggttttctgtatatgtattctattgttacggtatacacataccataaggagtaataataataataaggagttgttgttaagttaa

SEQ ID NO: 10801 - DNA, 186 bp, Candida albicans
tcacacgtacacacacacttatttcactctctcctattaatcactcacactattcttttttttttgggtagtagaacaatgaaaaaaaaaaaagaaaattggaaagctaagcaaaaaagtagggctgccaaaaaaacaacaaaagcaaaagaagagccaccacacaaatactttttgatatattag

SEQ ID NO: 10802 - DNA, 204 bp, Candida albicans
ttatgtcctccccaagccacaggaagtaaacacactggcttatggttacttatccaggcatcacatgaatactgtgcaatatctagtggggtgtatcggtatggatttgatgaagataaaactgttgaagcaagtccaaagactaacaaaaaaattgataccaacatggtttatgcagaaagctgtgtaatgaatgcaatttaa

SEQ ID NO: 10803 - DNA, 357 bp, Candida albicans
gatggagtattggcccagcatttcggtttaatacacattccattacagagaacaatgtgtctcgcacaagaattgcgtcgatctctgagcaaaaaaaaacgtttcgatttcctttttggggcaacgcctcctcctccaacctccattttctcagccaccagaaaaaaaaaaagagggactactacttttgccgccacttgttatcaacgtatcaatcatcacaatatgatccgcgtaaaagcaagtcaaaatattctttttgcaccattttttgttgacactaacaaagagatgcaattacaattagatattgtattacgaaaatatgaatttgaaactttgttgatctctaaataa

SEQ ID NO: 10804 - DNA, 204 bp, Candida albicans
atatataatatcattaatttaaagagaactccccttaataaaaaatcaaaccaaaagaccaaaaaaaaaaaaaaaaaaagtcatgcattatctgtatactatatatatatatatttgtataaacaattaatttgtattattatttttatcattgttgaacttcattgtaagaaggtaaagtatcatcgatatctctattattaa

SEQ ID NO: 10805 - DNA, 228 bp, Candida albicans
ttgacaaacaaactaatcatatccaattgttctaacagaaaccaaataccaacaataattatgagaatacttacaaaggcgcgagcatttaatcctcatttagcagagatgtttctgaacaagataccctattattacagcagagctcatatggctgatcctgaaccatgtccaaaaatacttgataaatttagatttaaaaagttaaatatgatggttctaaattag

SEQ ID NO: 10806 - DNA, 297 bp, Candida albicans
gcccaccaaagttctaattctatccgaatagaagagggaaccacggcaatgacgcaagcaaatagagaaaaagacattttgtttagtactaattatatatatttctttataacattatttttagtttataatatgcacatcctctatcatttattttggttcaacattataacgcatctttatacccattgccgacaactcactatccaaatatttcaatacaaaaggtattgccacagttgtggtatcgtcaccacccacaaatttcttgccatgtccatcttcccatatatctga

SEQ ID NO: 10807 - DNA, 990 bp, Candida albicans
tcaattcttttggtgatgtcacttttcccaacacaatggatagccaagtccataccatttctagggcaagaaaaaccttgtatatatggttttacttacaattcagagtgctactactatggactctatttatgtaactttgagaatgtatggaaacaagaggtggacaaacaaaagttggttcatattgccaaaacaattggaattgaagatatgtctgatgacgatttagtggaactcatcaatgacattagtcgttatatcccagagaaaatggtgtttgagcaggatgatgtgaatgttagggcaagaacaattggcgatatagaatggagattcaatctctcgagacaaaaccaggagcaaactatagaatttctttataaattaaactatcagcagtttgaaaatatttgtttcatgaaattccaagttgacagtctaaaagaaattatttcagtaaaagatcagtattcgagatttttagccacaaatttcaagcaaagtcatggcatggatatgataaacaactacaagaaaaataatcagtctgatattgagtttatagaaaggtttagcccgaaaaaatgggacaagaaggtggtcagccagtatagaaacctacaatcaaagaacaacaggtctagcatcaatggattgaaaatctgtattgaaacagcaattaatacaatctcaaaatttgccagtttgttttctgagaatgaagcaaaagaagaagaacaatcaagtcctgtgaaactagatcccgtggaggattctcaattggtgaaagtctcaccttcaccctcccagtcagacgcacagtcgacccagtcagccaattcaaattcaatgggatcaccaatcaagcgacggatatctacctatgagctgcttgttccgacttcaatgtctcaggcatcacaaagtagcctagatactcaatcgccaagaaagaaacgtaaaataggatctttatttaaaaaatga

SEQ ID NO: 10808 - DNA, 555 bp, Candida albicans
tctgaacatacacaaataattaacacagaagtaatgggatttggacaaattttactttttgcatgctcaatactatacttgagtaccggtggaagatggacggttgtagcacttgtatttgttttatatattttatacaacaaagatcaacaacaacaacaacaaccaccacaaccacaacaacttaaaccatctgttcctccactagcaaaaccaaagaaagaatcacctatttatgcggttgattttactttcagttcaaaagcattcactccatcaactacgacaacttttcctatacgaagagtgatagctcctcgaccaaaaagatcacctaaaattttcacagcatcaaaacctattgttcaacaacaacaacaacaacaacaacaacaacgtcagccagtattgacgaaaaccaccgtcgaattgaaaaaatgtcaaatatatattttttataccaccttaactggatcatcacaaagaatagctaaatccttatatgcaaaactacagaattttcaacagcagcgccaggatccagctaatcccccc

SEQ ID NO: 10809 - DNA, 225 bp, Candida albicans
atagaattcaaaaaaaattacacaatgtataacggacgtcacaccgggttgaccaattccattagtaataacaccacttccaaactagttggagattttgtgcgccgtccttaccctatacctttgttctatttttttttagtgtttagtttcagtttcaattttagttcatttcaggtttgtttatttgtttgtttttgttcgaaattgttggtgttttactaa

SEQ ID NO: 10810 - DNA, 222 bp, Candida albicans
tcaaaccaaaaaatcaatttccaactcccaattgaagaaccaacaactgcaacaggatccactgaacaacagtcgcagcaacaactggcacctaattccccacaaagggaacaacaacaacaacagtcacagtcacagtcccatcatctgcatcaaacctcaattagattcaaactcaatcatatagaaaaagaattgaataaactcaatcaattgatatag

SEQ ID NO: 10811 - DNA, 264 bp, Candida albicans
ttgtgtaatcaagatatgcataaattgactgaagctttagtcaatacctttgaagaatttttactgaaaatacaacggaaatggttacaattaatgataacttatattcaaaattgtaaaaatatgtttgaagcaaatttaactaattggaaagaatttaaagaatctttagttaatgaaaccagagaagtgaactacattaatatgtcttgtatatgttactttatttcaagtgcctgctttgatatttatttatttaattga

SEQ ID NO: 10812 - DNA, 354 bp, Candida albicans
  unsure (85): Identity of nucleotide sequences at the above locations are unknown.
acacccccgccagccattgtgtcttacaacaactattcaaagtacacccgccacctatctactgacgtgtttatcagcacctcanagatcttatacgccttcaaccagatcttagtcagtctcgatgcaacccgcaacgaaattgtcaccgccgtaaccatccaacatgacattatcaacttcaaccacccgttcatcgccacctatgcgtacgactttatcggtgcctggtcaatcctactgaaacaccaccctggaaagttctctgctcagttgcagcttaacatctccagtctacagaaacttgcaaacaacgacgatatcgataaactatgtacatatataaacacttaa

SEQ ID NO: 10813 - DNA, 279 bp, Candida albicans
  unsure (249): Identity of nucleotide sequences at the above locations are unknown.
gccgcattcaaagtgtctttggcaatgttccgcccaataactccaattggaagagtcctttcggattacttggcccaggctatacgagtggggttaacaagttcaaacaccacccaccacgaatttgattggagaacattgcccaccatgttgttgtacaatagacacccccgccagccattgtgtcttacaacaactattcaaagtacacccgccacctatctactgacgtgtttatcagcacctcanagatcttatacgccttcaaccagatcttag

SEQ ID NO: 10814 - DNA, 534 bp, Candida albicans
ataaacttgacatggttgataaagaaggcaagagaaaaattttttttgttgttgttgttgttgttttttttaaccatgtctttacgtgaacgattgagagaggtggaggaatccccaaacacatacacacatgtcctacaaaaggatattgctcgtgttgagacgtttattaaggaatgtgacaaggcaattgcccagctagacgaatccgctccagtcggtacacaaatcattgccctctacgaaatacttggagttattccctacacccccgacaaaaacgataccatcggcacagcagcaacaacagtggtgctacaatccatgatcaaccgctacaccccccaatccacaactcctattgatttcctggaaataatcgccgacctcaaccatttgcgtgccaacaaacaaactgctcttgccgacttacagtcccgcaactttgcctccccactacccgaaaaactcgcagaagcgagggaacttgaaaaattgctcaactcttatatagcaaaaataaacaaccaatag

SEQ ID NO: 10815 - DNA, 213 bp, Candida albicans
ccaaacgtgatcgtacaatctacagctgtgacgcgtgtcggtcacgtaaaatcaaatgtaaccgacaaactccatgtgcctcatgccacaaatccaaaagagactgtgtctacaccgtctccagacaacgagatgcccaaatcacaaatagaaaactcgacaaaaagacctaccaccagatatcagcaatcgagaaaaagatctcggctctag

SEQ ID NO: 10816 - DNA, 336 bp, Candida albicans
tgtaatttactgagagtgatagatatcttagcaagagtgatactagaggaacaaacaaataaaagacaaggcatacataaaacccaaaaaaaaatcaaactcttgagaattaaagaaagaaaagaaaaaaatttgttcattaaaaaaaacacaacacacgataacgaaagatctttcaacaaccaaaccaactttcatccttctaccaatatcttcaacaaaagttttattcaatactattttaaaaataacagtgttactcgttcatttgatttgttaataagactgatttacccactttttagttcctataatcatacaggtttctcgtcctaa

SEQ ID NO: 10817 - DNA, 312 bp, Candida albicans
gagatgacatatttgattgaattgatagatatatggactgttgtctgtgaaaagaaagagtatgttaagtcacgtcacataactttttacacacagttggttttttttttttctcctcgtcttacaacttacttaacctttaattattttttagcgtcctttggtgatatgtgtgtgtctgtgttcaattgtacactgctaatataccaaaaaaaaagaatagtagcagaacgaaatagagaccatttaatactgaaacaccgtagggaggacgcttctagacagagtatattcgtagttaattatttatag

SEQ ID NO: 10818 - DNA, 186 bp, Candida albicans
tttctgaattttttaatgacaaattcattgattaataggtatatagacactgtaacagcactagtaatgaagatctttcttttatttctattgaaaaaccccgccaatgaagaaaaaattgccatttttttatcctataagtatattttttcacacatcgccgattgggccgatcaatcgcttcaa

SEQ ID NO: 10819 - DNA, 204 bp, Candida albicans
caacaaatctttccaatgattggtatttgtgcgactctgcacgacatgtgttttcgtgcatttaaattgtttattcaaaattcaagacatatgcagatagtacacaaattaagagtttggtataaaaggaataagaaatgtcaaatattttatatagttatatattttaattatgggaaattaaacgtttattctgttctataa

SEQ ID NO: 10820 - DNA, 369 bp, Candida albicans
  unsure (10): Identity of nucleotide sequences at the above locations are unknown.
gaatttgacnttgagattacagaagtatatggtgttttgaatagccatggaattgatcatggttcgtctgatgttaataaacaaactttccctcaatggggtattgcttcagaatccgtcgaaggaaaatcaacacaaccaaaaacaaatgaatttaatcaagtgtttgaaaaacatttacatagaagcagcgagattcgtcaactgattacaaatgatgttgattctccagttagtgtcaattctgattcaacatcaaatgtacaatctattgagccagttgatacttatagttcagcggaaattgacaatttacttggaaatatccaatggtttgatcaatggacagacttcaacattgatttttag

SEQ ID NO: 10821 - DNA, 186 bp, Candida albicans
tctagatttcacgtaatcagaaagaaaaaacgatacgatattgtaaatataagaccaagttcagaagaagaagatataggcttgtgtgtgtgtgtgtgtatgtgtgtgacaaataaacgaggggccaagtgttgtatagtcgtggcattcgactcaattaaagaacagattgcattaccaatttaa

SEQ ID NO: 10822 - DNA, 1407 bp, Candida albicans
ttaggtcttgtggctgcattaattttattatgttgttgtcttaaaagaagaaagaacaaaaataatgaaaataatactaatgataatgatgaatattttaatgaatttaaacaaccaagaaaaccaatgcctccaattaatggtattgcaggtgccggtgccggtgctggtgcaggagctttagctttagctgctggtgcaggagccattgttgcaactagttcaaatgaatctattaaagatgaatcaacgatgaatgttttcaaattagaacataattattccaaatcttcaagttcattaactcaagttgaaacatcaagtagtgaatcattttatgatactcatgaaaatacaccaattgtgaaatcttggcgtgctaatactgaatcagatagtaaattagctcgtattagtaatggatcattagctactgtgaatacggaaaatttatttctggttagattaattgatgattattccgttagaaattcagaaacttcatcgaaatttttgagtagtaattcattaaatgctttattacgtcgtgaatcattatcaaacaacaatagtaataatagtactaatttccaaagattagatagtaatggtaatattgttggtgaattgaattttaataacaataacaacccaaagagtaatcgatcatcactgtcggaaaaatatatgacacaattatcatcaccattaccaccaccatcattaccacaactgcaagcaaacttacatattgtacctgaagaaaaatctcgtgatttgagtcatactggtaaagatgaaactacaggaactataagtaatttattattgcaatttaatgatcatagatcaaaagtaagtgatgatgaatttaatagttcatcaagggttaaacaacaacgacgacaacgacatcaacatccattatctagagaaaattcattttcaaatcattatgattttgataatcgattaccatctccaaattatgcattaggaactaattcttcaacaatggtttctcgttcaagtgatacatttttattagatgaatcaactccaataaataataatcatattagtaataccaccacagctccaaccacaaccacaaccaacagtaaccctaataataacaacaacaaccaagatggacaaaccatgcaacatcaaaatttatcagcaattttattaggttcaatcaattctgataaatttttctttgacaagaatcatactaacgccaacaaaaatagcccatcatcaacaccatatagtttaaatattgggaaatcagctaaattagttgattttacaagaaaaggaagtttaagagaatcagcttatgagcctgattatatatatactggtcaatcagcatcgatacagattgatgatagtgattag

SEQ ID NO: 10823 - DNA, 219 bp, Candida albicans
caaaataacacaagtcaaaaaccaagtcaaaaacaaaaacattctctatataaagacaaaaccaaaaataatatcagtaacagtgtattatattatattatatcatatcatattatatcatattctaatcactatcatcaatctgtatcgatgctgattgaccagtatatatataatcaggctcataagctgattctcttaaacttccttttcttgtaa

SEQ ID NO: 10824 - DNA, 192 bp, Candida albicans
tttatgggaaccaataaagcccaactttatattttcgtccacatttctaagcagaattacaatctaatacttgccccgaaaaaagggaaatccatctccatacgtgataaagataattttccacttaaacatttgggtatcaataaacaattcttgaaattgttcgaattggaagaattgaaaaacatccct

SEQ ID NO: 10825 - DNA, 669 bp, Candida albicans
aatggcagtacaatgcaaaacatatgtagaaagcaatatttagtagtagaaagtgtatatatgctaccaaatgcgagacgcgcttcatttgaattttttttatttgcacaaaaaaaaaattactctccaatcctgaaaccttttctccttggaaccagatcatccagaatttttacacacggatcaaaaacgacctccaccgtttttgaagaaaaaaagtcgacttatagataccagcagttgatatttctatttttattgggtttccttgattttgttaaaaattgcaatagccttttctttttgtatgcaaacgaagaattaaattacttgagactgttgaatatgccaccaaaaagaaagaagctcctgaaggaaacgaaattagcgctgctttcgaagaaacaatcacctattgtcacgacgaggagaagaagatcagcaagaaaactatcacatgagaataaaaacagtccttcacggactcaaaaaattgaagatgacattggtgttgatactcaaatgtcagaagagatagcgagctctttgaattcctcacctataaagcaaatagataggcgcctgaacaattcgactcctaccaaaaatacactttccctcgtctcccaatcaaaaactagaaaaacgttgcattttcagaagacctaa

SEQ ID NO: 10826 - DNA, 276 bp, Candida albicans
ttatgcctaaattactccttataccactcttggttaacacactactattatgtcggcgtactagcaccgccacctgagtatactataaatacgggtgctcggtacctctacttacgtagttctatacttttactcttcatacgactatcctccttcaccaccaatatacacactaaaaggactaatacccacactcagggttataacattagttcattttatagatatatcagtactcgatcttataattataaatatttatttatatatatatag

SEQ ID NO: 10827 - DNA, 183 bp, Candida albicans
cttagtactatggagttatcttattgtgtgtaccctttgcaattgatagtttcaagtgcaggcagatgcaaagatgttgctaaaaagatcactacatatagatggatagatacgtcaaaggcagtgctgtttcggataggtgcttacaaagatgggcgactgctatattgtagtatgttttga

SEQ ID NO: 10828 - DNA, 189 bp, Candida albicans
attttagtaccagaactatcacctaaattttatataaccctgacaccatcaaaattacataaaatacaacaaacaacatatctattcaaagcgccaaacatacaaaccacaacaaacacaaacttattcacccttttgaagtgcttaaatcaaaacacctctcaaaatattaatgtcttcggtgtgtga

SEQ ID NO: 10829 - DNA, 186 bp, Candida albicans
aacaagaaatcgcataataaaaaatcgtcatggaaagcaaaccgtggtggtatagattatataaaactttttgttagaattttaaattactcctccaataatatattagttgactttattcaactcgaggttttccttcttcttgagaaacaaccaatactcaattttcgtaggtttattgtatga

SEQ ID NO: 10830 - DNA, 186 bp, Candida albicans
ttcttcatatttcagttgaaggctactgctccaagacccaaagctaaaatgccccaacatattcgtttggcctctaagcactattcacaaattcacaaatcttgtgcttacctatttagacttacattctctatagctataatagaacctacatttaagctaattccgttaaacactactcaataa

SEQ ID NO: 10831 - DNA, 249 bp, Candida albicans
cttgttagtaagaagttgggagagcagacgagtaaaggcgacacaaacaaaatggtgcagtctatggatgagactgctctaattgcaatggggttattaatagagtcatggtgcgaggagttgatcactgatgagacagcaagacattttctcacaacacacaaggatgacccaactattttactctctgatgaagaaagtgactctaaggtgaataatgaggatgtacaatatgaacacgaagaataa

SEQ ID NO: 10832 - DNA, 195 bp, Candida albicans
cgaagcaagtggttgttgatttatggtttggacataatgtttagtatacaaggttggggagttgtaagcagtgtacatccagtagatggtaccatggataatccagattctattaaaattggtaacgaaatgcaaccaggttctgatttccttataagttttgaagaaaacattcttccattcaacttcacctaa

SEQ ID NO: 10833 - DNA, 342 bp, Candida albicans
aattcagatatgcccaacagcgctggaggaaattttgtcaccccgggacaagaacttgttgacaccaagtttgataaaatttatgaagtttccgataaattgccaaaattaataactatcgatgccaaagaattgccatttggcaaagatgtggttatccaaaccataagaaaattaactggggaatcccttgatggggaaattgctgtttcttatttggacaccccagaagaaactttatcagagataacagatgttggtagatatcaagtcaaactcatatctgctgatggaaaagactttgtgttgcaaactttagacgttgaagaagtttcaaagtaa

SEQ ID NO: 10834 - DNA, 225 bp, Candida albicans
ctatatggccattgtttaatcggttctgatcattgtccagtatttacagattgtgatatgagtgatgaggatgaggatgaggatgagaacgaggacggtaacaaaaccagtgttgatcttattgaacaacccaaattatcatttgaagctaaaaatcatttcaaaatcaataaaattagagacattacaagtttctttggaagtaaaagacaaaagctacaataa

SEQ ID NO: 10835 - DNA, 246 bp, Candida albicans
acttctacgcatttgtctggtcagcagttattgtgtgcatcttggttgtctttttcaatttattgggtcattgctgtgggttatttggaacaagaagacattatagaacagtcagaaatccacaaccagatgctgaacaacataaagaagaaactgaaagtgattaatctaattgttttaaggccaaatagggtttttatactgaatgtttcttcgatattgttgtttgttcagttttgcttttga

SEQ ID NO: 10836 - DNA, 195 bp, Candida albicans
atttacgtccttctagttttgaaaaagtttgttgtgcgtggtggtagtagtgtcgcacatcttgagatggaaagtaaacatcaacggacaaaaaaagagaaaagcaaaaaatataattatctagtcgaattttatccaccatcacctacactattatctactctcttcaaatatgatatgttcaatatctggtga

SEQ ID NO: 10837 - DNA, 186 bp, Candida albicans
tctttggtctcgcttaccaagccgtatcttccacttcgtggtgaagattcgctggtaaagatcattagattagattttcattattttcaatgcatgtgttatattttggtatttttagtcattttattatggtttattttttattttttttctctttcaatatcgatggttgttactttttactag

SEQ ID NO: 10838 - DNA, 321 bp, Candida albicans
  unsure (6): Identity of nucleotide sequences at the above locations are unknown.
aaaaantccaggggctgtccaatcactaaaaaaactcttggtaatgggaatggcacgagctcatacagattccccttgtattatgattctacaactaatgaaaaagtaattatgtcactggggaatcaatcaatgattatgaatcaagaatttgaatatggattgaaattattaaacaagaatttagtgatcttgatagataaaattcaaagtttgatgattggtgatggttcaggaaattatgatagtcatgttcccatagaatgtctagataatattctatggaatttaaaatatctagaattatttatgacagtttga

SEQ ID NO: 10839 - DNA, 279 bp, Candida albicans
aaggtggttgctgaaggggcggcgttgaagaaatcattgaaaattgcggtggtggtgattgttgaaactgtctttgatgttgaagatgtggttgctgttgattcgattgctgctgttgttggtattgctgcagttgctgcaggtgcttttgttgttgttgttgtgatggttcttgctgttgttgatcttgctgcattggatactgctgaagagttggtgcttgtgatggtaaagattgcgagggtaaagaatctaaaacttctcttgttgaaccagtag

SEQ ID NO: 10840 - DNA, 195 bp, Candida albicans
ccggtaatcaagatgttcctaaaagaatcatcatatcctattggtttcagcacattgttgaggcctaccgatgcaccaccaaaaaacatttcctttgttttggatgttgctcccgtcgatgctctgctggacataatactataccaatcaattcttctcacttgctcaacatcaaaggcacataaaggtgggtga

SEQ ID NO: 10841 - DNA, 195 bp, Candida albicans
atctattttagtttgaagattattagatatcacgaatttgctttattttgttttgaaggttatattttcagtttgggacttgtcgaaggcttagaccaatatcggaatcacttgtatatagatggatacgttgaagacatgtcacgattcaatacatataatgtagactactttcctacgagaaaactcgaataa

SEQ ID NO: 10842 - DNA, 372 bp, Candida albicans
acatctcaaccactttttacatcattatttgacttgaagaataaattttccttaaaatccacacacttagtcatgcatccacagttagataaaaatagattcaatacttgtgataaattaatggatgccttggaagagtgtcatcgacaagaatttctcaaacaatgtttaggaatgtgtaattttgaaaaagaacaattgattcaatgtttacattatcaaagagttgaagattctaaattgagaatattggaaactagagaaaagaggaaaaactgggagttgaagaagaaacaagcagaagaagaagcatatggtaagaatggatatttgaaaaaagtattagaagcagaagttgcctcgaagaaataa

SEQ ID NO: 10843 - DNA, 225 bp, Candida albicans
tggactgatggcaactcttatcaagggcgctatttctctcctgtcgctgccacgactccaacattttttattttcggatccacagaaaaaaaaaaagataggtcacgatctggacagaggaagaaaaaaaaaagtataacaggaggagaagccgataacgatcctcacttcttttctacatctattcgttgttttgtcatcataattatatttttatttatttag

SEQ ID NO: 10844 - DNA, 1527 bp, Candida albicans
aagctattgaaagaaggatataatgttggtatcattgaacccacagatggatcatcaagtgctggtgataaatttgaagctatcataacgttttgcacttggcattgtttgagagcttttaataagaccattaacaaacttattacaatacaaaatagaacaaataatgagcaaatatccccaaatgaaattatcacagaagttgacggagaaatgacagatgaagaattcataaatcagatagccactcaaggggttgttgcacaatcaaacttaactgcaggtaggaataaggaagagataattgcaaatcaaagaattgctctttcatatatggtagaattaaaacggaaaaaagccattgaagaagctaatgattttttgcatgtaatcgaagccacgtttcgggaatacccggactttgttgcatacgcccagaaaacattcaaaaccacagggaaatactggttaaactgccattttggtaattacagagaacttacaaataattgtgtgaaaagttatcaccaagttttaaaaaccaaatatttcgaaagacgcagaaaataccgagttgaccgagtaatttggatgtttattgaacccattgctaagtactatgagtattaccattcagctgttattgttacatccctgttaaggtacattgataaagctgaagaagcttccaaactcaaagcagaagcagtttcagatgaggacatgaggcaaatgattgttgaccttccaggttatattgcagttaaatcgttcaatggatcaaattattacaagattagttttggtgaacgtggaatcttttcctgcgaatgtccgtacaacgagtattcaattgattggtgcaaacacattttcttatataagcgttataaggtggctaaaggattggacataccttttgtcgagcttgaaagaaaccctttggctgacttaagtggtttaaacggtactaatgagatagttgaacgagaaacagatactattggagatgaatcagaagacgaagaattagttgatagtgagtcaggatttaagaatgccacctataatgagagtgattttggtgacgataattttgattctatggaaaatgatccagatggtgacgaaccagattttagtattgaaaacacagaaccaactgaagtatcccaagaagagaccgaagaagaaattggtgccaggcttgcacgcgacagagttgatcctgggttctccatagatgacgacaatattggaaacgacttcgaactcgctgactcttctcaagtttttacagacggtggaacagcttattacacacaaaacacagaatcagacccatttattgaatggcctataagtgaaacaattgatctgcaagaaagtgctgatgttattttagaaatcgaaagcatagaaggggtttatgctaagaaagctgctagaaatattaagcaacgggaagagaattatagtagtttagatacagagcttaaaagaattcgttttcacacacgccgctag

SEQ ID NO: 10845 - DNA, 879 bp, Candida albicans
aagagaaaaagaagaatcgatgcctttatagaaaatgtgcaatgtcttcaaaattatgttagagatagctccaacagtaaatacacttattatcgttgtgagtattgcaaaaagaataaaggtgttaaaagtaaaaaaactgattgcaagcataaaattgcagtacatgctcttgaaggtggaaaatacaaaatagtctggcactttcagcataaccatgctttcgatccaagaaggattacaaaggcaaccagaaactggttgatggacttagcttcaacaaatataccaagggcaagttctgacagcaggagatcagtgactaaattcaaactgagttcatttttactttctgacaaatttaaaatttccaacaaggtatttaattattataaaaacaaaaataaagagagccaggcacatcttgacaaaaatgttatcaaaagtttaaaaatatgggtttcatatataaatacccttaatgaatttgccgtgtttaaaaagagaccaacaaatactgaaaatgctgaattctgtgacgtggaagccgatgctttgaatcctgagtctacgtggtattttggaattattcttttgagcaatctccaatatatgctgagcccacaaactgttttccttgatagtacacataaattaggccacggccctcacaacgaggacataataacatatatctttatcacaaaaagctctttatctggaggagggataccaataggttacttaataacaaatagagagtctcatgagccgttagcatcatttttgagattttttgttgaaaagaaaatacaaatcaaaagattcgtgatagattgttcagctactgaaataaaagctattgaaagaaggatataa

SEQ ID NO: 10846 - DNA, 234 bp, Candida albicans
cttttcttacaagtacccacacgtcccccatcctccttctcatcatcatcctcccatttttccgttttcaatatcattaaagttgtatatcaattagttattccatccattatccgtccatcttcaatattagagtataaaactattacaaaaataaccgttacaaaacaatacattttaacggataattatttgaattcaaattcagtccgatattattattattattattaa

SEQ ID NO: 10847 - DNA, 204 bp, Candida albicans
actatgttcaatgggcttaggaaagtatggagtttggcaatttttcagcgtaatttatttatatataacgacgtcatcaacaagcaacaacaacaacaacaaccaccatttttttatcctttttactttcctttttctttccgagatattacaaccaatactagaataaaaggttattttatcaaagacgggtttataaaatga

SEQ ID NO: 10848 - DNA, 237 bp, Candida albicans
tctcttttgaaagataatcgaaatatttgtggggtgttgtggtcagtgatttctttcagtatgatccaattcattattagtttataccattggaaaatcagcttggtgttaatagagcatttatcagataatatcactgggaatgaattgatctctcctgcaagttctctttgtgtgtattttttgattgacgctatttttaaatcggttgacctgaatcctataatggaatgttga

SEQ ID NO: 10849 - DNA, 255 bp, Candida albicans
ataaataaacaaatttcaatcaatacaatttatctttattttgacaattcgatattttctctgagagaaaaactatgtattattatggaaaggatacctctttcagtatttgaaaaattcaataatcaagagttgttactggatgttccagaagataggtttatttctaaatctttacaggctccagaaatattttcaactccaagcgaagactgcacgtactttacgaagtcaaataacagcaacatcctctag

SEQ ID NO: 10850 - DNA, 624 bp, Candida albicans
cttactacaatgagtaccgctagagtttatattggtgtttttttcaggtttttccagtttgttggaaatgtgggatgttttgctaccggtgtaaagacattacgcccttacaatgcttttatattaactgtcacggtgttgaatttcatttacaattgctatatttggtttggtgtgccaattattgggggcttgaaagcctacaacggaattttgttaggtggagatatctcgtttttctttttgtacattgggagttctatgttccaagccttcgccggttacaccgacgattggactgaagatgattttggtttttcttttaatccctattgttactatgcaagttgggctattggcgttatttgtgctgcactttacatcattacatttataatgtacgtatgttggggtctcattcctgcttctaggtatggcttttcgacagggttctgtgaaaggccgccattcaaatttggctgcctagtgtttgacaaatcccaagttgatcatgactgtgagaataataacgatattgatttggaatcaatgcagcatagcacaagtaataatactggaaccaaacaaaatgaagttgaaaaacaagaatcaattgtgttctaa

SEQ ID NO: 10851 - DNA, 264 bp, Candida albicans
cttcttcaacaaattgtcatccccaaggatagatttttattgtttgacggagggtttggcagcatcgaagttgaccccgtttatgataccgacccaaacacatttgaaagtcttgttgacaatcttgtcaccaacaggaaccttgacatatttgtttctaccaacaatcaaagcagcaattgcgataaagaagaagcagaacgtaagcaagtaagaagaccagaatccaatgtgagcctccatttgagtggtggcaataactga

SEQ ID NO: 10852 - DNA, 243 bp, Candida albicans
tttggcaaatattattcatctcttgcactttattcatgtctaccccaacactacaaagataggtatggcactcataataatattaacaagaatattttagttgatagtgcttggttttcttcaacccactcaagtttgttacacatatttacaagagggaaaaagaaactaacaattatcaacaattaccataaatctaagctttacgatctttcatctcgtggagaacaatgcattttctga

SEQ ID NO: 10853 - DNA, 264 bp, Candida albicans
ggtcaaactaccgaaaaatgtagtttactagctattgttaaaagtaaaacaaacactgttataacgccatttaatataagattttcaagatcttttcacgaagttagtcgtattgggaacataatgccttggacatttattcccgtcactttacaaagctgtttagaaggcttttcagcagtagttttgtgtgctaatccagctgaactgagtaggcttgcaataaaccaaatatcagttcatgtatctgaaatatgcctttag

SEQ ID NO: 10854 - DNA, 855 bp, Candida albicans
cttcaggccgtggtgaagatctacgatatttatactcgatgtattctaaaattgtatcttaaagttgcaaaagaagaaacacggaatatgttttatgaaaagtataagaatttgcataatcatttacgattggaggaaacgtttcatgaattttttttcaatgaaaacttaggtttcgacccaagcaaaacttatcaagcattaaataagttatttcgaccattttggataaagtctaatgagaaacccaatcgtactcaagccaatgctgctgatgatgctactagcaatcaaatgagtagtacgccattggaatctctgtcatcatcaagtggtattctatatgggaactcatcatcatcatcgacttctttccaaccacctatggttcatcaaagaaattcggtatcttcccaccagtttgattacacacaagattttccgcataatggtggaaaacctcttgaaatctcttatctagtacatcctcaaatgaaacattttgatgctgcaattggctcagtgacgaaaagaaatggaagtcctaatgataaggaattgtcagaaacattcgatccacaggctattagtgtcattaatgcagctcaaatgcagcagcaacagcaacagcaacaacagcaacagcaacaacagccaccattttttactcctccacctcctccaccacaacagtccctactaccatcacaatatcaacaacagtcgcagcaacaacaacagcaacaggaacagcctcttagtaatcgattcaattcaaactttactagtttagaagaaatgattgaagagaattatgtgggtgacttgaactttcctgatatattttataactaa

SEQ ID NO: 10855 - DNA, 192 bp, Candida albicans
acaatagtggtcatcttaaatgattgctgctttcccgttttcatgttagctttttattgtttcggaaggcttacttttggagttttctttctttcatttttatttgtctacactatgatcgtactatcaaccaagtatgcaattactactgttgttacgactaaccaaagtatcacaaaagaaggacaatga

SEQ ID NO: 10856 - DNA, 408 bp, Candida albicans
cgatgtgaagacgaagaggacggttctaacaattcaaacgacggaaacttgttctcgttgtctttcaattcatcacagaaaaagtcaacgcttgaaaaagcaaaactgacatcacctctgaaatctactggaaaacgttcaagaaagaattcattcaaatataagccaacaacttctactaaagataccggagctaaaagtcgtccaatattttacaacttcgacagtagtggtgactcttcatctgaagaagaagaacaagaagatcaggatactcgtaaggatgatgaagaacaagatgatatgctgatgacaaaggaaagtaaggataaatttgtgctgcaaaagagtgaaaacaaagtggatggggattctgattatttttggttcggtaataataataaatag

SEQ ID NO: 10857 - DNA, 306 bp, Candida albicans
gttcctcattcaatactctatattaccctactaacaatgtcttcagttattgcttctaacattccatctaaaactactcctgctcaagttaaagagtttttcgaatcgcaagctggtgaagtatatgatttgattccattagctgataatggtaaggttcaaaaattcgaagtcttgtttaaagatcgcaagtcagtctatactgctttggacttgagtgaagcctacattgatgaagttgccatcagagttaatgaagttccagaattgactgatggtcaagtaggcaaagctccacaacagtag

SEQ ID NO: 10858 - DNA, 222 bp, Candida albicans
gggaattggggaatgggggaaaggggagagatagaggccggaatcaattataataattatcgtataacaaacattatcaatttaagggggttaatatgtagaagagcagttttatgtaatgtaatattatgcaattacaaaatatatcccatagaggatttgatcttgataagaagtccattactaagtaataaccaaccaaaatataccctgatgatatga

SEQ ID NO: 10859 - DNA, 183 bp, Candida albicans; identical to SEQ ID NO: 7895

SEQ ID NO: 10860 - DNA, 249 bp, Candida albicans
cccttcttcatcaatttatcaaaaaaggatccttcttttccagaagagcattcgacttcaagaccaactaagtcaaatattttgttattatccaacgagagcttgccaaatatattcttatcttctattaatttgcagtccaacttttttgctttggataaaagatcatcaaaattgtatgatttaattaaagcgccattttcatataacgagatagcaatcctgtcctcacttattttccctaaatga

SEQ ID NO: 10861 - DNA, 195 bp, Candida albicans
tgcatacatcagaataacaaaattgtatttgcctcttgtttcacagtgcaacataacaatatatttaatcaacagaaagatatttgttcatatgcacagaatatagatggtatgcctttcaggtatttatcttacaaagcagatcaaataacttatccctatatatcattggtatttcttagcatgatttcttag

SEQ ID NO: 10862 - DNA, 339 bp, Candida albicans
  unsure (330),(334): Identity of nucleotide sequences at the above locations are unknown.
ttggtttttcttcaccattttgattgtatgacaaaagaaccatactatatttctaatttaacttcaataaaacctagcaacaatagaaactactcgattgtatctccagatttaccaagtcttactaatactcaattaaaatatgcacccccgttaactacaaatattgataattctaccaacattgatgttggcaataaagcaagaaaacgttctattgaaccatattatagtaaacctgtgaaaatcggggttttaccaccagctattttaaatcaatttgcttatcatttccattcttcaccacgggtcgaggatccgcgtaaattncgtnctccg

SEQ ID NO: 10863 - DNA, 204 bp, Candida albicans
gatgttataacgcagcaaaataatgcacaatatgacacaataacaaatgaaaggcgatatcaaaatataaaccaaaaacaacctacaaaaaaatactctcctattattcataataacgcaacagtcaaatcaattggaaattctgatgatcatcttaagcgcaaggggtttatatttaccaacaaaaaaccaaaactaaactga

SEQ ID NO: 10864 - DNA, 195 bp, Candida albicans
gattatcttttgtcgcatttggccattcaagcattgatttatgtttatttttcttttattaatacgaaaatactattagtgaggcaaagaaaacagaaaagagagtgccaacataaattcgaaaaaataaaactgacatgtggtttgtgtattccttcaggtcgagatttttttcaatctcgggccgcaccatga

SEQ ID NO: 10865 - DNA, 504 bp, Candida albicans
tttgatacaactgggcttcaaacaatggatataattaagaagaaatatccattttggaaacgcttattacataaatggcaatctcgtagagatatccccttccgtaaaaaattcttcattggttatgatttatatggtaatacatattgggaattcaccattgatgggaatatgtcaagattacgacgtaaattagaaccatttcgtaaagaattatttgaagttgattattttaaaactattccaccacaatggttacaatggttaagaagaactagggaacattcacctagtttaaatgaattaattgaagatcaaattagacaacaacgaattaaaattttggcacaacaagctgatgagaattggaaattggaaaaattaagattagaaagagaacaaccattgaaattatcaaatgaattaaataaagtgaaattagaaaatgaaaaatctattgaaaaacaaaaacgaaaagaaaacgaagcattactaaggggttga

SEQ ID NO: 10866 - DNA, 825 bp, Candida albicans
tggaacattaaactaatcaattattcacattatttatttataattatggtaacaataaactatgaacctttagaacatttacctcatattgatgagaatattagtcctgaagaaagatcacacgttgaacagttgattcgattagagttggcaaatcaatttaataataacattcaacatatcactcataatgatgagaatatggccaacccaaatataatagtagaacaacagcaacaacaagaacaacaacaactgttagtgccgacacccatgcatccattagttgatcaacttttaccactaaatccaaacatacaaccaacttcaataatgcaattaacccaagaacgttttgaagaagaatttggtgatgatgacgatgatgatgatggtgatgacaagcatttacccccaggtattgatttaacaaaatacacacaattcaatataacgtcacctttagatgaagaaggtaatcaatctatactagatgacaataataatcaacaaataaattataccaatttatacaccacattaggacattcagcattacagcatagaaatttagagttattgatacgaaatcaaacagatttgaatcaattacaacaacaagatttggcaagattggatgaattaaatactgaattgacgaaaaatatcaataacaagagaagtatggttgatgaattgaaaaccaatcgtaaaagacgtcaattaaatgagttaaaaccattacaagaagaatatgaagaacgttggaaacaaagtattaatacagctatagaatcatccattaactcaattaaccagaaataa

SEQ ID NO: 10867 - DNA, 222 bp, Candida albicans
aatttttttttatataggatagtttcaacacaaaacttaatgatattatacaccagatatatacgttttaatattagtaaagtagatattacaaaagtagtattaattagaaatcagtttagggctattaatataccaactgaagtgattaaatatgtttgggttgagatcagtcatttgtttttgtttttttccattcatccacgcacacacaatacataa

SEQ ID NO: 10868 - DNA, 324 bp, Candida albicans
aaaaaaatgtttgcatttaaaaaatctactacttcaattctcaaaacagtggtcgccccaacatcatctcgttatttatccaccgtcacattaagatcaatcccaagaacattccataatgccactaaagtttcattattcaatggattaagaactacaccaagattttatagtgtattgactgaatctccagaggcaaaagtatataaatatgccgatgttaaggatgtggccgtacaccctgaaaaacaccctgattctgtttttaggggaaggttagagaaccaactgaatttggagatggtcatattccaagagctttga

SEQ ID NO: 10869 - DNA, 198 bp, Candida albicans
ttggataggtgggtctatatatatgtacacgtgaatgtattgtataatccaataattaattttgacttgaacagtgcaagttatataccaattggagggggggtaggtttggggatttcgttatctctacttaaagaattattaaaacaattgaaagaaaattttctgtctcattttttttttttgctgtggaattaa

SEQ ID NO: 10870 - DNA, 318 bp, Candida albicans
acaggcataaactttaagaaactgttactttgttcaataaatacggtcaacacagaactgaagaatactaaaagaaagattatcagaacgactgacacatatgcattattgcatgaaaagaatttgctaaatagtttgtggggaagagtactagaaatagatatggaaggaggatacgaaaggaacattgtaataagtttacgtagtacaaagataagaaagcaccaagatggatatggtgttcttgtgggtgaaactaggggcaatacatttgcaaaaacactccttttcaccgaattcaatgttattaaaaactaa

SEQ ID NO: 10871 - DNA, 330 bp, Candida albicans
tcagttctattcgaggaagaggtcatcacaatcaaccatttattgagggaacgggaagagggccaaatgtataagagggctaattggggcgccaaatattctgagaaggcgggtaaggaaagttgcggccgttcacaaagaaaatcattgtcaaattcaggcggatatggcgaggggtgccgaaattcttcaaagggtaatttaatgggattagaaccggaaaaaggatcgattcttggtttttcctcaaaaatgggggggagtaggggggaaattggagttcttctcaaaattaaaaaaagtatggaggattatttagaaggaaaataa

SEQ ID NO: 10872 - DNA, 300 bp, Candida albicans
ttttccatcaatgctccgagtttagtttcatttttcctttttctctttttctacatcatcctcacaacaatttcaaatatgtctcaagacaacgtctcatcaacatctacagctgaggctgtaaataatgaaatcaaagtcaaagatgaatttccacaagaagaacaagctcataccaattttagaattataacccagttaattgctacattggttacatcattaagtttttccctattgcctttgggtggttttgtttttcggttccaatactggttacaatttccgggttgtatataa

SEQ ID NO: 10873 - DNA, 348 bp, Candida albicans
gtgatttttatgcaagtttcaaaatcctatgcacgtccacatttaagcaattataaggcgagtcgtgttaatttggttaaaaataaaagaaattattatgcatttcacgcagatactgatctcagacaacgtaatttcatccgaactgaacattcacataggctgcatacaatagaggcatttttttttctcaattgtgcttttttctcaatagaacaagaattgagaaaaagacaaacaataaagtttaactattttgttcatttagtcacaaaactagttttatttttttttgtcatggttcgagttaatccgaagagtttgttcatcaccacgccacacgcctag

SEQ ID NO: 10874 - DNA, 186 bp, Candida albicans
ttttaccaaactcgactgattattaggaaaaaaaaaaaaaacacggaaaaactaatgcagatgcacaaaaaagagcttgtctttcgggcgagaaaaaaaaattttcacttgttgaaagcctctacatcaacaatactaacacaatcaccctacactgctggtatttcctcaagtcaaattttataa

SEQ ID NO: 10875 - DNA, 357 bp, Candida albicans
gagttggtggtttttcctttttttttgactattctttttcattttgccatgggggaagtggagtggtgctatggggacattcgcatgtatgccgttttagtgagtgacccagaaaaaacacataaaaaaaatctcaacctttttttttcgagcagttttttagaaattgtgcatatttttttccgatctcatcatttggtatggaaattagaatttttacaattgttaccgaataacaaaaaaagcaagcggacgacaagtattcgatatttgtatttacataccgattacatagctagagtttttttctccaccaataacgatataaagattatcagttcagtttggtatccataa

SEQ ID NO: 10876 - DNA, 240 bp, Candida albicans
aaaattattttcattttagccccacagcagaagtggatttttaatacacacacagatttaattggagccaatcccgcacacagtgaccgaaaaaaaaaagaattaaattggtgcacgtggttgatttcttctttcggattcagatgcggctgttttaataaattgttccaaagaattttcatatacgattgtcgaagagatgagttgcaaacgagtttctggttgaccttattccagtaa

SEQ ID NO: 10877 - DNA, 303 bp, Candida albicans
ccaataccccaaaagaatgcaaaaaaggtcaataaccattggtctttatggggtaagaactctaaaaagatacaggtatccaaaactaaattaccaccagcagcaaaacaactcaaaaatacaaagatacaatatgaggccatattgttcatgacaccagttaaaatggtgaaaagtgcacttaataataatgttaaattgaaagctaaacgtcttccaatcaaatctgcagaaaacccccaaaatagtgctcccacaagcaaacccgcagctaacatttcatttgaaacagggtacttgtag

SEQ ID NO: 10878 - DNA, 219 bp, Candida albicans
cattgcagcacactggtgcttccaccgccggttaaaactattacggatattgtcaactcatctctcactggaaaaagaataacaggatcgaaaaaaaaaagaaaaaaaaaatttgaattgtgtaatacattaataacaatcaatcacccaatttcaatcttaaacaatgccggcaaaatcacaacaaggttgggaaataaatttcaatcagtcgtctga

SEQ ID NO: 10879 - DNA, 198 bp, Candida albicans
cagcttcgagaaatagagtttcttctagtaaagactcacatacatttacgtactgatagcaccctttattgtgatttagtgcaaatacttcaagcaatcggctattctgctaggttatatctaaggtcacgaagtatagctgtttggcaatttagagaatatataacaactggtgtggtggggtttgagaactcttaa

SEQ ID NO: 10880 - DNA, 1029 bp, Candida albicans
agaccacttgctaccagatgtgcatttgaaataggtaaagaaatggcagaatcaacaaccaccacctactatcgactaaacaatgtgcatttatttgatcctgatcttgtgaatcctagtatcaaagaattgtatgatgagttgtatggagacattgatgattggattgatatggaaccagcacaagttacgaacaattatagacaatatctacttattggatatgtcagtaaactcttggtgatacattcccagactacattatatatatttttgcctgtgttactacattggctatcacatcaaaatccgtatctacgacatttgggacagttactcgccaatgatttttttagtttccccgataattcaacaaccaacattgaggagttgaatggattgaaatttaataatacttcaagaatattctggaccttatacggagttgattattggaagccatttttgaatagagcgagtttatcagttgtgctaccatacaagatttctttagagttgtttgatgagttagaagacactcatcagttaccaaaaggttattacagaagagagttgtattcaatgtttcaaatttgtctcaattataatataatagttatgataatggtgaaaatactacaaaaaacccgcaagaaatgtaaaacatacgaagatgcgtaccagcatttcaagaatatttacactttggccgtggaaatggcatgtaactggttgcctttctatagcatcacttttccaaataataaaataattttcaattcattaaggcaactacaagaatttatgcaaggtaagttaaaagtattgtctagtcaaggagggaagtatacattattatataagagatcacaaggctttttcgaatcacttgaagctatactgtattattatctttatcctgaccggaagattattttgaattcggtggacaccgttgccaagacggcagtcaagttgagaattgacaatcataaatttctagcctggttgaacagaaacgcattttaa

SEQ ID NO: 10881 - DNA, 366 bp, Candida albicans
acaattttgtttatttatttatctatctatttatccaatacaatgcattctccatttaattttgtatcttgtaatattcttatagcttcatttgctaccgactcaaccagaaccagatttatatctgccatgactttattccccatatctgtttctttgactaatccgggcatcaatgcattgattctaattttccctcttaattcttttgatagacttttagtaaatcctaataagccagccttagatgcagcatacaccgaagtccctggtataaaatgttcagtcattgataatactgaagaaatatttaatattgttggatcagaccctttttggcgaagcatattcttcaccaccatttga

SEQ ID NO: 10882 - DNA, 222 bp, Candida albicans
tcagtcgctagttccagtaatgattgttgcaatatggtttcatttctagataataatgatactgctgctccttcaatggctaacttcttactgattgcaagtccaattcctcgagatccgcctgtgactaatgcagttttgcctttaaacatcgtcaaaatgagaaaacacacttatgaagagaatttgttcaaaataaatttagtcatttatttgaaataa

SEQ ID NO: 10883 - DNA, 225 bp, Candida albicans
aatgatgaaacagttaacgagattgatagtgtgactttgccaaagacattaaaaaatataaaactaaacaaaacaaaggaaagagacaaactaaaccacataatgaaaaaaaaaaaagaaaacaaaaaaaataatataaagaacagaggacagactattcaagacagcacactaccgccctattccattcgatatgctagaaacagatctatacgatgttcttga

SEQ ID NO: 10884 - DNA, 183 bp, Candida albicans
aaaaaagaaagaaagacacaactagttagtattcaattgattgtaagaagtaaaaaagaaactgatatttataatcatatatttaattgtggcacatacccagatcttgactatagattgctgttgttagtttttccgtcctataaatctcactcaattgtttatgacaaaatgctgacgtag

SEQ ID NO: 10885 - DNA, 945 bp, Candida albicans
ctttgcatggcccaatttcatagtattgtgcagtcaaacggaccacctccgacactttcaggttctcgtatatcaacacaacaacataatattcaacaacaacctggcatgattaatacatcttttaatggtaatcaacaagttgattccaatatgactactggtttattaaagattagtaatttaccacccgatttaactaggagagaagcaacattaatatttgccttggtaattgaagaaatgttaagcattgaaattaaagattatcagatatatgctgtgttcaaaaacatcaatacttgcattactactggaaaactactcgatggtaagtacatatttggtactgattaccctcctattaaagttgaatacgaaaatagcacattgttgggatcaccaacaaacatttctagcacacaatctgcatttaattcattaaggttatcgggaccaccaaataccaacatttctccacctaatcttcctcattcacaattacaacatcaatcttcaagcaattcaattgacaatggaaactcaagtctgacaggctcttttgatatgctttcgaaacggcaatctattgggaaccaaagatctagatttgttttcagtgatccatttgcacaagatcaactgcagcatcaactgcatcaacagcagcaacagcagcagcaacaacaacaacaacatcatcatcatcatcatcaacaacaagatccacacgcaaaacaagaaattatcggcattcaaccagcagggtctggtcccccatctgtgggtcctgcacctattggtctttcagatatgagtgggaagttcattttattgatggaatctccaaatgatgcgagagaatatgaaaatcttgttcgggattcatggggtccaaccacaggtaattctggtgtttcaactgtttcagcaaaattcccgtaa

SEQ ID NO: 10886 - DNA, 1197 bp, Candida albicans
atacaaacaaacatggtatctcgaagtcactcatcaaccccagtgccaatagatgctgaccatcctatccatttcttaaatattggtaatcaggaccaaatagcatccttgtccaaacaaacaccaataatcttactaaaccaacaagaagaaaatggatttcaaacaccggagttagttgcattaagaaacagcaacaaatacgtgttcgttatcaactggttatacaattaccgaggctatttaaagctacaatcagagttgtttgatattgacttatttgaattggaattattgggatttttcaatgcattcgatttgtcgagtttatttattaataaattaaaattagtattgatcacgtctgttcagaactctaagcttgttgagttggaagattttgaatttgtattccgtgctcattttggggatgactctccacttggtatccaaacagacaacgaacaagattcggtaaaatttgaccttctaaacatcacagagaagtttgatatcttgtatattttaataaactacatttcaaagtattccaagttcagagattggacggaaaaacagggactaacaactagacttgacccactattcaaattgtcactgactgaatatttttcattatttgatgataatcgattatacaaacgaacaataacttattatcccttgaccattcccaagaaaagaaaattatcacctgaatcaccacaagattattttgatgcagaggtttttgatgttaaagatgtcaaatttgaattggtatataagaacatttacgagttcaatgaatatttgagcaaaatcaaaaaaagcctggcccataaattgttatataccaaattggcaggtaagtccagtaccatcattgatacaatttttgataacgaagtgaaaaagagaagatatttgataaacaagcgtaaggagattcaaatggttaacctattggcagtacgtaaaagaagttctcgtttagaagctaaagaaagacaacgtcaagaagagttagaaagacagagggaagaagaatcgaagcaagctgctgaaagaagatttgaacgaagaatgaaactaaaaaataccgaaaacatggatactgggaaactatcaagagatcaacgaatgcaattaagacagttgaattatgaaccaacaccagaaccagacaaagcttag

SEQ ID NO: 10887 - DNA, 243 bp, Candida albicans
gacatgtccaacccccaatcaataaagaaaacagaaagaagacgatcaatagcattattgacgaaatctccattatctcaatctccatatattagtccatcaccaagaggttcagcgcctagttcttatgttgccaactctcagtttatgcgaggtgacactgaatccgtagcgatggaatcaacatcagaaaatcttccgagaatcttcaccacgggagtggacggacccgcgcttaagaat

SEQ ID NO: 10888 - DNA, 183 bp, Candida albicans
gattttgttagtaaattttcttgtttcgcctgttccgcgcatcctcctcatcctcctcgtttcatttggtcgccggaacttattgcttgtttaagatatgatctagttgttcaatttccatcaacactaaaaaaatctactaaaatttcaagtctacaaccaagcgttgaagagggggattga

SEQ ID NO: 10889 - DNA, 273 bp, Candida albicans
gtttatagttgtcgaagggtaaaccgctgttggtggtgttttaagattcacaattcagttttgttttttcctcccttatcttgtttatggtcaatgtgcactactaatttcactaccacgcaactacaagaaagaagaaaaattgcacgaatttatgttttagactctattaactacaacatctctatacaacactatcgtttttcaattttaatctctccaaatcttttgatctctttttcaccacggggctggcaggctccgcgcttacgt

SEQ ID NO: 10890 - DNA, 186 bp, Candida albicans
cgcgggagttatttttccaaagcatctggcgtacttttgatattcattgtttgttacaataacatacatggacttactttagcggcatccccagttcatagtaaaacttcatcctcaactgttcttgcattgttttccatgcgtcactccctgccattccatctcttcatagagaaaagttcctga

SEQ ID NO: 10891 - DNA, 672 bp, Candida albicans
attgtgaatcttaaaacaccaccaacagcggtttacccttcgacaactataaactcattagactatctagatatgacagaaatacaccttgaccaaacttctcaaaagatccctgacccggtaaagtttgtttctatagaagaattgcatgctttccctttaccaaaggcattagagtcgttgccaccatcagttttccaacaatttttagaaagtaaagacttactacaagggtacttaaagcaattaaaagcatatcaagaaaagcagctggaaattatagatcaattgggtgaattggataatattttagagaacgtgatacacaaacaattgatcaaagattacgcagcactagtggataaaataaatcaacaaattaaaagtataaacataatatatcaagaatttcttaatcttgaaacataccagtatcaactactttctaataatttcaatcaggatattttgaagttgaaatttaaaaaattattggaaaagaccaatcaagatagtttaaacattgtcaagaattatcatgaaaagggagagtcgacagatgacgatttcaataatatgattgaaaattttaaagaaagtcgaaaattgtaccattcaagaaaggagaaattacatcgatgggaagaagaaagagtaagtggatttgtataa

SEQ ID NO: 10892 - DNA, 270 bp, Candida albicans
tttcatcattatatctattccataatgtttactagatcattgattaaaggtggtggcagacttgctactaccagatcattggtcaacaactctactagtttggttttaaaaaatcaatttaagaaatattcaacatcaactcctcctaaggttgccaaatcaaaatcttcgacaattggtaaaatattcagatacactttttacactgctgtgatatcggttattggttcgttttcaccacggggctggcaggcacccgcgcttagcgat

SEQ ID NO: 10893 - DNA, 192 bp, Candida albicans
actagatttaatgttgtaataataattaatgccaataatgttaggttatatcagattttgtatagaaaggaaattataattatcaatctaattaaactgccatttgaaagttatgtgaaactcaagctagaacgacatcaagaacatacagacactgtcactacgaaagggaggcgtgtatcgccatcataa

SEQ ID NO: 10894 - DNA, 204 bp, Candida albicans
ttcaaaataattatcaaaaatggttatataacatcacccccaacattccttattaataataattctactactactactaatattaataataataatactaataaagataatgataataatagtttttttatttcacgattgattcgggttatagtttggattgggtttgggttaggttactctttttcttttaatttattttaa

SEQ ID NO: 10895 - DNA, 225 bp, Candida albicans
aagttcattatacataggtttatgtcaacatttgtctcaatattggttttctgtgatatttattcctggattaaaaaggagaacactcgaatggagtttttaaattctataatcggatttaaactcaacaatgagcccattcttacaattgttggtccctattgtactaatagtttactgtttcagtactatcttggagacttggctctactcaatactcaataa

SEQ ID NO: 10896 - DNA, 609 bp, Candida albicans
actttatctataacagtcattaaaaatttccaaatcatggcttacgcaactacttcagcttctactaatactgtcattaacaacaacagcaacagcagtaatggcagttattacgatgatgacatatttgaaatgaacttggaagacaatattccatcttcttatattgattatgaaaatgtcaataactacaccaccacaactacaaatgtatctgcattgacaaaatatagatcaacctcaattatagcgagtggtaatgaatcctcattacctccttcacctttggtcttgccacaacaaatgtcaacttctccattacaaccttactattcgtatacatacaattcatcgtcgtcgtcgtcgccttattctacatttgcaaatgaagatcaagatcaacacgatgatgatcaatttctatatgaatgctgcatatgcaagcaaaaattgaacaatagcaacaacaacagtcataactgcaccagagatttattcaatggtaacactttgaaggataatgatttaatcattattgaaaacaataaattgattcaaaataattatcaaaaatggttatataacatcacccccaacattccttattaa

SEQ ID NO: 10897 - DNA, 240 bp, Candida albicans
aacacttctagaaataattcaattgataatgatctgaatgtacaaaatgacgttattaatcgccatggttcggtagtcaatgctttatcggggacaaataataaattaaccaatttgagtcgatttgctgaaagtaaggttgccgttgacaaaattgctatacaccaacctttggttataggtggtaaattagctaaaattgcatccataaataaatcaagtaagaaatgtgattactag

SEQ ID NO: 10898 - DNA, 300 bp, Candida albicans
ttcttactcttgatctctttggaagccctgttgttgttgttacttggtgtggttagttattttcaactcacacgaaatctctacattgatttagccagcttaacacgacctacacgatatcagttttccatagtcttcactaaagagttaaattatctacatctaaaggtattcaattcaagtgataaaattactgaggtttgtcatttccaaatacttcgtaatatgacaaacattgtaaatgtgtgtagagaatgtaatttggaaatcacaaatcaattaacatatcgtctaatttga

SEQ ID NO: 10899 - DNA, 270 bp, Candida albicans
ggagtggtggtggtggttgtggtggtgctaacattatacgtgtttacgtatcatgatgacatgagaagtaattacaaaaaaggatcaaatttcaagttgatattatttcaaaatggcttctcgttttcagtttccaaatatgtctttcacctaatagtgtcaacgttggtgcgagaattattattttttgaaaaaaatctgctaacagttgccaagaaacaagatttgaaacccataaagcaacattcaatacaaaatttgtcattataa

SEQ ID NO: 10900 - DNA, 267 bp, Candida albicans
atcaatgctagatcaaataaaatgcaaaacccagcaacgacagtgtatgttcctccaacattcattgcattgatcatactatctaaaaccccggctcccaaagctgctaaccaacatctcatcaaattaagacaactagtagatccgcttccattattaggatataaatcaaccaacatggttgtgcaaatagctataaagactgatgcagaaaaggatactaaaatagtagaaattataatggatattatatgtcgtttatattga

SEQ ID NO: 10901 - DNA, 195 bp, Candida albicans
cacctagactctaactcagtagacaatgaactcaaaaccatcgtccatgctgcaaaatgtattcccacaggtaatagtgtgcaaaagacatttttttggaaaaaaattttcaaaggacctaataaatcaaacctagttgccggtactattgtagttatgtcattattcattcttttcttgaaatgtggaaggtaa

SEQ ID NO: 10902 - DNA, 312 bp, Candida albicans
atatatggtgatttgtttaaaatgtttttaggtacaactgatccatttccaactaatttccttgatgtttctggtaatataaaaatcgccaatataaatgtgacaccacctccaatagttaaaaatataaatattgatctccaactattgaatgaactgatcaaagctgcacccaccaatccaccaattccattgccaactaattgtaaaccagcaactgctccaaccatacttccacgattggctctagtacacacatcacctgctacacctgaacttatagaaatgactgctgctatccctgcagcttga

SEQ ID NO: 10903 - DNA, 207 bp, Candida albicans
acatttgtttgtgaaatggcgacacaagaggcacagaatactattatactcgctagtatcactggtcttctgccaaatgtgtctgctaaattagatgagattgtcggagcgatgccttggaaaatcaaatatgccacaactgatatattcatgattgatgaacttgtgtggaaatatgatgttaatgtaggtaatgctgggaaataa

SEQ ID NO: 10904 - DNA, 198 bp, Candida albicans
ttgattgttgttctctgtctgaatgacgaaatttcactcacgacgtcaaaaatctcgatccgtggtagaatgcagacggatagaaaaagaaattctgctttaaaatcaaaactaaaaagtaaaaaagataaggatagaatttgtaaaaaatcaacaacctttgataatgataaaaaagagtcattttcaatgtattag

SEQ ID NO: 10905 - DNA, 393 bp, Candida albicans
tgcatatttttttttaactgtgggttcttatccaccagatattttgtctctgattttctctcttcgttaccacatcatgtaaaacttacctcggtggattttcatttagtttactcagcaacaacatccagaatagtaattagggactttaattttattaggagtggattgcatagaatatgctatctaatagatacatcttattatattcttattcatgggaaagcaccagtatatggaaatgctgcccaaggtagtgcacacaacaaactagtttacaaagtaaaattcgaagttacgtcaaagcttagaatggttcttatagtagttgtctactctatcaaaaaacccataatttgtctatataacgtaaggatcactatatgctgttga

SEQ ID NO: 10906 - DNA, 255 bp, Candida albicans
aattatagtaagctggaaatattgaatttaaatataaaaaaatggaaatattattttttgcgccaaaaaaacaatactctaattcacaaacaaagctttaaatgtaaagatttgataatttctttcaataaggagggagattcaccaaaatgtgaagtagaaaaagaagaaaaggaaaaagagagaattaggattcatttaatctacaaacaaagggaatggtttcaatatttatacattttattaatttattag

SEQ ID NO: 10907 - DNA, 183 bp, Candida albicans
ttgaagtataattcgcattgtgaacttgcacgatacgctttcaccgagagattgaaaaagtcgatttttggaaatctagatcttgacaacagagcggaaaacaatcaacgacatacaaaaaataacgttattttaaaatcagaacatacttcttgttcaaaccaattggtatcaaaactctaa

SEQ ID NO: 10908 - DNA, 183 bp, Candida albicans
aattttttctttgttgagaaaagtaattccgttaataggaaatcccatccggctttattgctattggttgaagttattcctcttttttccgttgcgaaaaatggttttatccacgacctaggaagtagtaaccaccacagtttgtcattaactcgctatactctcatacataacagttgttaa

SEQ ID NO: 10909 - DNA, 231 bp, Candida albicans
ttggtttctgcacttgaaaaagtaaatgcaacccgcgtccaaaaaggagagtttatcagttgcttattgggagaagttcaattacaattaatttcacaaaaaaatcactcaatttctaaacctattgttactaaaattgcggtacttgttgaaataatcgttctacttgttcaatccatcgttctacttgttttccaatgtatacgtcaacttctttctttgtttatataa

SEQ ID NO: 10910 - DNA, 201 bp, Candida albicans
aagcatctgcacagtttaaaattattgagcaattgggcaaaggtagcaaaattgggaacatgcattatttctcgtgcacaaccaacatcatcatataggtctacctatttcactcatatagacttacgaattcttcacttcagtttaatttccttaattattatagcccccctccatacttacagctctttgcaattctag

SEQ ID NO: 10911 - DNA, 192 bp, Candida albicans
tatttttttctctctctttgtaatgagatgagacttctttctgatagtttgatgttggaaaaaaaaaatgaagaaacacactataaatctaacaagcgcacgacttggttatcagcagtttcggtagttagattagatttccgccagggctccaaatgtttagcaaaaaattgtgttatatcaagaatttag

SEQ ID NO: 10912 - DNA, 651 bp, Candida albicans
tcattactttgccaaactattatggtacaactagctctattcaccaataacaaccacaacaataatagcaacaacaacactacaaatactttaaacgatgatacacaatatgattcaacaactatgaatacagaagatactcctataataccggacaagaccgataaactcaatggactggattcccgatctctgtcaagaaatagaactcgatccatatctttcacgaggtttcttttcaatagcaacaacaacaataacaacaataaagaccacactgaacaatcacgttgtccttcaaatgaaacactggataattctgttggttcacctgaacaacaaaattcggggtttaataaattgaagaaaatgttcaaaactaattcttctttgacacaagaagatgggaaaaatagtggaagaacaagatcggcttcaacaccgttaactccgcctaaagtgaagaaagaaaccagtgtacctgtcatcaccacaacaaaagcacctaataaggaagaaacaacaaccactaagatacattcgcctcctgaaagtcccgttgtgcaatctaatccatatttccaatatcaaggagtaccagcacatacaaagacgtcccgaaaggtcctcaccagcgcagagatccatgtc

SEQ ID NO: 10913 - DNA, 630 bp, Candida albicans
ttaatgatatttatattatttaaatcatcaatttcaaaattattggtattattattaaatgctagatctatatcatcaacaaaagaatctgattctcaattatacaactatagtcataataatcatatgataatacctcaatcgtcatcatcgtcatcaatatcagtatcaaatactagcaccattgcattttattttgtattaataacaaaattaatcataggatatttcattattagtataattattgctggattcaaattattaaaaggtcaagatcaatgttatgatttaccattaactattcatcaacggaaattattaggattgaaagttaatgatgtacctgaagattatatcattgatgaaaaagccgaaatgatattaaaacaacgaagatatgatttattgaaaaataaaaataacgataaaaataaagataaattggttaatatggttaataatcaacaatcaataccaaaatataaaaaattgaatgattattattgttcttcttattatgatggtatcaacaataatgctgaagaagaacaagaacaattacaagattctatgtttaatattaatcctcaagttaatggcaaatataatgatggtgcattgattaag

SEQ ID NO: 10914 - DNA, 1419 bp, Candida albicans
ttgaaaaaccacttagtacacacaccattagcttcaatcacacaacccaaacctttagaaatgaatagtaatttcaaaagattccgggttttgttggagtcaaatcttcctaatttacagaatgaaaagtcaatgattgaaataaatgaccgaactacggttaagcaactcaagcaattaataatagctaagaatgacgaaggttctgtcacacgtacatttatagaacaaataaaactatcatacgaagggaatataataccaacctcatttcaagaagaggaagctagtgtttatgaattgttgggattgaatcaagagcttttggaacagaataacagtgtcataaaattgaaacttacaaagcatgaacatgtaaatggaactggtgggttgttgagcagagaattttggaaggactttcagtcaaatgatagatttagatttctccctgccaccaatgactctttacagcaacccaatttggcgctgtcgaattcagtgccattagaatcaacatcagatttgtctgctgcaagaagcacaacaaatccaactgctactagctcatcctcagaacaaggaattgatagtgatatttcaacatcaccaacctcggctaacccagtaccttcaccttcaaattatgaaacgctggtgccaagtcaacaagactctattccatttgtcaataatccatcagagtcttcaactcctaacatagaccccattaaacctgccagtattcaggtacgtggtggatccacatgggaaatggagggaacatcgtacgatactatggttgaacagcattcagggaaaaaaattctagtgaaacaggatgacttgtctaatgttgagtatgaacttactttgaaagtagacaatattgtgaagaaagtaagcttgggtacagcacaatgcattgttgtggataacggcttgcacgatccttatctactactcggtcctatgggtgcagcaaaagttcacaaggtgtttaaactggcttctggtgagccattgattcaaaaagtactagtaatgatgtatgatattggtagtgacctggaatcagaatctaatgaacaagccgttccaggtgacgctaataacattgatgttgaagatgctgaaattgacgatcttatggatagattatacaccaacggaagactgcttcttataactatggttaaactcacttttgttttatatttgatggggttcagactcaatcaacatatgatgaattattggtttcattatgcggttttactagttttacttttccatgcatatgttctactttgtacaggtgcaaacagagtcattcgatttggtggcaacgtgaacgatgtatccattatgatggatcgagtcgttcggacttgtgtgagaagaacttctgaattataa

SEQ ID NO: 10915 - DNA, 207 bp, Candida albicans
ttggtccaatcacgagatcctgcttggttgaagacggtgaagttgaattttgagaatatttggaaagacagtttgttatttggattatgtatttttccttcaatgcaagctagggttttccatcaattaagcttggctgaggaagacgtttctatttatgaagaattggttgagcctaatgaagtggtggatctggttgaaatttga

SEQ ID NO: 10916 - DNA, 438 bp, Candida albicans
ttccgccagttacaaaaaaaaattaaagctcgcgagtactatcaacaaaactacaatatccagttcactttgttccttctgttttccagtcttgtactgattctacacattttcttgacactcatgtccacatcttcttttgaatcggctgcttatccaagtacagttcctgctctttcaacagcaaacatgaacaattcaggtaatgtcagtgccaatctgtcagtaacaaaggacagtggaaatacgacaattggcggaagtggtgatataccagcaacttcagacaaaaagcaatcggtgtttgatattgcagaaaatatagagaaggatctaaataaaatgttagagcaacttaatcaaacagacgtcgagattaataaaagaatagatgttgccttgaaaaaagttacttcattatatgataaattcaattga

SEQ ID NO: 10917 - DNA, 186 bp, Candida albicans
tttttttttgtaactggcggaatcagatcttatgcaatactcaaatccaaagaaacagtcaatccagatgaaaggcatgtaatcgctagttttcataaacagaatcatgttactagtcatattttctataaaaattcaatacttcattctttttgttcaatactaactataaatgcttacaaatag

SEQ ID NO: 10918 - DNA, 252 bp, Candida albicans
attacagtcttcttagctataaactatattatagttaacttagtattgattaacataaaagttttactacatattacattacaaatattatatctaaccaagctgtggaagctattattatcatcttataggagaggtgccaaatatcaattttattttttagataaaaatatgaatttaaaaaaaaaaccctcggttatgctaagtacccgatttactaataaccacttatttctcgaagccgaatattaa

SEQ ID NO: 10919 - DNA, 183 bp, Candida albicans
tacaccaacacacatttgaaaacatttagattatacatatttaatatcaaaataaaaaaacttaaatatcatgctagtaattcggaagatatggaaagcggtttaataatacgtttgatgaaaaatagttatcaaacatatgccacacttcaaaaaaagtgtcaatttagcaagtttgattaa

SEQ ID NO: 10920 - DNA, 246 bp, Candida albicans
atttttgatttgtttgtcctcctcctcctgctcctccttacaaattcttacaaccaaattttttcttttacttctttattctattttttttttttcattcatttacccacttcatttcatttcccatttaaagccatatctgtattattaataacatttacagagtcaagtaactccaattccttaccttcatttgctagctactatctccaagctattgcactgctactctcaattatagtctag

SEQ ID NO: 10921 - DNA, 516 bp, Candida albicans
ttctactttatccaatttcgaattgctatccacactcttatgactaaaaataagcacaatttcacgctaaataatagtagtgatggagttaataacaatgacgaccctagtgatcaccatgattattccgatgattcaatgccaccaaccccaacaataagtacgtttaataaatttcctcgacagtcatcattacgattcaagactcctttgccaaatgatacaccacggtcgtcgtctctggggtctacatcaaataataataaccacaatcataatcagaaatcgccgttccttgatgaaaacgaagcttcgtttgatcgaaagtttggttataattatgataaggataaagtggtagaggaagaagatgaaaatgaagatgaagcaacttatgttgttggtgaagacaatgaagacaatgaagacgaaaacgataatatcaatgaaatggatccatctaatctaaaaacaaagagacatcgttggggtactactcgtcataaaacatcgtag

SEQ ID NO: 10922 - DNA, 195 bp, Candida albicans
tttcatcgaacaagtctgaaaatttttctttctttttttttttcccaacccaccactcactcacaccttgtcacttcgcgtaaatttaatacactccagacccttgtgttaccaccaccacggccatcattaccaccatatcagctccgagatgattcaccagcatttccaaccgccctgggtagctccatttga

SEQ ID NO: 10923 - DNA, 1203 bp, Candida albicans
ccattggatcactgcatcgttgtcttttcattaacttcaattatgggtaaagatactaataagccagtagtaacaaaactaccgttggataaagccttattgttaattaacaagaagattactacggttccattttacaataaagttcatatcatcaaatcagaatctcaaaatgacgacaataacagcagtaatgataggataccttttgattcgttaaatactaggacaactttgatttccaattgtgctaacttatatcaaatcattttaaacgaatataccaacaggttcaacagtaataataatactgaggatagccaaaataacaaaggtggaacacatatcgaagccataccgatggaaaatattcccaatggagaatatcacgggaataaattgacatttaacgctaataatggaataatcgaattatggattaataataatttgtttatgaaaatccccaatttgaaaaataagtatgataataagaaaggaggggggaaacaaggaaaagaaggtcaatttattaaattatcgaaaattacatcaaatttaagacacgaagagtttataatgaagtataaaattgatttgaaagtgaataattctttatctttgacaaatcaattaattaaatcagaattcaaatacattattgagttgttatttgataatgttcaatgtattatatacaatgatcaaccactaccaccacgaactctaaaagatgacaatagtatggatatcgataaccatgacagtaatacccccaccagtgaaaatattttcaagattattaaatctcctgaactacaaccaatgataaatcttgaacagtatgatcaccaccaacaaacagaacaaggaattggtttagatgaatttgaaaaatatgaattgttgacattgtttactaatttcaattataatcaaaatattttaaaagatcagtattataatgatttgccgcattttaatagtcaaaataaacatgaagaagatgacaatacactttacgtttgttcaaaacatagtttacttaatgttctgtcacatcttttgactttggaaactattaatgattggcagataattagtttccattatcgtaataaatatcatttgttaatttataaaaatccatcaaataataatgatgtctattttacgaggtcgtcaccacgggtggaaatccgc

SEQ ID NO: 10924 - DNA, 195 bp, Candida albicans
aatatttcaattttaagcagaaagaaaaatagacgaggagtcaaaggacaatctgtcaagaacccgacaaaattaagttctcctttaggaaacggttacaattcggacgattacatagagcaagtatctcgtgaaactttacaattacatgacaacgagaaaacggtttttaacaagagaagacgtcttatttga

SEQ ID NO: 10925 - DNA, 201 bp, Candida albicans
aaactgtggctcaatattgacaagtttttcatttatattatctattctggaatattttatttaccacttcaaaaacaagaaaaagaaggtaaaagaagaagtaacaacgttcctttattacaaattaacgtctactcaaagttcatcaattgttcatcactggtgttaataatattgaatggaggagataaaagtgaataa

SEQ ID NO: 10926 - DNA, 267 bp, Candida albicans
gaatattttctagttttagtagatgatgaagtgttattgttattcttattagttgttgtggaagttgttgttgttgagggattgattatattggcaatacttgattctcgtttcacttttaattccgattctgattctgatattatattggttgttgctcctattcctgttcctgttgttcctgttgatcgtgtattgtttgatgttgttttcgttgatgcttcatcaagtaaaaaattccatcctggttcattacctgatggatga

SEQ ID NO: 10927 - DNA, 303 bp, Candida albicans
ggattgtacatatttttgattttacaaccacacacacacaagatgcacagggtacatacatacatacatacatacatacattatatgcatgtaggtacaattattaagttaccaaaagctccacattctctttcccttcaattctttttttttcttctatttttatttgatttctgtttcatatttgactctgaatcgatcttcagaagttgctcttctttgcaacccaaattagcacactacactgtattacttcttttgttagtcaaaaatagcagttccgtttactcacatgaaatctag

SEQ ID NO: 10928 - DNA, 207 bp, Candida albicans
  unsure (142),(145),(170): Identity of nucleotide sequences at the above locations are unknown.
caagttgttttctgtttagaggctattagtaaagtttcacgaggaatattaccattggattatttatgtggtaaagaactggataatgaatggaaagataatttagcagcaacatttcgtgatggccgaaaatacattgatntanagaaaattggaaggttttcattatnatatgggaaaatgttctataaatcccaaactggttaa

SEQ ID NO: 10929 - DNA, 255 bp, Candida albicans
ttccattttaaaaaatacatccatatcagtcttactatcattatggaatctagaaaaccttctttattcaatcaacttgaaccacataatgaagatagtgatgcaacagatatcagtgatataagtgaagatgaagattgggaagatgatccacccttatcacctaaatctcaaccactagaatgtccaaaattagaacatgaagttgcaactagcacgtcctccatccttactatcatgttaaataaccaataa

SEQ ID NO: 10930 - DNA, 207 bp, Candida albicans
cccacacgtaaaaatacaagcccactttcccccactcataaacacacacatcaatctcttagtatagataacaacaacaactaccaagaagttttttttcttattcagtgtggttattgttcatctttttttcctaatgcgggcgatgatgatgatgatgatggcaagccaagtttagttttcgcggggaaatttattattaaatga

SEQ ID NO: 10931 - DNA, 252 bp, Candida albicans
ttttcccatttgattaatttttcaataaaggaaaaagagaaggaaaaaaataaaaaagttaaatctatttctcaaaagttcaatactttaaccttcaatcttactttacttctccctacaatccgcccccatactattcattcatccatctatccatccatccaatctgacttctttgacttcgttttcccccttgaattttttttttcagattttcatattttcaattctttttttttaattccattttaa

SEQ ID NO: 10932 - DNA, 216 bp, Candida albicans
ttctgtttttgcttgatagcgaagattggagacgcccaactgttggatatggcaggacataagatgtcagctttccaaatagttttaataaagtttactttacataaaaggggggatgagaaatcttctttactaacaataagtgatatagcgaacaaccaagtatatactgaaatatatgtacaacaggttagttattgtttattaattacttaa

SEQ ID NO: 10933 - DNA, 195 bp, Candida albicans
ctaagcaccgacgtaacaataaacacactgtctggaaaaacaaaaaaaaatgttgacaagaaaaatccactaaataaaaaaaagaaacgatttgatacacaaaaaaatccgaagtacagatttgttccgggtagttccctaattgcagcacgaggtacactacgaaagaatttacacgatacataccacacgtga

SEQ ID NO: 10934 - DNA, 438 bp, Candida albicans
aatggtccgctaccatatttccaggcagacaaaaaaaaactgtcttcccacgaccatgcgatggcattgaaaaaaaaaatccaaaaaaaatatacatacttctttacccaagacatatcaaccaagcccaccatgtcaaaaccagagctatatgaccaatatatgattacaactcttcctcgtactcctgacttggaattatccgacaaagttgtagtgtcaacgataaaatcaatcgacacatctattatcgatattggggtttcaaaatcaaccatatccagtcacatcaccaaacctacaccaaaattattatggtcttattcattgaatccaacaacaatagttgaatgtatggatgtattagctaaggaagacaagaaatattacgtttgtggtttgagtgatataaaaaagtttaggcttttattaatttga

SEQ ID NO: 10935 - DNA, 186 bp, Candida albicans
gatattctgataacttttttgctgtttcaacaaatctctaaattaagcggtgttgcatatagtagtatccaacaaaaaaagaaagggagaatttcttttttggaccataataaagtctctcctttgctactcatctacatcattatcaaatcatcatctactgatgctaaacaaataaacgtgtag

SEQ ID NO: 10936 - DNA, 363 bp, Candida albicans
ctggatatggttgattttgaaaccccaatatcgataatagatgtgtcgattgattttatcgttgacactacaactttgtcggataattccaagtcaggagtacgaggaagagttgtaatcatatattggtcatatagctctggttttgacatggtgggcttggttgatatgtcttgggtaaagaagtatgtatattttttttggattttttttttcaatgccatcgcatggtcgtgggaagacagtttttttttgtctgcctggaaatatggtagcggaccattttacacacaaatcttggtgttatctgctacattactttataataaaaaactatcctatcctgtattgtacactctataa

SEQ ID NO: 10937 - DNA, 195 bp, Candida albicans
gttttaaacggtatttctataaacgttttagtacttttttctttcagtagagttgaatcaaaagttattgcagtaacattgtataaaatgaatttttctcagtgttccgcggaagcatatatgtttcagtttaagtttaagtttagtagaggaaattttattaattcaattcaactaagttatgttttagaataa

SEQ ID NO: 10938 - DNA, 192 bp, Candida albicans
ataaccccggaagttgttttaaaaaatggtattaaaatattgtatgttgatccgacaagaatgatttctttttgtttagctgctttagaaactaattgtttggaattgggcaataggttcaaaaagaaaaaaaatcactctaatcactttagtgttatattattagatgtacttgttaaccatttagaatga

SEQ ID NO: 10939 - DNA, 336 bp, Candida albicans
acaatgccagttccatttgaagggttgttaccatatgctataatgactgcattttttggattggcaggccatggcgtccaattcattagatactgggataatggttggaagaatgacagataccatttagacgaatgggatgacaaaatgatggccagagacttgttattaactggggtcaaacgaggtcaaactagtgaagctgttgctcctgaatcgttcaagactgctgaaaagatcgaacaaagatactggactccatacagagacgaatatttcacattaagagaaagattattcaggggttatgcatttggcgaatgggaattatcttag

SEQ ID NO: 10940 - DNA, 192 bp, Candida albicans
tcacccgtaaaagatttacgaaaagttactcataaatatattcaaccacctattacattgttttctctggattatgtaccttgtagcgactgtttaaggaatccctattctaccacatatttttactcatctacaattccgacttttctaaaacaaaaatcaaatacactgagtgagacagaatcattctaa

SEQ ID NO: 10941 - DNA, 264 bp, Candida albicans
aatggaaatagaaaaaattcatttttcaccaacaataagcgaaacgtagtcaccagaaaccaagttcgaatttacaaggaaaagaaaaagaaaaaaaaaggggatagaacaacaaataatagctcaataattatgtccacagatttcaattcttttgttattttctctttttttttcgtccagaaattattgttagctggtgatggaaaagagattcaacaacatcagtatatgtttagtgccgactgtttagtaattgaatga

SEQ ID NO: 10942 - DNA, 1239 bp, Candida albicans
caaatactaataatgatatcaggacatctacaaacaccagatctgtctgatcattcaggtgatgaagcaaagttaaccaaaccatcaggattagaactgaaaacaaatgaactatggtcatcagatttggaggaggaattggaaagtcgaataatgcaacctgccacatttagctcaatattaaaacaatttccttctatcctggaggagactataatatcgaagattatgtcaaataaaaattgcgataaaaacaattggaagaagaaaatatattgttacaggtattttttacagccactgaaagaagaaccagatgttggcaacatgaagtcgctagtggaaaagcttgaaaagttaaagttgaaaaaatggagtgccctggaaattgagcaactcttttgcaattatttagaggatttgaccacgtccgcagtgaaggtgtcaattcctggaaagactttggatgaggtggcagcagcagtgaacaatattcacccgagaccacgttggacacgtaaagaaattgagtgtctaatcaaaaatgaaaatgattttaaaaagttggaaaaggatcttttcgtcagagatcttgattctatcaagaagaaaataagaagggataatctttctattcaaaatgaaattcaagattccgaaaaaaagtctccccaaagtactgattcaaataataaagattcttcgcgggatttatctcgaaaggaacgagatcagttgaaaaaattactatcaaaacctatatgtttttcagagttgcttgctaaatttccaggtcactcttgggaatatattgctcgtgaaataattcaattagattcatctgaagataatacgatttggttaaagaagatttattactactgtgttgtgtattcaatatctgttgataaagaaattacgaaatacataggaggtggtaacaggatttatgaaaaggttcggtctgattggagtaaaatcaaaactcttgattttttcaaggattggtcattacaagagtttgagcgtttgtattgttttgcttttcacgatctcaccaagagtgctttgactaaaaattttccttccaagaatctaaatgatatttgcaaagttgttaatattagttttccaaaagtaccttatacggatcgagaaatgaaatacttggaacgccatttagatacaccaatgcagactctagaaaataatctacctttcagatccaggggatcaata

SEQ ID NO: 10943 - DNA, 222 bp, Candida albicans
ttacgactattccgtttatatatatatatatatactgtgggtacaggaaaaaaacggaaaaataaaaaaattcattttcttactgggggtttaaaattcctacataaaaatagtactagctgttttattttccgtgcgatgggccggccgaaacaagaaattcctttttttgcttctgcttttgcttttgcttttgttttgttttcatcctcgcttgattaa

SEQ ID NO: 10944 - DNA, 213 bp, Candida albicans
acaactctttgtttacttggttcaaacggaagggccaaggcaacaatcccaatgacacctattaaagcaccacaaatccaaattggtactgccgatgaagtatcagaataccaagctataatggggaccattgcggtagagattcttgtgataaacacacataaacaattcccagtggctctagcagctgatggcataacttctggggtataa

SEQ ID NO: 10945 - DNA, 1077 bp, Candida albicans
gacgcggatcttccagccccgtgggcggaagacaaacaagtcatagattgcagtagtggggttatcataggatcctacgatgagacaaaaacaaaacccagcacagtcgaaaagaggatccccctgccgcccataataagcgacgaaagttttatcaatacatctgcgtgttgtacgcccaaaatatcaaaaggaaaatcatgtggatgttgcaacaataagagaaaagcagtcaacaaatcaaaaatattacaaaattacatcaaaaacaaattgaaccagaagataaacaacaacgaaacattggtgtttatgaataagtcccatactacgaataacgaacaaaaggaggaccatcaactatacgggatggtgcccgtgccttcttgttccattcctggaacctgttgttgtgatgacgcctgttcatgtcaaggatgtgtggttcatggaaatagcaaatatcaaataccactaccgaccctgaaacaacaagtaactgatactaccaacccatttgagaatgaggaaaaatttatcttcaattcaatgccacagacagataaatcggatttatttttcaacactatttcaacaagctccaatgttcctccagcagattcgtcttccgaatgttcttgtcctccgaatgcatgtgattgtaccaattgtgaaactcacggaatcttaaacggattccgattagatgattattttaaggatcaaagtaagttaatgaacgttttagattttaatttttctgaattgttaggtacaattccagaacaacctattccaacagagtttatgcaaccgccatcggaaaatacgttgctaacatctttatcactggaaaatagttttattccaaaccaaacaaaagagttgagtacacaaccaccaattcttccattggatgcacagaatgtgtgcaatgaactagaccaattggaacctttagtgccactgttgcaaccgtgtgacaagaaggcaacaaagtgggtcaacaatcgagatacgctagaagatgtgtctgacaatagggtgaagtcatgttgctcaaaaaagaccaaataa

SEQ ID NO: 10946 - DNA, 213 bp, Candida albicans
gtttcacaattggtacaatcacatgcattcggaggacaagaacattcggaagacgaatctgctggaggaacattggagcttgttgaaatagtgttgaaaaataaatccgatttatctgtctgtggcattgaattgaagataaatttttcctcattctcaaatgggttggtagtatcagttacttgttgtttcagggtcggtagtggtatttga

SEQ ID NO: 10947 - DNA, 195 bp, Candida albicans
agagtccttgatgaagtttgtcaagataacgataataatgatgatgattcgattgtcattcagatgacttttttttttttcgtgccgtttaaagagtcggttcaagttatacccgaagttgatcatttgacttatatatataacgaaacaggtgcctctattacatacaagtttttacaaaaatcaattctataa

SEQ ID NO: 10948 - DNA, 216 bp, Candida albicans
atagaagaaaatgatacccgtaactctcagattgttaaagtagcgacgaccaaaagtaaaatgagaatggccaagcaaattttcaaaaatgtcgcgtgtttgtgtacaccgcttctatttttatattccatgtttattacgacattacttgaacttcaatcccagctgaaaaaactcattaaaaaaagaaacaacaacattttcgtttcgatttga

SEQ ID NO: 10949 - DNA, 231 bp, Candida albicans
cgtagaataattgaactcaacaagccccaaaaaacaggaaaaggaaaggaaaggcaatctaaatatataattctaatcaacaaaaaattgatgctttgttgtaaaagtgaaatcaaatccaaacaatatctagagttgttgatgtgttttgaattggtgtgttttgaattggatcaaatcaaatcaaatcaaatcaaatcgaaacgaaaatgttgttgtttctttttttaa

SEQ ID NO: 10950 - DNA, 189 bp, Candida albicans
atgtcgcaaaagacaaattattcttgctgttttgtgattgtcgcaaaatgggatttcttgaaattaaattttagaatcacgtgcaagtgtcataaaaatttaacgatttctattcacaccacagaagataccataaaccaacttcaactaacacaccttacccctttcccatacctttttttattttaa

SEQ ID NO: 10951 - DNA, 195 bp, Candida albicans
agaattcgcataagacacatttacattttttattttcttattttcttatttactttactctttactctttactcattacatttattatcacaagacttaaacgatacccatatacaactactacaacttcttattccctcccacccctttttttttttttattcaacttttattttagttactaattaccaataa

SEQ ID NO: 10952 - DNA, 879 bp, Candida albicans
  unsure (861),(864),(865): Identity of nucleotide sequences at the above locations are unknown.
ttactaattaccaataaaccaatttatttcttaacttttaataggaaaagtaagatcagtatatataataattatcatatcatggtaaaaaatcacttaacaaccacaaccacaacaactgataatagccctatcactaataataataataataacaccttcctatctaacaaacctagacgtaaatcaaaatcatcaataagaaatcgcaaccatcatcgacacggtaaatccttatcaccaaatttatcaaccaccacgaccaccacggccaccatggccacgacgaccacgacgaccacgacgaccacaaccaccacttcctcttctaatgctagaccaaaaccaaaaatgatcaaacgaagaaattcatcatttgctaattcttcatctccatggtatagacgtaattcttttttatcaaaatcaatgattcaaaatgaaattttccaagtttatgaaagtccttattattataccacaacaactaagagaaacgcggcgtatagtattatttcattaaaagaatgtcaaggatttatatttaatcaagatttatttgctacacctttccaacaactgagaagtttggctattgaaaaaacacgattattaagactaaagaaacaacaaagacaacaacaagaaaaggagaataagaagaagaataagaataagaataagaaagggtctgagatgattgtacaaaatgaccatgatgatgatgatgttgttgttgttgagggtgattgttttagaagacatagtagttatcatcctatgagacctagacttatcagtattgttgagaataaccataatcataaagataaaagaaatagtattgataatgacaatgcnatnnttgatgaagaatga

SEQ ID NO: 10953 - DNA, 228 bp, Candida albicans
aaattaaaaaccacacgatggggtcaacacaacaaacaaataaacaataacaataagatgaatgaggcgtcaacaggcaattatcctgcgctacacaccattcttattatctttgaaggtggcaacgagttgacaactgtttcacgtaaagattatggagaaaataatacaagctgtagaggaacatacaacatagagttcagtactaaactaaatcatttggcatga

SEQ ID NO: 10954 - DNA, 1626 bp, Candida albicans
cagtttattacatatttaagacattttagatttgatttttcattgttaatttactttcttagtttaggtatatatatatacaaatttgcaccaatactgttaacacccccaatgaatgttgatttcatacaatataaaaccaaatccaatatcaaaggcaacaataattacgacgacggtaatctcactgacgacgaaaacgataccaatagtaacaccacaatcagtaccagtataagtactagtaccaaagaagttaaaaacaccggccaagtccatcatcagttatacaccacaactagtaatccagtagggtctttagaatcaactacttgcccatccttagcaaccacatcttcagataataccagtagctcagatcacaactatttatctgcatctgaactgaccctggtacccccaaatacggccactaacaacaataatccacccccaaattggttgaaagttaacccacctccaaagctaacatcattacccatagatattccattacagattaaagaaattgctcctgaggaatcaacatttagttcaagcgattcagacgagtgtatgaatagttatccgaacactctcaattataatcaaccagccaattttgctatgatttataataatgctcaattaaaacgtcaacagcagagtattttattaaatcagaaacaacagcagcaacagcaacagcaacaagaacaaggacagcagctacagcagcgtcaacaacagcaacaagcaatgttattatcaccagctagagattataatagtcttagatatattgctaataaaaaagttgattcacccatgtcagatgagtttttttttcaggataattatcctctggatgtgaaattccaatatcaacaaagtattattgaatttttaaattatatcattggcaaatataaggagatggaacaagggataaactcgtatatggattggtggaatgtttatgcattcaaaagacaaacgttagacaacatgatccatattgctcaagggtttaaagcaatgattatcagtattttgaaacagttgagcgttaatagtgggataattaaaaatggttcacagagtaaaaatgaggctttcaaacaaaggtctttggatccttcttacatcaataacaacactactgatagtgatgatgatgatttaataaattataatgtgttccaatttgtttataattgttcgattgaaaatgttaatattggaaatttaatcaattgttcattatttaccaatacattcaaattcaatttattgagttattattacaagttgaattatcttttgatcaatgttaaagaccaaaaaaattggttagtgatccctatggaaatatggtataagttgccttcgtttattaaaattattaatgataatttaactaaaattaataaaccaatgacgagagatttagaaatcactttggtaaaattgaattcaattacttgtaaattccccaccgttgataatttgaaaaaaactgatcctataggatcatggcatgattttgaaaaaattaatcgtttgttgacggaaaagtttcctgattatacagaacatggtcaggtccaagaattccctgtctga

SEQ ID NO: 10955 - DNA, 213 bp, Candida albicans
attttctcaacaaagcgacaggtacgggtcataatcacagtcgaattggagacaatttgttttttaaaatttggtttactggctggcagaatttttttgagagccaccaacgttgtgggctcaaaaaaaggattttcattaaatgtcttctactacaacgaacaatttgatagtaataaccaaattttcgactatttggttgaaaacaattgg

SEQ ID NO: 10956 - DNA, 867 bp, Candida albicans
atctttagagttttgttttttaatagtgtaccagttcactatttttttttcttctttttatttttcatttgttttgagaacatttttggttgcaaatttttatttagtttacagagctgcacaaattatccatatctaattgtgacagcaaatctggaacaactaccaagagtgttgaatataatctacatgatgtacaatactattagtcatccatacctacaacagggacaagacatttacaattcctgtaatcagctgtcggtatccgatgtgacaacagccagagattcaaccagtcctaatttcaaaaccctaccgccaataaatttgaagcaatctactacacatatacctgttaaaattagtttcccatcaaatacgatttctccaaacattccagattctcaaattacaaatacactggcaacaataactgatatagtatctcctcaaccgttcttttcttattcgccacaagaccaaactagaattgccatacagaaaaatctaaagctagcaattgaagaaataaaaagaactgaatcacaatacctatctaacttgaaaactttaaaacgagattattttgagaaattgatagaagacatacatttggatgtgcctgttccaattaaaattgtatacaatattctagctgaattaatacaatatcacgataaaatgacaaaactatttgaaagagtagatgatacaaacatttttaaacaatgtgaagggtactgctcaataatagcagaaaacggaatcaatcttttttggtataaatggtattgctcgcagcaccaaataatacaagacctgtatcatgaattttctcaacaaagcgacaggtacgggtcataa

SEQ ID NO: 10957 - DNA, 228 bp, Candida albicans
ctagatctgctattgatgatgattcacaaatccaatcaaaacaacaaagcatacatcctgaagttaaaaaatatgataaattgtccaatagtaatcaaaccctgtcagtcgatccatcagttagaacttactactagtcaaaaagatcacacacttactgttgataatattaaacacataataaaatatattattaaactttatacagaaaaaataacaaaaccgtaa

SEQ ID NO: 10958 - DNA, 237 bp, Candida albicans
aaagttagagtttcacctttttcaatttccatattatattcatcccatagaaatgctagtaaattgggtgatatgtcattgggagatgagatagggtatatggtggctttagtagatccatcttttagtagtatagcatacggatcgatatttattagtatatctcctgtggatttatcaatttcttcaccaggggtattactcctacaagttgatatcgataatggtgtactatga

SEQ ID NO: 10959 - DNA, 258 bp, Candida albicans
catgatctatttaaagattgtaaggaatatcaaagtttgtataataataacaaatggcggagatttaatggggggggggggcaaatggtgataacaaaaaaaaaaacaacaatcatcataaacattcccgcagttaacttatctccgggtaaaccaacaagtcctactatgattaatccccttaaattatacctaaataaaaactctctacaattggggcatgttcttttgaaagattacatctggtttcaaaattga

SEQ ID NO: 10960 - DNA, 222 bp, Candida albicans
agctgctgtcacaatttgaagatttatcaaatagtcaaggtgttactgaggtgttatttaatatattataaagaagttatattatcgaactgtcaaataaaaacaaataaaaaagatgcaaaaacgcaaaacaaaataaagaatatgcaaaaatgcaatagaaatttaaaaaagacaaaacaatataaaacaaactataaaaaaatacaatacaagatataa

SEQ ID NO: 10961 - DNA, 183 bp, Candida albicans
acggcatggaagaatttccactgggaacctacggtggaaaccgttccaaccaaaaccaaaaaaagaatgggtgccatcaccatgggagggaaaccaaatgtgggtgggtttttgggaaattgtgccttgggaaaggggttcatttttcttccccccccaaaaaaaattttccatgggcccaaa

SEQ ID NO: 10962 - DNA, 216 bp, Candida albicans
ccatataataattcattgaaggtaccaatgggcaactggaagttggatagagcatacaaccaaactaaaggagtaacaatcacagcaccaaaggcaactccaacaagaagacaccaccacggcatgaataacgagtccgttgcaaatatcactaaaagagtgacaaatgcacataagaaaagaatagcataccaatacaatggaacttcttcatag

SEQ ID NO: 10963 - DNA, 249 bp, Candida albicans
gttttagagaaaggagcactttcaaatattaaatatgtggttggtattaaggaaggaataaaaaccaaaaataaactaaaagttcaaataagcagagacgaatgtcagccagttacatacatgactattgttaaacatgcagagagaatgactttattaattggtattcttttgctttccatcaattatcgtgatgatgtaacaccaactgagtatactaagttccataatattaaatgccgcaaatag

SEQ ID NO: 10964 - DNA, 234 bp, Candida albicans
attgcaaaccaagtagttctaaacagctattcattattgttgaatggctacaataacgtttattcaatcatcaagcaaaatagtaaccagttcaagctagttacttttgaagactatcactacgcaatagttactcgacaaccaatatttaacaatacacctaaagggaaagtccacaaccacactaaacacctgtttctaattttaagtttcaaatataaggtaccatattaa

SEQ ID NO: 10965 - DNA, 198 bp, Candida albicans
ttcttgctttcaactttagaagttaaaagttgtttcaatgattttagaggtttgcataatagcgattatgtaatcacgactttgcactttttaaagtatattccacatttcccacaaatgttggattttattgtttccatatctttacacaaaaagtggcattcatttgattacaatcgtcatctgtccagtacttag

SEQ ID NO: 10966 - DNA, 204 bp, Candida albicans
cactaccatgtcacttttcttgagctagtcattggacaagattgtttaaagttaagaagtttctcaagcaccaagaaagttaatccatggcatgatactagatcgaacgacattaattctagaggtcagttagcaaacacttctttagccttgttgatttcatgttattattttaccacctctctcaacacagaactatcgtaa

SEQ ID NO: 10967 - DNA, 186 bp, Candida albicans
catgatttattttatttgcctgagttcaagatggtctataaaagcatgtattgggtatgtcaatctgaacaatacaaactaaacaagacttggaaatttcatattaatttgctttcattgtttgtgttttttcttccccaattgttgtttagtgaaatatccgataagtttaaaatttcagaatag

SEQ ID NO: 10968 - DNA, 267 bp, Candida albicans
aaagataactttacgtgtacctattgtcttacagaaaacctaaaacaaaagcaaataacgatagaatcaactaagccatatggtactttatataatgcgaatagatttaatagacatgtttattattatcccatttttatggaaaaaataactctctcgttggacaattgtagaggtattcgtttacgtcaggtgttgtcatatcagagtttcaataatagaaaattactgtttaaacactgtctattctataaatctctatcttaa

SEQ ID NO: 10969 - DNA, 1116 bp, Candida albicans
ttgggaaccaacgacaaaatgtgtttatgcatgtatcaagcggttgtttcgttacgccccatttcaagttccaattcatttaaccaggttaatggtacccattcgttacccacatcgcatagttcattttcagtacgagctgcgcttcaagagggtgctgcctctacacatgcaaattctccgcttttgacaccaacctcaagttcagcacagctagccaaaatgcagcaatcgtactactctaaagttaatcagagagatattcatgtttccaatgacctgaaatcagaagttttccatccatataagaagaagaatctatttgggaactcaaaaataattggtttaatcgcctttggtacacccaagaaggagtactttgtgaattacgttcccttggaactgcttctgtcgaaatcaaagaaagtgtcaccttcagtcttggatattccctttgacttgacatttatttttggtgacgagaaaactggatctgtgtcgtcgctacctgagtttaagtcattatctgttgaattgattgcgttgaccgtgaaatcaaagaaattgccaatccctgttgttatacatccagaaatgatgttcgataacaaaactaaaaatggggggagcagcaacgacaattttgatatattgacgattaaaaagtttcagaaatatgctgttgaattactgaagttgttaaaggaagtgggtccggaaccattggatgttgatagagacttggttttagatatcaagtgtttagcgaacttgacaacaaaatatgtacatatgaaaatcaaggacgtggtgattaaggcaaatgaacaatcgtacacttcgatcacagctgttccttggcagaaggaggttttaaaatctacagacagcactactggtaaagaacaaagtacagtaaagtacagtaaaaacttgaatttatcgatagatttagctaatacggtaatgaagccaaccaatctgacagatttctgtttagtccccgattttcaaacctgtttgatggctagaatatattacttgaaggttgatttgaagtttcatactggtgaaaagataactttacgtgtacctattgtcttacagaaaacctaa

SEQ ID NO: 10970 - DNA, 297 bp, Candida albicans
  unsure (9),(110),(282): Identity of nucleotide sequences at the above locations are unknown.
ccaataatnattcaatttcttcagagagtaggttggcatttatttcaaattgaacagcttgtgttagaattcccgttatccatatttaaaactaaacaacaagaaacaantgcaacaccagaccggatatccattctgttactggcagatggtaactcgtcgtcaaacaattttggggtgataaaacaattagaagaaaacaacaatgaagatcaagataatttcttcaagagtttaacaaagtgtatcacaattttgaatatgatagagagactttactanagaggaggaaattag

SEQ ID NO: 10971 - DNA, 231 bp, Candida albicans
aggagaatgaaactcttgtttatgaatcagaagttgatccagatgaaagttccattgattctttgtttgaacaaaatgaagaataaaaataatactttacctgatattgatatcttacacaaccaaccaactacccccactcgaatttatcaaacccaaatgaaattatatatatatatatgtatagaaactagttgtagtattattgtacatttttgcataaaattatag

SEQ ID NO: 10972 - DNA, 270 bp, Candida albicans
aaggaaaggggattaatgagtcttaaaaaaaaaaggttgaatttcctgtgttttagggccaaaggtataagaagaaaaataagaacttcaaggaagattaagaagaaaattttattaccccacgttaatgttaaactttataatattgcgcgttatacgttagagagacaatctggtactactggattaactgtcaaccttaacataacaacgtggggtaagacgatcttagcaatagcagaaataatacaacaacttttaacaatttag

SEQ ID NO: 10973 - DNA, 651 bp, Candida albicans
tacattacaatgcaattctcatccgctgtcgtcttatccgctgttgctggttccgctttggctgcttactccaactccactgttactgacattcaaaccactgttgtcaccatcacttcatgtgaagaaaacaaatgtcacgaaactgaagttaccactggtgttaccaccgtcactgaagttgacactacgtacaccacctactgcccattgtcaaccactgaagctccagctccatctactgctactgatgtttctaccaccgttgtcaccatcacctcatgtgaagaagacaaatgtcacgaaaccgctgtcaccaccggtgtcaccactgtcactgaaggtactaccatctacactacctactgcccattgccatctactgaagctccaggtccagctccatctactgctgaagaatctaaaccagctgaatcttccccagttccaaccaccgctgctgaatcttccccagctaaaactactgctgctgaatcttccccagctcaagaaaccactccaaagaccgttgctgctgaatcttcttcagctgaaactactgctccagctgtctctaccgctgaagccggtgctgctgctaacgctgtcccagttgctgctggtttgttggctttggctgctttgttttaa

SEQ ID NO: 10974 - DNA, 240 bp, Candida albicans
aaaatccattttagtttggaaaaaaaaagggtgtaccaatttatacaacaattaactttttcagtcaattattcatactattactcattagtaaacaattcacactatacaagaagagacaccccaataccaataattacaacaagaacaaagaagcctattgttattgcagcaacagatttccacataaaacttacatacaaacgaacaaacaactttcttagactttacagattttaa

SEQ ID NO: 10975 - DNA, 1542 bp, Candida albicans
  unsure (974): Identity of nucleotide sequences at the above locations are unknown.
ggaagcacagctcccatgacgatgaagaatgtttatagtagatggccacaatcagtacacaaatgtccctatattcaacaacaacaacaacaacaccaacttcaacaccaaccacttcttcatcattcttcttcagttgcaggaagtacaaccagtattgttaacaatagtttatcaatatccaatggaggttatggcaataattattccaaaaatttatcccgttcttacaacaagtattctaactcccaagtttctcaactactgtatatgttgccacctcaaacagaatcatcatcaacagcaacaattgcatctggggcgtcagtgagtgtgaaacgcgaagatgacacgaacaacggtagcaatgcccccactggcaatgaaaatcaatatgtaaatgcaattaatcacctgcatacttcatcatatggtggtcaaggatatgctacagatgctacaggtatagcaacaccagcatacaatagttattcacaagcaaatacaagcatcaatacatctctgcaacaacaacaacaactacaacaaggccaatatggccaatatgttcaatatggcgttgctccaagtaccatttccggtgcaacctctactaacaataatagtggtaatgctcctaatatcccacaagatgtatactatagtcattatacaggttttgttcaaccacattaccctcaataccatattgccacaggtaatgcatctgatcaatacaatacaaatgccgctaatcatcagtaccattcaaacaatactacttccagtgccaacaacaacagtagctcacgaacaacaggagtaggatccaaacgtaaaccaagtattgttagtaatagtaccagtggaagtgttagtggtggtaatggcaatggaaataattatggctacaatccaaatagttctacttcaaccaatcgaccaccagcagtcagtaccaacaccacaagcantacaagtggaggctctagttttagtggacctagtagcaacataactacaaattccatgtcgaataatccttggtttaatagttctacaaatatggcagtgaattcaaattatattacaagttcaggtggtggtaattcacatggaggaattggaaataacgaatatgaacccatgccaatgactaataatagtgccagtattcctgcttattatcaacaacatgttccttctcatgttggttctgctcaacaacatcaactgcagcagcaagtggctggtgtaggagcaccacatatcattcataatcatccgtatcttcatccaacatatggtcaaggatcaaatagtgctagtactggtgataattcaacacctggtggatcaagtggtagtggtagtggtggtagtggcaacaatggtgctggtggatctagtagtgtagctgctacttcgggtgttactagttctaataccagtggtaatattgttactaatggaacattggttgctgctggaacagatgacgcagttggaaattcttctgggtcgtattacaccggtacttag

SEQ ID NO: 10976 - DNA, 348 bp, Candida albicans
atatttatgtattcattacaaagtaatcaatactataaaacacctaaaaactttaaccccttaaaagaattgaaccgaaatatagaacataaaaccatttctacgaagaagtcagacactacttccctttggcaaaaacgaagaaacaaaattaaaattttgaaccgaaaatttctagaaaagaaaacagaaagacaaccctttaaagacaattactctaaaaccaagttgaacaggatttaccaagatttatgctttttcttttcttcttcttcttcctcaaataaaatcacaatgatttcaatttccttacatttatcatcgatggaagaatcatataatttgtaa

SEQ ID NO: 10977 - DNA, 360 bp, Candida albicans
accataataatgtcagacaggaaaaaatctgaatcaaatagtcaggttaaaaatgggtttgataaagactacttcagacatttactagattttcaaaaaagagcacgtcttgatgatgttactattgatcagtatgaacatcaaattaacattatattccaaatagccaatatcctacagcgtgatacaagaaaagatttagatgctctttattatctattagatcatgaactaccgacaccttcaattttttcaataatcagtttatctatacagctaaagaagcttcaacttttagatttgaaactaagagttgattcaatccacaggtcttcaacagcgatggagatcacgtcgaca

SEQ ID NO: 10978 - DNA, 222 bp, Candida albicans
tcattaaaattattatcgcagaaccaagcaaatttacacgacccaagcttctttactaggaaggtttttgtcagacaaaataccacggctgatgtagagagagagggaatttacacgagactaaagttacactccgtgctgagcccgtacaataaagagagagagagagagaaaaaaaaaactaaacaaatacgaaagaatatagagttattttcattttaa

SEQ ID NO: 10979 - DNA, 189 bp, Candida albicans
gcacggaacggcaggaagaaaactaacgcaaatgtactaaaaataaacaaatgtatactaattgggggaagaccatcgactaaaaaaacaaaattatacactattgcacgacggtataaaaatatggaagattatttatcatcaccaacctgtcataggaatgttactaattataccattctcggttaa

SEQ ID NO: 10980 - DNA, 267 bp, Candida albicans
atatgggtgctcgccacctctacttacgtagttctatacttttactcttcatacgactatccgctttttccccaaatacacatgcctaaaggacttatgccctgtcaggcctatgacacaacccgtcagccgtttctatatgtaaaatgtgggaacagcaataacacccctagttcagagacaattttcctacaaagttacgtacttggaatgagaaacacaaaattatcgtacgagttcttcagaagtagaatggagaaactctag

SEQ ID NO: 10981 - DNA, 576 bp, Candida albicans
ctacgaataatgtccagaatagaccatgatgtttccagtgtaacgtcatcgttacaatcagatattcactcacaagaggaaccagttcaatatcaaccatcagcggtcaatgagccatcatcacgcagaccgtcaatgatacgaagattatctaattcagcatcaagttttttcaatgctagtaatataacacaagaaagtttggtggaagatgtggaagacgatatattggatattgggaatgaaaattatgttgaagaaatgtttggagctaaacaattaagccacgccatgacttcaaaaagtagtgatgaagaagagcaaaccccacaaccttatacaggacaacaaccacaacagcaagaaagctcaactggatcccaagaatcaaaagcagatttaactggtgatagcaccactccgccaccacaacaacctgtccagagaaggaaaggttcaattgtgagtgctttcagtaataaaaagtacagtttctgggataaagaattcaaatcagaaagaatcaagattgcgatgcaagttttagagaattatgtatatttagtactgtcttca

SEQ ID NO: 10982 - DNA, 192 bp, Candida albicans
cttacaacatcgattcattcatcaattatatatagggaatatttcaatagaatattaactttttggactttatttaactatttattctctctttttttttttatttatttaaaaacatccatcttctccttggcatattcccatcatcattttattgaaattattattcaacgtttcactattcccctttga

SEQ ID NO: 10983 - DNA, 1281 bp, Candida albicans
gatactgaagaccacaacaaactcaacctgaaatcagactcttatacttcttatattggacatgaattagatgtaccccaatttgaaagaacaatatttcaacatcatgatattcaaatcaatgtcccggattccaaacatagtttagaggccacagaaactgatatggaaatttctgaaattttgcaattacgtaaatcatattttgcttatccaactacaactacatcagaatttaaacatacaaatataacaacaacaacaacaaacttgccagatccagaagttgttgccgctgctgctactgctgcaaaatctgaagaaaaggaagaaaacacaatcccaccaccatcaccacctcaacaacaacaacaactaataccttcttcaggtgccactgaacagaaagttaatccagtgagtcaagcattaaaaatgaatactagtatcaagaaattaaaattggcaacatctaataatattgatggagccactccacttattatcaatagtcctactgtaaatgaaatcaaattaccaacaaataattcttgggttttacaagattatgaacaattatttggaaccaagaaattccataaagaaattgaattggcaaaatctttacggtttgctgatactacaaatagtgtttgttctgatcttaaacatgaaaaattgatttatatttcaactagaataatcaatccagggaaaatcttatcattttatttaaaacatccaccactaccaccaccaccttcctcttctactactactactactactactactaacaccaaaagagatttatacattgatttgataatgaataataatggctgtaatatattgttacaattgataaaatatattcatgagaatgaaactttagtggagagttcaattgattcagttcatgttagaattctggcattttatgttcatcaaattaaagtatttcttaatttaattactgaagtgatgaaaatttatcaaaaaattaaaactttaggattatttgttcgtattcatcaatatgaaaatggatatgttttaggtgctccacaagaggggaaagttaaactccctcaaaagttagagaaattatatttagccaatgaattgaaattggatgaatttttccatttaccagcttcaataaaagcacttgggttacataataccaatttatcaagtttaagtaaattcaatttatgtaaaaatttggaaagtcttcatattagtggtgaaacaataaatcaaactaatcgattataa

SEQ ID NO: 10984 - DNA, 198 bp, Candida albicans
agttggattttgaagttgaaattggatttgaaatggggcaaaacaaaatgtaatgtgtgtagattcttttctttcaaaaaaaaacaaaaaactaaaaaaactaaaaaaacaaaatcaaaggggaatagtgaaacgttgaataataatttcaataaaatgatgatgggaatatgccaaggagaagatggatgtttttaa

SEQ ID NO: 10985 - DNA, 339 bp, Candida albicans
tcaactttaaacattatggcagataataaattatctggtattgattctggtatttcatcaaacatattattagctaaattcatctctgataattcaatccctttaatcatattaaaatcaaatgttttgaaaaaattactacctagatcaagaaactttaaaccacttgttgacacctccaccaaagatgacgacggcggcggcgacgacgacggcgacgacgacggcagtggtgatttaataaatttaatatggaaatttgaggtatgtaatttattcccatataaactacaagacattaatttttcatttaaagttaaattaaatttggaaatttaa

SEQ ID NO: 10986 - DNA, 279 bp, Candida albicans
acaagtctattggcggtatcttataccgtaaaccagtcttgttctagtttgaatataataggcggttgttcaatatataaggatcaacaaaggacaatgggagcaaccgagaattatcagtttaattacttattgtttaagaatcttggtcggcttatttttcagatttcccggctcgctgagagtggtccttggaacgaaacaatagacagaccatctgattttcatttaagattgtttcaattatcattcaatcctatcaataaatgtatagaatga

SEQ ID NO: 10987 - DNA, 207 bp, Candida albicans
gccaaaaaaaaaaagagacaaaaattacactacccaccattacaacaacacaacagcaatcgattaaatttcaagtatcataacaatcaaagaaaaaaaaaatacctatctgattactatcaccaccatttcatatttcacttttcagatttcatatttctcttaatagaactttctaatatttatatttttaatttcatttcctaa

SEQ ID NO: 10988 - DNA, 333 bp, Candida albicans
agcaaaaagagaaacgtgtacctttgccaggttctatctcggcattgtttccttttgttgcttcgagtaattagcttttgtgatgtggaaatgtctcatgaaataagtcgactacaaacaataaaagatgcgatgagaaatgagcaaaaaaaaaaggggggacggactacaaggcggacatggcccaaaaccaaaaatgtcgaactagttattttgatgcgacatagttggtatccagacagagagagaggggtgacgagaaatattgatctttttttttttcacattgaacaaaaacaggggatgaaggggggggggaagaagttgatttga

SEQ ID NO: 10989 - DNA, 771 bp, Candida albicans
tgtatacccttagcaagtcggctgctgtatccacctaattcgaatgtgtcaaaaatgataactgactttggccagaagtacaacccagacaccgaaaagaatgaccattcctcaagtgttctgaaagctaactctcagaatgtgaaagacactaaagggaatgacagcaaacacgaagttctgggtaatctgcaaagtgattcaactggacaagtaacttcccagaatccggggaattatttgggagaaattgaacaaatgtctccagaagaactcgaaagagccaaaacaataatggaagaaccaaaagaaggtgaagaaacaacaaccaagcttggtgtgcctgaccctaacaactccaaattttctcctgtgacaaagaacaagccagaactacctcaaatacccctagttggtacaaaagacaaattaaaacggttcaaatttagaatatactcccataacgtgaagaatggtggttaccacagtctagttccaggagagcaacagtggtcagatagactaattccattggttgcatccattaagtttaatacattccctgacaactcaattgtcacattacaagaagtttacaaatttcagatgttggatatcttgaaagagcttaatcgacacgaacctggtaaatgggattattacggtaagggaagaatcgatggggaagagatgggagagtttgtcccaataatttggcaacctactgagtgggagttaatgtatagtgacacaatgtggctcaatgataag

SEQ ID NO: 10990 - DNA, 195 bp, Candida albicans
cacaattcgtataggttggtgggtgtcttgaagtttttattggactttgacaaaaaaaaaataaagaataaaaaaataaaatataaaaaacagacatgcacactacaacaactggtacatacggaaaatgatagcctttggagtttccttcttatgacatggtatagcaattacattcctatagcactgatttaa

SEQ ID NO: 10991 - DNA, 189 bp, Candida albicans
cttgaaaactatttgaatagcttgctagacttctctgagttaataaaacgaactcaaaatttagcaatttcattgagtacctgttttttgtcatattttggtaatttttatttcccaaaattttcactcatcaattcaagtttaaataggaaaaatatttctacaaacattcaaataattagccagtag

SEQ ID NO: 10992 - DNA, 321 bp, Candida albicans
cttttgggaatggaagatctcgattctaagtttaataacacattgttagccgataaaattacactatctggtatggtggtattgttcgattcatctagctggcatattttgttttcatttgttcttgtgcgtctcatattgccgatcgatattggtataatcagtgcatatactttatcctccccatgtgccaagacagtttgtaattggcaaagtttgggacatactgacgaatttgaggagagcacacaatttgcaagaggtgtctcagatacagcattggtaggtggaataactaaattggaaatggtaagggggtga

SEQ ID NO: 10993 - DNA, 213 bp, Candida albicans
agtagattgagattattgataagatgtgccgaggcacctgtgtcaaaaaataaagaaaggttgtcctttgatttgatttggtcagatgatgccgcccatccaaagacgtcccgtggaaaagaatcttcagtggtggacgagatggtatcgtcagtaggtgagggattagttattattgttgagtttgccgaccgattcgtaggaggaggttga

SEQ ID NO: 10994 - DNA, 219 bp, Candida albicans
attgctgaatacaatgacatgtacttgaaacaagaaaagctagttaccaagctggatctaccttctctaatgacatctaaaacacacgatatctcaaagactcgagacgtaaatggtgctgccaccgatgcttctgcttctgaaagagaaatcccaacatctgctgcttttaatgccccacagtcatttgcaccatcaccacaaaatccaactgtataa

SEQ ID NO: 10995 - DNA, 216 bp, Candida albicans
tatgtttcagtcgtttttttagatttaatagatagtaattgtttgttagtgttaccccagtttagtctaataattgaatataatcactctacacgtaaaattaactgccgacacgcaccttcggcattatctaaatcggctatttctcatttgtgccgaattattcacaaaccatcaataatttctggagacttagtcaacataaaaccctcatga

SEQ ID NO: 10996 - DNA, 222 bp, Candida albicans
atgcatcgaaacatagagttgaattccatgaacaattacaaacatgggcttaacttgctgggattgttagttaccttttggatacttttttttgttctacaagttatattcgttatatatattttttttaaaagtacttttgaggcaatagtcattgttttactttatagctgttcgcaatataatctgaaaccattcaatccgattccactaaactattga

SEQ ID NO: 10997 - DNA, 249 bp, Candida albicans
ataatatttttgtacaacaatagagtagagtatagccagttaccatcaaaatattctaagttgaaaaagacgcctttgaatgatgatttctctcaatgcacacaactgctgtcgtgcaagaacgtaaaaaaaaaacaactatgtgagacaaaaccaaaattatcttttacatcgatgaattgtgagaggcccagtgcatatcaaattttgttgactttgtatatccccaacgggtcaaaaggcacataa

SEQ ID NO: 10998 - DNA, 198 bp, Candida albicans
gttttggtagctaagttttggaggataaaagtaggcttaaatttatttcagccggcattcaaaaatcataatcccataccaatcaccggtgataaaggcatctatgataaagtactcaaaaattatttttttgattcaattttgatttgttggttatttattcagttcctgaagaatcagagccgtaattgttcatga

SEQ ID NO: 10999 - DNA, 183 bp, Candida albicans
tcttcaatgtttagtagtatttttacgttaatagaaccattccaaagtttctttttaatttcggctatattgtctatatcattcataatgcaacaaaaatatttctacggttgtaaattaacgcctcacaaaagtaatgccaacaatgatcttctccttatgattgtactttcaaagatatga

SEQ ID NO: 11000 - DNA, 207 bp, Candida albicans
tctttatggggaaagcaaaaccaaactgttttcttatccatgcattggtttgggcttttgcttactgccatgcaaggacccttgcccacaactaatgagcctttactagggtggaccagagcagtggtcctgaccaccggtattgccaccggtttagccacgggctttggctttagaccctgctcagggattggccatttcccttga

SEQ ID NO: 11001 - DNA, 216 bp, Candida albicans
ccaaatcaaaaccgatcatcccgaaacaaagaaataagcatccaattacatataaaaccaatcaatcaaacgtcaatcatcataaaaaaacaaaagttccatcttgaagccgctagcataattaaattttttctagataatgaatcaatatattatcaagtattatttataatagaagtactaaattgtcaaaggaataaccataaaaacagttga

SEQ ID NO: 11002 - DNA, 273 bp, Candida albicans
caacgacacaccagcttgcacaactctccagaatattttccaccaccatcaactactgaatctacaagttgttctatcgtcccttctccaactagcaagcacaacgagatacatgtctgggcatttacaatagcttctactcatcattttgcatctgccatgcaatctgcccaccacccatcatccaaccagcaaacacaaccgcaacgggcattgacaactgcttccactgctatgacaccaccactgagtacatgttgttcacccagttaa

SEQ ID NO: 11003 - DNA, 192 bp, Candida albicans
gtacatgttgttcacccagttaacacaacagctcaaaactgcttccacaactcgtgttgcatctccggcttacttgcacaacagcaatcacaagatacacactgggcattcacaactcctcagataatttacaataagcttacacaacgggcattcgcatttcatgttgcatttcccactgccatcaactag

SEQ ID NO: 11004 - DNA, 192 bp, Candida albicans
tcaacattagttggcgaatttgaacagctaaactttgcagttggtgcagacactggtggtgggacagtcgatagactaaatgaatttgaggagtttcaagaattgaagaatttgctggcaaaaggtaggggtggcagaactggtggtgggaaagtttatagtttcagcaaacactcaatggtagaacaataa

SEQ ID NO: 11005 - DNA, 351 bp, Candida albicans
aacaagaaacttccaaaagaagagaagaagaaaataataattgttgctagttcgtctacccaaaagatagagtattttaaaattatttctggtattgttttgtgtaatgtaaattggttcccctgtttgaaattgatattgacacaatattttttttttttgttctggctcaacaaagttgattatctttttatttttgaccgaattacacaaacacaagatctcattaaaaatacaacaacaatagcaacagcaacaacttatcagcatgtaaaaaaaccaaactttaaagaaaataaccattttttaatgaataacaatcaactaatggcaaaaagaacaagaacatag

SEQ ID NO: 11006 - DNA, 255 bp, Candida albicans
ttcactttttttgatcaaattgtccttcccccacatcatcaatttcatactgtttcttttctcgtgcgctctattattgtgaagttcgtaagatacaatataaaccatacatattctatgaatttacaaagcagtgaatttagggaagcaatctttttcacttcttttatctatttaatctataatgtggtggcatatttgtacaccagcaactcaatcacttataattattataattctattatcctgacataa

SEQ ID NO: 11007 - DNA, 291 bp, Candida albicans
tactttatacttgaagcaaataacctaaaacttaatgtatatcatttttctcaaccaaggataataaacaacagattacatgtgaagaatattgtatacttgggaagagcaaccgtacatggcactgttttaatagataactgtaccaataacttcaaaccaaaccaagcaaccgacataattgcctcaaaggtccagttctattttgaaagcgttgtttctgttaagaaacgacagtttaaacagttattatgtcaggataatagaattataataattataagtgattga

SEQ ID NO: 11008 - DNA, 1296 bp, Candida albicans
ataatgttaggaataatatcatcaattctaagatggtctatatcaccagtgatatttatttataatttgattcatacaataatttctcacacaattatcatcccattaaaaatatttttcaaaatctcgatatacataccatttttgaaaattcctgttattattcccttggtgtatcttttagaattacatgagataagaagtactgattggattttagcccaaattgaattattctcaattactactttacattttttgattgtttgtatttttttgggtggtattgttggtaccattgcggggataaatatgagtgccatttcaattgttctatcgggggaaccaattgtatcgacaccagctactactactaccaccaccagtattgcttcgggtaagccaagtatgaaaactgcaggtgttgataagagtaaattagaacaagtgtgggagaaatcacttggaactggatttagcaacgaaaatgaaggattggggattaagaagaaacttgaagaagtaatcattcctgatatattacccaatatatccaaatcaagaattcaattgaaattaaagcagcaacagcagcaacaccaacaaatacaaaaattgaaagaacaacaaggaataactcttcgaaatccagaatttaacgacacgcaaaaacttaggaatgtcacaattaatgaagagcttggtggtggtatcgataatgataacaacaaaattaatgaaattcatgatatagatgatattgaaagcacagggattgaagttgttggcttggaagatgacggttatgcatacacaggaggattgagaaatcgtaatcaatatcaatatccatcaaaacaaaagataacggccagggcatctggtcatgcatcattaaatctgccacagatagtatcagcaaccacaggtaggaaatcaaaagacgtgaatgatgaaacgagtactgattccaaaacagtaaagtttgcagatgagttggtacaagatcagccaactgggacactgctgagcaagagaaaggcagcatcaacagtgatatttgaagaagaacaaacagagatggaacaaagaaacctaccaagaggtgtcaatattctacaagaaagtgaggaagtcagtagtactgatgaaggagcgttatcgaatataccagaggagacagaaacggaaacggaaacggaaaccgagaatgaaacaggaacaggaacagaagaaatcgaagagcatatatttactcaaggtgaaagtgtaacagaagatactctgttgtattga

SEQ ID NO: 11009 - DNA, 225 bp, Candida albicans
caggtattccaaatagacagtactatgacagacaatgtcgagaataaggattcaatgattacggcttatacaaggatttcccctgattcaagtgatctgcgctttattaaaattgttaagtttcaacatcatgtagataagacaccaacatcaattccattcccttcaccattaccaaataacacttctgctagcaaccacatcaatctaaaaacatctgaatga

SEQ ID NO: 11010 - DNA, 219 bp, Candida albicans
aaaaagagcactctgttaggagaaaaagatacttctactgagctcagctgcttggcaattgatttgttgtataatgctcattttataggaaacactaaatattcaaataatttgaaactcaatactaaacataaaagatcaaatgtgtttaaaatctatatcctgtcttccgctatattactaaaagttcatcttaatagcaactgtatgttttcttga

SEQ ID NO: 11011 - DNA, 246 bp, Candida albicans
caactgtatgttttcttgaatatcatagagtacagtacggtgaattacactagtattttttgtgttaaggagtcaaattggatttcaataatacttattttttttgcgtgttgtattttttcttcctccttttcaaatgttattttgttttttcatcctaaaagatcatacaatcaatcaattatggtaaacatcagtgattttttcaaaaataattctcaatcgggttctgtatgtatattataa

SEQ ID NO: 11012 - DNA, 186 bp, Candida albicans
tgcttaaatataaatataaatatttggactatttttggttggattgaatgtttatatatttcatcttttccatataactcctctttcaattcttcttcttctattatacaatctttaattcacattgtttactacttgcaaaacaaacaaaataaagaattccaatttaatcaaattcaattttga

SEQ ID NO: 11013 - DNA, 276 bp, Candida albicans
gtcggcaattcttacactatacaccaagacaataacaatgtgtggaatatactagaagcaattgagaaaaaaagaagtaaaaaatcagcacatctttctccattgggaaaatctccgaaaacacaaaacttcctgaagtctgttttttccattgaggcaaattatgttgacgatgaaacagaaatgaatccagtaaaatttataatcaagttgtttattacacaaagattgcatgaaggaggtttcccccctcggaaaaatgttattattttctag

SEQ ID NO: 11014 - DNA, 186 bp, Candida albicans
caagtccataaattttttgttttactgattattatggaagtagaaaagttgagaaaaaaagaattgatggcggcagtgattgcaatagatagtaccaagattaatagtgattggcaatggttggcggcagtatcatacatcagatcgtgcgagggactcgactcggccataaaggtttttttttga

SEQ ID NO: 11015 - DNA, 1743 bp, Candida albicans
acccgatggtcacccgttgggcagattggtagcaataataagaaaagatcttctgaaccaaacaagaataagaaactgatgaaaccaacaaaacctgggaaattggggaaaccagggaaactaaataaaattaaaccatccaatgttgatgaaaatattgttcatgaacaacttgaaaatgcttttgttacagttgcattaatgaccaataaagaatttttagaacaaattgcattagatggaagaaatttcccattcaaacattttaaatcagattatttgattgatcgtcaagaaatattacgacaaatacccgatatgataaacatttttaataaacaagatatgaaaaaaattgaacaaatttatcaaaatttatcaaaattagatcaagataaatctatgcatttacaatttttaaaacaatcatttatagattataaaaatgatttattatatttagatcaatttttaagagggataaatctgaaatttaaacaatatcgtcgtggtgaagttcgatattttttcgtttatccaacagtttttgaacatgttcatgataaaattttacatcaatataatgttgttggatttgatcgaagtttatttggaatgcccttggataaacaattggataaacttgttttaccacgtgaatttattcaagatttaccacaatttgataacattattgaattgaataaaattgatgcatcattaggatttaaacttgttgaagaacaacaatttgggaaattgattgattcactttgggatcctcgaatggttaaacctttgaaagaattacaaaaagaatataaagaaagactcaatgaacagaagaaggataaaaatcagcaacttgagaagcagttacaaccaccattgaaatctaaagatgatactattaatgggaaacaaccggataagaaatttattgttataaagaaaggtggttatagacaaattaaattaaaagaatcaagtttacaatatagtccagtgataagaagaattgaagaagaaattgaattaatgattaatgatttaaataaacaaattaaaaccactttagaatcagataatattaaagtattaatccccaatgaaaatgaaaatgaaaatgataaaaatgataaagaaacaatcaccactttcacttcacctactggttctcaacccacctcacggattaagactaatttttatgaaattgtatttaaaaaaaaaatttatcaaggttatttagtttccgttgaacgattaattctgaaaaatttcaatatattaccaaattatgcattattatatcataaaatcaattatccaccattaattaaacgaaaattattaaatcatattttcaaaatttttttaattaatattaatgaaaaattcaattatttacaaaaaattaaatatttaactcaaagacaacaaattgaatttcataaaaaattaattaaacaaattaaatatattataagatttaaattattaagatattttgataataatactttgaatcaaactacaaattcccttaaattaaataatctaaatgttttccaccacgaagaagaagaagaggaggaaaggtatgataataattttgataagtcaaaacaaagacaaagaaaaacgtttggtggagctcatgcagtgatttttaatccatatactgataattgttttaaaagaattattggatttcttcaccatatccatcatcaattataa

SEQ ID NO: 11016 - DNA, 228 bp, Candida albicans
gttatattaataagtattttatacttggctagagtaattaaccaacgtattggtgttccaaagttggctcctccttttttttttctgttggtcgattatacactaccatcaccaattaattcaattccaactctccttttcaaaaaaaaaaaaaaacaaattgaatctgaaaatttttctaatccattaaataaaccacataatcaattaatctttttatatatctaa

SEQ ID NO: 11017 - DNA, 282 bp, Candida albicans
tgtgcgttttcagacgttaccttctccaaggcaagtgcgctgcaacttaatgcccttgaatctgtgacgttggtaaaaattgtatccattactcaatttataaatttactgtctatgctcttacaaaagccaatccagaatagctacaatatacaattactaaacacatcgctattatatgttctcttgattagcgttattagagtatgtatatattgtcacatcaaattggctatgttagtaaggttaagtcaagttgtctacttgcaagtttgctcttga

SEQ ID NO: 11018 - DNA, 192 bp, Candida albicans
ggagttcaaaatatcgtcccaaatactgtaatttccataaagatcaaattaagcctaggctcacctacaccatcagtgatatcaaatcctaatcgccaattgaataatgttactacaccatacgcttccttaaacttagtactgactaaatgtgttcaagaaatttttgatttaactagcacaactagataa

SEQ ID NO: 11019 - DNA, 192 bp, Candida albicans
tttggaatctttttagtttttaaatcaagcatagtttttaaagctcactatccaatcttttctgaagtagttcaacatagtataaggtatgggtttgtagaacattgctcgttagcctatgttgatttgaacaatggctcacgagtttcaagaaataaaagtattagtttcaaaatgaccttccataattga

SEQ ID NO: 11020 - DNA, 192 bp, Candida albicans
ttaatggccaccacaatcaatctcatgacatccattgctaatactgatattgacgtctttgtcggtctaggaaaacttccctcagatgttattagaacaattgtcgattacttgcctaaatgtatgttgccagagttattatacttcccacctattagagaagttgtcttgaccacgggtgaagaatccgcg

SEQ ID NO: 11021 - DNA, 225 bp, Candida albicans
tgtaacatttttattaacaaagttttgtttttagttgcccccaagaggaagagaacttttaaaacatttttccttttaaaggtggttgatttaaaaagaatttggttagaaatgcccaaattgaggaatattacccaattttatatggtgccagagttcaagaagaagattattccagaggttttagaattccaagaccaatgggttttaatccaaaaaatttga

SEQ ID NO: 11022 - DNA, 333 bp, Candida albicans
tataaagggcagagaaaagaaagatatttaggatatttattatatagggaccgagtttcaatagacacttttagtgggcgtaaacttcattcactctgttttttgcttattacaaattatcacctatcgtgtactaggactaattctcacgaatattccgtgtatacaaacaaaattttcgaaattagtcaatcacaacaaatttgtttgagttcaactgaaacgataacaaccatcataattcgattgaatactttgtgtcgtctctttctttctatgcattctactacttgtcgactacatatatccagccatgtcttgcatatatcctag

SEQ ID NO: 11023 - DNA, 207 bp, Candida albicans
ataaggttacttaaagatgttctttacgttgagcccgctgaaccctcaatttcagaaatttacttgtttgttgctattattttttcaactcatgattgcattaatgacgtattctttacaatttcatcaaacccagttgttcttgttttccgaatgaaagttgatagttgtattgctcaaattcaaggggggagggggtggtggtga

SEQ ID NO: 11024 - DNA, 192 bp, Candida albicans
gttatactccgaattcttgttcagcattgtttagttttgtttgtgatgaatcgcaacaaacaaactggttttacaataagacgtttgttgttgcaaaaggaacaggcagtcacccttcctcccccacaaaaacatattctgtataatctatgtaatattataacatccaatcaaaacatcaccaacaaataa

SEQ ID NO: 11025 - DNA, 243 bp, Candida albicans
ccagaattctcaatacatactttttcatatcgatcctttttcttcttcctcctcgatttttggattatattaactaaatttagcatttacgtttataatgattttcaatacaaaaaaaaaagcataataaactatatatatatcatcttgaatagtaaaaataaattagtattgatagaaagttttttacatctgacattatttactaatttaaggaagaatgggactttaaaaaatatctaa

SEQ ID NO: 11026 - DNA, 390 bp, Candida albicans
atccatttgaatttgaaaaaattttccgatcaagatgatcaactgtttagtagcactagcaatgccaacagtaatgatgaatccgatacatcagcaatattagatgacttggatttggatttagatttggagaacgatccaattgacgaatcttcatgtttgctagaaaatggtggtgataatggtaatggtaacgatcatggctctaatggcgagattaataatggatccataactaaatctagtagacagaataatggcgagccaactatttcaagaagaaaatcaacattagatgaagaacgtgaagagtttactgattatacatatccaggattaatagacccactagatggtccatgggttggatttactggaaattttgtctag

SEQ ID NO: 11027 - DNA, 183 bp, Candida albicans
  unsure (100),(138): Identity of nucleotide sequences at the above locations are unknown.
ggccaggtcatattatggttcatttgttataaattaaaattaaaagatgttcaaacgtgtgggtttggagcattggaatgtgatatttctttcaacgtgnttcaagtttacagaagattaacaacacccacggcaacnacattgaacaacgttttattctgtttggactgtacaactgattga

SEQ ID NO: 11028 - DNA, 249 bp, Candida albicans
aatttgaacaatttgtttacattacgaaaaataaaaaaaaacatgaactttaatttgtcgtcattgtttgatcacaaatgtaaagggaacaacaacaacaacgcttatggatttaactataattgtggctttgatactttatgtataagaatactgatattgacttttcaacgaaacttatttgatagaaaatgttgctcatggacagagaaactaccaaatgatcaattgccaagagttgcattctaa

SEQ ID NO: 11029 - DNA, 183 bp, Candida albicans
  unsure (95): Identity of nucleotide sequences at the above locations are unknown.
gcgaaaagtatatatattcatatatctatacatatatggattatgagaaacctggagttaatatgcaagttacggacaaaaataaaaaacaatancggggctgttactacaccatcaatagaccaaaaaacccatgattaccccacttggttaagaagcacccacccaagatgtagattctaa

SEQ ID NO: 11030 - DNA, 642 bp, Candida albicans
atctacaaatctcttctattaaacttttcagtttcaaaaagaaaacaacagcttttgtttttgcaattgtattcccccctccgcccaaatatcatcatgaagttatccactttatttacattagccacaaccatttctacattgactacttttaccattgccagtcccgtagtagtagtggagaaaagagccattaatgaaactgcattagctgaagatatcccaaccaccaaaaacaatcatgctcaaacatcatatgggaaaccatttgccatttatcaaccaaaagcatttattatttccatgtttagtttagaaagagatccttggttaaaggctatggattttgttcataatattaccataccgggattatcaccagtttatcccgatattcattgtacaacaaattataccatttgtcaaatcactactggagaaggtgaaattaatgctgctagttcaatttcagcattaactttaaatccattatttgatttaacgaaaacttattttttagttggtggaatcgctggtggtgaaacaaattatactaccattggtggagttacatttgctaaatatgccgttcaagttggattagaatatcaattggcttatgaagattatcataaaactaat

SEQ ID NO: 11031 - DNA, 240 bp, Candida albicans
ataaattactgtaactttaaactcgttgataatgataaattaaaacaaatcgtaatagctttgttcccaaataggaaaactgataaactattgttgtttttgttgctgctgaaagaatgttccgattttccaatggaacggcaaaacttctcactttcggggaaatgcatcggaagtttgtcacctattattaaaaagcaggcacggcatcaaatagataaagaaattaaatattattag

SEQ ID NO: 11032 - DNA, 207 bp, Candida albicans
agaatagttgattgtaaaggattaatttactcttcaattggaaagaagaagaagaagaagaaaaattttttgtttgatggaaaacagacgacacgcgacatttttaagcaatcgatgagattagagagatgtcgtttagttggtagcgctcttctattaaatggtgttttcccctataaatgtatgttatgtatacatgttttataa

SEQ ID NO: 11033 - DNA, 189 bp, Candida albicans
tatataaactatcaagtattcctactgtgcaacttttttttttcatttcttgattactttttttttgacaaggttattagtttagttaataatagtaaagttggtgtagttcttattttccaatcatttaacttcattcattcaattattaatttaattattcattcgtttttgttttctacatcttaa

SEQ ID NO: 11034 - DNA, 807 bp, Candida albicans
ttattcattcgtttttgttttctacatcttaaatcggactattcacattattcaacagcaatttgtatgtcttcaaatcagacatcaccagttagaagatcaatcttatctcgtaagccatctaactttaccaacaacaattcaccattaggtaaaagattcaatacaagttcaagattaaccccatcaccatctaaatcaggttaccatagatcatcagcaactctttctcctaaaaagcaaacgttaggattcactatatgggaagataaagtagataaatcaaactctacgaccgatgttgttggtactcctacttcaaataaattaaaccataatgaccaagaaaacatattacaacctaagaaagttgaaaacaaaagattccacaatgatcgtcaaccattaagtaatttaagcattaatgaattcaaagggtttatttcaaccaatggcgcagcaccaatacaattgactgaattatatcaaccaatcaactttaataatgaattcaaatctttacataaacaactgaacatcccaagctatgtgacaccatcaagaagatacagagacaaatatttagccaaatcgggtattgatgaaattgatgaagaaatagaagacgaaatggaattgcttttatccaaaaaacaacaacaacgttctacaacattaagtgccaaacccaataacatcaataaaactcatttgattagaaaacatactagatcactaacggttggtaaaaatgactctaaattaagtttaattagaaaaaacaaattctccattttatcaaattaa

SEQ ID NO: 11035 - DNA, 186 bp, Candida albicans
caaaacgttggagatgtaaatggtggagtcgccgttggcagtgaaacaacccgaacccttaatttgggttgtttgttcgtagacctggttattcaaacagatctgaccgttgttggtgatggatcccaagggcataccaagacttacggtgccggaggttctttgattttggtaaaacagcaataa

SEQ ID NO: 11036 - DNA, 189 bp, Candida albicans
cccggtgttggtccacagggcagaagtgagtgcggtggagctggagaactcaccggaagcagcaaagtacatttccccgttgttggtgaaggagacgccttgcaagtcataggaggacgaggttctggaaatacgcgagtcaaaggagacgactccgttgttggtgatggagtggagcaatgttgttaa

SEQ ID NO: 11037 - DNA, 837 bp, Candida albicans
tttcacattcaaccatggtacctcaatcgtctgtttctgccttgtccgttgttagtgagtcgctcgcttctgctgagccatcatttgtcgtcccaagtgaatcattcatattcagtgcatcttctgctgccccccaaccatctagcagtacttattcagtctcattcaccacacaatttgaaaccccatcttctgctggttcctcattggttacttgctgttgaatcaaatactgaacttatttcatctgccattcaatccagtaatatacaaactgagttcacttccacttggactactaccaattctgatgcttctgttgttacagaatcaggcatcataagccaatcaggtacttcattaaccaccttgacaaccttccagccagccacttcattagttgttcccccttatagtgtcattgaaactgagtttacatcaacttggaccaccacaaactcagacagctcagtggctactgaatctggtgtggttagtcaatcagacactttattaacaaccgtgactactttccctcctgcaccatctgctattgtacctgaattcacatcaccttggaaaatcaacacttcaattgagtctaatgaaacattaactgttagtgccagctcctataagagagtgtgtgaatcattggctgctgccacttcatcatccttttcttctgctactgttgttgttgcaccctcagaatctgaaatcaatactagcagctcaatattgaataatgaagagattgcttctgctccagtctccgacacaacgtctattgtcttcaccacaaatggctggaagacccgcgtccccgtggctgtt

SEQ ID NO: 11038 - DNA, 249 bp, Candida albicans
tctcaagaaggacagaatcggtgggcaaaaaaaaatttattatggtttcgtaaacgcacatcagaaccgctaaaggtctatagatctgtaagtttgctttcgtcacttctccttagttttcttttgtggatgtggttgattgttagttggtcagttagcggtcattctattatttatgcacctttacaacattccaatctaaaaaaatctctgaatttgtgtaaagtcaatcttttacccctaagttaa

SEQ ID NO: 11039 - DNA, 300 bp, Candida albicans
tgctatacttcatgtctatattttagacaagataacgatgatgattacactaaacaagatttgaatcaattgctatgggaaacattttttattttagtgtctctagtttcttactttagtcaaagaaaagcaatcattttagtacaaaggattccatttgatcaaattgataatagcaacaagcaatctatgaagtttttttgctttgtcatattactaatacaactacaatgtaagaagtttcagtttagtatgattcacttgctaaatggaattgtgaatactcccaacgaacactga

SEQ ID NO: 11040 - DNA, 291 bp, Candida albicans
tattatcgtttaaattttatatgtaaggttcatagtaaagaaacacggcccagagaatacataggaagggggcaaaccatcgttaaagtaaaaaaaaaaaaatcatgccattacgtccgttttaatgacgtattttctcaaattttagtttcctttcaacttcgttttggttcactcttacgattggttttgtggcagaaattggttcattcatcattatcaacgatattgcttacttcaatttctatgactataaaatttagaaatcttgaattgaggaaaatctactga

SEQ ID NO: 11041 - DNA, 195 bp, Candida albicans
ctcttccaatcttgtgtctatgtggagcatagtagcaaaatatattttgttatcgttcttgttgcggcagtgccagaccaggtacaactgatgtcattcataaattatactgataataataataatatttctatcgtatatgtacaagctctaactcctaagatttatcaacgatgtgagctaattggagtttga

SEQ ID NO: 11042 - DNA, 189 bp, Candida albicans
ttagacgagcattatttaatagtgacattagaagccacactactactattgcatcaagtgtggagactgatcatgaagataataacaatggtgcttttattggtgatgatggtggtggtggtggtgatgatattcatggtgacattcatagcgatggtaataatgatggcggggataataacagtctaa

SEQ ID NO: 11043 - DNA, 696 bp, Candida albicans
aaaaataaatacgcggtgagcagtagtgatatttcatctaaatcttcaaaatcaaggaaaagaaaattatcaacttctagttccagttcaagttccaattcttcattatctgatgataatttaacatcaaacattggtagtactagtatcaattcaactaattataaactgaattataattcacctccttcagaacaagaatttgatgatcattattattcttcatcatcatcgtcgtcaactaccaccaattccacttttgcattatctaatcaagatcaacataacttatcatcttcttcttctagtacatcgaaaatggattattatactaatttggctaataaatttagaatcaaatataaagaatattctcaattatataatcatttattaacaaattcttcaacaaatgataatgatggtagtaatacaaattataagaaaaatttaatgaaattatttgaattacatcaattattaagtcaatggaaaaaattattatgggattttgataaagatttaaaattaaaacaaaatttgaatcaattacacgttcaaaaaagggataataaaactgttagtactacaactacaacaacaacaaggaatagcaatagtgccagttctactagtggtgccagtggtgggaataaaagtccttcgaaaaaacggaaattagttatggattattaa

SEQ ID NO: 11044 - DNA, 237 bp, Candida albicans
gaccaagttgtaacattactaaacggaccatttccaaatagacacataatcaacagggttgccaaatggttaagcattcctcgaaactataatttggagttttctaatactgacagtaaagtgacaataaaaattttttttgttttgtttggtccaaacgttggaatgattcagtggagatcctacttgtttattttatcctcagatacacgacctccaaaaaatagctttgtataa

SEQ ID NO: 11045 - DNA, 207 bp, Candida albicans
gcggtgagttttccggatagtatgcttaaacccctaaatatatttaaagaagaatgtagtacaatgttttattcaaaagagttgacttttaatactaagaatattgtgttggttccaggacgcgtattcgaaaatattattgataaaaaaaaaatgcaaacatcgatatctctttttcagttttgctgcctaactattcctttttga

SEQ ID NO: 11046 - DNA, 198 bp, Candida albicans
gttacaaaactagagcatataccagcgttctatgtgtggtacactatattttatcatggtagtgaacttacactgcttgacatagtagatgatactaccaatgaaactcaaaaaattaattcatttgtactcttcgatgatcccactagcaacaaaatcaaaaactcacaattgatagaggataatatgatatattaa

SEQ ID NO: 11047 - DNA, 474 bp, Candida albicans
gcacacaaaaaaaaaaacaccacccagtatcgaaccaacattgtttccccaacccccattcttgtaattataatgtcaggtataaaaatcagtttaaagaaaaagaatccaaaactaaagaaacttatagtgaataattcacaacaaacagatgaactgtcagagcagcagaagaaattgattacatcatattctacagaagataagactactcataaagatgaaaccaaaccaataatagttttgaagcaaccatgtaaaagtatgttacagaaagaaatcgaaattgacgagaaaccaatactaccgtatggtgtaacaacgtttgaaaaagtggagactacaaaacaatcaatgatcaaaaagatcgaatcagaagattccgatgatgactccagcgatgatagaaaaatcccaatagatgaatttggtgcagcatttttaagaggacttggttgtgttcaccacgggtga

SEQ ID NO: 11048 - DNA, 354 bp, Candida albicans
actctaccttcaattcctggtgatttgaatttgaaaataaatggtatttcatcaaccgtcattgacgatgtcatcttgaaagaagaagccttgagaggagaagtgttgacatgggatactgaatctgatggtttgatgtcaacattaaatgaatggaattcagaaggtgtgatatcaggagcagtagcactaccacgacttgtttccattaatgaatccgaatgtgctgattctgtatcaccatcggtattgtccaaagaagtccaaaacttgttccatgctggaccttcattggttgagtcaactgcagttgagccattgcttgtttcactagtttcaagctgttttatttga

SEQ ID NO: 11049 - DNA, 279 bp, Candida albicans
ataagaactgaaattgttgacccgataataattttttctccaccactttttcttaataacgatatgttgtacgagaaaagagtattacctcctaaaaggagctatcagaggaacccaattgtctgggcattctttgtcttggctattcttaccatttataaattacccttaactttgtttcctcaagaacaagatgttatcgaccctaaagctgttattctcaatgcccttgaaaccaatttagctggtaattgggtcttcaccacgggcctggaagat

SEQ ID NO: 11050 - DNA, 210 bp, Candida albicans
ttcattgccaatctacaaggcttcaacaagtttttgcttaatgatgataaaaacaaaagaatgactgtaatttattactttatatacgtaaatcataataatatggaatttaaaatgcaacgggatttttcaaaaaatcagcttctctactctccttttcttctcataactatcatcaaatatcaaaaaaacacccgaatagaaacttaa

SEQ ID NO: 11051 - DNA, 219 bp, Candida albicans
caattatacgaccagcatccgcctggttccggttggatcgaattaaacgggactaagacaatacataaaatctacacaacagtgaatgaaatgcaaacttctgtcgtccaagtggggcaacgcgtaacaacacactatttattattgaaataccttttttgccgtcttcacagcaagtctcagtttttccgtggttttaatattagcaagttcacgtga

SEQ ID NO: 11052 - DNA, 186 bp, Candida albicans
tatttttcgcatggaagatcagacaagcggcttagtttttcaaggggcataaactccgttatcaagagttttcgtgtagtgaatagatttcgattaccaaatatttatgggcaatataaagatgttcttttatgtagctccgaatatcccagtcgtgacacttatcgtttaaaatctatttattaa

SEQ ID NO: 11053 - DNA, 468 bp, Candida albicans
acgcttagacttccagaattgtcaatccgaaccaacatgcaagatatcattgataaccagtttctacttttggaattctcatatttagatgatgaagacgatggtgatacaggatttactacagtcagtcattctacttcaagagattcattttttgacattcatggaagtgattttactacaagtacatcaagtcaaaacaatatgggagacaaatttaaaattgccaacaatctccatagcaagagccagaaattagccgccgtaattcaaaaatggtgtttcaagaaattctacaagaaatcaaaagtaaaactgaatgcaagtaagaaaattctgatcatctcaaaaaagcttgacaatagtaatgacaagtttgtttattttgatcaatcaacagaattagaaagaactagcaatattgcaactgaacaatccaaaagagataatggaaacgtcatgacttga

SEQ ID NO: 11054 - DNA, 192 bp, Candida albicans
agaaaaaacttcagcaatataattgaaattcccgaaaacaaagattctcaaagtttaaaggaagttcatcaactatatgaaaaaataggatcaattaggaaaaagtcatggcaagaaaaagaccaaaaaataacaagtgtatcatcccaaattacagttttgaataaaagcagatcatataatattttgtaa

SEQ ID NO: 11055 - DNA, 183 bp, Candida albicans
tacgctaattctccatggctattcgtaaggtcaattaccccaacttttccaaaaaaaactgaaattaaaccaaaaaataagattgagtcattatggagtaaacacataagagtcaaatattgggaaagatcccgtggtccgtggtttaaaatttcaaactctctcatttgggaggggaagtaa

SEQ ID NO: 11056 - DNA, 225 bp, Candida albicans
ttgtttttgaatcctgggttggaatcatgtcttgataagatgggtgttatggtggtggttgaagctgttctgctatataatggcactgagtcaaataaagaatttatggatgatgaggagcttatgaatctcaagtcagcacccgaaggactgtgtggactcgagctagactcgatgtctgtggataatggtggtaattgtttgagtttatttcgttgcatttga

SEQ ID NO: 11057 - DNA, 195 bp, Candida albicans
aagtccggtccttccacgcccgtggtgaagacaccactatatatatatcccccccgtcaaattattaaatttcaagggttttttttcaatttaaataatattaatcaagagtttcacaacaaccagaaactcaaaccactaccactaccactacaacaacttaatactattaatttccaagatggtttattctag

SEQ ID NO: 11058 - DNA, 201 bp, Candida albicans
tccaataatagaaaagatcccgctgacgccgttacagataatagaattataattatactcgaaaaccctaatgtaaatcttgttttcaccaatgagtacaagttggcgcttggtagtttgccaccaagggctaaagaagcatatataaacataaccaaatacgatatggcaatagtttttatgtctgtatttgaagattga

SEQ ID NO: 11059 - DNA, 327 bp, Candida albicans
tgtgaagaatatttattatcacgtgtggggacgtacgaaaaaaatattaaagttatgtatatgtacatacatttaactaagttagcattaactgactgtatctactaccattctatgataggcagatgtggaataaaagtttatccaaaaaaaataaatggacgagataagagtcgaactcatgacctttcccatgctaagggaacgcgctaccaactacgccacacgcccgttttgacgactgctaaattttgtgctttttgtcactgtcatttattagagtacataatgacactattaatgttgttaaattactttttacagtaa

SEQ ID NO: 11060 - DNA, 435 bp, Candida albicans
gttcacggtttctattttcattttaaagtatatgcatgcttactttcaaattgtgtttattgctgctgtttattgtttgttcttttttttgtccccatgtatatgcatatttgtaccttccgcattagacgcttactgcttgctcgtgcttggtacttgatgtcttatgcatcacctacacgccacaaactatcatctcttttttttttttgcagccatcgagtaaaatatacttgttcgaatattttagatacaattaatattattattattacacacttgaaaacaaaactaaaaagaaaagaaaatggaaaagacaatgacttacacacatatatatacatatacatagatagatattatgcaaaaaaagaaaacgtttttgtttttgtttttgtttatgtctgtttctatgatagaactgaaagaaaataa

SEQ ID NO: 11061 - DNA, 321 bp, Candida albicans
ctagactactcacacacacacacaccaaggatgttgtggaaactactacgtttattcattattattaaactcattcaactagctataatttatttctcaccatgtcaatttgatacttcatctgaattgatcattcaaaatttatcatccacgtcatcatcaaaatcttattataatgtcatcatcactaccatactaaataaattgattgtttgggattcagtttatttcaatgatttattcataaatcctattcaatttgaacatcaatttgtattttgtcctggttggattcaattaatcaaattgttgaatatcaaa

SEQ ID NO: 11062 - DNA, 186 bp, Candida albicans
attgttttatacgagaatttcccattgatgatgggtgagaacgataatgttgaggaaaagtccgaagacaatgataataatagagtagtaagaacaaagtttgtacttttagccaaacaagaaccacagttttcaagttcgaaggtaaagagtcttcaacaggcgatggtaggacaacgctcacgc

SEQ ID NO: 11063 - DNA, 207 bp, Candida albicans
acccataagaattaccatcgctacaatgttcatgaaagtaccttggtgaattccaagactgtctcggtgattgatcgagatcgtatcttttatttgttgcaaaaaaacgatcgtaacgactactgtattataaaatcacctgaagcttgcagcacagggaaatgcagattgcagattccatcaagggaattgaatcaccagagataa

SEQ ID NO: 11064 - DNA, 195 bp, Candida albicans
  unsure (38),(53),(57),(58),(59),(60),(73),(85),(91),(104),(107): Identity of nucleotide sequences at the above locations are unknown.
gcatgggctgcgtggtgtaaccattatactgatctgcntgccagctcccttanccannnnggctatcgatcgncctttatgaaancaaaancatttttttatanaanaaatttaaaaaataaactcaataaaaacttctaccactttggtttgtatcaattacaaggatatccttcaattataaataatagctaa

SEQ ID NO: 11065 - DNA, 294 bp, Candida albicans
  unsure (167): Identity of nucleotide sequences at the above locations are unknown.
ggcaaatccaattcgatcgagtgccctgatgaagaaacaactgtaatggcaactattggtaacaaaagggtagcatttagtttggcttccacatccgattcatttagctttgacatgaatgacaagtacacgattaagaaggaagtgtacatggctgaaaacactgntagccaccaaagtgtccacacaaaatatatatgttcacctttggttatgagggcaatgaaattcactatcgttatgtaccccatggaaaatgcacccatgaaaactgctcgagatggatcaacatga

SEQ ID NO: 11066 - DNA, 231 bp, Candida albicans
aacaattactccaatcaaacaaagcgatcttcggatacatgtttcaccaaaagagataccaccagacagcgtgttgagtatgaccaatctaaggaatggatacacacacactttttaacacagaacatttttcaccccgtgactaaatccacacatgcagtatcatttgcgtctacagatgcatctaacatacatggccagtcagcacgttccgggacatgtcgtcgttaa

SEQ ID NO: 11067 - DNA, 252 bp, Candida albicans
aatgtatacgataacgaacaaaataacggacgaacgacagctgcaagtccaacaccaatgagaattttccataaggaggctggattaataaccgacaagagaggagaaaaaaaacattgcccatgtatgatttcttgtttttatgatttttgcacgacacgcaccaacccattagatcatgaagaaaccacttctatcacatcagcatataatgggaattttgcagtcaaacaacaaagagcattgatttga

SEQ ID NO: 11068 - DNA, 252 bp, Candida albicans
  unsure (203),(223),(238),(239),(242): Identity of nucleotide sequences at the above locations are unknown.
aactctcacaaaatatcttctaaatcattcacacaccacatacccaaaagatcactcatcatattactaatacctaaacatcacacaccaaacacaacacaacacaccacttcacacattcatataccatccagcgtatccaacacacagactagaacaactccaataggatttagttttattctgctttctttctttcattnttacctttttctcattgtcntttccgagagagaannttncaagcgaaat

SEQ ID NO: 11069 - DNA, 279 bp, Candida albicans
tgtaacttatttcttggttttgtcactcttttcctcttacaatcgttctgttatagtacaattcctgaagggagcggaaataaaatagacatttatgcacaagggggaaaagaaacagtcaccaaagggcaaaacacacaacaacaacaacgacaatcaggtcaaacccacaagcggaagaaaaagaagaggaaaaaaaaaaactataaaactctcacaaaatatcttctaaatcattcacacaccacatacccaaaagatcactcatcatattactaa

SEQ ID NO: 11070 - DNA, 267 bp, Candida albicans
aatggaaaacaagaaaatagacaaagaataaaaaaaaagttgaaacgtatgaggtactcacaccagagatatacatcacaaagacttttaccacctaccctccctcgactttcaccacctgctcagagatcccccaaaaaactaaattacctgactaccaacgcttactttgactctgatcttttaaggtgtgggtttttttttttcttgacttgtttgtttgtttctcctggtttattcatttcaaaaataatagtaattaattaa

SEQ ID NO: 11071 - DNA, 183 bp, Candida albicans
ataatttattttccaaaggggaaggggttatttaacacaaatatgtccagatttggattcaattatatgaccattgtttcctcaaaaaagaaaccacaaatgttgacttatttggatgacaccagtggtggacaatcaatgatcgttgagccagatttagaccagcatgttataatcaaatga

SEQ ID NO: 11072 - DNA, 327 bp, Candida albicans
tcgcagctatcctatgttagtgtgttaatttttatttatttgtatggtgtagttttaaataatttcagatttggtatttccaaattaggcgaattaataaacaaagcaactggtcctacttgtttcaatatcgcacgcgagttcttgcaacctataccagaagcattgatcatgatcaaatgggatagctttatggaatttctcattttgatattgtcacttagaataacctgtaattgtcttatatgtgtgtgtgttatttttatgtggattagtaaatacccactttcactggtgtatcaccattttctgatttttttggtgtaa

SEQ ID NO: 11073 - DNA, 264 bp, Candida albicans
tacaccagtgaaagtgggtatttactaatccacataaaaataacacacacacatataagacaattacaggttattctaagtgacaatatcaaaatgagaaattccataaagctatcccatttgatcatgatcaatgcttctggtataggttgcaagaactcgcgtgcgatattgaaacaagtaggaccagttgctttgtttattaattcgcctaatttggaaataccaaatctgaaattatttaaaactacaccatacaaataa

SEQ ID NO: 11074 - DNA, 189 bp, Candida albicans
ccaatagaatactcggctcgaattgttcctccttgtttggcaaattcaggatatgaatgggctagagcaataaaaaccccaagaaaaatgaaaaaccattgtcctataagaaatgatatgaccttagaggtccatttgtatgctttagattctcgaaatgtttccaacgacatgctatatcatgaataa

SEQ ID NO: 11075 - DNA, 255 bp, Candida albicans
caaccacagttttatcaagacaataatccacaccaacttggaaaaagtacagacattccaacagttatatacacaaagagtcaacaaattggaacaccatatgggaaggttactaataaagaggcaacaggctttgaaagaattggaatattacaaatcaagataccaagaagaatgcacccaattaagatcattgcgactactgctccaaacgacatggggtcgagaattagagaaaaaccaactgaaatttaa

SEQ ID NO: 11076 - DNA, 195 bp, Candida albicans
aacaagcattccgagttttatacaatgttgcaacttgcaattgatcacgtaacaccaataactactacactgaatgtgctgcaatttagggtctccctaataaatttcgcactacaaatacaccccccccccctgaaaataataatttactgtacaagttttaatctaaaatcaacaattcctttagggggttga

SEQ ID NO: 11077 - DNA, 360 bp, Candida albicans
accatgaattacttgctacgttgtacttttacaattgggttattggcatatactgctttagcttcgccaggggatgacttgtatgctttccaggattgtctatatcaatgtgaacaaataacctgtaacaataacccttaccatatcattcaacaggaattttatactgaattgagcaataaccccgattatgagttcagatactataatccacattggcaatttgacccaatgccattaccactacacctcagattacttgggtggaactgtgaactgaattgtgattatcaatgtcaaagaattattactggtgaaagaattaaaaatcatgaagaaatttatcaattaccatggtaa

SEQ ID NO: 11078 - DNA, 279 bp, Candida albicans
ttgattgatattttcttgacaaacacacacaaagaaaaatttttttttttcttgtttcttatttctttctattccttgttgtgtgatattccaaatttattcaagaatcgaccaaacaaacaacttgactcattagtctacgtgctagtggggatagtaatcctctgcctctggaggaaagaattcaaagtgatttcaggtgatgaagagcccaatacgaggggaccagaggccttacaaagactacagttagatattcttgaggacgaagaaatataa

SEQ ID NO: 11079 - DNA, 441 bp, Candida albicans
gaacttgttaaattaaatattattaataaactagagttgtttgttgtacaatcaccacatcgaaacgaaaggtcatacaacgttgaattgaattatcaaaacaaaaccggccaatgctcttgtgaaatgtctacaattaaagaatgcagctgtatcgataccttggctgtatattgttatataaatatctacaaaaatttctatctggaaaaaatcagaggtaccccccaaaacgccatacctctttgtcttagaatagaaatgttcccgttggttggccaaaaaataggtacatatgctgcagaagaattgttggaagaactcgacgaagaaggaaaattggaaacaagtgtttctgagataatgaatcaactagctgcatcaaatgaaccacttgagggatgtcttccaattagtccccttttaagtctggctatgtag

SEQ ID NO: 11080 - DNA, 240 bp, Candida albicans
ccctttccttttaacagaaaggaactgtcggtaaaggatagtttgatcttaattgtcattgctttctggaagattgttataattctgcaaaatgttattacaagaatcatctccgttggtatacccacgaaaaatggaggtcaccagagaatgagaattactactaacagattactgtctttggctactgagttattttacaccaagaggtccaaagtatcccgtatggaagtcacatag

SEQ ID NO: 11081 - DNA, 825 bp, Candida albicans
ctatctattcaaacaaagttaaagcttactaaggaaactcaggaaattgcaatgttagtcagacgcgtgattgtaaaacacacaattaaacccaaatgccacaatttggtccctgcttttcatgttgcttctggtgtaatctcttatggtaattgccatggtcctcccaaactatttcaaagattggattcccaattatacattagaaccttgtctacatcaagtaatgacaattttgaaattgattttgtaacaatgaagaagaagcctaaaaaactttctgagtctgataagcaacaatatgtgtcaattcataaactggaactaccaaaagttgatttcgataacatacatttcaaacatagtgctcttgatgagtggttatttcaattgtttaaagagaatcaattttctgcttccgaagacagtttatccaataatagattgaaagaaaatcttggtatcattcacgaaatctattccgagttgagagaatttgagatatttgttcaatttaaacgtaacaagaagcatttcaagttttctgaattgagtacctccgatattttaaagtatttagaggagtttaaagaagttcacaatggcagttcccaatcttaccacaaaatgtatgatgaattatctagattattgaaatctgactcagaattctctcaaactttatcctatgagttgattcttgctattcaattattggaaaattattcacttattattacagtggattatttgtgtttgaacaggagttacggaccttggacaaacaatatgatttcaaaaaatttagatccaccaaggatttaa

SEQ ID NO: 11082 - DNA, 201 bp, Candida albicans
ttaatcctgatcaaagaaggtatgagcagggttctttttgtttttgttttatatcattcggctaagtttgatcttaacccattgtttctttctttgagagctcatatggttacaatagagaaggatcgatatatcaattactatcattacaattgtttgatcaaagttcctcaagtcggcttactattttttagttattag

SEQ ID NO: 11083 - DNA, 1227 bp, Candida albicans
  unsure (1199): Identity of nucleotide sequences at the above locations are unknown.
aagattacaatcaaaatcaaaacaaaacagacaactctgcaaaacatcaataagagaacaatccaccctttattcagttactttattattattatgaatggactggtggatctaaataacaagagtttatcacaaccggcaactccgccgagatcttctccaaacactactattgatcattcacaatcacttccaaattctattcttcgaggaagtagaagaacatcaatatataacatcccattaccaccacatggattatctgaagctactacatttttatcacaacaactacaacatcaattaagtgaaagagggagaagtagatcgagacatagtacacacaatactacttcaaatcatggttctgtgacccctaagctgcgtcgatcagtaactccaaatagtcgaatgtctttgacaccaatacgatccagacgtaacagtagaagaaggtcctccataattataacaaagacaggagaaaaattgtatgaaccaaactatcaaggtcccattactatagattatttgaagtttttctgtaaaacactgatccaaaatcaagacaaaataaatcagcaacagcaacaacagcgacagcaacagttgggggaaccatttgttgatactcgtgatttggttacatctgaagaaagaaacgatagtaggatttcagaaacaagtaaacacgttactcaagaaagcacaaatgtcgtatcaccgttcgagaagaatgaatcaaactcaccactacagatacaagaagagtttagtcaatctctaataattccatctaataatgacaatattttggaatctttggatgaaacaaaacaagatgtaaatgatgttgtattgcaagaacagcactcacacattgatgaaatgccgcaacatgataaagattcccctgagaaacgtaaaccattgtcatatttacaaaagattttgttagcaaaaagcaaaaagagttccttgattagtaggaaaacatctgacgaaaccccaaccaaagaagttgtacccaagttggatgatcttaaacaatctgaggagaatgatgcgctgactgttgatactggaaagcaagatagccagtttgaacaggataatggtgaaattattgataagatagatcattttgctattcaggataattccaagatttcaaactcgatactcccagattggagganttgcaacacgccgctggaagatgcggag

SEQ ID NO: 11084 - DNA, 216 bp, Candida albicans
aacacgttgaaagacctcccaaatggagatcgaaaccttgtgcaaactggacaaagtacggcagttgtcgttatggtaatagatgctgtttcaaacacggcgattaaatacagttctgggttatggtatgtttatgattttttaggtatttatttattttgctacaagaaaatagtctttgtatacttctttaatatatttatttattcgatataa

SEQ ID NO: 11085 - DNA, 615 bp, Candida albicans
ttggtggagttaactgagttttcgaaatcaagagaacatttgaacttttctaaaattatgcttccagaaccatcaaagacagaagtatcaaatgaatccaattctagccaagtagccaaggcaaaagttgaaaaaccaaacccaaaaaatattctttcagttgaattaacctcacacttgggtgaagatatttcgcaatctaaattcaaatttgcttttgaaaaatccatttctgcagctatcagacaaacatatgcttccaaattcccacaatttgctcaatcccctactgcatcctcaatttacgacaaatatgacgtgtttgatgaaatactttctgcaccagttacaaagaatagatttgaagtttttgatatcaagtacaagttttacggtgaagaatcttctaaaaacaaggtttcagcagatagttttgatgaacttttgggtttgctgactcctgtccagtatttggaaactgggtcttctaatgtcaatgttctgttcaaaatcaaatttgacgataaattgcaagattccaaattgttcgttgaaaattttgaaaactctttactttcacaaattccagccaacaagttaaagatcacaaactaa

SEQ ID NO: 11086 - DNA, 1038 bp, Candida albicans
gtatacaaaagcagaatgcatccgtatcaagcttctggtggtaacaataatctttcaagtggaaatgcatccacaaacatacctcaagtcacatccccaacccaatcaaatttgagacaaggctacctgcaacaagtgccaacacaaaacatcactaacaattcttattatccaagaaacacatcgagcaacgtagctccaaatctacttcctcatttatcctacaatggcatacttcccccacgtacatttattggcacatcacctttgaatggaattccacctcctgcgtatggaagtcaaccaaaacaatatcaacaagcgcagccatcaaatcagcgtcttagtttccgtaatgatcaaccccaacaattagatccaaagcaacttcaaaaaataacatcgccataccagcaaacttcgcaacaatctttatcaccaccacctccacagcagcaacaacaacaacaaagttattaccaacagtcactgcagaattattcccgggaatcctcacagcatcctcaaggacagcagacgcgtgggttattatcatcaggaaatagcagtaaccaaataaatctctcggcttcgattcagcaagatgaccatagacaacataaatctaacaaccacaaaaagacaaatgaatcaaatgtggttgcaaaacctattgatcaaatagatccttctactggaaagaaaaaaaggggtcgccccaaaaaattcatacttgatccttcaacaaacactatgattgattcaacgcatcccaattttaaacagttgaataaagcgttgaaagatggaaatattgaccaagatgtgaggtctaatggaaacaacgtcactaatgatatgagtgtattactcaattcttcagggacagtagacggatttaatgactcggagttgaaagaattactaaagaagaaagacagaagaggtcgaccaagaaaattccctgttgaagaaactggggtaactattaaaggggttagaattaatggaagcggtatttccaaaaccaaaaattag

SEQ ID NO: 11087 - DNA, 531 bp, Candida albicans
acgcatagcgttggaccttcggcccgcgctggtgaagaaaaatcggttattaaagtaatagaagagaatggtgaccctaaagagtttattattgaatgcagtgatagtgaagctgaatcccagttaacccaagaaatgtattacaatcctgtgaccaagcaattggaaacaagtcctccaacttcatcgtcatcaatgataactggagacgaagaaagtattgtaaccaacaaacctgaggtgattactactcgaggtttgcaatttgatccaaatgcacctgttgtggtaatatcaacttggatggacttgattaaacgggtgcaaattatgaaaatgctttttgcccccattgacattattggagaattcatacctggtctacaaggtttagttgtgattattgaattgcttttattcatttggatattgtacgagatgagtagattagtgaatgcgatatgtatgatgattacggctgtatgtgcaccaatgatagcagttggtaagtttatgaatagaattgtttga

SEQ ID NO: 11088 - DNA, 186 bp, Candida albicans
aagagaggcggccagaaagacatagaagggagagagattagggtttattcgtttgaggaacccaaagagttaagttccgtttgttccaaattagagcacccaattttaatgagaccaatgggtgaaatttccattaaattcccccccccccagagaacattagttattcgttataaccaattatag

SEQ ID NO: 11089 - DNA, 183 bp, Candida albicans
cggggatttcctttaaattggtggttgttcatggaagggtctccaggcaataaatattattctttagcggcaaaaccaaaaagtaacaacaacattaacaacaatgcaattaacaataccagttatcaactaaaatacgagaaaggaaacaggatattaaagtttattatcatgtttagctaa

SEQ ID NO: 11090 - DNA, 189 bp, Candida albicans
ttaaaagcactcagttttgatcttgttttaatgaaccacctcaaacatccaaaacataatcagttaacccactttaatcatttaataaaaattgaattgactattttgttttgggattttgcaaccatacccggttttaataataattggttaatggcttgggttactataattggttataacgaataa

SEQ ID NO: 11091 - DNA, 186 bp, Candida albicans
gccaaatcagcagtataccacatgactttcttagggacacatccaacattaacacaagtcccaccaaactttttgaaattcgattcaattaataatactttggcaccatatttggcagttgtttttgcagaggcaacaccaccagatccgtattcagccacgagggctggcagatccgcgtcgtac

SEQ ID NO: 11092 - DNA, 249 bp, Candida albicans
gttgagataatccgcaaatctgctaaaaggtacatgtcatcgagcaaacgaatgccaaacctttatattacttcaatttctaaggatgctatttatatggtagtgcgatcagaatcaattttattatgggctgaacaatcaacaaaaaaaaaaatacacactcaagaaactactcatctagaaaaaaacagctttcaacagcaaccattagaccaaattaatcacagatgtcagcaggtattccagtaa

SEQ ID NO: 11093 - DNA, 213 bp, Candida albicans
attgtatgtatatatttgtattataggttttatacggttgtgtggaacaacgtactttttacaccattaaatacaattgtgtttattatactcacaggcagtactctaccaccacactatttaaaagcggcacgctatttcaccaagacaaaaaaaaatagaggacaagcaaaaaaaaaaaccgtatcaagtctaatttttaactcgttttag

SEQ ID NO: 11094 - DNA, 336 bp, Candida albicans
tcgagatttcttttgaattcattctacaaatcaaaagagagaaagacattggctaattggttctctttaacattccattaccatagttttcagttatatacactaccccttgtattcaatcatctatttatcttggtttcccaacaatatagtttaatatcgtgtattcacatccccaagagcaaacattctttttttttaatttgcataccaatagttcttgttgttatttcggttaaaattattgaaattaatctagaatcatcaaattctaacaacaactacataataccagaagaaaaacgtcaaagagaatttatagttgtatcaatttag

SEQ ID NO: 11095 - DNA, 210 bp, Candida albicans
tcaatgttatgtcaaaaatcaaatcaaaatcaaaccgcaaaagaattgtgctgtttattcattttttttgattacgagtacactaaaaagtttaaattggaattggaattggttctagtctcacttttggttctaattagactttactgtaaagtgtatgtgcgtgtatggatgttattaaaaagaaaaaaacaaatgtttcaggtttga

SEQ ID NO: 11096 - DNA, 183 bp, Candida albicans
aatgaagataatgtaaagcaagaatgtttagttggttctaggaaatttttctctttttttatggaaaactttttcgtgtcaatggggaaacaaaaacaaaaacaaaaacatctaaaacaaaaaacttcacgaggaaatcgagaattgaagaataataaaattgtaattccaaatctaaattga

SEQ ID NO: 11097 - DNA, 252 bp, Candida albicans
gcagggaaaaattcttctccaccattagcactctgtagtgaaaagaatttagcagctgattttggttgtaataatccggatattgttgatgatgatattgggggtagtggagttcttattggttgggcttgttcaatcaagtattcgtcgttgaaggcaacttggtttgatgttgttgcagtcgcagctgtacctgtaggtacgccaagacttggaggtataaatagtgttgcatccaaaaatgaatcgtaa

SEQ ID NO: 11098 - DNA, 231 bp, Candida albicans
  unsure (139),(153): Identity of nucleotide sequences at the above locations are unknown.
gttctgtatcatttaagtactaagtgcactatcccactctctgccattcattttcaaaattcattcttccccagaacttctaatccacatcaactccaccccctgaagtcatcgggtactcctaactcgtcaaaatgcncctgtagttcattngattatcatccaattcccctttctcttgaagaatctcccttcaccaatttaattttccctaagtggtttccacgttta

SEQ ID NO: 11099 - DNA, 237 bp, Candida albicans
gccttttgtggcgtaccgagtattaatgaatgttgctatcaaatttctggtacaacgccagaagcaaaatcaattcattgggtatgtgatcagtccagagacacgaagtcagctggaaaagttaaagaggaaccatatgctccaactatcttgggtaatgttgtatactgtgtagatttttcttttcgtctacaggaaatttgtcaatatatttatacttttggttttgcttattga

SEQ ID NO: 11100 - DNA, 225 bp, Candida albicans
cgcccagagaaatgtgtgtatatttctagaaagttcctcgataatgccaacaaaaaacatttgcccctaaatttaccaccccctaaaaataatagagtacaattgagttcccaacaatttgtcttttactgtttcaataagcaaaaccaaaagtataaatatattgacaaatttcctgtagacgaaaagaaaaatctacacagtatacaacattacccaagatag

SEQ ID NO: 11101 - DNA, 204 bp, Candida albicans
ccaaaaatgatttttctagagagtgttggtgcattccatatgaataagattttaagtgatcatatctttaaaccagaagattgggaaacaagtttttcttccactggaattggaagtagtatgactgaagaagatcctgatcccgatactacacaagactttgcaaataatgtcaaagaggaaagtgtttcagaagaagagtaa

SEQ ID NO: 11102 - DNA, 195 bp, Candida albicans
atagcccaaccccttcaaaaggggaaaaagaatgttaatattggtactcttaaagttaaaaggaaaattcatatcaaacataccttatttggggttagatccacttcaaataattcttgtaatgcatttcttattcttttcacagttatttcttccaaattggcaacacttaaaatggcctatttcaatggttag

SEQ ID NO: 11103 - DNA, 219 bp, Candida albicans
tacccgtttcttaggaaagttgacgcagcagcacaattttacatagaccaacaaaaacctacctgcactagatgtacacagatttatgagttcttgaaaatggtgataatttcagtgttgtctatattgcgatgtgttttacacggctatattaacaaagaatatagacaagctgttgttaaaatgttccacgttactttgtatgatttcgggttttga

SEQ ID NO: 11104 - DNA, 192 bp, Candida albicans
atgatagtactgaaggtggtaacaacaatcatagtagcagtagtagtaatgatactttacttggagaatctcacaataaaaacaattatggctcttataatgatgtatagaaaatacatatatacatatataaatatattattagaaacaaatataaataaattttatatcactctatgtacaagaatttaa

SEQ ID NO: 11105 - DNA, 195 bp, Candida albicans
ataggacaatccgtaacaatcagaaatggagaccagagattagtttacgaggggggttatcttaacactatagattatctatccgaaagcaaccagcaatcagtctatccaccactactattacaccagggaaatgaaaaaatttacagttcggataacggaattaaggtattattactaatagtagttatctag

SEQ ID NO: 11106 - DNA, 273 bp, Candida albicans
tgtaatgaagtttggtataataataaacaacaaactccggggccacgagttgtgtccaacgaggaacaaaaatggtacgagcaaaatctaagcgaggcaaatcgagggaagcttttttcttcttttatttggcccaacaaagtaaagaaagagagagatcataattgcgttaagagtacaacaataacaacaacaacaagctcaactcaactcaacaatcttttctcaacacttggacacaattcacacaacccacacagttttaaattttga

SEQ ID NO: 11107 - DNA, 192 bp, Candida albicans
caaataaaacatagaaaacaggtttaccatttaattatgcaattgaacaattccagattgatttattttgatgaaataattgctgttgttacacttccttcaaaagtgtcgagtagttgcacccaaaccaactataaattaaacccaatcttccccctaaattcatatctttatttcttttgttcttactaa

SEQ ID NO: 11108 - DNA, 522 bp, Candida albicans
attacaatgcaattctcaacccttgtttcattagctgctgttattgtttcaaccaacgctgctgctcttcttactcaaacagttgaatcttcaaccgttgttaccattacttcatgtggtccagaacacacaaactgtccagcttcttctccagctacaccagctccagctccttctgcttctgctccagctccaccagccccagagcaaccagaaccatctgctccagcaccagctccatccgctccagctcctgaacaaccagaacagccagctaccccagccaccccagctgctccagctaccccagccactccagctgctccagaaccatctgctccagctccagaacaaccagcttctccagctactccagagcaaccagctgctccagctaccccagccactccagctgctccagaaccatctgctccagctccagaacaaccagcttctccagctgctccagctccagcaccatctgctccatcttcttacaggcgggaagtgaactatcctggt

SEQ ID NO: 11109 - DNA, 231 bp, Candida albicans
acgtttctctcacgcacagtggaagaaaaaaaaattaaagggggaggatgggtggggggaccagctgcagccctagttaaaatcattttaagtggcgacgcgttaaaattagcaaatgaactagaactgaaacattttaccgtcaataagacaagagagtgtttaccaatatatacatttgaaggaaaaagaaaggcgtacattcccgcccctattgaatacagagaatga

SEQ ID NO: 11110 - DNA, 186 bp, Candida albicans
ttttctattgttatttcatttcatatgcaaaaggtttatttctacaaacttttctattggcatattgctaatgatcatggtgacagtggtggtgatgataatggttgtagacgtttctctcacgcacagtggaagaaaaaaaaattaaagggggaggatgggtggggggaccagctgcagccctag

SEQ ID NO: 11111 - DNA, 222 bp, Candida albicans
ttgacaaatctcttttttattttttggttgacgtggatcttttttttttttttatttttcaaccatttggtgaaatatcatctacctacttacttacctttcaaacgggccccacctaaaataacacctccttcaagtaagaaaaacgaatcattaagacatgaaagcatcatttataataggtatactatttttttatttaacatcattttctatagctaa

SEQ ID NO: 11112 - DNA, 1686 bp, Candida albicans
gagggttttatcaacgacctaaatttcaccctaaacccctccccccccccccgcataatgagatttgaatacaaccctgttattatacgatatcaaaataagactgaaacttttgctagttcaggtatccatttagttattaaacctgaaaaatcatcaaaaaatgccaacgatcttaattcaattattgatgaattcttcttaacaataaatcatcttcccgatttatcaaaatttcaaatactcatcagtgaaaattatatcctgggaactgatcaaatacctgatcaagtgatatggcatagaggtaaattggataaagtatataatttaccatttgataaaatttctggattcaatgttttcccatttgattcatttaaccatacatcatcatcatcatcatcacagcaacaaaaagtgagtttaataaaaatacgatgcattaatattgatatttcaaatatcaccacaatgagccaatttgatattgatgaaggtacaaatgttggtgatgaaatcaatattatatgtcagccatttattcttactaattcgtttttgtttaaaaaattcaaatgtcaaagtaatattattgggaaattatttacaaaggataccactatagttaaaaatttccattattattggctaagcgatttgaaatatttagatgatattcatggaggaattgtaatgacaaagcctaacgagaaaataattggattagtgtttggtaatctaagaaaactcaatggtgatggagatctcactattattgtccctattgaaaaagttgtcgaattaatagggttgccaattcccacgaattctcataaaccatcgctttctacttccctagcgtattcatcagtgactccgccaacaactatcagttcaagcttggaaagtagtggagactatgtgatcccattattgataacagactctagaggtaataatacatggggatcctcagttttgtttcaaaataatgtcctaataacaaaccaacatgtcattcaaccatatatggatgatatcaataatggacaatgtgttgtgaaaccacaaacaacttctttattcacacttggtaaaaaagataaaataattatccccatatcagggattgatctagcatttatattccttgataaaccgatcaccagtaaatcaagactagtgaaaatttgtcatcaatataatcaaggtgatgcagtatattcttcaagttatggattaatttatactggaacatcagacaatattcaagaagaaccaatcaaatcaaatgggataatcaatcaaataataaaactatcgattcaacaaaatttgaaacaagttatgaattgtatgttgattagttcaagtaattgttggaatggcagtagtgggggtggattattcaaacaacaaactaatgaattcattggtttgatttgttctaatgccaatgttaaactaccattaccattcaacaataatggtaagggtaaagttgatagatttgaaaaagttccatcattttcatttattttaccaatacaaatcattgaatattgttattatatgatattgtgtaatcaagatacaacccaaataaatcttgaagggttaattaatctttggaatttaaaatcactgcatcaagatatacttttagaatcatcaaaattgtaa

SEQ ID NO: 11113 - DNA, 825 bp, Candida albicans
catctttttcatgggagtttcacttttcattatcgaactagcactctcaacgagattgatataagcatggatccacctagatataatcaggtattagattttattgctattcttgagcaatctgatcccgctgcttttcaaagttataattattctactcaaaaggaatacccttcaattcaacgagacaaaatcactgacatcaactccaaaggtttaccaacaattgctgatgttgtagcccatttgaaattattgaaagcttttggtgcattgaaggcaaaagttcttggtacttccaaagtaatcaaagaccttgaaccggctcaacacaaatactggcaagtgtttcttaccaatgcagttagacgatttattatatttgtttcggcattgaggaagtattcttgtgatacagtgtcgactgttgtcagagaagatactttttttaaggtcataaagaataaaaagttcgaaagtatgatgagtcagatcatgcctcctttggatgtgattatggtatggcacgcatttttattgaatccaaaaaccttttacgattcatttaccagaactgattttattgtgtttgccaagtatccattaccgttggatagaatccatggctgtattgacaatactacttttgaatttaatgtaccagagatttatcgagaaaactattcaagtttgttgcaatctttcaccaatgatcctaatgatttgatttttgatcccattgacgacttactggctgttaggattactgataagcaagtcaacatttatttccttcacctcgggtatggacgggccgcgctatat

SEQ ID NO: 11114 - DNA, 183 bp, Candida albicans
taccaattgggtaagtcatcactcaaaattttttttccagaaatccgacctttaaatacaaacaatggtggtaatatcaaaggtacccatgaaaaatttgcgacttcaatcactgtacattgtatctctaaccttctggaaaacttgaacataccctctaaagttctgccttatgcttggggt

SEQ ID NO: 11115 - DNA, 585 bp, Candida albicans
aatcaaaattggggggatcaacaaccctttgggttcgtgccgacacctccgcaacaacaaccttatggctcagtaccaccgccaccaccacaatcttcatcatcacgaccaccacaatcttatggtcaaccgtattacgggaatcaacaacctacttatggttcacctgtgcaacaaccagctatgaatcaatggaattctcctcctcaacctccacaaaatccagctgccaatttattacaagggcttaacccagcacaaattcaaagcatgattcaattacttcaatctcagcaacaaggagggcacccaccacaagggaattacggacaacctcaaagacctgccccaaatagctatggaggtatgggttataataataataataattacggatcaaatgccccatcaatggctccgcaacctcagggaacgaatgacaatagtgctaatcaagttcaagcattacttgctcaattgcaatccaatcaacaaggcaattcttatggacagccttcttcccaaaatcaacagggccaaggtagttctttctatgacaccttgtctaggttagccaaacaatag

SEQ ID NO: 11116 - DNA, 330 bp, Candida albicans
  unsure (89),(97),(197): Identity of nucleotide sequences at the above locations are unknown.
atcatacacatatacatatatataataactaaccatagaaatattatgactgctgctgatactcattctatcattagtgctgatgttcnagaacatnatagacacattattcgtccaccaaaattcacttggcccgctattcgaaaatatgccattacaagagttacttcattatgggttggatgggatgaattganacaatattcctggcacgaagttcttaatccgtttgaaccattagtggaaatgaatttacatcaatggaattttttctttttgggatttgggcatggacttgggatgctttggatttttttgttacttcattaa

SEQ ID NO: 11117 - DNA, 456 bp, Candida albicans
atacctctatatatattagattttttgttttatattaaacatatttttttgaaaaccacctcaataaaaacaaatcacaacttcaataaaataagttcaattttcattttgcttaatcttgatatcccttggcttaacaacattatgattatcgtattgacgatggagtttttggtattggcgataataggtgcaacgtatgcctcggttctttttgagccactggcacaatcggttagaaatatgagacgggtcaactatagatcaacttataccaatgtcaatagctttaagcgtaagattaaaaggagttcaaaaattaaattagcaagacctaaagtcaaaaatagaaagaatcgtatgcaatggcaacctgaacagaccataagttaccccggactagctttcaatattgacccccgaaacaaatacctgctgggtgtccttccgcactaa

SEQ ID NO: 11118 - DNA, 186 bp, Candida albicans
gcgccttcaatggtccttcgaccggcgtgtggaagatttaatagtaagggattaggtgatattgatattgataatttattaactaatagacataaaaatggttatgatgttaataaacttcatcaattacgatttttaagagataaaaagactcgattacaatactcattaaatcggttgaattga

SEQ ID NO: 11119 - DNA, 351 bp, Candida albicans
tcaacccaaagatgtatattaaagacagagggggaaaggacagaaagaaatatacaattgatttttaatgtttttattctttatgaaatgtatatgttattattattattatcattatataattgtgaatcgaaatcgaaatcgaaattgaaattgaaatcgaaatgttgtaaaaattatattgttcctctaactaaatatattgtatcaccagttttaaaaacagttgattttaaagatgttgatattaattttggttctccatcaacaccactactaccattattatcttccaatttaaaaatatttaatttctccagtgattcattagtaacattatttttattttga

SEQ ID NO: 11120 - DNA, 186 bp, Candida albicans
actttttgttttatacttactatcactaaaatgaaagatggttctaatatgatgataattactcaaatgggaatacaacctaataatacgatgggtttgttaatcatctatataatttacacctctctatctaactctaatctgatacagaactttcttctacatttccctattcagaatttctga

SEQ ID NO: 11121 - DNA, 276 bp, Candida albicans
aatattaaaccattacaatctaacatggctaaatattatcaatgtagattagtattaggttcagattattcagcaagagtatttcttgcattattagttgaatgtaaggtatctaattttgacatacaagtcctatcaagctttactttacagacaactataaaaactatccatgggtctttgattagtcttcaaagggggtatttatataaattttctaaccattctctttccaccacatgttcagttttatccctaaaaggggaaacattataa

SEQ ID NO: 11122 - DNA, 204 bp, Candida albicans
aagtatcattttacgcacaacaagaatatctctcagtgcaaggaaaaaaagagaatcaaaacctacacacaaaagaaattatacgcaattgctacttttgaatataactattttctttctcaatcatcatatattaacaatgttttcgggttttggttcatcaatatatgggtccggatttggatcatcaggatttccaagtaa

SEQ ID NO: 11123 - DNA, 540 bp, Candida albicans
tccagctgtcactgttcaatttattttgtcgaaaggattttggtggacttttacaagttgtggattaagtacagctccgactttcaaagtgtgtacggttgcaaattgcaagttttagcaagtatgtctatcttgaacaatgacaatgctgttaatttaataccagaggatttgatcggagaaactgtcgatttattattgtcaaacattgctactttaccgagtgccatcaaagccaagaatgccatcttatccagcgaatccagtcaaaagacacagcaaaaggtcatggaggacaatggtgaggacgaaggtgaagagttcgctgattttgaagatgactttgaagttgatgaagctgaattggaagcaatgaaggaaactccaattgaccagctcaatgcatttgaatactttgcacaaaatcttttatcacttcaacagcaacaaaacaagtacgacgtgttatttggaggaattgattcgaataagaaagagatgatccaagagttaattaagattactcaacaaacaagataa

SEQ ID NO: 11124 - DNA, 246 bp, Candida albicans
cttgacataatttcaaggaaacccatatccttatttgttatctttatctcagaagttatcattattaggttgaaaaaaaatatggatcgtcttaatttgatatttcctagacccgaaatattgtcagtcagaataagctctccaactggcattacgaaaggagactggaaattggcatttacgttttcatctctatacacatttattctcattttcatgatcctgttaatgggtctttttgtttga

SEQ ID NO: 11125 - DNA, 267 bp, Candida albicans
gtttgggtagtagtgctcggtggtagtaattatttcgggagggaggaattgctagtttatctggggggagggcagaggaagactgataacacattgaacagagagaggaaagaagaaaagaaaatccaaatgggagaagaagaaaaagaagaggagggaggaggagagagagaagagaatgaaagaaagaaaagtataaaagtaaaagagcaaaatggagaacgcgagaaatttaatcaaacaaacaaaacaaacaaacaagaataa

SEQ ID NO: 11126 - DNA, 201 bp, Candida albicans
  unsure (140),(142): Identity of nucleotide sequences at the above locations are unknown.
agctataatcaatctgttaatgatgataatatctcatatatatatatatatatatcaatggggaggttgtattgtcttgaagtaatgtattatgaatggaaggggaggggaggggaggagggggaatggtgtgtcgcctncnacgatggaagacctacatttttgcaaccatcaccatacaaatcaaaacaaactggctag

SEQ ID NO: 11127 - DNA, 225 bp, Candida albicans
ttggcaattaatcaattaatccaattaataccgtatcagttgataattaggttgggaagcaaagaaaagaaaggaaaagcaaaagaattagattgtgtattattaaagagagattattttgatttggtagatattacacacgacttatgtactgtactgaagataaaatttcatctcaataaagaaaagaaaaaaagtatcacaaaaaccaaaaagagatggtga

SEQ ID NO: 11128 - DNA, 240 bp, Candida albicans
tctgatctggttacatttggtctatttagatataacggcgtcattggaggttcttcaagtggtgtttgtactggtcgtataacaggctcgtcgcctattcgattcatggatttaggtggtgacgacaaccaaaaccgtgatggagagcttccaagtgatataggagctagattcggagagtccggagttggttgttgctgtattggaatgaatctggatgttgaaaacgaatgtgtataa

SEQ ID NO: 11129 - DNA, 585 bp, Candida albicans
gtaatgtcaagttcacctaaagatatactacctttaacgcataggcccttcggagatgagaatcaacattacgtggaccatccagaacccgagcttttagctacttctgtcgggaaagaggttgacggtagattaataccttctagttcaactatatcgctactttctttgaaccagtcaccttcactaagaaactcaacaacaacttcttacacaaatctacaacatctacagagaatgcaaccttaccataaccagaaagtaacgacttcaccagcagattatacacattcgttttcaacatccagattcattccaatacagcaacaaccaactccggactctccgaatctagctcctatatcacttggaagctctccatcacggttttggttgtcgtcaccacctaaatccatgaatcgaataggcgacgagcctgttatacgaccagtacaaacaccacttgaagaacctccaatgacgccgttatatctaaatagaccaaatgtaaccagatcagattatttttcaagagttagcactgtgagtgaagaagaggagagacgtagtatgggccacaaataa

SEQ ID NO: 11130 - DNA, 240 bp, Candida albicans
atgcgattgaggagaaatataaatattgaaaatgcacatgatgtggatctcgagacatctatatcttatagtcttgttattgctatcttttcatcattgaggatcccttcaaaattgtatactagtacgtatattatagccaagtgttcccaatcttgttggctctactttaaaagtgatatgaaggagtgtaacttgcgaaaaaaaaaagtatattttgaagatcatcagtattattaa

SEQ ID NO: 11131 - DNA, 231 bp, Candida albicans
tccaacgttgatccagtgtttggttggtgctatggctttattagattttcatggcaaacggcaaaagatagtttggttaaaaacaatgccgcagaagttgtttatgaagatcaaggtaagggggtagaaaaaggctatcaagatgtgtttgctatgatagataaaaagaaagataatagtaagcttaaaaggaactacttttgtagtagtagtaatgtaaacttattatag

SEQ ID NO: 11132 - DNA, 525 bp, Candida albicans
ttaatagtttctgattgtttggctaacaatgattcagaatgggataattccatagtagatgataattctatttccagagcactgacagttgatgaaattaaagattcagcaatcacagatgacatatcaggttgtggttcagtagatggttggacagaatcagtgctaactgctggttcagaaatgttgataattattgattcacttggggtaacaaatgttggttcagcagaagaagatacttttgagatatgtgtttcactagggaaatatgaattagatgatatttcagaagatgaagttgaggttgagactgcaccaacactggtagataattcagggatagatgattcattgacaattatagaatcacttggtgtgacaatcgaaaaagaagatgctttgggatcttgtgtttcactaacaaacaatgaatcagaagtgaacgagtccacaacaacggatgattcagtaacatgtgtctcaatggtagtagatgatgaggtgatagcagaagattcgtga

SEQ ID NO: 11133 - DNA, 204 bp, Candida albicans
ctgaagaaaaaagacgtcaagaagaaatggctgaaagagctcaaagtggatataccaagcgtaagttggaagaagctacaggaactgcttccgaaaagaaacaaaagcttagaggacgtagacgttgaacataaatatagccttaaagtatgtacaagtatattaatagtctatgtgcatcgtattttatctagttttttgtag

SEQ ID NO: 11134 - DNA, 249 bp, Candida albicans
tttgttgtcactttttcttttccttttctttcacatttatcaaacaacttcaaatcagtcaacccgctctatgatttctttatagcaataagtttccgtgtctggtctgctacttttccagtttatgtttccctgtcgccgttagttaaattccctcatcttaaattaatgtatttgccgctaacaatttttcccatatcaaatcaattttcccctaaaaagagtggtccacacggcctgaaatccggt

SEQ ID NO: 11135 - DNA, 204 bp, Candida albicans
tcagactccaaatacttctgcatatttatgtcatccaattcattaacatcactcatttcatcctcgttggtcttgtttgaatcctttttgcctccaattattgaaccaaaatcttctttaaatgcatcagatattcccggtagagggtttttagatagtttgtcaaaaaatgattctttgagttcttctgaatacccacgttga

SEQ ID NO: 11136 - DNA, 237 bp, Candida albicans
aatgaaaacaaaaattatacgaatactctctcattacatatcaaacaacacagtaatctaattacttataaacaattattggcttattttttacaacatgaaccatcatcaaaggctaatctagaagatttgtcgacattcaaagtacaagtatcaacacctttagcaccagctttgacttcagaggtggttctagcatatgatggtttcacatccaaaactgggttttctgtgtga

SEQ ID NO: 11137 - DNA, 267 bp, Candida albicans
tttgagtatattctagtatcacccattcggaaaaaccttcctccatatgttctattatgtacttcatctgttatatccgtgaaaagacagtatcaaaagttaattgcctggattttttttttcagatttttcttttttcaggacaaaactttcaagatgccatcaacaaaactgttacaacggaaaactaacaaaatctactatgaaatgaaaacaaaaattatacgaatactctctcattacatatcaaacaacacagtaatctaa

SEQ ID NO: 11138 - DNA, 501 bp, Candida albicans
atcaaccaactcaaaaccgcttcaatgtccacacaaacagatatattaatcacataccagctaacctcaaatagtattgaatctttaaaatcagttgatgaatcagaatattggaaacggaaactcattgaattgttattaacaagatcaatacacattttccccaatgatgaaaactcgacacaaatagtttacgatcaaatctcaaacaataggatctctatttttggacaaaaagaccaccctggtaaacgaggtatcctttctaaaagctatactatttcaggatcagtattgttaacaattaatccattggcggcttattatcatgatcgtgcaaaacaaccagaatttattgtaaaatttgaaaaagttttacaaccctacatcacaacttatacaaagacattaaatcaatatgaaaaaggattaacataccttattattagggtgtttcttgcatacttggtcttcaccacgggctggaaggtacgcgattgc

SEQ ID NO: 11139 - DNA, 189 bp, Candida albicans
attggttatggtatccctgatcctgctttgaaaaagtgggtatcgaagttgaacttggaaatgccgttgttgaaggtgtcaagtttgattgttgaaactgatgtagatgctgctgcgcctgttggtgctcgtgatccagttcttgttcctggcttcgctctcgttgttgtccctgatctgggccagtag

SEQ ID NO: 11140 - DNA, 303 bp, Candida albicans
atgaaacttcaaaaattaaacaaaaaaagaagtagtggtagcaatacgataataacaataacgataaatgataatggtaataattcgaaatcaatcaataggaatgggaaggcaagcaagaaaaataattatcattataaaatgttttatagatcaattgatgggtatcgacgggaaatagtaaaggatgaaaaaaaaaaaaagaaagggttttctttttcggtaaatcaacaaaatagtaaaagtatgtttgtatgtatacataataatactaaaaaacaaatgatgaaaattgaaaaataa

SEQ ID NO: 11141 - DNA, 600 bp, Candida albicans
attggccatatacgtagggcgcggatcctgccagcctccgtgggtgaagacataactactcctgggtcagctatctatagaaatcctgacagtgttttacaagcattggcttcattgattgatagtagaattccattgactggattagttactgatgatcaacaagtttctggttcttcatctgatagtaatccatctactaattcttatggttcaatggatatagtttccaatacaaaagttgccgataaaggaagaattgctggtataaccattggtgcagcagcaggatgtggattatacatgacattgatggtgttgttgtttagaaagtttagaaagagtaataaggcattagaattaccaattactgattctgaatccaatttgggattcagtgatgaagattcatcaatgttagaatcttcgtctggattttctgctattttttcaagaattaatcacggtggagtattgactggtgatcctaatggaggaggagacgatatgatgatgatgaataacaacaacaacaatcttagaccaaataacatttctgaacctgttcaagcatccaattcattgggttggtatcattag

SEQ ID NO: 11142 - DNA, 207 bp, Candida albicans
ctttacttcaaatattttattggtttcaatgtaacccactatagaagagaattaataattatcatttatgtgttagatccatttgaaaccgggaacgataataaaagaataatgaatatcctaataattatatatatatataacttcacacacacatatatatatcttagacatgggttttgcattgtattgagaattatattttga

SEQ ID NO: 11143 - DNA, 1392 bp, Candida albicans
  unsure (50),(86),(92),(254): Identity of nucleotide sequences at the above locations are unknown.
gagacatttaattggtaccatttcatattcagatacgacacattacatcntaaaatgagttcccggaatggattcttgctgtcacnatggantagattaattgtactgaatagaggcatttcccatcattatacatgtattcgttggaatcacctgagttcagattctcagcaaacgagacaacaagtacccatatcacctgagatatctggagagatagatgctatcggtaaaaaatcaacagaaaaatcatntgaaggactttcttatgatcttagtcaactccttgatgaagatactttagtggggaagcaaaaagatcaaaatcaaagttcggaacaacttccaattggaagtatgatggagtcatcgagtgattctgaaccaatggattttcaacaattaagcaactttatcaaagaagcttacgaaaagaatccaaactacaaagaaatggaaaggagccccagtgctaaaagaagacaagtggattattttgaggctttattttctaaatatggtggtacactggatcgtggcaagaaaacgaaaacaaagtcatctgtttctgattctgaactggatagaatttcatcgctaaaggaaaagcttagaggcgaactaacctcgagatgtactgtggcattagagccaacattaacccatttcaggacatacaagacatcacatgaattatttcaaactgctcaaacaatcctaaacaattttgcaaaaaagttgcaaaatgtgggtaagaaaaccagaaaaacaaacacaagcgaaacagattcagtgaaactaacacaaataagagaagaaatatttgtccagcatttgtttcggccaatagacaaaaacagttggttggatgtacatgaagaatacgttaataatgtcgaaacacaatcaagattatcacctgaaaatcctatttgtgatgtaataaccttacctattattttcaacgagataatagattgcttggcttttaaattcaatcagggacagttggcgatgtcattatttgatttgatcgagaaggatttcagttttcatacaattgccgtcaaccaagatacctataatttgatattacgtcttgtttgggtatattatggaaacaccaacttggaccaattttacagaagatatcacagaatgacttcattaggattcactggcgatgtgaaaaccctaaatattttaaaaactgtctacaatgagtatgacagattgaagaacgggaaactgatttttaataacagtaatagtccaatttatactccagaggacaatataagaatggagtattttgaaaaggaatacaacaaattaaaacgcagacttgaacacggggtacaacacaaggattttatgttaaataattactaa

SEQ ID NO: 11144 - DNA, 201 bp, Candida albicans
ttgtacaattggtgtatttgtagaattattcaagtcggtatcatattgttggttattctcaaccagatatgtatcataaaactctccgaattgagacattttaaatatgactacaagtgtgtgtttgagttatctaattgtgtaaaaaataagtgtcacagtcaatggtatctattgttttctaaggcttccagcggttag

SEQ ID NO: 11145 - DNA, 372 bp, Candida albicans
aggaaaaaaaaaacactttgtccccacacgttttcccaacgtttaaattcaacatcaggcatgacaaaccagcatttaagagatagccagatgggatttttacaacgatgttctgagttttttctgattgtgcaggactttttacatgacagagtgcgtcgtgatattgtgaatggcgttttgacatcagatactcataaaaactaccaatttgatccagagttaaagagagtctgtgaaatcaaaagttcttctcagtatggagaaactagaaagctgtatagacttacatgggtatgtattcgttgttttaaaaagaaataccacatatatggtgttaatacggtgttaatcctccaaatactaacttaa

SEQ ID NO: 11146 - DNA, 228 bp, Candida albicans
tatcggaaatcaactgctgctggtggtactggtgccttccaatgtgtgagtcgtgtaaaattgccacctgcaaaaaaaataccaaccaaaatatcagaaaggcgagattcattaaatattatttttttttctattttgttttcctttaattcttcatttaacatttatctatcggtgttggcaaattcaactttatatcattcatactcatcatgtcaaaacatatag

SEQ ID NO: 11147 - DNA, 192 bp, Candida albicans
cagaaacatactaaaactaccttacagaacaagaaaaagacatgccgaaaagaggaaatagaagaagaagatgttggcaccggtggcagtggtggtggccgaagtggaagaagtggctctagaggaagaggtggtggaagaagaactccatctggtgccaatcgtggtagaacacccactgcgaggcaataa

SEQ ID NO: 11148 - DNA, 312 bp, Candida albicans
aagaagaagatgttggcaccggtggcagtggtggtggccgaagtggaagaagtggctctagaggaagaggtggtggaagaagaactccatctggtgccaatcgtggtagaacacccactgcgaggcaataaaaacagatctcctagaacaataacacaatatggggatttaatggatgatgataatatttttattcctaaaactatgtccgaagtggcatcaaatatgggtagaaaaaaatatgggggaatgtctgaagaaatagactatactggaagtcatcaagaagattttatgccggatacaatttaa

SEQ ID NO: 11149 - DNA, 231 bp, Candida albicans
atgtcaacacaatcaataccactggtcacaccctatgattatcatgatgatgatgttgataagaaatatcgatcgaaaggtttttttgaaatgttttattcactaagaacgttgattataagtattgttattggcataataactctatttacaatttatacccaaatatctaattcaaaatcaggatatgctcctaatttatcaacatttgatacttctcaagtccaattt

SEQ ID NO: 11150 - DNA, 210 bp, Candida albicans
tacccaccaagaaacaatccaatattttatggtttttctatatatacccgacgtgcatcggattatccttttgttttcttgaatcttgtcaataaacacacgaccctcataatttggtggagggaaagattacctgctttgcactatcttagagtttgtttgtactttgtattattttccgtaattacccttctaccacttcacacttag

SEQ ID NO: 11151 - DNA, 321 bp, Candida albicans
gaagagaaaaaaaaatttgtatgtgtgtgtgtaataatatcaagagattttgatttagtggtttgtgtgccaatctacgaaattcttctctcgctcgatgaaccgatacacactacacacacaacacaacacacacataataaaatgcatacgcacatacacaataggctaaaaaaaaagaaagtaaccattatcttgtttttgtttatgaaatttctatatttaaaaactaactatggcaataaatattgctttgaacaactatctttgtacgaagcggttatgaatgtcaacttattagtgtttgtcatgaatttttag

SEQ ID NO: 11152 - DNA, 195 bp, Candida albicans
atatataataatacgtgtgtttatgtacctctatgcgtgtgcgcgcaaaattacacgaaactcttttttaaattagacgatgataaatatgtaaacaagatgtcgcgtcagtcaggcactcccagagacccgttatttattcattgtattgatcgtatacatacaaacgttaaagtatatatttacccctcctga

SEQ ID NO: 11153 - DNA, 219 bp, Candida albicans
tcctactgcacacccctttttttttttcaaattattacaccaccaccacggcttctgacttattccacagataattttttgtgtttagactttttttttagacttttttttttccaacaactaaattataataatggctctacccaactaattctcaacaatgcgctctatagaccaagaagtttgtccacaacgcgtaggtcaggtttgacttgctaa

SEQ ID NO: 11154 - DNA, 255 bp, Candida albicans
cacaaacgttattgtggttttttagttttttgttatttgttttttttttcggatggtgttgataaaaaaaagactatgatagttggcaacaaaccgttcaacaagtgtgataatagtgggttgtgtgttgagtatgtaatttcaattatctactatcttagtcggataaaaattggtttaatttatagcaactatgataataaaagtgttccgattccacccctgaagggggctcgatgtctcttttttttttag

SEQ ID NO: 11155 - DNA, 222 bp, Candida albicans
aaaaaaaaaaaaaagttgattaactaccaatcagtgagcaactcactgagaactgtaccaagtgagagggggtcaaagaacgctcttttttttttctctctcttttccagaaaatattttcttatttgttttccatcagtacatttatcagagtctagtatagtcattaagggtaatagctactcagaaactatttataaaaggaaaggatacaatgattag

SEQ ID NO: 11156 - DNA, 558 bp, Candida albicans
  unsure (2): Identity of nucleotide sequences at the above locations are unknown.
tntataggaagcttcaccatttcagttcccagttatgtgcattacaaaaatatattagtgaatctaataaacgtatggaacttcacttatgatacaccatcagcaaatgggaaaaaccagcaaatttatgattatcatcaatggaaaacacacaaaaacgatatcttaattgaaataccaaccaccttgcggcgaggactacaccaacaatcttataatttcccatttccaattttttattaccatgacgaacttactgcaattatcaatgtgttccatcggctagccttgttgtttttacacgaagggctaacaaaaagagtatcaagaaaagatagacttaaagaagacatgatgtttccactaaattttgcctatattgtctcactagaaatagttgggactctaaaaccatacgaaaatagtccatttattagttctatcgggttgtttgcactcaagtatatttggaaatacttgcaaaatgattcaaatctaacaccattattacaaaatatggtttcggatttgtctctactttctaaaatacgtacttaa

SEQ ID NO: 11157 - DNA, 228 bp, Candida albicans
agacagggattgtggaacttaatactaataagtgaaccagttgaaattgaatatgacgtattgaaattatgtccttattattttcaaagcaaaaaacgttttatcccccacagtagttatactatctctcatctaatttacttcaatctgttgaataatcttggggcaacacaatcgtttacacagtgttgcaaatggaaaaactcttcaatacaatcttctttgtag

SEQ ID NO: 11158 - DNA, 423 bp, Candida albicans
acatcaatgggaataatcccatgcgggaagaacttcagagaaagtccccaacccccggaaactgctactatcaattccgaagctgaaatgaccaataaacaagattctacttatagtaagtctatcttaccacagccacagccacaaccacagccagtgcagtcaattactaattatccacctgcaagcgcccctgttcaaccccaaccattccaacatgcacaaccacagagattgcctagtttccatcaactaccccagattgcattcaaaacgtccatgtttggtaaggacaatgagaaaagtacacttccaagtttatctaaatcgttacatccaagctctttgtcgtctcaagtccaccaccaccggaaaaccatcaagctgctgcggcagttcacctctaaaatcaatcagtcatag

SEQ ID NO: 11159 - DNA, 276 bp, Candida albicans
gggtatctgaccaagatgctgatagaccgcagtttaccattgttgataaaaaaagtggaattcaaaccatcaatatggagttttggagtggcgagagttcattattggattttgaacaatactcaattcgacagagacgaagtttgttatgggggtgaatacaagataggtcatgttaataaatacacatttattgaaatttatacactaacaacatatttctctccgttggcaccaatcttctctaaatcttttagagcattatcaatgatgtga

SEQ ID NO: 11160 - DNA, 1566 bp, Candida albicans
attacgatatggccatcggcagttgaaaactcgctttatgatcatattttagcattatcttcaacatgtacatatttccggaaaaggttagctccaatattattccaatcattgagtttagtccgaacaaatcaagttgatgccgtgttggaatctcccaaatcacaacaattgttcagcgataccaaaacaatccaacaacattttatgaaagagttgattgtgaataatattgagcaatgtgaaagagcagctacaacttggacaagttttcagacgaatacattcgatgataaaatgtttaaatctagatacggaaaatatttaatgatgacaagatttgtgaactatttggaatgtgacaattctttcttaaatggtgaaggcataagacttttttccaatctaacggctttgaaagtgttagatattggagaaggtgcggtttttatgagtaattttgaacttgccaatcttcgttacttagcaatcaatgcccaaactttaatctattctccacaattcttgagaattgttcctaaactaaatcgattggacttatttttggattatgggaatcttccgtctctagtaggtattcgaccactcattcaacaatttaggactttctcacaattaactgaattggtcctattgttaaataatccattcacaatcgcatatttggatacaataaaattattggaaactatttctaaaaatgcctcaaattttgccaaacttacaattagatatatacgaaggaacaatgaatcaactgttgatcaaagtggatgggagttgtatcagggccgtattggtggaaaattgctaaaagtattcaaaaatttaactgatttgattattgatatttctatattggatctcataaagtttgatccagaaacatattcttcaccagtattgtatactgatcatttgatggaaaaacgaatcactttagttgatgaggtagtagtgggacccaatattgactctactacccgtgaaatagccggtgttattattcgtcactgtcaattcacccatttgttttttcaatatggcgagtcaatagaggaatcacatttgcacgttttgaaactattaactgattttgtgggttggttgagcaatggtcatttggatcagagccgcaattacttgggaatacgtcagatttctttggaaaagtgctggtcaatgacagatgattcattacttcgtgacatgatcggtagttctatcaagtccaaatcagaaagtgatttgtctgctttacaaaaagtgtatccttggacaacaacgattaataattccccaagatataaagatatcgacagttacaatattaattatgtcgaggaagctggtttgtccattactgattcacgaggatattttataggggtatctgaccaagatgctgatagaccgcagtttaccattgttgataaaaaaagtggaattcaaaccatcaatatggagttttggagtggcgagagttcattattggattttgaacaatactcaattcgacagagacgaagtttgttatgggggtga

SEQ ID NO: 11161 - DNA, 453 bp, Candida albicans
aatactgaaaatgctcttgaattaattataacttatttacaaaatgttgttaacaataattcttatattgaagttgatgaaactgatgctgctattgtttgttcattacttgtaattgttttatttactaattataattggattaatgaaacttttacagaaaaagatattcctaaatatgttcaagaagaacttgaaatttttttaaatcgttatcaaaaaaattgggatgaaaattataaaaataaacaaattgaaattaaaattaaaattggtgaacaaaaagaggtggtaagtatcccaaaattggcaaatttatcattaaaacaagtacttaatcctaaaattagtgaatcttgtgaattatgggtggaaacagaatattatgatgaatggaaacaaagaattcaaatacttgttgataaattggaacaaattcaaacatcacaataa

SEQ ID NO: 11162 - DNA, 195 bp, Candida albicans
attttaaatcccccccttttttttttatatacctataacaaatttgatacaattaatatacttcattcatttttcaattcttcattcttccccttccaaaaatatcatcttaacttcttaaaaatcatttatgggtgcttggggttgctggttattttgatagtgatatgtcctgtgaatgttgggctgaattaa

SEQ ID NO: 11163 - DNA, 195 bp, Candida albicans
aaaagttcagaggggtatatcaataaggaacgaaaacaagaaagtatattatttttatataaaaaaaaaattcaagaagaaagtttaagagactcctattcaactgtagccaaatcaggactttcagactttggagatgtagattcatcgtcttctgaattgttgggatttggcttttttcaaatggcgaagtag

SEQ ID NO: 11164 - DNA, 186 bp, Candida albicans
acaatggttgagtataaaatatatagaaatgaaaatcgagatatttattacctgattaggaaaatgtcacatgaaatttttattatcttaactattgtttgttgttcgctggttttttgtgtggttaaaaaatgtggaggtgggaaaagaaaaagaaagagggagggaggggggaaatggtggtag

SEQ ID NO: 11165 - DNA, 297 bp, Candida albicans
  unsure (204),(255),(277): Identity of nucleotide sequences at the above locations are unknown.
ggggtatgtatttgcgtttacatcaatatgttttttctagaattgacgttacatctatataaccaaattgactatcacgagattatcatgcaacaattgaaaggttgcaaaataaatcagaactttatccacaaagtatatctgtttcaacgttttgataataataatactgtgtatttttcatcgttatctgaaaattacttnttttttcctaataatactaaccccccaatattaaaaaagaatggatggttnaaaaagatcccggagatccttntcccatgttgggtttgttaa

SEQ ID NO: 11166 - DNA, 198 bp, Candida albicans
atatataaatactttaggaattggaatgacaagttatatatatatataagtattgaaaatgacaacaaacaacaatcaatgaaagaaagaaaagaagatttttttgttgtttgtttgaggaaggcaaaaaaaaattgtaaagaattttccttctcattcttttgtctgtctttctcactgtctctatctctctgttag

SEQ ID NO: 11167 - DNA, 909 bp, Candida albicans
gtctctcctcttttttttatcgccaccaccaccaccaccataactgctatgacattatctatatatgatttaggagaagatattttaacatctcaaatatccaattatctatcgccagaagatattttcaaatttttcagtctttccaaaacattatattcaatctatcaaaattcatcaataatttatcaatatttatataataaaaaattcactaataatgaaaacaattatactttatcccttcaagaaaatcttaattggaaacaattattttatttacgttgtaatcgccatcaaaaagtttatacatggggacaatctctgatggggagattaggatataatttatcccaagtacctatagagaatcgatccgagaattttggatggatgatggttcatacacctactaatattaataattttaatgatcatataattgttgatattgttgctacgggtttcagttttataattcttgctaatgatggagaattattttttacagggaatgattggaaacaaagtcataatagagctactccaggaccaattaaaactcaagattatcgtccaactccagggacaatggcattatatacattgacaaataatcaaactcttgaaccaattatatcacgaagaaatatcgttagaggagttccaccaatgcccatgatgaatagacgatatgccaatgatgatagcgatgatagtagtggtgagaacagtgatggtgaaataatcacaccagatgctacgaccacaactgaatcaactagtatttcagtaccaccgttggtacctgctccaactagttctgctttacctcaagggaagaagggaaattactcaaccagaaacaacaccaacatcaacaccagcattgacttatcgtccttctaa

SEQ ID NO: 11168 - DNA, 876 bp, Candida albicans
tacaaatataaagagctacaatcgctgatgtcgataatactaagtgtagttccatattttacaattgttctgggtttagggatatgggcttacaagttaatataccacaataatctcatacaaaaatattcaacatatttgtatatccccaaggtgcatatcaatgactacatagataagaacttgaagcacttgaacctaatacgggtgaatatagacagccatgatgatttacacgaagaaaaacccagtgtcctatataattcgaaatcggatatgttgaacagaataattggaattgttttcagtgttaccctatctttaagtgtcggtttgatactattgattcttcttgaattgggagatttcttggatgctgattcacgattgggattgtttaaaataacaattaacacattgatttttctactagtcagtgttgtcccaatttttatcataagtttattagctatacaggatatacttccgaaaacgcttccatcagcgggacttgtttcaattttatatgctgtgtggttgttggtattgcacaaatgtggagacttaacccagtctttcaatccaagaggtgatgtgtctcgtcatgttgtggaaaaagtaatcaacgaggtttcgatagtgggtattacaatcttggcaatcctctctggagtagggtcaatttctacgccatacaagatatttgagaagtacaaagggttagaaccagactcaaaggatgtcaatcaagcggatataaactcgaatattcactattttaagaataccattatcattgattgcccagccggaattcagaactccattaattgcaaattgcaacagggggaaactgtttattatttgcccaaatga

SEQ ID NO: 11169 - DNA, 183 bp, Candida albicans
catgatagaagtattggagagtggtatacatttgttagtactatccacataattgaagcaagaaatattatgcattacgacgtagaattaaaaaaaccaaagttacatgacggttcctttcggtatcaattatcacactcatatccacattgtagcctcaaatctaattgtttatacaattaa

SEQ ID NO: 11170 - DNA, 204 bp, Candida albicans
ttttacatacattggtataatataatgttatttttggacggaatgagagattataattgggttgatctcagatcaaaggtgattcaaacttcatctaatttagttttacgttattcactatgtacaaaacacaaaaataccaacactaataatttctttgtttatcatactcaaagggttgatggtattttctattatcagtga

SEQ ID NO: 11171 - DNA, 198 bp, Candida albicans
gaacaatattccttcatgactaataaggaaccaataataaaaagcataattggccatcgagattatggtcctggtggttattacttggaaattgagtttgaaaattcaaaaaccggttggatgctgattgctaatgtcaaactgagaaagcctgatttgtttaaaaaatatgtaaagaataatccagaggttaaataa

SEQ ID NO: 11172 - DNA, 342 bp, Candida albicans
  unsure (178): Identity of nucleotide sequences at the above locations are unknown.
ataaaaaatagcacacaaaactttataattgaaagcaataaaatattgcaaacatacgaaagtgtgtgtgtgtgtgtatcagtaggcggcggcggcggaagtaataatcagaaaaagaacaataaaattgggatgatgatgggcgggaaaactaatgactataattggaagggggtangaaaaaattggggttgctttacgatacaattggagataaataaaatttcaggggggacatttaccacttatttatgtctgtggaaaatggttttcgaaatagttactactaatggtttgattatttatataaccatggtgatgacccccggtatattggaatag

SEQ ID NO: 11173 - DNA, 648 bp, Candida albicans
ttgaaactccattcaagtacattcgaacccatacccacatttctacgatctagagtgagaagggatcttgttggaaggatcgatttaagtgcaaagatagataaagaagacaaacaattcttgatgcagaaaatgagctcgctacaatcgttcctcaaactagatttcaacacaaccgagttaatatgcattgcctatggatcaacaaatatggaattgaagttaaagaataatataatggagactgacacactacgtaaattggggaaaacaaggttcaagatgagtctattcaaaaacactattttcattgatgatagatatttgactgctacgccaatggaattaagttcagatctagacattttcaataatgaagaagttatttatgagtttctaaaactaaatcaactacacagacacagtttacttaaccgggaattgttgatcaatacaaagctaccgaggaaagactatgtgacaaaacggcaaatgctttggaaacaggcagccattggcagtttctataccatgttgggaatagtgatggtcaaatatcgggacgaaaaactattggacaagttgataatagacaaaataataaatggtaaaagaggtgttattaaaatagtacaaagaaatctataa

SEQ ID NO: 11174 - DNA, 189 bp, Candida albicans
ccgtttcgtatatttaatttgcagcaaacgttttcattcaaaatgaaaaaatatgtggttccaattggtttgattacttttgatgagaataaggcacaaaccacaaacatatatttaattttcttactagattataagagattaaaatcgaagcgaagatggtttatttcgattcaaagatgcaaatag

SEQ ID NO: 11175 - DNA, 429 bp, Candida albicans
tgtacagtttatttagatattaaagtatttccagcaatatttatgagagatattgctactttactggatgtaatcaatactatttttattggttggtcaatttcagttgttattaatatcaatccaacatcgcgttcaccaaccgagctacaattcttgaatactgaaaacttgccatttctattaattttaattagtaactgttttctaaaatctatttggtcgtacaaaccaggcggaattagcttaaattttgaaaaagaaaaagatagtgtgacggtccgtaaaatagcatgtgttttaaccgccgggggtcttggttttgtcataggtatgatcactcaaaatttcatactaaaaagttttagctctgttgtaaccatttcttttactcttagttgttttactattactttactcctcaaataa

SEQ ID NO: 11176 - DNA, 252 bp, Candida albicans
gttcacttgccacacaggatggcgatggcagatgcgttcattgacatttttttaacagttttcttcatcaacaacttcaattactcaatattgagcttatccgtttctcttgttaattgtgttaatattaaattaagcagatataatcgaaggaaagtggtagttcaatcatggttgaataagtcaaaaatatttggtgacacaaacgcggctacaaacttgacacattttgttttgtgtactatttgttaa

SEQ ID NO: 11177 - DNA, 240 bp, Candida albicans
ctaattcgaatgcatgataaaggaaactatttcaaatttgaaacaagagaggcaagtgatgacaaacgtttatttgttaaatacagttttggtaatgaaatagcaaatagtgtcacaaggacactattttacgatattgagagtaattataacaataagtacagtaaattcttcgaagaaattgaaaaaagaagctgtcaaaactttccctttttattggcaaggtatggcattatttga

SEQ ID NO: 11178 - DNA, 198 bp, Candida albicans
cataccgaaaccgccaatcaaatgaaactcaaaagtaatagacgcaaaagagcaactctaccaaaaaaaaaagaaatgataaggcgtatgaaagtacaagccaaaaatccctcattgtggagaatacatgagcataaacaatcacacattgtgcaaatggttcccttatcagttttgccaatcactaaaatcttttaa

SEQ ID NO: 11179 - DNA, 186 bp, Candida albicans
gtaatgaaagaaatgctgcgatggaaagtattgatcatgaagcactttctgattcaagaaatttactgtgaaaatcaaaaactcttagattgtgccctatttagtactagagtattgattaagtttatagttaagatgtctaatcatagtcatggtataggttatttgactgatattttgaattaa

SEQ ID NO: 11180 - DNA, 186 bp, Candida albicans
gatacttggatgcatctgccattgaaccttggatatcttgagtcatgtcaaaaaaaaataataaattctgtaaaatggtacctagagataaatagaaagaagaaagaaactaaagaaggttggaatctttatgatgttagtttaatacgagcacggttgactacttttttttctttcaaatgttaa

SEQ ID NO: 11181 - DNA, 261 bp, Candida albicans
tttgtgaaagtttctactaacaatctgattctggacttgtactacttcaccactacatcagttgaaggtcttaaactaaagaaagatatacatctcacttcatttaataaatgtacatatacactgcaattatatattactatttacatattcgcctggagtggtgacggtagctgcactcgtaccgtttacagttgtagatggtgtagtagttgtttttttggtaacaggttctctagtgtttttagttctaggccataa

SEQ ID NO: 11182 - DNA, 186 bp, Candida albicans
aaactttcacaaattattgtacagtataaagaagctggatatttgaaatgtcggtttagacgtcagtggtttaagggtaaaattcttgcttcccaagcaagggctccgggttcgagtcccggctggcgtagtcatgagttatttttttctgaaaacaattcaaatttactagacataaacttataa

SEQ ID NO: 11183 - DNA, 234 bp, Candida albicans
tctttgtttatcaatttatcatatttcctgttcaagatatacaatctgtatttctctgccttactttatagttgttcagacgtgtttctcaaaattaatctttttctcattatctcttatcgcacgtacatctgggatttgtataaaactatttacacaacctatgattggaaaaacggaaatcaaatagataatactaggctactgcaacagcaatatatagtttatacttaa

SEQ ID NO: 11184 - DNA, 324 bp, Candida albicans
cctgatcttccagccccgtgcgtgaatacgagtaatggcaactacatctacaaggaccgcaatgggatcagccagctagagttggactggaacaaggagtatcatgttgggtttgagtggttgcccgatatcgatgatcaggggggcaagagtgagtgggggcactggtttaatttacggaagtctaactgccaacaagaacgacttgtacctgttatcaactccgaattcaaagtccctcaatatctagctttcactaacaattgtctaaccaagctgaaccactctaaaactaccccctgctgtaatcaccacaacaattaa

SEQ ID NO: 11185 - DNA, 261 bp, Candida albicans
cacttcggatcttccagccggctgggcaagatacatcaacaacaaaagaacagcattaccaatcttcaccaacctatacaaatccatttatcaaatgttgacacaactgcacacaccattatccattatcttaccacaaaatattcacaattagtaagtgagacagctagaccacctagcgagcgttcgtataagtacagtatctcactcgataccgaccaaatcattcagagtaagccatattttcttactcaccagtga

SEQ ID NO: 11186 - DNA, 225 bp, Candida albicans
tttataaccataaccataaccaccaccaccaccaccaccaccactactactactactactaaaaacattaatttattattattggtatatacatacacatacacacaaatcaaaaaaactttgatggcgggggcaggagggagggagggggggggactacttgaccctttttctttttctattttagattttgaatttttcacttttagaatgaataccatcaaa

SEQ ID NO: 11187 - DNA, 609 bp, Candida albicans
gggcctgcgacaaattttttttatttttttttcactgctattgatttttcattcttaattaccaataccgatctagccaaacaaatgttcaggtcaatcattcagtcaagacgtcaattagttcaattgcgtaatttatcaaaatacgctcgcaatccacagatatttattcatgaagatacgctaactccgcaattgtacaagttttctctatcgaaatcaccactggcattacatatgggaacatctttgtctttaaaccctacagcagcaaactttaaagctaacaacgaatttattaaattattggactctacattacatgatagtattcatgatgatttcacatatataatggaagctagtactcatgctagttcgtttatgccaatatatgatatgagagaaatcccacgttatgctagaaccccatatatcgaagatgtctttggttatgtgcaagttgatgacaagggtagcatgattcctaatagttatcaaaaaaatgaaatgtatcaaatatgtagtgggaagactggtttaccagtattcagcgagtttttgtttgaaaccttacaagaaaaatgtgaaaaatcgtccaaagtataa

SEQ ID NO: 11188 - DNA, 198 bp, Candida albicans
ttgtatttttggagcttctgccactgggaagcttctattgtccgaaaaagcgcaacgacttacccagttaggaaagtcgctgcattgccgttggaacagattgataagcatttattatatttcaccaactccgtttccacttccacttcttcactagttaacagcaaattcatttctttagtatatttaccagtttga

SEQ ID NO: 11189 - DNA, 186 bp, Candida albicans
actgaactgaactcaactcgcattcttaacttcctcttctggagtattgttgctcatgttgcttgtgcttgctctaagtttcatgtaatactttatttagtattactgaattctaaaaattttgattgtgaaatttctattatggattttcaaaaattgttattaaaaactttaacaattaattaa

SEQ ID NO: 11190 - DNA, 192 bp, Candida albicans
gttcagttcagttcagtttttagtagaacaacaacaatccacacagcaacaacaacaacaacagaacaacaacagaaaaaaaaaccaaaaagaaaaaaagaaaaaaaaattttgaacgacataccaaacactaattacataattattattgacacttcatatcaattgcatataaccaaacatcgtaattga

SEQ ID NO: 11191 - DNA, 609 bp, Candida albicans
ttttcaataatggaaaaagtcactgaacatttgaacgaattcaaatccaaaataccaaatagtgtggaggaattacaagactatcttgattatctcaaggaaaaaatcccaacttcatacgatgatttcaaaccacagattgaatatgtaaagtcaattaaaggtgaagatgttgttaatgattttaagaacttgaaagtatcaccaattaccgtgtccttgactttggtagctttcaccacattatacttgtttgggaaattgattggtgggggtcgtgctgaagaaacaccaaaaaagaaaccaagaaagaagttgactaaagctcaaaaggcaaacagacaaattcaagaaattttggattatgttgaactgacatatgttcctgaaattgataaatttatagaaacctataaagaattgtcatctgaagatgttgagtataaattcaattattttgaagaaatgttattgaaagaattgatgaaattggatgccatcgatgtcacttcaaatgaaatcttgagagataatagaagaaaagtcattaaatttatccaagatcatcaaaagagattagataaatttaaaaaagaaattagtacctag

SEQ ID NO: 11192 - DNA, 198 bp, Candida albicans
tggatctttttttcaactgaacttattgtagggcacgataatctggaaatatgtcaagctttaaatacctctgatgagctaattataactgagcaagttaaaaaagcaaagtcttccaaaagagaaacaatagttaaccgtttgagttcaagtttaaacgaacaaataaacaaagaaaaatggattggatgctcataa

SEQ ID NO: 11193 - DNA, 186 bp, Candida albicans
catatttccagattatcgtgccctacaataagttcagttgaaaaaaagatccatcaacaaaatcaaaccacaagagagcctaatcaaagaatacacccccaatcaatagagaaaagtggagaacaccaggcgtgcaagaacattctattgatattgtgcatcaagataattcatattcacatctag

SEQ ID NO: 11194 - DNA, 252 bp, Candida albicans
cgcaagtgcggatccttccagccccgtggtgaagacttttttggtgcaatgcgtcgggatgaagagaaaaaaagtatcgccccatctgggacgaagcaattgaacgtgctagatcaccatccggggcacacgacattaataagaaaacagccgactggaaccacaaaagaaaaagaaaagggcgatcaccgcatccggggcgggacgttggtgttattaattttcctaattaggcatacttattattattaa

SEQ ID NO: 11195 - DNA, 213 bp, Candida albicans
gagaacgctatatcaagagttttgcatccaaggaccacgttgcatcttcctcggatctacttctctctcaatagcgctttccccatcaccgtatctcctatccccgggacattatatcctgtacaacttacacacaaaatacatactcctacagtaattacctatataattttaatagcgagtaaaccagaatgtctaatatgtagatggtaa

SEQ ID NO: 11196 - DNA, 234 bp, Candida albicans
tcaatgtcaacagtgattggggaccctaatataataacattttctattaaaccatatccaccgcgtcttgccatttcaataagacaagaatatatcaatctggaccccaaagaaaatccaactaatgttattggcctaacacctaaatttcctgaaattatggtttcagccaaaattttgcctgccttccaagcacgatctaaggaaacattccaagggttatccaacaagtag

SEQ ID NO: 11197 - DNA, 423 bp, Candida albicans
taccaatcaattgaaattaatcaaacccgaagaagaagaagaagaggaggaggaggaggaggaaggaagcaagaagaggagatattgggagagggtgaagaaagaaagaaaagtgacaaaaataacaattcagttactcaatttgatgtaaatgtgatgaaattggtgaaaacaaatttactgaataattttggaattgatgaagaagttagtggatatgaagatgatatggatgtagaagatgaaggtgatgatgaagatgaagaagacgaagatgatgaagacgaagatcaaatggggaatttaattaatatcaaaaaattatctgaaaatggttctaataatgtatcttatatcacttcaatgcttcaaaattttgtcaacaacgctaccaagttatcatcgaaagagcaaaggcaatga

SEQ ID NO: 11198 - DNA, 198 bp, Candida albicans
  unsure (55): Identity of nucleotide sequences at the above locations are unknown.
tgttgcgttgatatatataacggattgaggaacaataatttacaaccagcatatnttttttaccaatgtaactatactaccatggtaacggaaatcaaaagtaaatctacatatgtatatcaagaaataccacacaacacaacaactaaatactcatcaaattgttattgttgtgattcaattttccaaagaaaatag

SEQ ID NO: 11199 - DNA, 192 bp, Candida albicans
ctattaacagtcagatttctctactttttcctttttttttgtattgtttcaaacgcgtatatatcaaagatcaatcaactttttataatacaacaggggtgtagagatagaatatatcaaggtgcaaaagagagggcggacgagggggaggggggaggggggcaagaaacagcaaggttatcatcatcatga

SEQ ID NO: 11200 - DNA, 207 bp, Candida albicans
  unsure (11): Identity of nucleotide sequences at the above locations are unknown.
ttatcaattanggcgctcgtgcagtccgaggtgaagaatgtgtctcataaaattaaaagatatagaatgagaattaaacgatcattggaaaatcaatatagaacaaatgctaaaagagaaatttatactgaaaaatttgataaaatttggtggtcttcagttttttgtttagctttagcatcatcatatttctttcttaaaagataa

SEQ ID NO: 11201 - DNA, 216 bp, Candida albicans
actgtatatgacgaattagtttccgactttatggatttggttttatgcccgttggatgacattcatagaagatttagaggttgtggtttagttgaaatgaatggtaagcttagtgagttgtctggttgtaattattttttcttgccagaaaataggtatggaatgcaaacattggttactacaaataataatttgttctacaccccaaaagtctga

SEQ ID NO: 11202 - DNA, 651 bp, Candida albicans
tttttttcacatagaattttattggttgaagtctcaatgaactgtaaaaaaaaaatatcttgttcccaaaaaaaaaatacacacacatctatttcaccaacttatctgagttctaataccatactatatacaacgataaatctgctcaatatgctttctggagtaagacaacaatcaaaattatttacaaaatcaatatcacaagtttcaaaaagatacaattcgtcacataaccatcatcaccatgagccagaatcaaagccattggaaataacttttgctaaaatatttggtgttgctgccatagcaggaggccttttagtttacaagaataaagataaaaccgacaaaccattgttctcctcaaagttttttgacgaaatcaccactggggaacgtagccacttaagagatgaacaatatgagagaaaatacaagattggataccttagaacctttgacagagataacggtggtataggacaacaattgaacaaagtgtctgcttacgaattgccaaacaacaacttaatccctgctcattctccatttggaaatcaatttggagttggtatcaagactaatgaattgggacctagaagagaaagagcacaacgtttcgctccccttcaacaaccagctgaaaattag

SEQ ID NO: 11203 - DNA, 276 bp, Candida albicans
gcaataactcttacttcaatacatattaaattccattcatacaacatgactatgaaaccattccctaataatagcttgttactattaggaccagtgtttttggttgctagtgatttcgttatcaccaggttttctcaatcaggtgcacctaaaaagcttgcaaacaatacaagacaacaggcatcttcgtccttatcaatatcatcatataatccacactcgtacagatctagctggatccaaagccaactagagaaagaacctccctccaaataa

SEQ ID NO: 11204 - DNA, 273 bp, Candida albicans
actggtttcacccgaggaatcagcaccttaattaactataaggcatctgttgtaaagtatggggtccagaatccttcatattccggtaacgaacatacagaatacaaagaacaagaaacggtgtttgagaagttgctaagaaaaagagagggcaaatcggttgaaaaaaatatcgttcgatttgcagtatatagtgaaggttgtttagctcggacatacaattccgaatttctaagtgacaattatcaggtcattattgcttgtaacaaatga

SEQ ID NO: 11205 - DNA, 249 bp, Candida albicans
ttcacttttaactgttcaatgatactaacatcaagaatttttaatttagaacataaatcttggaccggttgtggtaaacatgtccacgaaataatggatatcagttctaaagataattggtgtacctgtgagccattggataaagatgaagaagttttcattgaaggtcatggggtttatccaccaaaagcaggtcaaggtttgagaagaggcagtggttgcggttaccagagttcttccccaagataa

SEQ ID NO: 11206 - DNA, 198 bp, Candida albicans
aggggtacaagtattttctttcttgtaaaactcaataattcaaagaataaagtaattatattttgttttgcttatgttggtactaaacaagtattagcattctacaataattgctcaggggattgctatcacgtgaatgacgtttccctttggaatggaaaagaatatttacgtgtccagaacaaacaccaagattag

SEQ ID NO: 11207 - DNA, 201 bp, Candida albicans
tacttgaattggaagttagacacccgggagataaggggtttatggaaaagtcattttatttggaacacttattttgaacaagatgtcaaatcagtgggtactagcaagatggaagtaagtgaaggatttcaagtctattgccgagaaggagccacgcattggagagaattcaaaaagttgatagataggagagagaattga

SEQ ID NO: 11208 - DNA, 216 bp, Candida albicans
ccgaacaaaaaaggtggccaaaaaaaagttgccgggaaacctcactgttgttcttcaaccaccgggcaatccacattcatcacacattccgtccgatatttattcagtccggtaaattggtttatgcagatgggaatgatacttgaattggaagttagacacccgggagataaggggtttatggaaaagtcattttatttggaacacttattttga

SEQ ID NO: 11209 - DNA, 186 bp, Candida albicans
atacaaaaccagttaaaaagaagggtactactgccactgagcaaaattagacacttgggtcttttctttttatgtaaatacatagattataaatcttatatacacattacaatcattatcaagaacacatcacatcctcatatatatatacataaatatcaattgcgtcaactgcattggttttaa

SEQ ID NO: 11210 - DNA, 216 bp, Candida albicans
  unsure (198): Identity of nucleotide sequences at the above locations are unknown.
agaaattcgaaaaaaaaaaaggagaaggcttggcctgaaaaaaaaaaaacaactttgaaaatgtgttcggtgttgacaatcaaactgttaatgaaaaaaaaaatagaaaaagttattaataaagagattaaaaaaaaaagaggtctgcgtggtgtcttctaccaacaaaaaaaaattctacaaacttgtctttggtancttgagttattcaattag

SEQ ID NO: 11211 - DNA, 258 bp, Candida albicans
ctattgagctccatgttgtttgaaccagtaaagaattacagcattttgtttagtatcactgatgccacatattatgatttcgacaaaagtatacaatatggcaacatagaaggccaagcattttattccaacttcaagggtaatttggtatcttgttcagtggtgatgattagacaagaaaaaaaaaaactggtaaaaatcccaattctttcgaaccgctgtggcattctagtgaaacttccccaccaagaaaaatag

SEQ ID NO: 11212 - DNA, 189 bp, Candida albicans
tattcctcaactttgggatctaaaaacgggttctttgaaatctcatctgactctaaagatgaatttgattcagtgtatgtgattattttattgtcttgtttttttaaggagcttgaagtgttgttggaagcaattgagtttgcacccaggttggctatgtctttttctgtcacaggcattgtgtactaa

SEQ ID NO: 11213 - DNA, 279 bp, Candida albicans
  unsure (185): Identity of nucleotide sequences at the above locations are unknown.
cgtttactgataattataacatgtctgggtcatattaacagatcaacagagaccatgtcagacaagagagatttacctaccaagtatggctatgacaatagttctaagcataccccagactctgaaacagacgatcataacaaaacaaatcaaagtcaacaagtgatcgacgaaaagaattcccnagaaaacatcgagatccaagtttcttccgataacgatttatcctctcttgaaagtgaccaattaacaaaaaatccatttttagatcccaaggtc

SEQ ID NO: 11214 - DNA, 228 bp, Candida albicans
gattgtgtggaagcgcaacataaaaaaaaaacagcaaacacatcaaaaaaatctttgaaaacaaacaaacctcaaaagaaagggataacacacaatctaatccagtctaatccaataccatggtatgtttattccaaacaacaagtaactttttttaaaagccttctatttctcctactaacgctctcaagtctgctttattcaacttccaatctttactacaagtga

SEQ ID NO: 11215 - DNA, 216 bp, Candida albicans
tataattatctttttcttttggttgtatgtaaatgctatctaaattcatataattcattcatggaattgcacaataccggtgctctttcatttcctacgattttttcaagattcacagcatcccatttggaaaataatatcttaactaaagctaaatccaaatcacattcttctttaaacacagatttaccaatgaatctaatcaattctttataa

SEQ ID NO: 11216 - DNA, 204 bp, Candida albicans
ggtttgtttgttttcaaagatttttttgatgtgtttgctgttttttttttatgttgcgcttccacacaatctcactcaacttacaaccaaccaatactaagtcctatcaaacacgaatcatatacattttattatacatctatacagataagattgtttcaatttttattttttgaaatacacatcatgttatcgactctttga

SEQ ID NO: 11217 - DNA, 198 bp, Candida albicans
ggacttaatctttcaccaattctagcaaatttccaaaacacactaagaatacctgattttcgattgtctaatattgctggagctgtggaatggacatatgtacatgtacaaatcaataatagtatcacttgtagtaaagattggaagttgaataaagcagacttgagagcgttagtaggagaaatagaaggcttttaa

SEQ ID NO: 11218 - DNA, 204 bp, Candida albicans
taccacgctcatggattcgtgttcagattgaacatcagtctcagcaaacatggaaagttaacaatttttgttgtctatgaattacagaaccaggggaaatggcaaaacattacaccaagaaatgatgagacagctaaccctagaattatggcacaagtctcaaaggtgagtaagcgatgctgttggatctggttatgtccataa

SEQ ID NO: 11219 - DNA, 315 bp, Candida albicans
cgacaggtgaagagaaatttgtcgatcaaatttcatcccgaaggttctttatcagagatagtgttgaattttcccaaaattttttggatatctttagatgtagccccagccaagactaaccaagggggggccactggtttaatttacggaagtctaactgccaacaagagcgaattgtacgtgctatcaactccgaattcaaaaatccctcaagatcaagctaacactatcaattgcctaacgaatttgaacaactctaaaactcccccctgctgtaatcagcacaatttgaaagtcaaccatctagagatttag

SEQ ID NO: 11220 - DNA, 390 bp, Candida albicans
tcagagatcatggctggtagaaccagaagtagaactagtggtggggataccccagaaaaccacactaatgttgttcctcaagaaaacttgagagatgaaaacaattcacatagtgaaaatgcttcagtcagagacgaacaagcaaacattattcacgatcttccaaaccagtcagacgacatggaaatagaacgtccatttatttttgcaaagaaatatcctgatggtagagttcttttggaaatggatccactccaacactatgaaatttcgaacattccggatctgttcaaagaccagatgatattggtgtacgaggagtgttatagtttgctgcgtcaattatcaacaagattatcagaatccattgctccgactctcactgtgtga

SEQ ID NO: 11221 - DNA, 252 bp, Candida albicans
gatgaaggtgatgaaattttggaacctaaagtaggtaatttaggtgctggattattaattgttgtaccattagatgaagatgaagaagatgatgttgatggagcaacactggaaaatattgatgatgaggctgatgacgatgaaaatgacgttgaggagccattaattgaagaaacatcttttttagtcttattcattaatgatattccattgatattattaccttttttgaaagtagcactaggaacttaa

SEQ ID NO: 11222 - DNA, 288 bp, Candida albicans
ttgaccaaaaaagaaaaagaaaaatttgtattaattatgtataaaatctctattttattaatatgcccaaatcactatttgaggctactagcagtgaaacaagctgttgatgctgtaatggacaatgataccgccaagggacttcacaaaaaaccatacaccgatctaatcaattttattttggagagaaatatgaccgttaaaaaggatcattttcttcataaatattacacttttcacacagtgagagtcggagcaatggattctgataatcttgttgataattga

SEQ ID NO: 11223 - DNA, 198 bp, Candida albicans
atggataagaactacaaatatagggcgttcatacttccagaactcttaggtaaacctacagtcaactactttggttccagccaaggagttcatagtcatggaatgctaaacgggtcactactagcttacccgcgtatttttctgtatgactttaaacaaggagacgctttgcttgaggtttatttgccatcaaactag

SEQ ID NO: 11224 - DNA, 234 bp, Candida albicans
aaaaacctattattcttaattgaaatcttcatcaacgataagattgaaaaaagtaatagaatagatcagatctttattgactcaacgtactatactgcaaacagctattgcgatattactgaatttattgttgaccttttattttccaataagaatcgtatcataggatttaatcagaataacccaatacccatatataaatttatacataaacatataacggtccccatttaa

SEQ ID NO: 11225 - DNA, 792 bp, Candida albicans
  unsure (748): Identity of nucleotide sequences at the above locations are unknown.
tactccagtgcaagaatgaataatggatctcagaatcaaagtgccaataatggccaacaacctcaacagcaaatcaatttacaaaatataccaccacagcaattggcccaattggtgactgcaatgagaaccgcttatgatcaggccaagaattctaccaatgaggccgaaagacagcagcattttaatcgtgctgaaaatatcagaagattattagcaagatatcaagctcaaaaaaacaggttgcaacagcaacaacaacaacagcagcagcagcagcagcaacgcactcaacaacagactcaacagcagactcaacagcaaagaaatttaacagaacatcaacgacaaattcaagctgttcaagcacaagcacaggcactagcacaaatgaataacaatgagaatttcaatgctatgagcaataaccaagttggtacgcctatgatgcagcaacagtctcccaatatgatgcttcaatccccaatgatgcaacaaaaacagactaatgttggtacacctatgcgacaacaatcacctttgatgacacaacagtcaccgccagagcaatttcaagctcaaaaatcaaatccaactccacaaccacaagtgcaacaaaatgtccaacaaatgaatcaaaataatgtgatcagaaacaatgccatagtaggtacaaatggtgcagcacctggacaaataaacggtgtgcctattgctaatagtaatataacaatggaaaggttcagtncaatcagacaaaaactcatcttacacagacgggatggaaattag

SEQ ID NO: 11226 - DNA, 300 bp, Candida albicans
tctattctattacttttttcaatcttatcgttgatgaagatttcaattaagaataataggtttttttattttccgagattttttttttctgctttgtttttttctttcttgcaacagactttgttggctgaaggttttggttattttcatgctacccaccataatttcaaaaataatgataagcaattaacatcattcaaagcaatagtcttgttacatcttataaaattaaagattgttaccttttttgaagaattagatgcaataaaaatgcttagaactacgattttaaaaaactaa

SEQ ID NO: 11227 - DNA, 204 bp, Candida albicans
ccaaacttacttcttgctctaagatgcggaccaaaatatccaaacacatatggaacgggaaccatggccaaagcaatgaatgcaaaaagagatcctgcccagcctatacccaaattctcaaaacattgtactgtgaaaagaggaaaaacagatgccaatgtgtatcttaataaattattggccgcaatagcagaagcaacgtaa

SEQ ID NO: 11228 - DNA, 204 bp, Candida albicans
ttttgttgtttggaaatatataatattgttacaaagtatttccccccagagacaaacgaaaaaaccgaaaaaaaaaataaactgtgtctcaaaagagttttaaaaaaattgcgtctcttatcctcacaaactttgcagggttgtattgttttcgttttattattctttttttttttttttgcgggaacaattattcattcctga

SEQ ID NO: 11229 - DNA, 477 bp, Candida albicans
atgtctcgtgataaaactttgaaaagctacaagcaagtcattacagaaattgccaaagttttagaatacgatgacaaagacttctcaaaagtggccaaatctcaattatactcttatcatgagaaattagcaaagggtgttgcagatatgtttgccgatgttatatcaattgagagtcttcatttagatagaatggaattatttaaccaacactttgaacagttattagagaggaaaaaacaacaggaacttaggaggaaactaagagaagcacaaaaagctgctaaagaagagcagaaagaacaagaaaccaaacctgaagaagttgaaattattgaggaagaagatgaagttgttgaagaagttccaaagcaaacaacaaccgatgactctttggagcaaaacacaaattctgtagatgaaaactcatcaaccgaaaataaaaagaaacctgatgtggagcatgatgaattgtag

SEQ ID NO: 11230 - DNA, 363 bp, Candida albicans
cttctattcctattgcaatacccagattggctacatgatttgtacaagtattcttttacagcattcactaacgcaattataaaaattattgttagaaataacttcatattgacttggattgtaaactgtagcaagttactacaacttagatcagatgtcgtttgttcgcggatggggagaaactttaaaagggggttgtgtgagagaaaaaaaaaaagagacgagtcgatggattctgtttctgaagttaataatcagcgcaacgaagcattgttccagattagctgctgtcagttttgcttttgtatgtttatgtggttcaaggaatactttagaggcaacgataaagagtttattcaataa

SEQ ID NO: 11231 - DNA, 291 bp, Candida albicans
ttgaacaataaagtacatgagagaactaaaatgatattttggtgtaacagaaatgaaatgaaaactttcaacggaaaaaaaaacaaaaagaaaaacttgcttgaggcactggcagacttacaaattttaactatgagaggttttatttttgtcgttgaaactatggacggacgacatttgtcgcagcaagcgccactaccaccagcaccacccgctgcgggttgtaaaaatgggaacaatccacatctgcaaaagctaattccgtggaaacacgccatcaatggggtttaa

SEQ ID NO: 11232 - DNA, 264 bp, Candida albicans
aaactagaatgtgcaacagtgattaagataattttttttaatacttccaatttttttagaatagaacaaaagaagatagataaaagtgcccaatatttcgtcacaccagacagcataaacgtctactattatttgatccaattagtttgcattaggcacgaggctttgtcatattatctacttagatgtcgaggaacgtttcattgcctagcaccactgaatcaactaaaaacaaacgagtggtatcatcacaattacgattag

SEQ ID NO: 11233 - DNA, 270 bp, Candida albicans
ataaataaaacaatagaagaaatgcgtatttgtggtgttgataataccaccaataaaaccacgagacatacctactgcaacaacatgtacgaatatttactacccccactgctaataccatatgattactattacaatgttgtttcatcaaatcctattcatagcctaacacaacaaagaagaacaaaagaacaaaagaacaaggaaaagaaagaaaagaatagggtttcattgaggaatttgattttttttttatatatgaatatttaa

SEQ ID NO: 11234 - DNA, 1659 bp, Candida albicans
ctggctatgtatactactatagaacatcaacaacaacaacaacaacaatacgaaccaatgccagaatcacaacattcaagttatttcaagacagcattcaatactactagaccacttgatgattatgaagatcaaaatactaccaataataataaactcacgaattcaattcaaaaattatcaataaatacaaatacaggacatccacctccacctccacctccaccagattctaagaaattcaattttgtttgtgtattttttaatcgtatacttaatttaaaagatccaacaataattttggaaaagaataaagatattggtaaattcaatgagttagttaaaatagatcgacaacaatcaaagcaacaaccaatagagataatgagggatctgttttccccggcagatattgggattagagatgaaattaaagtgaaagatgctaagattaagactacaatgttgaaggaagtcaatgaattaatggaaactgaattaaaagatgttaatgatcaaactacttttgaagaaatcacgttaaattattatgctaaattattagtggcgtataaagtatatgatatacccacaagaactatttataattcttatcctaattatattcaaaattcaatattattatcattagaagaagaagaggaacaacaacaacaacaaaaccaaaaccaaaaccacaatgaagataataataaaaatctggaatttgattttgggtttttggaaaaaccagtttatcgtacttcatcaaatcaatcaaatagttctcaaaaatctaaagacaaacgatcaagtaatggaagtactttatcaaggaaacgatttctgtcatttttaggtagtaatggacatggccatgggcatggcaattcttcatctaaagattcttcaccagatcataatcatactcaaccccattctcaacaatatcaccactcacaaatggcatcacctacaacaccaacttctcaaattaatttacctccgcctaatctgcatctgcacctgcacctgcatctgcacctgcttcaacaatcacaacaccatcaacattcatcattatcatcatctccaactttccaacaagaaggtacatttaataatctattaaccaaaactaaattatatggacgaattaaaaaacatcgagaatctcaagcatcaataaattcaactggatctcaacatagtatcaatagtaatcgaaatagtgtgagcactaatgctacagcaacttcactgggatcacgaagaagaagtaattataccataaatagttttggtggaggcaactcagccgctccaaatactccaacattatcattattatcatcatcaatttcaactattcaagatgaacatttccatcaagaaaaccacactagttattcaattcaagaattaaagttagaaaatctgaaagaaaaatatgaatattatattcaaattttaagattatttaaaaatagtgaaaaaattttgaaaattttaattaatagtcataatattaataataagttattaaaatttattgaatttattaaaaaaaaattattgaaatttataatgattgatataatgtcaatgattttaacttattgtgatttacaatgtattaatttttataatataaagtaa

SEQ ID NO: 11235 - DNA, 228 bp, Candida albicans
gtaccttctttaatcaatattttaattctataccttgatggtaaactacgatctaatctaactcgtatacctaatccaattaatgttgctaatgaacaatgtgtaattgtaggggtgattttaattaatacttccgatataccaccaccaccaccatcaccaccatcaccaccacaatttggtgggttagttattttgatgtcggataaattcacaacggctaattga

SEQ ID NO: 11236 - DNA, 930 bp, Candida albicans
tatttaatattaatgttaattcgtccatttgtgggaattgatcaagataatcataacaaccatgatacaaatagtaatgataacaatgatgacaatgatagcgatgatagcgatgataatttatctcctttatcaatttgtttgaatgctattgatgatttatatgaatcaattaatcgattccaaaaaaaacatggatatagaggtggttcaattttcattgtttattcctcaattttatcaatttcaatattattattaactaattcaagaatccaattagcaagtgaacaaaaaaatcgattacatttttttatggatgttttatatggatgttctaaaacttggaaattggcagaaaaatcttataatttaattacggaaaaattgaaacatctttatgaagcaggagagttgaaagatgtatttgaatttatcattgaaaaaaaatcatctccatcggcgaccaatacaagtggaaacggattgaatgaagccagtggtaataataataataataattctcaatcaattgaaagcaatgaatttaaattgccaatcaataataaaacactttcaaagttgaagcataatcaacaaaacactaataattctcttcctacttatgatactaccgataccatcaattctacttcaggtgctaccactactaacaatagtactacattttcaatggatcaaaaccttatggaagcaccaactccattatccacaataagcaatggagttaacaataacaacaacaatggtggtggtggtggtggtacaaatactagtagtgcaactgatttcttgacagatgataatgttgatttcttgggtggtccaccagttttaatgacagctgatttatttaatgaagattgggaagcattatttcctgattatatatttaattcgaaaaattga

SEQ ID NO: 11237 - DNA, 1167 bp, Candida albicans
aaaatcattctgactaaatacaataatgatcccatacaattgattcaacaattatcattagatttaacgaaaaaagaaactgagttggtggtattacgacaagagaaattccgtcgagagcaaaaattatataaattattacaaaaattagggaatctttccacgattgagattgatcaagaattgaatcaagttgatgataaattgaataaaaatatagataagataattcatgatatgatacaagtggctattgacgatgaaattgtaccaccacggtcaaaggagattcccaaagaagatctgcaagtgaggaagaagaagaagaagaagaaaagacaaaacccacaaaggaataacaatcagagtgataaggatgcaaaatataaagcaaagagaaaatctgatcctaagatgtgtgaaaaaactgatagtcaacaaccatttcaatcgaagaactcgttttttaccaaaactgatacgtcgccagaattctcaataccaaaagcacccgttgaattacaaaatttccgaagtcaatcattattacaacatcctggttctgaaaagaaatccaattcttttagatttcctttacttgtacaaaatgaagaagtagatattgataaatatggatttgttaaagaattcagaagtaataccccaatgacccatcagtcatcatctgcttctgcttctgcttctgcttctgaatcttcatccccgctacctcatggacaacaacaacatccagaaccatcctacgaatcatcagcaatacttataaacaaccataatagtcattctaaattacatttgattgatcaattgaaacaaatatctcaaatccatgattcaacaaatttatatattgaaaaagaatgggagaatttaattaatgatattaaccgacaattttataccaatcattatcaaaacaacgaaccgaaacagaaacaaaccaaaaaagataatgacgatgatcgagaattatattggagatttggtattagaggtagtaatcttttacaattgaaaaataatcaacaattttattatccatttattaatttaatcaatcaatatgggatacctaataaatatcgacgaatattatggttagaattatcaggtagcaatcttccccgcccggctggaaaatcgcaa

SEQ ID NO: 11238 - DNA, 207 bp, Candida albicans
tttgatgattttgaagctgcagcttgtgctgaatccattatcggtgttttaattcgaaagtatgaaacaagtaaacgggaagtttctaagtttttgaattttgaaaccacgcttgaaaagcattccgatagtgtagttatggggaaaacatcaagaggcaaaagttgtgtgtctaggtggtgtgcatgttttgttgccatagtttaa

SEQ ID NO: 11239 - DNA, 228 bp, Candida albicans
atcggcagtataaaccaaaatgcaagtgtgtgtggggggggggggggaagtaagacggtaaactgcgacaactccacacaaaaactctcggaatctatcataactactatattgggaaatattgacggagttctgcaattaatccggttttctcccgaaactaaacaaaggaatagtaaatcccatactgatctacattcccgttattttccttatccgtttacttaa

SEQ ID NO: 11240 - DNA, 228 bp, Candida albicans
atagaagtggaccatctcctcaatttgttcctgttgaatattattcaaagaatactcctagttattagaattttagaaagtaacatcaagcaaagtgatatattcatcaaagcttttagtgctctatattacattgaaattatagcacacaatgtttgtgatttatcttatccgtatccttatgcgctggatcttcaacacagcggtggaacatccgcaattgcgtta

SEQ ID NO: 11241 - DNA, 333 bp, Candida albicans
aaaagaatagataaaaaggaaagaaagaaaaaaaaaaagaaaaaaaagaaaaagagaagaaaaaaagaagaaaaagcaagaaagaaagagagaagagaaagaatgaaagaacacgaaaaacgaaaaaaagtaaaagaaaataacaaaagaaagaacaaagggacaaaaaaaaaaaaagaagaaaaaggtaaaaaaataaggaagagaaaaacggaaaaaaaagggagaagaaaaagaagcaatagaagaaaatcaaaaaaatccaagaaagaaaaaagtaacgaaataacaataaaaagaaaaagaaccccaaagatactccatcatcaataa

SEQ ID NO: 11242 - DNA, 1311 bp, Candida albicans
acaatgtcatcgttggatcacgaaatagaacaagcaatactccatgatcgctttttgaggatacaaggagtaattattgatcattccagtggtaaggttaccaagaatggaactttatacgattatcgtcgtaaaagatcaagacatcaaaggcatagcaatttaaatgatttgaccaaaggaatattcacattaccagaagaaattatttataaaattcttgaccatgttaatcaaatggatactattcatttggcattgactcatagatcattccgtgaagtatgcaaagccaaattgttggagaacatttgcgtttactatgaagaccctagaaccaatttgatacccaaaaattggtacatatcagaatataccaattatacctttgtcaacgggctcaattttgaaaaactctattttaaagtttttaaacatgttaaacatttgtttttccgaaatgttgtttataagacaggttcaattgtgctacacaatttaggagagcaactgaattgttctataactttcggggctgtaatgaaaccagaattcttgtggtggttgttagcttaccaaaatagaattaaaccggcaaatttgattttattttataagaaggactttgaattaaataattatccactaggaataatcaaagagttgagcttggattttacttttttaggtaggactccaattaaattctcattgatcaacgagatgccaaatttaaaaaagctcacgttaatcgatccccaaaacttgcaatcaccagagccagtggatattttggatttgcatgttcattataatttttgcccagccgatatctttggaagctttaatctaaacaaaatcaaaaaattacgagtattttattggtggaaaactcggagcttcccttcactagtttataatgctgataaattaacttcgcttgagagtttggatgtaactttcagtgaagaggagttggtaccatttgatagaagcttaagaaaaaattcattaattgaaattggagttcctgaatcattaaaatcttttgaaaccatttatccagcattatttcatcataaagattcattaaaagtaattttcgaaaataaagattattaccgtattatcagctatactgatcaggagatttcttttgataccagttttaatgttgatttggatctaactgaattccctaaattagagtatgttgtcagaaatggtggggtcaagctagtagatagaagtggaccatctcctcaatttgttcctgttgaatattattcaaagaatactcctagttattag

SEQ ID NO: 11243 - DNA, 252 bp, Candida albicans
ttgattaaaatgaaaaagagaaagaaagaaagagagaaaggtagtgtgcgcaagcatagcattttttcttctattaactattatccaccgactcactcactcacccatccactcactcagtattcccgcgaggaggaggagaagaaagaaaaaagaaaaaattatttgaaagtgattcaaagttattcatcacttaaaatctcttttctaccaccgccaccaccaccacaacaacaacagttaacaatctaa

SEQ ID NO: 11244 - DNA, 213 bp, Candida albicans
acaaacaatctctctactatgtccggacgtcaaggaggtaaagctaaaccattaaaagcaccaaaaaagaaacaacaagatttcgatgaagatgatgctgcttttaaagctaaacaaaaagctgatgctgctgctaaaaaagccatggctgaaaaagctaaaaaaggtggtccattagttggaggtggtattaaaaagagtggtaaaaaatag

SEQ ID NO: 11245 - DNA, 252 bp, Candida albicans
attatagaaaaacgagcaacacatttttatatattatattttactgatatactaaacacagaaatttcagaagtcatcaaaaggactgggtggccaagttggctaaggcgtgagactgttatttcaaaaatttttaaacgacatctcaagattgagagttcgagcatctcaatggtcgctaaaatttatattttttttcatttttttaccaatttaattaaattgattaataccttcttattctttttttag

SEQ ID NO: 11246 - DNA, 216 bp, Candida albicans
atcggccttaagaagacttattggtctgcatatcaagagtatcatcagactggcaaaattaataaaacattctatattatatatacaccgaaaatatcgaaagaagaaaagtcacatagagaaatcccatttataacattaatatctccttcgcataactattgcattgaccttggtcctccctcttttttattcatttttttaattaaacattga

SEQ ID NO: 11247 - DNA, 891 bp, Candida albicans
gacttgtctactaaacaggaaccacaacaacaaagacaattatggattggatttttacgtgctcatgtaaaagattgtggttgtggtggatcaatgtatagacccaatttcttaatcttggagaaattgaattcaaaattcaaattaacctatttatcagggtcaattaatttcaatgtttcagtttatggatgggcaaattatgatgttgtttgtgctggtcatgaagctaatgctttgattcccaatggtatttcaatgtttgatcaagatgatgattatttgactttgagtatgagtgttgctgatcaagataatactttggttcatattcatggtgtgaaaaaattgatttatctgttggatcatgattggaatggtattttgaaagaaaataaacagattgaatgtgtggttaataatgctaatgatttttgtaaagcttatgcagatgaacattataaattaggtgattctgaagcagctgtaaaagaagtaaagcaaaaggctaaagaagaagctgaaaaagcaaaagctgaaaaagagaaggccgagaaagagaaggccgaaaaggaaaaagccgaaaaggagaaggaagagaaggagaaggaggaaaaggaagagaaggagaaagctgagaaggaaaaggaagagaaagaaaaggcggaaaaggaattggctgaaaaagaactagctgaacaaaaagatgaagatgccaaagatgaagataaaaacgaagacgaagacgacaaagaaaagaatgatgaatctggtctaactgagaaatctgaagtagaggaaaatggcgagaatgccaatgaaggtggtgaagatgatggtgatggtgatggtgaagaggaaaaggaagacgacgacgatatagatgtgtaa

SEQ ID NO: 11248 - DNA, 267 bp, Candida albicans
aaaatcatgcaaagtagcgcgtttatatgcatttttttcccccccttcacacaaggggttcttcgtttggaaaattgggaaaccaaatttgacgaacgaacgaagaactttacagattatatgggaaaggaaatggaaagtttaattaataaaaaaaaaaacaatggcaataggtcaagtttacataatgttgtaaaaggggcggcttacatgttgttgtcaactagcatacttttggttcaattttttttgtttactcttcactaa

SEQ ID NO: 11249 - DNA, 207 bp, Candida albicans
agtcagccatggaaccttctcaaactatccaaccttcccaaattacccaaactacccgaacagccactatggttctacctagcctataatttgttgataccatcccttttagtaattgttgttcattataattatgaacttaaacctcaccaagatttaatttttatgcttttatacattgattgtgctttgcagagattacgttaa

SEQ ID NO: 11250 - DNA, 216 bp, Candida albicans
gaaggttccatggctgactctaaattaacagagaacgatataatgtacaaaaaaacattcataattttaaacaacctttatatatatattaaatgtacttgtcatcaacttgccgttgcttttgatgatgctttcctgttaaatatacctttaagaaccagcttcactatctcaactaatattaacccttatacttcttgttttgacattccataa

SEQ ID NO: 11251 - DNA, 708 bp, Candida albicans
  unsure (328): Identity of nucleotide sequences at the above locations are unknown.
aataactctatgaaaactcaatccttatctattttgtggttacggttatacatattgattttatttattagaaactgtctttgtgatgagaaaatcatagacagctctaaatatggaagattaactatcaccaacaacacttcccaagacactttagaggttgcaaacactctacctaattctcaaccaaaaatgtttatgcacaaaactgagacgtattccgttgaagtaattaatgctactaccttgtctgaaaacacacgaaagaaaaggtttgatgtgtctggacctgttcgaacacctgctcaagcaaatgtttgtgttctangtgctgcctttagttaccaagttatgaaagacatacctaatggaattaaatatttattgaaaacggatcaatgtcagacagatttggcaatggttgaagtatacagagacattgatgtatattggcaagctggtgaaatcactggatcttgtgacctcatacgaaaatctgaaataattgaattggtattacaagagcaaattgatgaagtatacaacacacgtatttgtgctttccaatgtattaagttaaggcgtggtttggattggacgttttatttgaaatttggaaccagtagagatttggttcaatacacagaatgcagcagcaaaacaggaggattcagtgaatgtagagaaggtgaaattaacgatatttga

SEQ ID NO: 11252 - DNA, 231 bp, Candida albicans
atcaacatcacgtgcaacctgttagggcttttgagccctaatcacgtgacacaggatactttcaattgttgcataatagttactgtagtttattatcagatttgtaaatttatattaatgaatccattctttttttatacaatcaacttactttatccatctacatttacaaatgattgttccttttctttaacttcccaaaagagatcaccaacattgaaattaccatga

SEQ ID NO: 11253 - DNA, 228 bp, Candida albicans
gaaaatatgggaaatagagataggaccgaattaattgaaagagttttcttttggggaaatgggttcaataagatttttcaagattggaatcaaattatgtcagatgtgaagaagagtaaatataacaagaagttcaaatcattaaaaattttatgtaaatacaacgattatcaattacagtcaacgaatagaataaaacaaaagccagcatataacagataccagtga

SEQ ID NO: 11254 - DNA, 354 bp, Candida albicans
gtacaacttcaaattgtaacaccaacaccaacacagatacaatcacttgttattagtgtaataccagttatgcaatgcccacaaaaacttgtatcaacaccaataccaacatttgtaccagtaccattaccggtacattcagttccattggcaagacctccactttttgggaaaccaccaggcgccggtagttcgtattctcgtcgtaaagcatttggaaaaccaccaggtgctggtagttcattgtttcgtccacctacatttttatccaataaaccaagctataaaagagaacttgaagatgatgaagaagaaggtgaacaagctactaataaaattgccaaaacagaataa

SEQ ID NO: 11255 - DNA, 246 bp, Candida albicans
  unsure (116),(118),(119),(120),(121): Identity of nucleotide sequences at the above locations are unknown.
gaaagagataaaaaccaattaagagagaaagaaaatagtagactttatcagattagacacgaccatgtatttgatgggtctctctctcatcgagaagaattcctctcttcgctatntnnnnagaagattaacaatttttttcaaattcttgatcaatttggtcttgttcctgcttgttcctttcctttaatttgtctaattatccatcactttgacaatgccttcttattgggtgatataatataa

SEQ ID NO: 11256 - DNA, 366 bp, Candida albicans
agcaacaacactttactttgtttttctctctctctgttggttcgtcttttttttttttctttttttctttcttactgtcttggaaatagaataaacttttattatgcagacatttttttatcttctctctctctccatgatttaatgtatggcaaattacaatgtaacgttacatttttgtcaagttttgtgtggagaataaaaccgggcactaaatctcatgatttaaaaaaactaaaaactaaatcatcagaacacaaacatgaattagacaagaacaccaagactattttcacaacgtggggggaggaggtgacacaaggcgattgtagactattttctcagacaggaatgttttttttttaa

SEQ ID NO: 11257 - DNA, 195 bp, Candida albicans
tcagggatttgtggaaaatggagtttaaagtctaaggacatggaaactactctgagagacacggaagtcgacgtggcaatggaagtggcaagggaattgggaagtactgagagaatgaacagccaagttattagaagtggaagttggatttgggaaagaaaatcagagaatgaaaaatcatggaaattattttga

SEQ ID NO: 11258 - DNA, 270 bp, Candida albicans
tacttgaattggaagttagacacccgggagatgaagagtttatggaaaagtcaaattggctggaaaattaaacaaagatgtcaaatcagtgggtggttgagagatggggctacatctaatgctagaacaagacgtgagagaactgccatgtcgttggaaggaattttagcaagttgtatgaaagcagagaaaactgccagcgaaagtcaaagaaaatattcttgggagagagggccagacagagaaaagggtaatgaagatggagtgtga

SEQ ID NO: 11259 - DNA, 258 bp, Candida albicans
cgaaccaattttaacgaatcaaattcacattttatttcatgtaatttatccccagtattagcattccaaattttgacatattcatctttagccactgttgcaaacgtgaattctgtcattggattgaaagataaacattcgactgctttcagatgggcatcaacaatagtttttgggtcaactactgaagcaggaagacatttccaaatccttactgatctatctgtacgtgaatataccactctagtaccagtttga

SEQ ID NO: 11260 - DNA, 345 bp, Candida albicans
acaatgatcttccagcggctggtgaatacgggtacttgggtgttcgcaccaattcaaaaacattatgcatacagtgaagatttatctttacaagtaccattttatgtcagttctgccttgtgtcttttcagtgcatttttaactattttttttgttccgccagtgggtcaagatgctattaataaagaagatagattgtttaaagaatatttagaagaaaacgggtttgatataagattgttaggtgatagtggtgttgtcactcaatatcaagaagatgaagatattggtgtgatttctgatgaaaaagacgataccgttaaagtacaacagaaaaatgtataa

SEQ ID NO: 11261 - DNA, 894 bp, Candida albicans
ttggtagaggattacgattacacaagggagaaaagtcactgtcatgtgattgacttggtggggataacaaaatcaagtctagcattgaaagcgacattatctggggaagagccacaagagcaagagaaacggaaatacaaagatgaaaaagatagtgaagaagaagacgaaagattggacgatttggagtatattgaatcgatcaaatcgttgcgtgcacgtaggaaactaatagtggaacgtgcattgtactattacaaccatggggtgtccgaattgcaaacaatagatggcatacaattatttcaaagatacatgctggatatagaggttgtgaaggatatacttatgaaaggcaaactcccatgggtggcattgcatagagattcagtatggggtgttggtggtctagacaatacttttttcctaattgaaaagatcaagacaaatgacaggatagagtttaagttgactcaaaatcagcttagtagacatagcaactcaaatcatgaagaagttgagcatatttacacaagcagcaatatacttgagttgatgcagaaattagatgacacatttccagaacatgcatcgtatacagcaaagtataacacgtttagaagaaagtgtcacagatattttgctgaatttattatttcgaaattaaatactcgaatcagtaagtattgtcatgagaatggtcttgagagacaacagtttcttgcctcgcttaacgatgttattcgtggattacacttagtaacagcatacagattaaaatttgcattaacatattctccacactgtgattattctatttggaaaggaaaccagcttctagcacaagcagtgacaaattgtcgcaagaatacactttcaaaatatagagattaa

SEQ ID NO: 11262 - DNA, 651 bp, Candida albicans
aggacaaaaggatctatgaagagtatgattagcaccatcaacctgatagtttctcaaggtagtgataaaaaggaaggtgctaatggaaagcgtaaatcgagaagtagaaagggaactcttaagaaagaacaggaagaagaagaagtcattaaagtggaacagtcagaaacgccaaaatcaataagcgaacaatttatgacgttagtggatactattggtgggttgataccaattccatttttgagcaacactgttgttggtttcattattgttttaattgggtttttaactacagtctcagtattcaacaggttgacatcgacatctcccaaacaatacattgaacttattcctaatgattatttatatgcatccagaattcaaatcagagacaataagtatttattgttgcctacagttgaaactagctttaaaaatgaaaggttgaaaagacaagaggaattatctctctggtcatggttaaataatcgtagtgaggggagactcaatttgaattacaaagctccaagtttggatgagttggatgattctgatttgaagtccaaatatggtgaacaagaattgaaagaaatcgtcaggttaacaagaataaaattggataagctatcagagaaattagacgatctttaa

SEQ ID NO: 11263 - DNA, 201 bp, Candida albicans
caaaaattatatgtttcaaattcaaaatcatctttacttgaagtatattcatcagatgattttgaaggggattttttcacttttattttgcctggtaacgatgatgccaatgacagagtcgatgatgatgatgctaataataatgacggtgtcagcgacgatgatgctggtgacgcaggtggtggtgctggtggaggttga

SEQ ID NO: 11264 - DNA, 2025 bp, Candida albicans
actgggttcttccaccgggtggtcgataagaagaaatccactagtgattctcaacaacaactggtacggggtaatcatgaattgcgaagacacagccaaccaaacccaattatcaattatgaagtattacattctacatctacagcaaatgggaggaatcacattcgtcaaaatgagtctgaatcagttataattgatgaatctactgatcaagaaatgtcaccattaacatcgactcaaagtagtcaatcgacagcattatctgaggcaaatacattgtttattgatagacatcaacgactagagttacaagataattatttagataatttcacaatgtacttaccatttgtgattagacaaatgcgattaattgaggaaagacgatatctagaatcacaagagtatcgtaatgaaaatgaacaaactagcgacaataatgatccattacaacaacaacaacaacaacaacaacaacaacaaacttcgcgtcatgttgtaatacccgatattacaggtgatgatttagatgatatttctaccatatttgatgaagctcatgtcccattagaaacttttgccatgaatcattataaaattcttgaaaaacaattgtcatcatttgatattaaacgactgtttataattgttgctggtatgttaaaacataatacttatatattccctagtgctgaatcatttgaattatttaaacaactacgatcgagcattaagaaacatcgcaagaatctgatcatggtatatgacaaccaaggaactattaaacgagcatcattgacatcatcaacaacaaatatcaaacgagaagatattaaccaagaaagtgaaggaataataattgatgatagaccccatattattccattagatcaaaaactaaaaggattaggattaccattgtttaaaattcaaaccccatatttatcttcatttcggaaaaatactccatgtataattttcaaaagatataaagaagttcctcaacctccaccagcaccaccacctgcgtcaccagcatcatcgtcgctgacaccgtcattattattagcatcatcatcatcgactctgtcattggcatcatcgttaccaggcaaaataaaagtgaaaaaatccccttcaaaatcatctgatgaatatacttcaagtaaagatgattttgaatttgaaacatataatttttgtcaagtatattccaaatattttcaatcatatcgaagatttatatttgaattcacaccattggatcaaccaagctttaaagtcattatgtttcaaagtaatttacgaccatttgctgatttattatataaaaagactcgttttagagtaattggtccagcaatgttactgggtgttatacaaaattataatcctcatatgagattattagtaatagatgatgataaaccttcattagtcgataatataatcaataaaaaaccccatagtggctcaaatacctccattgccacagtggccaccaactcaattactggtgccgcggctgctgctgctggaggattatttcataaacgtaaatcaaatgataaaaaatccaaaacatatgttgaattcaattatgatgatccaaccacttttattaatccaatacctaataatacatttgctgatgaagacaacaacgctaatatcggtcaagcaattaatacttcactgtatataagcaatgatttaccaccatttggttgttttaaagattcaatgttatatcgaaccaattctagtttattaccgaaaaaatatactgaagaaggtaaaattcaaatgtatcaagataaactgtttttaattgataaagatgaaaatagcaccctttcaattgatattgattctatggttcttgtttgtatcatggctactttaagagatatatcgattaaaaatgctggtagaacaaatactcaaagggcatttggtattggattaggtaatagaatagggtatggattagaaccatctcatgtagggataattggtttatag

SEQ ID NO: 11265 - DNA, 243 bp, Candida albicans
tttattcaaagcaaaatgtcattagataattcaacagaaaaccgtgatttggaagaaaaggaagaaattccaaagaacgaacataacgaacaaggcgaacaaaacgagaacaatgagcatatacccactttggaagataaaccattgaaggaatatattggtattagtattttgtgttttccttattgcctttggtggtttcgtttttggtttcgatactggtaccatttctggtttcattaa

SEQ ID NO: 11266 - DNA, 1329 bp, Candida albicans
  unsure (462): Identity of nucleotide sequences at the above locations are unknown.
atttctgtcaaaatgaatctgaaatcacaaccaagtatctaccccaagcgttacaagaaaaccaaaacgaatatgctcttccaactaccccccgaaattatggagattgtgcttgataatttgcatcaacgtgaattattacaaatatcccaaatcaacaaatactttcgacacttgacactcttacgtcagtactctgtgatttctattgactcaagtcctaagttgtttcaaagagatacaaaatcattaaatgattttcaagagttgcgtggtgtataccaacttgactattattccatcatagcagtaaacatttcgtcagtctattgtttgatacttttcttctcgacactaatagaaaatcctcaatatggggggttattcaaaatattccccgtccagcatttaccagacatccctgatttgcatgtggttgagtatttgccaaaaatcttgccnttgatgaatacattaaaagtatctcatggtgaacattcctaccccgtttccatgaagttgttgcaatacaatttacagctaacagctgtccgtggtaatattttgtgtgacaatatcaatatggatgcataccctttactcaatgaagctgtcttgactgttaccgattttcatttaccactacggaaactcacaataaaaaatgttgatttaaacaacatttctgtcaacacaacattgttaaagtcgttgactattgaaaattgttctaacgagaaagattttttaatcaaattggatgcccctcgtcttgaagatttgtccttatcgatagaagatcaaccattttttgcaaaaatgttctcccaattacatctcaaaagtttgaaattatcgatcccagaacaatgtgaaatgttgaaagttagccacatattaaattttttgaacaaagacatttccaggttggaaatttccaatcaacccgacagtcacagttacaagattttacctaaattcaacaatttagattatcttcatttatcagtattggaaaaagatatttacaaacttctttcgtcattaacgaaaaaattacggtttctttccttgaatgtacttgaggcaactgagagacgtaattgtttgattgcaagtgaattttgggaatgctcaatgattgacgagaatcaattaaaatacactgatttcattctagagtaccacagaaagttggatcgcttgaaatggctccgctttcaaggcaatgataccacatatatttttgaatgcaacgaatcagaaccaataattttccgtgatggattttatcattattttgatagaatagtaaacacattaatataa

SEQ ID NO: 11267 - DNA, 216 bp, Candida albicans
tatcagatatactattcccaaaacttaatgccttctcgtctaccctgtttatattcggttattttcagtttaaaatggtataggagaacacttttgttttggaaaatcaaaaccgatcatctccaccctgaaaccgcctttctctcaagaaagactattcatgcggttttgggactattacaaatgatctacagttattatctattgacattttaa

SEQ ID NO: 11268 - DNA, 234 bp, Candida albicans
tgttgttgtgtgattcatctgatttctgttacttgctttctagtatgttcttggatgttgggaaacaacgttaaaaacaaggttaaagagaaggagaggggaggaagaaaagagttgttaagaaacgtttcttatctgtctttgttttttggtgtaaactttatgttatttcattttttgattgatcgaggattatcagttgtacagacaacaggtatcaataacaatgaatag

SEQ ID NO: 11269 - DNA, 243 bp, Candida albicans
ccattgattaatttttttttggttgcaaagattataatagtggttagggataaaaagaagataaatagcaaccacttagatttgagtaatagagaatcaaatctctgtaagattttatttttattttttcagtgcaaagtacacgcaaaaactaacatttttgttaggggggaaaaaattgatttgcccaaagtacacgcctcttcaccacaaatatttttgccaccttcttccaagagttga

SEQ ID NO: 11270 - DNA, 876 bp, Candida albicans
ccgcccagtggcgtggtgaagacaaaggaagaaagggatgatagtattactggtgcttataaaaagaaagtaacatacaataggctgaataaactgaaatcaaaatcaaaatcaaactcaaactcaaactcaaactcaaactcaaactcaaactcaaactcaaactcaaactcaaactccaaaccaaaaccaaaaccaagaccaaaaccaaaaccaaaaccagtatcaaaaaatatactgaaaatcaatcaaacttctaatattaatccatggaatgaattattagataatatagaagaatcaactgtatatctacccaaaatatctttaattgatgatgaaaatgaatcagatgagaatgatcaagttcaaataggtgtcaataaagctcaagaaggaggagaaacaattacaacaactagtattataaatttacctatattattaaattttgataatgaaggagaagatgacgaagaagatgatgtagaagcagaagaagaagaagaaaatctacaacaacaattaattcaatcaagatctttatcaacatcaccttcaaattcaaattcaaattcactgaaaccgaataaaacatatgcacaagatcgaagttatttaattcttgatcaatcatatattgatgtaaaacaagaattaggtgaatatataagtcgaaaacatgattttgataacaataataatgatgacacagaggaggatggtgatgataaagatcacgaagatatcaataataataaactatcgtcctcttcttcttattcttcttcttctttttcttcttcttctggtggtggtagagtgatagatcctcatgtctttaattttcacctgcaaaatggcagagtacgggaa

SEQ ID NO: 11271 - DNA, 279 bp, Candida albicans
agtttatttttagttattatatatatttataagtcaatagataaaaagaccagtaatttccagtttcgttattatttttttttagaagttattaaagaatttggattattacttttaaacattttatcaagacctgaggatgtttattacgagacttggatatttccggcacgtgattgtcgtggtgggtcgagtgagcgagtgagtgagtgtacaacattttacactgtgacaataaacaataaatcagggcgtaaagacacgcacaaaagatcttaa

SEQ ID NO: 11272 - DNA, 294 bp, Candida albicans
aataatcagtatctatttatagatagtataaaattttttttggtacaatatatagatatatcaattatggttatgatagcggggaaaacacagtacaattataataagccgatgttgaactccttctcctttctgtttctattctcgaatcttagatttgacatgaatatacgtaaacagttttatgagttgcctaattttgaaaaagaaaaaaattatatcaaattgaatcaaacaagacagaaaaaggggaaacttctaaaagtatcaactaatggtccttatgataaatga

SEQ ID NO: 11273 - DNA, 201 bp, Candida albicans
aacaatatgtcgggattaacattaaatcaaattgaattaaatcaaataaaatcttcttggaataaaataaataaagtggatttttatcctgatttatatgttaatttatttgaattagatccacaattgcgttcaatttttaataataatgattcagtaattagtgtctacacgccgggagctggcaggaaacgcgtcgaa

SEQ ID NO: 11274 - DNA, 267 bp, Candida albicans
tgtcccgagcatgctcttctacggcgtgttgaaaagaactcggggaggtctggtggtgcaattgcattcactaatgatgagttgagaattattccacaaaccgacagtatgatgctcggtggttccgatactactgataaatgtacttgcaatcctctgactttccaccaacaaagagaagcagtaattgggtcttggactttggaggcttcggtaacaaaatccaagagtttggttggatcgcttctgctgaaaagggataattga

SEQ ID NO: 11275 - DNA, 807 bp, Candida albicans
gggactttatgcgcggatccgccggctccccgtggtgaagatgtgcctagtcgtagaagaggaaatccaaatttccgtcgtggtggtggtggagcaggagtctccaccagaggcaatcgtcatcatccatatcgatcaaatccttcaactagaagagacaccgattcatatattcctagaccagcagtttcatcatcttcttcaataccaaaacaagtatctttattagccaatggacgtccaacattaagaattaaaaacattcatccggaattaaatggtgaagatttatcaaatttattttctagtatatcaccagttgattttgttaaatttgatgatgataatgatactattgcatatatttgtttccaaaatgattgtgaaagaagtaatctggaagccattgctaaatttgatgggaaaaaagctatgggtaaaatacttattgtggaaaatactactagtttattagatagaattgatacaagaaatatcaatcatagaataacaagtaatggaccactgcattcatcacatcgttcttattctcattctcatcctagaggtactagttcaggtagacgtcctccaagagaaagaaaaatcggtggtggaactagacctgctaaaaagacagcagaagatttggataaagaattagaaaattatatgggtaacactactgatgctttagatcgggaattggataattatatgcatgagacaacaaccacaaacacaaatgaaccatcaggtgaacaagtagctacatctactacaaatgatgaaatgactcttgattga

SEQ ID NO: 11276 - DNA, 192 bp, Candida albicans
tgttataataataaatatgtcaaagaatctcaaagagagaaacagaaaaaaaaaaaatttttcaacccttttacttcacaattaacttttttaaaccttctttttttcttttctgtttttctttatattcttaatcaacaacaacaacaatcaataaatagacacttctactttattaactataaatattaa

SEQ ID NO: 11277 - DNA, 204 bp, Candida albicans
ttcgattccaacagaaagaatgaaaatacaggaaacaattgtattgaaattgttgaagggaaaaaaaaaatgcactcgagtgtgagtcgtgtattaatgcaattatcatggattgaattctactcatctctttctgatattatttttttttttttccttcttctcttgcagtgtgggataacagaatcgacaattgacaaataa

SEQ ID NO: 11278 - DNA, 210 bp, Candida albicans
ttcttgatctttgaaggaaataaaaatcaagttagaaagaaagaaaaggtataccgaaaggttaaaaaaaaaaatttaagaaaatccaatttgtgggtgggtgagtctggagttaaatacccgtcggtactaaatttggatcagttgcgtcaaagtgaatttgttgataatgcgggaaaagctgatacagagcaaaaacaaccaaaataa

SEQ ID NO: 11279 - DNA, 837 bp, Candida albicans
aaaccatttgaaaatgaacatggaaatcctatccctgccactaaattgttagatgaatcattatcagacataatcaatgatcgaattcaatacaacactcttttggacgataataagacaaatgaaggagtcattaatgtaaatgatgagttagcaatggaattaaaactgattatcactcaacagttttcaaattggatcacaccatttcctcatcagcctagtaaatcgattgatattgatgggttagtgatcagttcttgccatgataagaaaaatgagttgatatatttgagtagcaatgattgcaaagtctatgttattaaacagaaacaaattattcacactttgaaaatgccagtggttattaaaaagatattgactattgataatagcgataaaatggtgttagtgggaatgaatggaattttatatttaagagaaagaggtacactagaagaaattgatcaattccaagcacacaaaaggttaattgttgatgccaaatctatcacttttcaaaatcgcaactacttgattacattaggctgggatttccatcttcgattgattttgctaaatgaaaacaatactgatcaaaatgaggttcagagatttgaaatattatctgaattgaaattaaaacaacaggggtcatgcttagacgtgacagtgtatcaagatcaattggtgattatattaggtaaaacagaaaacacattattggatgttatcacaatgagtggaaaagattctcgtgagttgacattagttcataagatttccctcaatgacgctgaattcaccgcagcaggatttttcacccaagttgtttaa

SEQ ID NO: 11280 - DNA, 321 bp, Candida albicans
  unsure (52): Identity of nucleotide sequences at the above locations are unknown.
caaaatcttgccaatgaaccttccatcaaaagaaatcaaatcataaagaatntgaataccatgtctccccaagacagatactcgcaacccataatagcatggagactacaaaaatcggataataacaaagcaagtggagtatgggtgatgggtgatgatgggacaattagaggtattgatatagttgaagatcaagttatagttgagctcaaagacggtcaccaaggtaaaataaaagattttattacttttattgacgaggattcagtggagaagttgataacaagtggtatagatagggagatagtaacgtggagatga

SEQ ID NO: 11281 - DNA, 210 bp, Candida albicans
actatacataaccaacgatattacatgacttatctttatatacttattcattatgtctatcattcgtgtatgagatatgctacacaatacacacatacaattcataaagctcgtcgtattaacctaactaacatctcttggttgaatcttacaactcaatttccaagcacgatcttcttcagttttattcaattgacaaatcttccataa

SEQ ID NO: 11282 - DNA, 222 bp, Candida albicans
atcaacaaatctattgctaattgtggtacatttccaattgagacggaaggaattatcaaagtagagtgcttcaaatcaggattgaataccttcctcaatgaagtaccagatgaagatttcatgtttcacttcttagtatgtcgtgatagatcaatacttgtttttaactatgaaaaaaaaaaaaagaataaagtgatctgtttcatttttttccgcgattga

SEQ ID NO: 11283 - DNA, 309 bp, Candida albicans
ttttattttttttttttcttcttttttgcagcacttcgaaccgaaaacacatgcaaatacgaccatgccagcaatcatcaaatgcacctgcgtcaggtctcaattggtttagttagtgagtgcctaataagtttcttgttgtttttttgtatcacacctccaataccgaattataaggttaaattgaatagatttgctttttttgcttctgatttttttactctgcaactaactactattataagaacaattgataaacatttattcaaccttaaatacaataaggttgattgtaatgaatgtggctaa

SEQ ID NO: 11284 - DNA, 186 bp, Candida albicans
ctttcaactcaattgacaaccaagttggttctagaggctttgtttttccaaataatcatcaatctacgattaaaagaacccaaattagtgtttacaactacacttgcgagacatttaatttatcgaatcgaagggtctaatattgacatcaaagattcagttaaaaattcgcccatcggcatctaa

SEQ ID NO: 11285 - DNA, 210 bp, Candida albicans
tattattctagtggttttaaaacaaagttccaccaccaacccccttccaccaccacctacttcccctttttttttgcaatattaatacttgctgaattgaaacattatatattccctacagtttaccctttagaagaagaaagatttttacagacgatttcttctatttttatattcttttgtttctttttgccattttcagtattttaa

SEQ ID NO: 11286 - DNA, 213 bp, Candida albicans
aatcttttatcactttattttaacgttgtggttaatacaaaaattttacattggttggtttctcggcttgtctattttaatcagcaacaaatctggttttccatgaggggtgttttaagaattaatagtattattctagtggttttaaaacaaagttccaccaccaacccccttccaccaccacctacttcccctttttttttgcaatattaa

SEQ ID NO: 11287 - DNA, 186 bp, Candida albicans
tttgttacagaacatatagctgtaatatcgtttgcattcacattcaatggcgatttaccctttcattgcaaaactaaccaatttaataacgatacaaatacacataaaaattatgtatctaaactttgtaagcaaaaagttttagtaaacaaattgagaaatacaattgtaagaattatccattag

SEQ ID NO: 11288 - DNA, 687 bp, Candida albicans
  unsure (538): Identity of nucleotide sequences at the above locations are unknown.
ttcacaatcattatgtcaactactaccacatcacaaattaatacgaacccaataactcatcaaccacccccaaacaatccaattcaatttatatcattaatttctcgtaatgataaaccattatatatccaagcattcaatattggtgaagaagaagaagaagaagaaaaacaaggagaaaaacaagaaggaaatacaactccaatgaatcatacaaatgctgataaatttttaaaatataattttttaagtcatatggcattagatatttttacatcaccatcatcattaagtttacgtgaacaacaacaacaacaacaacaacaacaagatactcatcaaaatggtgatcaaataccagttatacttttatttattcaagatcaagttatggtttatggatatgaaactaataatggattaaaaatagtcattggattagatcaaactagaaattttaatgataatggtaatggtaatcatcaaaattcattgacaaaattacggaaattatttttagatgtacaaaaatgttatntacgaacaatttttaatccattaaatcaaatatacatcaatctgggaactgggatcagtcttaatgacgatgatgatggtgatgatagtattttacaatctcatacatttgatagaaatattaaaaaattagttaattcatatatatag

SEQ ID NO: 11289 - DNA, 231 bp, Candida albicans
atgattgatagtcatcatcatcatcatcttcttcttctcctttccccacaaaatcaatgccgagatgggtctcgcactaatagttcatacccgggtccaagtaccctttttcaaatccacactttttccaataaagcctccccccaagcaaaaaaaaaaaaaaaaaaaaatttctcaccaatcgttgaaccaataaaactaatcaagtctccaactaaacgaacggaatag

SEQ ID NO: 11290 - DNA, 228 bp, Candida albicans
aagatttggttatcttcatactattatccattgacattgtttccattttttttttttacacacatttatgaattgtttattattgatttatctataatcttgttttttgtttgcttttttttttacaaaaattttgctttagaattgtattataaaaccataaccatacccaaacctatttatctatctatttatttatttattttgcatagtttagttcttttatga

SEQ ID NO: 11291 - DNA, 387 bp, Candida albicans
  unsure (43),(47),(50),(53): Identity of nucleotide sequences at the above locations are unknown.
agtttcgctggtacgcggataactaacccgtggtcggtcctgntaanacnagnaccagtgggaccaaccttgagtaaaattccaaattcatcattagggaaattggaaattacaccattcgacgactctgagccacaacagcaacaaccacctactaatgaaagtccctttgcatcatcaccatttggctcttctaaggttgtaaggaagagaaaaacatcacttgggaaaatagtttcagtaaaggataaccttggattggtgatgcttgcagtttctgatgtggaaaagtgccaaatttataaactcgaactaccttcatttgaaggcggaactcaattcatcggcgttaaagttggtattcccgattggtggccagtaaattga

SEQ ID NO: 11292 - DNA, 270 bp, Candida albicans
attctttatttcttccaccaattgttgtttataaatttttatatttttattttttttttcattttacaaccatcaacagtttctttatttttatatatatttgaaaatatcattaaacaaatggcagcaagtgatactcaatctacttcagatgaaacaactccattggtaagatctgatgaatctcgttatattcccaaagatcaaattgaatatgaatttggtggtccaattggtgccttggggatgatgattggattctctctttaa

SEQ ID NO: 11293 - DNA, 372 bp, Candida albicans
tcgctatggaaaaaaaaaatcttgaacattggaagagatggaaaaacaaaaaaaaatccctcaaatgaatctctctttgtgtcaatttgtcgatttgaccgggtttaccaaagatggataataaaatatcacaaagacggaatcaaaaaaaatgtaaagaaaccagatgttgaattttccgaggctaacaaaacaacaacgaaaacgaaaaatgaaaaacgaaaacggacacattcacagatgtcaaagaagataatcgactattgtcagtcttcaaatcctaatcaactggttatgtatgtatctatggctattatcttagatatcacaaattctgggatcctgttctcgtgcctgaaaaaaataaaataa

SEQ ID NO: 11294 - DNA, 294 bp, Candida albicans
  unsure (153),(155): Identity of nucleotide sequences at the above locations are unknown.
ttccgtctttgtgatattttattatccatctttggtaaacccggtcaaatcgacaaattgacacaaagagagattcatttgagggatttttttttgtttttccatctcttccaatgttcaagattttttttttccatagcgactaataagagnanagaagatacagataatgatgtcttcgtctgttgctgctgctgctgctgctgctcattcatccaattgaagggtcacagtaagttgtcaatgtgtagtttagatcaacacaatttttcttttcttttcttttttgaataa

SEQ ID NO: 11295 - DNA, 216 bp, Candida albicans
aagaaaaagttagacaagaagtggaaaccacagttgactaattgtcaagatttatatgtgatcaggtgtaggcaagggccaaagataaaaggaaataaaaaggcaccaacaaacaaaacaatggacagagagggtgaggaaagaaaatccgaaaacaaaacaaaacaaaataaaacgacaaaaaaagtgatgaatgtaaagttgacagcgagataa

SEQ ID NO: 11296 - DNA, 201 bp, Candida albicans
gtcttttgttttcaacaaaagattagtatagaatcaagtgtaaactcacatttgtgtttttatgcttttgttagggctttaaacatttgcaatttcgtaccaaattgtagtcagacatcgcacgaattacaccgacacaaacccatcagtgtaggcggaatactcgcagtaaaaaaaaccacacacgaaaaaaagagctga

SEQ ID NO: 11297 - DNA, 915 bp, Candida albicans
gggacttttatcaagttgatcaatcgagacaattgcaagaccacaatgtcaagtgatattgagaactttttaaagataaactcacaaacagttaaattagatgatgatgataatagttttttctttaatttgaataccacatcaatgggtgaagtgaatttcaatttcaaaaacgaaattttatcaaacgacttgatttatacattaattgggtataattttgatcctaccacaaatagtgaattaaagagttctatttccatgaactttataaatgaagagatcaatgttattgatgagtttttcaagaatgatttattgaattttttgagtacagattttcatgccggtctcgatgacgataatggggaagaagatgatgacgaagaagctggtcctggttctactcacccaatgggtgcaactggatctcaaggttctttatctccagaacccgtgtcgactggtaacccttcagttccacccactaggaatacatcaatatctgaagttaacgcacagaataagcgtgggaatgaggctgtgttgactccgaaagaaactgcgaaattaaattcattaataagcttgattgataaacgattgctttctaatcagttcaagtccaaatatccaatcttgatgtacaacaattgcatttcatatattttaaatgatattttgaaacatatatttttaaaacaacaacagcaacagttacaaagttcttctagtcaactacatgacacccaacccttgacacaacaagacacagcccaaggaattggcagtagttcatcaaacgccaacaatactaatagtagttttgggaattggtgggtcttcaattcatttatacaggagtacatgagtttaattggagaattagttggtttacatgataatttagtatag

SEQ ID NO: 11298 - DNA, 186 bp, Candida albicans
gggtgttacacttggaggaataatttcagcggggagttagagagattagatgcggcgaagttcccgagagagaagtctgcaatttttttggttttagttaagaaatggatcaatttgaacgatttattgagggacttttatcaagttgatcaatcgagacaattgcaagaccacaatgtcaagtga

SEQ ID NO: 11299 - DNA, 240 bp, Candida albicans
aaaaagaaagatcaaaatgatgcgctccaaccaaatgaatattttaaaaataataattatctattaaatccttttattgtttccaactctggttttcagaagaaatcaattgtttgctttataaaactaattaatgaaaaaaaaatactatataatattaataaaaaaataaagattaaaccaaaaaaacaaaaacaagacaaaaacaaaaagtcacaaaacttaactgaggcaaattaa

SEQ ID NO: 11300 - DNA, 294 bp, Candida albicans
tgggatatttttaatgacatgttcaatcaaataacaacggttggggggactataattctactggagagacccacaagggattcattcaacctggactataatttatttatttatttatttactacaaagccaataatcacgatattttttacaacgattatggtatacatacatttgaatagatttgtacttttgttaattacatttttgaagtttgttagaactctttccataaatttattgttgtggcaatcttatcaggtaaaaaaattattagatcattcaattaactaa

SEQ ID NO: 11301 - DNA, 438 bp, Candida albicans
agtatttttttttctgggtatggtcagctcactataattagaaatataattccaaaaatgccttctttatctgatttggattatgagaaccctgtcaagattgcttcgactcaaatagaaactgtggctatcatcggtggtggagcatctggagcaattattctagacactttgttaaaagaaccatcaaacatcaaaaaaatagttgtatttgaaagacaaaagaaattaggcggtatttggctctttaataaagacattagatcgactcctaatgatctcatcaaatcgggtagttataatttggagaatgatccacaattgcctaatccattccataagcaacaagaaaaagctaagagaattttattacctataaacaccccaagatatgtttattggaaaccccaagtttattatggaaatcaccaccaacat

SEQ ID NO: 11302 - DNA, 420 bp, Candida albicans
tactactttccgttaataacattcacaatgatgacctctagaaaacgtacatttgaagaattttcaacatctcactcttttccattttctgaagataccaattcaaccagaaccaatatattcaattgttttcctccatcgtctccaccgccaaccactaccaccagcagtagttacgatttctacaacacatccatggatgatagttcatgtggtgaaaaacggtttcagaaacataaaatacacagtgagatacatacaaccactatagaaatgatgatgaatgctcaattacaactacaacgacaagaaaaattgcaacgtccacaacaacaaccacagcagcaacaagaagaagtagaactggatggtgaacataacaatggagaatcaacttatcaccagtgtccatactggtaa

SEQ ID NO: 11303 - DNA, 288 bp, Candida albicans
ttcacattatatataagatctggtttttcaattactttgcaatatcatgcagtaatgcctttgcaacagccacaaggacaatcggtattaatgcataaagatatcagctcttcaattgtttgcaacaatttacttaccagtatggacactggtgataagttgattctccattgttatgttcaccatccagttctacttcttcttgttgctgctgtggttgttgttgtggacgttgcaatttttcttgtcgttgtagttgtaattgagcattcatcatcatttctatag

SEQ ID NO: 11304 - DNA, 192 bp, Candida albicans
cagatgacgtcagtaaaacaacgcgagataattaggatcgcgaatgagatgggtagagacgagaaagccagattagcggaagacaagggggcgtataaccgagaagggccaaaccggggacccgagaggagcggcaaggtatcgagagaacgcgccctgaggcgaacaagttgggagccaagaggagagtaa

SEQ ID NO: 11305 - DNA, 201 bp, Candida albicans
gaacggggtgggataggtcgtggaggtgaccagggaaagggcgtcagtcatgtcgaatacaacggcgaccgaagggaaacgagaagagggagacgctatgtggacagaatggaatcagtgacggagagggtgagagagaatcatagaggggactccgtcgctagtagctatactcaggcagagataaacccagggacatga

SEQ ID NO: 11306 - DNA, 243 bp, Candida albicans
caatgccttccgctagattcattcttatttggtgctatgatccagtttttgaaaaacctcggttttattattggattcggttatacgggggaaaagttcgtagcagataagaacaatacaaatagcaataaagatatgggtgaatgggctagtgaatctcttatcgtgagcaaagtacgaaacactagaaaaaaggggagagggagaagagaatgtgtgcttgagacggctatagtgaactga

SEQ ID NO: 11307 - DNA, 201 bp, Candida albicans
gtgttaaaaaatcaaggagggagagaagggagtgtgtttagtttgagtgaattgaggcgacccaaatgtacattaaccacttggccaaaaaaaaaaagagaagaaagaagaatgcgtgtattttttactaaatccattttgtatttctttgattttgtgctcacgtacacgcatcgttttaaaccgcgaaaaataaaataa

SEQ ID NO: 11308 - DNA, 183 bp, Candida albicans
aacattccatactgtgatttggttggtcgtcgtcttttcttcttcacagatcaagtcagaccaattaactcgcaaaccacagatgaaaaaatgaaatgcaaaaccaaaaaaatatatgctagactactgttgttgttgttgtatcacgttgcaatgttttacaagaattcatttattgggtga

SEQ ID NO: 11309 - DNA, 192 bp, Candida albicans
tcggttgataataaaagtgaaaacaacttgtcaaggaagttaaaaacaaagaatcaaataaaaaaagttaagatgagaataaataaacaatctggagggaaagtaaaaaaaaagaaaaagaaggttcaaaatcaaaacattgtaaaacagaaagaaatagatttttttttttgcttcttgatgcgattctaa

SEQ ID NO: 11310 - DNA, 1686 bp, Candida albicans
caaaagccattgttgattttaaataggtatatccaaatatttacaataactgtcagaataacaataaaaaaaaatataaaacaaacaaaattggatctcaagaaatatgtaaacgtcaaatttttttttgttattctttgcaatcaggttgcggataggaaaccattttctagctataatttctatgtttctatcaatggggaaagtctaatttatcattattacacaatgcattttacaagtagcctactagccaccttgatatggtttacattaccggttcaaagtttgaatactgaatctaggacaacttcaaataacacaatatcaatacttacaaaccattttcaaatactaaaggatttgctaccatatagcaaaacttctaaaccgcaaatcaatgaatccagaccgttgattaaagttctgagagatggagtgccaattaatttccacatggctccggctataataatgaaatcgaacaaaacagacgatttagtcaggaatagcaataaaacaatggtgctaactgaaataaaaacgattactgaatttgcaactaccactgtttcccctacacaagaatttcaagcactacagataaaccttaacacgttatcaatagagacttcaacaccaacattccaatcccatgactttccaccgattaccattgaagacacacccaaaacactagaaccagaagaatcgtcagatgctttgcagagggatgcatttgatcaaattaagaaactagaaaaattggtattggatttgagacttgaaatgaaagagcaacaaaagagtttcaacgatcaattagtggatatatataccgcaagaagtattgttccaatttatactacacatatcgtcacttcggcgattccatcgtatgtaccaaaagaagaagtaatggtttcacatgatactgcaccaattgtaagtcgtcctagaacagatattccagtatctcaacgaattgatactatctcaaaacataaaatgaatggaaaaaatatattgaacaacaatcctccgcccaattcagttttaatagttcctcagtttcagttccatgaaagaatggccaccaaaaccgaagtagcttatatgaaaccaaaaattgtctggaccaactttccaaccactactgcaacgtcaatgtttgacaattttattttaaaaaatcttgttgacgaaacggattctgaaattgatagtggtgaaactgaattgtctgacgattattattactattatagttacgaagatgatggtaaagaagacgatagtgatgagattacggctcaaatactattatccaattcagaattaggcacgaagacgccaaattttgaggatccttttgaacaaatcaatattgaagacaataaagtaatatctgttaatacaccaaagacaaagaaacctactacaacagtatttggcacttctactagtgcattatcaacttttgaaagtacaatatttgaaattcccaaattcttttatggtagcagaagaaaacaaccgagctcattcaaaaataagaacagtacaatcaaatttgatgtgtttgattggatatttgaaagtggtactaccaatgagaaagtacatggattagtgttggtgtctagtggtgttctactaggaacttgtctattgttcattttgtaa

SEQ ID NO: 11311 - DNA, 189 bp, Candida albicans
cttgtcaaaagaaaaaaaagtaaactaaagttggaaagtcaagttttttggttaaagcgttgtctccctcagagagttgaatttttttctttttcctctcagtcaattttttttataaactctctcaactccaggttaagtaaacagacaggcaggcaaacagcttttttgtttgtttgtggcaattaa

SEQ ID NO: 11312 - DNA, 243 bp, Candida albicans
caagtagtaatttgtgttcaaatatgtatatgtatatgcattctacataagcaatttggtaacaaattaacatgcatagacgagttttgtgattacttttccattactacactacaagacattgagcaattgtttgttgttgtccaatcgatatctaagatatattttcttaattgggtttgtttcaagactgtttcaatctcaactgtttttgttcacttagtatgtgctaccaccagttaa

SEQ ID NO: 11313 - DNA, 195 bp, Candida albicans
atatctttcacagattgctttattttagataaaataaagacacgtacaagggttgtgttcattttttatcaaaatatcaagtttataagggatttacaacatgcaaaatactataatctttctcaacagaacaaaccaagagctcacgtgactcaaacaaaagttagtgtatcaccactaccatgcaaacaatag

SEQ ID NO: 11314 - DNA, 204 bp, Candida albicans
cttatttcaatatacagtaccctgaaatttgattgtgtttaccaaattaattttattggacgattagatttcgttatcagtgatttacctgcatatagacacgtttttccgattttgtgtaatacgactagtaaacaattttttttttttcctccaccaagtttgaaaacaatttattattgcatctcaatcattcttttttag

SEQ ID NO: 11315 - DNA, 288 bp, Candida albicans
ctttggttatgtagacaacacaacaacaaatgccttataatttgtattatacataatcacacagctgttaaagtaaagcgttatcgttatccaataatctatcactgtgactttcaagtagtcaagaccaatggagtttttcatatagcacaagacgtttttagtttgcaaatgaaaccaaaaaaataccttttccatttatcggaattccctcttttgattcagtcaattggtagtgctacagttgtacatgtctcaattctaaaaaaaagtacaaagacaagataa

SEQ ID NO: 11316 - DNA, 213 bp, Candida albicans
aaattattaggcaatttgcaatacaatttgtaccatagtcatcaatatcatgttacaaatttcaacactctttccttttcatttagttcttttcaagaattgtataaatatttctgtacttctcctagttttccaatttttcatttaatctttcatattcttctttttccttttttatttgatttgttatctttatctttaactttcatttaa

SEQ ID NO: 11317 - DNA, 1056 bp, Candida albicans
atcaatcgtattccatataacaacccacaaccactactacaaccactactacaaccactactacaaccactactacaactgccttttcttacaatatggctaccacacctgaaggtatgtttggatattaatacacttctgtttgaaactatagtactaacaatattatcattattaatagtaactgattccaatggtagacgtgatcatcccagatatagattagctggggttaaaagattgatgcaaggtcaaaatagaaagagtagtatgaataaccacaccgacagaagtacatatagtaataacactagtgataataaggaggatgatacccatcacaataacaataacaattacagtaatgtgaatagatctcgacattccaatagacaatcaagaaataaacttgtatctaacaaaaaccgagataagattcccaaaactgaagtggtgattgaaagtcacgataacaaccccattcaaagccagtcagtacaagaaaacaacaatattgacaatgacgaacaagatgaaggagaagaaagaaactcattagatgtgatgagtgaccaaattagtgataatgttagtacaactccattgaaatcaatagtatcaagtcaatcaacaaaatctccatctattttgagtggtgatgctcataatgatcaaacttctttgattgcatcaaccgcagaaacctcattggctccaagtgtacaaactccaactaattacacttttcttcccataattactgctagtctaactaatactacatcgtcttcttcaaccaccacaaccacaaccaccaccacaacaacaacaaacaataataacaatgcaactaccaacaacaacaacaataataatacaattttgccagttacatataatgcaagtatcggtggtcaggaccgtgatagtgaatccattgtgacattggctagttctacaagaagaataagaagaagaagtattgataccaattgtagtactacaggtattccgccagcgtcaattatggaaagattaagtgtttcaccctggtaa

SEQ ID NO: 11318 - DNA, 270 bp, Candida albicans
gtcaagaattttttgagtatccatttgatgacagaattcaatgaattacaattatcacaaaccaaagtattcaaaaacagattaaacaaggaagatgaagatccaacaataaaaccagaattatcaaaaccattaacacataaatcaacggggacaccattactaacattagtacccaaatattttatatcagtaaatgtattcaatgaaggatcaaaagaaccaaattcaaatggattcatttcaataacagtagaattcaaattataa

SEQ ID NO: 11319 - DNA, 198 bp, Candida albicans
aatggacaactttgccaatatcccactttaattaatttatctatcccatcacaatcattgaaaaataaattccaattaataaagccaaatttaaattttaaatttggaattgatgataaaataaattttggtatttcaattaaagcattaattttaatattaataatatcattacctttattatcaattgttgaataa

SEQ ID NO: 11320 - DNA, 852 bp, Candida albicans
  unsure (750),(835): Identity of nucleotide sequences at the above locations are unknown.
ctttcagacattttattcatttttaaagttaaagttttggtggtgatattatatcttaattattctcatcactacttacaactacaactacaactacaactacagacacttactacttacttacaaatttatactttttttaagggttgttgtatcatttgcaaaataatgatgagtataacaagaactagtactgccactacaacaaccacaacagcatcagacatttctcaaatggaaattaaagagctggaaatagaacctagacctaaaagtacagataataattcttgttcttgttctagttctagttcttcatccttaataccatctaacaccactaaatctaatcatattcataaaccaatagctagaagaaatattcccattgaattgaaagacgataatattgatggtttaaaccccacagaaaaagaaaataatatgacaaaatgtatccccaatacaaaaattgattcttcttcttcttctactaattcaacttcaactccacttataccttctgatattcatcgtgcatgtaaaagatcttcatcttcttcaaatgatctaatatatgaaagagatagatttagagctagattgaaaagttttaatgatacacaactgcataataatcaacatgaacctccaccaggaacaacaacaaaaatggaatcgacttctaactccaccattaatggaattaatgaactgtgtgaaatatgtgatgaaataagtgttactgtnaaaacagcaaaattaaatattgataaaaatccacttgataattcaacaatgttttataaactgctacccaattattatcccgatnaggaaaaatggatgata

SEQ ID NO: 11321 - DNA, 294 bp, Candida albicans
tgttttattgttgcagaagagaatttcatttttggttttctttctttctttctttctttctttcttgtgagagagaaattaaaacgcaacacgcggagatttaatttttatttaagccccatagtaattcttatctttgtatttatctttttatctttttatctatctataaccaccatcattcatccacattatccacattattacttaatctcacactcctctattaaccatttgatgtgtatgtgtatctacagtttatacagtttatttttagtaagctttcaattataa

SEQ ID NO: 11322 - DNA, 267 bp, Candida albicans
gaatatagaaagagttgtcaacgtgatcctctcttcctttcttttcttcaccccttatctcttctctcaagtactcactttaatttatactacattctcatattgttaaaacctcttctcttggtttactcagatgagctattgatcaatgtttttcctacacatgtatcatttgtaaatattaatattcttgttccttcagggaactcctttaaatctaacaagagtaaagaagtgattgatagtgttcttaccatgagactctaa

SEQ ID NO: 11323 - DNA, 1368 bp, Candida albicans
tactttttgtacattgatataatgagtgataatgaaattaaatcatcttcaatgcatcatcaccgtcatcatcatcatcatcaactgcaattgcaagaggaacaactcttaaccaatgaagacaactcctattctcaaaaccaaaataaagatagcagtgatagttgcttaactgctccacttataactgatataaacaccactaataatggcatacaacttaatcaagaacaaccattagtaccatatgattcatcaaatgaagaaaccccgttattattaaataattcaatatccactatcaccaccaccactaccaccactaagtcatcacaatcaacatgcttcacttggtattatattataataataataacatctataatattgattggattattatggggtggtattatttataatattgttcataacattgaatcatcaattaacgattccattcaatttaatcttgatcaagtatcgattcaactgataacttctcaaggtatcaatattcatatattaggttcaattgatattaattataatgatattattaatctgattcaacggaattcaattaaattgattactgggatatttggtagtttaacaattataaatttacaacccattgaaatttatagtaaatttattgatttagaagaaaatgacaacctgtcgtttattccattggtggattcttatattccttcaatacaaccaattgatattaaaattgggaatttacaaactactgatattgatattatatcatcttgtaaatttattaataatgaaaattttatgaaatttttaaatgattattataaattacaaaatgatgatgatgatgatgaggaggatgataaaattaatttgaaaattaaaggattagttaaacaagtcaaaattaaattatggtggatgattctgtatgatgtggaaaatattgaattttataaagatgtaacaatttataaacatgatattatacctacagttaatattgataaatttaatctttattcaacaattgataataaaggtaatgatattattaatattaaaattaatgctttaattgaaataccaaaatttattttatcatcaattccaaatttaaaatttaaatttggctttattaattggaatttatttttcaatgattgtgatgggatagataaattaattaaagtgggatattggcaaagttgtccatttcaaatagtacaccaagaaagagaaaacctatatcaacctattttattgacagtcatagggaatatatcatctatacctgatgaattaatgaatgaatgtcctaataataatgatggtacaagtcccataaataaaatatga

SEQ ID NO: 11324 - DNA, 1107 bp, Candida albicans
caaaaatatttagataatgaacccattgaattttatctaccattgttaagttatgtagatgaacacgataatgggatacctgattggttattaaatttttacatgaatacccaatttaatttaactataacattaccgaaaatgaatatagatcaatttgattttcatgaaaatcttgaaattataaatcattcatctgaagtttcgataatgaataatgatcaatttttagttagtcattggaattctaatatttcaacattaattacaacaataaaaccattcaaactggtagatttggatataaataaatttaaatttgattttgaaatatcgtctattgataataatgttttagttaaagtcaattctaatgatgaatatatttatataactatgattaatgataatcaagaattgattaatatggttatgaatttaccaaatttgaatatttcaataattgatgcccaccaaatgggcaatattatcaataaactactcaatagggattatacggataacgatggagaaaaagaaccggacttgtttattgaaggtaatgtatatgacgtatatgggaatttaccaatatggaaaaacaacaacaacaacaacaagcaaaggaagttgattgatcatttatatataccattgatgaaattaccaaaattatcaactatggaaagttttccagcttatactttggatacgttatcaaatttaactattacaataacaaacctttatttaattgaatcaactattcgaaaacttgaattatcaattgatttaactatttataatccaaccaatttcaacattaatttagattcatcaatattaatagattcaataatttggcaaatttttaaaaatgattcattaattagttcaataaaagtatcaataccggacactaaaggtggaaatggaaatggaaatgaaaatggaaatggaaatttattcatccatattcaagattatttcaatacaactatgaagataaatatttactcattaaattatcgagataaatcaatattagaaaattcaataagttcattcatatcaaatgatcagttctccaatatctccgtttattga

SEQ ID NO: 11325 - DNA, 192 bp, Candida albicans
agaggagcagattctgattttgaaatgtttaaatgtggtaccaagacaccacaaacagaagttaccgtggaagataacgattctggaggtatttgtatgcttttggtcttctccgggttagaattgtattccacttttggtaaacttaaaaaatttgaaattcgtttagcttctaataatgcaataaaataa

SEQ ID NO: 11326 - DNA, 201 bp, Candida albicans
aagttagaaaagttttacaataatttccaattgctctctatatatttatatcacaaagttcataaaacaatcaatctcgaacaatgcaacaatacaaaaacttacgactacgaaatgcttcatgttgttgctgtggctgttgttgctattaataacagattaggttacattcctcaacaagttacgagaagtacaaactag

SEQ ID NO: 11327 - DNA, 183 bp, Candida albicans
attagagatatacacaaaaatggaatgcaagcatatgaaagttttattgactctataagtatcagcaaattagaacacaatattagaaatctctttctaagggtttttcaaaaaaggaaatttactgttgatgagcttgctccagttgttttgtgtttgtgtctgttacatgaaatttcataa

SEQ ID NO: 11328 - DNA, 192 bp, Candida albicans
tatttccaacgccggtttagcttgaagaatcggtttcttaccccggataagaactccatcgatatcgaaaacaaaagcaaaatcgtgtcccttgtgatcacaaccggtaatccttttgttcaaattaacgacggtggtgtggaattgactgtaagaaattctaggaatggctctagttggaattattggtaa

SEQ ID NO: 11329 - DNA, 270 bp, Candida albicans
cggatttccaccgatagggtagaattacaagataacgacgaccatggtccatcattacctaacagaccgaagggtgaacttcaatcagatactcccactttgactactagagaaaagggagccactgataaaaagaagtggcagccattggagtctggagtttctgcagatcctgatgcattcttagttactgacagtgaagacgatggtgaagatgttgcaactacagacgctactaaaaacaccacaattagctccacaaaaaagtaa

SEQ ID NO: 11330 - DNA, 201 bp, Candida albicans
agagatttggtaaataatcaaaactcaaaaagaatggaagacgatgaaatagacgaaaataattttacaggtttgtgtcgtgacgtttccttaacaacgataccgataacaattctaatgtacattatctttataatagaacaacgtaaaattaaaaaaagggaaaactttgtggaatgggtatctctaaatactacataa

SEQ ID NO: 11331 - DNA, 276 bp, Candida albicans
atgaaaaagtttaatttatcatttggtatattattattatttttttttggtcttaatatctttaatttatattgcttcctaagagaaaatgatcttaacgcatttaatatgtcatacaagggagtaaaaatatctgacattgaatatcttttatacgtgtttaacataattgatattctttcacttagtcgggtttataaaatgcttacgcacattaatttaaatggaagatttcattttcgtgtgttgttaaacggaaatacacatgatatctag

SEQ ID NO: 11332 - DNA, 432 bp, Candida albicans
agtatgactttttctacccttaatggtgatttaaatcatcatacactttctacaatggatactttgtccaaaacatatccaatcgattcatcaacactgtttgccaaagccatttttgaaaacttcaaacaaactttcacatcaacaaataatagtcatactactactactaaagtatcgatgtttgagccaatatctagttttactactgttgatactactcaatctacaataattccatatcgatgtgaaaactctatttttagaaagaaagcaaaactggttgattgtccatctactgaagaattggaaatgagtcttgagatttggaaaatagaaggaaatgatcaatattcaggtgaacaaagaagacattttaagccattcaaagtattatttgatagaattagagaccagggaataaataaataa

SEQ ID NO: 11333 - DNA, 219 bp, Candida albicans
acccgactaagtgaaagaatatcaattatgttaaacacgtataaaagatattcaatgtcagatatttttactcccttgtatgacatattaaatgcgttaagatcattttctcttaggaagcaatataaattaaagatattaagaccaaaaaaaaataataataatataccaaatgataaattaaactttttcatttatagagataaagttctaaagtaa

SEQ ID NO: 11334 - DNA, 213 bp, Candida albicans
agtactaacaataataataataagtatggtagcagtagaaaggggggagaacattgtaaattgcacaaaactaaaacttatcatcacgcacttttcatttccttctttctttctttctcctcccaccattgcttttcatctttgttagcttgttcatttttttatttgcatagtcaagcattatcgcaaactatttgtttttacttcttataa

SEQ ID NO: 11335 - DNA, 237 bp, Candida albicans
ccccataacgccaacagacatcaacacaaatttatagcacatgtgtgtggagttatgtgtcacatccgcggtttgatatcggaggagagcggagtgaatcaagataagcccgagacttgttgtaaaacaggatctggaatattttatgtgcagtcctttcgaattcaattcagagagttcgacgaatcctttattattgctattttattattctctattatatactacttttcttag

SEQ ID NO: 11336 - DNA, 237 bp, Candida albicans
ctcaattacattatagcccgttttaagcttaatgatagtggtggggctttgcctgcagctaatagacagaaacaagaggtcgacaccacttcatcccacaagaaattgatcatattaccaactactacatcacatgatcgattgataattgttatatgctttaattacaccaagtcgagatgctcgacaattaaatccctcagctacaccacgacaatgtgtgttggcatctcttag

SEQ ID NO: 11337 - DNA, 312 bp, Candida albicans
atttcctacttttctttgtttttatctcatatatatttcaattactttgcccccattttttttcattcttattacttgaaattttcattattcactatatatatatattcacttacaaatcatcaaacatcaacttccaaccatcttgttatttttcttatcaagattaacgagattcataaagaacaattcactgaactagtcacattaattggttacaactactaccagtgttattattattattataattacaaattctctacaacagtgtttatctttcagttacagaatagagagaaaatattgtaa

SEQ ID NO: 11338 - DNA, 1932 bp, Candida albicans
tttcaagaaataaacaagcattaccaaatcatgtcattatcaacatcaacatcaacaaagccaaaggcaccaccatcaacaacaatagcactggtaacatcaccatcttcaccatcattgaaattgtttaaatccaaaagaaagataaaaaatctcaaaaatttaacaataattggtccattgagtgaacaacaaccaggtaagaatgttaaagtgattacaacaacaacaacaacaacaacaacatcaccttcctctttctcatcatcatcatcattgatgtcacctattacatcacaaactccaaatattcccaaaacaccaaaaacaccaaaacattcaaaacatgcaagtagtggaacatcatcaataatagctgatatacaatctatatctttaccatcaataacaaaatcattattaccaaattcctcatcatcatcatcaacatcaacaccaacatcattagccaaaacattatccatgccaatgttattcaatcaagaaaagcattccaaatttccacaactagaagaaaataacaataacaaggaggaagaagaagaagaagaagaaaaagaagggggtttaattgatttaactaataaaagtattattttaataaccaaatatgattttattagtgatgataaagatcaattaaatattaaggcgaaacaatttttaaaattattacaaaaattaggtaatggatggttattagttcatgatttatatgataaatccaaattaggattaattcctgcttcttacgttgatattgctttaaatgacccattagaaccaattaaattgacttggttatatgaatatagcaagcaaaaaccactactgctgctgctgccaccaccaccatctactaaacaattgggaattgaagaaacattaaatgaaccactatcaccactaccaccaccaccatcatcatcaccctttataatgattgagaataacaatacatcaaaaagtttaagatttgaaattgatcaaattttttataataaatcaaataaatcattttggtataaaatcaaatattatgataatttaaatcatcaaattatttatttaggtaaattttataaagatttttatcaattacatgatggaataatatcccaatataataataataataataataataataataataataatgctaataatattaacaataaaaatacaaatgatttatcaattaaattaccaccaccaattttaagaaattctttatatcattcaccaaatgttaaatttgataaaaatttaattgaaaattcttataaattattaattagattaaatgattatttaaatcaattaataaatcattggcccaatatattgaatgaatgtcctaaatttcatgattttatttataattgtaataatataattgttaataataataataataataaaggaacaactccaacaacaatcataactaatgaaacaataattaaatcattttatccaaattcaattatgataaataaaaatattcatgataattctgttacgttttcaaaaactgctccattacctaaattatcaaccataacaacaaaacaaatgagtaataatataagaccaacatcaatcaatattagtactacaaaaacaccaacaactactagtactaccaataaaccagtgattgctagtcctaccactaatagtaatcggatttttagattacctgatcaatatattaataattcaacatatattgaccaactcagtaagaaaataagagataatactactattaatagtactagtactacaaccaccactgccaaggcaaataatactaaaaatcttgataatttatctactattgttcattcagaaagtgacaaatcattatttagtattcaccacgggctggaaggaccgcgtcgg

SEQ ID NO: 11339 - DNA, 195 bp, Candida albicans
ttctcatttggtttgtgtgactataacttttgtattttatgggggtttgacaagagtactagtcttcatgtgttcaagttacattccacaacatatggaggtataaagattggacaaataacatcatatatcgaacagccaataacaatcactttttttttttttggttcttatcaattaatgtcgaaaatatga

SEQ ID NO: 11340 - DNA, 219 bp, Candida albicans
ttctttagattctatttgattcttttgattcttttatttgaaaaaaaggaaaatgtaacttcaaagaaaaagaaaaatgaatataataaatgtaagtataaaatgaaacccagttatagtgaattgattattgatattgaatttcctgatcctgatcagatgaaaacttataatatatatgaaaagcaaaaaacaaaagaacaatctaacaacaaataa

SEQ ID NO: 11341 - DNA, 480 bp, Candida albicans
ttgaataacattggcatggataatgttttggctaatgatgttggtgttgatgttgatgatgatgatgaggaatttggtaataatgattttgttattgatggtaaagatatagattgtatatcagctattattgatgatgttccactacttgcatgttttgaatgttttggtgtttttggtgttttgggaatatttggagtttgtgatgtaataggtgacatcaatgatgatgatgatgagaaagaggaaggtgatgttgttgttgttgttgttgttgttgtaatcactttaacattcttacctggttgttgttcactcaatggaccaattattgttaaatttttgagattttttatctttcttttggatttaaacaatttcaatgatggtgaagatggtgatgttaccagtgctattgttgttgatggtggtgcctttggctttgttgatgttgatgttgataatgacatgatttggtaa

SEQ ID NO: 11342 - DNA, 465 bp, Candida albicans
gatataactgcttttaaattatataataattttgaatttaatagtaatccattttgtggagttttattattattattattggataaatcggttgtcacagtgacagtacctgttgtgaatgtttctgattcatattttgctttatcaaaaccagtggaacttgttgatgaatctgatgaatgtggtgatgatattggtgatgttgatgaagaagatggggatacaggttcaagttcaagttcaagttcaagatttccatcggattttcttccaattggtccatttttatgggaattttctgacatgaaatgttcatcttgttttctaaatggtaatctcgcatccatatttatatctttgggttcaacaatattatgtgatcaattgattttacttaggcaaaaaacattatttgggtttttcactattcatttaatttcttggatcaaatactgtatcgattaa

SEQ ID NO: 11343 - DNA, 213 bp, Candida albicans
tttgatgtgaactgttgtattggccattcacactcagtaaggctagatgataactttttcaatgagttaaaggctagtgtgaaagaggccttatctataaatgccacaataccacagtttttaggtaacttgcttgcttgttcatcaacagcgtcgaccaaatccaagtccgatgttagtttggttaaattaatccatatgtcttcaggataa

SEQ ID NO: 11344 - DNA, 261 bp, Candida albicans
cttcttggtatcaagcaggatttgatttccccaaaaattctttatcgcatcaatgtaaaattccttggagtgctaccaatgggagagtcactacctagcaacaacaagaataacaatgatggtggtggtggtggtagtgtacaacaaaagttaaaagaacaatctcaaacaagacgatggggcgaaggtggcgagcgtggcggtggaaggacggaagcgcatgcgtacatgcgtgtatgccatgcgcgcgaatcagattag

SEQ ID NO: 11345 - DNA, 219 bp, Candida albicans
cctttttccaaagattggatgtattcctttttctcttcctcagcctggatgtgtactttggttacagctccacaaacaacagcaactattggatctggtctttcaccaattcactttttggtgattaattcatccaaccaaccagttgttattggtatttacctcaaaatctgtgaatttctaacaaattggaataattactccacagttaattcttaa

SEQ ID NO: 11346 - DNA, 216 bp, Candida albicans
cgcatgaaaagtaatgcagagctatatttggatacaccatgtgttgcagaatttgcttactggaaatttgctctattggctactttatggaatggaattgcaaaaagaatagccaagaagaagaagaagaagaagggggggggggaaaatgatgttttcaacaaccttatggaaattatatataaacaggtatttcggacaacaattggtttttaa

SEQ ID NO: 11347 - DNA, 288 bp, Candida albicans
ttattgtctttggtgagatattattggttggacagaattatattttttttttcttcttcttcttcttcttcttcttcttctcactataccgaggcaacaccacccgaaaaacaacaactactaaaaatccagaaatcacataataataataataataataataatagaagaatgatcattaacgtggggaaatacatatatactcccatctcctccctcactcctccagcaccattgtatttcatatcacgcaaattttattttaaacccaatcaaatcatcagataa

SEQ ID NO: 11348 - DNA, 885 bp, Candida albicans
tttgcaacaagtccttacccaacacccatccatacctttgctgaaatgttacacagtcaaagcatatctaatatgaacaataccaaatcatcttcaagctttttaaagtctttgagatctaagaaatcagataccaatattaaaaacggttctaccaagagcaaacggaattcacgtcctttgagtgccagtatctcctcattcaatcttaatatatctctgcccatattaacttcccaaaaaagttttattgaagacaataaagaaaaccaaaatggtgtaaagacattaagacctcgttcaagtgctccaattctagctgaacatcaatcgaaaaatctttcatcacaaacattatcacgtccaccactttcttcaaaacgatattcatcatactattctaccagtagtcaaattagcccacaaactgttcaatcacagatagattcgatatttgatgaatcttcagtactatatgttgatttggaaaatgaagaaaatttgtcatcatccaattcatcgttatcatcgatagttaatcaagatcatacttatctacaaaacaaaatccatcgatcaattaattcctacaacttgtctgattttgtaaatcgaatgaatagtaacaacaataacgataataatgccaatgtggaaaaaaataagtcgtttgaattggaccagttggcacaatggaatgccagacttactggaattaataatgttaataacaacgttggcgaatttgaaactgaattcaagttgatggaaagtatccttgttttatcagtaactaataagagtagccttgccggtgtctctgccagaaaaaatattcttgctgttgacgattatacgtatgttttcaaatcagaagatacgtag

SEQ ID NO: 11349 - DNA, 252 bp, Candida albicans
acattttttggacctaaaaaaatacaaacaccaattacgtaccaagaagcatctaatcaactcccagatcaccactatacatttaaaagtcattggtcaataactatactcgagtattgcctcatcaaagaaacaatcaaatattatagatactcactccatcacgtgataatttcactggtatggaaaagtggaaaattttataaaaaaaaatttgatgcctttggcatagctgaaacttcggcccaatag

SEQ ID NO: 11350 - DNA, 276 bp, Candida albicans
ttcatttgcaaccctacaaacacaagttacaagaacgtacttgtgataggttggaaacaacacttttacagattaaaaatgcataatatggcattaaattttagttcttgggtcctatataatctacgaaagtcgaatatctgcttttatgacacagttttattgtataagaatatgactttcattaaaatttctgttaggtctgaaaaagtagaccatttacaaacccatcaagtaggcctgcgtggcgaaatggttatcgcttttgacttctaa

SEQ ID NO: 11351 - DNA, 1134 bp, Candida albicans
attaagttaggtgatatcatggatgtatcttattcatttacacctttgacgggatataaagatagtttggtcaatcaaaatgtaaaattacctttaaattatccaaccatcgacaatcacaaccctaagaaatctacaactcccaacaatgaattccataagaaaatagctactacaggtaagatcatcaatttacctaaacaatcaattgtcccggcagtttcaatctccgtttacaatgatatgaaaaccattgttttaacaccaatggaatttcaactgagtagtattggtttccaatttcaaaatttaattatagatttacctcattcaatcatttcaaccaattgtattacattttattatcatcaagatcatattttgattgatttaattgatcaaaattatttgtttatcacgttaaaaattgccgttgatagattcattttaggtggtcaacaactcactttagataattttgaagaatgggggtatatttctgttccttattcatttgaactaagatcttcaccatttttgttgaaatgtttggataatttgaatttaattgtttctttgaaagatggaggattgctacatttcaaaagagatgaggaattgggtgaaattaatgtgtttaatttccaagaacaaggtacattaataccatttttaggttttttcggtagtgggaaacagaaagatgttgttttagatggggtttcgtctaattcaattgttgatgctttacagattggtggtagtggtgtggtgattactttatctgtcaacaaagtgttgaaactttggaatcttgatggtcaccagaacttgtcttcattgacaattgcttcagatgacaatacatggttacccactattcctagcaagtatttaaaatcttatgaacaagaagatgggaaaactattataacattgtttatcaataccaaatcaggagattcatcaaagagtatgtttgtattcaaatcatttgaattagaaagttcaaatttgcatgatttgtcagatctttctttccaaccagaactccctaattcattattgttttcctctgatgtgttttatcatgaatccaatttccaaaacactatttggtttattcaagattaa

SEQ ID NO: 11352 - DNA, 1149 bp, Candida albicans
  unsure (1132),(1148): Identity of nucleotide sequences at the above locations are unknown.
ggatccgcacatatcagcctcaaatactatatattatggaaatcccaaacatcttcaatattggtggaatatataataaacccagttaatgtgccaattttatcaattgaaatttcccatcttaatgggattgaatttgacgaaaatatatatgcttatcatgacgctgaatattatatggatagaatatttgattctgggaattacgactcgttaattgttttgacatcaattaaaatattaagtcaacattgggaaatagataatgacatggtggtgacatctcagtcaattcgacaattggctatagatacaatcaattcaaaagcagaatcaggtaccattaaaaattattggtttaaattgcaatctttatgtgaagaatttaaaaatttgagtcaagaaacattgtcattgtcagttttcgataatcaagttttaactttgaatgttaatggtcatggtatattccgtaaatctgctttttttgaatcttttgctaatcagaaattgaatagtgctgatgggaaattaatgctgattttcaataaatttgaaacttttatatcacgtaaaagttatcataaattgcatgaagaattacttcaattgagaaaaatttcggcaaatgacataacaaatttattcacaaaacacattgaaggaaaaatatctactgatgaaatacagacaattctaaaagatttagaacagattcctgggattgttgaaatagtgaaatcgttaattggtagctctgggtttgaattaatcgtcgatgcaaattccatttcaagtaaagaactcggtgcttttcacaaaatatctaccgtgatgatattcaagaacattatggagacacataaaacattgttattagatttggtggtgttatttcttacatgtgaaaccaatgatcaaatagttgaatttgtcaaccaaattcgtgcaactttggtacaatatgatgtcatggaagtagttttcaccacatgtttgaataagggagaagttgaaactaagaatatgggccaagtgcaaaattctattttttggtcatcagttgtggctactcattctcaattaaaacgattaattgagtcattacagctaaatgatggctatgaatatntttataataatgtctna

SEQ ID NO: 11353 - DNA, 267 bp, Candida albicans
aaaaaaaatcaatttagttcggacctaaaaagaaatgttactgccggaacaattatttcatcttatcattcgaatcatcagctattgataaattatatcactcttgttaattgtgtggatagtaaagggaaaagaggagacttggtggctgttaatgtggtaactcttaaaaacaaagaaggaggggtattgacatcaagactattccagcctcttaaagtgttattgtatagtgtatgggcacatacccatggctatttttcttaa

SEQ ID NO: 11354 - DNA, 336 bp, Candida albicans
tactcacactactttcaagcagaacaaaaagaaacaaaaaaagaaacaaaagtagttttctcctcttcttccaagtactttacccctccctcgttttttgacacacagtttttgggtgtacgaaccaacttaactaacccaacacatctaaattccgaaaccaatgataggaaaaagatttcaactcctatatttgttatgctttttggtgctactagtagtatatgtaaacacatacaaaggaaaccaggaaaagtagaaatggaatatacaccacgagtatctaattctacaactgatgtgattttcattttctgctatttaatatccacataa

SEQ ID NO: 11355 - DNA, 201 bp, Candida albicans
  unsure (2),(55),(113): Identity of nucleotide sequences at the above locations are unknown.
tntgtttggtgttataacttgataacagtagtcaccaatttttcattggttcacngagttgccacatctcaccccaccaacaaatttttatatcaattatatattaaattcanattctcggtatttggttgtttcgatcataaactgatactaacagtcttatcttttgtcgattttcagatttggtttgaaaagcaatga

SEQ ID NO: 11356 - DNA, 258 bp, Candida albicans
gtccgaactaaattgattttttttttagaaggctgcccttctatttctacacacaaaaataccaaacatatccatatcttttcctacattaggttaatgtggggaaaatgtcacaacccacttatggcaataacaacaccactaagtaaaaaagtttatatatatatattagccatgttttccagttttctatcattacttataatttattgtattcctttaaatcattcctatttatttaaattaccccttcaatag

SEQ ID NO: 11357 - DNA, 192 bp, Candida albicans
acccttcacaaaatatcaatgaaccaagcgacaggtcattaccatgggcttataccccttacagcattggaaacatacaatagaaaagaaacagatgggttgggacatgtttccacagtaaaaagaaataaaaaaatcggtaggacaaaaaagagagtatcgatactagcattaaatataaaccagttataa

SEQ ID NO: 11358 - DNA, 885 bp, Candida albicans
ttgatctttctttggctaagaatggagtcaatactgcacaagtatcgagacctaaagtttcgtgtcaatcatttattagttgcgtacagacaacggtactatagtacccacaagaatcctagagtaatccaatcgagagtacaaaaccaacaattactttccttacgaacgtttccaaaagatccatacttgactggtagtgataagcctttcttacatttgtcaaaggaatatgaagagaccgagtcccaatacttggacaattctgatgagagagactatactttgtttgaatacaccaatgatatgtctctgaaagcccatgattctgcaacacacggaaaaagctatagtgaacctaattttggtgaagggtattttctgacatttcgattagaattgcccacaaacccgtcaagtgacgaacaacatcaagagattactcaattcgatcccactcaaccagcagaacaatgtgaaccacttttggatatgctgataaccacagacgagtatctttccggaagttctatatctccagtctcatttccctgtacttgccactgccacacttttgaaaagatcgccccacaatcctcgacaaataagagaaaccataacgtaaaagaaaaattatacgattttgtagttaacaacttttccaaagtcacaggtcaaggaaatgatacagttgctacaatctcctcaaatatagaaacttttactccccttgacatccaagcaactgatagtatagaaacagtgccagataaaactgatccaactaaaggtacagacagaatctggaaattagttctcaatgacgtatcgttgtctgctgcaaggttatccacagggaagttccaatattccagtagtaaataa

SEQ ID NO: 11359 - DNA, 609 bp, Candida albicans
agaagctctaggcacacgagatgcagcagtaaaagctctgatcaaggacatattgtgctgttgttgattgtatggtctttcagtgtgcaaagagaaaaaaaaaattttctattcctgaaaagcagtggtggaacaagtcgtgcggttacgatcaaaacaaaaactctaataataaacaccaaagtaaccaactccttaaacatggcatttgaacttcctcagctagactctgaattaaggactgaattggaggtgattattcagaacaagacatttgatgagtccaaatcccaactgcaatggaatgatggaatattgcctaaacttataacgcgattaaatgaattggcggcactatcgaaagacggagaccgatttggtaatcccaaaggaattgattttatatctgaaatagaggcaaccaatgaaacaataacccatcatttagcagaacaaatgagtttgtcgccaccgttcactattcacagacttgcagaattgattgttgatcccaatagtcaaggctacaccataaccaataatgaccagcttttcaaatatttcaattctttgaaaaaagtgtgcattgtttcatcaagaatatcatag

SEQ ID NO: 11360 - DNA, 195 bp, Candida albicans
aatgatatcagtaaagtgaaaaaaaaaaaaattaaagaaaaatctcagcttgagatggatttggatttgaatttgcggctttctttaaaaattaaaccgcgaatagcaaataagcccgctaatgaagctacaagaaaaaattcaatcgaagaaacgacaaccagaagttcaaccagacatcaagtaatatgttga

SEQ ID NO: 11361 - DNA, 207 bp, Candida albicans
ctgaaaaaattaatcatctgtattactagggctattagtagcgatgttaattatgaattgtgtcaaaattatatttctgccaatcaaaatacatcaaaaaaagtcttgtcaggaacaaacgggccgagaaaaaacaaaaagcagctaaaatatttttttctttgttgcgtgtacgtgcgctttgatgcgaatagactgattaaatag

SEQ ID NO: 11362 - DNA, 198 bp, Candida albicans
ttttttgagactcggtggtatggttggagtaatatccctttgatttttgttaggaatgacttacgaaatcggtcttgtaaaatacaggctaatcatgtacattattatctcgtagtgctagcgagggccaacggaactttaagtagcaataccgatttacaaattaatgtattattgttaaaaaacaaatttaaataa

SEQ ID NO: 11363 - DNA, 249 bp, Candida albicans
tattcactaagtagaattggtaacagaagagtgggggatgcaagttttatattaatcacattgtttaagttttgtgttgcatggcaccaaaaacaaaaaaatctcaatcgatgtactaaaaaacttttagggttcatccaatcacagtatttgccgtttattaatgtgatacagatgattatcgataattggagaaaagaaattaacttctattataatgatatagcaaattggtttttttttggttag

SEQ ID NO: 11364 - DNA, 183 bp, Candida albicans
cgtagactaataaaccttgaatctattacaaactgccttcaactgaaatctgataatagtaagatcattcaaccatttcacacaaaaatattgtcgtccattcacgttgatgtaccaccaaaaacttatacccaagcactaatagaacttattggcaccgattcctctttaagatctttataa

SEQ ID NO: 11365 - DNA, 270 bp, Candida albicans
attatatataactattttcttttcttgaagtttcaatttttaattgttattattattgtttcctttatatttattaggaaaggaataacaaataatcaaatcattgggttcagaatcgtttttttttttgattttcatacccctatagttttattcaaacgcaatctcagaacttcaccctattatcaattgatcagattacttttccatcaatcggtatataatttggaagatcaaggaatacatcaatcaattcattacctcaaataa

SEQ ID NO: 11366 - DNA, 186 bp, Candida albicans
caaagaaaaatagaagggaaaaaaaaaattaatctcaaccgtttcaagttaagtgaaaatttcaagttgagagatgagaaagaaagaaaattgataaacccaatacctaaaaaaaatccacaacaattgacgatttgcgtgttattactattattgcgacgcccccttgtttttgttgtcttttga

SEQ ID NO: 11367 - DNA, 249 bp, Candida albicans
ttttatttcatttcctcacgtgggttgatgtttagagttttttatttatttagttcgtggtggtcaaacactactacaacaatgcttaaaaaaatttttttgagaaagttgcgattatgtaatcattgtacatgcattaaaaatttgaatgcatcgtcagtgactcacaagtatttacgaacaaaaaaaaacaaaaaacagcaattgtttcaacttgttgctattcgaaaagtgggaaaatcacactaa

SEQ ID NO: 11368 - DNA, 198 bp, Candida albicans
tttcaggtcattaaaagaaacaaaaatcgcgaattctctttactcaatattggcgatgaaaagagcaaaaaaaaaacttttcatccatgcataaaactaaaattacaaagatctaaaaatatgctaaagaaaactttaaataaaaaaaattttgctttcgatttaagtttttctctttttagtttcgttttaaagtga

SEQ ID NO: 11369 - DNA, 234 bp, Candida albicans
gaaaaatatgaaaagagaaaagagaaaaaagagaaaaaagagaagcaagaaccacaagaacaacaagggaaagggaaaagggaaataaacttgtatttatatgttgtggagggaaagagaggaggggcgggacggggaacggagaaaaagagtcaaagagagaaatcaattacgtatgatgattttgcttttttggatttagattttgtctcaatttattacttttttgtgtaa

SEQ ID NO: 11370 - DNA, 198 bp, Candida albicans
ttcgttttattactagaaacttggtggttaaaaataaaattatgcactgttagccgaattgaactaattataataaaaaaaagtcaaataaattatagcgtatcacagcattgtaaggtgatcacgatcagcatgtgtcaaagtatatctaaagttaggagagggggggggacaagagcaatgacacctttagtgtag

SEQ ID NO: 11371 - DNA, 192 bp, Candida albicans
ttagtcaacactcgcattaccgcagtgatgaaatgtggcgttcatgggcgttttaatactcacaatctattgctgtcttccttccctcacttttgttttgtttcaggaaagatatgtgcaaggcttaaaaaaactcggtcgcgccgttatcggctaatttccaacagtccatcaatcaatgatataaattga

SEQ ID NO: 11372 - DNA, 213 bp, Candida albicans
ttacaaattaggaaagtttccgttgtaatgacacacggcaaggttaaagtttttactttgaagaaaaccaaaaaatcaataaaccacaatctatctgacaaatacaaaaattataccacgttaggattattaataattaataacagtagtctaacctcatataattcggatttaacgttgggatacaatctgtgtatgctctgcaaaaattaa

SEQ ID NO: 11373 - DNA, 183 bp, Candida albicans
ttacagggaacacccaataacacaaagtcatcattagcaaatcgtttattcaattgttctagaccattgtattggaaagaaaacccacatctggaggcaacattaacaattaaaaccactttacctcgtagatttttgaatgggaatggtgatttcaggttatctaagggagttaaatcataa

SEQ ID NO: 11374 - DNA, 210 bp, Candida albicans
cgctcgagaaaattaaaaattaaaaaaattaaaaaaccaattacaataagcctggctgcatatactatatgggatgggaaatatttccgtttatttctgaatgattatttccggtacgacaaaaaaaagtgtctcccccaaaatcaaatcaaatcaagtgaatgcaaattgaaatgcaacaaaaatttgtatagtaaaaacacattataa

SEQ ID NO: 11375 - DNA, 189 bp, Candida albicans
ttacattatacaatatccattcacacactgattcgtgtaaatgagttcagtatgattggacaagtattcatttccaacaattctgtgtttatatttttacccagaaagggtagtccaaattgtaaattgattgctaataacttggcttttaagaaaccatcacatggtgaatataataataacacatag

SEQ ID NO: 11376 - DNA, 201 bp, Candida albicans
tattcgaaaaccacaagaccaagaccaagaccaagacgagagaatgagggaaccaaatcaaaacaaatcaaaaatcaaaacaaaaaaaaaaaagatttttggcgtctaaaattaaaaaaaaaaaaatcatttacaacaacaacaagtattagtactactactactactccattgtcttcaccaggcggtggaagatccgaa

SEQ ID NO: 11377 - DNA, 213 bp, Candida albicans
atagttcgttgtctagaccctactagcatttatctatctaaaacatgtattaaaaaaaaacagctgaaaaagtacgaaagtctagactttttcgttcaagacttcatcgacattgccggtgctgacaccttctacaaaatcttcttcaaggttggatttaggacctgtgtagaatctgtagccccaaacgaaataataaatcaacgccaataa

SEQ ID NO: 11378 - DNA, 195 bp, Candida albicans
ggtaaaagaatgagcaacacaggaagtccccatgaaagaacgttactagcaacagcaagactgaaaagtgcaccagatcctgctgttccattgatcaaaaccaataatcctaataatattcctaaaacagctgcaaacattgtagctcttatgggtactttaatcttgggattaacgtatttaacaaaattataa

SEQ ID NO: 11379 - DNA, 228 bp, Candida albicans
actcatatgaacagtaacttgaactgtagtaacaatattcggagcagcaccattattattattattattattattactgttgccattactgttgccattactgttaccattactgttaccattactgttaccattactgttactgttactgctaccgttattgttactgttactgttactgttactagtaccatcactatgattgttattatgttcatgatcaattaa

SEQ ID NO: 11380 - DNA, 294 bp, Candida albicans
tttgaaaaaccatttgacaaccaattagaatggtcgtgtgtgatagtaaagaaaacggagcagttgggttttttttttccaacttatgcacgccctaaaaaaaagttgtatttcttcaattcaattcaattcaaagggcaaaaaaaaaaccatcatctaacaacaacaactcattacaactcatcttcaatccattctatttctttatatcaatcacaaaccaatattcaatcaactgtgatcattatcatcaagaacaagaagaaagacttggaatattcattactagtttaa

SEQ ID NO: 11381 - DNA, 195 bp, Candida albicans
ttgattgttggattaaatatgatttatttcaataaagttatagatccaactcccatatttatatgtttttcaagatataacattatccatcagaatattatccctttgagtatggcatcaaccagcaaaagctatagggggggggggggggggggagaaggaggtgtaccatttttaaaagatagcacaatttga

SEQ ID NO: 11382 - DNA, 699 bp, Candida albicans
ggacgaagaaaattgtgggataggaaaaacaatgacaacaacttagattccgatacccagtaccccatcgagcaggttagtgcccctaccactagcgatgaaccagacaatcaaagggttgattttgaagagctcatgataaagataagtggctttcaagaaaactttgttaataagttgccttatacaaatgtcaaattgagtcgaacccaacaacgacaattagattacaagcagttgtatgagtatgaatcaactgatattgaaaacggctctgatttggtttgctatgattggaaaattcaaaatgaaacaatactatcccaatatacatcaattcgattgaggttctcttcaaaacaaaccactagcaaaaggcaaaataaacaacacgtggaaaatcatatgggtgtacttggattcattgacaggtatagaaataacgcttctggtaatacaccaacacgcaattcggatacatcatttgacgatgtgaatgcaaagttaaacgatgtatggacacaagagtttagtcgcttgtttgcacataacgctaatgccaccaccgtacaaaaagacacaagtacaacttccaacacggtacctgatattgaagataaaaatatttatgaagacagaacagttaatatgagtaatttagcgaaaggcgtgaaactaaacggacttttgaaaatataa

SEQ ID NO: 11383 - DNA, 195 bp, Candida albicans
atcacaattcggaacttgtcagttacaacttgtgaccaagatttacattgggccaacttaaaccctacgttttatcctgtgctttctttagaacatactagaaagaaaaaaaaaataagtctcaacaatggtcatacacggaactcgattttcgcccgaaagaataataaccgtttctcttccgttcttcaataa

SEQ ID NO: 11384 - DNA, 258 bp, Candida albicans
catggcttacttataaaaacaatatactggggctcatgtgggaattaccttaattatttctttataaaaataaaaattacaataaacaattcttcgaggaacatttttaaggggaaccaaatcccaaaccaaacacaattggctgattcaaaacttataaaaccaaacatgtattcaaactataaagtttcatataacaactctctcaatctgtattcttcattagcatcctcgatttcttgccaattaccaatataa

SEQ ID NO: 11385 - DNA, 228 bp, Candida albicans
aacaatcaatcaatttcgtacattaatttgcttattttgagatttcttgctgtcttcattgctctaacttcctcccctctcagtctagttggctctcttacctataaaagctcaacaatttataattcaattttgaaatatgaaactagaccaaaactgtataagccaaaagtactaaaaaaaataccgcaagagaattttattcactcaattgaacaattatattga

SEQ ID NO: 11386 - DNA, 234 bp, Candida albicans
acttctggattagagtctaaaatctattaccaattgttcaaattattagttagttattatcatctatccctgaatttcaatttattcaattgctgcttgtcttcctggttcaacaatggccaaaatttagtcattgcaaagtataagctaaaagctgcagggatgagaataaatgaaatattagtcaattgtggatacagttcccatgtagagagtataaatgccaggaaatag

SEQ ID NO: 11387 - DNA, 225 bp, Candida albicans
aataattgctgctggcctctcccttatctaatgcaagagcaagaaaaccactatttcctggcatttatactctctacatgggaactgtatccacaattgactaatatttcatttattctcatccctgcagcttttagcttatactttgcaatgactaaattttggccattgttgaaccaggaagacaagcagcaattgaataaattgaaattcagggatagatga

SEQ ID NO: 11388 - DNA, 198 bp, Candida albicans
cggagcttgataaaagtgggcgtgaaaacccacatctttgtcaccaatattagtagtgcttacttacttgtgcccccctatatacaggtgctgactaacatttatgttactaagggacaagaaaaaaaaaactttataccaactaaacaaactacaaataaacagccaatgaggtggaaaccatttacctataaatga

SEQ ID NO: 11389 - DNA, 195 bp, Candida albicans
ttcccctccacttcattcattgatataaatggtgcagtgaatagaatgcaatttcgtatcaaagaaagaaagaaaagaagggaaaaacaaagtaaagaaaaaaaaaatttcatagtgaagaaaactatttatactacaaaaattgatttggtgggtgcgtgtaggtttagtcaaaaaaaaaatggtcgtgggtga

SEQ ID NO: 11390 - DNA, 402 bp, Candida albicans
aggaggaggaggaggaggggaagtagtagtaacaaccctaatttgaacgctatgtgtctattatctcaagaaaacaaagtaggagcaggaaaaaaaaaaagaaattaccaccaccaattctgttacataccaacttacatggtcgtaatcaccaacaatatgacagatgcatttgatctaaactacttgttcattaatcaattggcatttactttcaacaaatatatatcgtcatcatcgtcaaacattcccaaatcaagtataagcaacacagcaaaacaatgtttagattatatgaaacaatatgaaattatccatcccattgcagagactttaattgattatttatccaaagaagatcgatgtcttcaccacggggctggaaaatcgcgcgattgcgca

SEQ ID NO: 11391 - DNA, 183 bp, Candida albicans
aaattggtgatctgcgacatttctggagtgacaacacgacatagtggagacaaaagtgaaagcgtaaaaaataatgaaggagaaaaaaaaactagccaaatctttttgttgccaccaccacttagtacaacatcttcaatattgttgtcgttgttatttaagtttcctattcaattgccataa

SEQ ID NO: 11392 - DNA, 234 bp, Candida albicans
tttagaaaaactttattaaatattttttttttcttctatcaatttcgtgatgatgggatgaatgatgatgatgatgatgatgatgatctgcaaaaaatttttttggccagtgtacacacacacttgtacaagcaaattcaatcatcgagatgtcaacgtttactattgagtttaccaaagtatactagaaacagtctcaaaaaaatagaggtagacgaaaagtatatcctatga

SEQ ID NO: 11393 - DNA, 1137 bp, Candida albicans
  unsure (102): Identity of nucleotide sequences at the above locations are unknown.
gtcccaaaacttgaagataccacttcaaaaaaagtctttgctgaattgtccaacaaaactgttgagaagaagtcagaaaatgaatcgtcttcttcctcttcnataaataaatcagacacatctaaaaagagagaagaatctaaagctagctcagaaattttaacaaagcccaaacatcactttagaagagctgaaaacaaaaatcccgataatggggggagaaacaaagacaaagaaaacttgctgtccttactgtcaaattcaaatagtcttcctcaacaactatttaaaattcaggcaactgtgccacaaaccaccgccattgttgttgatccaggaaacgacactgttcccagtaatattcccctggataaagaagcaatcgatgctgctaaatcagaaaaagagacaaacaaatatgaacatcaatcaattgatgccacgagcaacgagcaagcagtatcattatctgaggattcttttccaatggcaactactatcatgatgtctctgttaccaagaaaaagaaaatggcctagctctttaaaatccttgttttgcattaactcgatagtggagagtaataaaatagaatatgaagagtctggtgtttgtgatttacaaaagcttcctgaaatatcaacacaatatcgacttaaagaaataaacgggtttggggtcttgtccacaacgcagtcacttactcctgcaaatcaacagatctatcaaaaattggttgctacgggactagaattgagtttggagttctgcagatacttggaaatattaaatgagcggtccatgaaacaagacattaaggattcatttctgattcaatttggtcgtattcattcagggttgcccttcacaacaaatcatactaatagtgacgctaccaaagaagagcttttgcacataggtgagttatttgacgaagttttcaacaataataataccgtttggattgccaacaaatttgagtataattcatttggtcgaaaattcaggaaggcgattgtagagacgttggaatcagactatcaaatcagaataagtcatcgacgagatttgtttcctcgacaaatgatagcagctagtttattccaatggaagaaaaacatacatcttcctgaataa

SEQ ID NO: 11394 - DNA, 282 bp, Candida albicans
gttaaaatagaaacagaaagacggttaattatcttggcaactgaaacaaccagtatttcaatcaaacttggactttttgactataacaaacgtttaaaagaaattcttttttcaaaacaccagaaacggaagattattttgagcttatttggtggagaaattggcaagcaattattaactgttgttacattttattttaattatgtatttcatgtgccacaatttcggaatttgattattgtctctttattctcatgcgttatcaaaggtcatgagaaatag

SEQ ID NO: 11395 - DNA, 375 bp, Candida albicans
gatctaaaaaaaagtctagacaataatggttcatttggtgttgcatatagcaaagtcgatccatatgatatgataacaattacaaatattcaacttcttacaataaaaactatctttgttagcatcagacatattttaaagttctgttttataatgtacgggtattattccaaatggttaaagtttttagttcgttaccactattatcactttcactgtggaaggtcattcatttatttatctattcgagaaattttatataacggtttacacttagctatctactttttatggtgccgttttaaaaatcacaaatcctacagatggtgtagcacaaacaaagtttacgtaataaatgagctgtatatgtattag

SEQ ID NO: 11396 - DNA, 975 bp, Candida albicans
atttatgcgaaaatctatctaatcgctgttacctcttggaagaatattttgcatgataatgatgataattatgaattgtttgaaattgttggtgatttattgggtttaattattaaatttattgatgtatctaaacatcaagaaattttagatcaattgaatcaaacatttattaccaataataatgatgatgatgatgatgaagaaacaaatcatcaaggaccattcaaatatccactgaatttattaattgaaccaaataattatatcaatgtttataataagattttaagttccattgataaaacttgtgttttcaaacaagatgttgatcaacaagtgattgaatcaataataaatttgatttataaaattggtagtgatgatgaatatttacgattacaatatttacaaacattatgtttgttgattaataaattcactaataatgccgacttcattgaatctaaattgaaatttttagaaaaagttgaagaacaagacttcccaataactaaaaaagattttatatcatttgaaatttttatatggatattaaagggattaattgttaaacttgataaattagggatcaattatttaaatcaattacttgaattatttgtaatcactgaaaactataaattgaaacaattaattggtaaatcattacaaattttatttattgatttgaaaattttcactaatgagagaattactactactgacaacaccaatagtactaatggtggtattaaatcttctagtcaattgatttcaaaagttaaaaatttacaagtcaaatcattatataaacaacatatatttgtcattattctaccatatttaattaatgattctaatgaaaatttcactaatgatgctgatttcaatttaaaattcaattcattatcattgattattgaaaatttatcaattaatggtaataataatattttaattaatcaattaatt

SEQ ID NO: 11397 - DNA, 249 bp, Candida albicans
tcatttatacagggctcacataaccattcctggatagtctttgatgtaccttcagttagtttgattccagcacacgatgcgtgtacattgactccacatgatgagcatatcaacatctcctacaatgacgcagatttagcggcattgttatcgtgttctagacagatacaacagtttctttctgatggctcacacggaagctctatggatgaggatggaacagtcacatttgttaataggttgttgtaa

SEQ ID NO: 11398 - DNA, 720 bp, Candida albicans
gccacaatggagttttatttaattcctccagtttcttaccaaactcaggaaaagttgaaaaagaaaactaaaagaaccaaagaaccatcatcatcatcttcaggttccaattcaagttctagctctttatcacgagaccttctggctttaaggagaggttcaacgtcagcttcttcttttacttcaaactcaatattctctagtgcaacatctacaaaatccagaaaatcatcctgttgctctatagaaaccgcttctaccgccaccaccaccacaacaacaaacaaatcaaaaacgtcatcaaacgcaatcccaatgccaatttcttcagcatcattaactcaaccaagatctctttcgagaaaacctacaaattcatctgattcacattcaattaattctctgaaaacaaactcaagtctaaaaatatctagtacttctagaacgtcaacttctaaaaaacattataattatgaatcaaatactaccatgaatgaaatactttctaaaccaaaattaaagaagaaaagtttgcgttcagttttcaaaaatttgagtttaaataatgaaaaagaaaactctggtcataaagatcatggttatgattatccaactgatgacgatgacaatgatacactagataatctggatttgaatactatttattcagatgcaaattcaattttcagtcgtcggaaaactccagttgctttgaaatga

SEQ ID NO: 11399 - DNA, 297 bp, Candida albicans
gttaatgatgctgaagaaattggcattgggattgcgtttgatgacgtttttgatttgtttgttgttgtggtggtggtggcggtagaagcggtttctatagagcaacaggatgattttctggattttgtagatgttgcactagagaatattgagtttgaagtaaaagaagaagctgacgttgaacctctccttaaagccagaaggtctcgtgataaagagctagaacttgaattggaacctgaagatgatgatgatggttctttggttcttttagttttctttttcaacttttcctga

SEQ ID NO: 11400 - DNA, 279 bp, Candida albicans
  unsure (50),(63): Identity of nucleotide sequences at the above locations are unknown.
agaggcttattcataagtatttttcaggagtatacacatttgattgaatntgcttcgcttccntgctcccaattattgcggaaaaagaaaacattacacaataacgatttgatggaattaaatttccggatctcgatgtataatgttgctaatgacaacaaccgactaaaacgatttgtcttgagaagagcaagtttctcccccaaatttttcaccgcgttgtatgacctgctaacgaaaaataaccagcatattattgtgatagttaggcaatgctga

SEQ ID NO: 11401 - DNA, 210 bp, Candida albicans
  unsure (32): Identity of nucleotide sequences at the above locations are unknown.
ttaaattttggtataaattttcatgaaaaaanaaacccaaagccaaacttatacttatttgcttatgttttcccacaaaaaaacacattaactgagcagcaaattctttttacttacattattaatataaaattacacctacctaattgtccatcagctttcaaccttaaactttcgttgctcaattgcaagttgacattaaaaagatag

SEQ ID NO: 11402 - DNA, 294 bp, Candida albicans
attcacaacatgcaaccatattctagatcaggaggtacaagaagatgcttttatgaatttcaatcgtggatgtcatgtgtgacatctgctgacaccacatctgtcaaacaatgcaaaccagtatttgaagattacgaagaatgtttacatggattgaaagaaaaagaaaaagtaagacttatggtacaacaattaaaagataatgaaacaagtaagaacggcgtcactgcttctgaattgtacaaagcttcaaacaccatatatgagaatttggatttgataaaaagagaataa

SEQ ID NO: 11403 - DNA, 630 bp, Candida albicans
ggcactggtgccacaagtgggtcgatgctatcaaacaaaaccgtgaattcaaatgaccaaaattcttcaattccttcagcccaacaacaagctaacaataatataaatctcgcaacacgtgcagcactactgagactatcactgttgcagaatttagttaatctgaataaaagaagccgaccggactcagaatctgaagaatctgatgatggagaagatgaggaagacgaagaccacgatgaaccagaacgtgtacggaaaaaatccaaattaatagcatccacaccaattcctaaaccaataatgactccattgagtgggaatggtaataaacttagatcaaatttgataccatggtcatctaaagcaaaacccataattcctaaaccaataccagcacctgatccaaccaatgaaaatgatgaagtcaaaaataaaaacccacgagaaggagctcaagtgatagacaaactgaagaatagattattatcgtccttaaccgatttggttggtaaaggattacccgatgtcaaggataagaaaactgttgctaaaaagccactaactatatttggagattcaagtgacagtgagggacatgatgatagtgatagctccgacagtgattaa

SEQ ID NO: 11404 - DNA, 1503 bp, Candida albicans
atgataacaacaagaatacgtccaattatgaataacacaagtactcacactaacaccaagacatcaaccacgatattagcaaaaaggtcagcaacagcaacaacagcaacaacttctattcccaaacagtcatctatgtcaggccaatctaagcatgccatactaatcccatcagcattgaattcattattgcatactgataaacaaatcaaatatcatttctatagtcttggaggtgatttcattagattggcttcttatcgaagattcaaacagttatttcaggttggtggtggttcattagttaaacaatttgtttttgatttatcgacatttttaaaagaagagttgaatgatataaattctttaagacatcaccaattgaagaattttttgacttgtaataagactattttagaaaaagaaaagtccatgactttatgtgatcatcattttggtttaaagaattggctttacataatatttggttatatgttacagaattataatgaacaagaagtcaataattgtttggatcagttggtttccatgtatttggaggcaagaagtaatcgattctcaattaatgatattcgaataatccgtgatgaaagagatcagtttattttatctacttttgaacaatatttacttgatgtccccgttagaaatgatttattatataatgataatggtgacaataaagatgtgaattatattatcttgagtaatatcaaacatcacaaacactcaaataagaatgctaccattgccagtaataaagctaaccatacaacaaatcgaattaatttaccaaaattacccaaaattaaagataaatcattattggtaaaatctttaatgcataaagagttctatcgtgtattattggatccaaatcattattttggtaaaaaaatgttgggtcgaaattattcattagatcctcaagattattcattaattcgtaaagaactttcaatattggatggattgggtgatttattcttagctcaagaaacatcaaagctaatttatgaattaatatgtcagaaaaatcatattaatattaatagtagtactacttatcaattattaaaaattatgttggcaaccaatactttaatggcaaaattgaccaaagcttataatttatatcaagggttggatgattccattataaataagcgtattgctaaagaatggttaccattcaccattttaggtgaaacccctcctcattcagaatcttctgattggcaatctaaagatgaaattcgaatctatgaagaagaattcttgggtgatttttttgaaagttatatggcagcattattgattgaacaaccagaagttgcaaaatcttttattagagaaatatatcatcgaatattaatggtaatgacagaaactttacctccagatataacttatcagacttggactagtaatatattgggaagaaatatttataggaaaaaaagtgaatcaattcaatgctga

SEQ ID NO: 11405 - DNA, 234 bp, Candida albicans
  unsure (196): Identity of nucleotide sequences at the above locations are unknown.
actcagttacaaaaagagaaaattagtggtggtggtattggcagcggcgtcggtaatggacaaaagaatttttcaagaagatatgcatactctcttgaagcttcattaacagtgaaagaacaatacaagcgcattacattttctgtggtggtatttttagtcgttgttatttctgtgttttacgaattcccaagtnttcaccacgccatggccatccaagcttatatgtggggg

SEQ ID NO: 11406 - DNA, 186 bp, Candida albicans
ctcttgatttgtgtatcattattaactttttggatgtatgattatgatctagccaaaactaagcatatccgtcaatgtgtattagtagcagaactaacacacacaattcttaacgagattggacaaaattatttgtccttctgtagtgatttgttttgtttttatgagcaaatctgcttaatttag

SEQ ID NO: 11407 - DNA, 345 bp, Candida albicans
  unsure (48),(322): Identity of nucleotide sequences at the above locations are unknown.
gttcaccaagaaatgggatttgttcagttcaccaaggaattccacctngcccagttctccaatcccgaggcaccatctaatgaccaattggtgacaccaaaggaacaatataatattttcatttcacaaccaccgcatgggacagaaacaggtgtccaatcaccaaaacatccttattttatgcaagatgaaagggtacctccaactgaagaagtccaagctccagctccagttccagcttcagcttcaaagccccagaatagctatattgaaactactccattggcaccggctaatccacctaaaacatcggtatctaatntgggagccacgtcacccgggtaa

SEQ ID NO: 11408 - DNA, 234 bp, Candida albicans
tatggtttattagaattgttcaacttctatttaattaactttcattttctattaaaagaaaaagagggaaatttagagaactcaaatttttttttttttttagatttcattcttcttctttttgtttatttagaaaaaaaaaaacccataccaagattttttttggcaaccaccataagttataacatggatgaacccaggttggttggttggttggttgattggttgtactaa

SEQ ID NO: 11409 - DNA, 1893 bp, Candida albicans
atagtacgtgacaggaagaggtttctttataacgataatttatctaattcacatatggttcaaaagcagtaccgatttgccccaaagtcaatattcacatttgtgtttctatgttttgttgcaatagttgtcataatatccacatcatctttagtgcaggttgaagaatcgttagatccaatcgaagtatcagatgaaattaagaagcatgatagaaaagtagtcattttcccaagcaatttccaatctgctaataataaattggccgattttttaacagaagcatttggacaaaggcttaataaaggcgatatagtgtacaaaaatcgagatacttacgagctaccgcaaacagtgtatacttggaatactatcgatttgtttcaatcaattggtgaaaaagataacttgaaatgtgaaaaaatacctttaaattttgaaatcagcaagatatacaacaaaaatgcagatttatacaaaatacttcgagattttaaaaatgaaaatagtttttactataaagaagtttcagtgttttttccagatttaggaaaacaactacgagaacgtaccattgaaaaacattggtttcagttaataggctcgtctgtttggcttgaacagtatggtgttcacttaatgatatcaagagtcatatataccaagacgggtaacaaggtacaaccagttatatcgttgtcatatgttcaggcgtttgatcgtaattggacagaattgaaaaatgtaactttagttgtaccagatagcggtaaggcaaagttcaagacggtctcgtatccgtcgtttataccgattccagtgtaccacaacgtcaaccaacaacggggaaagttttatggagtagaagatccaagaataatgctagtcaaaaataaggaggggtatgaagagccattgatcgtatacaattccttcaatcgcagtccaccaaatgctaactatttggaagagattaaaaatcttgtaaaacttgatacttatagatcaatttttatggcgtggatatggagaactcaactcgggaaatccaatgtaggtctgctgctaccagatttggcaacaacagacgatcataaatatgtcaaggttaaagaattaagcttgcctaataaaaagaggcctaaaacagagaagaattggacaccatttgtcatatatgaagatcagaaaaaacaaggttatgattcccatctatatttcatatatctgtttcaagacttgtcgattctaaaatgttcgctttgggatgctggaaactgtatttgggagtatcgaatgaataataaaaagacaaaaatatctgagcttcgtggaggaactgaattaatgaacgtcaaccaactactagacaaatacaattttgctggtttggaaacagtgaaggatcaattcaaaggtaaagaagtttggattagttttgctcgagcagcgttaagtaaatgtgggtgtggactgaaaatgtatcgaccgaatttcacagtactagtgaaacaggggggtagatttcaattgtcttttgtgtcgtcgtatatggattttggtgtgccaatattaccgtgggctaaaggaaaagggttatgtaatggcaaaaacttacttataccaaatggaatatctaattgggttttggcaaaagacgaaggtggtggttttcaagattatatgactcttagtttgtcgagatctgattctacagttgatattatacacatgaagggaatactaaagtcgatattatctgaatatttattgcaaacaaacagagatgtgcttaataataatgctatacattgtgctttacttgaatctgaaagctattgtaaaagttatgctgaaaattatagagcccatttaaagcgatggcaaaattag

SEQ ID NO: 11410 - DNA, 192 bp, Candida albicans
aatcgaactgtaggaaatcttcttggtataagtagtctaaacatcgatttttatatccaaagaaaacaaatggaagttttttcagtttatgctttagcttctttgctttttttttgcttgtataattttttttgtattatctacaccatgaccgatgaggaagaaagaagaagagatgtcacttggttataa

SEQ ID NO: 11411 - DNA, 222 bp, Candida albicans
atgttattttataaaaatgatactatttgttcagtttgttatgatgaatttgaagatgtttcatatatttatcatggtagtattgatgataataaaaaatattgttgtcctgataatggcaaagaaataatcttaagaacattgggaaaatatgatgcaagcggagctctacctgattatacaaagcatcctcataaaaaaaacagtaacgtcttaggttag

SEQ ID NO: 11412 - DNA, 402 bp, Candida albicans
ctgaggacgaagttggtttggtttaacttcaagatgaacaattactttacaaaatatatacctaatataagattgtctaatacaggtgattctgatgatcatactattggcaactcgaccaacagtctaccgcatataaattacataattatttttaatccaacatttgtgtctcccaaagccgaatctgatgaagaattaattaaaccaattatagttttcctacaaggtaaagacttgccacaatcacaattttcacaaatagaacaattgaaattaattggtttattgagaggaattgaatcgcttggtgaaagtttttccaattcaaccacgtccacaacaacaggtaaaaaaccaacaattcttaaatcattggatgcctcaactgtaatgatataa

SEQ ID NO: 11413 - DNA, 210 bp, Candida albicans
tttaatccatacttgtcttcagaagcaaaactagatactttccccgctgctgcaactgctgctgccgctgtcgacgatgatgtggtttcattaaacctaaatacaatcattggtttcatttcactcactttgagaactaaatttcggttaatattcagcaggtacattccattaactcctatgaatttatcaatgatgtcaaattcctaa

SEQ ID NO: 11414 - DNA, 1497 bp, Candida albicans
  unsure (34),(36),(69),(150),(304): Identity of nucleotide sequences at the above locations are unknown.
aatccgttctcgaatcttcttcttcttccaaatngntgttcttctgacaacttaaagttcttggagttntatttcaattctattcttctttattattatctcaaagctatgtttaattcaaaagtgaagccggagcctgtcaaaaaggcnacacatatcagtgattctagttttatatcatattgtcccttgacttcagatggaagtgttgtatcgttcccagttggtcaatctttaggtattaaaggggcttcagatacacacgagggtagatttgctaaattgacgaatttttatttcaaanacaaccacttatcaaaggtacacgctaagattagatatgatcagcaacaggggttttatatccaagatgcaaactctacatttggaaccgtactcaataacgagaaggtgttgattgctggtgttgaacatttgttgaataccaatgacaccgttggattaataatgtccaagacgtctctgcagattaagaaaattacccaagaatttgtttctgccaattcaaccgacaaagaaataagatcgatccccataagcaagtttgataatcctaccattgtcttaaattttagaatagagatcaaggattcggttttaaaacttgttccaattgaaagggaagaagctcgggctacaattgatgctaaaactggcttaaaatctattcttacagaccatacaaaatctttgatcaatgtagaagagattcccgacgatactgaatcgagtgataatgaggtggaagtagttgatattgatattgtttccaatccagttacgaaaattgacagcgtgtgctctaatggacacatctcagatgaccaaatcattgaaattgatatatcagatgacgaattagtttctggaaaacaaacccactccaaggaaaacaaaattaccgagtctgattgtatcggggatggcaaaactcaaaaaactttgtcaagaagcgcttctgttgaagaattaacacctacaaatcgagttgaaagccatgcttcaaaaatgattgtagaagttccatcttcggagtacgaggatgacgagtccgatgttaatgagatccttgagaaaaccgaattcaattggaaagaacaagtttcagatgaagtatcagataatgactctagtggagaatccttagattctgaactatcaaacgatggttcgagtgatgaatcttccgattcagttaccgtgaatgatattaaaaataaacaagatgaaattagcatttcatctgatgaaagtgaactgtcagaaagggaatgtggtgattgtgatcaaactgaaggtgataatagcaacagtggaaaccacgaaccattctatcccgtttgctacagattatggaaagatgatcgtggctcaaagtactataatttgctcgataagcatgatgacgctgacagtgattcagaaaatgtactggatacagagtccacctttttggtagcaattgcgatgaggtag

SEQ ID NO: 11415 - DNA, 264 bp, Candida albicans
  unsure (134),(144),(147),(169),(178),(250): Identity of nucleotide sequences at the above locations are unknown.
ctccagattggcccatcattgcaagtgttaccatattctgttggatgtgcttatacactttttgttcttcacgtgtcaatgaattctggaatatctgttgttgctgctgttgctgaaaagtctgttggggactnttctgtcgtngtngctgtgattgtgactgtagatngttattcanacttccaatttgcggttgcagtgcttgggacagttgttgaaaagcactttgaatattcatcgtgggtgtatntgctgtacttgtaa

SEQ ID NO: 11416 - DNA, 426 bp, Candida albicans
ttcagaaaatgtactggatacagagtccacctttttggtagcaattgcgatgaggtagatgatatcaaaattgctgaagataataaactggtcgactccagttcaatagatctcagggacgattttgatgaaatcacgtctcaagatcagtcgagcttcaatgaaattagttttccccgtaacttttgcttatccaggaaaagaagatttgacgaacttgatagctttgatgaatttggacgtcatacacctatagaatattctgattgtgaattttcgaatcaacctccaaggaaaaaacatgcaagtactgagtccaagtggaaaacaattacgaaagaggttggtaaaggtttattttatgtttttgcaacaattgcagcacttggaatttatggtagttctattgcgaatgaggaaagttaa

SEQ ID NO: 11417 - DNA, 816 bp, Candida albicans
  unsure (114),(199),(271),(280),(302),(305),(315): Identity of nucleotide sequences at the above locations are unknown.
ccaaaaaggtcatttccgtgttcagattcacagcgccaaagggggaggagagaccataacattactggccaggaaaagttcaagcaaagcctagcacagcaaagccaaagtacnacgaaacttcagtcgaattcggtgcagggacaaattattgtcgggtccattgtggttaatggttctaatgttacaagtacagcanatacacccacgatgaatattcaaagtgcttttcaacaactgtcccaagcactgcaaccgcaaattggaagtntgaataacnatctacagtcacaatcacagcnacnacgacagaanagtccccaacagacttttcagcaacagcagcaacaacagatattccagaattcattgacacgtgaagaacaaaaagtgtataagcacatccaacagaatatggtaacacttgcaatgatgggccaatctggagttacccatacgggccaacaattgacaccacaacaaatacaacaagctattcaacaagcgaagaacttacgacagcaattatttcaacgattcccgctttattttcaacgaatgaaacagttgcagctaattcaccaaaagagaagattacagcagcagcagcaacaacagcaacaacaacaacaacaacaagcctctaattcctccggtggtaatcaaaataattcatcgaatcaagccgctccccaaactcaacaatttaatcaagcattgccatctacgtcagagcagtccaaacctgttacgacatcgccagaagttaaaaagaaaagaacctatcagaagaagaaaaatgcgcctgctaattga

SEQ ID NO: 11418 - DNA, 360 bp, Candida albicans
gatgacgactcatggtttctttggctttctatattgatttgcagattacttctttttgctagacttgaatgtgaatgtgagagtgaatgtttgcgtgaatgtgaatgtgattgggaatgggtttgttgttctggtgctggtgtcttttcttttgaaactgggatttcaatggtacgtaattgcattctaatttctaaagtttcagaagacattttggactttttaccaaatatagatcctgctcctaaactttggcaaacacgtccaggaaccaaacatgactcattagaatacaataattttgaaatcacgccattggctacaaaaggttcatctggttgttcactaatatcttggtaa

SEQ ID NO: 11419 - DNA, 234 bp, Candida albicans
aaggagctcttaaatcaataccaaatgaagttgtttataaatgaaaaaagaaagaaagaagataaaaaagaaagtaagaaaaaaaaacagttgtttatagttgttgtgatttttttttttggtggtgggcttgctttgctcgatgggtattctggcgatagaattggtagtataagcaaaagaattaatttgttaccaaaaagcctaaagaaaagaaaaaaaaaacaactataa

SEQ ID NO: 11420 - DNA, 645 bp, Candida albicans
tattcatcatccgtcaggctgatgcaaattaaaatcttatactccatatataatcaaccaaatgtttatttgtcacgctcagaaaacactcttcctgtcaaagttgttcaaattccacttggaatgaatgaagacgaactaataaccttaggtggtttggaattacaagattgtgtgaaacaagtggtacgatcggcacctgacacgttcaacttgaatttccgtgactttgaagtctattaccaagatattagtgaacaaccagatgaaccttttgtagccaatggcgtgatttcaaaattattgtattctaatgagtcatgtttggttcctggacgtgtttgccaaagtttaggagcaggatctatatttggtaaaaagtccaaaatgtcttctgaaactttagaaattagaatgcaattacgtaccattgaaatcccagtttcaaaagaaaagacaccagcaccagaacaacaaacccattcccaatcacattcacattcacgcaaacattcactctcacattcacattcaagtctagcaaaaagaagtaatctgcaaatcaatatagaaagccaaagaaaccatgagtcgtcatctcattatgaatcaaattctcctgcggaggcccaatcttccccttgg

SEQ ID NO: 11421 - DNA, 1425 bp, Candida albicans
gcacctaaagggatcctaattagctatattacggtgagtcggggtaaaatagattttgacggattgcttcaaaaagggatacttactcgagatatgatagaaaggaaaagacaccttcagactatgggagatggaaaagattacagttcagtttctgatttcataaactcgataattgatattacaaccggtgatattaaagtcaacccgataaagaatttaataaacaatcccgatgatcaatcacctgttgaaagaaatgtccatgaccttgctgcaattgaagaatttcttgcctctgataacttacagaataaaaaaattagaattggagaaccaaaaccttttccccaaacaaaagatgatatagtcgatgtgaaacgcctagctactacaggattctatcaaataatatccttgaaaaatgaaaaagaggctaatcaaaaaattcaagaatacatctcagcatttatagaatatccccattatattatctacatgcactattggttgaaacggaaagaattttggttaaaagggtgttcggtcaaccaaagtggaattgacttcaccagtaatcttgttgcctcctggcattctatattaaacgagaaagtcttgaacaaatcaaggatggcaagggctgatattataatttacacccttttctatgaagttcttccatactatgagaataaagatggtgtgtctggtgataataccaacaaaccaaatcttatacaagccagtaaaaggaataaagatatagttgatgctttaacaatggaagaaattgaaaagagagtggaaatcaaacgttcaaaaatattagtgcaatcatcgagacaagaagacatattttatgaaattaaaaaggacgatgggaataaatattcatgcaattgcgaaaactatcgaccaattaaactatgcacacatgtttacatagttgcaaggtttttatctgttcacccccctaaaagaacgtccaataaaagaaaagcagcaacaaccgaaaccattaataaactgcaaaaaattgcaccagcaaaaaacaatgagacacatgagtatcaagggcaatctgttcaaccagaataccatgctagtctaacagaagaccattcttttccactaactccattgacttataattatgactcaaatagtacagattcacaattcaattcatttaatcaaccaactaccgagatagactttcctgatataaatgagccagatggacacataccattaattacaaaagaggaaattaacaaagatatagccgaggccattaaagtgttaaaggatacctccaagtatgttagagaaaatgggtcttatgaggaattactaaagttttctaatcacacaagagattttaccttgaatgtaaagaagttgcttctgaataatccttag

SEQ ID NO: 11422 - DNA, 246 bp, Candida albicans
cactatacacttttcctatcaccacattactctacttcaagaaagcatacaataaacactgcagtacccaagttagactctgaaatattgaggcaagttattaatgactctttaagaattgagaatgtgactcttaatgacactgccagttcaataattccaaatcaaacacccgaaatggaacaattaattgaagaagaggcttccctctcaatatcattagcaaaaaatgatgaatccttttaa

SEQ ID NO: 11423 - DNA, 438 bp, Candida albicans
ttcccggtgcatgaaaatatgaattgtttaataaaggactttttaaaattgccattgattagagaagagcttattgatgcacatccgcactttattgccctccttcgacgtccacatctcgactcaaactttggtcaacgaatatttaatggagattatttgaagaaaaattttgacagacaagaatttgaaaacaataggcatatgcttaattctaattataaatttaaacctaaacctagacctaaacctaagtccagtcccgagcccgagcccgagcctgaacctgaacctgaacctgaacctaaggttaaagaaatttcacttgacaatattgaatatgccagctttggtaacgctaatgctagtgtaaggcctcattctggtgcaagatctcatggtgcaacaaactcatggtgcaagaacgtttgttgttga

SEQ ID NO: 11424 - DNA, 936 bp, Candida albicans
tacagtcccactttcgatgaatttaaactgtatttaaagaccactaataaatatttcaggtggagcatgaatagagtaaaagatcatatctacatgaaatgtgaaaaagggaaaaagtattatgaaacgaaaaccaaaacaaagaaaactgggtgtcctgcaggaattaagttacggactaaaaatgataaagtacaaatggagtattgtttccatcataatcattcgtttatagaccatgatgatactgtttcagcgactgtgcgggatcccgtccgtacttggctcattaaacaagctctccaaggaagagattgggcatgggttaattctcaaagatcaaaagttaactttggtacaaacattgcgagtttagaccatagtttaaagttcaattgtcaattatatcatagaattagacaaaaattgggtattttcactggtagggtctcttcgaaactagaggaaagtctaaaagagtaccaagacattttatcacagaatggatatgtaaaattttggctgaacttgaatgagaacaacgacaacagcaagccaagaacgtgggggtttgcctttgcaactgactatatgttgactaagctacaacagtatgggaatacaatttttattgattcaacgtctaacattggaaaaagtgacaaaatcactgagagagtattcctttacacagtcatggtattagataccagaatcggtcaaccagttccaattgcttggcttttaacacatactcaggggtcgtacccactttatttactacttcatgacttgaatacaaggcacgggttaaatccttctttgatctgtattgactgtgcagacattgagagaaaagccattcgagcagcgtttcccaatgaaaaagaatctgaagtttcatactgcttctatccccttaccctaagcacctaa

SEQ ID NO: 11425 - DNA, 225 bp, Candida albicans
ggggatagaagcagtatgaaacttcagattctttttcattgggaaacgctgctcgaatggcttttctctcaatgtctgcacagtcaatacagatcaaagaaggatttaacccgtgccttgtattcaagtcatgaagtagtaaataaagtgggtacgacccctgagtatgtgttaaaagccaagcaattggaactggttgaccgattctggtatctaataccatga

SEQ ID NO: 11426 - DNA, 183 bp, Candida albicans
agatgcatattgtttcagacacaataccattgctgtcttaacttcccatttgtccttcaaaacaaccaattgaagtcaactaaattgatcagttgttcaagtagtaatacaagacttacttgttataaagacgtaaagattttcggagttgaaaagattgcttcgaggttactccacttttaa

SEQ ID NO: 11427 - DNA, 183 bp, Candida albicans
ttcgcgactatcaatttttccccattcatgacactttacgattcactttataaaattaatgatttggaaacaaacacaaaacaagacaacgtccaaagtaagggcagtagtgcgaggggaagtcactcagttgctatcaaccaacgtcttcgttattcgaaagcaatagcaaatgagcattga

SEQ ID NO: 11428 - DNA, 243 bp, Candida albicans
ttctttttttttgtttttattctccaatatttaacgtttcaacataatcatttagtcaagcctttgtttgaattgaaaagacggaggataaagaataagattatattattaatgatggataatttgaatcaagatccaaattcaggtgtttcacaacataacaatcaacaccagctccagttttctcacaacccttccttgtctaacactcaccaacataatagtgcagactttggaacatag

SEQ ID NO: 11429 - DNA, 360 bp, Candida albicans
  unsure (29),(272): Identity of nucleotide sequences at the above locations are unknown.
aactgcatcaacttgtcagatctaaggtnttgtgtcgtatctacaagaaagttgcaacttaattttgtggcacactcatttaatttattgttgattctgttgagaaaaaaagttccacccttttcttcttgtaataaagagaatggttttattcaaaattggcaatccactataaaacacgttttagtttgtattaattatttcttgcttaatgtttttttgggggttattgtttggtttaatcccaatccacgtactgaaaaacattttantatgaaagtatggtgcctttgttattcccggagaatacacctatttcccaaaatattgtggaataaacccttcaaaacctcatattga

SEQ ID NO: 11430 - DNA, 207 bp, Candida albicans
cgtgccggacatgttgggttcactgtttcagtaaagggtggttttgttttgcttttcaacttggcaacaaaatttttaatcaaagagtttttttttttcgttcattgtagatactatgatgagatgaatagtgagacttttttttttgccgtcttggacaatgaaagctcacactctataggtaaatcattcatgaaaagtgactaa

SEQ ID NO: 11431 - DNA, 207 bp, Candida albicans
ttagtaccagtttacaaactaaaactgaccagtctaaacttccaatacaatgaaattcccatcaatcgaccaaaaatgaaaaagaatataaaaaaaaagcaaacagatctttgtttaactaaactctcctatacatatagaccattacataacaccactgctatttttttctacaacacgtttctaacgacatgttctccaacttga

SEQ ID NO: 11432 - DNA, 204 bp, Candida albicans
gagaagaaaaaaaaaaaccgattacatgatgtttattatttatttacgcgttttttaaaaactagaacactagtatctcaaacaactctatttacaagctatgatttacggcaaacactattccacttaggatatgtatttgtattcagttatcaactgtcagggttctttcattgtttttattcttatcccagcattctttaa

SEQ ID NO: 11433 - DNA, 237 bp, Candida albicans
tataaaaagaagagaaaagaaagatatttaggatatttattatatagagaccgagtttcaatagacacttttagtgggcgtaaacttcattcactctgttttttgcttattacaaattatcacctatcgtgtactaggactaattctcacgaatattccgtgtatacaaacacttattgccaacttatggtgcggaactttatttgtctgaaccaaaatcaaagtcacatcatttaa

SEQ ID NO: 11434 - DNA, 189 bp, Candida albicans
ccaataatacaaagaaaagaaaaagggaagaaattgtttctattgaataaagaatctatttatgtcaacgttcatttaaatgatgtgactttgattttggttcagacaaataaagttccgcaccataagttggcaataagtgtttgtatacacggaatattcgtgagaattagtcctagtacacgatag

SEQ ID NO: 11435 - DNA, 192 bp, Candida albicans
aaggcacttgcatacgttgcaagaaacccaagaatattaataattagctttcgagtcgacaaatcttcaatactagtgagatcgtcgagtcgatcttacaaatttaagggtgagaaaaattttgcaatcaattcttattatcaacatatctggatcgttaaacgtatatttctaattcagcgaacccatctg

SEQ ID NO: 11436 - DNA, 183 bp, Candida albicans
cacattctcaaattaagttgtatatttaattcaaaaacaagtaaaagttacttaatattcaagaactatgctttaaataaaactctcacaaaccaatatttatcacgtgactggctgcatttattgtgtgccatctggagttcattatataatgtctgcataaaccctcccataggagcttga

SEQ ID NO: 11437 - DNA, 447 bp, Candida albicans
ttggactttttaaggggggaggtaatactcatcgtgacaccagtagtgagaattcatctgtgtttgacaatgagagaagagggtccattagtttcaacgactacgtcaatcgaaccagtcgactatgttactattaacaattacaagttttattcccaagagtacacctttaccactgttgagaaacaatacatttccaattgcataccagatttgaactcttttgataaatggaatggcaagttaatcaccgtcagtaacgtggatcattttattagagataaaagatcgtttgaagacaaagatgacgttttcattagttatgctgcattggggaacttggtacaatcatatgataaaaaatcacataacgactcatccatgcttaccacccaaacttttatcattcatcaaaaagggttagttggtttaggaacacaagtttga

SEQ ID NO: 11438 - DNA, 630 bp, Candida albicans
tttgttgattgtttttttgagccttctgttttttttttttttcattttttttaccttctaacaaagctcgtttttctgacccatttttattcatgttgtgtgtgcactaagaaaacatctccatttattatactattcgatatcaatcacacacacacaatgtctttaccaattcctgatttaagatttgaacaatcattcatcagccagttaaataagtatgcgggcaacaaacaaccagaccaacaaaaactacaaccattgagtagtaagaaatataaccatattgccactttaactgatgatgatttgaagttattgaatgaagaactagacattgaagaagaggaagaaatagataactacactgataaaccacagcccaaaccacttgctcctataaccccttcgatagtcatttacgctataataaaggatcaaatgcttatgcctttattacaaggattcttatggacaggagtgctactttgtgtacgtccacttttaaaattggtagttagaaacggtcaatacgccggacattgggtgtctaacttgttgggactaaatagattggcgacatctcgctcgtcttcaccacggggctggacggatccgcacttaagttaa

SEQ ID NO: 11439 - DNA, 207 bp, Candida albicans
tgtcccacccacaatctgcttaacttgtccggaatggatatcaatgcagcccctaaatttggtcatctttggctgaattgggctaatactaatattggttcgagtatatctttaatgaagtatctctcgcgtggactagatatggaaagtggttataaaaccgagtccaacaatcagaagcgtgtgcggaaccaaaaaaaaaattag

SEQ ID NO: 11440 - DNA, 192 bp, Candida albicans
tgcacacacaacatgaataaaaatgggtcagaaaaacgagctttgttagaaggtaaaaaaaatgaaaaaaaaaaaaaacagaaggctcaaaaaaacaatcaacaaatcattgtacaagtaacaggtacatcccaccgtactacctttcaatccgaatattgcacaaatatagacagtacactatggaaatag

SEQ ID NO: 11441 - DNA, 222 bp, Candida albicans
cgatcctgtatatttcgtcataattcacacattcttaaaattatgcacacatccttgaaatgtgttaatattcccaacattatcaattatatgtgttcagaattggttgcaaagttatcaactcaattcacgctatataaaccttacaaattctctacatttttatatttttttatattggcttttcttttagaatcaatcaatactttttttatcatttag

SEQ ID NO: 11442 - DNA, 222 bp, Candida albicans
ttcgcacgcggatatgccagccccgtgggtcaagaatcagacaacgatccaatacaggtttttagttcttttaataaagaatatgatcgagtacaacaaaaattgttagacaaaattcaatcagaaagagatcatcaattaaattgtttgtcagtccaacatttacacagacaaagaaggttactcgatatatccagctgtcttgagcaaattctgcaataa

SEQ ID NO: 11443 - DNA, 207 bp, Candida albicans
aatcaatcaatactttttttatcatttagatacatctttcatctattaatagattatctttctatatatcaaaacacgacacagtcacgtgccaaaaaggatataagaaggaacttcacaatgcaactgagagcccccttttcttataaatctgaaacatcgactataaaaccaccaaaaaaatcccatccatcgtcaatctgttaa

SEQ ID NO: 11444 - DNA, 1206 bp, Candida albicans
aaccaccaaaaaaatcccatccatcgtcaatctgttaatattacccaccaggcaatgctacaatctacgcctaagagctggaaagactttttaaaatctccaaagaagcccactagccctaccaccccaccaggcagtgtgacgatcacaccaaatacaacacctccaagtgtgccatgtgtcagtccacgaccagcgaaaatcccttccagagacccatttcaaaccataaatcccggactagacctttcctttgccaatattctcaacaagtcactagcaaatcacgaaacatgtttcatctgtggagaactactttctactgtatttgcatcagaacgaatcctaaagttaaattgtggtgactccacccacagcgaatgtttcaaagcttattttaaggaagatataccacacgcaagaatccatggcaagacaataacgtttgccaaaacctgtcgtggtttaaattgcagtggcaccagaaacgtagttgtcgatgtaaacaactggcacttggtttctgctagaaagttgtcgttaatacccaagagaccagcacctccacaccccaacagtgtcaacattaacgctttaaagacaaccttacaaaacagcgatatacctaccagatctccttcaccagacccaactgtttcaaccaccacagaagtggacgcatatgaggttgaaacggttagaaaccaactaatcaaatatttgttagatctgtgtcctaaaatcaacttgtcaagattggttctgttgggaaatttgcgagttgcagacgagctatctgtttgtgtggagccactggactatttccaaacaaggtatgtttatttattcgaaaactacatggttatatggaatagtgttgactaccctgtattcgtccctatgcagaatatccaaatctcctctcgtggatcgtccatcctacaagtgcgtcaaaaagatgatgggttatcgacattgattcaatctacatctagcacagtagtggaaaaatgggttgttgccatttctgacgctcatttacagttgccagcaccggatataacgtctacaattgacacctcccctagtgatagtgattccgatattgattcagacgaagaagttattcagcaagcactaactaaaaacaattgggccgatttaatgattgagattgataatgcgttacttacatctgacccgtaa

SEQ ID NO: 11445 - DNA, 360 bp, Candida albicans
cattcttactaccataatcactacacaatggaagcttcaaatatcagaatagacggaacattattacaagccaataagaacaaacttgtcagagtgatgggcaaatgtgaatcatttgatcatgcttcgaatcaagccatcatagtgtgcaacggaactatcaagttagatttatcacaagttacagattccccattagagattcataagaactacgaaatcattggaaaggtcagtggtgatgaattaaagatttttgtgtactctgtcatagagttgagcgataatttggatataaatgctgcttcaaagttggctcaatatgctcaaaaagtatctgaattatacagatacgattaa

SEQ ID NO: 11446 - DNA, 183 bp, Candida albicans
gaatgttatactttaatgacagaagtaataagaagattgtttaaaaatacaacgcgtcctcaagtttttcgaatgttagagtttgagattttccgtgttcttcccaactctcgttttattcacgtgcaggcagacaacgaattcaaaccaaataaagttatttgtgggaataacctctgttga

SEQ ID NO: 11447 - DNA, 279 bp, Candida albicans
tgtcttccaccggtggtgaagactggctctactggtgctgaattacaagataataatcaacctaccgctggtttatttggtgatggtaacagttttggtaaccaaggtctcggtggattccttgctgctaccgtcgattcacttactaaaaccatcgctagtccaattaaaggcatcttacctccacgtggtggtagtggtggaaatggtggtactggtggtagtggtgctgctggcggtgttggaaacctttactctggtattttaggaggtttataa

SEQ ID NO: 11448 - DNA, 237 bp, Candida albicans
agtttctcactcttcggttattcttaccaattctttaaactaatacaagcaggatttatgatctcatttaagtactttcttcaattagatgaatggcaattgcaacttgacaaatttttgtcagccttcagtattgattcttggatcaacttgcttgacttgcttaatattcttgttcatactcttgatcattctcttcagaccaacttggtatcgatctcttccttaatatcttaa

SEQ ID NO: 11449 - DNA, 264 bp, Candida albicans
gcgaagtttaattatgagattaatcaatcaaagattacctatccctgtcaagtaaaatattatatgaagtgttacagaattttaataagaaaaccaaactgttatacgaagtttaattacgaggttaatcaatcaaaaaaagattacctatccctgtccagtgaaatattttatggagtattaagaagttttaagatattaaggaagagatcgataccaagttggtctgaagagaatgatcaagagtatgaacaagaatattaa

SEQ ID NO: 11450 - DNA, 366 bp, Candida albicans
caaattccaatgttattactagccaagatattgcagctacacactaatctcacattatcaattagttcattaggaaatatgtcttcgaagaaacctcaagagaaaactaacacaagtactgatcctaactccgctattgaaaattatcaccacgataaggaagtcatggcgatgcataggatcgagaagcgatttaacactttagagatggaaagtgcaattcaacaacagcagataaatcacatgttagaaaagattattacatataatattatattgaaacatattatgcaattgttacaagaagaatataaagttcaagaaattaccaagttggagcaatcaattaaagaattaaagatttag

SEQ ID NO: 11451 - DNA, 207 bp, Candida albicans
aacaacttgtccaatagtaaaattttcaaatggtactacagcataatccactttttgtttcatttaaaaataatggaaacaatctcttatggattggttgaggattttttcataacattttctggttacaaattgttgggaatttatgccttgaaaaatgaatggttaggtaacttcacccgtaagtatgaagatttttggagttcg

SEQ ID NO: 11452 - DNA, 216 bp, Candida albicans
ttaattgattatggtaaaccatcggtgacaagtattctaaaactgatggcaggtagcttagctgctcgtaatatgatagtttgttcaggaagcgattctttgaaaagagaggtgagcagtatagtttatgaactccaatcgttggtgtttaacaatgacttggtcagatccaacgttgaagaaatatatttgcacactgagtcttttggatggtaa

SEQ ID NO: 11453 - DNA, 228 bp, Candida albicans
atttcaatacagaattccaacaagagattgaaagttaggatgaaatcctcgaacaaacgaacgaacgaacaatccgtgagacaaaaaaaagcgagattttcaacgttggaaaaattttctatcatttggcaacaagcacacgaccaggattatacaaacttgccccaaaacattaagcaagggttcttgagaacaacatctatcattataaaagttcacatatattaa

SEQ ID NO: 11454 - DNA, 216 bp, Candida albicans
atcccgaccaatgtggtaacaaacaatccaaccatttttacagaacaagtacaaccaatggaaacaccagttaaaagaatccatttccaccattttctagaaaattcttgtgatttattgttaaaattgttgaaacgtgaaaaacagaaaacagtagcaacggtgaagaataacaacattgaatccaacaaaatgaatttacctaaagtgacataa

SEQ ID NO: 11455 - DNA, 216 bp, Candida albicans
  unsure (157): Identity of nucleotide sequences at the above locations are unknown.
agcaatcttgacacatttcacgttgcactaagatttaggttaaacattgttgaaaataccaatttccactctttagaaggctttttttttttcagttttatggtggtgatattgattgaatatacaaaaggtaaaacggaattgactcgagaaaaanattttttttttcttcttcaaagattcgattgtctttttttcactcaattacaaacttga

SEQ ID NO: 11456 - DNA, 438 bp, Candida albicans
ccatcagaggtgttactaaagtttgttattaatgccctggttttacctttatgttcaggtactataccaacaatcctttcattacgatgtttatttagttcatctgtgttggagtttattggattaatattgaatatcactgcagttattcaaagtgttagagctggagccatgtatgaaattgaacgtgaacgtgggaaagtagtaacgaaaacaagagtcgataaatatatcatttttttccaaattacatcaatgatattttcattactttcgacaatttgtgtttttatattaatgataatttgtgaaaaggctttagaatatattggtaataaagttgatagaagagtacttaaacgaaatagaaagattcgtatcggttctgaatcaatagatgattatcgatatagattagataggtattactcagtttga

SEQ ID NO: 11457 - DNA, 324 bp, Candida albicans
cttatggttcataacgtattatttgatcctcctttaccagatgggcagagaatcaatgttgggaataatacaataattgaaaacatttatagtatttataatcttgccgtgtttaaaaacattttccgaatttatttgacattcttattgattcaatatattctaatatatgtttgtgttccattagatgatattgaaaatcgacctcccataggtattatatcaacagcatatacactaattatggtatgtgaaaaaaaaaaaacaacttcaaacagacaagaattctgtctgaaagatactaaccatcagaggtgttactaa

SEQ ID NO: 11458 - DNA, 207 bp, Candida albicans
tttcaatgtttgtggctttttttcatttttaattctttttttgtaaacatttttgcaccaaaaaatggcaccataattgagaaacgctttcaagttttcaaacccttacatatcgtttttttaatcatgtataggcgaaaaagcccataccaggataaaattactactataaccgaaagtaaatggcaagccagccaaggtatgtag

SEQ ID NO: 11459 - DNA, 834 bp, Candida albicans
  unsure (787),(788),(802),(818),(821): Identity of nucleotide sequences at the above locations are unknown.
atattttccgtttatttttttggtaatttgtaccacaagaaatcaaattcacaaagataccagagaataaagatggcatacaaatggggcagatcaatgactagttgtaatatcaaagagctcccacttttaccacccactgccaacaccaacacaaacacaaacattaatgattggcaagatacttctagcaacatctcattgagcgaatatcgggaaagattattacgtcgcaatatgattgatgatcctaatgatgactactccacagatgttatgccattaccaccaatgcttcagacaactacatactcactgctgtcagaggatttaactacattaaccacactccgaccgcccgaaattgacaatgaaaatgatcacttgaaggcgccattttgcgaacccctgcattcgaccaacatgtcaattcaatcaccaattccatccatccactcaaatgaagaagaagattttttgccggacccagacttagatgatgcaatatcaatgtcctcatatacaaaggcacagaaaaggaaatcacgataccgccctgtgcaaggtagtgtgaatgttgcaaatgcaccagaaaaaaataacaagaccaattatcgtcactttaatctatcagaatctaacgataaggttgttcccactacacatgatacggcaacacagtttgataaccctttcaaagaccctataatcactaagaaacctaaagaaggattacttaaaaaatttagtttaacgaatttaaatatccattttgaggggctcaagnnatttttttctaacnaagcagaccgaggatnccngcgaattattaat

SEQ ID NO: 11460 - DNA, 204 bp, Candida albicans
gggtttgaaaacttgaaagcgtttctcaattatggtgccattttttggtgcaaaaatgtttacaaaaaaagaattaaaaatgaaaaaaagccacaaacattgaaatcaattaacaagttggatgttttacatacatttgcttatatctgtcaaaatgctgttacgttcagatcgtcaagacgtatctgtttgaacggtatttag

SEQ ID NO: 11461 - DNA, 243 bp, Candida albicans
gtaaacaaattaacattatcttcaaacaaaaaaagaaaacagactttctggttgttaattgttgatatgtgcccctgtaaaaggttgcatttgaaggctggacattgttttatttctgaaaaaaatatcgccttagagttagcaatcgtaccagtaagtagtagttatgctagtggcagtgtttctttggctttttttttttcatatctagcaatgaaaaaattgcaacatgaacggtgttaa

SEQ ID NO: 11462 - DNA, 189 bp, Candida albicans
acaaagccgcttaatgcttatactaccacacgttctcttgtccaacttgaaaatctttttatacaactgaactcagttaaagtatcttattcactacacataactattgcgacattggtaaacttttatacatcaactttactggcagcaaactttatgatgggtcctaagaatttatttttcgggtaa

SEQ ID NO: 11463 - DNA, 189 bp, Candida albicans
  unsure (11): Identity of nucleotide sequences at the above locations are unknown.
tcatgtattancttatttaaattttcaagccaacccaattatagtataattcgggtatttattgaaaatttattgggttggcactcctccggaataattttaaacaggaaaactctttttttaaattttggaagaatatattgtttcctttttaatgaatgtgttttaatgagaaataaccccggtcac

SEQ ID NO: 11464 - DNA, 1197 bp, Candida albicans
agacaaagcgaaagtcaaaataaaaagaatttaaacactgcatttgaagatttggatcatgaatcattattatttcaagatacaccaacattatgtgatactacttcatcaattaaacatttagaagatgaatatcgaccattatcgaaaaatcaattgaaacgattagccaagaagaatcaaaaggataaaaaactcttagaattgaaatctttggaaaataataccgaaattttttatcaagaattaatgaatactgaagcattgatattactcaccattgtggaagaatttgattttagtgaaagaatccccggttggattggcaaaaaattgaataaatggtttggtaaaaattccaaattcccgattttatgtattcgatttggattattaggatttcattggccatttaaacggtctactttttattgtagtgctactaagaaaccagtagctcgtggtgcagcagttttatacgccatatcacaatggaatgctcaacatgagaaattaaccgtattattggatccaacatataaagatgtgaattttgaagccgggataacttcgagtggatggtataagatcaaattacccaattctcatattatcgatttacgaccatttcaaaatcaaaccagtacagattatttcaaggccatcaaatatcgaactcaagataatagttttaaacaagctcatggacaagtgattgaaactaatgtatttaattatgaaaattgtcaagaaatcattaatatgaatcaaaatatttctcaaaatagacaactgtcaggacaatcacaacaattattacaaccagattgggaattcatttataatttaggcaatttttctaatgaaaaaaaatatcgatcgttattgtttttaaaagttgataatcaaatcattgcttcatgtgtgatattccgtttgggtgataccatgacctcagatatccaaggtttggatcatgctataagtaaaaaatataaagcatattttgtaatgatgcaagaagttattaaaattggtttgagagaaggagttaaatttattgattttggtcccacaactgaagaagctaaagttacgattggttgtaatgttgtaccattatgtggatcaatttacccgaaaaataaattcttaggacccatcataaagtttgctgccagtaaagttgatgtataa

SEQ ID NO: 11465 - DNA, 267 bp, Candida albicans
acaaagttgcaatttctcctttttggaaattttcttttttctctttctattgttgttgttgacatttcggagaagtcacgttttattgcactatcttttcaatcgcacattgattatgatgtgtctaaccaggctataacgtttcaaaaaaaaactgatatcaacggcacaagttacaatcccaaaaaaataccttgccatataggtttaaggacaatcaaattcttaaagaagattattaatttatttataaaactgtggttttaa

SEQ ID NO: 11466 - DNA, 246 bp, Candida albicans
tacaataaacgtataccagtagctttaaaacaagaccccgcagataattatctcttctattttcacttactctcgactatagatgccttatgtttcattatcatacaaaatacaattgcttccgaatgttttagaatggatcaagttgccaaaaatggaagaagcatagatctttatcaggttccgatctttttgacctttcacattcttatcgatcggaaaggagccacgtttatttttttttga

SEQ ID NO: 11467 - DNA, 231 bp, Candida albicans
aacgagatttaccgtcaagggtggaagattcttaaaaaccctaagggggtagacagaaaaatttggccaaaacaaagtgaacaccggaggaaggaacgaccatttcgtggggatgatacaatttatgggtgtaaacctaggagaatcttaatccatttcccaaaatttattcagccaatggacccagtggcattaacaacacttttagctttaatttggaagaattcatag

SEQ ID NO: 11468 - DNA, 285 bp, Candida albicans
aaagttatatgttttctactagcgcgagcggtttgtgcggtttgtgcaggaaaaaaaaaaccgttagcattgttcccgttcaatgaaatcctattctttaacacgcatggaggacaactatttcacctaaatattctacagggcaattatcatagaacaattcaagttgattcaaatcaagtagagttggggttaagtttggatgtcttaccctttgaaggtcaatcgggtttgttgcgattgttattaataataagcctcaaacaatttgaaacctattgttga

SEQ ID NO: 11469 - DNA, 228 bp, Candida albicans
tgtttaagatttaatgatcatgatcatcaacatttggctacatatactactaccattattgttgttgtactaagtttccccttattgttattaaatatatacatcaaaaaaaaagaattaagtcgatttgagacaaattatgaaatagacatcaagcattattttattttattttattttattataataattatgaatttatatctctatggacaactctctatttag

SEQ ID NO: 11470 - DNA, 207 bp, Candida albicans
agagttaataactttgttgttatttacacatatatcttattaattgatatcccagaaagtgattcttttctttctttttttaatattttgattttatattattataatatacattatgaacataccgctaaaagaattagagaaaacatgcaacatacaatacatggacattttgcttttttctctctccaaataataaaaaaatga

SEQ ID NO: 11471 - DNA, 186 bp, Candida albicans
atagagctttttttttcaatattcaatattcaatattcaatattcaatattcaatattcaatatttcacactttatttagtggagtactacagtttatagaagttaataccagtaccactaccactactattatagaaatttttatcatatatatacaattggctactaaaaacttaaacttttaa

SEQ ID NO: 11472 - DNA, 261 bp, Candida albicans
aattctcaattcattttcttctgcttttttttggtttgcttgtttgtttggacttggttcagttcagtttggatttggattttggtttttggtttgattaaattcttttggaaaattaaaaatagaaaaatagaaaatttatttttccaaaatatcatccgcgtaaattttaatcattttcaactatacaattcaacttttacttcaaactattttattagtttaaacctatatccaaatgaatgggataggatcatctaa

SEQ ID NO: 11473 - DNA, 225 bp, Candida albicans
tcaatatttgaaaaaagaagggatgaggatttaaggacggagatgctaaactttgctcatttttttttcaagagtttatctttttttcaccgactcaactcaccaacctatttgatcattaacacagtagctcacagtaggtcttcatataatatatgccaatggatggataaatgcatagacatagattattcgccacggcgtggaagatcccactcggatgca

SEQ ID NO: 11474 - DNA, 186 bp, Candida albicans
ttaattcctagagcttttcagtttaacatgtactatatgctcttatttgtaagatcagttctcagttcctcacttgattacatagttgatatttcggtgggtttgtttcatcggaagcactcggatattagtgaaaaaaacataaagtggggcgacaatcgtgtcttgctcaatcttgatcggtaa

SEQ ID NO: 11475 - DNA, 237 bp, Candida albicans
ttacctgaatttgatactcaatttgttcattcatatctagttattgtcgtcgttgttgttgtacgtggagaaaattctgaaacacaatctttcatgttaatttttacatcaaaaaaaaaaaaaaaaatgaatacacaacgcagaatacaatttgagaacgttgctattacctttctaccaccaccatcctatggtaattctcataacaggccaagattagtgatatttattaattag

SEQ ID NO: 11476 - DNA, 453 bp, Candida albicans
atccacgcaaaaaacaaagcaggagcagcaacagcaacagcagcaacaacagccacctcatcccctaacttaaagatccgcctacaaatgtcacaagaagatttgctaactagggtaacaccggtcccattagatgaaattgaagatactaatcctattataccgaagagaaaacattggttagtccccacattatatcgaattcaaaaatatagtgcatattcttttatttcatttctagggatccatgccacttcagtcatacttgtccccattttacctattgaccaactgattaaagatgaagtctttgccatggctaaagaagtctatcaatcagtgccactttatgaaccaatatgtattataggatcagttgcagctcatgtcatggctggtatcagtataagaattacaagaaatgttttcaaaagaaaccactgcatcatataa

SEQ ID NO: 11477 - DNA, 186 bp, Candida albicans
gttgaaatttttagtttttttaaattcaaatttattcaattaatcttttttcactttttcttttccttattaactcattggtcaatatattttaccattcattatttatttattaatcaatcaatcaatcaatcaactaatttatttatttatatattatatatcaacagcaatagactcacataa

SEQ ID NO: 11478 - DNA, 183 bp, Candida albicans
catgcatatataacaagtgtggtcgttgttgttacgacctttaccggcataccagattgtggcatttgtgtgtttgttgctatttatcgaatgagtgctgttaatgagagaagagttttggatgtactgtttgtgcggttatatatcgatgagcctatcactctttctctacgagtggattga

SEQ ID NO: 11479 - DNA, 183 bp, Candida albicans
aaacatatatggctatggattaggttggtcctgaatgtaaatcctgcagatagactaactaccaactgtgatttaaaatccacccacgaacaaccgaaaaaaaaaaaaacccaaaaaccaagagataaatcaggacaacacattttgaactatcccttgatctataatttgattccaaattaa

SEQ ID NO: 11480 - DNA, 207 bp, Candida albicans
aaattgattcaaattctcttttccccacgaatactaacacactttaatcatttaagaattatcagttatgttgaagagacacctgactatttaattccttacaattggagtttacctccagatcagaatagatttgccaaatataaacagttgagaaatgcacgcaattcatctcaagctacagttggttgttgtacaattgtttaa

SEQ ID NO: 11481 - DNA, 306 bp, Candida albicans
attcgatataatgtggggactaaccaatgttttctcttcggtataataggattagtatcttcaatttcatctaatgggaccggtgttaccctagttagcaaatcttcttgtgacatttgtaggcggatctttaagttaggggatgaggtggctgttgttgctgctgttgctgttgctgctcctgctttgttttttgcgtggattcattttactaatatggagaatgtcattggtgcagagttgcggcatcaagaaattggtcaagtttatcaacacaaaatatcattgactccaatatttacctaa

SEQ ID NO: 11482 - DNA, 291 bp, Candida albicans
tctacagacttttcccatatcattcaagctctggcaattcaaaaaagaggtactcagttttctaaattagaaaaaaaaaatatggacgagataagagtcgaactcatgacctttcccatgctaagggaacgcgctaccaactacgccacacgcccattttataaactcgtaaatgtgctacttttacagaacaaaagaatagagaaaaaagcctgctacattactacaaattggatcttaagaacattttttattgcagatttgcagggactatcgatactctctatttag

SEQ ID NO: 11483 - DNA, 183 bp, Candida albicans
actcgtaaatgtgctacttttacagaacaaaagaatagagaaaaaagcctgctacattactacaaattggatcttaagaacattttttattgcagatttgcagggactatcgatactctctatttaggtcaatcagcacttacaaatatacgtttacgtttgcactcgatagcacctaagtaa

SEQ ID NO: 11484 - DNA, 306 bp, Candida albicans
tctaaaacacatactaatcttacccgacatcgccacataggaattaaaacatatataatattccctaaagagcaaaataatggaaataatgtgtcgacccaacaaaaatatgaacaaggaaaaaacaatcaaaatttaacacacgtagcaaacgtgtcagttcctaacatttttttcttttgcttgtttggtgcttattcaatttcagtcaacagtttcatatcttatcaccataagtatttatacaggtgttataacagattttgcattggcacagaaaaccaaagggggctggaacaacaataa

SEQ ID NO: 11485 - DNA, 222 bp, Candida albicans
caaacgtgtcagttcctaacatttttttcttttgcttgtttggtgcttattcaatttcagtcaacagtttcatatcttatcaccataagtatttatacaggtgttataacagattttgcattggcacagaaaaccaaagggggctggaacaacaataataacaggaagcagaattatattggatcaaacgtttgcttgacacttgatttgattaatctgtag

SEQ ID NO: 11486 - DNA, 195 bp, Candida albicans
cccgtagacgaactaaaagaccgtggaacagacgtaccagaaatgggatttgcattgattatgggaatattatttgctgacggagtactacttctggcattacgtaaaaatgccgctaatgatgcattagaagttgatttgttactagtgatcgatactcttctttctaatgaagacgacgggacacttggttga

SEQ ID NO: 11487 - DNA, 183 bp, Candida albicans
aaaagagaacaacaaatgaaccacagtttagatagtataggtgtgtacgtagagggggagaaagaaaaaatgaagataagcaaagtaaggaagaatgaagaatcaagtaaagatttaaatagttttttttacatttttttcttacttgtaatcattgtctatattttattactatatatatga

SEQ ID NO: 11488 - DNA, 204 bp, Candida albicans
catagaaagaaagaaatagagagggagagggcggagataagctggaagaagaatataaaaatacaaactttaaaagaatcggatataaaattagaaagagtgtgtgagtgtgtgaatatgtgggacgtgtatgaaagtcataatttacatatgacagaaattaaatattccgccctcccctcccccccacacatatatatataa

SEQ ID NO: 11489 - DNA, 198 bp, Candida albicans
gcccatatttacatcgagtatgcaagtttagttggagtaaagttgcaggttacaaaacgtgtagacgagagaggcaagagacaaaataaaaaatttgataacaagaaacagagacatatcgaacaaacaacaaatacctcgcatagaaaggaagaatgttaccctagtcttcaccatggggctggaaggatccgcacg

SEQ ID NO: 11490 - DNA, 204 bp, Candida albicans
atgtgtgtggtaactccgaccctgctacctagatacaataatctttggtcaatatatacacaattccctatcattgatgctgaaaagttccacatggcatctcgagataagtgtacatctttgatgaatatgtcaacagaatcaacttgtactgaatccaaattgaataaatcttttcaattgaccctggctaactggtggtaa

SEQ ID NO: 11491 - DNA, 207 bp, Candida albicans
aattattttattattttaaggtgtactcacactttagtttttttttcctttcccttcccttttttccttttcccttttttttattttgttttaatactattttatattaacttcttgttgccatcgacgaatcattacccctatctaatctttaatagatttagttgtcacttttttaattcttcattcatcaacaatcatcgatag

SEQ ID NO: 11492 - DNA, 195 bp, Candida albicans
ttgaagataacaaagactgttgttcctgttgcagtaccagcagtggcagttgaattaacgattgagcaagataatcggacatatttttgtaaaacagatcccacgaatgaactcacagggtactacttagtggatgttaaagtttttcttttttttttcaaattgaaagaacttaaaaaagtatgttacaattga

SEQ ID NO: 11493 - DNA, 201 bp, Candida albicans
attctctgtcaaaaaaacagcttgtcacttactaagagatttcatataaaaattgaaatctatacctttactgaaaaattaaattacatctacacacccaaagtgagctataagtataagtattatcacataaaaagagtcactttgtttcaacacaccacttttaatccactgatacttttaaatcaaaaagatcattaa

SEQ ID NO: 11494 - DNA, 186 bp, Candida albicans
tttatctcagaacctgtaactatagattcaacctcatggaaatctgagtcgcctaacgaaaactccgaaaaatccgaggtgagagatgccgcaggacttgcttccctgccgccgtctattgtaagtttaacctcctctgttctacctctgttcttctgggattttagaaacttcttagtgagttga

SEQ ID NO: 11495 - DNA, 303 bp, Candida albicans
tcaccctttttccatcccatgccattcagtcgaacatttgctacaaagagtacaataaaaaatgccttgtcattagaggaatttctatttagaagccgagctatatcaatatatcgcgaattgtgtcgagaaatatacaagactcatgaacgtcaagatttgatgagattcctacgtgacgaatttaaagtcaattccaaacaatctgatttgcagtacagaaaatatttattatcacaagcattgaacactattaatcaaatgactgctagtctaggaataactataaagaaaaatctatag

SEQ ID NO: 11496 - DNA, 255 bp, Candida albicans
acaaagaaacaccacccacaaaaatataagcaacacataaagctagctagatcaaataaattttatattaaaattttaaaactttattccaaccctaggagtctatatttcaatattagtttgcttttttttcaattttttttttgtacatgcaaggttgaactctgtatacttttttttttcttctatttttttcgcagccaaattgttacatttttcaagacaccagtactagataatatgataaaactataa

SEQ ID NO: 11497 - DNA, 978 bp, Candida albicans
ctattgaatttccccagtttccaacagcataaattgaaacatgatagatattacacattagattggactctaatcctagtcaccagagctttagacacattaattatatctaatttcaaatctattttccacaccaatctgaaaacagcgaaaacagtcggtgcttatggagatatagtgttatttgtaagtgcctgtttctttattatggattcctggtttttcgagccagaaaaattgactccacactatgccaaatggatcaccaaagcatcacatctagatgagaatgtattattgggaataaggtatcttagagatggagaattagattatcatcccactaaaccattaccacatcaaaaccatttcaaagatttttgcattaaatataacaaagaccccaaattaggagatttgaatcaaattgataaaatcccctgtgaaattctacatcagtttaccactaagagttgttggaaacatgttttaatattatttcgggttcaattcaaatttgcgttcaaattatatgctacattaaatacttttttatttgtctttattaaaaagttcagaggtagtccattgaagtatttatataaaacaattagatccgcttcatttttaggtgcgtttactggtatacattgggcagctttctgtttcattagaaattatcatccaaattggttcggacaaaaattctgggatattctagcccctaaagcagggtctgcattatgtgggaccagtattttattggaatacccaagtcgtcgtaatgaattatccttgtttgtattgcccaaggcattagggacttttattgatccaaccccaactgaatcgaatatagcaaccgaggtgatagcttttagtttaagtttcgcagtattaatagcttatgctagactgcaaccaagtaaattaagagggttagtgggtaaaggattgagttatatggtcaaacattaa

SEQ ID NO: 11498 - DNA, 216 bp, Candida albicans
ctcataagatgtcttcttcaattactgttttttgtttcatgtgcttcaggccctattactcaagttctactcaaacaatcgaatgaaaagggccctaaagttgttggtactattagatccaatgaaaaaggtgactttttgaaagaaaacttgaaagctgccaaattagcatcagacatctcagtcgtcaccacgggctgtgaaagtcccgcgctg

SEQ ID NO: 11499 - DNA, 405 bp, Candida albicans
ccacagttatatattgttatccacttatctcctcccactctacacaacacatactatatagtaatgcttagacgagaagctaccaccataagattatcaccagaagatatcttagaatatgatgatagtgtggcacaacaacaaaaacagaaacaagaactacaacaaggacaagaacaatctatacctcaacagaatccatctgattttagtcctcctaatatcttacaagaacaaataaataatagtagtcatagtataattcctgattttaaagaagaatcaggatcaatctatcagagatcacgtgtgagtcaacaacagcaacaacaacaaagtcaaagtcaccaccatcaacaacaatctagagatgagaggattggtattcaaaggaatcatggataa

SEQ ID NO: 11500 - DNA, 240 bp, Candida albicans
acacacatagacacacacacaaccaaaaaaaaaaaaccccaatttgattcctgttatcaaataatgtcaacaaaagtcgatcaagtcataacattagctcaagtactgtcattattagataattcagaatcgaaaaaatctataatttggaaagagtttggtaattatttagataaaagtgttgacattgaagaccccgacccatccacatttatcagaatcggaaatcccctccattaa

SEQ ID NO: 11501 - DNA, 207 bp, Candida albicans
tcttctaaactgtcaaacgagagaacggcaagcctttacttacaaggaagaaaaaaaaaaaaaaaacaaaacaaaacaaaacaaaacaaaaccgaaaccgaaaccgaaaccaagaagtcagagagaaaaaaaaaaataatagatttcgatatatatccctatttaatcttaatagttatccactatattaatattattattgtttaa

SEQ ID NO: 11502 - DNA, 270 bp, Candida albicans
ttattaaaaataacgcaacaaaaaacaaaagtcaggaaagataactttcctgtttttttaaaaaactatttacaaaacagacccactatattcaattttcactttttgcagcaatcaagaagcttaactatttcaaaacgtggtgttaattatatgcagtgtggaattgttgttgttattatcgcccatcaccatattcacaccgcacccggacgcacccaccgcacgcacacaccctcacacccagaaaaaaaaaaaaccaagcagtga

SEQ ID NO: 11503 - DNA, 201 bp, Candida albicans
  unsure (55): Identity of nucleotide sequences at the above locations are unknown.
ggtaaatattttgaagatcatgaacccaaatcaaagtttattaaaatccgttcantattggccttgaaaaaaattaataatcaattgaatttggtgattaaggccaaaaatcttagtttcatatttttcattaatttgatgaaaatgattgtgaatttcatgaaatccaaccattatatgaaattttttcaaaattgttaa

SEQ ID NO: 11504 - DNA, 192 bp, Candida albicans
atgatgttagcaaatatcaactattatgaggtatttaatttcttgttaaatttccctcaaattttactatactacggctgtgaagaattatatggtattatcattggttttgtaaatgtacacagcccagaaggttacaaaaatataattggagaagtagtagtagagcattattattataataatttctga

SEQ ID NO: 11505 - DNA, 195 bp, Candida albicans
cgactactagtactattttatttttttcattctatgcaaacctcaatatcaacgacaacaatagaagatcatcttcaccactactccccggaagaatcacagaaattgttatctcgagaatccagtattaacacagatttatttaaacatgagaatggtatgtacattttttggaatgtttataaatcttcttga

SEQ ID NO: 11506 - DNA, 363 bp, Candida albicans
ttgattttcttattgaagattaaagttttaagttatagtttaatattatgtgaatttgagggatctagggaggacgaacggacgggagagagggaacagggaattagccggaagaaagggagagcgagagagaaagaaaaacaaacaagaattgaggaggagggaacgaacggggaaggacggcaggcaagaagaggtggggacataaatttagacgagaacaagcaatccttagtaccaatcacttcaagaatttccctcccccttccctcccctccccccattttaattattttgttgttgttgataactctctcctcttttttttacccgcttaattattattgtttatcaatagagtaa

SEQ ID NO: 11507 - DNA, 210 bp, Candida albicans
actaacccccctttccttcccttttattttttttttatttttttctttttttctggcattgttatcttattatctcatctctttaaaaatttgattaaatatgattttaaaccagatatatataatcctttaaataatccttttcattttgttgaattagaaaaagaaaagaaggtaatctctgataacactatcttgggtaatttctag

SEQ ID NO: 11508 - DNA, 240 bp, Candida albicans
tttctcgaattaatactctccattacaagagtaagagatagcgaagtgatacaattaaaataccaagccccgttttatcaatttaatttaattttaaaatcctcggatggttctgttttaaacacccccacccacccaagcacacacacacacccacagcaaaaaagcaaagaaatcagggagaaatcaattgatggtggaactaaattttctcatctaataaataacaataataaataa

SEQ ID NO: 11509 - DNA, 243 bp, Candida albicans
attgattgctgtctacaaatggagtttacctttttgtgtttatgtacagatttgtggttaaaaaattttgtgcgtgtacttttggataacttttttttttgcaatcagttttcattcttacatagtaaagctatcatgaactgtttcacttacacttgtaaatgtatattatataattatttaatattaacacacaaacttattgaaaaaagaaaaacaaaaaaaaactaccaaaaagaatag

SEQ ID NO: 11510 - DNA, 348 bp, Candida albicans
actccatttgtagacagcaatcaatttatcaaactatccaacgatgaactaagaagattttacaggtttaatctgattaacacttggttgaataatattctagatagttgttttgagaattttttttttgttttttggacaggaaattccttgtactttccttatggatgcatatcaaaaagaaactttaaaattgttgcagcatttcatgaaaaatctataaaccacacatattacctcattgaattgccacaaacacaagtacaaattatgtatggtttggagtatattgttttttgtcccagtccctccccccttctcacacactctctcccattcaatgaataa

SEQ ID NO: 11511 - DNA, 396 bp, Candida albicans
attgttgataatttagttttgattgcaaaatgggagaaactaatgttaccaatcacttttcttcagatctacatgtcacccagtaataaacttgtttccttttttttaaggaaaatacaatatttacaattaaagcaccgtcatattattcatcccctaaaaattgaatggattgctttttatgaaaaaaaagaaaaaaaacaaaacaattggccagtgtgtgtgtatatgtatgtatgtgtaattaacaatcatcatacatacattgttcttctatttaccttacccccaaatcatactctgatcattccacttataattacagccacaaacttctttataatggagtgtttgcaatcctccctcaaagaaaaaaaaaatacaagtaaagtgtag

SEQ ID NO: 11512 - DNA, 207 bp, Candida albicans
atattacctaccacccatagaaacaaaaatcatagaataatcaaaaattcaaattcattctttttcctaatcaataattacaaatacaactttttaaaacattcgttccaaaagtttcctaaatacaattttcattctcattcaagagagttcttaaatctacatacgacatctttcttcacccacggggctggaaaatccgcgctg

SEQ ID NO: 11513 - DNA, 213 bp, Candida albicans
gacaaaaatgggattatgagcagctttagggaaaataacgcaaagagaaaaaaaaacataagaactagaaaaaatttagagtatggatggaaatatctcaacagattacacaaaattggattcaagataatttttcttcttctactaaaaggcggaaaaacaaaaactacgattaacgatgaaagtgaaagaatagttttttgtattatatag

SEQ ID NO: 11514 - DNA, 213 bp, Candida albicans
aataagaaaccatataaaagaatagaatacattgggttacgtggggctaaaatatgtatacagaattataacccaagcttttgtcaaacagcttcatttgatgaatgcagtaaatttcaatctataattgcacataattaccagggaacacaccggtttgaccattgtatttaccagtccaccatccgttggcatcttcggttctttgtataa

SEQ ID NO: 11515 - DNA, 189 bp, Candida albicans
atctcctgtaatctcgtattgtttagccatggtgttgtataccaagaagaatatcaaagttatcgtaaggcaaagagaattttttttttcattccatttttttttttgcaagtttttccttcggccgctttctttactatgaatcaacattcaatacaacaattattatatggagacatctccgtataa

SEQ ID NO: 11516 - DNA, 192 bp, Candida albicans
atctcggagtacagaaaaaaaaatacccttgttaaccatactgcccgccttaaaatatgtttaattttgcaagatctaagacaatgtttgggtaagctgtaccaatattgcggatctttttcaaacgtttatcaagttttgccagaaattaagtggtggccaaagctagtccaaaacttgtatatcctataa

SEQ ID NO: 11517 - DNA, 315 bp, Candida albicans
gaaaactacggtagaattatttttaggaagtttcaacactcaagtcatgcaccagctagtgaatctgttccattttccaacaaatttggttttgatttaagcccaccaccaattcacgaatactggaatatccacaactccaccatactctttgcattcgttccagtttttcttggaattgcatactttgctaaatatgttggtaagacagtggacgcaaatgctgcctacttaggctacgctgactccgaagcatcaccagtcagcaaaatcccatttgggcaatctcaagcagcacctgccaaagaagagtag

SEQ ID NO: 11518 - DNA, 657 bp, Candida albicans
cttgtgcacacccacagaaacatgatatcaagaattggcctcagaacaccagcaaaggtgttgtcactcagttccagaggagttgccggctatacatcaaggatcgcattaacaaggagttatgctactcaaaaagctacaatctatgatcaaagtactggtcaaacaatcgagttggctgacccagaacaccctgaattagcagatttcaaaaacccaccatttgtattgaaacaatacttagatccatatgccaaatacgacgatccacagaatagaagaaacaagaatgacccaatgcacattgatgaagacatgttggatttgtggtcaccagattactatgaccatgtatctgatagcactgctttgaaacataatgccatcttttttggtttgatatttgggatttcagctgtaattgcctacttccaattaaacccagaaaaaccagccatgatcagatcattcccatacaatggtttagcagatgcattaggagctacctcagaagagactgcaccattttatcaaaacaaaccagatttgactgccgaaaaggaatgtggcattttacccgctgataatgatatcaccaataatcaagctgcctacgaaaaagagaactcagaattcataaaatctggtactgcttag

SEQ ID NO: 11519 - DNA, 558 bp, Candida albicans
atctcatcttgcagatccagcaaacacatcaagcatattctcacaagaaaaccagaaatgccagagaatggaagactaaggaggacactggcaaggttgactcagaatggaacttcaacctcctcctctacgatttatcagaatgggaaacgaaccagccagcatgcacaagaaacatcaacagcatcaaataaaaaaagaaaagtttcaactcaatcaaaggaagataaattatcagatattatcgttgattttaatttggcagttaatgaattgtaccaactaaaggaatacaaatctattataagctgggaccctatagaaaattcaagtgcaaatgataggggcattaaggcagagtttgaagaatttgtgaaaaacaatgattacagacttgtttgggataaagaaattgaaaataattccaatatagacagtttgccactaaggtttcaaaagaaaaagttagcggaacagaacaaattattagatgacaaatttctgattcgacagaatctttttcaccacgggccggaaggtcgcagattgcttggcgaa

SEQ ID NO: 11520 - DNA, 261 bp, Candida albicans
aagtataattatatgaaaaataaacccaaatttaaaagtggtgaaacaaatgtgtgtatgtttatatgtcggattgttagtttagctagttgtgatggtttccaaacagaatataaatacagaacaaaggaacgaaaactgaaaaaaaaacaaaaaccagtaaatgggaaaccaggatttgaatcaattttattatttgattttataagaactggaaatagtagtagtagtagtagttcttttgatataattgatatataa

SEQ ID NO: 11521 - DNA, 267 bp, Candida albicans
tgcactgttaagagaggggagggggttcaatttgacaacaacaaatacatcagaagtaagaaacagtataataaacggctctttgatttaataagtagtaaagtaagaaataaggccattaataaagacagggtaagaaatgaaatggaggggaaaaagaatcagaaaacaactcatattatagttatatatactttacttttctctcttttttttccccctggtttcttgcttttgaattccttatccattttcacatttcattaa

SEQ ID NO: 11522 - DNA, 243 bp, Candida albicans
tttgggattttttttgccatcaaaacacaccacaagatccatttaagacaagtttcagtctttacatatcaattaagaaaagacttaaattatagatccaagatttcaactacaaaagcgaagagatttagattagaaacaactacaagaaattggaatagcaagagaaaatcccccacatcaatttgtttataccagattagacaacgatcagtcttcactgccgactgccgaacgcgctaa

SEQ ID NO: 11523 - DNA, 198 bp, Candida albicans
aacaatgggaaatggtgcaacatcaaccgtcgtttggtgatgcacagtggaaaggagctgaaactgggaattggaaagaactcattgcaagagcacggagtaactaaaagtcattattctgaacctaccatgacagtaatttttctatcacattatagatatttcaattgtgctaattatgtttctgtattgttataa

SEQ ID NO: 11524 - DNA, 240 bp, Candida albicans
atgcggtccttgcggtccttggtgaagaagggggtgattaagaataaatggagttggatgaaaagaacaagagggaaaagaataacaaataaatttgaatgggattttggtttctatttatacgtagggttaatcaatagttattcttcgttcaaccctttggttttgaaatttatttttctttattattatgtccataattttgtagtaatacttaatagtggtagcgatagtaagtaa

SEQ ID NO: 11525 - DNA, 252 bp, Candida albicans
atccttaaattttgttattttagcaccaaaaggaaaatgttgatatttataacaattgtggttcccgttcaattgtgtgttgtacacaagaggaaaacccattgggttatgggtttaattcaggggagaattttggaaaatggggttgtagaattgcaaagttatataaaattcagtgaattggataattacaacgttattgttattacaggagggggggagatgtttttcggattatctaaaaactgttaa

SEQ ID NO: 11526 - DNA, 522 bp, Candida albicans
attgaaaacctaccacaaacaaattatacaatgaaattcacaaacatcgtcactgcttcattaatttctgcttcagtcactcaagctgctgttattccacaaagtaatgaagaccttgctgttagagcagattctagtgatcctatttctggactccttggtggacttcttggaggtggtagtggtgctccagctccagctccagctccagctccagctgcttctggctctgctattcctcaacaagctgaagccactggtggtgctgctcctcctgctggtcaacaaagtgctgctgctccatctgatccaatttcccaagtcattggtcttgtctcaaacattttagaaggtgggttcagtactagtggtgctttgttacacaatctcattggtaaaagagatgattcttctgctgctgctccatctgatccaatttcccaagtcattggtcttgtttctaacgttttagaaggtggtttcagtaccagcggtgctttgttacacaatctcatcggttaa

SEQ ID NO: 11527 - DNA, 399 bp, Candida albicans
atcatgaagacttcagtcgttttagctgctgctttgacagcaatgaatactgctaatgcagccgttattccattttttgatggtgaattatctatcaattatgatgctcattcaggatggtcatttggttttgataaacaacctgctcaatctggttctccaccagctacaactacacctggaagtggaagtggaagtacaactacccccgctaccacagctgatgacggtgatgatgatgagggttcatgtgatgactctggctctgcaccaccagctaataatggtggcagtaatggttcttcttcaggttcaggagattacttttctcaatggaaacaaggactcgacaacttaattcaaaaaggtaagacatggtttagtggtcttttcggttaa

SEQ ID NO: 11528 - DNA, 246 bp, Candida albicans
atctttcttcttcttattcaactttgtgttgttttatttttgttttatttcatttcaattctcattatcgttcaaaagaatttttttataccgttttcaaatatattcactacactgacagggtataaattgtcatggggtgaatatcacatgattggatttttatttgtttataaattttttgtcatttacaggtttcaattcttaggtatatcaaattttttttctcataatataaataaataa

SEQ ID NO: 11529 - DNA, 234 bp, Candida albicans
ctcttcttttcatttccgctttgcgttttttttttttgttttgttttgtcgcctaattctcttacaagagcagaagaagatttgggcagaaaaaaagataacacgacacacgacatatttgtagggtctatgtgtgagagacattttttgaatgaaaattggttaggacgagaaaacttttcaatgtgtttttctttttcttttattcagagatttgagactagtgacagataa

SEQ ID NO: 11530 - DNA, 342 bp, Candida albicans
tatcgtaaccaaatccatggagaaagactgtgtaaagtaagagagaaaaaaaaatgtcaacctagaaatttcccaacgaatcaaatctcgttgattaccaagctattagaaatgatttgtcctggtaaagtgattctggtactgatacagttgatactattcattgttgctggtatcaattgttttgaattggggaaagagttaatagtcaacgactcacacggtgatatttatcggattgtatttcctggtctagtatttgttacatttttgcttaaattatttgttttgccaatcagatcaaagttgacgacatcgtcgaaagaagtcaaaagtttataa

SEQ ID NO: 11531 - DNA, 231 bp, Candida albicans
gctttccacactaatcaagaattagcattagctatattacaacatctatccttgaaatgttgtactttcccctctggcatatttgaaaaaggtttgtttccagagctagagattttcaaatatatagggaattacgaatctacttatcgtgctaataagtatcatatagcattacatctcccatcaaatttaaggcatttgtttcaaaaaaaagacgaaattcccccctaa

SEQ ID NO: 11532 - DNA, 603 bp, Candida albicans
aggaagtatgggttcaatacattaatgctcaaattgcaacagagagagaaattccttattcacttgtttgggttacatttgtcaaaatctatattaccacaagagtaccttagaagtgcccatccagttcttgataaaaatgtgattaaaatatttcttgatacccatccaaaatgtgatattgatcaaattatgtcatttgtaaataatgaactgattaattatgtagggaaaaatgatacaagggaaaatgatatgggacagaatttaagagagagtgatttaagagagagtgacttaagtgaaaatgatatacaacaaaatgagttaagcgaaagcgattcaagtgaaaatgatttaagagaaatagcaacaaaagaaactgttagtgaactttttgaaaatcaatgtcagaattgttttggacttggtcatgattcatatgaatgttcactggcatttagaaacaatcagtatattccagatttattttctagacttcagagttttcgtggaaatagaattcaaaataataatagaaatgtctggtctagattctcagaacaagatgagtcaattgcaaatacagaaaaaggtaactag

SEQ ID NO: 11533 - DNA, 222 bp, Candida albicans
tttaattgttatttttactatttaaatgttgattttatttatttaattttaattgtcatttttaattttacttattatattttacgtgtgactattatctatgataaaacactaatagtggatattgagtgtttatttgtttcatcgcagaggatatttattggaggagggagaaaatgtctatttggtataaggaagaccataaaagttggttccaaatag

SEQ ID NO: 11534 - DNA, 297 bp, Candida albicans
cacaagagaaacaatatttttgttgatttgtttttcgcgccacaagagaatatttttttaaacacccataagtggggcagcaccacctttgtttatattaccccgcggggagaaaaattaatgttggaagaattcttttataatccccattgcggggtaaaagaaacaaaagagggaatttccgggttttttccagaaaaaatttccaaaaatattggagtttttatatttaaaaaaacattttttggccctggtgagggggaattttggaaaaaacccctgggggtttttttataa

SEQ ID NO: 11535 - DNA, 597 bp, Candida albicans
ttgctagtatatttgaaagcactacagtatagtatgtcagaatcagatcaattaaactctactaataatacaggaaacactttcattagtctagatcaagccagtacaataatggcagatcaaactcaaggaggtaacccacaacaggttatgagcctcgcccgcttattgaatttagataatataggggcaatgaaagcttttgaaagtgttgattttcctgaatcattaaaactagaatccaagattaattttcaagtgtggagaaatgaaatccttagatatgcacgtggtattggtgctgagtttgaaaactttgtattgaatgaaactccagctcacctgtatgatcttagattgggaaatatgcttcatcaattattgattcgcactgtgaaagaaaaagttagaatgcctagacaagaacttggaaaatcaggaaaagaactttatcttgatcttattaaatcattcggtactcaatacccatacgataaatttgagatagttaaatactattgggatcagttaacaagccctttaattaatgtgaacagacgtcttgaaattgaaggaagtatgggttcaatacattaa

SEQ ID NO: 11536 - DNA, 891 bp, Candida albicans
  unsure (29): Identity of nucleotide sequences at the above locations are unknown.
cgcggattttcgtctccctgtggtagaanaaaaagggtttgttggttcccgttaatgaactcctcgattaaatcctcacaaataaatctgccgcaatcgaagaaattgataaaaaaacaaataacacctttgcaaccaactcctccaataatttcgccaattccaattccacagcaaccttcgacatctattgcagtggcatcagaggaactgcgattaccagtaccacccccaccatcaccaccaccagtaccacaacctccacctccaattcatccttcaccatttattagcaacactattgatgatgataatgctcaaacttcgttatcttattcttccaatttgctcaattattgtcaagaaagtgtagctacacctacgtatccagtagtagccacaaaaaactccgatagtggagttcgcaatgcaactgtaatttaccgcaaaaaaaatactgaggagttagattataatttaaatgaaatatcgccaatatcatatgacactaattcacttagggtggttaaaagacagagcaaactttctgctaactccaaattagaagcacataccttaagtaatgattttaaattggaaaaggataaaattttgtcaccagatttggaaatagtgatggcaaaagctgaagataatgatgatactaatatagaaataaagcaaaagaatattttggaaacccccacaagttttgataacaatcagactcccaaaatcgttggtgataatgattcttacacttccccagtgtcaactgaattgttttcaaatataaccagaagaggggttttggtggattattgtgatcttattaggcataattgtaattttaattggtggatttgctcctgcggtgtttattttgggtaa

SEQ ID NO: 11537 - DNA, 219 bp, Candida albicans
ccttgtgaaaagggggtatcaggactttcacctttaagacttgaagagtaccacgtttctattttgttgataatctcactttcgcaacaagtaactccttcatctaaagtgtccaaagatcgagctgaaaccaaatttattaacaattctaatgtatctaatcttttgggagttactgtcgatttagcaagcaaacacaaaattgcaaatggcacatga

SEQ ID NO: 11538 - DNA, 189 bp, Candida albicans
tctgcccattcttcaagtgaatcaaacgtggcgagtgttttctcgaccagttgtgaatactttttatccttgggtgacaattttgttttagatagaagggagctcatcttttccgataagtcgtctttatcatgcaattttcaaactaaaagtgaattaattataccaattggtgatatagtattgtaa

SEQ ID NO: 11539 - DNA, 261 bp, Candida albicans
gcatgtaaatacattctacttttagtaataccaattatttgtaaaagtttggtaccaatttcaaacaaaaaattaacaggtcatagcattttggccacgactgttaaaaggaaccaatctgtgcgtgaaatgaaaaaaaaaaacataattgagacacgaaataaacaaaagattcaactatcacttcattcctgttttcctgtcctttttattttttttaatagttatttacaatactatatcaccaattggtataattaa

SEQ ID NO: 11540 - DNA, 2097 bp, Candida albicans
  unsure (57),(330): Identity of nucleotide sequences at the above locations are unknown.
ccaacgttagaggttcgagcatctaaatcgtcagatgactccagtgaaacatctgantactgtaaaacacaccccaagtccgatcagtgtgaaaaacttgttagtgataatagtgttaccattgctttatctattgtgttaccatgtcttgctatagttgccgttcttgggtattttctttatagaaactaccgtaaggataagaaggaaagtttagcacatgatccagactttgatgaaaatggagaggctactgcattaccggattatccccaaatgatagattatcaagaagatccattccataatagaaactccgttagatatccnatggactattctaataataaaccatacagcaaacaatatgaaagagcttcaaagcaacaacagcgtccactagacccatatttagatagttttgttttgccatatcaacatcaaactggatcgaagctttctctagatgactatgcaagaaaacttggtgatctgcaaggttatcaaaccccttccaacgtgggttctagatctagatcaggttctatgcatcttgatggaaatctcaaacatacaatggcagagggccgtggccattccagaaaaccatcttcagccaagagcccaagtaaaaagaaagatggtaaacaatataccaacattccgaatgattctgacccttccatcgctgagccaaatgcaagagatataggacgtggtgtacaagaggagacatctgacgaatcagagaactattcttcaccagaagagaaatttgtcgtgtcctatgaaaatgaatctgttcctaacgtgaataacgacgttccacagatatttgttagcgaagaaaatgaagaatcaactgaaaactccaactctccatttgatgatcagcaagatcaggccacaaacactactgagtcaacaatggagactatccctcatacaaaacaagcagctactaataattatgatgatggtgactttacattttcaactgaaggtgatactcgaaacacaacagcaactgaacaattaacaacttctaaaccgcgatctccaagaatatctgcattcaatttgttgaagaacgatagcgacaatgaagaggaagagaacgaagatgacaatgacgatgaaatgaacgaattaagtccggaacaacaagaagaacttaaacgtatgaaatctgtttataaagtttatttcgacaaagaagttactggggaagcggcaccaactaggaaatatgaaattgatgaaaattatcctcctgtaccagataagattaacgatgagttgaagatggacactgaatatgctaaaagatttagtaacacttcctctgtatatcaagagcacgatgaacagcaatttgttcaacaacaccaacagtattattacgaccaattcaatcagcaatatcaacaagaatacggttctccggtcgatccacaattataccaacaattccaagaacaacagtactataattattatgaacagcaacagcaacaacgtattaaggaatccaaaagaccattaccagcattgcaaaaaataccccgtccatcagacattagaaaatctactttacaaacttatactgatttcaaaccaagcatgaaaaaccaaactgtgacgtcttcacctactggaaagttaccatttgttccgatagagaatgatggagtatggacatcacctgtaaattcaccatcaatacagtcacaagcttcattcccactgcaacatcaacattccatccaaccagatggctattttccatcagcacaacaccaacaaccatcatcatcatcatcattgacgcaacaacaacaaagaaatgtgtccccatcaacaaatgtaccttcagcttcacagatggctagatcatcagtggttatgttaaatccagtgacagaaatcactaaacaaagaaaattcaaaccagttggatcaatacctagaattaacaacaatccacgtcccggatatcaacaatttggtcatagagatttgaatggaccggaaagtgatttgcttccaggtaatagaaaaagtgatgttagaagaatgatgaatagtaatttttag

SEQ ID NO: 11541 - DNA, 519 bp, Candida albicans
cacatgtcatccaccccagtcacccctcaaacaaactcttcatcgaaagtaacagtatcaactagtagagaagttgcattagaacaagaactttctcaaataactaacatcaatgctgttttggaacagtttcttcaaaccattgaaaaagtcaatggtgatttgaatcaaattaataatggtgctacaaataccatgattttgatgaataaatggacagatataatgtcacaagctgattttactcttgatgtgatcaacaatagtggatggatacccaatgatgaatacgataatgagtttggagaaggacaacaacagcagcaagacgacaatgaagatgaggaagaaattgaagctaaattacgtgctctcgaacaagaaaatcttgagattagtaaaaagattgaaaatcaagccaaggaaaagaatgctaaaatgaatcgtgctagagagattgatagtaaaagaaaaagggaattgggattgtttaatgttagaaagaaagcatcacgttaa

SEQ ID NO: 11542 - DNA, 204 bp, Candida albicans
tataaaaatatgcaaaaaaaaaaaaaatggagtaatgtgttgtctataaatcaatatttgtcgaaaaattattctacgcggaacgatctttggaattggagtagcaaaaaagaaaaacaacaacaccaaactaagcgtgcgggaatttgtcctctacttttgtttaatcggttcaatataaaacagtattatattctacattga

SEQ ID NO: 11543 - DNA, 231 bp, Candida albicans
atgatacagcgattactgcaaattagttgccttattctactgctgaagccaactcaaaaaaacttcatgtttacttttgattacccgttcatatatatatatattgatacaataaaaataaaaaaagaaaagaatacccttaagaacccatgtaattatacaaaaaaaaagacgtcattgttaaataaacacaataaccgttgcttgatgaccaatgaaaaaaaaaattga

SEQ ID NO: 11544 - DNA, 183 bp, Candida albicans
gtactgttgatctacctggctatagttcgcaaacaagctccactagttcccttaccgcaagatatttccgtgatgaagaatttggagaagatttatttgatgaggaaatcccgaatcgaaggtgctactttaccatattatgtgaaccctgaacgtgttaacttgtttgatgaactgaattag

SEQ ID NO: 11545 - DNA, 204 bp, Candida albicans
ccgtttatgattcaagacaagtttttgcttatggagaagagggaaattaactttatattgctagggaataacaaaattcatagaataccaaagaatgctatgaattggcaatctcagcaaaagtattcacatcggaagtatggatcaaaatacaatacgcagtctatgccgggattacatacacgagcagatttcctcgtctaa

SEQ ID NO: 11546 - DNA, 189 bp, Candida albicans
tacatacttaccatgccacctgacccaaattccatgattgctgaattggcccgtcttatgaattgtgttcaactagacgaaactgttttgcagttgtgtataaagttattagacgaaggagcaaatccacaacaattggccaaacacattcttgcaatcaaaaaagaaactaattcaatactaacctaa

SEQ ID NO: 11547 - DNA, 195 bp, Candida albicans
agtggccaatcaaacctgaatcagcatttcttagtggaaaaaaaaaatcagctggaaaaaagaaaaagaaaacaaacaatcagaaaatataaacaaactttaggtgttagacattcattgaaacacaatcaaccattaattacatttattctaaatagtacatacttaccatgccacctgacccaaattccatga

SEQ ID NO: 11548 - DNA, 297 bp, Candida albicans
cccatttcattcattaaggaaccagaaatcttatctctctctaatggaagcttattggagcatcattatgcgattgaaaaaacaaatcaacaatataaaaatataaataatagattaaaaaatacaaaaaaagaacgcataatagagttattgttatataaaataagactcctcaagcggttaacaaaatcatcatcatcgggtaacaaattggataacctgggcgctattcactactactgtttggaaagttattggagcacaattatgctgaaaagaaacaaatcaacaatataa

SEQ ID NO: 11549 - DNA, 189 bp, Candida albicans
caaataatcaaagtgttactaaggtgttatttaataatttataaaggaagttatattatcaaactgtcaaatgaaagaaagaataaaaatgatgcaaaaacgcaaaacaaaataaagaatatgcaaaaatgcaaaagtaatttaaaaaagacaaaacaatataaaacaaattataaacaaatacaataa

SEQ ID NO: 11550 - DNA, 207 bp, Candida albicans
  unsure (162): Identity of nucleotide sequences at the above locations are unknown.
tcaagcatactttttaggcatctggatatgcatgttgtgctgtatcatgtaagcatccggaatactattgaccccgagaaatggaaatgtaaattgcccccccatcctatcattattgattattttggaaatcaattaccacttgatatgattctcctcttncactttaaatcccaagtgttcaaaaagttcttaaccccccaacat

SEQ ID NO: 11551 - DNA, 186 bp, Candida albicans
ttggacaatttccccactcgacctcgagtcgcagaagaggaattgaggaactttctaagaatatataatacattctgggcgctctataacaaaagtcgtacattttataagacgttattcattttgaaatgtggtgatactctaaagtcaccttcaattagacagattatgattgtacaatcatag

SEQ ID NO: 11552 - DNA, 252 bp, Candida albicans
  unsure (122): Identity of nucleotide sequences at the above locations are unknown.
acgtttagaaggttcagcacccatgtacttggaattgacttgggaaccattaattctgctgtgccagttatgggatcagatcaagagccacagatcattgaaaacgaagaaggcaaacgtantaacaccatcaatggtggcattcagcaaagaaggcgaaaccttagttggtcttcctgcaaagagacaagctgtagtaaaccccgaaaacaccttttttgcaacaaagagattaattgggagaaagtttga

SEQ ID NO: 11553 - DNA, 186 bp, Candida albicans
aggaacaaagttgaagtaacaactttagaaacgcgtcagctgaaaagtaaattatgcacggcgattgtaagtaatgctgttattcatttagttaaatttggatccctgttcgaaaaagttgcattaagcagaggtgtttttgctcgtctgaactttgacacctttttttggcagaaagtgaactaa

SEQ ID NO: 11554 - DNA, 198 bp, Candida albicans
cacaatcttccgagttcatggagaagcattacttcaaaaagtaatttgcttttcgcatccgaacaaagaaagggtttgaggcaacaatgttacttttttttccctgaaactgttttaactctgaacatcaacattgtaagactaaattttagtcagttcctgtttttgcaacaatggaagttcactaaaaccatttaa

SEQ ID NO: 11555 - DNA, 216 bp, Candida albicans
tttgaattattaaagggatgctccgatattgagtattataataatatctacgaagaaaagaccaatagaattttctttctaggaaacctttattgtacgataaatgtaactcttaatgaattgaaggatatgctaacgactatttgtgaaatgattaaagcaggatatggaacaaaaatttttgccttgaataagagaaacattattgcagtctaa

SEQ ID NO: 11556 - DNA, 264 bp, Candida albicans
tcattcgcttttatacttacaagaatgagatttgcaactacccaacttgccacactcgcttgctttattttgacagctgaggctaccttcccattaagaggtttgttcaatgatgctccagttgatgttgatttaggtgtctatcacgaagaatctggtaataataaagaacaaaaagttgatgggttcaacatgagtccaaacattaagaagagaactcatgaatcatcggctcgaactgacgatccggattatttcccgaag

SEQ ID NO: 11557 - DNA, 183 bp, Candida albicans
aaaaacattttactcctccataatgtacctcggatgtcagaagataccatctacaagacatgtgattttgaaaatacatttccacatacccaccatatagtaatagaagataatgaagtgaaaattgtttattatttatcattgagagttgtaacttttgaaatcatcggagaagctttttag

SEQ ID NO: 11558 - DNA, 213 bp, Candida albicans
ttcaattcaattagaattcttttcaagttgaaaactaatcaatgtgatgaaaaatttaatagaaaaaaaatggtatttattgtaagttgtaatctatacaccgaaaatgaaaagcagaataagaagaaaatacgaaatctaaacaaaacaattctaaaagaaaaaaagcaccaacttttttttatgtaccaaagtaaatattcaatacaataa

SEQ ID NO: 11559 - DNA, 192 bp, Candida albicans
atgtatatgttgacgaaagttgaaaaaaaaaaaataaccattaaacaagaaagggcgcgacttttaaattattatgacgcttgtcaatcttacagatactacagatcacgtggtaagttacaaaaccacaaccacaaccaacaccaaactacctcaatggttaaccaattaaccaagctcataacgatctaa

SEQ ID NO: 11560 - DNA, 258 bp, Candida albicans
gtaaaaagaaaaaaattgtgcaaaaaaaaaaaagactcacaaccatttgacaccattggaaaacctaatatgtcaggtgccattctcaagaatcaattaaaggtacatattttaggagcaggtgctattgggtcactagtagctcatgacttgaaacaaaaatttccaaccttaatcaaaccagttttattattaaagcaagaatcgttagttgaaccatctttaaatcacccaattaatgttacacgtttacatgat

SEQ ID NO: 11561 - DNA, 204 bp, Candida albicans
tcggattttggtttagtgcctttgaatctttctgcaattcttctaatagtaaaagtaaataaagctgacgtaaccgcaaatggtgggaacaaatctagtaagtaccaaataaggttaggtttcatttcaggtactaaacactttattgattcctttaacgagtctaaacttccagagttatctagtactatatcggatcggtaa

SEQ ID NO: 11562 - DNA, 222 bp, Candida albicans
gttcttgatgtcccacccgccgcggtggatgaaaacggggtgatctacccttataaaaattccagattggatcctgtgtgggccagtgctgctatggctttgtcttctgtcagtgtggtcttgagtagtttggctttgaaattgtataaaccactgctcaaagctgaagattttggtgttgatgatagtaccgagagtgagctttcaccaaacgaagtataa

SEQ ID NO: 11563 - DNA, 1542 bp, Candida albicans
acccaaataatttccattagatttttttttggatactttttgtcactcattatttgcaaaaccacagtaactatgacagatggtattgattatattgatgtttgcaagacggatgtgcttggtcttgacacccttcatcatacctcggtaataccttcacccatacccacaatcacttttgactgtttaccatatactatattatcaaacatttgtacatatttgcaccaggaagaactaattaatttcagtttaatatcgaaaacgtcttatttacctgctattggcacattatacctgaaaattattgttactgacaacatagatttgacatgttcagtcaaaaaagctattaagaaatatccaagattttgtggaacaattatttccatatcgaactttggaaaattattgaattgcttgtaccacaatcaacatttggctggtcttttaagatcattgtctttagatttaaaccaagagtcagttaatctaattctgttattaggtattgttagaggactcaaattacaaagcttggttgcaccagatatcccattttcatatttttcaatgcgaggtcgattgaatcttgacactataaaaatattggctgtttcggccaaagatgtgggtttaacaccactacaattcactgaattagaaagtttaaaaatcttctacaacgagactagtagagataaaaggaatatacggcagttgtgcaaggtgctaaatgaaggcaattcattaagcaaacttcgtcatttggaatttagtgaaagtcttcagataaaagcaccgactttccttaatatcactaacgacgatttggatttggatagcattcctgcttgggctcatttttttgactacttttctaatggaaaaataactagaaaattagatttggattcgttggctattgagggatgggttggcaaaaaagccaaagagtgtatgattcgaatactaagtgcagttgatttatcaaaattgaatcacttacaattacatgtgaatgaaaaatatccaaagaatgaacaacacactagccagaggagattacttgatttaattacagaacgcacacctgctttgcaaagtttggctattaagccaacatcagatgatttgtttatccagcattataccatcataaagactttgaagcaaaatttagtccatcaacttaagcatcttctgttggtatttgaaagtccaatggcggagcaatcattagaagtatgcagcacaatttgtgattgtcagcataacttggaaagtttactaatccttgacaggtctactgcagtcgttgatagtgaattgctccactgctgtctcagttttgatgactatttgttaagcctctatgattatggcttgatatatgaaaagaagatcgtcgacttactatttagtgatgttttattaacagattttttgaagttggatgaacggtttatcattaatgattacatgcttgagctcgctcgaaatgccacagataatcttgccacgcggctggaagatccaagt

SEQ ID NO: 11564 - DNA, 231 bp, Candida albicans
ttggagtcattagcacctgtcagagatgcatttgtagaagaagttgatgtactggaactgccgttactattattagccaaggatggtacctccaaagaagattgtattggtggggtggcagtggtctttgtagttgctgtttttgtcggagtgctaggcgacgatgttgaggaggacactgtttttgagttgtttgtatctgttgatgccattacaataggtgctacttga

SEQ ID NO: 11565 - DNA, 192 bp, Candida albicans
gttataaatagtataattctcctaaatgataaaagtgtattgcgggagggttatgaattaagttcgtgtcgcacacaaagaatttcccattcatttttcctctcatctcatcaatacaaaaaaatttcatcttccactgtcacactcgaaaacattcataataacgattacagacgacaacaacaacaataa

SEQ ID NO: 11566 - DNA, 657 bp, Candida albicans
catataatggttgataatacatttgaaggacttttcaaacgaataaatgatcttgaattaatcctcttagatgataacaataataaagtaaacaatattggtgatcataatgacgacaaaacaatatcatcacaaattaaccaattgaaatcacaattatctaaattatatcaacaatatcctgaatttcaaaaattgaataatatcaattcgcaattgaaaatatggaataaattacaccttaatacttcgacagccacaaccacaaccactaccacgcctatcgataaagaaacaaaattagagtttttaaatctactttatgatgatcttatcaatactgacaattatgaaaagatgataagtataataaattttcaatatgaatcaattataaatggtattaataataattatttattatcgtcgggttcaatcaatgatactagtgaattgttagctaaacgaaagcagttgaatcaaattatgaaaatccatcaagcattaataattaaatcaatgattgtattagaacgatatattcaatgtacaataagacaaaataaattttggattgatattgatgatcaattggtgaaaattaatgccaaaattaaacaattagaattatcaaaactacaagccaataaatattaa

SEQ ID NO: 11567 - DNA, 399 bp, Candida albicans
accaactttcaaacaatgactttcttccatagtgctaattattttggtcatggtggagtaaatgcttctattccatcttcatcaataacaaatgtttcccaagagtttgctgatatcataagcaattcacagtatactgattattcaagttacaaatatttaattggtgtcaatgatccaccaattgacttcaaggtgaccaatgctgctaaatatttaccaaatgaaattgaaacaattgcacacttaaaactcattagaacattttcagtgatgaaaaagagagttattggctcagctgattccaacaatgctgctaatttatggagaatttttgttaccagagctgttcgtcgcttcattgtgtttgttactgcaattaaaaaaaccgttgttatt

SEQ ID NO: 11568 - DNA, 204 bp, Candida albicans
tacaaatacttgacatatttgggatcaacacaactgaacactaatcaaatatttctcctttttgatattaatagattaaaattatcccaacacgtctacgtgccacagctaatcttttttttttttctcgttggtttcctcctaaacactgacaatcacaatttcgcgagaataaaaaatcaaaaattaaaaatcaaagcctga

SEQ ID NO: 11569 - DNA, 339 bp, Candida albicans
tctcgacatacaatgataaataagaatttgaatttactgcttaaattaaacaagttggattttgttccaccaaacagcaactttggaggcagttcaagcccttttactccggttgatcaaactttgaagacacctttagaagcacctcagcatcaaactgagtttccattacaacaccaatttcagctgcagcaacaaggataccatgggaatgttaatcaatcttcactatatcaaaacccggaagtgaatgaatctgatgacaatcttaccgatattgatgaaacatgcaatttaactaaggcgaaatttcacattgttttttacaaaccaatttga

SEQ ID NO: 11570 - DNA, 309 bp, Candida albicans
gttaaaccttttttacaagaatttagcaaattatcttcaccaaaaatttttggaccttctgaatcaaagcacagagcacttttattgtacgaacaaacaagttacacgtattctaaatatgagtcacgaccctcttctttaactacattactcacactaattgttgttgactacagaacgacagaatcagttctggaaacatgcaaagaaagccaaaaactgaaaaatttctactggggacattatttgcgggtaagaacaccgccaataaccgaagagagaataactccattagcatttaaaagttaa

SEQ ID NO: 11571 - DNA, 201 bp, Candida albicans
gtaatgaaagaaatgctgcgatggaaagtgttgattatgaagcactttctgatacaagaaatttactgtgaaaatcaaaaactcttagattgtgccctatttagtactagagtattgattaagtttatagttaagatgtctaatcatagtcatggtataggttatttgactgatatttggaatcgattatttgatctgtaa

SEQ ID NO: 11572 - DNA, 234 bp, Candida albicans
ttgctggcacgaaagataatgttatggcaaacctggagagaactatttgtagttgaagatggtgaaatatttgccctagttgatgaagactctgcccctgttgttagaagacaattggatgatctgctgctccgtcaaattgaacagagccatcacgggattccaatgactacttgttcacaaacaacgtcaatgtgttggatacatctgtggtgcaaagtgaactgtttttga

SEQ ID NO: 11573 - DNA, 720 bp, Candida albicans
accaacaagaataattttatcacacctttatttccccccaccatgccagaaaacctccaaacaagattacataactcactcgacgagatattgaaatcatcaggatacatattagaggtaatcgaccaaaacagaaagcaaagcaatgtgattactagccccaacaacgaactaatccaaaaatctataacccaactgctcaacggcgaaatccaaaacttccatgctattctagaccaaacggtgtcgaaactcaatgatgcagagtggtgtctcggcgttatggttgaaaagaaaaagaaacttgacgaattgaaagtcaaagaagaagcggcaagaaagaaacgtgaagaggaggccaagaaagcagaggaaatcaagaaggcagaggaagcaaagaaggcagaagcagcaaagaaggcagaagcagcaaagaaagcagagaccgccccacaaaagtttgacgactttgacgactttattggctttgacatcaacggcaataccaacggcgaagacatgttgtccaacatggactacgaggacctaaaattggacgacaaagtacatgccaccacagacaacaacttggacatgaacaacatacttgaaaacgacgagctgatactagacgggttgaacatgacattgctcgacaatggcgaccacgtaaacgaagagttcgatgtagacagctttttaaaccagtttggtaattag

SEQ ID NO: 11574 - DNA, 237 bp, Candida albicans
tataaaaagaagagaaaagaaaggtatttaggatatagagaccgagtttcagtagacacttttagtgggcgtaaactttatttactctgttttttgcttattacaaataatccctatcgtgtactaggactaattctcacgaatattccgtgtatacaaacaataaaaactttcaaaaacagttcactttgcaccacagatgtatccaacacattgacgttgtttgtgaacaagtag

SEQ ID NO: 11575 - DNA, 183 bp, Candida albicans
ccaagggggggcactggtttaatttacggaagtctaactgccaacaagaacgacttgtacgtgttatcaactccgaattcaaaaatccctcaagatctagctaacactaacaattgtctaaccaagctgaaccactctaaaactaccccctgctgtaatcaccacaacaagtcaaccatctag

SEQ ID NO: 11576 - DNA, 273 bp, Candida albicans
ctattacagagggcctttaaagcctataaacagtggatattcaattacatgcttgtaaaagtgggtcaacaaatactttttagaaagaacatcccggaaaaaaagacttcaactcaatcaagcttaaccaatttatactattggattactataaaagctaaagctccccaaaccgtaacagatttactactgctgcaaatcattacaaataatttattatggataatctttatacgtggaactcttgctattgacgaaaaacggggaccctaa

SEQ ID NO: 11577 - DNA, 471 bp, Candida albicans
  unsure (24): Identity of nucleotide sequences at the above locations are unknown.
tggggaaggaatcccggattatanaagtccattgggaattcgatcttcaaaaaattaaggaagttaattttgggatttaacagtgccaagactgaaccgatgaaatacggtaaattttcattattcaccatgttgaaacagcttcgaagattaaatgatgttaccgagtttaatatatctgaatcggcagcggtaactactaaaactaggtactattcagagacattccaagtgagtgttaatgatatagatgatgataataatctccatattgtatctactctgggccatggatggacacaatgtcaactcacaaatattccattattgcaaatgaataataaaaccgatgaaagagcacagtttcgatatgctatcagagatgaggaatttggcgagttggttaatacattgttggatacgatagatttctgttacattacagggaataagatttatccattgaaatga

SEQ ID NO: 11578 - DNA, 201 bp, Candida albicans
cgcggaacaactgtaagttggttattatctcaagctacattagagataacaaaaacggtagctaatagtgcatataatcacaaactagaatttatgaaattacattctaacgtttttcctctcagatcgagcgaactggccaagacctatcaaaagagccatttcaatctcaccaaacacactaaatctcaaactctgtaa

SEQ ID NO: 11579 - DNA, 249 bp, Candida albicans
ttaaaaaaactgcaaaaaaaaataatgaagggtacgagattcgaactcgcgcggtcaactgaccaacagattactctggtaaagaaggatttgaaccttcaccttaagtctgtcaccttagaccaactcggtcaaccctccaaattcgatgtcaattcaaaagtgcataaaaatcaaaagggcaaaactgaattaagaaatgagattgaaaagtgcaaggaaaccaaggctagcaagttcaagagatga

SEQ ID NO: 11580 - DNA, 192 bp, Candida albicans
cataattgtaaactatactataaccattcacttggtggaattaggaaaagcaaaaaacggaaagtcgaacaacaatataaatcagaaaggaaaattataggtagaaagattgatgccgcaaggaaaatgttttgcccaaaggaaccttttagtagtgaagttttttcattttggtgctcaagcccaccatga

SEQ ID NO: 11581 - DNA, 225 bp, Candida albicans
cgtagcctaactattacaaacctatatttaagaaacaatattaaattaaaactcaaaacaaacacatatatactctataatttaatttctgatttctgtatcattttttcaaaccctttaagatcagaccctgtagtacatgaaccgccacatacaacaataacaacaatatcttctggttgcaaatatttaaaattcttgtacaacaagtcaattttgttataa

SEQ ID NO: 11582 - DNA, 198 bp, Candida albicans
aattcgtggggatgcgttgatgcacttaagcctaattctagtattgatcaacacattatcaattttaatatagaaatatatcggaatttttttaataaacagtttttcaatagtgatgatggcaatgggtcatcagaatatcttgatactcttaaaattaacttagatgataataattcacactgtagtatcttttaa

SEQ ID NO: 11583 - DNA, 195 bp, Candida albicans
aggggtgatgtcaaagttcaaattgaatccgattatgatcaagaagaagccattgatattacttcagtggttccacttttaactgatagagatttcaaaaccactgaatctaacaatcgtattgtcaggttcattagaccagatgtgtttttgaacttccgttacgtgaagagaattttgccagatactttataa

SEQ ID NO: 11584 - DNA, 525 bp, Candida albicans
attatgaaattcccaaaactacgaaaaagaactgtgtattgggctgttttgacggtttttgcacttttcactatacactttgtattccaatataaggagcacaacagccaccgagtacagcctatcgtattgataccgaaagcttttccgtctttaattctaaattctttagacactcaaaatgaagaacttgtccccataaagctactaaaaaattgccaaattatacgctcctatcatactggatatgaagagaacacgaagttgctaggacaagaaccccagtccaactttcacaagtttaatttcacagtgttcagctcaatgaagccaatcggacttgatctcaaacaatgtcaactactaagctcatcatcacaagtagaggtcaacgatgcagttaacatggatgcttcattacacgatatacttggcaaattattacaagatatacggcatgggaagttggaatatttgcaagaaatagcaccgtcttcacgcgcggcggctggaaggtacaacgct

SEQ ID NO: 11585 - DNA, 468 bp, Candida albicans
gcaattatcaacatgtcgtacaacccagaatcattcaaagaacacacaaatttccagtcggtgcattcatttcttaacctgtttcagtcaaaggatttcaatgatagtattatacagttagaagccccgagtatagacgcctcacgagaggtgtcaacatcacctacaaactccaaaggttcaacaagacttaatttcgatccaaagcaatactaccatcacctcgaacaattaccacaagcacagccacaactacagccacaatttacagaacaatttcaaatattaaatttaaacaaagatttatgcgaaaggaataccgcaactcgtaccaataagaaaaagttgagaactagtggcaatattctaactgctgatcagatttctcgaacttcttccacttcgccagctttaatgtcaccggtattcaccaacgatttgctttcaccgtcaccggaattgaattaa

SEQ ID NO: 11586 - DNA, 210 bp, Candida albicans
  unsure (46): Identity of nucleotide sequences at the above locations are unknown.
aagccttattttgatggagattatatgaagaacgttaatagagttnaccgttggattcaggatgatatttttcagctgcatgacaacgccacgaaaaactctaacccagctgctcatggtttgtttccaagaatggatttgagtgctcacaacaactttatggatatcaaagaaactcctttggacccagtagctcataagagacagtag

SEQ ID NO: 11587 - DNA, 231 bp, Candida albicans
ttgtataagctaatttctaactggaggggaaatgaagtgtacggaattgctaaagatggggtgtggctgttaataataaatttgttatcttcgccgagtgtgggtttaagaaacgaaaaactcgtaaacggattggacaatgatactaaagtctctgataaacagaacttattgctcactctgtgtcccctcatacatcttcgacttatacattgctatcaatattcatag

SEQ ID NO: 11588 - DNA, 252 bp, Candida albicans
aaatgcgaaatatatctgtactggaaaccaccagaaaaaaaaaaaacctatgctcaaaactatatgtactgtacacaatctagggctatagccctaatattgtacaggaagaactttaactatggtgcgaagagcgtttccaattttttttttttcaggtgtagtctgttctatggcaatactgttgttagtagagagtgtctcgcactaacagaacatttttttcagaacaggaaaatttttgaaatctaa

SEQ ID NO: 11589 - DNA, 186 bp, Candida albicans
aacaaaaataagaactcaagaatccaagtcaattataagtcctgtttgattaaatctatttatttaatattcgatattaataataaatctatattttatatttacagaagaacagaacaagacaaagaaatcttttttaatttattttattttactagtagtaaacccttcattatacagatttga

SEQ ID NO: 11590 - DNA, 192 bp, Candida albicans
acgacgaaacatacgataccgcgtgatacattgaggaatactattggttctctagattccaagatgattgccacgccatctttaccaaaacgaatagataatcaaaatgatatcaattcaggggagatgacgttactgcaaagttttcttaaagcaggtaacgaactgaaattatataagacattgtcataa

SEQ ID NO: 11591 - DNA, 228 bp, Candida albicans
tatcgtccatcctactgcaaaaagactattccatgctatactcaaatcaaaaaactgggtacatacttaatgatgatgactaaattcaaaccaagtgtcaccatttctagatggctactcaaaaatgagaatgatggcaaacaaatggaagatagatcaatgtttgaattgcttagacagagattttggctaaaacaccagcagactatgaatgcggaatacaagtga

SEQ ID NO: 11592 - DNA, 183 bp, Candida albicans
gtttcagtacttggtaaatccggccgggcattcaccttgtttccttactaccaatatttcgataagtttatgcaaatggataatcttgacacatgccatgaaacacaattaaaactgtggaattttaaccgtacttacacgtattcacctccattttcaatccacatcggtattctaatttaa

SEQ ID NO: 11593 - DNA, 951 bp, Candida albicans
gaactggaagttattactttcgggggaaacataccgttaattttggcttctgtggttagttcaggcataccaaagagacaggatcatgcagaaggacaagcaagacaggatgcagtagaaattcttttatcattgggaaaagaatttacagattccattggcagaaaattcaacaattcctactatgaggagagttttattttgaatattgcttatgttgccctttacattttgaatcaaaaagaacgtagcaaagaccaagtatataccccttttgctatctctcttttccaaaatggatttttcaaagttgctgaagccacctgtatctcattatggaacaaattgttgatcatggaccctgaattagcctcagccacattagacttgaaatatatcagtactcaagagagtagtatcatcaaaaatgcattaggacaaattctcatgatttttgctaaaactgtgaatcacgaaaatattcctaatgtgccattcgccaagttttacttttaccaaggatttgaatctaatatagaacagtctttgacttcagcattattgttgcaaattagaagtgttgctttatcattagtcgagcatactgtcggttcaaaatctcagttaacaggcacaaataagcatccagataatgtcccaactccattaattgaacaaatagccgttattattaaggatatatttgttggcaagaaagaactaagtgacagtgaatttatcccctttgatacgaggaacattagtccaccactggatcaatttgcttatttgatttcacttggtatgtcggaagatcaagcagcacatttttttgaacacggatgtaatttgagtgatattgcgtcaggaaaatttcttagatgtgttgaaattgatttgaaagaagaacaatggcaatctattgctgctctatcagagatttttcactag

SEQ ID NO: 11594 - DNA, 339 bp, Candida albicans
cattctactgaccccactaatttccaccaatcagaaatagttatacttgattttgacataattggttggaaattaactaatgacatttcaccagtggttaaagtcccggttttatcaaaaagtattatattaactccagtgattttttctaaaactttagcccctttaattaatactccattaattgctccaacacctgtccctaccataactgcagttggtgctgctaatcccaaagcacaaggacaagcaacaacaataactgaaattgataattttaaacaaacgaaaaatttcccattagtttcattttggaaaatttttggtaatttatcttga

SEQ ID NO: 11595 - DNA, 414 bp, Candida albicans
tttataatattttcatgttaccatttgcccatgggttgctttttaccattgaatattgttttaccaccagttgcagctggtgctgccatgatgtttagttctcttagtgttgtgttcagttcattattattgaaaagatggaccccaccaaaaattgaaactaagaaaacttttattgatgatttagaaatgggaaacaatgccaccggtggtgatggtgatggatttagtttgaaaaatggtacaatagaagaatttaataatgtgaaaagaaaaagcgccgttaattttagttcattatttgccaagatgactacaacaagaagaaatagaagaggagggggaggaggaggaggaagactgaatggaaacaataatcaatcttatgaattagtatccaataggttttcatga

SEQ ID NO: 11596 - DNA, 222 bp, Candida albicans
agtcttcattatagttgcaaaaaaataagagcaccaccaccacccactcaaaaaaaaaactttcctattttgttcaacactctttccacagcattgcaaaataaatcttcaacaatgaatcaaccatcaaaggaaggatccaagaaattttcaagactcttgtcttaccattggaactttttagggaattatactgatgaaatatcaattcttattctataa

SEQ ID NO: 11597 - DNA, 294 bp, Candida albicans
ttctgctttagaaatctaagagcatctgttgatcataatggacacaaaaatagatacaaggatcttagatcttttgattgtatctataaaattcgcatgaccaacgaaatgaaaagccgttcattccttgaaataaacaacactttgctaaaaaaagggattaatattcttgactattttgatttaaaaatagtactaaagccagttcagagcggcatattagcgaaattaggtgatttccaccataaatggcataatttgcttaaaacaaggggtttgagcgatattggctga

SEQ ID NO: 11598 - DNA, 183 bp, Candida albicans
tgctacgtgtacaggggtattatcttaatagttgcaaaaaaaagtaatctactatggaacacatattctattagatcaacgcgtaaatctaaaacgccaaataaaacaaaacaaacacgtaaagcggaaggaaaaaaaaaagaagacacagtggtaagttcaactacacacgaccttttatga

SEQ ID NO: 11599 - DNA, 252 bp, Candida albicans
ttcattgacttattactttggaatacattgatattattaatggttgttattgctgtggttataagtaagagcattcaaaaaaaacaaacatggaatactagactagaattactctctttattcatttcacacattcatacccttgttgttcattatttcgctaccactttcctgataattcttaaaatatcaattatttgcgaagaaaaaaagaaagaaagaaagaagaaatatattgctatacacccatag

SEQ ID NO: 11600 - DNA, 1188 bp, Candida albicans
tttcaaatcatctttcgttcagaatcttcctatttctgttacaatccttcacttcactttacttcactttactttactttatataatatgtggagatctctactaggtttagataatgatgattctgaattaatcaatcaaccaacaatagattataatactatatcttcaccatcaaaacaaccacaacaaccaaagcaaaactcacagaagaataagccattagacaaaccacgtaatcaaacatttggaaccgtgattgattattctgatgttgaagatggtgatgatgatgacgaatatttggatctaaataatgatattaaaactaatacacgactaatcaatcaatggagaaccaacaatatccaacccaccacatttaatcccaccattaatcaaaatggatcaattaatcgacaacctacactcacaaatgtttctttacctgatcaataccctgggaaatttcctcacctaaagaacgataatgatgttaaacaagacaactctgttaacctactagaagcagataaggaatatgaatctttaattgatgcaaaaattcaagcattacaaagagaaatcgataataatgataatgataatcacaacttccctcgaaacgttgagactactcacgtacttgatgagattgataatttacaattgaaaattacatcacaaattaaaacattacaagaattgaatgaattggttgatgtttatgaagatgaaatacaatcaaataataatactattattataattactactactactcctattcctactacaggaaaattaataattgattataaagattatcaaaatttgaaaaatgaatatatgaatgaattaaatcgagttaaaaaattatatgaagcttattatttattatttaatcgatatatttcattgaaaagaagttataaacaacaaaaggagcaaaaggtggcactgtctaaaaagaatgatgaggataaggttgataaggttgatgaggttgatgaggttgatgaggttgatgaggatgataaagatcccaaggatggtcgtaatggtgatactatatccatcaaagagaaaatcaatcaaataaagagtaaaactaatgattcatcaatcaagactatatgtgatacccttttaaaagatgttacaaaattggaaaaaaactggtactaa

SEQ ID NO: 11601 - DNA, 312 bp, Candida albicans
tataatatttacattgacatatttaaagggtttccaaaactaaatgaaattgatcaatggcaagtgatattcaaaaccaagaaaaacaatagaaaggaacaaaatggtttagtcaaaacatatcatcacattgttaaaatttataataattgtattgttcttttcttttttttttcttcttgttcttgtttccaattttgtactttttttttaatatttattctttcgatgatccctgccagattaaagatgtcattcattctacatataaaaatgaataaagatcaaacaaagttaactgccatgccatag

SEQ ID NO: 11602 - DNA, 198 bp, Candida albicans
ctgccatgccatagcaattatttgttcatactgatgccactgtattctcgtacaaaactagaatcatctcaacaaaaaccaataaatactaatatggttaatcatagaagacagaagttcttaatcgatggatatacaaaagcaactctcttgtggcccatggatattgttaatcatcacagccaatatcaattctaa

SEQ ID NO: 11603 - DNA, 393 bp, Candida albicans
ggaacgcgtattttttgtcttgataaaatatgtcgtgtagagtgcatttcttttaacaggaactacattgttgtaaaaaacccacaactagagtgtataatactgtacatacaaaccaattacttaccatttaatcctttaggtaaaaattatagtattaccacgagtggtaataacttcacctatacattatataccctactcaatgctattaactcgctaagcaccagttacgatgactcttccagctttccatttgacactttttcgaacaatactttgctcgcttacaaagtttgcattttgcaaattgtcttggaaaatcttcccatttgtgacaattaccacattgtcgaagtcctgctgtgtttcgcctacagctgttccgcatga

SEQ ID NO: 11604 - DNA, 306 bp, Candida albicans
cagaaaaaaaatttttccggaataagaaacaatcttgtagatatttactggacctcggatttttttttacccgagaatgtaataaccaagattccggtaatattcatggcggtggttaggaagaaatataaaagttctcccgtattgattataataattgatatacttaacatagaaaacagttaccatgtgatactggaatatgatcttaatcatgaatatcagcgaaatcaaaacaaaaaaaaagaattgtcaacagccttatgccaaaaacataaatctttgttagtacggaccttcctatag

SEQ ID NO: 11605 - DNA, 183 bp, Candida albicans
gttattagtattgaaattttttttttttcaacaatgatgaaatggatgtatgtattagtcataacccaacgatatgtggctagtacttcaatcaggaatggtccggtatataatgaaatcaagaaattggaagagaatttcattttctgtttgccgtgcgctgttgtaggattggtaaggtga

SEQ ID NO: 11606 - DNA, 225 bp, Candida albicans
acaaataaaatgttatatgcattagctacaccaggttcagctttcaaaccatctatcaaaaaagctaaaaacacttggagattgcaaaaattcaaaaaattgtatattcaaaaaggtggttatatatcaagtagtccaactgatagttcaatcaattctaatgacagtatatcgagttcatcttcagtgataactgctagctcatcagccccaagattcatttaa

SEQ ID NO: 11607 - DNA, 189 bp, Candida albicans
agatctgctattgaaggtttactttcagtctctaagtttgaggctaattatttattacaattcttgactaatatcgcgtcaaaagttttttcattgtttcaacaatgtatgattctattggatactcctgttggaagtattgttgtgaattttagttgcaaaatttgtggaagttttctaaccatttaa

SEQ ID NO: 11608 - DNA, 192 bp, Candida albicans
tcccaccacacattcacccctgctaaaactttctattttaaagagcaactagattcacataaatttacaaaaacaatagaatttttaatgcccctattagttatgaagggttacataacccttgttttaaacaaaactattggtggtggtgatggtgagatttttttgtgtgagctcttcgattgttcgtga

SEQ ID NO: 11609 - DNA, 201 bp, Candida albicans
tattgtgtgatagaatcgacagccaaacaagaaaaaaaaacttatagacacaaaaaaggtgttgcagatgaaattcagtcaattaaaacccattctacatgtttaaccgagttttccctaaaactaaaaaatgaaggacaaaccctcaacattgtagaacggaaaaagaaacaatatcaaatgaaattgagtttgtactaa

SEQ ID NO: 11610 - DNA, 312 bp, Candida albicans
tgtacttatacgtctttcacgtgtatgcactttacaatattaagaaatggaaatctgaccaaagggaatttgaaagatgtacacgaaaaagtgtacagtcaatattcaaaatttttttctcatttaagtatttcacagaaggtgcacacgaacccaactgaattaacgaattgtcaagcgaaatcaaagttctctaaattcattttagttttagtcttttttgtcttttcaaccctttcaattcgttcaaacgactaccttgcgacaatgaaacaatatagacaacctattagtgtaaaaaaaaaagtttag

SEQ ID NO: 11611 - DNA, 249 bp, Candida albicans
cattgtttgcagttacggttaatggccacggaaaaaaatttattgctcactaaacgtgacttttgtttgacgaagaatgctagagtaaacataatccattatagtaggctatatgtggagacttcgaggttaggaagaattcattcattcattccgagtagcaaagataagaaaaatgcacctatcatacctttgagcaacaacgtgggatttgtcatgaaattagtgacaattttttggaaagactaa

SEQ ID NO: 11612 - DNA, 885 bp, Candida albicans
caaacaatgggtttaactgacaaattaaaaggaatcaagaaggatgatgttgacaacatcaacagccaagccgggaaatatgccggtggtaaagacggtcaaactggtactgatcttgcccaagacaagtataagcaatataaagctggaaaaactgctgatagtgcaaaagattcattgactggtcaaaaccaaggagccggtagtggtacttctggatatggcgccggtgccggcgctggtactggttctggtgctggtgctgctggtgttggcgctacaggtgctgacctgaccaacgctgcttatggtggtactagtcaatctggtactggatacggatcatcaaacactgctagtggtcatcaacaaggttccactcattctggtagtcacgttgatagatcctctgctggtggatatggttctactggatatgatcaacaacaaacaagtggaagttatggatctggcgttactggttcccatggtactactggtgctcatgattctactggctacggatcttctcaaactggaactcacggtaatgctgcttacggatcttctcaaaccggcactcatggtgctaccggcactcacgattctactggttatggttctcaaactggtactcatggtactactggctatggatcgtcacaaactggtactcacggtgcttctagtacacacgactctactggttacgggtcttcacaaactggttctcacggtaccactggttatggatcatcacaaacaggtactcatggtactcacggtactcatgactccactggttacggatctactcaatctggctcccatggatcaacggtcgcccggccacaacttcttcaccgctggatcgaagacacggtg

SEQ ID NO: 11613 - DNA, 225 bp, Candida albicans
catatacgatttagatattctgttgttgccgtattcatagtagttgttgccttatcatgtttggcatgggtgtttgcaccaaaagagaacacaactgtctttagatcatcagtaatattagcattgtcaatgtgttatttaatgtgggcaatcacgtatttagctcagttacatccattggaagccccaagaagatctgatttgagaccagaacccaaggattaa

SEQ ID NO: 11614 - DNA, 267 bp, Candida albicans
agacctgttgggaaaccatttagaatatttttagttatgtgggtgtttgtatacaagttcgaagaaagttcagcggatgtaaaaaaaaaatcaaaatctcaaaacaaaaaaggtgcactaacgcaaaaaaaaaaatcgaatttgagagttatcaacaatatcagttgtcgattaaaacctaacagtaaagatacacgattatctaaaatgagtgggtatgtatctttttcagtacaagagacttacattatttatggcgtaatttga

SEQ ID NO: 11615 - DNA, 441 bp, Candida albicans
ttccttttaatttgtcagttaaacccattgtttgttattgttgtaaattatagatataagttatttgtacttgatattcaattgagttctgaaaataccaaaatcaatcgaaagcaattgggaattaccccctttatatatatttacattgagtctcgggagcaatatatgggagaaatttcacaattgagagtattggaattctccaaacgacctgtgtatagttacgtcatttccagatatttaccaatttcatactttccccgttttttttttcagttgctataccgatttcaatattgttgctatttaaaccgaagactgaaatataaaatgtgtggatccaaagaatatagcaaacaagcaacactaacagatgaaatgaaacaaagagcaataacaaataatatactagagcctcgtggctcagagaaaagatga

SEQ ID NO: 11616 - DNA, 261 bp, Candida albicans
  unsure (41): Identity of nucleotide sequences at the above locations are unknown.
aatgatgtaccagagatttatagtatgggtttatggattgntaaactttataaatcttgttataattttttaacacggctttatcccctttgtttactctataaattgataaaacgaagcattatttcgagatttgcaacagtagattctacatatgcacaagctcaccctaaaactaattctagatattacttcaagatacagaattctggaaatcgtggaatgcgaccccgattccttatcgtgaataacaacaactga

SEQ ID NO: 11617 - DNA, 255 bp, Candida albicans
gcaagtctgggggtaattctctatgggcgacattacgagaacttgagatcccatacggacatttgcataatgctggcaatgcatgcttactttacattgttagcagcgttgtcgttatgtgatcctatcgtgagaatccataagaatttggacatatacatggactcaccctataaagggaaaaaggcagcacatgatgataattcgacgtatttagtccttaaagatattgaaaaggttatagagagtttatag

SEQ ID NO: 11618 - DNA, 990 bp, Candida albicans
aatgtgtatgtcttgggtataaactttgagtactttacaggcttaaatttggtgtttttcacatattcaactttggttctcacaaatgttttgaatggactggatttaaacatggttggtgacaaaaatgatgaaatatttgtaattatttttttttctcgcaaattttttaaatccttgttggtatacgtcaccagtatggaaaaagatatcaccgagttaaagaattgtccaagcatcgagagagttcatgagatattggtagctaatgtggaaactccttctttcccgtacattactgcattgcttgaatttaccattccccagctatttgattcaattcgagactccaaaatcttgattcaaacatttcaaacattgattgggttaggaaatcttttgaatagaatctctacaagacaagaacaatcggaattatatataagtatcttagaacgtgtatttgatgaaggtttggcactaaatttggttaaaggcaaccccagtcctgttgaaataagggaaatcaataagcttgttttcaaaggcaaggcattggcggtggtcaatgaagcaacaactctatcgagtgttgaaattacaagtgaatgctttaagagtactggtggctatgtcgagtatttatccaactcattgctaaaactctatctgtccaacaccagaagtgacataattgaagagtttttacattcgactcttaaatttggagatgcgtcggtgattaaattttatgaaatatttttcagagaatccagctgggactactttgtccaatcttttcagtccatgaaaaagtttcaaaagaaagactacctaaaaggtttatttaataattatattgtacgcattgccccaaattcaaacttaaatgccttgtttaatttgttgagttttacatctgacgtatttgatgaaatggtgatagaatccattatccaaactgccaataaaagtcgtcttcacgcccgg

SEQ ID NO: 11619 - DNA, 276 bp, Candida albicans
ctagttcccagtgtgtttttttttgccttccaactttcttttacatttttccattactaccactgtcttcccccctattttgcagagttttcaaaatttatccaaaacatgttagtcattaaaccatattattataattattcctttttgtatttttttcccttaaaacacgttaatttattaatcgttccgttgtttgttattttatttttttgtatttatcaattggaatatatatctatacatgaatttattatctattctaccaattgttaa

SEQ ID NO: 11620 - DNA, 198 bp, Candida albicans
ggaactgttctttggaacagcggtattaatcagttacagtctaatgctttaccaactaagctaccgagagcaattgctgacgttgaaaattttccggattttcacattttcaagatcaaggtcattttccctactaaacataaatttaataccttaataaaatgttcaaacttctctaaatcaccaaaagacttttaa

SEQ ID NO: 11621 - DNA, 1272 bp, Candida albicans
acaacaacaagcctgttaggtaatccaatcatgtctattacagttacatttccgaaatccccatctacgaaaaaacgtgcaccggcatttggaattgagttggagtttagtcaacaaggcagtagcgatggtgctatagagaaagcggcattggcagttcctgtgtttagcgttgacaaccaagactttgtattgataagagaccttgccaagtactggggctacccttcatcgtatcaattgattgtcaagttggtcaaatgtgctaacattgaaaagtcgcaaatcttaaagaccgataaggatttgaataaagagttgtttgagttggatttgattgaagaagcagatacaaagattgatcttttttatatttcgttacccttggtctattcaagaatagaaaataagaaggttttttatgttctgcgtgaaccagaacagccaaaggtgtcgaaagccccaacacaagagaaaccagcaagtgtggttgctgctgaagaagatgacgataatctagatgatgatgaggaggacgaagtggatgaagacatggatgaagataatgataatagtggggaattgtctaaaggatacaagcacatgcacaaggaccatccaaagtatataaatgacgatagggttactattggacaagtgtttcatcaatacggacttgacccttcgacaccattaacccattcacttttcaatagtatcaactcaatgtcgaagctaaactattacaagaattttggagtttcaggttaccgatttcttcccaacagcaagttatcttatgcagaacgagaattggtgttgaatgccaacaactacaatgatatgcacattaacgaaaagacagaatccaagccgaaaaagagtttccgtaaacccattggaaagtcaaagaaacataacttgcagattgatccgaactccatagatttaagcgagtcagtgattccgggacaagggtttatacctgactttagtatccaccatctttgcaaagtccctaattattatgtgacatcaaaccaccaaagtctcccgctgtcgttcaacacaaagaatcttaatgcaacttcgaactcttcgtatttgtttaatgataatgtcaagataaagtcaaaaagtattcagaagttggtgttcaacagcgataccgataattaccatcacacaaagtatttctacaccaaaacctaccgtggtccagggtcggggaagtcttcaccacgaggcgccaggatccgccataagggcgcc

SEQ ID NO: 11622 - DNA, 192 bp, Candida albicans
acaataatcttttctgccgagttttcctcgtcttgtactgaattgaacgcatggccgtatctggatgtttctcctacgttgataaagcttgtgtctccaagtagctccactgtagacgacaaatatgaagctgggagaaagggaacagacggatcaggtagggaatggaactcagttttgattggtatttga

SEQ ID NO: 11623 - DNA, 240 bp, Candida albicans
acacgctcgatggaaggttcatcgaaccgtagtagtttccgagcatgccatccaaaatatttagaagcatttgatgcaaacccaggtgctgccacactattgaaagaggggaaaaacgattctgcttatgattcatcgaattcaccaaaaattttgggcatttctggatgcaaccgggcacacaacgcaaggatcgctaatagtactactgggtccggaacgtttcgttttggacgataa

SEQ ID NO: 11624 - DNA, 447 bp, Candida albicans
cacacaatggaagtagctacatccaatccacaacctaaacctcaaaccatcaacaaacaagttacgtttcagtttgccaatgaatgtgatttagagattcactgttcgccctttggtttgagtgggttatatataaaaatcaatggcaccgatatcatgggcattgggtccaccatggggctaataacgggatcaactagaggcttgatacattacaacgatagtaacgatttgattgatcagaaatacaagttatatgttgtgatagatgatgacgatatgttgagaattgatttcaccaaaatatacactgacgcttcaaacgacaacaacgaaaaacagattcaggaagtaccaacattggtatttagaggaaagtgtccggaaggtagacctgacactatcgaaccttttataggaatcttctctttcgaaagagaaacataa

SEQ ID NO: 11625 - DNA, 189 bp, Candida albicans
acgacggatatctctaccattaagctcacacataagatcaacaagattgatagtatcaccttttatcatgaaccacattatcatagtttgattggagaggaaatgagcgaggaggaaaaaacaagtgtttcctgcagacaaacactttacccattgaagcctcggctcaaatgttggagaagattttga

SEQ ID NO: 11626 - DNA, 186 bp, Candida albicans
ctattgaaagaaaaagtgaagaacgaaaaaaaactttacaatttcatttggggaaagattggtaatattttatattcttgttattttgcttgtgaaaaagtaaaaaaatgtgagggaatcaagattatgtggggagaaattagagattatggaaatggaacatttttatttttttttcgcccttga

SEQ ID NO: 11627 - DNA, 348 bp, Candida albicans
ggatctcaagatgcatcaccacctaagacaccaacagtactttctaatgacgattcacaagaaaccactgaagataaagaagaaacagtatcttccttaccaccaaccttagaactaacaaatggtgaaactgtagaagttgtttcacagagaatctataatgacatactaaataaagtacataatgaggcaacatcggcgttttttgaacaggaagagtcaaccaagcctaaagtgtcctataccaaggatatgaaagatgacttgcaaaactattatcacaaggctgaaataagaactaatagagctatcaataaaataatacaggacaaactaatacaagagtaa

SEQ ID NO: 11628 - DNA, 219 bp, Candida albicans
gaatgtttcaagggacacacatttggtgttacttcgagattcgaggattcaattgtggggaagggagatcaactcttatcaaatggttattatttttatgtcatagataaggcttatgtgaaatggtggggaagggaaaaaaacgtatcctatccccaccttatatccattatttcccggtgtaatagtagtagtagttctagaaagaaagaaaaataa

SEQ ID NO: 11629 - DNA, 195 bp, Candida albicans
ataaagaaagggtgttcaataataataaattattatatgtatatattactccctttatttttctttctttctagaactactactactattacaccgggaaataatggatataaggtggggataggatacgtttttttcccttccccaccatttcacataagccttatctatgacataaaaataataaccatttga

SEQ ID NO: 11630 - DNA, 393 bp, Candida albicans
ttaccatttgttatgacaaaattaattttaaatcctggtgatttatccctgatattccccgatatttctatatctaacccacaaagaattcgaatattatgtcaagtcataaaatatatccctaatgaatcatgtctaataattgataaaatacccaccgtagcagaatcgtcaacaaataaggagtctttggttaagattgatgtatttgatatattggaagatatattatcaattgaaattataaataaaggaacaatcattaatattgatggatattatgatggtgaaaaaattcaacctattgatatttatgaaattaatgggattaatttcacgattgaaaatattgaaatattaaatcaattgaatcaaatgaaaagtttaacataa

SEQ ID NO: 11631 - DNA, 339 bp, Candida albicans
cttgatgaaaatgatgacgaatttatactatttcgtttccccgtatctaacagtagtgattggtctgctgaagaatctgaattagctcttgatccagaaccagatccagaaccagaaccagaaccagaagtggggctattactgttgacactatttaatttttcctttttgtatttggtaatggcttctgtggcctcttttaattttgtaatcggccgtataaaccaaactgccaacgggaatgtaacaaaacacatgaatgctccaattccaatgacaacgcctatagttatttttcgtagtttattagcgggcccattgaaaacagaattagattga

SEQ ID NO: 11632 - DNA, 198 bp, Candida albicans
acacttattcttgaaaatccaatggcaacttttttaccaaaaaatgatttgacgccagttgctgtaccggaatttgatgctaatgcagttttcatcgatgaagatgaattgatattatatatggtaccagcttctaataaactattttccactgggaaaactaatttgaatccaataacttcattgtctccattataa

SEQ ID NO: 11633 - DNA, 243 bp, Candida albicans
tcatcttcactagtagaatttaatgctgaacgaatggattctgctgctgctacaatggtgagataccctgaaattgatggctgcagtaaaataatcgaactattcgatagcaccggtacggtgatccccataaaataccttgaattaaaattatccgaattattggcaatgggaccagtaaaatataatcccagtggagtacctaataccggaggcattgatctatttggttgtaaaggataa

SEQ ID NO: 11634 - DNA, 195 bp, Candida albicans
tcgatgaggtggtatttttttcataataaaaaaataacgtacctgtcaaatattaataaccgttctgttttgggcatgagcaatttttcatatgatttggctaatcaaattggtaggagaataataaagataaacaaagaaatagaattaaagcaacaaaaacttgcatttacgaacagaggagtattgttataa

SEQ ID NO: 11635 - DNA, 189 bp, Candida albicans
tcaagcgcgtttcctgccagccccgtgggtgaagacgaattggaaaaaattagagctcaaaatcaaagattacaacaaaatataatgaaaggtttatcagtagatgcttgtattgattcaagtgatttgattgatgttaaagctgaagttgatattagtatttataatcgtggtgattatactgaataa

SEQ ID NO: 11636 - DNA, 267 bp, Candida albicans
caattattgtacatatatctgtttaaagtaattacaattgaatctaaagcacatactagatatcagacaagtataaataaacaacttaatagacaaactagattaatttctgaaggtgtaaattctatgagcaccacctttgattcccatacaaaaacggccttttttgttgtagcatctccaatcattcgcctacctcaatcaccatctgcgcgtataataaacatttgtcttggcttcaaaacggtattggtttggtctttgtaa

SEQ ID NO: 11637 - DNA, 276 bp, Candida albicans
caaaatccaagtcctatatatttgctgaataaatattttaattttgttatgaagagcaacaaagaattggttactactattcacaaagctaaattcttagaattaggttatggattggttaagactactttggtactgtggataatgcttttataccagctgttctcaatccatgacaattcattgttttggccgtatggttttatcctatccaacagtggtgctgcattaatagatgtcttggatttggttccagtgctagcttttggtagatga

SEQ ID NO: 11638 - DNA, 225 bp, Candida albicans
gttcttagcttcaataaccaaagcaaggtgacaacaatctggccaaatccagaacatcatctaccaaaagctagcactggaaccaaatccaagacatctattaatgcagcaccactgttggataggataaaaccatacggccaaaacaatgaattgtcatggattgagaacagctggtataaaagcattatccacagtaccaaagtagtcttaaccaatccataa

SEQ ID NO: 11639 - DNA, 195 bp, Candida albicans
ctcccaaatgataatgattcactattatatctctctttcattctcttgattggaatagataaatcagacattccgccgaaacaaaaactggaaaccgctagccgctatcacaatatattgaaactaatggcgttaatgggatcgctaatacattttcaaaaggatcttaattcgaataaacaattgttagattaa

SEQ ID NO: 11640 - DNA, 201 bp, Candida albicans
  unsure (59): Identity of nucleotide sequences at the above locations are unknown.
tgtttgcatccgagagttttgatttattcagtgttgttttcattggttgagggcaaaanattcgcatcgagcagaaaaggtcgtgcccggggcatagtggacagacaacgattactggtgaaccacatgtgctacaaagaccaaactagggccgttttgaagctacaatcatgtagagtattggatgtaaattgggcatga

SEQ ID NO: 11641 - DNA, 225 bp, Candida albicans
tgtatgttgttgtttgtttgtgagaaatcaatcatcttagagagaattcgcgtttttcctccaagcggaaaaaaaagaaaaataggtttgtgtgaatatataagaacccgatactattggaaacatatgtgtgagagagagagcgagagggaaaaaataagagagacagaaaaagaaacagaaaatcatctaattcaaaaccaaaacattgaaatcaaaatataa

SEQ ID NO: 11642 - DNA, 1512 bp, Candida albicans
ttgaacatgaaaccagatattttaactgtatcactatgtcacaagtacattgccagattaaagcacgaagagaacaatttggaaatactaaatttacaaacgtcaacagtctgtcggtcatataaccttcaaacactagtgagacagttttctcaaagtaactacacaggtccttgtgttgtatcacaattgcaatgggaacatatactaccagactcagtatctacaaagcttgcaatagtagtagataatttacatattgcaatgattattgatttccgaaaggaagataccgaacctattttcatcaagcaacccaaaaatgaaggaattgaaagtatagaatggattccaccgccatctgagaaggatttaggagcgtataccaacagtcgtcaattattgatattttcaaagcatgatctagcagtcagggtgttctctttggattgcacgcacgtgttattcacaatctacaagccaatatcatcactcttaattcgtcctagtcatgacaatagattctggtccatacttgcaaacacccttgaatataacaaacctccggtattgtatcatttttataacgaggggtctgtcagccttcttattaagctgatcaaattaccgaatacgttgacaactgagccaaaactatcgtggtcagataaggggacttggttgcagattttcaatgaccatgaaacgatttttggatataatttattggtttatgatcttctagggcgtgtttctgagagaagaagaattgacccgttagtcgacgtggatatcttggataatgggtataacatgggttcagatgatcatttgcattttagtagtaacgagtttcaatctagttgggtgacgctcctgtctgatagggaatacattgttgtatctgatcttcaaggacaccaattgcaaattcaaataattgaaataaggttattacgagtaatcaaggcaatagaactagacttgaaagacaaacagggttggaagcaactgtgggacaaatttgtttacggaaaaatagcattacctgaaaatcttgaaattacaaaagtttattcacacgagtttgaactatatatttgcatcaacaatacatacgtggtaggttgcgaccttgagttgactgactcggatgatatagagatagagatagaatccatagtagaggtggatactgttattgttgatttctacaagaatgacaataaattagtactcgtctcagaaaagcagattgtgactttgaacgatgacaatgacaaacctcagaaaatatttgaaacaaacggtacaattaagaatactcaaccaaatgctgatcaaattactataatatataacaccacacaaaaaacgttatgggaaacagttttcacaagcaataagtttgccagccccaggaaaaagagacatttggtgggaaacacttccatcctgctagatgatataacagacacatttaatttaaagaaaagaatcaaatcaaaataa

SEQ ID NO: 11643 - DNA, 378 bp, Candida albicans
  unsure (378): Identity of nucleotide sequences at the above locations are unknown.
atcatggataacagcaatacccattcaagtcgaggcagacctggaataataataaatcccccaactgaatcaaatcttaacgtacatcatattcccgaagaagagcaggcatcttatgacgaagattacgacccaaataaaacatatatatctgattcacagtactggcaaaggcagtcttcgtcacaccatgaagacgatctagccagtatagagatacccgagttacaccaaattcaagacagagctccagattcattactggctcattcggataagcgatcttcacaaagtggacgtgatatacttaatgttctacatttgagccgacaagctcgcccaggtccactcattcaagtacatcaacaccaattctan

SEQ ID NO: 11644 - DNA, 189 bp, Candida albicans
ttttatagtgctgcttcattcacatcttctatctactctaagttgaaaacatcagaatttacggatacttccaatcgtaagcaagattcttcagtgtttgtgttaggaacccatattgaagaaacaataagagccactataattgtacacaaaaatgaaatggggaatatacgccgtccatttcgatag

SEQ ID NO: 11645 - DNA, 393 bp, Candida albicans
  unsure (1),(46),(88): Identity of nucleotide sequences at the above locations are unknown.
naggaaagagattttcccaaacccagacttgagattactgcatggnacaatccaaatttggctgtggatgatgtgttaaaactgttanagactatcaaaggtttaactgtaattgtcagcagattagatgatgataatttcatgatagtatctcgacttactgcaagccagagagctgaaaagataaatattgatttccatccagacaatcctgaacttaattatttgatggaggctaacctttgttatgattctgatcagatttattgtggtagtgaaatcagtttggatgatgtagaggacgagaatggcgacgactatgaagatgaggtggaggttgaatccgatgacaatggtgaatatacgtattatgacgagggtgaattaatatga

SEQ ID NO: 11646 - DNA, 300 bp, Candida albicans
aaaaacccccaatttataattattgaaatgtttgaaaaaatgcatctaaataatttgataattgttagtaatcaagacgagactttaatgacgggattcatcgatcgatttatattaaatgatttaataattgataaattcgaaaaattagttgataaattgaatgattatcaagtaattcaacaatttgatatagaagaaactgctggaagagttgagatgactgagtttaattatgataatgatgaagatgatgatatgacaagaattgataggaaatcaattgagttgattacatag

SEQ ID NO: 11647 - DNA, 183 bp, Candida albicans
atattatttggtgtcaaccaatcactaacaaatttcgatgtcattactccacccataattggtaatacatatgtcactgcaccagtcatttcaaacattattactaccactgacattgtcaatttggtgactccagtcatgaaggatgcagcaccctcttgcccacggaatgaaaaccgcgtc

SEQ ID NO: 11648 - DNA, 195 bp, Candida albicans
aagaaaaaaaatttttgtgagaaaaaaattgagtatatgagagtgtccgcaaagttatttggtgggaacacacaatcactaccacaacatccctatatcagtgtgactttagaaaatgtatgcagacgtcttaggcgagcgcaccaccatacaaaatccccttactatgtggaaattttttttttcaggctataa

SEQ ID NO: 11649 - DNA, 192 bp, Candida albicans
aagcaagtcttctctaaaagagcgttgttttcaagtgcctctgagattgtatcattaacgggaatggtttttaatgagagacaaaaatgtgggtcagtgtcttaccaagttttgataatagatttggcacaaactttgccaaaaaaagaacttaaagaatccaaacctagaattatggctgctccagtttaa

SEQ ID NO: 11650 - DNA, 186 bp, Candida albicans
gactgctccgtgtactttcaagcattgatttgtcacacagatatacttattatcgatcctagcctggaaattactgacttgctaaaaattgatgaagaggcgagagaggacaaggacgaaaaaaaaaatcaatacatcaaaacaaaactatcattattcctggtaataccacaaatcaaacagtaa

SEQ ID NO: 11651 - DNA, 444 bp, Candida albicans
atgagtgacccattagcagattataccaatttgtctcatgacgagattgatccttcatcagcaaatgctgctgagtctgaacaagcagaaccagaacaacaagtatcagagcactacgaacctcaaccagaagaactcacatatgaaaatgacgaaaatgtgcttaattccataaaggtccaaaaaatcaccgatgcggaagcaataggggaagttgtgcgtaagaaagtgattagggattccagaccacagggatacgaacaaggcgactttaatgacaacagtaatgtgacatcaggctctcgaccaggacaccaacaaaccgatgaaatcgatatttctagtatggacccacaacaaagaaagagatttgaattggaagaaagaatgagtgctgccataaaaccatcgaataaaagaagaagaaaggccgatggaagatga

SEQ ID NO: 11652 - DNA, 234 bp, Candida albicans
aaatcaaaaaaaaaaaaaaaattcaaaggggtgtggaatgtgataatgaaagaaaagactaaaagtagaccttttgttgttttttttgttgttgttattattattattagtatagttctgaataggtttcaatataaacaagtcttagattggaccgaaagagtattgcgtaatcgttatcaatgtttggattgttgcaacgctgggttgtgtgtatatgcgagaaatgagtaa

SEQ ID NO: 11653 - DNA, 2751 bp, Candida albicans
cgcggtcgcctatcccatggtgaagaggtggcgaggcccaaaaagattgaacaattttatactcctccccaaaactttcaggatatcattgatcaaaacgaaaataatatcccagtagaaggatcatttgttgagataactagaccagattttagacctaaaataggtttggtagttagacaagcactctcgagatttgatgcaagatataataaattactagtgttgacaagtgataacgagttgatagatgtctcagcatcggaagtcaatttccatttacaccaaatgatccctcatgactttatcaattgccaacagattgtgacatctaggcacaataagaagtataaggaaagaatacgagctattgaatttcttgacagttttatcaatgatgttgttgatctcaaaacatgcatggaaccaatgtttgatcgaatatatgcacaagtatctacaaattcaataagccatgtaacattagttgacataatagatgccataaagtaccaagaaactttggttataaaaattggcctgtcattttacaatcaatgtgttttattgtttagcattcactggtgtttggttagctcccccaaatggattgtacccaattattttgtcaataataaattgacaaatgtattacaaggacattcaaacaattttcatactagagctagttattttgtgactccaggtaacatatcggtatctatatcaaagttcatgcggtatatgaaaaattcggattctcatgaaataatagaaaagtttttggcccaactcaaaaccagaaatggagatgaactttcccattttttacaagtttatgatggtaggcacttggcttatatactcgaagttatcaagtttgctattgtctatccacatgactcgataatcaaacaattaaataaattagcatcttttaaaaactgcagtacaccaaatgatttatacaataagcttttggatttaaatatttatgacaaatcaactgatgtggtattgtcgctggggatagtgggaagttcggatagaataaatgtatcaagtgctgatcaattgcaaatagagaacctatggagtggagaacatggtgatttattcagacatttacgagccaaaaagaaatattaccgtgatcacataatttatgggttaccacttgacgataacgaaacttgttcgagatttgccatatctttggaaactataaattccagaaaatatatgttaaatattcatattcctgatatcactactgttttacctcctggtgattttatgatggagaacatgttcgataagtttactgaactatcaaataagtttagcaacagttttcagtctaacttattttcaaatagatttgaagaatcgaaaagattccataaatatgaaactgtggattcagagaatttgtgggatgatgagttgtcacagaatagtaaatcacaaagaaatccatcgaaagtcacatgtatgactatctcattccagtttaattcttacgagccagaaccattcaaatcttttgaggataaaatatcaataagttttgattcaatctcaaatttaaatgtcaaggtccttgataaagaacttttaaagaaatgtttatcaggaaagttagaaacgtcacttttcaaattgttaagacgaaaccaaactcaggggttttctgacagaccacatttgaacaaaggagatattcataatatcaattacattaatggtatcatgaaaacattttttaaaatgcgagagcattcaggggcagcagtaatcaaacctcaacaagagtcattggtttcaagcagttcaaatttcctttcaaaaataggggttgataaacctcgcctttattcccatagtgattttatattacgtgaactacagattttcactggagcgttagtagctgaatattgcacccaacacagaattccagctatgtttcattgtcaagacgtagaaccaactgtatacgatctggataaggtcatggtcacacacgacaatataatgattccgccatatgattcagaaaattatcatcacagtattcttgccaaagattccgatggatatatatcattacaagcaagttttgtatccaagaattatctttcgcctgaaaacgttattgcgggcccaggaaataataatctcctattggggttaaaaaacgggtatatcaatattgttgatgtcttcaccaaaaaagaggctataataaatcaatatcaacttttatcttaccagcaagctttatttagtagaaatttgagtatggaaaaaggatatttgaaaactgtacaacagtttaacattttgaaatctttagggtatcaattacaaggaccattaacagagtctagattgggatcttacattgaagcttgttatcaaagtcatgaaatttcactgtttgtggggtctatttcaagaaagtatgttgtattgaaatggcttgaaaaagctcaaattgatattaatgagggtaatggattagaagtgttccattgtattgttacattagttggtaaaaagtatgatttgggtgtcgtgtgtaaatgtttttgtatggaattgggcattgaagttgatgtgttgacggaaaattctgacatacatattggtagcaaattggtttgtgataaagttttgcaagtaaatgcaattgataggacgtgtttacttagagatgaaaattacggatcaacttggtatttatag

SEQ ID NO: 11654 - DNA, 1080 bp, Candida albicans
tataaatgtcaaaacaagattccacttccagattatacaaataggacatcagataattataacccagatacaactgataatcataatattcctccacctttcactactcatcctatagaggttcatccaccaccattctcctcttctacttcacctaatatccgtgtgccagcatattttcaaaatcaaactacttcaggatggacaatagtaataaataatcgattttggactgatggattcaggatatttgtttccgaagatgcatctaataagtttgatgccttcaaaaaaagtaaaaatcccgaaataatacaattacaagaacaaggtattggagtaccgttatttaaagctgtcacgtcatatattcctttagcaacaaaatttataacgtttagaagatatgtccctactaatttacatccatttgatattgataaagattattatgattattgtattgttaaacggaaattacacgttggatatgatagttatatatttgaatttactcctgatcctaaacaaccaaaattgaattttcaagtgatattattttctcattcaatactaccgattcatgattatatatataagggagaaagacatcgatggattgatgaatcgaatttaagaggatttaaagcacgttggcaagttaaatatggtttcaaacatacttatttaattcatggtcaaccagcattaactgataattgggatggtaaaagtgataaacttaataaagataaaaaaaatccttatttagataattttttaaaaatgaaattttctgtactgtcaagattccccaaacaggaatattatggtcctcattgtacagatacattgggagaagcagaagcttttttcaaattgggttatgctgaacttaaaattgatgatttaggtagaggaattcctgaaggtgatgatgataatggtgatgatgttaattatgaaagtattttttcaataccggaagatgaattggtaacaatttgtatagcaactgtgttgaaacgacaaaaagatattgaagaagaaaagaaaaatagaaggaaaagatcaaattaa

SEQ ID NO: 11655 - DNA, 201 bp, Candida albicans
aacgacaaaaagatattgaagaagaaaagaaaaatagaaggaaaagatcaaattaatgataaaagattgtttcatatatatatgtatatgtatatgtgtttctgtatttatttttttaattatggattctatgatctaaataatataacgtctaatagatatgaaaaagacaaagaaatagtaaaatttaccacaatttaa

SEQ ID NO: 11656 - DNA, 219 bp, Candida albicans
attttctactttagtagttatgttctttttttagaacaaaaaaattgcgcttgcgctaactctttttcattttttttagtaacaattttatatcacgtcatgtattatttctggttttttagtgatagcaatctaggtagtgttgcggtaccagcggttatgaatttgcacaacttggttttggaaaacttgttgctttttgtgttgcttcaagtttag

SEQ ID NO: 11657 - DNA, 216 bp, Candida albicans
tttcgttctattgccctttcagagatcccatacctagaaaggctgaatctgagaaagaaccaaaaaaaaggtggtttcttcttgcaacctgtatttgatagtaagttgtcaatcggtgacattttgtcgtgtttcaacataatgccgtctaaactattcaacatgtatcagtggtatttagaacataccaagaaaaataataataatatcatgtag

SEQ ID NO: 11658 - DNA, 186 bp, Candida albicans
caaatgagtcgacacttaaaaacgacggaaataagacattatcataatcattcagaaacccaaacaaaaaataaagctcacgctttactcagttggaatcatcctgttttctataatgtaattcgatttttttgttgggttaaacttcttgatttgtcaattattgccgatttaaagatgaactga

SEQ ID NO: 11659 - DNA, 222 bp, Candida albicans
agaaggtggctcaaaatcttttacagcaaacatctaatgtatactaatttatacattttgtcacattttctagaattcagtcaaccctacattcaaattgtaattattatctcaataggtgtaatttcgttctattgccctttcagagatcccatacctagaaaggctgaatctgagaaagaaccaaaaaaaaggtggtttcttcttgcaacctgtatttga

SEQ ID NO: 11660 - DNA, 204 bp, Candida albicans
tacttagttccgttttatttttttatcttgtatactattactattactattactattattataaaatcttataatatacatatatatattcccttttatgataaaaacaaaattgatcaaaaatttagtagcttgctttctctacagaaaagagaatatttgtcccttttcgtgactttttctataaatgcagaccaagtataa

SEQ ID NO: 11661 - DNA, 204 bp, Candida albicans
atgcagaccaagtataagttagggttcaaatacaataacaataacaataacaatgatagaagggataaagctttagttattcttattgacgagaaaagggttaatccatatagttgcaaaaacatgaaaagagaacaaatgaaaaaaaaaaaaagaaaaatccaaatttgtggtggtggtggcgtgtggtgtgtgcacgcttga

SEQ ID NO: 11662 - DNA, 207 bp, Candida albicans
gaaaaaactatatgtcattatcaaaatcttttttggtctaaggtttcttccaaaattggaaaaaaaagaaaaatgaatagtaatgacattgtagatctgtcaattaagtttatctcaaatagattgtttcaaattctccttactagtattattcaaactcctgtcaatttattatccaatattcacaacaatatcaatatcttataa

SEQ ID NO: 11663 - DNA, 204 bp, Candida albicans
actaagtcgtcatccattacgctagtcaaataccttaactgctttggttgtaatctatacagaagcttgctgtcattgtcaacaaatctaagaaaaactaaaaaggaggcgctcaatagtgtcaagaaaatacctatttactctcttccagctttgtgtatttataataaaatccaaagacttggtctgtttctttggttataa

SEQ ID NO: 11664 - DNA, 297 bp, Candida albicans
aaaatgaaacgtatcagtagttcaagaacagtccaaaaaaaaggacttttaggatgtcactattactttttagttagtttgccttgttcctttttgtgctacttacataagatatatgcaagaccacatgaagttgatcacaattgttatgagcctttagccgtagatgtaagctcacgccccatacatacttttagatgtagatcatcatctcacgtcattatcttgttacttggcccgctggtcattgtattctacttaacattcttcacaccgccctcgcggactacgaggtgg

SEQ ID NO: 11665 - DNA, 216 bp, Candida albicans
ctagagagagaggtaaaaaaaattttttttttaaccaccattgttatctttgaaaattctcattcacattctgctcttttttttaagactccttctccatctatcgcccaacacccacaatcattatgtctgaagaagttgataaagttgccgaacaagttcaaaaaacctatttggacgatgtcaccggtgaacaagtttccaaaaccgaattaa

SEQ ID NO: 11666 - DNA, 300 bp, Candida albicans
accaatactctcagaggaaaaagagccaaaaaaaaaaaatttttcttaaccagaaattgtattcctcaacaactgcaaacctaccaatcaaattcaccttccacaatgctcagaataggttatagaggcttttctacacgtagccgtgttttcaaattatcaccacaggaatatgtgaaccaagtgcaacaagaaaaaattgaaaatgaacaatttaaacaagcattatctcaagatcaattagaatataatccaaagatattgtcttctaccacagggggtccgaagcatccgcgctaa

SEQ ID NO: 11667 - DNA, 228 bp, Candida albicans
ggtaaggggaacaagaaattcattttgttaccaaaagttgaaataattttggttatccccaaatatttcaagggtaaggtgaattctgaaaaagggggattagcagtgtataacaaaaagggaggaaataaggggtattttttttttttgggggtggggtattcttttttggtgggggaaatattctctcccccattaaatttgggatgcggaataagctggaaataa

SEQ ID NO: 11668 - DNA, 213 bp, Candida albicans
gctgtccatctccagcccaaactagagtttttaaccgtgaaaccaccaaatatcggggcaagcatgggaccaccaaaaagcaccccagcaaatgtcgaaatagcggtacccctttgctcggtcagaaataaatctgaaaaaatagctggagaaacaacaaacgctgctgacccaacaaacccagagaaaaaccgacatatcataattgtctga

SEQ ID NO: 11669 - DNA, 342 bp, Candida albicans
gtataccttcatatggttttagggtcatcaatggttcttcgcttgatatggatcctgaggcaggcatggttgatagctagggaaaatacatggctaattctaattatggcgaaaatcgttgtggcatttatagttattgttgacggatctaaattcgatatctccgctgattcaaaatttatttttggatttgaaattttcggtaataacttgacgagtctggatatatcgtcactaacaaacattttacatataaccattcaaatttgtttactagttggttgtaaatgtatcaacaagaatattattataaatacaaccctaggatatacttctatataa

SEQ ID NO: 11670 - DNA, 777 bp, Candida albicans
tttgtttttaatataccacagttccaacagatggttaccgcttcagagttaaatcagttgaatgtatggaatgacaagatcgaagaaagcacttcttgtccggaaagctatattcccgactccatcagttggatgtttggtctgtcaaaaatttgcaacacaaacaatctgtcgccaacaacaaaccttagaaataaacgactacattatctatttaaaaatcacggaagtacttccaaagatcaagcactaaatgagaaaaagaattctagtagtaacggtctggtcaaagaaggagcagactcgtcgattgattatccaacaacacaattaaacacacatgaattaaccagtaagttagaattggagttagtagaatcatcctttttagaatatggaataaacaaggtaacaacaagggaatcttcacatcaaggtaaggagcgtgattgcctgtttgatagtaaaacttgtgatataaattgtttgaattcgatttcaatagggaatagtttgcctagtgaagcagaggggagtctgtttttgcaatccactagagatatcgagctggaaaatttcacagcagccccacatcaagagtttaatacacaaatgggacactctccagagaatatgctgattcacagtaatcctcggaaacacagacgtgataataacaatatggtgtacaattgtcctaaacctgttaaaagattcaaatccaaatctcaatgtgacttggtatttccaaacttgaattttcgaaactctggttag

SEQ ID NO: 11671 - DNA, 789 bp, Candida albicans
atgagcgcgcgaccgggccagtcccgtaggtggaagacacaaagaaatgataataataataataataataataataataataataataataataataataataataataataataatagtataatcactgatgtttttcaagcatcaagatccagatcgatttcattaccaatttcaaaatttaaatcacccaccactataatagcaacagtaacaaattctagtaccactactactaatactactgatactaactcaccatgttcaatatcatatacttcgttagattatgattatgattatgataatttatttgaatttaattcaccaacatctagttatgatcctaatttcaaaaatgaaaaattaactactaatacaattgatgatttgggtaaagaagagaaatttttattacctcctttaccatcttcagctacaacattaacaccaaaaatatcttcacctggaaaacttgacaataacaataacaataacaataacaataacaataaccaattagacaagaatgaaatggataaacaacaaattgatctactgttgccatcaactccttcaaataataattccaaaaaatatcaaaacatcacttcatcacaacaactactatcatatgagaataatcacaaccattcaaatttaatagattttgataataacaatactaagaatgatgaggaattagttgctgttgatagattggcttgttcgattttgtctctggttggtaaaaacactaataatcaaaacattgaatggaatatttag

SEQ ID NO: 11672 - DNA, 378 bp, Candida albicans
ataataatagagaggtgttttttgctgtatataaagcaattcatttatttatttatttatttatttatttatttatttatttatttatttatttatttatttatttatttatttatttatttatttatttatttatttatttatttatttatttatttattagcaaacataatagcttgtaatgacgtaaattatcatccaatcaattataaattactactaggatgtagtcaatttttttttaccaattatataaaaaagcctaacttaatccaaaaaaaaaatagaataaatggcccaaggcccaaggctaaggctaaggctaaggctaaggctaaggctaaggctaaatattccattcaatgttttgattattag

SEQ ID NO: 11673 - DNA, 216 bp, Candida albicans
tgccgtttgttgttgttactattactagtttttagtcttgacactacacacaaaaactcatcacaacaattctatcttttggtagcatctgcgacacacacatctatctattcttcacaaataaagtttggtattactcaatttaaagttaagaataaacaaataaccaatgaatgtatacattataaattgtacccaaaactgagtttgtgttga

SEQ ID NO: 11674 - DNA, 204 bp, Candida albicans
agaagaaaaagaaaaaaagataggaaaatttggttgtcagaatattgctgttgccaaaattttgataactttgttattttgatattttatacaagagacaaaaagaaagtaaaaaggaaaagaccaaatgaaagagaaaaaaaatttataataattgaatcaagacttacttgctcttatatatatatatattatattgtataa

SEQ ID NO: 11675 - DNA, 246 bp, Candida albicans
aaagccgaaggtggattgaggaaaagacgacgacgacaagtacatgcattaataaaaaatattctttttttaaagtttttgacttctttaaattatactatgaataatgatattatcaaagtatcaaaaccatttacactcctaacaccaaataatatgttgatcaccactgaggtagtagtaatagtagctattgtttctgatcgtgataatgttaccttattccttgtagttaagttacattag

SEQ ID NO: 11676 - DNA, 246 bp, Candida albicans
cacctttctttaattgtctcaagttttgggattgttgcacaacatctaagatttgttgagtcaaagcagaatcagccaatgggaaagcttttggatttggggcagacatttgtaaataatttagttcagactattaaatggaaaagtaagggctccttgcaattaatctttaaagctcgccagtatcaagtagtttatacttatgtagtaaaagaaagaaaagagaaagaggaaaggaataaataa

SEQ ID NO: 11677 - DNA, 549 bp, Candida albicans
cagacattattagaccgcagcaactatttcaatgccacagagaatttttggtgtattcgttattacttgctctgtttatatggcacggattttactattgctgaacagaatatgaaacagaatattgatttgtactatcatttttctattttcagattattggagttacaggttatcaaggagtattcaaagtctgatcaaaagtattttattgcttgcattgaaggggagaaggaaatgatatctccgattttcaaaagatggttggtcattttcaacaaattttttgatagtgacttgttgattaagttaattctgcttggatatccagacattgaatttgacgatgtatttttcgaacaaccaaagctaacaacttcattgattagattcattactgagaatttaccagcaagaatggatcttatcgcttctatacctattgtttgctttaataaagcattcaaaaaggagttacttaatggtttgtttttcttatttgtaagcaatcccactaagtcttcaccacgcggtggaaggaccgcgatt

SEQ ID NO: 11678 - DNA, 1038 bp, Candida albicans
tttttagtcactccctttttttattatctattaatcattatgacagtaagaaaagccagaactgcttcattctttattgatattgagaagaatggatttctagatgacgatgatgttgcttacaaacaacatctagagaaacaattacaattacatcaacaacgtggcggtaatggtaatgggaaaggaagaagaggagaatctgttactcttaccatacttgtgttgtgtatattatcattaacatattttatttatggttatggatccactatattaatgaataataatttacaattggataaatcaattttactttcttcaggtttaggatcaccagagatctctatattgactcaagaattaattaacaattatgatgaaatgaataatggtggtattggattaatgatatctgacgaattaaaagaagaattaaaacaacaacaacaatattattctcaaccaaaagtagcaaatgcattactgtcaggaggagatggtattaccaaacaagaaaaccaaggatatccagctacaaataacaacgatattgataatgaagatgaggattacaccagaaagacgcttatgaacaacaacgaagcaaataataatgtgaacaacaactacaaagatgacaacaacaatagtaataataatgtagatgataatgatacccagaatgcaaactataatgctgttgaaaccattcaagctaaccttaaagaaatgtttgccattagtcctatggtggtaatttcacaaactaatcaaattgatgaattacaaaccattcttacaaaattgaatattaatcctcaaccgaaatttattaatttatctaaacatcctaattatttaaatattaaacaatatttgaaaaaaatttataatattgatgaagatgatcatattcctagagtatttttagctggaatacctattggagatagtgataaaatcattgaaatgtataaagagaatcaattgattagtcatttaagagaaaaaggtcaaggattaataaatgtttaa

SEQ ID NO: 11679 - DNA, 204 bp, Candida albicans
aaagaattcttgagtctaaaaacactagccgtctctgccaagaatatcctacccaccgactcacccatcaataagaaaaaggtcattaatataccaaaacatatgtattttaaatttagttataatgcattctctactagaaatcaaactactccctccctccctccgaaaaaaaaaccaatggagaaggcacagttgatttga

SEQ ID NO: 11680 - DNA, 189 bp, Candida albicans
aagcaaaaatgtaacattaaagttgttgttgagactaaaaaaattattatacgaaatagtttcctattggaggaaaagaaagaggaggtggtgaaaaatggtgagaaattattatttaacagattggtaacttcaacttcaacagttttgtatttttttaccccaaccaataagaacagaagtacatag

SEQ ID NO: 11681 - DNA, 183 bp, Candida albicans
aaaattatagttaaaccggaggcgcccaggaggaagaggaggtctgaaaaaaatccaacatttttttctctctatctatctatctatatttgtattatctctacccaacgtgcgtatttaatgccgtttcaggagttctcactatttattccatgtgactttgacaattacaattcatcgtga

SEQ ID NO: 11682 - DNA, 201 bp, Candida albicans
tataacaagtttaagaaaagtgaaaaaaagaaaaaacaattaagaaaaagtacaagaaagaaagaaagaaaaaaaaaaactaactacaaaggtttatacctgtttgttcgtttagattataccaatcaacgaggaaatcggaaatcgagaatcgaaaatcaaaaaaaaaaaaattcattactgattatgactcttcaataa

SEQ ID NO: 11683 - DNA, 396 bp, Candida albicans
cttccttggactattttcaaatcaaagggtatcctagtattttcaactttagtacgacctcaaatgacacattattgtctgcatcggcaaaacaaatatctggctaataccgaggaatcggagagcattgacgtgccagttttcaaaattgatggatcgaccatatatccaagggtaatgagatctggcaacaatcagccaatgctgacgagaaaacatgcagatataaatatttttacaattgctggtggccaactttatgaaaagttaactagcattatgattgcgtcagtaagaaaacataacccttaccctgacaataaaattctggattttggaagattttgtgaccccacgattcaaacacttggtagagcttatctcagtaaagtataa

SEQ ID NO: 11684 - DNA, 714 bp, Candida albicans
ataactttcatgacaagcacaagttcttataccaatgttgatttcttcagtgatttggggaagttaccaccagaagttattactttaattattgacaatataccgaaatgcatgttgcctcaattattatattttccaccgattagaaaagctgtcgcttcctcgattttgtcaaatgtaaatattactattcctgaggaagttggaagacacgagtggagtgatgaaccaggtgttggttattccagatgtaaatgcgacgtgttcgacattgaattcagtgattttaaggagggcataactcaatggcatgtgtacccaaaaatcttttctatggaatatataaataattttaagactatttgggatactttcccgcaaatgataacaaatgctctgagcattaagggtttctttttgtgggaggatgatagcgatacagagaatgatatccatacaggagatgatatgcatacaaaggatttgttgaaattttttgccgattccaatattaaatttgattctttgaatctagcagagttcccgggtccaattacattacctcccattaccacaaatcttctgttactgcgtactaccttgactagttatgagatcccaggtttgaaaaagttggaaatcgatttatattgtgctggtgaacaaaaccaatcttatacgtttacttctgatttggaagaatttaacaattga

SEQ ID NO: 11685 - DNA, 216 bp, Candida albicans
tggaactcgttttttttcgaactccaactaaaatttgaagtcttacagtttgatagaggtatctggaaaagcgtttggaacaaacaatggggttatttgggattcagctataaatgcctaatgaataagatttatttgttacaagtgaaaccagctacaagaatagatggagacatagatatatttcttcttataagtaggggagattttgtgtga

SEQ ID NO: 11686 - DNA, 1149 bp, Candida albicans
acaggaaattcatccgtgagacacacaccaagcaatttgaaatataacaatttgtcattaaaggagttggagcatgtagatgatttattggattcttatttggacgattcatcatcattggggagtattgaaggagacgacgaaggtgttgatacatctaatatacttggtgatttggataaagatacaaattatgatcatttgccactgcaattacaagaaaaagtcagtgatttaacaaaggatgcgacacaagtagaaacaaagcataaacctcaaccattggatttgaagcaagcggtaacatctttcccaccactaccgccacctcgaggtaacttttcttcttctttggaggtgacaaacaatagtaataataatacctcatcaccagtgacaccaataaatgaaaacattactaccattattggagaaaggtcacctgtgaataattacaatggtatcaatgacaatattggggatttcccaaagccttcgagacaaagttttgaaaaacaaaataaactggcatcattagcatcaatgacctatcaacctacaattatatcattatcatctccagtgaaaacaaaatcagaatcgtggggaggtaaaccgaataatacgtctatacacaatagtattggcggaataagtgataatcataaacatttgaatatgtttgagccacccctgatatttagagaatcaaagcctcagccacccctggagggaaataaatctgccactgttggcaatactgaaaatagttttggttctacaagtcgtcgaaactcaaatacttctcaacattttgggtatggattatcaagaattactagttcttcatcaagtttgaatttgaatgcatatttgactgacgatgacgatgataatgatattaattctgctttaatgccagaactgaatcgttcatcatcgatatcgacaagatatagtttaaaaggtattcaacaacaactgcaaccaccaccaccacaacaacaacaacaggataaactgcaaaacatcgagcataatgaagagcacgacgagtcagaagaaggtgattcaaccataattgctaataattatcaaattatgagaaattataatgatatgagtagttacttagatgggttagattaa

SEQ ID NO: 11687 - DNA, 189 bp, Candida albicans
actcaactaccgtgcgacgcaacaataagaacatcaacaacaacaaacaacaaagacaagtgtaaaaatcaaactaacaacgaacgattcttcccaaggtatagtttattctattgtgtgattgttagcacactattgactaattcaatgacaatttatcagacgatcattggatttgtaccaacctag

SEQ ID NO: 11688 - DNA, 183 bp, Candida albicans
aagttggtgaaaaaaaatgacaaaaccgaaacagagtttagcaatgaaatggaaatggaaatggaaatggaaatggaaatggaaatggaaatggaaatggaaatggaaatttttagttttatgtttatgttttatgctttgggggtaattttcttgtgttatagaaaacgaatctcatcgtga

SEQ ID NO: 11689 - DNA, 213 bp, Candida albicans
aacttcttacaagtccacttagacaaccaaccagccttaattcatcaattttataaagaacacatacctaggaacagtgtatatattaacgtgttgataatattacacacctctcctcttccccgctacattagaaccaccatttttttagatcatattgatagttttactttatatatattattgatttgttcctgttgttatttagtttag

SEQ ID NO: 11690 - DNA, 261 bp, Candida albicans
tttagaatcagacgactacaccagaaccacaattccaccaatacttatatagaatctggcttggaaaaaagtaacatttatcattcctatacttttttagcaaacatagtccgtgttttacatatattattcacccaatatcataacaaaaacaaactgaataatggcatcttctattttgcgttccaaaataatacaaaaaccgtaccaattattccactactattttcttctggagaaggctcctggttctacagttag

SEQ ID NO: 11691 - DNA, 231 bp, Candida albicans
gtcaaatacatcgtgctccaccaaagccaagatgcgtatgtaacccacacaaacttgaatcgtggaaacaaccaacacaaaaataacacttccatgatacaacatcctgaatgtaacgatgggaatgccccaaaaatgattgatgaattggaaaatccggtggtatacatatcaacacctaacaatttatctatccttccaagtccaccaggagacccgtgcattgaataa

SEQ ID NO: 11692 - DNA, 186 bp, Candida albicans
ggtattttagcacacgtaaaatataatgccaaccaagtgaaaacgggcaaggcaggaagaaaaaattgtgatgttaagggtattaaaaaacaagtagcaaatgctaagattattggtaattttataaaaaatgaagctgggaaaaccacaaacacgaaaaaaagtatggaaaccaaaaacccataa

SEQ ID NO: 11693 - DNA, 306 bp, Candida albicans
aaaacaaatttttactacgtaaagccgttcttctactactatattacatgtaagctatactttacgcatttttattggctaattcacaattatactgaaaataaattagattgtacagtttcaaatagtccacccattgacttcttaaacatggttagagatatttttttgttagtgttgtcaatttcgcagttaaaacagattgttccagataacattcccagttgtttgaaacacccccaaaaaaaattaagctgtgctttttttttagtttataaccaatctgctgagactaacatacaatga

SEQ ID NO: 11694 - DNA, 243 bp, Candida albicans
tctttcaactatattattgcttctttatacgccaatccaatacccaactcagctcacaacatctttagtccaattgtggctaatatctttcctaattcaaaacaaacctctgttttgaatattatagagaatgaaaatcaagtcaataaatttgcttgtgaaacatcaatgaaaagaagagttgaaacactttgtttatccggtagttttgatttctataattttttttttcaacagtgttaa

SEQ ID NO: 11695 - DNA, 231 bp, Candida albicans
aataaaaattcttttttagattattctagattttgttgttacaattgccttaataatttcatttgttctattcacgttttcaatctaataataaagcttaagttaattcaaagcactgattcactcgcttattggtccaacaatattccagaattaaatttttgttggtttcgcttatttgacacagctttacattattactccccttcctccctactaacaaactactga

SEQ ID NO: 11696 - DNA, 417 bp, Candida albicans
ccaaaaatgaatgtgaatgtcgactttttatctcaattgattgcagatgcttccccattgttgcatacatctgctgaagccaatgggcagttcatatcaccaaatccaaatctattaacaactcacaacaatgatagtggtgttgagtttaattcaatgtcggagtttcccaacattgatactttagatttcattcctgctgctgctggtactggcactggtactggtgtggctcaacaacagcaacaacaacaacagcgtcaatttcaacagtatttgagaactccaaaatcagcttctagtcctaaatttcaattgactgctactaatttctccaatcagaccactccagcgtttggctctgtcgccactttttccaataatctttcttacctgatggtagcgacagtgatttag

SEQ ID NO: 11697 - DNA, 216 bp, Candida albicans
atttctatttcaaattatgaagtcgtagttttttcatataaccaccaaaaagttgaggcgttgatgatagcaaacatatctaaccaaggtcggaatcaaacttggactgcagcaaatactagtatagccgagccgatccatatagaaatgaaatcagaaactgaaaatttcaaagtccgcgagttaacaataaacgattactgtatgggatggtaa

SEQ ID NO: 11698 - DNA, 210 bp, Candida albicans
ggtatctaccccaactactgtcgttgtcccaggtactgttgttcacccaagtacttcttgctaccattatcaccaccactgctgaacaaccaccagcatctcccagaggtttccactaatgaatctgtggttattactcctgctacattgactgggtacaccactttattgtccagaaccaactattattgtgttgaccacttgttctga

SEQ ID NO: 11699 - DNA, 951 bp, Candida albicans
tcattcgctatgagatctccatcactcgctgttgctgctaccactgttttgggtttgttttcctccagtgccttagcttactatggtaatactaccaccgttgctttaactactacagaattcgtcactacttgtccttacccaaccactttcactgtgagcacatgtaccaatgatgtatgtcaaccaacagtggttacagtcactgaagaaacaacaatcactattcctggtactgtagtctgtcctgttgtcctgacaccttcaggtagtgctagtgctagtgccagtgccggtgccagctccgaagaagaaggaagcgttgtcaccactcaagtcaccgtcactgatttcaccacctactgtccttacccaaccacattaaccatcaccaaatgtgaaaacaacgaatgtcacccaaccacaattcctgtggaaacagccactaccgttactgtcactggtgaagtgatttgtccaaccactacatctacttctccaaaagaatcttcttctgaagctgcttcttctgaagtgatcactactcaagttacagttacagattacactacatactgtccattaccaactaccattgttgtttctacttgtgatgaagaaaaatgccatccaaccactattgaggtatctaccccaactacagttgttgttccaggtactgttgtttgtccaactacttctgttgccaccccatcacaatcagaagtagccaccaagccaaccactattaattcggttgtcactactggtgtcactacaactgactacacaacatactgtccatcaccaaccaccattgttgtttctacttgtgatgaagagaaatgccatccaaccactattgaggtatctaccccaactactgtcgttgtcccaggtactgttgttcacccaagtacttcttgctaccattatcaccaccactgctga

SEQ ID NO: 11700 - DNA, 366 bp, Candida albicans
ctgggtacaccactttattgtccagaaccaactattattgtgttgaccacttgttctgacgatcaatgtaaacctcatacagtttctgccactggtggtgaaaccgtcagcattcctgccaccattgtggtgccaagcagccatactactcaagtggaaatcactgtctcctcagcctcagtgccagcttcagaaaagccaaccactccagtaactgttgctgcagtttccagttctccagctgtatccactgaaactccatcattggtgacacctgctatttccattgctggcgctgctgctgtcaatgttgttccaaccacagcattcgggctctttgccattattcttgcatcaatcttttaa

SEQ ID NO: 11701 - DNA, 309 bp, Candida albicans
ccactaatccaaacaatggcaacgggttattcgacaggtgtatcaccttttgatttggatgaaaacaatcacaacgactcaattcatcatcgacaccaaaaccaccacagccagagccacgactccctgggtgaacgtgacgatactgaaattgaagacatcatccaaaaaacatcgaaacttaatattaatacctcaacgtcaaccaaaataaaaaactttttcattcacaatccctcacaattcagtacacgatttacgtacaaattcccccaaccattgggagggaatgtgtcgtcttcgaccacg

SEQ ID NO: 11702 - DNA, 198 bp, Candida albicans
ttttttttccttcagaattgcttcaacgcgaaaaacttgaaaaaaggagaaaacacattgaaatcttatacacctgtcaaactagatagattcaatctcattattcccgtttgtttccccctgtttagcatagatatcttatacgtcattgaatctttctatttgaacatctttcaaaactcaacacctaaccactaa

SEQ ID NO: 11703 - DNA, 405 bp, Candida albicans
ttactttttaatgatctattcctaaggacatttgacttgaacagagactctattatcgctatgattgtgtccgctataattaagcttgcatatcaatatgatcaactattaacttcgtatctacagtcaaattcattcaccagtaacttgttggctactccgatctcgaaattgattactgagtttttaatcattgtatttattgttttgttcagttacgaaaccatttattggagtgggatatatttgaaactatgggattatcatgccaaagatatctttacagaagtccccatccactgttcacacgtttacattagattgaattttgttgattcggagaacattgaactattggatcaatattatttcttcacccacgcggctggaaggacccgcgattgc

SEQ ID NO: 11704 - DNA, 198 bp, Candida albicans
ccacattccaagtctacatcagtttctgtcattcaagattcttttttaagaaaaaaacttcctagtttctgcatcgatgctataataccaccttttaatattcttagatattataaaaaccgtgtcaaaaaaatttttctattaatagatcataatatttaccactacattttcaccctatccacagttttaaaatag

SEQ ID NO: 11705 - DNA, 228 bp, Candida albicans
tttggcaggaatgcaaatgcggggggaaaagttcaaaagaggagtcaagcgaagatccaagtgaagttattagaggactgggtggaaaatcaagcggaaacattgaaagccttaaagattgatgaagggtacgatgaggaagtcgttagaagagccaagtattttgaagagaatgaacatctcattaaggaaaaaattgaacttttgttaggctcaaataaattttaa

SEQ ID NO: 11706 - DNA, 570 bp, Candida albicans
cgacatcagtcaaagaaaatgagtagcatatggagtggcccagctggattgtctggtcctttagcatcaacttttaaactatatgttcaagatgttcaccagatgttgacagaatctttggcagcttctggtgttgagtttaatgaagatggtgaggaggtcgcccctgcaatcacggaaactgacgaaagtgagtattggtatgaggtagcatcaaatagtatagagcttctagaattcatccactttcttgattctagattgtctttaaaagaaaaagcagaatcaccaatcccaatggcttcaataatttttagaccagtttcacagttacgtgattatttgtcggccatactaccattgacggagaagcaagaagaattgttgcaaacaaagagatcgaccatgaagagaccaatagattacagtgatagacatgctgctgcgaagtatggtgacgtctttgaaggagacgaataccttgaagccaacgacaatgatgatgactattatatggaggttgaaggatctccagttgatgaagatgaagatgaagaatatttggaatag

SEQ ID NO: 11707 - DNA, 219 bp, Candida albicans
caaagaaaatatacaatgggtgctgcttatcaaatttttggaaaaactttccaaccacatcaattagctttagccactttaggttcagttgtgttattggttttaccaaaaccatggggtccaccaagtccaaccacaccaccaattaaagcctcctctccagaagaagaaaaattcattcaagaatggttagctaaacatactgaagaaacacattaa

SEQ ID NO: 11708 - DNA, 237 bp, Candida albicans
ttaaaaaatggttttgataatttgaacaataaaatcaggtaccaaaagagtttaagcttttctgaatttgatatcatatggtcaaatcaatcaaaatttaaaattgaaaatgacaaacacaaaaaaggtacgatttataatcgacaataccaccaccaccaccatcataaccatcgtctacaaaatactttttggttgatgatcagcgtaacttttgttcttttagttgtcaattga

SEQ ID NO: 11709 - DNA, 282 bp, Candida albicans
ggtacatacacaaaaaaaagaattgaaaccacacacctgttgcaaacaacctttccttgttattctctctattttcttctggtcagcaaaagatttgaaatgacaaatatactcctgaagctacgcaaaaagaccagtgatgagcatttatctaattcagatttgctgtttcagcagttgaaacaaaaatacggtgtttctgtttcaacaattaaaaataatgttaatggagctaaactgcaagcaatttgtcatgaaaactggacaatgttttaccaatga

SEQ ID NO: 11710 - DNA, 237 bp, Candida albicans
tgcctggatttacaatatataaggaaaatgccatcaaatcaagtggatatttttcaaagaacagtggaatgcacatcaattcccgtttcaagatctatatttactaacggtaaacaacttccttgtctttatgttggtgttagcgacggtgctaccatttctgattttaccaacagtctaaagtcacttgcagaattaaggtaccatccactgatttacaaagaagcaatgacttaa

SEQ ID NO: 11711 - DNA, 204 bp, Candida albicans
cttcaggagtatatttgtcatttcaaatcttttgctgaccagaagaaaatagagagaataacaaggaaaggttgtttgcaacaggtgtgtggtttcaattcttttttttgtgtatgtaccctaggtacggaaagctatagtgaagtcatatatatattattggcaaacaccaatactaaagtgagacaaaatctatttaaataa

SEQ ID NO: 11712 - DNA, 777 bp, Candida albicans
ttactctgcatctgcctttttaatgtgtatagcatgtttacatatcttggcgatttgaatttgagacgcggtcaaaacgtttgggtttattatcccttttttttttattcacaacacctagttcttgccaacaagttttcaatacacacaatgggtccaacccgctatttaatattacaacaaattccaatctcatcattattagatccaaatccagtgattgaaactactgaaaattcggagtcaaataaggagatcaatttattacctcgcgatgttcgttatgaaatcctacatcatttcaatttaagagacgatgaaattacacctcgtgatggctattcaagaaaaaataacgactatgttgaaatcaattcttgcactggttttcactatgatcctctgttggatacttatatctctgggacaagtggttacagcaaaagaatgaatatgggactttctcatgccacgcttaacaaatatggaattggtggtaagtatagtaggggtcggttctatgatttttccaaacacaacaatccaaagtctaaacctgaggaaaaaacagctcaagaaccaattagagttaaaatggttgaccttttaccttcattgacagatacggaggaaaaactgtttgatgagtctaatttgctgcatctgtcaacaaaaaagaggaaaagagaagatgataccctgctggatatccgtgaaaatacagctattaagttaccacccattagtacgctacctatgccgtttccagaacattaa

SEQ ID NO: 11713 - DNA, 192 bp, Candida albicans
aaagcacaatcgcatcataactcatatttcgtacatcattggtcctggctgaaaaattggctgttactttacatccaaattttatttacttcggatattaacaaattaaaaatggctcattttaatcttgaaatttacattgccacaaaggcagttacaaaccgggacacattgaagttggttgctctctag

SEQ ID NO: 11714 - DNA, 204 bp, Candida albicans
agttggttgctctctaggacatcaatgctttttaaccccataaaatccgctttgaataattacgcgggttcaaaatactcattttcaagaattcctcaaacaaagaactcggataacactcaattttgcaacactcataaactcactataattgaaaagttatcaatatatttaatggttttacttataggcatgctttcatag

SEQ ID NO: 11715 - DNA, 270 bp, Candida albicans
acatggaaaaaaaatttttttttcgtgtctttacttttcactaaaatcaacaaagaaaagaagtatacatctatatatatatacttactatatatgttcaacaattttaggagaaatatttcccatatttatagacagtcatttttatcaaattatagaaccatgtcatcatctgccaatagaccaatcgttatttccggtccatcaggtactggtaaatcaaccttattgaacacatgtcttcacctacgggagcaagacacatccgcg

SEQ ID NO: 11716 - DNA, 459 bp, Candida albicans
ttgccagaatttgcaaaatattttaaaataacaacgatgcagcatccaaggatgttcaatcagacatctacaaatgcaaaaaaacctaatggctcagattcaagtataaaggttgctaatcattctaaccagagacaaatgtcagccaatcacgcaagtttgactataggtggatccagaaacccaattaatcaacgacgatcaatgctgactaaaaacattgggagtactttaattgtaagtcgacggaataaccattacttggacatgaaagaggaagactctaaagaaaatctcaccaaaattataagcaacaatcaaaatgaagaggatacagaagtttcagtcaaagtatcggtttggtttcatgaattacgcgattttaccgaagatataataatagatgagaatgcaataccaacaggggtacaatcttcaccacgggatgaagatccgcgt

SEQ ID NO: 11717 - DNA, 183 bp, Candida albicans
catactttttacgtacacacatatacatcttatatacatgcatacatagatatatatacaaggtttcaaaaattgaacatattttttatgtccacaaaatcatggtttactcctccatacaacagaaatcaactatccatatcaccagcttcttttttccaatttctctttttctttaattga

SEQ ID NO: 11718 - DNA, 189 bp, Candida albicans
tttggtgcccgcacttggctagaagaaagagaattgaccttggaaacatttcaaaaaatagctgttatgaaggaatttagaaaactacgtgtgttgtttcccaaagggaagaagatccagcatgcgtactgttttgatttggttatcagaattacgcatgaacataccaatttaacagcggtggtatag

SEQ ID NO: 11719 - DNA, 1041 bp, Candida albicans
ggtttcgctgatgtgcccattccacaagacgattttgaagatgacatagttaatgggtatgagaaagacatagatgatgatgtttcagcacttaaacgcagagtgagcaaccggaagagcagagcagaagaggcaacttccttggaagatagtacaaaagaggatgaggacaccacgatctacaatgctgatgttgagtctgagagtgaacaggatgaggatgacaacaataatgagtttgaaaatgaagacgagaatttaaagagacttttgctgagacctatcactgagataacgtacttggaacgcacccccaactccaagaagttactagttaattcgctatcgtcgataatccaacataaaatacatgcaagaataaaggagctgaatatttctaaaaacaacttagcaattacggatgacatggcatcgaatcccgctttagtgccattaactacccaacttgcaaatcgttttaattttttgattgacaatttgacaaggagtaagacttctaaaaaaacgatcaactggaaggatattctatgtacagcagtaaggggtgaaattggtccacactctaatataaatgcaaagagctacgaagaattgtataacaaatgtgagaagttgtttagcaccatgcgttataattacgagtttgaaagcgaactcgagtgcgaggatgatatcaggacagaagacggggggtttaacgtacatgagtatttgaagacattatcgaatagtgtccaggcgtccggtcaaatctcttacaaagatttggtgtcccgatatcctaatgacttctctcaaagagaaaaagaggaggccagattcaaacacaattttttcaaacttttgggaatccaagaccaatctttagatatctcatgcagcaagacgaaaagagaaccagagaaaaaacgtagaaaagtattggtggtagaaccaaaggtagaagatttgaatgaagtgaaagaagaaattcttggttcagtggaattagatgagaattcatatatgctaaatttatag

SEQ ID NO: 11720 - DNA, 213 bp, Candida albicans
tcttactttttttttggtctgatgttggtttggttaaagtatgtattttttttattcaacaaatgttatttagtacaagtaattaatttagtctataaatccccaatttgctgttgttcttcagttagtcagaatgagagcaattggagggaagaaccaaacaagggactgaatattaaagtgttgctttcgcttaaatattatttatcgtag

SEQ ID NO: 11721 - DNA, 876 bp, Candida albicans
cagaggaattattttttttggaggttttgtttttgtttttgtttttgtttagagaccaatttttatcgtctctttacttttttttggtcgtatttgtattatgacagaagccaccatcaatattcccaaatggccagaccaacgatatttccactcaaaaaggataataatggtgctcaattgatcagtcggttgaaccaattgatatcaattactgaatcattaaccacactcacttcggtacagcgacaagaattagtcaaattgtttcgtatgacaattgatatgattattcttcgaaccaatcaggtatttactgaattcataaacaaatgcactcgtttggtgaatagctaccaaaacttgatcatggcagtcacatcaaatgaacaacaactgtcacaagctttgcatccattcccattcccgcggtcactgcagccaccgcaactgcatccacaacctctgttatcattaccagctttatcaaacttgcgtactccaggaagatctaacatcagtacgccaaatcttcaaatcagaaagtatggaatttttcacgatagggtttcgaatttatctccatcaatttctactcaatcaatgtttgaagttgctcctaatcgaaaatcaaaagatatcagtagaatgcttctacccgaccaagaacaaaagagttccgatgaaagcgaattcgaggaagatgaatcacaagatttaatctacaatagctcatcacactcgttgtcacctggaagaccaagactaccgtcaatgtttttaagcaataggttgagcactcctaatttacaagttcatttgaatttgagtcaaaaaaatagtagactgcacttgagaaataattcgtttaactaa

SEQ ID NO: 11722 - DNA, 189 bp, Candida albicans
cgaattatcaacaataataaatttcccttctatttttttgtcgcttttctgtatgatgagttaatttatgtttttaaaacaatttatattattctattgattttaaattttagtagtaaatgtaaagtagaaattacaagaaaaggatcttgttgtcttgttggtgattttctatttaatggaatttag

SEQ ID NO: 11723 - DNA, 1470 bp, Candida albicans
cagtctcgtttgtctcatttagttcagaatcaagatccaatttctttggaacaaaacccccagttacacacagtctacccacaaccacggcattcaaaacaactgctgtcattgttgaaaaaaaatcagcaacaagatcgaataccagataacatgccacttcaaccacaagaaaacaataggactttgcaaaatttcccattgaatcaatttaatgctaatgaaattcttcaaaacgtacagcaggtagtcagggaaactgtgaaactggagattttagacagcccaaatatcgacaatacctataaaacagatatgatggattcatttgtgtctctggttattttggattataaagattatttgagctcacaatttttgttttctttgaagcaaaacctatatgacagacgagaagcgactcataccaatgttgaccttgaacaaaatggttccaatgagaacctttttgatgaacaaccacaacataaacacaatcaccaacacaatgaaaatcaattcctgtatcaactgcaaattcaaaaccagagacaaaatcaaaatcaagctcaaaatcaaaaccaaagtcaaagtcaaacaccaggacaaaatctgaatcaaaatgatagtcaaacccaaataccactacaaggtcaaactccacaggatcgtaaatctgccatgcaacaaaattggataccaggttcgactcctggagttggagggttgatcagattgtcaccattgcttaatgataatgataataatgagtatgcggcggtagcagcagcagcggttgttggatcaaccccaggtaatccaaatggtaattctttggaaaatttcactcatttgccagggattaattccagtacactaaattatttgatgcaattaccacatccttctgcaaatccaaactcaggaggagtctcgtctagtcagccgacttcttcgatgtcattacaaggtcaccagggactactacagcaacagcagcagcaacaacctatgttctctatgcagaatctggggcaacagttaccccccttgagttcgatacccaaattaccatcaagcaataatgctaatgtaaatttgaattcatcaagtacattgccacttcctttaaacaatactggccctacactaaatccttcgtcattattaaaatccacatccagaaatagtactaattctggaaatatcaatgtcaataatatcaataatagtaacaataatagtaacagtgcctttaatagtgtttttttaaattcatcaataactactaatcctgcatttattttcaatagtcaaggcaatccgactaattccaaccagtctatggttaattcaattatgacaacaaatctgaacaaagatggtactgctactagtaataataacagtagtggtaatacaagtaataatttattgaatgatatgcccaattatggacctggttggtaa

SEQ ID NO: 11724 - DNA, 204 bp, Candida albicans
tctcggaaaggggaaaatttaaataacgttaaggcggaaaccaagggaattccaggttgctggaaaattgaaggtttaattaagaggaaggagcaacatttggaaaggagggttaactacccaactaaagtggacagcaaagagaagcaaaatgacgctaacgacaaagaattggaacaattgatagataaattaaaaatttaa

SEQ ID NO: 11725 - DNA, 279 bp, Candida albicans
ttaaatgattatactattatgagctcaaacagaaattcttttgataggccattaaactatagaatgtcgattggcgaatcaagagagctgattatatctcccacacatgaaggatacagcaaattttcgtcaaaaactagtgttacccatcttccctctctaccatattcacaagcaactacatcaccactgtctcttcaggataattcacaaaaaatccatggtgtttatgacgatgcctatttccaaggtggacctaagttcaccagacccaagtaa

SEQ ID NO: 11726 - DNA, 186 bp, Candida albicans
ctctttgttgggaattggagtgccaggttcccgcccaaaaatgcaaagaaacagcaaaagaaaaaaaaaagtaacttaaaattcgccaatacctctaatcggtccaaacttattttatcgattcttttctatgaatttcctcttggctcgcaacctgtttcccgacacccaactattgctgattaa

SEQ ID NO: 11727 - DNA, 186 bp, Candida albicans
acaaaagcaaaaataaaaataaaaatgtttgtacttctttacgatgctcttctcagtctcagtctcagtccaggacacacacgcatcgttctagtaaattctcgcgactataaaaaacagtcagtgaaaaattttttttttaattctttttactttctctttttctcttctttaactaatttatga

SEQ ID NO: 11728 - DNA, 882 bp, Candida albicans
tacatcaatataaaaatgacaactagatttaatctaccggggacatttcctattgatgatgaaataccgtctgcaccagcaaacaccacctattcaacagtttcaagcacagcaactgaactcatagaatcacaacaaaacctccaattcaacaataatcaactaatacacaacaagacaaaatatcaatttgatattctaacacaaattgacgctttagtttatattataattttttatcaatttgtaaaattttgccattctgcttgtttgatccccttggtacttcatttggtattgcaaatattattgaattcaaagattgtgacacagaatagccaagtgcccaatttgttatcatttttatcaaacgaagataatcaagataccagagaaagaatatatgaaactttcatacataaatactgttacttgttgtatataaagactattcttgtgattttgtatcatacattatttgttgcaacatgggtgatgtatttagtcgatactcaacaattacagaaactaaatcatggaacttggtggtttatttcattcattggtgaagaaactcctgtaattgataaatctaccccatattggttgaaattgttcgagttgggattgtttcaattgatcttcactgatgtattgattttgtttctacaattggcattgtaccaatgcatttataagcaaagtgatgcatttcacttggatcgacgtttaaatgagaaagaggtgtacataataagaaccaatgccgacagtacaagtggtatagatgaccagagtgtggtaactgatgccgatggagttcccacagttttgaaaatacgactatttgaatgtttcaaatctgatgcttatgcgtattga

SEQ ID NO: 11729 - DNA, 225 bp, Candida albicans
aattatgatttgacacgatgttgtaagattttagaaacgaaaccaaaccaagccaataaacaaaaacaaaaaaaatactcatcaaaacttttatctgtttatagagaatacgattttatatatacacatatatttatattcatttattatttattttatttagtactagtcctagttcttaccagtagatccaaaaccaccttcaccacgttcagtattatctaa

SEQ ID NO: 11730 - DNA, 261 bp, Candida albicans
attaaatctagttgtcatttttatattgatgtactagattgtcgttgtgtgtggaatttgccattggtttttttattaggagtgggtagtatttttttgtggttgtttccaacatttatcaacaaaattggtcaaaaatatagagccaaaaaaaaacttacagataatacaactctctacacactaaatcgttatacatttatcttgtttctttattttcattatgtttatttaaattttaatacttttcttcccctttga

SEQ ID NO: 11731 - DNA, 531 bp, Candida albicans
tttacaagatttcccaccaatcttttcttgactttgattctgtttctgtttcttttttttttttggccctatctttcattcgttgacgtctatttgatatttgctgatcctttaaatatgttattgccagaaagtattaattcccagaatttagttaaaagaattgtgtattatagttcttatgatgattattccggttggtggaaatggagatggttattatggttattgttattgattcctatttttcttaccatctttttaatagcaagaagaggaagacaaaataaagtggtggcttataataatcctcctgatccacaagcaaatgaggcttattacaataataatcaatatcaaggagggtataataatgatttacccccacaagctactccaggatatggtaccacaaattatcctgaaacttcacagccaggatataatcttcaacaacaactgggagattataattctggtgaaatttccagaccggaaggtccaccccaggcacatacaaaatcttattag

SEQ ID NO: 11732 - DNA, 633 bp, Candida albicans
caaagcaaaataaataatcttggtattctttattattatatatttattgatgaaattcaccaatcttctctccatattttcttcttcttcttcctttttttattacttgacatctgtttgtgtttaaatatgttattgccagagagcattgatacccaaagtttaattaaaagaattgtctactataacaattatgaccgttcgggttggtggagatggagatggttattatggttattaatattaattccaatttttgccatgatatttttattatcaagaagaagaaggcagaataaagtagtagcttataacaatcctggtccacaaccaaatggagcttactataataacaataatcaatatcaaggagggtatcaaggagggtatcaaggaaataacgatttaccaccacaggctactccaggatatatccctcctgcttatcctgaaacttcacaacaacaaggatcatatggtggtggttatagttctcaacaacaaaatggttataatcctcaacaacaaaatggttataatcctcaacaacaacaacaacaactgggaacttataattctgaagaattttctagacccgagggtccacccccggcacatactaaaggttattag

SEQ ID NO: 11733 - DNA, 258 bp, Candida albicans
gaaataaaagtggaaaacatcgtatcaaatgccctgccaatattgccaacagagtccataagcttttacaaagcatacacttcttcaaattgtgttaagaatgaacaacttaagactaacttgaacttacttatcatgatgtttaacatacctaacggtctttttacaattgcgagtgcccatttacatagtttaaaacaaacacgcattcttcatctacctttcaaacgtaaacaattatatattcaatacaaataa

SEQ ID NO: 11734 - DNA, 210 bp, Candida albicans
gtaaattaccaggagggaggaaggggggtggtagttctattaaatggtaaaaagataagatggatgataatattcaacttaaactacgaagaaaatctggtgaaggctaataaaaaattgaaattggagtggacccagttaaacaatagtgtcattaattcttttcaattcattcgtatttaccttcaagtccaatactattacttttga

SEQ ID NO: 11735 - DNA, 246 bp, Candida albicans
aaaaatagatttgccaaccacttcgtcttcttcttctcattttttgccttgtcacgaggtaaaaagggggcaggagaaaaaaacgattttcacacgcactctctgatgataattattatacaaattagatttgtatggcaactaatagtaaatacattagaaatcttgaaaaaaaaaaaacgtgccaacaacgtgatcaccatctttttttttttttggttgtttttgttttctttcacactctaa

SEQ ID NO: 11736 - DNA, 372 bp, Candida albicans
ccaccatttcatttattcaatatttgtttctttgtttctttttttttccctcgtcttctattcatcaccttaattgcttttatcggagatgagaaactttcgcatcaactgatcttccaaacactaaaaatatactttactaataatttgttgacacaaaaacgcaaccacaatagtttaaaggagaattatagcaatcactcacttcacttacttcactttctctttcacccatccacaccaaacatttcgactcagccggccgccaacaaaaaacaaaaagattatgcatacggaactctattgtccctaacactaaaacgagatcattccaccacctcaaattcacctagtgttatatttgctgcctaa

SEQ ID NO: 11737 - DNA, 243 bp, Candida albicans
gggaggttaataattatagttaatagtaaggaacagttgaatgaagtgtggcaagtattgaacttatggggggtggagaagtcaataataataataataataataatatttgtaaatataggaaattcaaggaaaagtaaaaaagaagaaaagaaagaaggaaataggaagaaagaaagaagaataagaattaaaaggaaaaggaaaagtgaaaagaaacttaaaaggaacaaacaaatttaa

SEQ ID NO: 11738 - DNA, 318 bp, Candida albicans
ctgatagccctgccaatattattaatgtatcaactaaattatagtatttcaaatttagttttcacttttattaaagcttggctttggctttgtaaaaaaaaaaaaaaaaccttcggaagaactttagatccattgacaagaagaaaaaaaaaagtgatcagatttgatggtaacttttgttttcttctgcttgccaatggaaaaactgtaccattgatgatgacagagatcagtgtgttcattgatgtcattcatttgattttgatttgctttattattattaatgatttcatagtttgcaacctgataggcaaatga

SEQ ID NO: 11739 - DNA, 183 bp, Candida albicans
aaaaaaaaagaaattgtattcacaaaggggggaaggggggtgtgggaagattgcgaaggagaagaagaaaaaaattttttcttaccaaaacctaatcttatttctaaatcccgttttttttttttccatttaattttcaattattatttctatatctatactttatcaattaagcccaactaa

SEQ ID NO: 11740 - DNA, 282 bp, Candida albicans
ttgtatacaattgagttatttcccaatttgagggttattttatggcgacctattagtaaattcttaataatttcgcagtcgcaagaaaattccttatacgtgtggaaagcaattatggtcctctatcataagcaagtcctgggtccttctagccaatcaattggtctcaatataaccattatcaaattgaatgttgctcagcttgttatgattacatttgcaccctattactgtaaattgtgtgtatctatgctgctgcaacgtggacaggactgtgtgtag

SEQ ID NO: 11741 - DNA, 654 bp, Candida albicans
acaagagatatgactggacgtggaaatctgggaaattcatcaagaggaagaggtggttcaagaggtagaggcgccagcaaaggtggttcaaggggaggaagaggtggggcaaagaatggttcaagttctggtgggagaccaaacggggatacatctaacggcaatggtaaaggtaaaggtaagggtaaggggaaagttagtaaaggtaaaaaatcaaaagaaaaaggtcctaatgcaaatcttattcctcttggtacaccaagaacaagaaaaccaaatgatgacgaagggcagaatggacctaaccaaaaccaattaaatgacctagaaggacgtatttatgatgctaatgaagaagcatatgtgccccctagattgaggcaaaatccaccaaatacagcatacagtagtgcaaacaactttggaacactaccaatgaccaacaataataatttaaaccaatacacggttggtaacaatcaaaacaacactgttaataacaacagtgaatctactaacaattttcaagcaggaatggccccagctgctgctgctgctgccgccgcttctcctaatgctatgggagcaccagtgacagcagcaccagtggcagaaccagaacccaaagccaggttgatgcaccaattattatga

SEQ ID NO: 11742 - DNA, 192 bp, Candida albicans
ttaattaacaataagaaaaaaagagaagggaaaaacaaaaaagagaaagagcgaactttaattaatcaaacaacaataaatacttttgaaggcacgaatcaaattattgaatccctcgctcccccgtccccaccccacaccgacagatgccgaaacaaaaacatgtatacacacacacacacagagcattga

SEQ ID NO: 11743 - DNA, 204 bp, Candida albicans
acacttattaattttgaatactacaacaaccataaccgcgtatcaaactgctttctaaaaaattgtacacgattttctgcaaatttgcataaaattaaacacagctttaaatctagctacaaatatcaactagtatctacaccacatataaacattcttaaagatcaattatattccaaaatacttcaatatttaacagtatag

SEQ ID NO: 11744 - DNA, 1002 bp, Candida albicans
tttatttgttggacctttttttttctagtattctgttcccattcgtttaaacactcatatatatatatatatatctggatatcttcttcgacaatggagaaactaatccaatctaccatatcattattcatatcattatccctaaaaatttcaactaaatcttataaatcaataattagtatactattcataatttctctactatcaataatattaaccacaacgataacagtatatcatgatccagagagaattatcaccaccaccacaacaacaaccagtgcttctaagagagtattcactgcatcatcaccaaaacaacaggataaattacaacaagaaatagatcagcatcaatcagataatagccatgtacagcaaggtaaacgtataatcattttccctaataatttccccttgattaagaatgatcaattggttaaatattatattgatattatgaatcaagcattacatcctcatgatttaatttatcgaaattgttttgagtataaaattcctcaattaagttattcatctcaaaaaattgatgtatttagtgatggtggtggtggtgaccaatcagggattaaatgtcggaaattatcatctcaagttaatgtcaaagtaagtcctgcaattaataaaaatggtaatatgagacaaatcttaactcgattcatgcaagatgatggactttattttcaagaattcttaccatttttccccaatctaaaagaacaattacaatccgcagatgatgatattattaataaacattggtatcaatttattggatcaacggtatggttacaacaatatggagttcatttaatgatatcaagaatcatatatactgaagtagatcaaggattaccgataatttcattagcttatctacaattatttgatagaaattggaatgaattaaatgatgttgaattgattattcctgattatgaaacaacaacaacaacgaccactcaatcaaaatataaatag

SEQ ID NO: 11745 - DNA, 198 bp, Candida albicans
agaacagaagaagaaaaggaagaaaaatttttcaaagataaaatttttttttttttgccttgtcaagtttttaaattgattgttgttattgttgggatggccagcgcggttaatgacaaattaacaaaattcaattacctaattggtaaaaatgactcattcttcataacgccgtcgaaggaccatgtatgtcgaggg

SEQ ID NO: 11746 - DNA, 936 bp, Candida albicans
tttatcaaatttcctatcaccattacaaatatttccatgacaatcattacaacggacattgatctttttcaagaagtagcaaaacttccatatgaagttattgctctaatcgttagttatttaccgaaatgtatattgccacaattattgtatttccaacccattcaaagggaagtggcttctacaattttgtcagatgttaatgttaccgagagcatttatagacacaagggtagtgatacaccccatgttggctactccgaatgtgactgcgactggttccaaatcgggctcagtgatttgacgaaaggtattacgcaatggaatgtgtacccaagagcacttcatatgaatggagaatttgtatttaaggatgttttggatactttccctgaacttttaaaggaaactctgagtattaatggtactatttccctgtgtgaaggtataaaagcccaatcattgttagatttattttacaatactaatcttaggtttgattctttgcaattgaatggagtctgggacccagctacattaccctctgttgccacaagcattcgattatttcataccacattgaacagttatgtgattcctggtgtaaaaaagttggacatggaaatgtattctaataatgacgaaccccaaacatacaccttttcgcccgatttaaaagacttgcgtgtctacttcaacttcacgattcaagtgactttgcctctgaatttgcgaaaattatgtatcacaacatcattggattctgcagaattcatatctgatgaaatggtcaagttagagtatttacagcttgagttgccgcaaatggaatcttttgaagagacaggaatagtcgctccaaatttgaaaacattaatcttgactgattgtgaaaagttgtctgattttcgcaatttagaacaatttcaaaattga

SEQ ID NO: 11747 - DNA, 234 bp, Candida albicans
ccatcattaaaagatagatccaaaagttccaatcgtatcaatgtgggtggaagcattaaagtgctcaaatcaatatttataaaatcacgacatctgattgataattcgttcaaatttggaggaaaggttaataatggagtttcaaaattttcaagatctataaaaccgtttccatcatattcaaaacgctctaacataggaaagttatcctccttgaataaaccaaatgggtaa

SEQ ID NO: 11748 - DNA, 183 bp, Candida albicans
catttcgataaatttagtcatagaacacagttatccaaacatttgagttggaagggctcaaagtccctaatattgaaaattatttactgttcctactttttagttgtagcccccagagaattgtttaccgcatctacaaacaaacaagatggtgaaaaaaaaaaaaaaatttatgagaaatga

SEQ ID NO: 11749 - DNA, 204 bp, Candida albicans
tttggtttggatgtatttgcaaaaggacttttatgtcaattgagagaaagcagctatgacgatgttaaccttgtagaaaatcatgatctatcacccccacccccttttagtgtgaaactttttttatttttcaggattattcgattttttttaccattttcattaaatgtacatagatacgtatattttcagtatacattataa

SEQ ID NO: 11750 - DNA, 264 bp, Candida albicans
gagatgtcaaaagagacgcctaaattgattagtaatgccttgaaaataacctcaaagttgattgaatctgatacaaatatctcaacaattgatttgaatttgttggaaaacttgaacactaatcaatcattgaattatattaaactagagaaaaacatgaacgaaattgaagcaaatgccaaacatttgcagattttgagtatgtattattgtttggtgatttattcttgtacggtttgtactaacgttgccgatagaatctga

SEQ ID NO: 11751 - DNA, 186 bp, Candida albicans
acgactaacgtctatccaagactttattccaaaatcaaaaacaataaaatacaattgaaactttgtaagaaacctatacatatgtatataatttataaacaagcatataatattgggcaaaaattaagtttaagtttcttcttcacccaattcaaaataactaatgtcttggttagcgtcttgtaa

SEQ ID NO: 11752 - DNA, 192 bp, Candida albicans
gtttggaaaatatgtcattatttttcacaaataaggagtgagagaataataattaccactctaaaaagaaacgataaaatacaaatacatcccttaaacaactttaatctgatgatgcatgatcttgagaaaaacggggttagactccgagaaaaaactttaataaccaaaccacattcacagtctgaatag

SEQ ID NO: 11753 - DNA, 438 bp, Candida albicans
atagtattcctacttctcttcttctttttttggttcttacaattatcaagaatcaaatctttatcgataatgttacgacccgtcgttcaatcctccccactaatagtttatcgttcctactcgatcgttcaggctgcaaaaaacgctttgaataaagtaaatctcaagttgggaaaggttgcagctaaagatatcgaatacgttgaaagtgcagctactgagatgaataaagctgctcacaaaacagcagattccgcagcctatttgaataagaaaacgggagaaatacttgctgaaggtatcgacatggcccaggtggccaaacatcgtgctgatgcaatatcaaaagttcgtaagaacaaacttggctacaagaacttacaggacaagggctccaaggttgaaagtgagcaatgcagaccagatgatggcttgtaa

SEQ ID NO: 11754 - DNA, 255 bp, Candida albicans
aatcattttcaagatatcattatttatatcaaagggggtgtcacttatggagaaagtcggttgatatatgaattatcagagagtaacaagcggataaatttgattattggaggtgatggcatattgaatagtgaaatgtggttacagaaattgtattctatggtgacgaaatttagtgatgaaccaggtcatagtcatcgggctagtgaagattctcatataaatagacaaattcaactacgtgatatcttatag

SEQ ID NO: 11755 - DNA, 573 bp, Candida albicans
actaatctaaaatatttggagctccaatatttcgatccaatttggcaaacttctattattccattaactccatgtataactcgccagtttatactgccaaaccataaacatattgattctgcccccgtgggagtgattcttactcatcgtacagctatttatctgagacttagtttgggaactggattcagtttaggtgaaggtatattggtcaatagtaccacattaggacttagtttaggtagcaaaatcacattcaagttgaccaaacaacgtatgatagataccacggtaggatgttatctgtataaagatggactttcagcaagagtatttggttatattccaactttacaagttacaccaagagctagaaatatattgtatagtaggaagaaaaaaagagttgtcatagatcatgcttggcaagagttgaaacctaaaaagataatgacagattcaaaagtgcggactttgtgtgatgtcgggacttcggaagaactccaatgtaatacaaaaaccggtaaacacattgatcaatatggaaactctttaatctggaaccatagataa

SEQ ID NO: 11756 - DNA, 807 bp, Candida albicans
tttgctaggcgctggggtcgaatacaacctatcattagtccagtatccaccaatattgaagaatttcaatttgaaaatgaaaacaaacttgcacctgaaccaaagacaccacctcaacaacaacaacaacaatcaagatctagacaaccttcaacaagaacttcaccaataaggaaattcttacatgacagtagtcctaaacgaattttcaaatctagatcggtagtcggaccacatttccataaacattcaaattcaacaatttccaatacaatgtctttgaaatcttcattttcatcttcgagatcaacatcaccaaataaattgaaatcaatactcaaattacataaacatagtaccagtgtacccaatttccaattccatgacaattcatggactcattcacatccacatcagcaacattcatggtatttggataaacatagtttccattcaagtcatcatctgaaagtaattgctgaacctattgatttatgggatattcaaactacaaattttgatattaatgatgtatacgaagtacaaccatttgcattagcacaaccaccacaaatatcatcatcatcatccgcacaacccaaacagaaagaaagtagaaccaaaaaagttaaaaacaatgaacaagacaaagatgatgacgaagatgatgaagatgaacatcatcaaacaaatcaagaatcaagaattagtagtttacctagtcaagtgtttggtgaatatgataaagaaaaatgggatactttaaaaacattaggaaatgaaaattctcatacagtagctgtatag

SEQ ID NO: 11757 - DNA, 183 bp, Candida albicans
ctgatcgtagtatggctctttccagttagagatattgttttaaataagtcaacaaccacatacaatatattgggcgtaaacaatgaaagcaaaaataaaaagtcgtctttagcctatgagatgcaaaactcttacgacacacacaaaaattttttttcagcccatgtccagttttatttctaa

SEQ ID NO: 11758 - DNA, 225 bp, Candida albicans
ttgtacagccattccgggtactgtcaaacgtggtcaccagcatctcgcatcttagaagaaaagagcattgagcataatgagcaagtgcaaatgctctatcgggtcttatataatcagaaagggtttatagtgactaattcggattatttctggaaaaggtatttggttaacacccgtttaacgatgactggaacgaagacattcggatttaaagaaaaaaattga

SEQ ID NO: 11759 - DNA, 228 bp, Candida albicans
agattatgtttatgtgtgttagggttagtcgtaattgaaaaaagaggaaaaaatggcaatggcaaaaaaataaagcaacatgatcgagccgaggatcgaactcgggaccttttcgggacttacatccattgctggaaatgtaaacgaaacgtgataggccgctacactactcaaccagttgtcggcaggataatttttttaggtctttatatcgtgcaaaatgtataa

SEQ ID NO: 11760 - DNA, 183 bp, Candida albicans
ctcagtgacagcatacaaaaattaaaatctactaatctactacattatatcctgctaggaatcaaccagttcgatagaaacttggttaattttcaaaggcttatatttatcggtacttacttatatactcaaactccggcgtatgcctcttttctaaatgaagcctttccaatgcatcagtaa

SEQ ID NO: 11761 - DNA, 273 bp, Candida albicans
agtgtatacacaaacggacagggggctatacgactagcaaatacatcattattagagtttcaacaacttaatgttaccctgtcagtgaaaactattcagcatatggcacaaaccaactttcttcaaaacactaataaatatgtagttagttgcaggtatttttattgcaaaattaatactgtaattaaatatacaaatacaatattttatccagcatttcaagaatcagtcaaaattaatagtttatacattttgcacgatataaagacctaa

SEQ ID NO: 11762 - DNA, 201 bp, Candida albicans
ttaacaataaataaaaaaatacccctcttactggtactagtattttcccccatcatcatcttcttctataataagcaattactaagaacaataataaaacaacacaagtacaagaacctaaaaaaagaaaggaacgtaacctttttaccactccactttactactaccgatagtataattttattattgttacattgttaa

SEQ ID NO: 11763 - DNA, 507 bp, Candida albicans
ttgtttgttgcactgggtatttccactagtgatacatctattgtatatacgggacttcaccatgacttaatatatatatgttattacatttccttgtttcttactttcgttctttttatttcctcttattttgtttttacattttactatttattctattcagccttacatttatacatctattcattacatttacacattacctacactactactgtcattcaatacaccatgtcgatattaactaccatcactaacagattaaccaattatactaccaattttcaaaacaataaactaaatcatcaaccaaatatcgatgaaggcacaaccgtaacggaaaatgcttacgggttatttgatttatttctatattatttgatgaatttgatactatttatggtgttatttattgatttaattgtggaatttataaaaaattgtgtacacaattataatattgttgcttgttcattcaaacacaagttatacaataacatcaactaa

SEQ ID NO: 11764 - DNA, 273 bp, Candida albicans
aaattttcgatggttccaaacctcatctttcacaacagtttatacaatttgcaggatgacgtgtatttgaacggagaaaaaatcgagttcaaccaacccccaaaagatgatgatgaacctaatttacgtatcaatatcgaattcactcctaaagaagacataaatggatccaattttgcatttggtaatgactttacatatcccattagagattacgtcccccgttgggttattgaatacaggtttaaagcttttcaactggttcatcaatga

SEQ ID NO: 11765 - DNA, 567 bp, Candida albicans
atggatccaattttgcatttggtaatgactttacatatcccattagagattacgtcccccgttgggttattgaatacaggtttaaagcttttcaactggttcatcaatgattcagtcaagggtgacccatatcctgataagccatacctctacggacctgggattagtagcttcacatatatggctatcaagaatccggacgaccccacagtaaacacacactcaaaaaaagcagtagagaatttattccaacaagaagagaatataccaaaagaaccaaattcaagaaagaaattctttagtaacaagaaaaagtgtgaaaagttcactttcaaaaaaggtgtgacgtatattttacagtttgataccaattttgtcaagttggctgattcaaaatactcaatttctatccctagatttgattttgatgttagtcattatgccaatgatacgctagacaatgttaactgggttttcaaagaaggcggatatgaaggggttgattttggtaaattgggattgattatcaattttaaagtattactggaagattcagaagattcataa

SEQ ID NO: 11766 - DNA, 216 bp, Candida albicans
gaaatgaaaagggaattgagaagtgggtggaatgggattgttcttttaggggaaaaacaagaacaaggtgaaaatttcccttggattcaattatttgaacaaagtgccttttttgcagaaattgaattgatacaactcaattatctccgattgaaattcaatggattaatgagtatcatcaaagtatcagagacgattttggtagtaaattgttag

SEQ ID NO: 11767 - DNA, 192 bp, Candida albicans
agaccaaataacactgtagatataatagcaaggtttgaagcaacactttataaaagaaaaaggataaaagttgcttccagttctgatattactaatttttaccaaagagtgttatataaaacgtattacataattgaaaaaaaaaatcaaccccaatatactgtatatgtacaattaataatgtgtgtgtaa

SEQ ID NO: 11768 - DNA, 294 bp, Candida albicans
caagtaatgggttcttcctctcccctgtgctccgaaagttgggatcccccaccaaacaaaatgttagcgagagagaataaaacaaaccggaagtcgctcaacaaggaattggaaaaaaaaatgagggcgactataaaaccaccatcaattttcccagcaatcgaacaatttttttttcaattcttcttgttggatcttctttttttttttttgaaaaagtttcattattatcaattgacttttgataaagtaatcaatcaatcacaacaatcacaatgtcctcaaattcattag

SEQ ID NO: 11769 - DNA, 192 bp, Candida albicans
aatcttttgcgtgttgtgttcaataaataccaagtgcccatgataaccgctattaagtataacttagtcattggtagcatggcatcttctttcgtggtaattacacgtacttcagaaatcatcaatcaatttgttgcttgttttcgtttgccgtttcattctcatttcatttctctaattagtgcattgtaa

SEQ ID NO: 11770 - DNA, 600 bp, Candida albicans
gtaccaattgcccctgctgcaccaccggctgtggttgttccttttaaaaagaaattccctactcattatattcctgatgctataatgaaagaatatgaagaagaggaagctaaagggaccccatcatttggattatcacaatttcaaccgacaaagaaaaatattgttgaagatttagaattaaaatttgacttacaaaattctaaaccacttcctaaaatattatcattaccggaaaatgctaaatattggaatcaacaaataatcgaagaagaaaaagaaaaagaaaaagaaacggaaggagaaattgatgaaattgaacgagaaagagaaagattatcttgttatagattaccttctattctggaagcattacaatcgtggatatttcttaatgtttatcataatatattgaatattgatacatttacatttgatgattttgtgtttgctatgggatggaatgctgatcaattttctgaagatggtcgatgtgaattattagatgaaatttggtgtgctgttttaagtgcaatagtatctaatgaattacccactaataaagaagccaaagattataaagaaagagatgaaatctat

SEQ ID NO: 11771 - DNA, 1590 bp, Candida albicans
aagccaatgtctcatcagccaaataaaaaatcattaagacgaaaacccccaccaatagatgactcgactccttttagtatttatcaaaacctaacatctaatcctgaacaatattcagacttccaagtttcattgtccaaatcaccacctattcaagtaaatacatttgttcaatcttcaccacctaattatatccagctgcctccaagtgcaccaccccctcccataccagtccaacgaccagaatataccctgcaggtggggtcatttcctgaagcagcatcggcacctgtggatcaaactaattataatgtttcaatgagcctggagttcccctttgacgagtctttcatatcaatgggtggctcgccaaagccgaaaggtccaaagcaaatttgggagtatgaggacgatagtattatctcacaacctatagaatacgttcggcatgcttcaataaatagtaccgactacaagtcaagaccaagaggatatcaacaaatgtctacaacctcccaatctgcacctttagatagtataccgtatccaatagaggatttgctgcctattcaggctaaacctactactactacagctccttatcctacacaaaactttgaagattcaattgacaactattatgaatcagattatgattacacttttgaagatgattctccatcccagatgcaaagtgtcgataaatatgggaatggtgtttcgcctcgaattgatgatgttcctgatttgacttccaaacgaagtctgctacagctggcccaaagtgttaatactctgtggcaatcgcattctcaaactaatctgattcaatcaggtgctaatctggtgggtattcaaggacagtttccaatgtctgctccgccttttttggagtcccctccgagaccgagtcttcgacaattagcaaccaagaattctcaaaacttccctccacctaatacccaagcaatagattatgcactggatctgtcatatagtagatctccatctccaacaagaagaacaattgataggacaaaaactgtttcactgggcttcacttacgccgaaagcgagtttatagaagacttttcggaaggatataacgaatttgctgttcaacatggaccaagctcaagatggaattctgttaactccaacgcaacacacacaccagaaaacttgttctgggatgatgggtaccagttgccgaccgaatcaccagctactgaatactttgattattcaatgttgcctgaattgccaagtgtcaagcctttacctaaatcaccatcatatttacctgaggtgcttgtgctgaaacagcaacaagagctaccctcgttgccactagaactacctgatttgccatttagctcagcttttttgcagtcacagcattttgaaatttgctcaaagatttggtcactttcagaacttttcaagtggtgcttgaagttaagaatatggttgaacaacctgaccatctctaaaacagagttgaaaaaggcattaggtggtttattagctttccatcgacgtgacgtgccattggacgtggtttcaacaatggcggcgggagcgttttga

SEQ ID NO: 11772 - DNA, 186 bp, Candida albicans
atagatttcttatggtggtggttatcaaaggggttctcttggttattggtgtataatgaagtaaagatcgtggaatatttttctagtaaatgtgaacattatatatattatgttaaagatggaatagattatttattgatgcaattttcatcatcatattttattgtttcttttctttctttatga

SEQ ID NO: 11773 - DNA, 225 bp, Candida albicans
tcggattttggtgatgctattatcattatgggagaggaattttgttgtattgtggaagttgaatgtgtgtgtgtgctatgtaagttacttttcctttttttatatattaaatatctttttattactgttgttgttattgtttgtttagctttattctttttatattattataagttttcatatattatacgtatattattgttgttattgcaaaagaacatgtag

SEQ ID NO: 11774 - DNA, 186 bp, Candida albicans
gttaaaataactgctcgatttatttgtagagagatcatagttggggtatttatagaacttttaaaagctatcttgaatccaggtaattgtcattcctttacaacaaacttattaattcacattttaccttctcggctcacaggagtaccacccgaaaccagtgtcacaacaaagtgttgtagataa

SEQ ID NO: 11775 - DNA, 192 bp, Candida albicans
tatttacttagttgtattttcccttcaaattttttttttttaggatttcagttttatttacaaaagatttgttactgttcttttgttttactttatatttatcaaaaagaaaactcattcaatattcagttttggtgtgacttgaagttgtttaatcgttattatatatcaaatacagggacaggttcttag

SEQ ID NO: 11776 - DNA, 726 bp, Candida albicans
aaaattaataagggccagccggccaatgtttcagtggcgcaacaacgtgatttgcaacatcaagtacattcgcactcacaaaatgaagtgagacagtatgaaattgctgaattatggaatagttatttgaagcaggtacttttcaaaagaatcctattacgtcaagaaataaatatgtttcagaattttatggctactttggccacctctaacaaccaaccaaacacgagacacaatattgctgagtcaactgttgggacatcgtcatataatgagtcttccatactggcacctcttaaatctatgagaggtgaaaaatcagttgtttcttcatattgcagccatagtagcagatgtcaatctaattattcgtcgtctgataaacaggatactgcgtcagtatacactactgggtccagtgagtctaatttggagacaaaagaatacaattatgaggacgaagaattcaacaaaaaggttttgaatagaagatcaatgttgggcgagatgttagaatatctgtcagaagaggatgatgagaatgttgaagatgacgaatcagttgcctcactacagaaaacgtattctattgttagtagtgggaaacactcagatgtgttgctgaaaacatatggtactgtaattagaagaagtaattcaaaacccagttcacctttgaaaagatcatttggtttgaatcacagtctaagttctatagttagttaa

SEQ ID NO: 11777 - DNA, 192 bp, Candida albicans
caacaattatatatatacaaaatggacaaatgtcagtattctacctctaatatctcatgtaataaacctcctctccttgaactttcagttattgcggacaaaatgcaaagcaacaaatctttaatcacatttagttctttggttgttcagaagaaccagatgattcaccaccgtctttgtacaagtctttga

SEQ ID NO: 11778 - DNA, 186 bp, Candida albicans
aatgagcgagtggttgagttgatgttaccacgactaataccaagaacaacgcttgttgagcgtggtcaacttgctccaagacaatattacattgacgtcagtgacgaagaagagaaagatgctggcgaagaagagaaagatgctggcgaagaagaagataatgattatgaaagtgatagtgattag

SEQ ID NO: 11779 - DNA, 231 bp, Candida albicans
  unsure (151),(160): Identity of nucleotide sequences at the above locations are unknown.
atacagaaacgacgaagtggactatatgcatttaataagatatccttatatcaatattcagcctttcttgtgtttagtattattttacttacccaaataccagtgtctgacacaactcataagttcaaagctttgcacaacagtacaattntactgtttntattaacaaactctaaaggaaatgccgatggtacatttgaaacaaacgttgttgtcttgtggaactggtag

SEQ ID NO: 11780 - DNA, 192 bp, Candida albicans
ttgaaagctcataaaacagcaaaaacttggccatacaatcctgatgatcggttgtatactcataaccacaatttcttggttatgctatacttgttaaaaaccattactaccatgaactttgagttagtattagtaatagctatttatcacaaagatcaaacatgcacgttatttattgcctacaaagagtaa

SEQ ID NO: 11781 - DNA, 204 bp, Candida albicans; identical to SEQ ID NO: 10819

SEQ ID NO: 11782 - DNA, 657 bp, Candida albicans
gaactctccatgtctaacatacaattcaatttatgtactactttccctggtttacttcaaacttatcatgaatccttatatgatttaataactacttatgatttatatttatcctataaaagaagacaaatgtccttattattcaatctattattttcatcagctgaattaccttcaataaacaaattagagctgagttggatggttctacaaaatagtataatgacgaaaaatcaacaattatgggtatatagaagaattttaaatgaaacaatgacaacaatgattactttagggtacatttcaaagaaacaattatttgaattgaatcattgtatagtacttgaattacaacaagtggaagataaatttgaagatttaattgaaagtgaaacaaaagatgataacaccagtaatgaccgaaatgtcattacaacaacgacaatcaatgatgataatgaagatgagaatgatcgatgtttcgaattactgttgttggataaacaaccagaattgtttagagatattttgaatttacataatagtttaattagtaaatattatgttgttcaacgtcagaataatagtcataaaaataacaacaacaacaacacctgcagcagcagcagtatacaaagaaaatgtgtgtatatttaa

SEQ ID NO: 11783 - DNA, 183 bp, Candida albicans
ttagtaaatattatgttgttcaacgtcagaataatagtcataaaaataacaacaacaacaacacctgcagcagcagcagtatacaaagaaaatgtgtgtatatttaattcaattcaattcaatttggtgtttagtattggtgtaaaaaaaaaaaatttaattagttacgtgtattttatataa

SEQ ID NO: 11784 - DNA, 339 bp, Candida albicans
tgcaaaatgaagcattgtaaagtttttgtttgtatgagtggagagagtcgtgtaatgatggataatttttgtatggtcaaatttttttttttcctgttcttatttcaacaccaacaattgaatggcaaatctccttccttccttccttcctttctatctattcatcatttacaaccattgcaaaacatgtctggacaacaattattagaagaagctagaaaagctgtaactaataaacaatatgatgaagcagaaattaaatataaacaaataatcaacccatctgaatcttccacttctactactactatcaccaccaaccacaccaaaaagggctaa

SEQ ID NO: 11785 - DNA, 219 bp, Candida albicans
aagaaacaaaagagcccaccagtaaatcctcatttgtttgatgacgagactgaagaagttggcgattcagaagaatctagtttaagtacaactccgagctgttcaaaactggttagtttaaatgataggaagagaagacaatctcgtggaggtattaatatttcaatatcgaaagacatggaagtgcatgaacctgaagaaaagaagttaaaaacatga

SEQ ID NO: 11786 - DNA, 198 bp, Candida albicans
aagatggtccctgattttgctaagcttaacaattataacgaatcggtatgtgtagtttatatatcgttcccgtgggtagttagttatctagaaattggccattgtttaaaaatccgtttagaaaataaaataaaatctgcagcgtgctcgtaccagagaaaaattagtaacaggtaccaactgtccgttgtcaagtga

SEQ ID NO: 11787 - DNA, 183 bp, Candida albicans
tttgaaacgaatattttgcatctaataatgttagccaaaatcattgatccatatagttttaggaaatgtagttatgtattaatctatactaagattatgacgtcacaatccatctcgttcagcttaccagattcttttagaatcaaagatgcagtccacgccataatggtatgtaaattatag

SEQ ID NO: 11788 - DNA, 459 bp, Candida albicans
  unsure (455): Identity of nucleotide sequences at the above locations are unknown.
acttgtctatatacttatttcattatgaaacctttatttacatataaaatacctgattcacctcattggtatatagtaatcactgatacttctcatcatttttattttaacaatcacgataaatcatcatattggcagttaagtgatatacaagaacattacaagaatgatattgatattgtaaaacgattgattaaatcaatcaattttgatgaattggcgattctatttgataaatcaaggggagtgaaatttgaaaaaatcgaagacgaactagaatcaattgaagtggatcacagtaaagaggaagttcaaccaaaacagactgagcaacaacaagttactgaagaagaagaaattgttgttgtggagaatattccaagtaaagtgactaaagcaaaaccaaaagaagaaaaacagccactgacaaaacaaatcacgtccataatactttnttaa

SEQ ID NO: 11789 - DNA, 186 bp, Candida albicans
agattctcttctatatattatgtgaaatttaaattgttacataatcacacaggcattttttattttattctacttagttttgaaattacctacccacccactcatattcctctagatgtaaaatatatatccaatcctactccccagatttttttttatttcccttcacaaattatcacttattaa

SEQ ID NO: 11790 - DNA, 201 bp, Candida albicans
ttggttgtggtggtgcttgaggtagatgtattactatctagagatgaatcgctggtgatagaattattggatattgacgttgataatggatgtgatgaattttcaatcagtgatggtggtgaaagaggagttgtagttgtggaagtagaagtggttgtgtttattggtgaaacaggtgacattggtaaagacatggtgtaa

SEQ ID NO: 11791 - DNA, 195 bp, Candida albicans
gactctcgatgcatattcacaacaataggaccacgaagaaatatcacgaaaacgttttactcgataagtttatattgtttagttgagaggaggggtggaagaggggggaaaggtaggggggaggaatatacagtcatgcacatatgggcaggtggtaagaatggcggggaagaacaagagcaaactgaacaatag

SEQ ID NO: 11792 - DNA, 213 bp, Candida albicans
caagtttttttttcagttttcaatttacaaaatcataccctgaaggatacctatttcccttttattttatatccagtttatttgaactattcgttatcaaatttagtttattataatttgtttcaacattcagtgaattcttttttttatttcaagaaacaaataaccaactactattcattctttaaagtaaaacaaaaaaattccaactaa

SEQ ID NO: 11793 - DNA, 198 bp, Candida albicans
cgccttattcattttaaacttttctttattactaacttattcctctttatttcttccatactagtaatagcactgaaagtggtattgacagacgggtacagtgatagtaaagtaataaaacctcgtttgtgtaaacggaattctagtagtaccgtggaacagattggttcaaaatggaaagagaaatacccaaaatga

SEQ ID NO: 11794 - DNA, 189 bp, Candida albicans
caacaattagccaataaaattgaagaagtaggacgttatagcgaaataaacgccacatctacatatcatgaaattggcgataccaacaaaaacaaagaacaattaatattgaatttgaaaaatcatacaaaattaagtgaacaaaagaagaaaacaaacctattggtatatgatctgggaagcacagta

SEQ ID NO: 11795 - DNA, 258 bp, Candida albicans
tttcacattcttctgatttgtaatatagttagtccatttagatatcaacgggtgtctttattatttggtgtctctcacccgcaggaacattttatttctcacactcgtgtattaatattaattaatcatagtaaatattttcacactattactttgtcgcaaaggggggaaaaaatagaaattccactggaagcctttttcttttttccaactacaaagacatatagagttaatcaaatgaaaactatacaatattag

SEQ ID NO: 11796 - DNA, 195 bp, Candida albicans
agttatgagtcaacgtcaccggtgcgcttacgtcgtgctacgaaaaaaaaaaagtcgagagtgaaaaatcattcatttaaggttgtttcaccatccatcactacttcatacaaacagtctacccaatttctaccaaataagtcaaaatggttaagaaagtacttctcattaatggtcccaatcttaatttgttag

SEQ ID NO: 11797 - DNA, 195 bp, Candida albicans
gaccttattttggtgaatgaaagtgccaccaacctaattttaacaactgtttacaataattacgagaatacaccggattttttcttgggttatgaatttttcttttgttacccggataaattatttcccgaattggtccccaatgctctttttacattaaccaaccctgtttttttggacaaccctcattattaa

SEQ ID NO: 11798 - DNA, 285 bp, Candida albicans
atttatctatttccgaagcaatcattgatttccaatagcatttatgccactgggtatatcttttttctaaaaaagaatactattacaaatggagaacacaggctggggatggtacgttcggcaattcaattactaatatcaattaatcagctctcctcacttcaatttttttctgcttatatcatttttatcaattgtcactataaggaaataaagaaaatactacaagagagaatggggaaaaggataaaaactgcaaatcatcatataacctttgtttattag

SEQ ID NO: 11799 - DNA, 468 bp, Candida albicans
tatttccctaacatttcccagtatttttttagtatttccacctcacgtcccctcttcccccccgcatttttatttctaccactgtgcaagacaacgatgaatcgaatttctagtatttccggattaactccaaatcgttttctgcaacaagtctggtcaaataaattgagagagttcccacatttttttatttctcgacagtttattacatcttccatcaaccacaagtccaaaatgacaaacttacaaaaaccaaacgaagaacctaagagattcggattagaaaatcaagtgaaacggaacccacatcctgactttaataaagttgaaaactcccgaccaccatttgattttgagaacacttggacctacactcatatcccaaacaaagactggaaggttggatcaggagccaactatccatcatggaaagaccacaagaaattggaaattgacccttacggatag

SEQ ID NO: 11800 - DNA, 225 bp, Candida albicans
cgccattgtaacaacaacatgtccgcaaatcgaatttcacctccaatgtcatatatgcctgccgttaagctggccattgacgatgtaaaatcaggtaaagttgctagtcttcaggaagcagcttgcaattttaatgtctgtttagattggttacttttggaaattaccaatagatcaccagatacattcgtcaatgttttcaacacgccggcgaaggatccatga

SEQ ID NO: 11801 - DNA, 252 bp, Candida albicans
aatatacatcatttggatatcaactcaaaggtattctgcgattctatttacacagaactttggggtatctttttctttaacaactatcttactttacggtttattcgtacaattgttaaattcattcgagaaattccttcttattatcagttttctcctgattatgttcgagtttgtaagaaacgtttatacttttctaatcatttgccctatcttcacgcttacctaatcaataaaatcaaaacttcgtaa

SEQ ID NO: 11802 - DNA, 243 bp, Candida albicans
gcattgggatcacacctaattcgcaagccattaattacaactttcataatccttgaaaaacagaattctggccatgtcaaaccattacctatgttagagaacattaaactatcccataagtttcaaaacaagagtcaggtatgtagagtaaagttggttgtttttcagatgttccctgttatcggtacttcgtgcaacgccaatacattacgggtagtgcacaaagaaataaaaattaacaaa

SEQ ID NO: 11803 - DNA, 213 bp, Candida albicans
caacacaagaataaatgtatgtatagacaaattcgtatttataataacatcaaccattccgaaattgtaatacctcgagaagtttatatttccggctgtcggaatagattagataaaactcaaacttacggattatcaatattttatatagactcgtcgccaaagtgtcgagttttcttcgaaatctttaagaatcatttccatctcttataa

SEQ ID NO: 11804 - DNA, 183 bp, Candida albicans
ctatatgtaatgcagagtgtttttaaaaaaaaaattggctattggaccttccttttgaatgttgaagaaaacaatttaacaaacatgagtgggagaaaactagtaaagctgactaatttatacaatgtacgtttgatagccattattgtgcgatttattagcttatttgattgtttaacatag

SEQ ID NO: 11805 - DNA, 210 bp, Candida albicans
gtcgaatgccacgactatacaacagatttttggtggtccctagcaggaagatgtgattataaagacgatcaagttcatataatcaatggcaaatatgaggaactgttacttaagttgccgattaagaatttgttagtgaaaatttcaggaataaacaaatatcgcaccggagttttacgtctccctggccaggagagttcccatccgtaa

SEQ ID NO: 11806 - DNA, 1323 bp, Candida albicans
agtttcaaatactcggtatatactacatgtggcacacacttactttccatgagctttgttcgtaacagaaacaacaaacggcaaagaacgggacgtggaccacggaagccaaaatcaaatagagataaagaggaaagacaactttccataagaaatgaagagggatactttagtaaggccaccaaacttggttcaagcaatgaatttgttgattttgaaaccctgattcagccgtacctatggacaactgttacaccggttattgaatcagcgacaagaactcatgcatctgctcgaatgccgacactaaaaagattgtgtgctgaacaattggctcggaatgtggaatacataggttggcatttgatagcttcggcaccatggtcaatttggaaattagtatggacaatcattgtaaagactggacaggactctccagaaacgtatgcaaagtttgctaaatttttccattcttttcaggattttagggctcataggtacttgttagaacagggaatacggggacaggctattggtaaatacttgattccgggatgccgtttgcatcgtgttgagactgttttccgcaatatagacttacatgatacaataaagtttttggatatctggcaaccaattactattctcgacttgtccttgattaaattatcccgtgatgagtactttgcacttttcaatattcctaatttggtatgtttgagtctttgcaatcaccatattgacgatacttttattgctagtttgtgttctactattaaaaatgggaaattatggaaactatctgtgttgaaaatagaaaacaccaaagtaacaaaaaccggaataatgagtctatttgctctaggcaaagaatcgtgcgatttagcatgtatcgaaacagacatcccaattgttgataactatgcttgcagcacaaactggctgaaattagataatgaaagtgcactgatttatcgtcttcccttggccttgaaattgaatgctttgatgaagaaaaacattctccaaacaagcattatcaatgataatatcatggacttgatggtagttgataaaacatggcatagttcaaatgcgtcccaagagaatatcaacctggcatgggaagcacggaaagatgcaactatcaaacgatatagagggaaaacttacatacgaaaacacgagcttcagaaagtcgatggacctaatggcattaatgcagtaagttctacagaaaatacccttcttcctacagaacaacgacggaaaaaacataaaaatagaatccaattaaatgcaaaaaatttcttttgtatataa

SEQ ID NO: 11807 - DNA, 204 bp, Candida albicans
gtggggtttgttgagtatattgttgttgttgataattattatattgagatattgacttcgagttgtaatgatactgtattggaacatacatcgctgcaagttgatgcttgtcctgttcctggggaattaaaatatggttgtggcatacagaaaaatcgtggtacaaatgggggaattttgttccccactagaagctacttctga

SEQ ID NO: 11808 - DNA, 2118 bp, Candida albicans
tttagttgttggggttttacattacatttcaacttgcattcaactgtatacgacatgtcactgaaaccgactaagaaaccaagtggtgagcctgaaaaactgaagcgggaggatagggataaacgtacattcaataaagatgcaagtcccttttctccgtctgaatactctcaaccttcagatccttctgagttgacttaccaaccaccaccttcaccatttcaagcttcaaaaccacttatcagaaaatcaactaccaatgcatcaccaacaagctcttatgcatccactgcactgtatgaagttattttaaacaatattcctaatagcattagccaaaatgatcttcatcaattcatagattcttgcattaaagaagatcattttcatatcatagaatttaacaaaggtagtactaatactagtagcaacagcaacactaccaccacagcggtattaaaaatcaccaatttattgacatatcataaaatcaaaactaatttatcccaagctgaactagaaggaaacattattgaggtgaaattgaaggaaaccgacacaccacattcatcatcagcttcaccagtaccagatccacacttcaacccacaatttgtacctccactacaagcattcccttattggagacaagttcctttttctcaccgtaattcatcctcatcaatatccacatcccagagagttccatcatcatcatcgaatcgaacatcagttgattcgagacgtacaagttcaaagaccagtaactcaacacaaagttcaatatcttccatgggaacaagtcaacgaagttcaactgcctcatcggtaggtaatgatttgctgtttcccaagaaacctgcacctccatttatgttgagaatggcccaaaaccgagatcgtaatactagttctccggaatcttttgtttccaacactgaagactctcaaagtgatactatagtacaactggagcagtaccgccgactggaagggccagaactgggacagggaccgggaccagggcaggggcaggaaccgaaactagaacaaataaaggaaaaggaaaaggataaagaagatgttggagatgaaaatgaatatgaagatgagtatattttgattcgttctggcgatggtgaaaatcccgacgaggtgattaaagtgaaccccaagagattattcattggtaatgttccctacaattcaacttggacatcattgaagaatttcctaatcacgaaatcacttgaattagaaccagataataatatttccattcatcgagtcgagattcctactcaacaaattttgcgccatgatccatattttttataccatcaacacagaggacaaatggttggtgggccaacatttataaacaaaagtcgagggtttgcaattgtcagaactggcgatcgagagtcatcagagaaattgatccaaatgtttgataatgttgaatttgaaggaagattattaactgtacgattcgacagatatcccgattttaacaattatactgttcagcagatgtatggagggggaggtaataacagcagtaacagcatcaatagtggagttggtagaatgttccctatgcctccacaatttccaattcagcagcaattctatccgcattcaccaacattagatagatcaaacactcgtcatcacatgtcccagacaccattacctttaccacagccatatcaacagcaacaccaccaccaacaacaacgtcctcagcaacaacaaccttcgagcccatcagttctcagcagtcttgcatttgaaaagaatctgtaccaacacaacttatattatggttccacgggaaccggaatgccatctgcactggttcctcctccaggagcagttccaccacttccaccaccaggcgcaattcatccatcatatggccaagcaatgatgtctcccaacgctatagcccagtctgctcgtacaggtacagtagaatcaccaaggtatcaacaatatcaatatcttcaaggaatattgccaacgggataccaacaatcagaagtagcttctagtggggaacaaaattcccccatttgtaccacgatttttctgtatgccacaaccatattttaa

SEQ ID NO: 11809 - DNA, 186 bp, Candida albicans
atatggcacgtccataaagtcaccttcaaaagcaaagtcataggaatcatgtccgacgaattaggaaaagtttgtgacgaaattttagatgaaacacttttgaaatttcataaatatggtatacctcaagttgaatccagctgttttacaccacggccgctggcaggatccgaacttgaaaattac

SEQ ID NO: 11810 - DNA, 201 bp, Candida albicans
ttgaaattggtcaccgttgccgaaacatcacgaacggcaaactcgaaagagttattgcaaaagtttataatgttaaaacctacacgtgttattcaagctattctgtttgtgtttgttttgcatcaaaacgttaccgtacaaactttgttaatgaggaatgtaaaattgaaattactctataatcctatggagacttgctaa

SEQ ID NO: 11811 - DNA, 255 bp, Candida albicans
tcagagattaaaaaattgaaagctgaactcgctagcagcaatactaagatcactcaattggaccaatctacaaaagaattatcaagtttgaaatccaatgaatcacagtatgttgcagaaattgaatcggctaaacaacaattatcgaaaaaaattgaggaatatagttcaattgaagctgactattatagattaccaacggaattgatacaaatgaagcacaccaatacagagtatagcacccagaataactga

SEQ ID NO: 11812 - DNA, 204 bp, Candida albicans
gctcaaaatagatcaaaaatagatcaaaatttcgttgaagaaagcaacaatctatatagtattgttttgtcacaatttgtattgtcattccatttcttaaactctgtgaaatatattattgttagacaaaactaccctgttcttataatacttttgcttcgggcaagtaaccttattctttttaaatttcactttccaaaataa

SEQ ID NO: 11813 - DNA, 201 bp, Candida albicans
acactatcttcactaacttctctaataaaattaaatgaatttctattaactggtggtgccagtaatccaaatttagaatgttcttcatttggttgtattaagttgttattgttagttgaattgacaaccggtttattcccattcaatgaagaaagtgaaggattcgaattagataccccttttttcaaaccagattgttga

SEQ ID NO: 11814 - DNA, 576 bp, Candida albicans
ttactataccagataaagaaactattgatattagtaataaagattcgattgaattctaaaactccaacttcatcaccactttcaatgaaacatgatgattcaccgaaaactagcgttgaagaaaaagatgacgaccaacatcaaacatctaatgagaaagcgaataataacgatatcattgatgaccaagtcattattgcttcacctattttagaaagtgcttatagaatcaaatcccaacgatcagaaaatggcaaattcactaaacaaaatagaccaatttcaatgtcatttaaaggtatgaatgcaccttcatttactgggaaacttaaaaaggaagccttaagaagtagtgattctcatcaatcatttaatattaattttaatgatgatgatgatggtgatgatgattcttcactttcagtaggtggaggatttggtagtagttctgaagatgaagatgatgatgcatatagttttgaacaaggaaatgagatttcgagtgcatcaagattttatcatactaatgatgattatattgaaagtcaagatcttcaccaagggtgtcaatcccgt

SEQ ID NO: 11815 - DNA, 267 bp, Candida albicans
tacaaaacaaaaatacaccataaaagaaccattttttcctctgttttgattttcttttctgaaatctctgcccttgactgtttaatgtgcctgtggactgctgtcactgaacagttggaaccaattcaacataacaacattgaagatcacatatttgaattgtattctgagagacagttacaaaacaatttagggtatgtcgatcgtacagccaatgaaattactgttactttaccaaagaataaaattgacttgaacatcactcaa

SEQ ID NO: 11816 - DNA, 198 bp, Candida albicans
aaaataaacgcagaaatatcttggagccaaacattgtcactatttcaagtggttgatattgatgttgagaatgatttgggttattactcttgttatttccctaatgcaaattcattttccatgctccactcgaaaccagagagaaaaaaaagttgtgatagaaacccagagaacaaaagaaagacaaagaaaaattga

SEQ ID NO: 11817 - DNA, 198 bp, Candida albicans
tatttggtggccctactaggtagtttctcaaaaaataccggattattgagttgtttggctagcgtatttagatcatttgatgatgtgcgcaaatgggagttgattagcgaagacgagctgtcagttgctaaattattgccggtaccattattgttgttggtagtggtttccaagtcggtatcagtatcattgggatga

SEQ ID NO: 11818 - DNA, 264 bp, Candida albicans
gttgttctaaaactcagtgtaggaggaactaagaggaaaatgttgaaaaaaaataaattaaaaagacgacgaagaaagagactaacaaaaaaaagcaagaagattgtcgaatcctatcgactaagacataagcaaacaaacaaagcccgaatagagaagataaaaaaaaaaagaaataaaaagagaaaatttcttggctgtgctctttctttcgttactctttttttctttctttctttcgttcttttatttaacaatcgttaa

SEQ ID NO: 11819 - DNA, 237 bp, Candida albicans
gatgtagcaacttttgcatggatagagagtaaactaagactgttgttgtacactgtagcacaacttgctcaaatctcaaccaggatttgtgaaggaaaagacaagatagccacttatttatcgtttcctattgatcttaaagtaactagtaaaatagaaaaggtcaatttaaagttaactttcaaaataacttctgtaatgctaaggttaataaacaagacacacacccttacttga

SEQ ID NO: 11820 - DNA, 192 bp, Candida albicans
tggtggggctttgcctccagacagaaacaagaggtcgacaccacttcatcccacaaggaattgatcatattaccaactactacatcacatgatcgattgataattgttatatgctttaattacaccaagtcgagatgctcgacaattaaatccctcagctacaccacgacaatgtgtgttggcatctcttag

SEQ ID NO: 11821 - DNA, 222 bp, Candida albicans
tcgaggcagatcagtggaaaaatattattatggggttgtggcgaaagaactagtcaagcaattttagaatgcttcccagttaggcgaaaaagattgacatcaatttacatggttacagactacaaccaactgaactcaaccccttacattttagcttcaaggaatttccggaacgaaaaaggaaaaactgatattttgaggtacttacaggggggattataa

SEQ ID NO: 11822 - DNA, 381 bp, Candida albicans
tggatcttccagccccgtcggttgaagacgaacgtcttacgggaaagcgaaccttccttagagaaattgactaaaagccaaatgattgaaaaatatacaaaagatgttaaaatgcttaaatccagaatttgtttcctagaagcaatgaacgcacggttacaatttgatcttaatattgctacagcagctgctcagaacaagaaaccagaaggagtgagctccgctataccaatggatgagaataagggttttaagcaggtaatgggttacatcaaagaaatccgcaaagacccgataaagaaaaggagaagaaaggcactaggggatattacgaatactagtaagggttccaatagttataccaactttagtggcagttaa

SEQ ID NO: 11823 - DNA, 195 bp, Candida albicans
ttctgtataaaaacgacaataataataataatgacatcattaaatccattgcttatagtgtttttaatgtgtcatgactatacaaatattattcaaaaggaaaaatcgaaaaaaaagcaaaaacctacccccgaaagtcaaaagcgatttataaaagaaaataattatcaaaaattgcctttaatgttgaactga

SEQ ID NO: 11824 - DNA, 849 bp, Candida albicans
gaatggaattttatttatttggccatgtcgttcaacagagttgaaacattcatactacatcgaatatttgttgatttaaacaaagatcttttcgaaaaaatcacccaagaaccaattgtatccagggtgaaaacagggtctaaatacattccttatgaatatattgttcaatcaccaacaacaaccattttaaaaaatcaaattgccgtgtataatgccatcagtgaaaagattcaagaattacccattactgaaaacaattttgaattaatcatctatggtcttgaatatcaatatttacatttaaaattcaggacattagaaagaaaagatgttgttgatatcattggttatgttattagtacaagtgatggcaagtttggtattacaaacttggtggaatcaatacaactcataatcgatcccaaattacgtgttgtagtagatgattttgcctcatttaccaagacattccccaatttgacgaaaacttcattgaatcatgctttagcaataacttatgcttatggaatttttttttatcccgtggtccataatgtccttaattgtactaaaaatgttaaattaatgagagattttatgagatattattatcttcgatatttacaaaatcctaatgatgaatttattgatattactcaagaagcttataatttttgtaaagaaaatttccccaatgatattgaacagaaaactaatcaagttattgatgaaatgactttatcggttttatctagtactttaggtttacttgattcattagagactagtaaattagaatataaacacagaagaattggttatcaatatactcgaggttcattataa

SEQ ID NO: 11825 - DNA, 204 bp, Candida albicans; identical to SEQ ID NO: 10819

SEQ ID NO: 11826 - DNA, 1095 bp, Candida albicans
  unsure (69),(84): Identity of nucleotide sequences at the above locations are unknown.
tattttattatgaccgagaaacttcttttaccaattcctaattttcgattattttgtgaactgatggtnaaatggacgattatnttcaatgaagaaggattcaacgtttgccaaaagatttcattgattcttccctataatgatattttgattgataaattgacgtacgatgttacaactccaggtacttattgtatatattctcctttaattgatggctacgaatatcgcgttgatgttgaagaatcatcaatccagtttgataatgttgttttttgtgttgttaatattattgttaatttattctataaccaatttttcagtcgtcaaaataaagtgctattcaaactaattggtaaatttgaattaataaaagtgggcatatttgctgtttctttattgctttcattgagattcaatataataaattacaccgaggatattgtgtctgctgtcgatgatgtatttactatggtatttttgatggggtatggaacactttattccagttataaagaccaagatattggaaaaattgttattgttacattattcaccgttacaccagccatcgcctcccgtttttttgacctaaaactggatgttacgaatttggtaatcaataacgaatactataacgttgttgatggtgttctagggtcaggaaaatttgatggattgagtgtagtacaaagaatagtaagagacgtcaaagctcacaggtttagtgctgcagtggctgcattatttggagtcagtaaacttgttaaatttaccatgtacataactacaatcagacaaacattgaacaaattgactcctggtggaacaaaatctggatacatttatacagttgtattgtggttatttgtttatccatttgctagctttgccttttatcctgatttggtatataattactacttggttactgactatggtctggtcctaaaacaatttttactcgagagtgttagagacaaatatatagtcctaatggcagatgaatgtcattgggttcttatctttttgatttggtttgttggcaataatggattgacagtagagcccactagtctgaagaaagatgagtaa

SEQ ID NO: 11827 - DNA, 225 bp, Candida albicans
  unsure (73): Identity of nucleotide sequences at the above locations are unknown.
atattttttcggagaatgattttaataatccataagagaccatgggttaaatggtgggttgaaccccctgggntgatggaaataatgttattgggtttgagaatcacatttgaagaacctttttggaaacacctattgatgttcccaaatatcggaagaataaatataccattgattattattatccccatacataaaacccagcgaagacgctcagaatattag

SEQ ID NO: 11828 - DNA, 192 bp, Candida albicans
actagtttgttagctcaacagaccaactactttaaattggtaatgcaatctgttctttatttgagtcgattgccacgactctacaacactacagatccacagttttctcttacaaattctttagacaatgccgttctctacccaagaatcataaacaaagccttcttgagactatattgcttcaagtattaa

SEQ ID NO: 11829 - DNA, 228 bp, Candida albicans
gacacgatagacagttacccatggcgtttgttttatatgttatatgttatgttgatggaatatactaattgtttgatattgtcccaaaagaggaaactaattgaatattattatcaattctgttatattttattgtacactcttgcacgaaaaagaaaactggaagagattaaaggtagtgtacagttatcaatttttcaatctcgagattgtctcatttcgggatag

SEQ ID NO: 11830 - DNA, 483 bp, Candida albicans
catataacatataaaacaaacgccatgggtaactgtctatcgtgtcttataggcaattcaaatgacgatgactataatgaaacttcatctttattgagacaccaacaacagcacaaccagcaatatttatcagattatttgcaggaagagcagatacttaaacagcaacaaagacaacaagaattggctggcatagtgaatgaattgaatgataatttgattgatgttacttcatttttaagtgggaacaataacaataacaataataataatgcatctttgggtaatagtggaattttggctaatgagagtaatattaatgaggaagagcatacacaagtcggcaatactataaaatcacttccttacctttatactaaagaggataaagatgagatattgaagaaattaagtgatattgatgctgatgttaaacagagttttaaaatacaatcactggtgcccttatatatcaagttttaa

SEQ ID NO: 11831 - DNA, 267 bp, Candida albicans
aaaaaaaaaaaagatttaaagcaaacacataatatatggcggattagaaaatttatctccgaagaaaactctttgcacggggatactaaaaaaaaaaacggctcggagatattatcaagacggttaaattcattgccacaaaaaaaaaaagcgcatacttattatttgtcaatcattcccaataaggaaagaccgaaaaattcaattctaccatttaatacttttcaaaatgatgaaagaaatattccatacaatcaaatcacatag

SEQ ID NO: 11832 - DNA, 189 bp, Candida albicans
  unsure (44),(48),(50),(52),(64): Identity of nucleotide sequences at the above locations are unknown.
tctcggaaaaataaacgtccgcgtattttttccggaaagggaancaanananaagttaatgccnagtttgacaccaaacgagtatcgttaaaaaaaaaaaaattaatttggaatttacggataaccggttacttcccctttaagaacaaattcaaatatttgcccaaccccctttctaaaaaaaaataa

SEQ ID NO: 11833 - DNA, 183 bp, Candida albicans
tttactataacattaatgtcggaaataggaggcatgattgttaataaacatatacttttgaattcaaacaataaggacgttaactattatatttgttttctggggagttttttttttgttggtctcggtgatttatttaccgatgatgataatatatgtctggctttaaaccatacaatgtaa

SEQ ID NO: 11834 - DNA, 186 bp, Candida albicans
ctaagatatgttttatcaaaatttaagttattattggatgttatttttttatcaaaaatagactttactcactcgctcactcactcactcactcactcgccttcccctcctttaaatagatcacatatgattctagtaccactaaacattatcaacaactatcatcaattagtagaattactctga

SEQ ID NO: 11835 - DNA, 183 bp, Candida albicans
ctgactgcattttggaagaatatgcacaaatttcaaaaacacaatcttgggtctttacaagactatcatctttttattcttggttattattcgccatatcctttccatcctaattataaaaaactggagatacacttttatactcgttcagacataacaacaacacagtttaattttatatga

SEQ ID NO: 11836 - DNA, 210 bp, Candida albicans
atgcttattctcagtgaatctaaaaataacttgtttattcattcattacattacattactttgcatgtcgcaccaagcaagatcgttgttgttaaaaaaaacgcatttatgtatgtgtgtctcgcaatgtcgggattgaaatgcaacaagtcagtattcaattgtatcaattttttttcgcgtttcgctacagagcagatctgtgtttga

SEQ ID NO: 11837 - DNA, 339 bp, Candida albicans
atccttgccttatttggtctcagtgtggttttgagtttgtgtattttttttttctgtcgttgtgacgttctttcaagaatcaccttaacttgttattcgagaaattatttgtatcatagaccagaagtggtattaagagtcaatatgaaaagaactaggtttagaccggttgggtgtagaaacattaatggtgatgctattaataggggaaagaaaagagctttattttttcattataattcgttacaattttgtaataaaattattacataccttgtgactttgtcgtttgtgttgtttttgttctatcttttacagcgtgttaaaattcaactttaa

SEQ ID NO: 11838 - DNA, 306 bp, Candida albicans
cttatatatagtttaaattttttattttatgtcatttatttatcaaaaaccacctattttcaaatattgattgatgatattttcgatgagttgggacaactatttacaacatttatttttggtcgtgaaaattgggtcatcgggcaaaactggaacagaccccaaccctacccaaaagaattttcttttttttttgtgatttttcttgcgttgtactttttattttgtaatgtaacctatttaactcatcctccaatcaaattcaaccatattgtgcaattagttatagcatcactatttgattga

SEQ ID NO: 11839 - DNA, 270 bp, Candida albicans
actcaagtttctccggcgatacaggaagatctcgaagttttaggacccaagtttagttccccgagagaagaagagaagcagtgttcccccacgaattccgcccccttttttcaaatggcgccagtgtttttctttatgggcccggccctttgggcatgcaccgagggttatgtgcccccagccaaacccggaattcttgtttcttccaataggaccaggcccaatagaggcccataccttttagtgggggtgtccccaggcattaggtga

SEQ ID NO: 11840 - DNA, 546 bp, Candida albicans
agtaaactaccactttataggtcaaatatgactagtaacaatgatgataatgttaatttagaaaaacttaatatatctgatgaaattattaatgattatgataacggatcacaagaacaattggatgtattagaagcatatcaaacggatgaagacaaacaagaacaagaacaaaaagaaaaagaaaaagatgtcgaactagataatccagaccttgaagaggaggttggtatcactatgaatgatgatgaaggtgatcataaattaaacaatcaaaaaatcgatgatgaaatcaataaagaagacgaaaaggatgtaaaagctagtgacgattatgatgatgacgatgacgatgacgattttgatgatttcaatgaagctagttttcaacatgcaccaacaattggttccacaaaccaagagaatggtcacgacgaacaagatgatgatgatgatgatgatgatgatgattttggtgattttgatgaattccaagtatctcaaccatccccaaccacaacaacaacaacaaaaaacaacaatctc

SEQ ID NO: 11841 - DNA, 261 bp, Candida albicans
tctattaacagcagcagaatggaattcattgagcatttaggagtcaaattggaggaagatgaccaagaagtgagatcttttgtaatatgggtaaaagggattttatgtttatcagcattgttgatttatatcatgatttaccaaatggttgcaatttcgtgctcattggcgtcaatagtatttcctgattcagcaaatttgatcagaaacaaatgtggctactttttctgggacttttcgttatatttaatggtacgttga

SEQ ID NO: 11842 - DNA, 246 bp, Candida albicans
gctctatgtacaacattgaatgtggtggcggttttcttattgaatcttctaggcatggctgtagatagggatgagatggatagagttgtaaaaaaaaaaatttttttgttcaatgcgcgcgttaaaaatatatttacaaatcctatacactatcatgaattctatgtgaatgttctaatatcttttcccaattacttaaacagatacttgtacattgtgttacagcaagaacaaaaacaccaatag

SEQ ID NO: 11843 - DNA, 216 bp, Candida albicans
caatatccaactgtgtgggtgttaattccatttgtgatgtgtaatttggcccaacaaacgaggaaaaaaaaaataaaagttagatcaactcaatatatatttttatacagattggtaacaaaccaccacgttgacttaaacttttgtgataatcatgtcagcattgaaatcattacagcagatccttcccctaaagaacgaccagcccttagatga

SEQ ID NO: 11844 - DNA, 531 bp, Candida albicans
  unsure (443): Identity of nucleotide sequences at the above locations are unknown.
acttttgtgataatcatgtcagcattgaaatcattacagcagatccttcccctaaagaacgaccagcccttagatgaactaaatccaacacccatatcaaccgagttgtccctagaacattatcgagcaagtcttcaacaatcaaataacgaaaacttagccaaatgtgtatcacaattcgaatcttttaatcacaaaataaaagagcataaaaagaaattgatcgtagttggtgaaataattgaagagttttcgaatgaattgaataacctttcgtcgagtttgatttcattggaacaacagtccaacagcttgtccaaggactctaaattacaaaggagtataactgaaagacttaatcccgtaattttagacttgatgataccgccagaaattgctcgatctgtcttgcaggaggattttactcccccattgttgggaanacttgaaatttatcaccgaaaaaaaaacaactcccccatactttgtccaaaaactaaatccaaacatcggttgaaagaaaggatttaa

SEQ ID NO: 11845 - DNA, 192 bp, Candida albicans
gaattggttttattttgtacaatcaaggtttgtagattttccaatatatgtggaaagatttactatccaaaaaacgatcacgtgaccacgaatactggcggggatgatagaggcgagacaagacgaaagaaacagcaggcaagtaaaaaaaaagggataattcaactcacatcaatattaaacgtactataa

SEQ ID NO: 11846 - DNA, 267 bp, Candida albicans
acagaagcaagattgtttaataataatagtaatactagttgtttcaaagtatacatcgttgatgtattgttggattgtttagtttttgtagaagatattaaggggaaagagaagttggtatcaaaaaaaaaaggtgttttgtgttgtattagtaatggattggctgtagttgatcgatgcggcatcggtttccacttgggggaagtagaaatggtcatggcctttatagctcaggaaagagtggaagaagaaaaaaaaaaattttga

SEQ ID NO: 11847 - DNA, 192 bp, Candida albicans
gattgcgcctcaaatgatgagcagattattgaatcgatagagtctgatatctcatcagaagagaggatacgtgtctgtaggcttgtaacactgttgtcagttgatcgtcacaagagtcgtagagacaatcaagaatctgaatggtatatcaatatacttccaagtattaattgtcaaatgccattcatatga

SEQ ID NO: 11848 - DNA, 465 bp, Candida albicans
agtttaatgatcaatacagacacagtggtgttacaagtaatgacagaaaaacaaacagcgcaatataatcaaccaccacaacaacaggtctatgctcagccacgacaacaagtttatactcaaccaacaacagcatacgaacaacaatatcaacaacaactttatgagcaagcaccccaagaaggactgtcatatcaacaccaatatcaacaaccgcaagtaacactaacacatcaaaaacagtaccaacaactgcaaccaatgcaaaatcaacagccttatgtgcagccagcacctacgtatcaacagtcccagacaccaaaattttgtaatttttttctgttctataaacagttgatagctctgttactcacttcaaaaaatttttttctcttttgtaatgaaaaatcacatcttgaaagttcttttaagcaagacgaacaaccaacatggctccaaaactga

SEQ ID NO: 11849 - DNA, 249 bp, Candida albicans
tttaatctctggttcattttcaataattgtatgtttcataacttggaaaaggatagcttatactctctttctctgatctttttcacttttcaatttctttcacttcttttttttttaaccacaacacttgataaagtacttgatggtataattaaattaatcgaacttcaatcggcagctctcgttatgtgtttaagtttaaacacactttataattcaagtaaatttggggcaggtaaaacaaattaa

SEQ ID NO: 11850 - DNA, 2040 bp, Candida albicans
  unsure (14),(16): Identity of nucleotide sequences at the above locations are unknown.
atcccgctcagccncngtgggtcgaagcacaatttacaatcaattaatcctgattctaaaacttttacgatatttttaaaaggaataaagaaatattttgataatgaaatggaaaaaataatgatcaacaataatagtccaacaatttcaaataatgaacgtattattagattattagatattgaagctggtcatatcaaaacatcacagaaaattttcgaaagagctaaacaattagctttaccaccattgccaacaacttctaataatggtgatccagaattagattcatttaatattcataaatggaataaagaaaaaattgaattagattctccattgattgttagttatgttagtctgttatgtaatggaggaggaggaggaggaataataacaaactcaacaacaacaacaaactccaaaattaaaattaaaattaaaccacccattggttcacattatttatataatgaaaaagctttatctatattaaaacaatcatcaccagaaattgattcattattgaaatttgtccaacaagttattggtgaacaagaagaaggcaaagacatagataccgatagccctatagttgctaagaaatcatttaaatctagaattgataggaaaatcaatttagcaattgaacaagccatacaatccaatataaaattaaaatttaatgataaaattaaaaatttagatccttataaaattgccaatttaattaatgataaaaattttaatcctgaagtgattatgtctaccaagaatagtaaaaattttaatggattacaaccagttccattaattgatttcaccagagaaattggcagggaaaataatcatgggatgacgaaatttttattgatgccattatttgattcattaactaacatgggtaaattaaatgaatttgtcattgcattttggtatgctatgattaaatggggtggattacgtataaatttatcaatttttaataataataataataataataataataataataataataataataataataataccaccacccgcaatgttttaaatggtgtaatcaaagactcggaaactttgtcagtatcaaatatggcagcaggtaagaagttagatcgttcagtgattgatgaagtgattcttggaatatttattaataaaataactgaatatggacgtgaaaaaggattaactaaaactcatttaatcatggaattatttcaaactttaatatcaaaagatttaaatcctcttcgtccttgtcttgttggtaaagataaagataaagatagaatacaaattcaattcaaatatttaatgagaacttggtgggcgattcatgatgatttagaatattatcatgcctataatcaaaataataacaataacaacaacaatagcaataacaataacaataaagttgatgataaagatttacgatttattcaattggaacaatttttaaaaaatttaattatatttaatgatataaattatcaatggtcaagaaatttattaatgaaaaaacttatacctgatgaatttattgatcaaataaatcgaattttaataagattaaatcatttaaattggtttaatattggaaatgaaaatgaaaatgaaaacaaaaaaatttatttatataaattaatgttaaaatcatcaattaaattattaatcccacaaagatttattactgcaaagaaaaatggaaacggaaacggaaacacaaacacaaacacactggtagttgtgtccacttatcctaaattaatggaacaagaaatatttcgatatatatttgttaaattatctaaaactgataatttaactgataataatatcaaattattaatggctcttaaaaaatatagaaaggcaaaaccttataatgatgaagaagctgaaaaattatttaaagaaacaactaatgccatttatgatgctatagaaattggtgatactaaattgactaaatctgatataaaagaagaagaagaagaggaagaagaaaacaaagtgagtgggtga

SEQ ID NO: 11851 - DNA, 216 bp, Candida albicans
gagtgtttgcttcatgtcatgttggcaaagaaaaaaaaaatattttaccttacatttaatccgaacactcgtcagacacacttgggtttcaaacctgttttctggaataaccccaaaaatttggttggcccaactagtttagcgtacttgaatggtgtctattgccgaggattcgtaagcgtggtatatgtcaatgcacctttgtgtgatttctaa

SEQ ID NO: 11852 - DNA, 249 bp, Candida albicans
ttgtgtactacctataaccctttacatctacaaacaagacactctttgttctctatttttttttttttgccaacagatcaagcactggaacttcctcttatgaagcgttttatcatcttctatcgaacagtagattctttggcttatatcttcacattaagtcgtgtatgtccaccaaacaatcattttggtggttgcattttatatgatgaggaagaaaacgtaaatttagcacgaccgcgtttttaa

SEQ ID NO: 11853 - DNA, 198 bp, Candida albicans
ttacttttggcagtggtatgtttgaataagactaacgtcaacaatgatgcattggataaaaacaggtcatcatcattgattacaatttcttttttgcatttagggaacaaaaaaaaaacaagttgcataataaatcaatttcagcaaagaaagccaagaattcctaaatatttattaaattccagaagaagagtttag

SEQ ID NO: 11854 - DNA, 225 bp, Candida albicans
  unsure (5): Identity of nucleotide sequences at the above locations are unknown.
atttnttctgcttttaactccgagaaatcaaagaaatcaaagaacaaaacaaaagagaaaattaaaagccaacaaaaattttttttaactccacattctaattatttcagcttatttcttatgatgatacaacacactgcaaatagggtctataattgcaaaattataagttatcactcttcaataatcccatactggttaaaaaaaaactgttgtgtgtgctaa

SEQ ID NO: 11855 - DNA, 195 bp, Candida albicans
atccacatcttcattacaaatcaccttcgtggacctagactttgttttaagttgatgtcacacagtcagatcaacatacgaggaatgtcgctcagacagactgaaagtggctctatgggtgacatacaaatgaacacgacattgaaaggaattttattctccagcagaaaactcccagagaagaaaaaaaaataa

SEQ ID NO: 11856 - DNA, 270 bp, Candida albicans
agcaccaagtactttcataacttgctatatatccaaatatacttatgcccgttgctgaaatcatgcaaactttgtgaatgtaagatacatgggtttctttttaataatatcgactatgattattgggtaaacctacctaaattaaaaaaagtcatttcatttaggagtatgaatataacccaagtttacaataacaaatctgtttatccttcacctgtcaatagttgcatagaaacgatgtcttcaacagcccaaggaagatcattgtcc

SEQ ID NO: 11857 - DNA, 183 bp, Candida albicans
aaagtattctcggcaaaaggttatgaaaaaagcaagaaacatattacgtcagattttgtactccatatagatatagatatatatactccagcacagccattaattaattttgttgaaattttcgttcattcattcaatcattcttttatacagacaatctcaaactatgacagtatcatttaa

SEQ ID NO: 11858 - DNA, 528 bp, Candida albicans
ttaattttgttgaaattttcgttcattcattcaatcattcttttatacagacaatctcaaactatgacagtatcatttaattatcaaaataatgaaattgtttcctcacccacagtcattgttagtggctctacatcaacaagattatatcgtggagtaatttcatttacgaacaatcagaataaagtatttcctccccaatatttcgaagtcaataatggtcatttcaaagcaataattcatgtttcaccaggggaaagaaatattttccaagttgatatactggataatggatatataaatgattttggatttgtcgaatatggtaatggccgtcgtcccaacatagttgattcagggtctttaacattatctttcaatccattaccccaaaataaacctatccatttatgtttaattcgaggcagggattccaataatacttatgatatgcctaaatatagattacaacgaggtgaagtacctagtcttcactcacggaggctggcaggatccgcgcttaggtaa

SEQ ID NO: 11859 - DNA, 240 bp, Candida albicans
cagtatttgtcaaatgcttcttggttcttagggtccataatatctatggttgtcaatttgataggcatatttttaagtttgggggatttcaatgcatcatataatatgaatttggcattcgaacatagcatgcaattgtctttggtgaaaaatgtcaattgtacttgggaattgatggtgctgtatgaaaaaaaccttttccgtatagatgcacaatttgtatgtctcttaattgtatga

SEQ ID NO: 11860 - DNA, 240 bp, Candida albicans
tttaaaacagtatcaatttcatgttcatgtaaaaaatcacctacaataacttttgaaccttgtttaagtagttttatggtggtggctaaaccaattccggtgagtccaccagtaactattgcaattttgtttgctaaattatatgacatgattgaatatggtatgaataaattgagtgaaacaactcctaatcttgtcagatatgagatagagtttaaagggttttgccaaaatttataa

SEQ ID NO: 11861 - DNA, 255 bp, Candida albicans
acacaacaagtttacccccccttaactaactcacattttgtttcaatatttataactgatatatttactataagttatacagaaaggttacattttttttttctttttggtaaactgcccctagtaattttttttcagtcatggggttatcgttcagacattttaattattttgggtatgggatctataatgatatcaagagtagactaccgcattataaatcagatttcaccgatgcattcaattatcgagtaa

SEQ ID NO: 11862 - DNA, 258 bp, Candida albicans
atacacctagatagcagttttttttttccaccaatcagagaagaatatgttttctttgtcagtagtgttagacgattgagaggtgggcacgagagtgtgtgggggaaggggcggcgttatgagggcgcagcacggcttatgctcgtcattaatcataacgttcttacttatttttttttttttcaccacagaataattatgattattattttggaaaaccttaataatgaacccaagaaaataattgagaaaccttaa

SEQ ID NO: 11863 - DNA, 183 bp, Candida albicans
gatgcattactgtacataatctccgtcgataatatggttgtgtttcaattaccattcataaccaaaacccaacccaacacaactggtcttttcacatgtaaaaaaaaaggttctgtgctaaaaaattttaaagacggaaaaaaacaaccacaacttctatctcacctcggcgttgaaatatag

SEQ ID NO: 11864 - DNA, 606 bp, Candida albicans
atcattaacaaagaaatgacagatagatttggaagacacaaatcaacacgttgggtaaactcagttccaacttatggagactggggcgatgatgattatgaagacgacgattatacatatcaagaagacaattcttctcaacaacaacagagaaaagtgacaccccagagatttgagttacctagtgatcatgttccacctgtgccagttattgacgaaaaatataaaaatcttacttctcaaaacaacaccgaaagcaatgtgagtccaccgaaagaacttgtgttgtctgttgatggacaaactaatcttgagagtgatagtagtgatgaagaatccgagatcattagtcaagggggtgttagtccgtataaagaagcaaataagcaaacacatggtatttcccacaacgttgacgagaaactgaagacacccgcctatcaggctaacattcctgttgttgcatcccatgatagatctgattataatgaagaggataataatgattttactagaaaattgaatgaaatacaactgaaagaatcaaatcacgcggattcggcgtcttcaccatgggcatgggccgatcggagcttgagtctacaa

SEQ ID NO: 11865 - DNA, 519 bp, Candida albicans
catacaaacagagaaaaatcgttcatatatattctgaacatgttgctcaatactgcaattcattactggatatttttattgtccattgttagttcatcttggatcaaatatccaattgaaatttcaagtattccaggatggcacaaagaacctacagatattaaggaagctcaaaatgtatgtgataaagattctgaaataaataacgacttatattgttaccctcaatgcttcaataaggaagatgatcagccaaaattagaccactgttgctttaatgaaaatggtagagttttgtatgtctcgccatgtactgttgaacctgaaaatgaagccacgactactgaagtagctgctgatcaaactgagacattgccagcagccgattctactagtgctgctacaagtactgtgactgctgaccttgaaaagtaccctcaatgtttcaataaagaagacgaccaaccaaaaagagtgttcaccacggggctggaaggaaccgggcttaggcaacaaatc

SEQ ID NO: 11866 - DNA, 201 bp, Candida albicans
tcagagtttacatcaaattatcttcttttttcttggaagacaacaaattatattcttacagaattaaaacggaaaataaaaccaatgatgaaaaaaactagacttcaaagattgtttgagctatttcagcttagactaacactagcaggcaagagcaaaattaagcagtttcgttacttggtaataaaagtaagcaattaa

SEQ ID NO: 11867 - DNA, 186 bp, Candida albicans
tctactagtatcagtaggatatttaggctggaaatagaattattcactctcacaatgctttggctggattgtctaatttttgctgacattatttctgttaaagttattactaaaaatagttctggttatttcaataatgagagaacaacaaatatccttattatcttaaacatccattcaaaataa

SEQ ID NO: 11868 - DNA, 243 bp, Candida albicans
agtgaagcaatgccaatagtattttttttgagatgtcttcaggtttctatttttctattgggtgtggtagtgcgaaatcatcactcatcgtcgcctactacaaatgatcaaccctccacgtcttcctgtacacctacctgggcttcgttatttgaaaatcaagctattgtaatgttagtaaagagaagttctccatacaatgtaagaaaagcgttttgtagttttttttatacatacagataa

SEQ ID NO: 11869 - DNA, 201 bp, Candida albicans
ttaattgctttgtatgggaatatatataaaagaatatttttttctaccaaaaaaaaaaaaaatcaattggttgtcaataaagtactcgtttgttatcgttttttggtaaatattgattttggtggcactgtctctatgcattcaaaaaaaaaattaagcaagacaagaaatgatccacttacacacgaccatcggttatga

SEQ ID NO: 11870 - DNA, 1119 bp, Candida albicans
acaacaatgatcagactatttccaaaacaaatacgtcttctttcttatttgacgaagaccactatcaatccagttgatttccagttaaaaattccagagcaattcactccaaaatcattgctagttttatcgaccccaacaaatctacctcaagtcatggaggactcaatcaaattgtcccaaaaacaagatttgcaaatggttgtagcagttgttgatacagttgtaccttattcacacagaaatggagtttttgagctttggttggacgaacctattagtattggggactcggctcttttggaagaaaaagatgatattaataaaccacctcgagaaagtgatggcttgtatgttgttagtgcacagaaacattggaagaacatagcttcccaattgaaaattaatctaagacaagaaatggaattaaaattgaatctagcaaacaccgtgttctctactggctcgattataactttattttactttggtaatggtttgaatctgggacaacatttgtgtgatttagagatcctgttgccccgaggattgataccaagacactccagtgctgtggtaaaagacaactggaccgatttgtatcctggaactagctttaaggtcaccaattgtgtgggcaacttgcttaaatctattgataacaaccctgcagccaaataccttgaggagaacaaaaaattgatgagcattggatctaaggagacagaggttttcgtcaaaatcaagaaaccaaacagtacaaaagttgagaggtttaaagttactgcgggtggtggtggatggggagccaaggctgacatcattgctctctcaccagaagctaaactcgtaaagggaagcgagatacagttttttatggtcaccccagaagataggtatttgccaaatcataacgacgacgaggttgctcaatttacaaacgcattcacttttaccaactcctacgaagagactagttacaatgaggatacagatgaaagccagcatatatatgaaaatgtttttggtgctggcagtgaacaggggttctttttcaacgacgtaaaacacaattctccgggtgaatcagtatctctaaagttggagaagaaaaaatag

SEQ ID NO: 11871 - DNA, 189 bp, Candida albicans
gaagaagatatttatgttttgccgaaaccaaaaaaaaaaaaaatacgcgcgacaataattgcaacagaacccgcaatttcgattgtaggaattgttaaagacggaaatagtaagaaggatatggaacattcggaacctttcaaaaagaatgaaaaagagctttcattgggagttttaatattcttataa

SEQ ID NO: 11872 - DNA, 819 bp, Candida albicans
aaatcaattcccaataaaaacaaaaggatggtattgttgtgcaaatataaggtttcttgggttttcgtgttgtccgtagcaggttcttcgttgattagagactttttatttggtcaagatgatagtttgtcgattgagaaaagaacaaacgagtacactactccagagtacggtggtacaagccattgcaatggtggtgataagaattgttatcctcagtgttttgatcatcgtggccaaccaaagaaagataaatgttgctttgataaacacaacaaggttttatatccatatccttgtacttcatcttcgtcttcatcttcatccagtagtactgtatcatcaagctccagcgaagtaatttcttcatcttctgaggaagctagctcaagtgaaattacatcgtccagtgaaataagctcctcaagtgaagtcagttcctcaagtgaagttttatcatcaagcgaaatcattagttcgtccagtgaagttgttagttcgtcaagtaaagttagttcttcgagtgaagccaccagttcatccagtgaaattattagttcttctagtgaagttgtcagctcctcaagccaagttacaagttcaagtgaagtggtaagttcatcgagtgaagtcagttcctcaagtgaggtcgttagttcatcaagccaagttaccagctcaagtgaggtagtcagctcatccagtgaagttactagttcgtcaagcgaggtcatcagttcatcaagctcttcaagcgaaataacgagttcatcaagtgaaattgttagttcctcgaagagatgtttcagctcttcgagt

SEQ ID NO: 11873 - DNA, 273 bp, Candida albicans
tttgtgctcagaatagacccgctatttcagactgaatactatattacgttcccaaagataatctgtcttgtcttgtctgagaaagagattcagaggatccgaccgaacatcaggccaacgaattcgtcttctcagcaattcggagacactgccgaagattaccgttcttactttaatgagaacgccacaagtcaggaaaacatatacagcttgatggaaaccactgaacacgttattgataatcttcaccacgcggctggaagaatccacgat

SEQ ID NO: 11874 - DNA, 258 bp, Candida albicans
aatttagctatgggcgtatttggaagaggagcagccagtaggatatccatccgatcaattcatttgagaaacacggccaattttgttgttcctgaaaattataagccaaataggtcattgctcaagcagttaccatggaaagcaggacttgatatctggtggaagtccttgtctccaaatagactctctgatttgcagaaagatttagtggaatttatgctaccttctcgttttcaccagcgggggctggaaggaccg

SEQ ID NO: 11875 - DNA, 276 bp, Candida albicans
gtcgccttttggctggacttccatggagacaaccaactttttccaaaaagattttggtttattcattttgcgtgtcagttaatagttaatttagcttctaacaagacatcagagctaaaagacgaatttcatgatctttatataccaattccattccccagattctttgttatttttatttttcatgtaatggcggctgataaacaagtaaaacgttttaattggaaattgattgctagattacagcttatctgcaggatatttaatttaatttag

SEQ ID NO: 11876 - DNA, 279 bp, Candida albicans
tcacatgctacaactccagccactgaacttaagaagacagaatatgccgataagtacgtggtaaacttggaagaagtagagattaatttccatggacaaatagcaagagccaaaaatgcacaaatataccctcctcttctaatgttcaaaaaccttggtagcaaagctgaacaatctgtaccgaacgataacgagttggcagaaatgtttgtccccaactgtgccaatgcaaaagcagcagaaatgaaaaacacaccagcacgattcccgggagtatag

SEQ ID NO: 11877 - DNA, 255 bp, Candida albicans
ctgaataacgttttcaacccaaatagctctaccacaaatgtactcacagtcgtcaaaccaccacaaaaaccatcatctaatccttctaaaacatgtaatgcaatggtattagtgacaatatgtcctttaccgccaggcaatttacctcttgccaaaagtgtgaacaccgcaagtagtaacgttcctagaaaattggcagtaaatgtaccaagcggaaagtttgaaaccttattattcaaaaacttggacaagtag

SEQ ID NO: 11878 - DNA, 201 bp, Candida albicans
tactgtaattgtatatctgtcaacgaatttttcaaaaccttgttggatggcaccaatatggttcctgttccattaagaaactctttgcatgagttgggtaaaggtggtaatttggtctttttaggtttcttgtgtttcttcttcttcttcttctttttactctgtacttgttgctcgtcagtatctataaatagcagttga

SEQ ID NO: 11879 - DNA, 423 bp, Candida albicans
agctggaaaattactcatatcttttactatatactatcattctttagtccaatatacatggttgcaccacttgtatctgaatcgcaaagttctagtatagaagaaaccgatgagcaacagcaacagtatcaacagcttgcaagaagacgaacgatacagagtgatttggtagatattgaagctgagtctatttccagtgcattgcctgagggattcaactatgaaaaaaagactactgcaactcggtttctcgacaaaactcaaaaatactatccagtcatactaaatatagtccatggcgcaatctggggtgtgtcacttcgtaaagggttgatgctgcttaccacttatagtgggtctttcctatctggtgtgatttgggcccaattttgcaacatgtgtggttatgggattggccattga

SEQ ID NO: 11880 - DNA, 204 bp, Candida albicans
acttttcgtaaatttcatttttttccgacattaggaaggagaatgaatctagccagttgcatattgcatttcgaaccacaaaaaaaagattggtatactcaagaattattggggttacggattaactcactctgcagtgcgggtgaaccaataaatgatcacgactttttgttgattattttagcttgccacccctcagcttga

SEQ ID NO: 11881 - DNA, 300 bp, Candida albicans
gaccatctccatccaatgtttgtcaataatacaagatatttactacagtcatcgtctaccgcttcaccatcagcaatacccagtaaagattcaagccatggtatattttccataagtcaagagtacaccgggttagtaatattttttgcattgtgttgtttatttgttctattggcaatattctacttccaagagaatagtaataatccattaatgctatcgaccacgtaccaagaattaaaacaggagtacaattccaaccataataacgataacgaaagtaatgataaccacagatga

SEQ ID NO: 11882 - DNA, 267 bp, Candida albicans
gtcgcgtattgggtatgtgcattatataatacggaagttttaacattacctttaaacgatattcattgtataattgatgaaaattccgtgttccctggtgagaaaaaggttagtcaagtggaaaaacaagaagaacaaggagaagaagaggatatgggtggtggtgatgattcaataatggacaattcgattgaatttattcataaggcaccaagtggtgtttgggatttacctattacattagtgaatgatgtactatatgaatga

SEQ ID NO: 11883 - DNA, 201 bp, Candida albicans
gccgccaataattgtcttcatcatttattaaatatactggttcatcaaccagaagagtacaatgagaaggatcaggaccagaaaaatcatttaagaccattccatttatcaggatctacatctcgtggtggtgatcttggtggaaaaagaagaatatcgctttcactatcggaatctcaaccagaatcagaatcgtcataa

SEQ ID NO: 11884 - DNA, 183 bp, Candida albicans
gtatatatatacatatatagttttttgcttttcattaatatttgtgcattttattcattatcatcagatttcctgattccggctttgtttaatactctatcattaaccgtgatgcttcattcatatagtacatcattcactaatgtaataggtaaatcccaaacaccacttggtgccttatga

SEQ ID NO: 11885 - DNA, 267 bp, Candida albicans
catgtgggacattatcgagatattctacttgggttagtgaagaagctcatgaaggtggtcaatatgccaattatttccaaccaacattccaatctattgttgcttgttgcttggattcgaaaaaaattgtcccaagaagctgcattttcagcattatcatcaattattgaagaaagtgatgttagtttaattgaattttatttaggaacctttattacatcattttggctaaatgtttccaagtatatcaacggaaaaatttggtga

SEQ ID NO: 11886 - DNA, 240 bp, Candida albicans
  unsure (49): Identity of nucleotide sequences at the above locations are unknown.
acgacagtccaaaaaaaattcaacaacgactacaacaaagcagaacttnttaaaccaatacttgatggttttatgagatgctctctattttggagcctaagtgacgtgaagatctctgaattttttttactacagataaattgctcgcatgattttagattctcagttactagtttaagaagaaaaatcaataaaatgacctcatttgtacagcaaaatatgcataaagtgggctcataa

SEQ ID NO: 11887 - DNA, 285 bp, Candida albicans
aaaaatagaaaaagaaaatgcataatagatttgttatattataagactccagaagtagatttagaaattgatgtcactgttgtcataaatccacattacgaagaaggtgttaaacaaatcaaaacaaattacccgaaattgtatccaataacatatgaagctgtccagtcaatatcaaaaacgatccatttcataaatcaaagccccatgctgatgatgctgtcacaatttaaagattcaataaataatcaatgtttttctggagtattattcaattatttataa

SEQ ID NO: 11888 - DNA, 183 bp, Candida albicans
  unsure (136): Identity of nucleotide sequences at the above locations are unknown.
ttttgttatttgttaacttcttggaactatcttgtttttcttatcttaccaagagtatattcatacaactcaattgaattatatctaattaatcaaacatctacaatcatggcatcctttaaattagctaccgatntaccagaatggaaaaaattggaagaaacttacaaatcccgtcggtga

SEQ ID NO: 11889 - DNA, 201 bp, Candida albicans
aatctcaaatgtaataagtgggtatttcaaactattgcaattaggaaaaaagaaaaccataaattgatgtacagttcattttctcacatgaattttgagttttatttaggggccaaggtgtggttgtattgtactctgcgggccatgaacatgtcctcgcaattgctattccaattcactagcatcttgaaatttgattaa

SEQ ID NO: 11890 - DNA, 243 bp, Candida albicans
tgtaacaaaaattgtatagtaatgatttcccattcaacggtcccttctatactaatactgaatatgactctagtaatatcaaactatggaaaaaggatgtatgtagatattttgaaatttgggtttaaggaacagagagaaaaaaaaaagtattcctccccccaaaaaaaaaaagaaagaacggaaagcaaagttgaaaagcttgaaattgtgaaattaagattattctcgaaatttatttaa

SEQ ID NO: 11891 - DNA, 270 bp, Candida albicans
gattccagattaatgtggatgagaaaaaggggagagaaagaatgtttatacttattagaagggctttgtgatttgataatattggagtcttctccgatatgctatggtaaatactgtgtaaacgttttggatttgttggttgcaatatacggacaaaacaacaactttgaaacaggaatagtggaacggggtgtaatgttaattagtatgaggcaatatttcttaatttttgcgactaccaacatcggtatttatactgatttgatatag

SEQ ID NO: 11892 - DNA, 351 bp, Candida albicans
caccaatcagttttaactgttttacttatttgcatatatcaccacacaacactactattatacataatgtcagattttgccttcaataactattgtatacattgtgataaattatgtttgaacaattcagtctactgttcagaagaatgtaaatcaatagcatatgaatcttcattgaatcaactaccacacaatcacagtaccactagtgctaatgccagtgctgctggttacactagtaatgttaatagcactaaatcaaacacgccatcatgggtgttcactttggttaactccaagccttatatatacaactacaacaacaacaacagcaacagcatttacagataa

SEQ ID NO: 11893 - DNA, 192 bp, Candida albicans
  unsure (43): Identity of nucleotide sequences at the above locations are unknown.
atgtatgtgtgtataaatccagtttgtgtaattttatgtgtcnaattgactcaaaataatagagagaattccacagtaaaaaagaggagcagctttaattatagaaacagacctagacctaaacacgcatatactaattgtgtatatatatataagatcaagtcactttccctttcctttttttttttttaa

SEQ ID NO: 11894 - DNA, 273 bp, Candida albicans
ctccaagccttatatatacaactacaacaacaacaacagcaacagcatttacagataaatactccattaaatatatcatctttaactccaaacacaaattacaacaacaatgaatatgattatgatgataatgacgatgatgaattgaattattttgatttgaattattccgttcaatcaaatatcaattataccaccaataccaccaaatcaaataatgaattgataaattcaacttcagataattatcgtaaatggttaactgcattataa

SEQ ID NO: 11895 - DNA, 552 bp, Candida albicans
acattttatgtaaccatcgatataccttcaatttcgaataaaatcgacaatgaagaagaaccaccatcaaggacaggtcaagctccaaaattcaaaaacaatattatcaagccttcagcacaactccaatttactgatttaaaagaagatcatccattagtaaaaatatcgaacaatactatatctgctcaaggctcgtcgtcgtcgtcgttatcagcgtcgaaaaatggatttaatagtcatactcacaattcaggagtcattgatccatcagcacttatagatgggaaaatttatcagactgattggaatcaattacaaggtactgaactaatatttgatgaaaatggtcaatttataggcaaggttaaggaacatttgacttgcaataataacacaaaattcacattaaaaaaggcagaagaagtagaacaacttcgttcagcagatgattctatcatggatatagatcaagactcacaaggacaacaaccagctagaagtcagttcttaaaaagagcaattgtggctgctagagccaaaggtaaataa

SEQ ID NO: 11896 - DNA, 189 bp, Candida albicans
  unsure (126): Identity of nucleotide sequences at the above locations are unknown.
attttgggttttgcaaaccttaaatcagtaagacgagatctgccacaatgtggctcagatatgaacgagaatgcaccttataccgctagagtttttccaactgatgactttttttctccgtacacngtcccctgtggggtacccttccgtttaataactttctctctaacttataaatcttggttttcc

SEQ ID NO: 11897 - DNA, 357 bp, Candida albicans
acagattcatgtttttcaattatacctggagatagcttagcaaattatattacacacattataattattgaaatcaagaaaacaaacaaaacccaaatcaagtgttgtgtgttatatgcatatgtaagtttgtgtgtgggtgtgcgtgtgtatgtttcgaaaaccaaaaacaaaaaaaaattcagagattttacattttacaccggcaaaaagagaattttctctcaattactaaaaaccaaaaaaaccaaaaaaaaaaaacaacatccacccatcaaaaatactctttttcctttacaaccaaccttccagcaatcaaaccagttgtcacttggtgagacaaggtcccttgtttaa

SEQ ID NO: 11898 - DNA, 213 bp, Candida albicans
cagtgttccacttataaagattttgaagataagacgattctggtaagcacatattctataccattttgtctcaactcactaccaaaacagataaatatcatcaagagtggttctagagctttatatagcggttctcattttattataataacaaaagtgagattattcttgggcttttctgaatactccattaatggtaaaattttagtatga

SEQ ID NO: 11899 - DNA, 432 bp, Candida albicans
agtaggataatcaatcgaaacaaaggatacaaaatcaaagttattatagaaagccaatcagctgctttagttggatttagatttaatgcaaaacacgttacattatatgctgtgggctacaataataatttttttctgcgattgtattgttctctctcgactacaagccagccatcaatttatttctcaagaattacaatggtaatggtaggaccatctcaatataatacaagaggaaaggatagttggtccttatctcttcactctggatctcaccaacaaacagcatatgaaagtttacctaattatagttgtaggaatgtcttacaaacgacactgttcagtgtacgccatttattattctcttttttgtcgatggtacttgggcccagacctcgggccacctattcttcttggtctttttcactgtga

SEQ ID NO: 11900 - DNA, 222 bp, Candida albicans
atcaagaccatattatattgctctagcaatgggggtttatcacatgatttgtactcggagaaaagtgtatcaataataccgcaatttcttgacgatgagtttcaatcggatattaagatcttaagtccagtaattttatcactgcctgttaaattttgtcgaagaatttacctgaaaacaacaacaatatatgtgataaagctaaaaaagaagctttactga

SEQ ID NO: 11901 - DNA, 309 bp, Candida albicans
aaacagaatacgatcctttatttagtttttactaaaagcaagagtattcctctaataatggtcgtacgtttgcgtattctcgtaccatattcaaagcataaatctttgttgttcaccctaaacaggcttttattatattcttctaggtatacacaatgttatttttttctcatttgtggtaatactggtagacgaaaacatggagattgtcctaatcaagtactcgattgtcgtctaagcattgaaatgtcaattcatgtgagggggtgggggggggacgaaaaatatgggagagagagggaaacatag

SEQ ID NO: 11902 - DNA, 363 bp, Candida albicans
  unsure (351): Identity of nucleotide sequences at the above locations are unknown.
ttctttactttcaaaacaagtcaatggttgatattatcatactcaaagtgttatgtgttttttcaaatatttttaaaaaaattctggaacatttttgttagaaaaaaacaaataaagacaagaaaaatatggatacagttaatgttcgaattagggtgtgcaacatggctaattatgaacaataagctagcattgcataatggtagtaattgtactgaagagaacaatacactaatctattttattgatggaattaatggactgataattcagatggataattcagttcactgtgagaagggatttcctattatatataaaaagaaaatccttaaggaaattaagtttgtntattttctatag

SEQ ID NO: 11903 - DNA, 195 bp, Candida albicans
aaaactattctgattacatatttcaagaatgataaaatagtgggaaaagaaagggactttacaagagttgctatgttaaaaaaggcggatacaggtgatacaaagagaagttgcaaaaacggtattaaagtcgcaacaaaaagtgaaacaaaatgtagtcataaaaataaggcaaaaaaaaaacagctgggctaa

SEQ ID NO: 11904 - DNA, 291 bp, Candida albicans
agtataaactacaaagtttggatgagtttttcgggagtgaggatgatgattcatcatcgtcatcttcggaggaagaggaagaggaagaggaagaagtcagtgaggaagttgagtctgatgaagatgaagacgaagacgaagacgaagacgaagagattagagaggaaacgaataaagaagcgtaattatcgggtgattaataacatgctgcagatgcaaaatgttgcccttggtgatgttggttcaaacgttatgcaaaaaataaaaccaaagagtaaaaacttgttttaa

SEQ ID NO: 11905 - DNA, 588 bp, Candida albicans
agaatattttttgtacatctatttaatatggcattaccaacaatcgaatcgttcaaaaaattatcatcaaaagataaaagacaagtgcttgatcatttatttgagccatgcaatacattatccaattttatattcataaaagtacttcatcaacaatacaatacctatccagagtttataaacctcgttagaaaagaactacttgaatttttgaaacaaagtgaaaccttccaatcccaatatcaaggtgaaattaaccccgtgataaatgaaattatttccgcccatcccagattaggtgaacccaaaaaggaaaccctttcagtacattcaaataacgaacagaaaactttgaataatgatccggaaattatcaagaaattaaaagagttaaatgctgcttatgagaaaacattcccaggattacgttatgttgtatttgtcaatggtagaagtagacatgaaataatggataatatgcaaaaaagaattgaacgaaatgatataaatttggaaagagtagaagcattcaatgccatgtgtgatattgcattagatagagctaataaattaggtattaaattgtaa

SEQ ID NO: 11906 - DNA, 231 bp, Candida albicans
aaaaaaactacttttacaacaaaacgttgtcaaatttatctattacatattacaattaattctacagctttttgtaagctaaatatttatttcttatttaatacatcaattttacaatggtatgtttcaatatttcaattatctaattggttattccaagaatttgaattactaacagtacttttttcattttcaggccggagctttagaaaatgcaacaaaggaaattaa

SEQ ID NO: 11907 - DNA, 228 bp, Candida albicans
atgactgtagcattcgtccaaattgagaccctcaattacattttgtcaaaaaaattggtccctagtgttgctatcgataacgaaggtgaaggcagtttagcttggagacatttagagaacttagttacatctcatcttccgtttcgagaaatcgttgatttaccgtgcagcgcttatattgattgctacttgttcccagcaccacagcaatatagcaatcataaataa

SEQ ID NO: 11908 - DNA, 255 bp, Candida albicans
tctagtgggctattgtctgtgggaaaagtagaaactgtagctgaggaattttatacacacaaagttaacaaaattcttgcgaaaatactaaacagtcttaaacaccacctagacacaccaaacttcaattactactcttcacacttattatcactaggctgtttatgtcgaggacaagacactgcaataatgaaactagccaacttcacattttcaaaaaaaaacacacacagacacacacacaattgctggtaa

SEQ ID NO: 11909 - DNA, 189 bp, Candida albicans
gctgcattaccgcacatcatagtcttcatccctttcataattgtagctccacactatggctacgaggacttcaaaacacaacgtacggataacatcaactaccagtccctgttaataagcaaatggctaaacagccatacctctgctactaaacttgtagaaacttcaaaattatgtttggtcgtctaa

SEQ ID NO: 11910 - DNA, 252 bp, Candida albicans
gcgataaatggctttttatcctggtcttgtttgtatttcctgattcagaaataccagctgaattattgtactgtgaatgcagattgctataagtattgtgataatgattatgaaagtgtccgccctgtggctgatgttgctgtaccagattttgtctctgtccatattgcggatgctccggcagcagatgatgattatggtaaaattgactattcgattggtgaaacgtttgtggcaatgagttcatattag

SEQ ID NO: 11911 - DNA, 201 bp, Candida albicans
acaattgaagtgtgggggaatactgcgataaaattcattccgcgaagaaatagtaagagaaaaaaaagaaaaagaataacaaaatccgttgttatgaaatttactaccgaggagctcaacttcacatgcaaccgaggtccaatctacacacgtgacataagctattttttgaaaaaacttgataatatacaaagtttatag

SEQ ID NO: 11912 - DNA, 198 bp, Candida albicans
aaagatttcttcattgattggatttataccagtgttttatatataaatgcaattacaatcagaattctatactccatcgagaaaaattcttcaaaccctaacatgctactattggatttggaacagaaaactaccaacaaatatgcttacatctttgaaaagggtatccagggttctagacccaaatctataaactaa

SEQ ID NO: 11913 - DNA, 186 bp, Candida albicans
ttatttcaaaataatacgagtcaatttttggctgaagaaaaattagactatgcaacagctactttagttttagaatcggaattctatatccacacaacacaacacacacacacacgtacaatgattttttgtgaaatgtccaatcaaatttcattttttttcaccccttttttttgtatcaactaa

SEQ ID NO: 11914 - DNA, 561 bp, Candida albicans
tggtgctttagttctagtgaagaaagaaaacaaatggggaatctgattgatgaacaaacatggaagaatgcaaccacagactataaaaacttacacaaacttgttgaaaattctcactcaattagaagtttcgcttttaaatgtcaagatgttattattaacagatcgacggtggataatgcgtattatcaatcagcgaaaagattcttattgataattaacttattgggttttggaacagaaatacgacgtttgttaattgatgatttgaaaaagattcctaattttcacttaaattatcattcattatcaccagaggaacaggaaaatatggttagtcatgtcaagtctattcagaaatgggcaacacactatggcataaacttggaattagcatttttattggagttctcggaatatatatttaccaaacaattcatatacaattcacatattttataccagttgttaaaaagggaagagaaaatttgggaaagaagagttgaatttttaagattggaacaacagcagtatgagaaaaatagagaaaaccataaatga

SEQ ID NO: 11915 - DNA, 213 bp, Candida albicans
  unsure (191),(201): Identity of nucleotide sequences at the above locations are unknown.
ataaaaatcaattacaaagaagaaaaagaagaaaagaagaaaaggaaaggaaagggaaaaaaaaatgatgaagaagaaaataagtcaatttttataaaattgaaaatttcgttgttgagcaaactgaatcacatctactcggaacacagggggaagaaagagagagaaagggattttttccacaccgcctnggaaagaccngcaatggggtgt

SEQ ID NO: 11916 - DNA, 1137 bp, Candida albicans
ccaaagagccaatcaagtaagctccctacaacaatgaatgtcacaagtaacggatattactcgtcgcaatatttgagtgaacaacaaagaaaacaacctcgttaccaatacaactacaccctgaacctaccaccatcccctaaagaatttattgttgaagtggatgaagacgattctgctccatatatccctcaaatggagtttctacccctgcaaagacaagcatttatgaataatgtcagacccaagactcctaaatcacaatctgaatctatgatctcaccacctggtagtgctcatcgtagcacatcctcgttaccaattgagtacgatgatttggaaccagacaaccaacttgaagaaactataactccagcacaattgaattatctccaagaacaaaatcattatgtgccgtatcagccagagccaagacaaccttatcagccgcaacagtataaccctcccaaaccaaaatacccgaaaaataaaaacaatgactattatattcgtcagaaaaagaggtacgacaaagcacaggtcgtcaaacctaaattatactcacataaaacattccacgatgtttttgaagacaaaacagaaaaattggataggtataatcctatggatcttgtttttgaaggcaaggataccaaagacaaactgacttttttagaaaagatgcaaaccaaattaactaaagataagtatgatgattacaattattacgatcacaggccaaaaaagagtcccgttaaggaagaaatttttgtcgataaccaaagtgacgacgatgaagatgtcacacaagaggaagtcgaagtagctgaggtagtcactgttggagaaggtaaagataaagaaaccaaaatcatcaagaagaaagtacctttgaaaaaactaatgaagaaaaagctcaaccaggcaaagaaggaattgggaaaagattttgtggattattcccgaagacaaaaggaaattaatgaaaaaatcaaagagtcaaagcttcaattgaagaagaaaagggaattagaaagggctgcagagaaagaaaagttacggaaggagcaaaaagaaaaggctggcgctgaaggtaaggccacagaaaagacttctgatgacaagaaggggcgatga

SEQ ID NO: 11917 - DNA, 315 bp, Candida albicans
  unsure (26),(52),(54),(55),(57),(58),(66),(67),(71),(78),(79),(157),(158),(159),(160),(161),(162),(163),(168),(169),(171),(172),(173),(176),(202),(203),(204),(208),(209),(210),(215),(216),(220),(221),: Identity of nucleotide sequences at the above locations are unknown.
aaagaaaaagaaagggaagaaaaganaacagatggtgagggtgaaggtgaanannannaagatgannaganagatgannaggcggccgaagaaactagtgttccttggttggcatatcttgcttcatggttgtattatcccgacgaagaggaaggannnnnnnatgannannnganggggagagaagaaaaagaggacgacnnngatnnngaganngacnnnnnggatgangccgccnnnccagtccagaaggtggtatatccgcctacnccatttgaagaaaccactnaaagaactaaagtatttccaaggaat

SEQ ID NO: 11918 - DNA, 726 bp, Candida albicans
atcggcattaacaagtatataacggggaattcactttctataaccatgcataaattacgtaaatttatatcgaaaaatttatctcgttcattgaagaaggacaaaaagagcaagactaacactaacaaattggagacgggattattttcatggaaaaaattgggatatactttattaagtggtagaggaaaagttggacttgttggtaatggttcaagttcagggtatggatcatcaatttataatattaatttaaatcaaaatgaagaaattttaattaataaaaataatttattaggtataactgttaatggtccttatgatttacaaaattgtattgtcaaatatgaattccccataatcaacaatgccaaccccacaaacacaaacatcaacatcaaagaacctgtgactattgtaaaaccaaaattaattcaacctacaacatggaatttaattgtattgaaattgaaaaattttaataatggatttaaaaaatttttccaaattattaataaatatactttaggtttaaaaactactagttataattatttagcaggtaatcaagattttattaaagttattggtcccagaaatttacttttacaatcaaatacaaacaaaagtcatcgtgggtttaataatataatccctagaaataaaccacaagcaaaagtttggccaaccaatcaatcttcaccaccaagtgccgatcagcgtatg

SEQ ID NO: 11919 - DNA, 246 bp, Candida albicans
  unsure (185),(218),(228): Identity of nucleotide sequences at the above locations are unknown.
tcacgtgaaactaacctatcgattcttttttatatcagttttgctgcaaaattttgccaaaaaaataaaactatacgaacttatcaaatccgtagtagacacctcctctgctacaatgctttaatcaaatatatctatttcatttattctaatcatacaaacctattttttcatactttgtctcncggtcggtacattctggtgttagcaattagacntgacccaagngatggatatccgcgctcc

SEQ ID NO: 11920 - DNA, 216 bp, Candida albicans
tttgcaggtctatgtcaaagtgttcgcacaacgttaaagacaacaagaaagaataataataatactaaactaggaaacgtttcgggtttgtgtaatttcagtgaatctcagcaccgaaatctgcgaaatatgtcaaacccccatgttagctcatttaatactactacttatgttcgtttactcttataccctccttgtaaacgagatgatggctaa

SEQ ID NO: 11921 - DNA, 195 bp, Candida albicans
tattattattattctttcttgttgtctttaacgttgtgcgaacactttgacatagacctgcaaattaatttcgagggaaacagcaattgtaatgagctcatagtgatcatattatttttgcagtctagaaacagatcattgcttaataatactaaaatcctgggtcacagaaatatggtagaagtgaaatcatag

SEQ ID NO: 11922 - DNA, 531 bp, Candida albicans
tactatataataaataaggaacatataactacttcagcagattacacgaaaacccaaacaaagagtatgactgcctctgcccattataactataacagaagaaattctagcgcaacaccgtacacaataccaacaaaacatcaaccacaacaccaacaccaatcacccatggtgtcgtcgtaccaagttcatcaccatcaacatagttataatccacaaacgcgacaacatacatcttatcaaccgtcgtattctcaggaatcagctatatcgtcgccactattatcggcatcggtaccgacattatcccgagaatttgttgtacgcagaatcagtgaaggtgagaccggacgattgaaagaagaattgagatgtgaagcatgtgggaaagggtataagcatatatcgtcattggctaaacatttatgggaacatactccagaatggcatgtgactaaaaaattgttaatttcaaaacatcaacaagtacaattattggcagcttcttcaccaaggctgagaatccgcctc

SEQ ID NO: 11923 - DNA, 279 bp, Candida albicans
aaatcaacagaaacttttgtatccaaaattcacacagatactttgatgaactcaggacgtaacaaacaattaaacgaaacgaaacagataaaaaaaggggggaagggctccggttcgttatatacaaagttttttaagaatacgtgtatgggtatgtataatttagatttaaatatgaataaaatcttcttgatggtaacgataatggtctattgtttattctgtaaaaggagtgtatcgttaaaaatctgttgggatatggtttgccagatattttaa

SEQ ID NO: 11924 - DNA, 231 bp, Candida albicans
atatcaagtgttccttctccccacagaataaataattggtactacagcagttctatacttgtctatcttcatgaaagtttcaaaatgacagcattgtgggtgcaacgtttgaaacatgcagttttggttaacacacgaaagttatctttgttcccccacgaaaataagaaaaaaacaatgttacaccaagaaatcacatgtgaactcgactcttcaacttacagtcgttga

SEQ ID NO: 11925 - DNA, 225 bp, Candida albicans
tattcattttgtgtgattgggtggaaaaaagtgtccctgataacaactaatagtcaaaataccacaatagccatgtcgtccgatagtagttcaccagaaacaacaacaatatctgaacaaaatacaactacaaatgaaacaggaactggaaaacaaggtaggaaaaagacaaagtcgtccgttttatcagatgaacaaaagaaggtatgtatacagtcaagctga

SEQ ID NO: 11926 - DNA, 261 bp, Candida albicans
gcccaccatatcgcttcagaacagaaaagaagagaaaatatccgtgctgaatttgacaaaatagtatctttgactcctaatttaaacgagctggaaaatcgatcagaattaaatatattaaccaaaagtgctgactatattgacgagttgagagcagagaatattaaattgattgaaatatgtcgtcagaaaggtattagcataccacctgagttaatatattcgggaccaaaaaacgatggtagtgatatcgcaaaataa

SEQ ID NO: 11927 - DNA, 363 bp, Candida albicans
  unsure (28): Identity of nucleotide sequences at the above locations are unknown.
acgcggaatttcattacctgtggggcanggttcgtctcgacaatcattcggaatcgaggtctaatgcagaccattctacttttggtggtggtgttggaggtaaagaaacaagttttagttccgggaaatcagactatatcgaccattatgaaccaagagcacgtagggaccattatgaaccgagaatacgaaatgataataaagattccaacgatgtcagaggagagtttgaactggctacaagacaagaacaaagacggagggatattcaaaataggcttgatgcaggtggaatggatacttacattccaaaaactaccacagcaaaacttcgggaacacagtggtacagagtctttgctga

SEQ ID NO: 11928 - DNA, 309 bp, Candida albicans
tttaaactgattgagtccaagaaggttgaggccgttaaagaagatgacctgcaagagtttggtttagagaatttggatattactgttgataatcggaaacaagttgattatggtttgaaaaataagtttactgttgataaaggtattaaagagtcagagctttgtttgttagatgttagtaccaagatggatccagaagaggatgaattggttagggatattattgatcaagttaggaacaatccagaggacattagggaacagttgattagtgctccagcagaatgtcatgaaattgcagcacaatag

SEQ ID NO: 11929 - DNA, 183 bp, Candida albicans
tggttcatcgtcactctagttttcggtctatataagggtcagagatttcccttgtcttcttatatattttatatttttatattcttttctttagttagttttcatactacaatcagagtcagaataaaggatattgttttcccgttcttcatattattgtctacatctacagctgttccttag

SEQ ID NO: 11930 - DNA, 408 bp, Candida albicans
cattgctatattaagatccagtctacaatgagtatgccaggctcaatcgatccaccaggtcaagctcaaggtcaagctcccatcatcatgaatcaggaatcattaagataccttggtgctgttattgctgaaagtgtaactaagtcccaggatgtggttaagcctactaacttcaaaggtggtaatcgttctggtggtgaagaaagaggcattgatgcagatggtgatactataatggccaacctgatgcaatccaagaaattgagttggactgaacggaaatttttaaaacagaataatgcctgttgtacttgttatcgtgttggatataagtcctttgattgcccatatcgtaaggacaacaagaaaaatccaccaaaacagactaacaagagtgatttaaactga

SEQ ID NO: 11931 - DNA, 1089 bp, Candida albicans
  unsure (29): Identity of nucleotide sequences at the above locations are unknown.
gacgcggaatttcattacctgtggggcanggttcgtctcgacaatcattcggaatcgaggtctaatgcagaccattctacttttggtggtggtgttggaggtaaagaaacaagttttagttccgggaaatcagactatatcgaccattatgaaccaagagcacgtagggaccattatgaaccgagaatacgaaatgataataaagattccaacgatgtcagaggagagtttgaactggctacaagacaagaacaaagacggagggatattcaaaataggcttgatgcaggtggaatggatacttacattccaaaaactaccacagcaaaacttcgggaacacagtggtacagagtctttgctgaagaagtatgataactatcaaccaataaacatctccagaggatcaaaatctccatctccgtcaaaactcctgtctatttcacaatcaaaggcagatctcattagtaaaccatcggctccaaaggttgcatctagagaaagttcgctcgagaggaagcaagtttcaaatggtatccgtactactaccgatgtggaaccaccaagagcaagggctcgtggaccaactgacatgtttggaagaccgttgacttcaaatagtactcaggcacaaccaacaagaaacaaatcggtggagcgaccaaaagatcttgagaaacctacaaatggtgtgactgaggataggaataagaaaccagttttggaagagaagaaagaagttgtcaaaccaaatttggcaattccaaaaatcaaaaagagcagttctctagtgctgttgctgtctagatcgtccacaacaccagttatttctaatccgtcgaaggtcacaaaaagagcagcaagtagtgtgacaccaccagtgctaccaaagaaaccaaaaatatccaaaactagttcagaaagtgaagtaagtgatttggaagaagacagtgattttacaggtgagaatgcaactgtatttgaaaggtttatggcacttgaacaattacaaaaatcgccagtttataaaagaattataaatgagaaaatgaggtttgaaaagttatcgggaagacacaaatctatgtaa

SEQ ID NO: 11932 - DNA, 210 bp, Candida albicans
aaaaataagatcaaacgaaaatcaaaattttcccttcaaggacgtataacaacaagagataagaagaggtttgaactgtttgatttcagaggagatgacggtgcaaaaagatctaccaccaaagaagcacataattttttgaatgattcacgaaagagttccattagtgatatctcaagccaaaaattttcaagggaaagttccccttaa

SEQ ID NO: 11933 - DNA, 219 bp, Candida albicans
  unsure (192): Identity of nucleotide sequences at the above locations are unknown.
caggacaggaaagttacaaagacgtttccactcgaatataacgagagcactttagttaatggtcacgtaacaagagttgcatctggtattttcaaagctactggtgagaatggcgaagagattacaaaaacaattccaattgagtacagaaaaactactgaaaggatcgagtttattactgtctgccccaantacactagcaaacggtcaagtcattga

SEQ ID NO: 11934 - DNA, 198 bp, Candida albicans
ttacaagtttattgttggtttgattttagcttatattattgcttagaagttgttgctagcgaaaaagttttcaaatattgtcaaactgtgtttttatttgcaagtatttcaaacgttttttcttatgctttttcgttgaaaccccaattctacatatgtggtatgttttaccagactttaattgaagaatgtggttag

SEQ ID NO: 11935 - DNA, 219 bp, Candida albicans
tttattgccattatgacgtcttcgcccccagaatatgctccaacatccacgtcctcattcactgtatcaacatctgacgtttacaaccaagaagttaccaaatcactgttaatcaaaactccattacataaatccgtatatgattcactagccgaaatatatcccatactacccactctagaaatggttgagaattcctatttgaaaagattatatccc

SEQ ID NO: 11936 - DNA, 417 bp, Candida albicans
gtgataccatttgccactacgagtagtttcatatatggaatattaatatatttgttacccctttgcaaactccctactactactactactccccgctttttaaccatggaccctaatattgatattgacatattcagagacttggatgctccatttatggaaatattccataggaaaccacttcagagatatttagaacatttacctcctggagagagagaacaacaactaaataacataatggcccaaggagatttatacctcagccaacaacaaccacaacaacaaacaccacgttattatcatgttcattggatattcagtcatattccatttataattttgaattttgatcaaatgtgtgagagatttttcatggagagcattttgggcacgtacaatagatgctataactag

SEQ ID NO: 11937 - DNA, 720 bp, Candida albicans
attttgatcaaatgtgtgagagatttttcatggagagcattttgggcacgtacaatagatgctataactagtgctgtgataatgacagttcgagctctcagattcacaacatttataattggatcaggagtttatttccaaggagtggtgaggagattatttgtgttttgtgatgtcattacattttctgataattttatccgtgatatgttcacatatattttaagagattcaaaagatatattggatcaatgcgttttacttgaacgtcatctgcgaaatgttttttactttttacaatatgatgagtatagtaatttgtcaagtttccaagtaataaaattagcgtaccaaaacttattggcatcattaataaatgtcgaatgcatcacttatgctccaaattcaacaggatcaacaacaacaacaacatcatcatcatcatcagcaacaactacaagctgtaaaattttgaccaatacattagtgtttaaactttccagtgtatttcaggaatatttcccagctttaggatcaactggattgaaattaattaccctttggatgtacattagttatgcactaattggtgatattatctgcttgaatattttattgtttgtcagttataacctaataaatagatttatgggttataaacaggtgtttcaaggacttagggatatattgtggaatagtttatttaaatttatattataa

SEQ ID NO: 11938 - DNA, 231 bp, Candida albicans
ttgtatacaagatttaaaaataactcctgggcaaaaatttcgatactttgtttacttaagcggcttttaattgccgctcgacctgattcaaataactttcaaagactttctaacaagtatcggcaatgtgttgctcctatgaaagtgccaatggtgttaaaaaaattacttgatttagcacagcgatttagtttcgataattatacatatgaatatatttcgtcacactaa

SEQ ID NO: 11939 - DNA, 183 bp, Candida albicans
actaactttaaaatcagaaagacaacgaaaaactacccaaattttagtttcttgttattgatttataaaaatattgtagtcatagttacaaatagttggacttatagagatctaataccctcgtttcaaaaggaaacctcagcccttagtttcactattaatggtttcatctattactgttga

SEQ ID NO: 11940 - DNA, 207 bp, Candida albicans
tttagttttgttcgtttttttattttatgcagcccaaagttgatagagacatctgacacttttacacgactatcttgggtgaatttttttgttcatgaattcaaatatcattttactattcatttactttttttattttttttttcaagtgttgaaattacttgttacccattacaattatctatttatgtgtcaatatataattaa

SEQ ID NO: 11941 - DNA, 189 bp, Candida albicans
aaacctgtttgggtgataatatattgttcttatgttttactcagactgagtcatacaagttcccttaccaccaaaaagaataaaactttacccaaattatttacaccatttttgaaccagcttcagttacaaagagctatttcaatttatttagaaattcttgtcccatctagtgttccacgaatatag

SEQ ID NO: 11942 - DNA, 216 bp, Candida albicans
accggaaataccgcatatatatgcaattatctcgcatacacttctttttacttttctatacatttcaatttaattttagtacaaatatacaagagatgtgacaatcaaataacaacaagctccataatgtttactttaatcaaacagtattcaaaactgttgacaacatatactaaggaaggagagaaaaaaaaagacattgtttatattacttaa

SEQ ID NO: 11943 - DNA, 186 bp, Candida albicans
aagttatttgaatcaggtcgagcggcaattaaaagccgcttaagtaaacaaagtatcgaaatttttgcccaggagttatttttaaatcttgtatacaattacactaccaaactcgaaataggacaacttaaacaaatactgtacctacctgtaaaccgagtatatgtcctagtttatgtgagttga

SEQ ID NO: 11944 - DNA, 282 bp, Candida albicans
aaaaaaaaaaaagaaaaagagcagaaattactggcaaacaataattgtgtcatttttgaaaattgtgttttagtaggttttaataggattctcaataagtttgttttcactacaacaatatatacctatatatacgaggaaatacatgctcttgtggctcttcaaagcattcgcttagatgtcagatacataaaatataatgcagtatacttgtcaattaggaaaggtcatgagaatattcgggaaaagggagcagtgaaggaaatactttgtgtattctaa

SEQ ID NO: 11945 - DNA, 195 bp, Candida albicans
atttctaattactttctttttctttcgtttttttttttctcttattgtttatttaattggaagataaaaagttttctatttcttcaacaattggaaagtgaaaataaatatattcattctccaagatgtctcattcggcctacaaagcttccggcaagccattgtcagcagaagcattatatcatcaacgagtaa

SEQ ID NO: 11946 - DNA, 441 bp, Candida albicans
tcatttacatacttactcagtactgtacactttatgttcagtagacttgtatcttatcgatatccaattggtgtccaattaaaacaagcaaataggatcatgtcaaataagaaacaacaatcattagctcggttttttggaggtatcacacctccctcaggttcaaattcaacatctcctgaaaaacaacaatcattgactagattttttggaagttcctcaaacaatagtagtccgaaaaaggcaaccactgaagctaaacagaaaagagaagctacaccacctaaatcgccaccccgttccaagaaagctagaattgaaacaaagtatgatgagagtagtagtagtagtagtaatggtgatatcgagatggaaacagaaccaatactggaaaaaaataatgggtctggcaatgatgttcgtaatgaagaagaaaaataa

SEQ ID NO: 11947 - DNA, 312 bp, Candida albicans
actttttacaacacaatgccacacttctcaatgtctggtaatcatcaactaaacaaaaaatctcaagtagtatctccaacggcaatgaatggagatgcacaagcgggtactcatgtactttcttcttggaaaagaacctgcctttcttaccaatcaattggtactttaacattgctgaaagaaaaagttgtcgaaagggtgatttttttctccccaaactcatctgaaatgggggtgtgtccttacgtacaggaatttatgtccgccttgctaaaacatacacaaaccttaaatttatcctatataccctaa

SEQ ID NO: 11948 - DNA, 1434 bp, Candida albicans
attcctgtacgtaaggacacacccccatttcagatgagtttggggagaaaaaaatcaccctttcgacaactttttctttcagcaatgttaaagtaccaattgattggtaagaaaggcaggttcttttccaagaagaaagtacatgagtacccgcttgtgcatctccattcattgccgttggagatactacttgagattttttgtttagttgatgattaccagacattgagaagtgtggcattgtgttgtaaaaagtttaaccatattgtcaacaagcacctattgtataatctgattgttttcaaaaacccaaaaaagttctaccagtttgccactatacatctactagcagatatcagcaacaaaatcaatttcctcaacaccattgagtttatcaacccacaaattaaggactcagaaaacacaaaactaaatatagccgggagctatgcagtggagtcgaaagtgagagccatggaccagctcaactatactgagtttatcttgtcgttgtcgaacttgtttacccatgcatttgggttgcagtgtgttatttttagcgagatttccccgtcgtttgggttccccatggagtccaagtctggcagcagtaatatttttaaacgcaaggccccgaagacaaagaatagacgtttggggaagttggtgatgaagacacaatcagggtggtctataccattgaggaatacccatttgtcacttattgcagagtattttgatgtgattgacgaattgtgtttggtaaactttattattgataatccaatcacgatcaaggatctacgaataaataaaatacactttgaatcgtgtatctatccgtttaagaagggaccaaaaagagagaatctgatattcaccaatgtgtcggagctagaactatccaaaattgccaacagcaccgaattgtcgttgatcgatctaatcaaagtgaagaacgaggcattgcattacttgacgttggatattgggtcaaacattttctataccaaccaggagtttaagtttggcaagtataatccgtttttccagttgttgtgttctggggtaggagggtactcgaggttggatactttgaagttgacaaattttgaattgtttgactatttgagacacgatgatgtgcacaaggatgttgactcgtggatagagccgccaactgataattttgaaacgtttatggagtacacgtcgcagatcccgcacttgattattgtgctacgaaagtttccgccacgagtcaagacatgtctcaaatgtgggttcaaggagcagcagctggataaaaatatagagtcgttgacgtatgatgattggaaaatatttcttaaaccgttagagttgaacccggggaatacattacagatttttcgacacgattatagattactatacacaaagtcaaagtattaa

SEQ ID NO: 11949 - DNA, 261 bp, Candida albicans
gctaatcgaaaggttttttatttttttcactcaccaatgaagttttcaaatacgcaatccaccaaacttgccctgtattttgatagggttttgaaagatattactacatttaatggcgattccacgccgcaattaattgctccagggtgtacacttggcgttacagatcgggattctaccgtgtacttgaactcgaaaggtgtgagaaatatcgatgaccctgtgccgttttcacacacgacgcggcaaggtaccacgtaa

SEQ ID NO: 11950 - DNA, 183 bp, Candida albicans
aatttcaagttcctctcaaccaccaccaatatcacaaaagtaaaaaaaaaagataatcaatttaataattgtaaatctgaacaatccctccatcaattagccaatcaatctgagaaatggtctggagatatttctatttttaaatatctcagaatcctcgtctccacctattctatgtcatga

SEQ ID NO: 11951 - DNA, 270 bp, Candida albicans
tattatgtttcagattggaatttgacgcaaatcatcgacaaaagactgaaacagtttgacgcgtgggatttattgtatcggcaccctacccgttattgtaatgagagtaatggtggtgatggtggtttgctggataaatccccgaactcgtcgattcctggtaccttaattattgaaatcgccttttttgaattcttgttgttagacgagaaaagatgcacgttatacaaatcaaggcagaatttcttgatagcattaaatcaagcttaa

SEQ ID NO: 11952 - DNA, 183 bp, Candida albicans
cttttctgttatgtttttttttacagcatctgtttgaaaggcgataatatcttttcacatcattacaatttacttaagaaaatcaaaattaacgcaagctacataaaagttacacaagaacaattaaccattaagcatcaagccaccctttattccaaaaaaaaaaattggtttactagctaa

SEQ ID NO: 11953 - DNA, 216 bp, Candida albicans
agggctgtatatatttttatgtttctagcatgtgaacattatataaatgttgtgaaaatttggagagatattgaggaggttagtaaaattgctttgatttattactttaatttagtgattgagtatgtgaaatactgtcgggttcaagtcagaggactggatatgttgaccaagatgggaaataatttgctttttttttgtaaagattttgcctaa

SEQ ID NO: 11954 - DNA, 240 bp, Candida albicans
agaaaaatctcaaacttttctctctctctctgttccaaggggtttacaattattttttttagtttctgttgttgttgttctcaacatcatcatccaaatttgtatacatatattatatatataaatagtagagtagatggagaaagaaggaattctttattaaataatttaaacctccctccctccccctcccaaaaaaaaaaaaaattaattaagactaaccctttatccatattataa

SEQ ID NO: 11955 - DNA, 282 bp, Candida albicans
tttgaattgaaccaaactagactttacggtttaaaagaaggaaaagaagaagaaatcgaggtagacaacttgcatatttcatatattagaatgaaaagtccaattgagtatattcacaggttaattattgttttttttttctttttaatttacttgattagattcttattttggtttgaaaatttattcagttcagttacaatttgtggtttgagtttgttttgttttgctttgttcttgttggtattttgctatatagatcaaagtacaactgcattttag

SEQ ID NO: 11956 - DNA, 189 bp, Candida albicans
gaacaacaacaacagaaactaaaaaaaataattgtaaaccccttggaacagagagagagagaaaagtttgagatttttcttcattctttttttgttactaaagacacgcacaaaccaaaattgccatttcttcctgttccacctcctccaataacttcaaaccaacaaacaaacaacactaacttttag

SEQ ID NO: 11957 - DNA, 432 bp, Candida albicans
tcaccctattactttttggagttaataactctccagagttttcattattcaatattaagttttaatattccttccttccttccttctttctatccctcctctttatcgtgtttcaccctttccacccacttaataacactttggttgcttctattatatatcatgttgcaagaaaaaatgactactagagagaaagatgaattcaacattggcctgcttcagaatagtcctgaatcatcaactaatatgtcaccagatgttatcaccacacctatttcaaaatgggcagcattcaaagattcatttaaaccaccagaacaaaaaccactagcgtcgtcatcatcgtcaacgtcatcattatcagcttcatccccacatcacaatgatgtcgctaataactacgatatagagaaatggcttagaccagattaa

SEQ ID NO: 11958 - DNA, 189 bp, Candida albicans
cgaattatgtctagcaatatattaaggatatactatgcaactatggagaatgtgtcttacactttatttgtgttgttgctgagtttagacaatgttattgatattttttttagaaagattatttactttggctattgttattatttggcaggtaacttggtatgtgcagccacgataaacgatacttaa

SEQ ID NO: 11959 - DNA, 246 bp, Candida albicans
gtaacaacaatcattactattaattccactgttgctacaattattactgtcattactgttagaattaggtttatcaatactatcattatcattattattattaatactgttatatttggtttccaacaatggagaaaaggttatacactggtaaaacatcaaagaatcaaaaatgttgaaaaattagttaggttatcatcatataagtttttgttgacgactgaatggcaattgatgctggtttga

SEQ ID NO: 11960 - DNA, 339 bp, Candida albicans
tataaagtattttttgggatttcaacagttgaagataattatggctttaccacacttgcgtttgtagacattaatttgcctgttgtttatactaactttgcaaggaagatattggaaaggattcccaatatattcgactatatggatgaccatcttatccataccgaaaacattacacaaccatgtgtcattagtcaacacagtcatgaaagtatcaaaccagcatcagctgctattcaaaccagcatcagctgctattcaaaccagcatcagctgcttttcaaaccagcatcaattgccattcagtcgtcaacaaaaacttatatgatgataacctaa

SEQ ID NO: 11961 - DNA, 225 bp, Candida albicans
tgcctgatggcatccctttttttttttttctttttttttttcaatatttggaaaactaatgccaatcaattttccgccaaaatagctgttgatttaagccgttttcatagagtcatagtaacaatgtatgcttgtcccacaaacataaaggaattaccagcagcattgacaaattcacaatatttctctgctttagatttgaaaaatgcattttatcaaatttga

SEQ ID NO: 11962 - DNA, 222 bp, Candida albicans
tttttcaacatttttgattctttgatgttttaccagtgtataaccttttctccattgttggaaaccaaatataacagtattaataataataatgataatgatagtattgataaacctaattctaacagtaatgacagtaataattgtagcaacagtggaattaatagtaatgattgttgttactcaataatgtttggttgtatcatgaacatttgtacttaa

SEQ ID NO: 11963 - DNA, 246 bp, Candida albicans
acacacatgttagtaaatcttggtatacacactctattcacattaatcttggcgtattattattataacacatttagattaattcctcactttatacaggtgtattatatctcatctctgtattatatttccacagtgcaatgtagtcttacattattcatcacaacatatttatcacaacatccccccataatgaaagacttcattgaccaaatcagtattaaattatatcatagttttaagtag

SEQ ID NO: 11964 - DNA, 195 bp, Candida albicans
ttttcttgttactccgtttcgttcattcttttattttataaaagtccaccactttctagtataacatttactttgcaactgggatacaactatcgttcgcttaatatatcattcctaatccttttgatcccagccagcttaaaaaatgtatcagcaccaagatcaaactcagcatcagtattaccaacagtataa

SEQ ID NO: 11965 - DNA, 222 bp, Candida albicans
gtcaatgttaccgggaacttgaaatcatttagaatcaattttgttgagttcgacgaaataatggagcataaataccaaccaatacaaaacgaaacaatcttaacatcaataggaggcaaccaactgaaaaaagacgacgctaaaaagttgcttgtggttactgatgcggcagatagtataggttcgggtgacgttgccttgctgagtggtgataatgggtag

SEQ ID NO: 11966 - DNA, 210 bp, Candida albicans
aaaaaaaaattaaaagaaaatggcgatgaaattatatttaaccaggggaaatttaatacaaatgaaattacgtattttttttttatttatagcaaacaacaacaacaacaacaacaacaaacattttactctcaaatacatctcaaacccacgaagaaaagaaaggaaaaaaaagaaatttcttttttttgtgtgtactatgtaaagtga

SEQ ID NO: 11967 - DNA, 312 bp, Candida albicans
cataagcgctgtatccggtcagcctcccaggttgaaaacgttaaggccccacgtattggttatggtgctcctaagtttgttgatcaacatttttcattcaatcttttgcatatatgcattcaccgattgaagtttaattttttgcgtactgagaatctaaacttttttttgccacgttccggtttcgggtccgcgattcccgatcacaaaactatggtggtgataattcgtgggtttgcaaagactccgggattatccaacaataataatagaagattaaacaaaaggctgaatataaaagaggggagatga

SEQ ID NO: 11968 - DNA, 183 bp, Candida albicans
tttttttttttcttctctctccctcaatattattatcatcaccaattatcggcaatagatacaatttcttggtgtaatgaacacgcccaagatttgtctatggaaaaacgacaatctatctactccaaaggaaaaaataatatagcaaaaggaagatccaaacattgttgcgtgtgtatctga

SEQ ID NO: 11969 - DNA, 207 bp, Candida albicans
agaaagcggtataattggttcgagtatagaatagtaaacaatcaggcgatcaaaaaatacaaaaaaatagaatcaagtacgagcttaaagatggtgacaaataatattaccaagctttcctttcacaacgtcttcaatttattttttagaaatctagcattatacgcaaagtcaatgcatgctttaatggcaactatttgggattga

SEQ ID NO: 11970 - DNA, 183 bp, Candida albicans
agtcgacatgtcagtggtttatttatttatagatatcagttcatcaatttatctcaggttgataaaaaggcggggctgatggactatatacattcaaaatctgatcgaaatttactgtggagagataatttgatacacaaaacaaaaagaactgttagtgtgactttaaattcttgttcatag

SEQ ID NO: 11971 - DNA, 207 bp, Candida albicans
agatttgttttactaagtaaaaagatgaaaagtttgttcccgttgtttattgttgttaaaaaggacagaaaacctaaaaacagtcaggaaaaaaaagaattattgtcaaaaataatacgcgtatcgatcaaaaaatatgtcttcgttctgttatataacaaaacaaatttgtttggaaaggaagactcttttaacgttggagcataa

SEQ ID NO: 11972 - DNA, 201 bp, Candida albicans
agatgtgtgtggtgtttttctggtgcacgaacaatcatttcctggttagtagtggtgtttgctttgtgttactcgaaatactgtatgagaattgtttgttcagtaagtgctttgggtgacctacaagatgcaaaagaaagctcacagttgttgggtataattgatggtagattttggaggattggattaacatgttcgtag

SEQ ID NO: 11973 - DNA, 204 bp, Candida albicans
tcttcttgtttctgggcaaagttaaatgctcctgttggtttagaaccaaacagaaatgcattgttggatgaatttgatccaaaattaaagcttggagtagttgcagaatcgccttggttgtttgaagccccaaaagtaaatggatttgctttagacgatccaaacacgaactttggagcttctgatttgtcctctcgtgtcttt

SEQ ID NO: 11974 - DNA, 336 bp, Candida albicans
ggcggatctctacccgtggtgaagaccaataacaataacaataacaataacaataacaataaccaattagacaagaatgaaatggataaacaacaaattgatctactgttgccatcaactccttcaaataataattccaaaaaatatcaaaacatcacttcatcacaacaactactatcatatgagaataatcacaaccattcaaatttaatagattttgataataacaatactaagaatgatgaggaattagttgctgttgatagattggcttgttcgattttgtctctggttggtaaaaacactaataatcaaaacattgaatggaatatttag

SEQ ID NO: 11975 - DNA, 330 bp, Candida albicans
ataataatagagaggtgttttttgctgtatataaagcaattcatttatttatttatttatttatttatttatttatttatttatttattagcacacataatagcttgtaatgacgtaaattatcatccaatcaattataaattactactaggatgtagtcaatttttttttaccaattatataaaaaagcctaacttaatccaaaaaaaaaatagaataaatggcccaaggcccaaggctaaggctaaggctaaggctaaggctaaggctaaggctaaggctaaggctaaggctaaggctaaatattccattcaatgttttgattattag

SEQ ID NO: 11976 - DNA, 207 bp, Candida albicans
atgagaactgttaagatgggtttaaagaggtggaaaaatttcgtagagtttgtgagaacagagaaaaaaaccaatcctataaatttcactgttgatgattttgctggcaaaattagatgtaccaattatcattccaaagtggtattttctgtccaacaagaagcagttataacaattgattattttggttatactgaatatttttag

SEQ ID NO: 11977 - DNA, 213 bp, Candida albicans
gtgacagaagtgttgttagaaactgtcatgatatcgaaaagttttaattttgttgaatttgggtttgatacttcaataaacgaaggattaaatggatgtaattattcacagatcttgcttactgatgtttgttcgcaagacaataaggaaaaatctttatcaacgacaattaatgagagagacagaaaaaaaaaagtgtgtaatgattactaa

SEQ ID NO: 11978 - DNA, 183 bp, Candida albicans
ttacatccatttaatccttcgtttattgaagtatcaaacccaaattcaacaaaattaaaacttttcgatatcatgacagtttctaacaacacttctgtcacttatcctattcaacaacaagcaactattattgccggatttggtatacaccagcggaatgggagcaccgaacttgcgaaaaag

SEQ ID NO: 11979 - DNA, 267 bp, Candida albicans
acaatggtgtttactttgccggatcgaataagaacgcttaagcttagggagttaaagatatgtatatatatttatatttcctatgtaagcaactataaggttaatctggagattgagcctactgttgttgttgttttattctccttttattcccattcgggtattaaaaagaatgcgtatactctggctctaatatcggctgtttcttcatcttcctcaaacattggtttccaagtgaccatttcaattttttccgttttgaattga

SEQ ID NO: 11980 - DNA, 357 bp, Candida albicans
gcaacatcgttaagaaatggtaataattcttttcttgttcgttctggtcccaaggcaatagcaatggtgtccaatttttgcatcgcctctactctattagaaacgtcatcatgtttcaattcatccattaacaaagctaatgggtataaatcatcactaaaattattcataatgccagtgttacttttgaagtttctcttgttttatggggaaaatagattaattatgcctgataatcaaaaaaaaatagggaaactgaacacaagcaattggaaaaaaattaaaaagaaaaaatacaaatgtttagataaatacaactgggaagggaaaacaaaaaataatcaattaataatataa

SEQ ID NO: 11981 - DNA, 246 bp, Candida albicans
cgaaaaagaaaaaagaaaaaaaaggaattcgttgcgttttgggagaaatttgatcaaacctattttgactttcaacaacaatcaccaaccaccataacaacaacaatttgctcatttaataatcaatactttaccaatttttattttactccccacacacaacaacaatttatattattaattgattattttttgttttcccttcccagttgtatttatctaaacatttgtattttttctttttaa

SEQ ID NO: 11982 - DNA, 252 bp, Candida albicans
ggtttactcaattcattcaattggctggaccaaaaactaatttcaaattcttttgatagacagaactcacccttgtacattgaaggaccaataacgagattcttttttttagggaaatttcaatttatcggtgtttacgacacacgacaccaccaacaaatagttctgtctaaactacacacaaaggttagggaggccaattatacattattaaactacagcagtattaaagagcagactctacacacataa

SEQ ID NO: 11983 - DNA, 1326 bp, Candida albicans
ttgcaaatgttttctccattctacaacggtgattattcctacgaccaaccaatcgatttcgagtcgcttttcgatttgttgcatcaacatcaattctactataaagaaaacacccgtccaagagtcattaaaaagttagaaaccgaggacgagttccaaattcaaatttataaaccatacggaaactacaacaattatgaagtgaatgttgttaaatccaatcctcctattgtcaatgtcgttatcagctccgtccaagacaatttcaaaaccgttttgccattcaatgtcaactatattgatattgataatatcaattggcaatggtacaagcaacaaaacgtattggtattgaacatacccaagagaatccattatgttcatctgaatgttcaagatatcctcaattgcttgttaggctgcaatgatgctgatgctagtagtgctttgaaagccccaaaccaacagccatatgctaaaccacaaactaagaaggatgtccaagccaagaccagtcctaaaaagaaggaagaatttgccaaagtgaagaaagaaattgccaacaacaacaacaataaccttgctagtcgtgatgccaatcttaaagactcaattgaagaacatgaaaatttaattgaacaggctgcaaacgctttaaaacaagccacagaaaattcttccaaacaagtgaaacaggatttgaatggcaaggctaacgcattgagtgctggtgctcaagctgctgctgaggctaaacacaaggaagcattagaaaaaactaaacaagaacttgaagctcaaagaaaagctgcccatgataagattgtcaaggctcaacaagagcttgaagagattgccagaaaggaagctgaagctgtaaagttacatgaagctgcaaaacaaaaagaattagaagaagaaaaacgcaaggtcgaagcggaacaacaaaaagcaaaggaaaaagaagacttggaacaaaaggagtacgatcaatttgttaaacaacaacaagaattccttaaacaatttttcgggtttaatttaggaccagctatccccactaaagatggtgccaatgctttttacactgctgctaaacaagccaaaaaacaaaagccaaaagtagcaccaaaaccaaaacagttgcaaactcaaccagttaagcaagcaaaagatgaagaggaatccattccttctgagccggaaacagaagaacctgaatcttctaaatcacacaactcaaatgaaaacttacataagcatccttctttagaggaggttgaggacgaggagtctgtaatgtttagaaaaagatttggtcattag

SEQ ID NO: 11984 - DNA, 243 bp, Candida albicans
ctttttaatgactcttggacgggtgttttctttatagtagaattgatgttgatgcaacaaatcgaaaagcgactcgaaatcgattggttggtcgtaggaataatcaccgttgtagaatggagaaaacatttgcaattagatagtttgataatttatgatattttgttgatgaataaaaaaaaagaaaagtttagggaagatgacattttaagaatattccttgctatttatagggaaaaatga

SEQ ID NO: 11985 - DNA, 249 bp, Candida albicans
tggctgagaataaaaaacaaccaccgaaaccaaaatatagaactgaatcagttaatattacatagatttgacattattatagaaagtagtgtgttggtcgcacacataagaaatcgtaaacaacagagagagacaagagagaacagatgtcgtggagtacgacgttatcaggtaaatgatgctgatttgataactcgtgcacgacatggactagaattacacttaattcgcatagtacgagagaagtga

SEQ ID NO: 11986 - DNA, 225 bp, Candida albicans
ttattatggtcaatcggatttattaaagtggtagtgtacaacagatcaaatttgtccttgttccgagagccgtcaatgaaaagatggtggaaaaatttccaacaaaaagcagaccacccaccatttcaatacaatttcaatcaatacacccagatggcaccaaaagttagagaagatttggttataccgtatgaaattgagtcactgttattacgttttgcttaa

SEQ ID NO: 11987 - DNA, 231 bp, Candida albicans
ttccagttaatatgcaattatataaacctaattaatgagatccccttcgagctcaaattagcccataatgtagaacgtaaaaatatagctaaaaattttgagagcacaactaactctaggaataaaaacgaaagagtccacttacaatcaaaacagtttggttcagttggtacatcttttaactcttttcggaagctctatgtaactgtgataaagatacaaacaaactaa

SEQ ID NO: 11988 - DNA, 258 bp, Candida albicans
tctggcatcgggaaaagggtgtctggtccactggaaagaaaatttacaaagcaactaaacgagggtgttaaaactagaaaattctctctgacaaaagcattctattgtagtattctcaaatgcaaccaagtgattaatatgtgtaaaggttatttcttacaatgttatttcgtgtttttgaacagacaaaatagtataaatatagctcaatcctcgcccattgacaaaaaaaaaaaaaaaaaaaattgttactattaa

SEQ ID NO: 11989 - DNA, 561 bp, Candida albicans
acttttgtaatctccaattggggatcaccattcccagttttaccacatgaattattaactctcgaatcatttgtttttcctgctccagtttatgtccgttgtcaagttactattaatccgaaacctaagtactcttatgcctttttgaatgatattgctttttttgtcccatgtcaaattcctgattttttaattgttgatactactgataatattaatgctaatactggtacaacttttggtcctgaatatttgggtgactctgatttgtttgattgtgatggaaatttgttaaatggtgatagtttttctgaatatgagctggatgatgatgctgaatctttggttgaaaatagttctcttgttgaagtatatagtgatctggataatggttctgatgttagaaatgttaggagaaatactggtacagttgctgaaattcgtggtttgggtttaacttgtattggagatagcttgctgggtccttttagaatcgttggttttcttcctgttaatatcgggacaatatttgctactggttcgtctcatcgttttggttag

SEQ ID NO: 11990 - DNA, 195 bp, Candida albicans
aatatgcgtgtgtatgaatcaatctgtattagtatgtttgttcgttttcctaaattttgcttttcttcttcttctgcctttgaaaggaaaaagagacagagagaggaaaaaaaatttgtcaaagagtatctctcatcatcacaacaacaacaacgatacactattcaacattactttgaaaacttgccatcttaa

SEQ ID NO: 11991 - DNA, 225 bp, Candida albicans
attttattatttgtgagcagtaaatggaaatctaatttttgttgcaactcatcaaaaatatcatcatcatcaaccgaagttgaagaagtcaaatcaaaactagaatcatttgaagatatgggagaagctttaattggtattagtctagtgaaaaattcaagagttgtatttgaaaaatctgaaggaacaaattgttcttgtaaaactctaaataatttatcatga

SEQ ID NO: 11992 - DNA, 183 bp, Candida albicans
  unsure (126): Identity of nucleotide sequences at the above locations are unknown.
aagagagtgttcaaagtggagcaccaagatattaagaaattaagaaagaaagaagaatacataaatttgaatataattttccttttttctgttggaggaattaattgttgtatttatatgagaganagcacttggagagtgaaactgtcgtgtaataacaatatatatctatatcaaatgtag

SEQ ID NO: 11993 - DNA, 321 bp, Candida albicans
atttccagaataccctttaaactacataatatcatgaagaatccatttgacagtggcagtgacgatgaagatccatttcttagtaatccacaatctgcaccatcaatgccctacgcagcatatactagtgacagaacatcgccccgcaagacataccaaccattgaattttgacagtgaggacgaagatgctaaagaaagcgaatttatggctttcccactgtcgactagtggatctccatttcaccccaacagcaatccccaagacaatcacctaatattttttccagaagtactgcaagagcagcaacctcaaagctga

SEQ ID NO: 11994 - DNA, 264 bp, Candida albicans
gtatttaggatatctaatattgttgtgactttatctattaaccaaactggacagaatttgaaaatggatctggggggggggaacatttactcagctctgaggatcaataaactattctctttctttttatttcaaaaccttgcagtaccatggaattatatcaagccatgttttaaattgatcagtagtctaatcgggcttcaagggaaaaggtggtttactcgcttaacgatacttttgacatttctactacttagattgtaa

SEQ ID NO: 11995 - DNA, 258 bp, Candida albicans
cccccgtacgttttcttcgcccggcggggaagatatcttatagtcaaggaccagaaaattgacctgcaaaaggaagctttttctctgcttatgaaaagtgcattgaaacaagttgataaaaattatcaattaaaaattgagatgaataagttaaggaaggagttggtagatgctcaagcaagattggttgaattcaaagatgaatggtgtatttttggtcctgagttgaaaaaaattagacgtcagaaaaaagtataa

SEQ ID NO: 11996 - DNA, 243 bp, Candida albicans
ataaatggaacgctgttggtgaaaaggttgggtgaatcaattgataatatcaatcaactcactttaacgatagaaacgccatttaatttggcaaattttcaattggaagaaattcaaagcattattcgaacatatttttatgacattgattctattaatgatattaatagaaatattaatattgaggtaataaaatatcactcattgaaagagagtgttcaaagtggagcaccaagatattaa

SEQ ID NO: 11997 - DNA, 183 bp, Candida albicans
gaagttagacattattacatgacaagtcctggattgcagattataaaaaaagacaatcaacagaatgatactttttttttccatagtatagcctggaaattgaatttgtttgacaaatcggcaacacgctatttcgattggagccttgttaatcattggtgggaactacaactgctcaaataa

SEQ ID NO: 11998 - DNA, 297 bp, Candida albicans
ttcaataagagagtaagatcagtcatattgattgggtcattacaccgagtgaaaaaaaaaagtttggaaaatcaatcatattcatatttcgaagatagagtattagaaagaaagggattaatcaaattgattattgattgtatgttaaacattagtcaaaccaataccgatagcactgccacgaatgagtatttaattgctcatattatgactccggttggctcacgacagattcaagcagatcgcgtgagtcatcttctgacgagtgcgcgcgcattctcatccgggtataaatag

SEQ ID NO: 11999 - DNA, 183 bp, Candida albicans
agaagaatcctttacgaacaattaataagttttattattcttaattctatacaaaaaaattacaaaagcttcttttggttgacaacactacaatcacctgagttagtcttattttctaagttgattgattacaaaaaaaaagccaaaagggatagggagacgacaacaagacagattggttga

SEQ ID NO: 12000 - DNA, 213 bp, Candida albicans
tgtttgacgatcagtttttataacagatttattgaaaccgttgtatcattaaatgaacaactggccatatctaatttgacaacttatatagtttgtgttttttactcaactaaatactccactgacattgtcattaatttcaccaagctaaaagcttggaaggtatttatttgtagagataaagttttggatgaaaaattggtaaaaaattaa

SEQ ID NO: 12001 - DNA, 270 bp, Candida albicans
cctattcaaaacttcactaacttcttgactataaagaaactaagactaatagtgcatctacatgaaaacaatcagactgttatgtataaaaaaatacttatattaaacataatcgtataccgtaaagaaaaatatccttttgagctaagggatatctttcatcctataatattagttgttagaaaaccagccgcattacaaatacgactgctgtccgccttaggaggtttcaccgcattcgaactcgaccagaattaccatcacaattag

SEQ ID NO: 12002 - DNA, 186 bp, Candida albicans
tttaaacgtttagtaaaccaccaatgctctcctgtcagtgtgttaagattgcataccttagattttgttttaaataaaaaaatagcttcaaatttagtcaaatggaactcatgtgccggatttaaaaaaaaaattgccccacttagaaaaaaatgcgtgtatgcagagcttcaattagttacttaa

SEQ ID NO: 12003 - DNA, 240 bp, Candida albicans
aatcaatttctaacagtagaacgaccgtttctaaaaataatctttacttgtataagtttaacttttatgttaaacgacgtatatattaagagaaaaagcttatccatctcgcaccacatggaaaatcttttaaccggtaaaacttacaacaaaaaatcaaaacggtttaaggaagactcaaaaaaagacatgcattcgattataagcttgtgtgtaggctgtggggtcgaccaaatgtga

SEQ ID NO: 12004 - DNA, 279 bp, Candida albicans
gaccattttgagttatcgactaactattgtgaaaaaagtcgcttaaggagtattgtatgtcgcattataccttgtggagcgcaaacaataaggctttttgtctctttcaacacgacatatatagcaaaccacattcatgagaaagaaaaactcacacaccagcttgttggtggtttgagagacccaatgaaacaaagccagcaatatagcaaaagcaaccaaagagttttagaaaataataatacacctcaaactaaaaaagaagaatttattacttga

SEQ ID NO: 12005 - DNA, 192 bp, Candida albicans
gaaagaattgtatgtgaagaaactacgcactcacgtgcaaaacattttattagggctgttgccctaaactatttttctgcatgcgcgagttacgaggtggaagaggaagagagaaaaaaaaaaaaatttcaaaatatcattaacaaacagaactttcagttttccctttccctttccctttggttcttttaa

SEQ ID NO: 12006 - DNA, 183 bp, Candida albicans
atgaatttggctaacgtaagctgcatcggctcaagtcttattaactaccgccttaatttaagctataaatatatatatatttcagaatcactttctgcggaaaaactgtttaacgatttaccaacaatcataaactacaatataatatttaacaatggaataacacctcttccactactataa

SEQ ID NO: 12007 - DNA, 414 bp, Candida albicans
gatgaagccaacgataaaagtaaagaattcttgaaggaagctagaaaagagttgaaccatttggaagaagaaggacaaaacttattgtctcaatttgttgcatatgtcaaatccactgctaactcaattggacagtcattaaataaagctggagctgaattgcaactggccactagtgcagctgtctcgagaacttcggttgaattgcaaaaccctgttgtcattgctcaaattgctgttgctgctggtggtgccgctgctggttacttggcctacttggaaagatatagaattaacaccgacaacaagtacgttgttggtatacatgcctccatcattactgggttagtcgtactcgatggatacttgttttctacctactatccaaaatacgataaaaaagttgctaaataa

SEQ ID NO: 12008 - DNA, 252 bp, Candida albicans
aatatatttgattggttggatttacaatatagcaaaactgctatcacaaaattaagtaactgtaaaaaaagctataataaaattatgcacaaggtttgctcctcgtggccaccattattgcacaaaaagtatcaaactttaaattgtttgaattcttctcttacgtttgttacgcaaatcagcctgtatatagatagaaaacgaacatcctcaagcttcatgctatcaccatttatacacgcgcggaattaa

SEQ ID NO: 12009 - DNA, 189 bp, Candida albicans
cccgaaagatttgcaatattgatttatgtaagtttgtttgtgcaccataccaaagcaaaacctatcaatgagatgagatcacgtaaaactgctcacatttggtcgaccccacagcctacacacaagcttataatcgaatgcatgtctttttttgagtcttccttaaaccgttttgattttttgttgtaa

SEQ ID NO: 12010 - DNA, 312 bp, Candida albicans
  unsure (296): Identity of nucleotide sequences at the above locations are unknown.
acctgtgttttccaaaattgctttaacttggcctttccttctttaacatcctataatgttaaagagatcttaaacagtcattacttattcattgatttatttattatttccttaatcatgtcatcccaagctccctctgacgaacaaattaagaaagacgttaaaaaagacgcggataacattgttaaaaagggtaaagaagaatccgaacacttgaaaaagcaaggcaaagaagctgtcgatgaagccagggaaaaagttaaagaattcattgatcaagctaacaaaaagggtanagaattattaggatga

SEQ ID NO: 12011 - DNA, 222 bp, Candida albicans
taccgacgcggtaccttccagcccccgtggctgaatacacaagcatatcaattgattaatgaagttgccgatgatcaactgaatgattatttagattgttttataaagagtggtcgtattaaagaatttatggctaaatgtggagaattatctataatttcttgtgaacaaggtattaccggtatatttagtggtactacaaagacgactgatagtatatag

SEQ ID NO: 12012 - DNA, 207 bp, Candida albicans
ataccaggcaatcaggatttgagtaaacgtaatataactgcttttgttttgaatgatcgctactccttgcttttagataagattatttttttttgtatgaaattcactaaaatcgaattcaaatcaggcgacaagggatttttatgtgtactagaagaaactgattcacttccatatatagatgcgataatttctcttctcctataa

SEQ ID NO: 12013 - DNA, 306 bp, Candida albicans
aggcttcaacaactgtgttgccaaaaaaaaaattcatctttttctttagtcttattacacttgatgctaaaaatgccctcccaggcttataattataatatcaataaatattcagtttataaatcagacacaaactcatggtatcactatccacaaaggactaatttatcagtaacatttgtctataatggtgatcaggctgatcaaattgatgttattgttcattggaaaggctcaaatttggtacgtatactctttctcgtctatagttttcagctattcatttgtgcttgtttattatactag

SEQ ID NO: 12014 - DNA, 717 bp, Candida albicans
ctaagtagacaatcaaataaggataattttaatctttttaataccaataaatgtaaaacaacggtattgtgtagaaaaccttgcattggggttaagcaagtcaataataatggaatagtttttaaacgattccaagtcagcttgatcaatgaggtgacaagcaattttgacacatgctgtactatgttgagagggtttaattttcaaataaagatcaaggataacatgaatgaaaccgaagctcaatctcaacaaaataatggtaacatacaatcaaatgactcacaaatcgttcaaccaatccaatccatttctgatacacaaatgtacccattgatacaacctgcatcccaaattccaattcaattaccatcacaaaatatggcatcatgtttttcctctttctcaacacaaccactgcaaccaccatcacagattattgaaccacaaatttatcaattattttctcaaccaggtcatgttatgcaccaaggcaaaattcctgaaactactaataaagttgtatctaccaatttgacaattgatgcaacgacgcaaacattaccaagaaaattacaatctgtttttctagatgatataaatgaattgaaaaaaattagtaattcttctttaagatcagttaccaaaaccttgttacaacggaaagattttttagatttgatagatcgattagataaaataattactgatatttga

SEQ ID NO: 12015 - DNA, 339 bp, Candida albicans
tataaaaagaagagaaaacaaaggtatttaggatatagagaccgagtttcagtagacacttttagtgggcgtaaactttatttactctgttttttgcttattaaaagtcaatgtctatcgtgtactaggactaattctgtcgtggagtacaaagttatctaccaaaagtggttgattggatactttgtgcacgacaagagagaaatttacatttatgttaatttattagcgaaaagtgagaattgtaatttagtgttaataattgttgaaatccaatatggttttagtgagatgaattatgcaagatgtacaattggtacacacacgcatatttcatag

SEQ ID NO: 12016 - DNA, 1626 bp, Candida albicans
cctcgaattctagtcctactggagggatttcaattccaacctttcgcaagcaccagtcaaagtaaaacaagtgtctcgtcagttgtttcaaaaagcacttctgaagatgatgatgatgaaactgagtgtgagacagacattccaacgatcattccaagtgggtctgtccttccaacaacgtcagttcttccaactattatccctactggatcaggatctattactattcttccaactaaatctgctacttctgatgatgatgatgatgagactgattgtgagacagacattccaacaattgtgccaactgagtcagccactattatcccaactgggtctggttctgtaactatcattccaactggatcaggatctattactgttctcccaacaaagtctgctacttctgatgacgatgatgatgagactgattgtgaaaccgatataccaacgatcattccaactggaacagccactatcaaaccaactggatcaggatctattactgttctcccaacaaagtcaaccactactgatgacgacgatgacgagactgattgtgaaactgaaattcctactatccatccaactgtgtcaaccagtagaacatttacttccgatggggtgccaacaactcaaacactcaccacgaaattacctccaaccactagtcaacatactgaaacggaagttgtttctatcacatatactggtggtggtcagacatttaccacttatcttacacaatctggtgaaatctgtgatgaaactgttacgttgacaatcacaaccacatgtccactgacgactgttgctccaggtggacagatatatactacgactgtgactgttattaccacacacactgtctatccagatgactgggaagatgatggctatgaaggggaagacaatgccggtggttctgccagtggctcctctgatgatggtgaatgggaatggtatgaagaagatgatggcgaatgtgtgccaacaggtggatcaagttctggatctggcacaggctcttggtggggttctggtgctggatcaagtggtggtactacttctggttctggttctggatcaagttcaaattctggagcaagttctggtggtacctggggtggatctggaaatgattacgtttgtcctggtgcagaaggttatgacgatgaagagccagacaatggtggcagctggtggggtggttcgggatctggttcaagttctggatccagttctggtgttagttcaggtgattccggttcttcttcagttactggtggatcgtctggaagctggtggggtggatctggtaacgattatgtttgccctggtgaagatggctacgatgatgaagatgatcaaactcctgaaccagagtgtgacgatgaggatgatagctgggatgatgatgaagagtgtgatacacaagctgctaaggaagttgtcaactcggttactgttgctgctgaaagtgtttatccatctaccactgctgccagtttgaccacatcatggatatcgacacaaactgcccaatcagtcacacaaattgagaatattggtggtaaggtttctgccagtggactttttgttgttcttgggttgttgttgatataa

SEQ ID NO: 12017 - DNA, 204 bp, Candida albicans
tataaggggattgttacaggatatataattgcaggcagttttgatccccaaacatggaattgtcttgaaaaaaaaaaaattatttttgcttatttcgttaacgttagatttattattttccagcctagtagtttagttaggtacatttttagtttaataccaaagatttttaagaatagaggaaattgtagaaataatttttga

SEQ ID NO: 12018 - DNA, 246 bp, Candida albicans
tcatttccagatccaccccaggtaccaccagaacttgctccagaatttgaacttgatccagaaccagaaccagaagtagtaccaccacttgatccagcaccagaaccccaccaagagcctgtgccagatccagaacttgatccacctgttggcacacattcgccatcatcttcttcataccattcccattcaccatcatcagaggagccactggcagaaccaccggcattgtcttccccttcatag

SEQ ID NO: 12019 - DNA, 795 bp, Candida albicans
  unsure (124): Identity of nucleotide sequences at the above locations are unknown.
accaacaagaataattttatcacacctttatttccccccaccatgccagaaaacctccaaacaagaatacataactcactcgacgagatattgaaatcatcaggatacatatttgaggtaatcngacaaaacagaaaacaaagccatgtgataactagccccaacaacgaactaatccaaaaatccataacccaactgctcaacggcgaaatccaaaacttccatgctattctagaccaaacagtgtcgaaactcaatgatgcagagtggtgtctcggcgttatggttgaaaagaaaaagaaatttgacgaattgaaagtcaaagaagaagaggcaagaaagaaacgtgaagaagaggccaagaagaaggaagaagaggccaagaagaaagaagaagaggccaagaagaaggcagaggaagccaagaagaaggcagaggaagccaagaaggtagaagaagcagccaagaaggcagaggaagccaagaaagcagaagaagaggccagaaagaaagcagagaccgtcccacaaaagtttgacaactttgacgactttattggctttgacatcaacgacaataccaacgacgaagacatgttgtccaacatggactacgaggacctaaaattggacgacaaagtacctgccaccacagacaacaacttggacatgaacaacatacttgaaaacgacgagctgatactagacgggttgaacatgacattgctcgacaatggcgaccacgtaaacgaagagtttgatgtagacagctttttaaaccagtttggtaattag

SEQ ID NO: 12020 - DNA, 186 bp, Candida albicans
ccctgtagaaactgtttactattacttactgcggaagaaaaaaaaaaactgcttgatgtgaaaggttttcaaaattccatgttacataggctgaacatttttattcttccttcaacacccttcaatagtcagggaataataatagcgttggacgatcttacacccaaacattcttggtgtgcttaa

SEQ ID NO: 12021 - DNA, 186 bp, Candida albicans
gaggatccgatctcaagaaaaagaaatcatcaaaagatgaagtcgaggaagaaagtgaagatgaagaggtgttcactgatattaatactgatacagaagatgaaggagataattaagcttagtttcccacttttgttattcgttcattcatttattaggaattgtaaagttttgattagtctttaa

SEQ ID NO: 12022 - DNA, 267 bp, Candida albicans
gtgataaatatatatttgccaaaaagaaaacaaacaacaatagatacacacaccaaattacaccaagaagcgtcaccaaaaaaaaaaacgacaattgcccaaaagaaaaaagtatacaacttaactttgccacgtgcaattgcaaccaaacaacaagagacagttttacaatactacaacaagaatagactcattacacaattcatttattttttaatggcgtcaaaactatacatcttcttattattcctaccatcatctttatga

SEQ ID NO: 12023 - DNA, 225 bp, Candida albicans
aatattcttcgggttatttcatgcaccatcacaaacatggtaaccggtggcatcacatggataaatgacgatgtagtcttgtcgatcgaatgtaaaactaacgagtttctccatgtgattactgcccacgataacgttcccaacgacaaagaaaacactgaaacaaacaaggtaggcgattcagggaatacccaaatgaacaacattagtaacaagttgacgtaa

SEQ ID NO: 12024 - DNA, 936 bp, Candida albicans
  unsure (169): Identity of nucleotide sequences at the above locations are unknown.
ggggttcaccacattgtccaccaacaggtaatgtggaggcaacagcaacagcagccacattcacaacaacttcaaccaggcccaccgccaattgctcctcaagtattatcccacaatgattatttaccacacaattcatttggtcatcaagaacagccatatattagtntggatcagattaatgctgcccataatttggatttgaatagtgggaatacattgatgccgatagatacttccatatcaacaaataatcttgcatcaacccatcttaacggattcccatatgacgataatatttatactagaggaatcaattcgccacttccgttgcataacaatgcggctttgaattatggtgattataattcgttattgtacagatacagctcaccttctttaactcaaagtaacagtaatttagctgatggggtttggggtactacgacaaataatggtaacaatttaagtgctaacgatttgttgaatccaactcaacaatctggttttttgatttctccatcacaatcaacaaatatttggttagatgataagagtcaaaacttattgttaaatccaacaaatggtacacataccagggcagtttccagtaactcacagatttggagaaatgatgctaccagccttaatggaggaggaggtagtaatccgatccgtggttttgattttggtggggtatctacacaaggcaatggtgatttttcaccatttggtaacaatattagtatccacaaccccactgatagcttgtacggagtcaatctgtcgaatacacaagtgaatgaccaacagctacagtcacagccgcagtcacacttacagcaacaacaaccacatccaaatttgacttctttcaagagtgataatgatgaaaatgattcggttatgggaggaaaagagcagtttttcaaatag

SEQ ID NO: 12025 - DNA, 231 bp, Candida albicans
gtgaataggacggactcgttggtgagtatgcaggacttgttggtgagtatgcaggacttgttggagcgtagcttggactcgttggtgagtatgcaggacttgttggagcgtagcttggactcgttggtgagtatgcaggactcgttggagcgtagcttggactcgttggtgagtaacttggactcgttggtgaataaccatatcctggtgaagtgtaccctggagatgtaa

SEQ ID NO: 12026 - DNA, 255 bp, Candida albicans
aaatactacagaaacttatcttttgtcatttttcgggattttccgcgtcttcttcactttaaattgtttcttctacatatatccatcaattatcgaaccattttatttaatttccagaatggtataattaagaaaaaaaaaaaattaatacctacgcagaacgcgttacgtaatgctttgcataaagcagtatcgtttcattttgtttcgtttaatagagactggatatatttcaaaatgtcgcgtgctttctaa

SEQ ID NO: 12027 - DNA, 207 bp, Candida albicans
tttttattgttttgtggggggtcacattatagatgcaagtgtcatttctccgaagtagatagtcccgataaagaggaaaatcaattgggttcgtattatgaatttatttgggggatccgaagagtcttaagctctgacttggtagcttttgacagttaccacttttcttgcttatctttcttaaagacaagctacttgaatatttag

SEQ ID NO: 12028 - DNA, 321 bp, Candida albicans
attagattaaatattattaaaagtttaattgatggaagaaataacgaaaaagaaaaaaattatccgcgcaaaaatcaccaagaaaaaatttttttttttttgggggatggggatcagaaggcaggcaggcaggcaggcaggaggaggtcgtggtcgtgtcatctatcgggcggatttatgtttaaactatgtgtggccaattctacgagatatcttcatgcggcatccgccgaaagtttatacaacaacaataagaaaaaaaaaaaatacctcatgccaaattattatgtggggctaaaattagtgtttatgtattcttga

SEQ ID NO: 12029 - DNA, 192 bp, Candida albicans
gggaattttcattaccactgtcatcactactactattacaatttatacacattatattaccctattggacttgatttgaatggttctttgatatttagtagttgtcgtcgtcgagacttattttattattttttaagtctatttaagaaattgtacttggagttgaatgacgtgtattgccataaaatttaa

SEQ ID NO: 12030 - DNA, 207 bp, Candida albicans
aaacacacacccatatgcaaaatgtatatggggtgtttggcagtggaaccactacaatttccatcgtcgcccccagattgtcaaatgcctaatattgtattaggtgtgtggtggggaaataatgagaagatttacaggctctggattgaatttatgaaaccatctcgtatgtccttctttcttcaatttctgttgcagggggtttaa

SEQ ID NO: 12031 - DNA, 195 bp, Candida albicans
gaacttgatactttcaatcaagaggaaagttaccaacaccctgcaacagagattagacccttgaacacaaacttctccataaaacgacaatctaaatattcaagtagcttgtctttaagaaagataagcaagaaaagtggtaactgtcaaaagctaccaagtcagagcttaagactcttcggatcccccaaataa

SEQ ID NO: 12032 - DNA, 195 bp, Candida albicans
ctttatgaaaattggaagcaaaaaaaaggttttactccaataaatacacaaaaaatggttgaaaaatcttgcacatcaatctcaagtttgagaaatcacagaaatcatactacatcaacacaagagaaaccaaacagatttagtttaaaaaatcaagccaagaaactgtatgtatgtcgtaaatttccccaatag

SEQ ID NO: 12033 - DNA, 222 bp, Candida albicans
cgagacagtgtaatggtaaataattggtggaagtcacgtgcgcagttgatgcttaatcattttatgggaaaatatcacaaatcacataaaattattactatgaacatactccaatgtccgtatgtgaccaatatcgatattgttgttgttctgaatagaagtctcgcggtttttaatacaagagcatttgattttgtgtgtgcggatggcctaattttttga

SEQ ID NO: 12034 - DNA, 183 bp, Candida albicans
gatctgaataagctgctgtattcagtttactttacaatattgatattattggacaaagatcaagataaagtagaaagaaaaaaagaaagacaaaatcatcacatcattaataatttgtttgcagttagttgcatttcttatgtttgtgtcatattttatattgaaattattgttcgctggtga

SEQ ID NO: 12035 - DNA, 183 bp, Candida albicans
tttttgatcctattcgagaatggtttattgagtacaagatactccacaacaggaaatcgtttgaccagtttaaggagagcagatggttcaagtatctctacattccatacagaaccatcactggatgggtgtatagtagttacgactacattgacagtcaaatccaagaggttaccgggctga

SEQ ID NO: 12036 - DNA, 285 bp, Candida albicans
cattaccataagaatctgaagtttaaaaagcatagttttttttatttcttccatctcagattcaatttcaatttttgtcttgtatcgaaaagtaacaaggaacataaaatcatttcattctttttacaattgttttgttattcattcatttttcaaatagataattcatttcatttacttgcacttattagctttttacaagaaattaaaagaaaaaaatacaacagtattgataaactgcaacctcataacgtcttcaccacgggtaagaaaatccgcgtcccc

SEQ ID NO: 12037 - DNA, 906 bp, Candida albicans
ggagcgtgtttccttccagcggcgctggtgaagaatattacttccctggctattcctgctttatcagattgtattgttgaaggtaattccaatgatcctgttacttcatctattatttccaatatatccaattttccaattttatatgaatttattttcgaaaatgtttttaccatcaagaaaactttatttgaattcataaatgaaaatgttttagccgcttccagaatttcagcaacgggtatttttcacaatgtattactttcaatgctgaacattactgagaatgttgtttttgctattattgcttcgttttatggtatttcaaaaaattttccaattatttcacatgtccaccacaatttcttagaggttgtttccaagttatcgtctactttccttctgatttgttatctgtccaaagacaaacttgaactattccttgaaattccacacatttgtttttccttaattttgaatttccctattttctgtttctccttcttacagaatttcttcgatactcatgttgcatctgctgctgatattgattttcaatctagcttgtccaatgctttcctatttggtataaagtctggctttaccactcgctcttgtttctttttttgggaggaggtgggaagtgtagaccgtaccgttcataaggctctcgaaacggctcatgctaaagttacttctactgatgatacttctcgtaaggatcttgataccaagcttaatattagagttcctgttatttgtcaatatccacatgttccggacgtggtattgaagtcattgcgctcatatttgacaagcaagttcattggtcattacgaagtattcaaagagtgcttgccttcgagtatgccttttatggagtatacccattggtgttgcttttga

SEQ ID NO: 12038 - DNA, 234 bp, Candida albicans
attttccgagtattattgcgtgtagaagttattttttttttaactgggtgcaaattacagacggcacgggaagtatacaataaaaagagaaatgaggcacaaggaggagccgtaaatgtaattattaaacggcaatacaaagccaagaaactatttgcaagtttgaataatcgccgtgtcaaaatcaaaaaaaaaaaaaaaaaaaatttttatgcatgtacatatcctcattga

SEQ ID NO: 12039 - DNA, 204 bp, Candida albicans; identical to SEQ ID NO: 6923

SEQ ID NO: 12040 - DNA, 315 bp, Candida albicans
ttatcaagacaagcaacaacgttatatgaaatgtgggatgactttaagggattagagaaagcacttgaagattatggtatttcggttacagaatggttgaagttacatggtagttcagaacgacaattccgccacaccagaatgaaaatcattagatttattgaagacgtagccgcacgtcgtaataccaatgtcgaagatataaaacaacgtttacataataaaatgagaaacagaataagaccatggacattggatgaagtccaaagaatgttgacggcgaacaaacggattaatttagatgataacagttag

SEQ ID NO: 12041 - DNA, 2082 bp, Candida albicans
ttaaatatgacaatcatggctacaactacagctttgagtctacccagttctgatgtaaagacatttcataattatcaagttttccttccgactcaattaccaataaagcgcttatataatccattgaaagaacaacttatccaactgattaaactacccaatgacttcaactttaaaaagaagaataacaatgccaacaacgccaataatgaaatacttgtcaaggttaagatgtgtggcatcaattacttgtctgatttcaaatcatctgctgtaaataatggtgttattcataaactgaggaaacctattgtacctgggatgagaataatttgtaaaattgatagtataaaaaatattaaatttttagtattcccatttactacatgtcaattagaaaatattcataatcatccacaccttgttcgtcaacaaccattagcaaacaagttagaggacagcaataataataatgccaattcttctgtcgaccataattgtgatttgatctatggcaaagatattgatggtggattacagactcatttgagtgtacccaaaagtttattaattcctattccatataacattagtcttcatgatgtttgttttatatttgacatattgttacctttttataagtttttccaatttgtgaaacctgggaaaaccattattttattaaatgatatcaagaaggaattgaatgaagttttattaattttgaaaatattcaacattaattttaattcgataattattattgatgggaattctttatcacctcgattcaataataaatttgaaacagtttattgtttcaataggaatttaaaatatgaagccattaattattgtgtttccactggattacaagcaacaagatcaaaatatactgtattgactagtttccctgttaatgtcaattcaatgttagccaatcctaaaacccataagcgtcacaatgccagtactgattcaagtattagttccatttcaactttagcatccaattccagtttcaagtctgcatcaatgatgatgggtggtgttaattctggtacatctaataacaacccaaacactattagcaataacaaattcaagaatgataaaactatcaaatatatgcaattgagttatcaggataagccattatgtattgaagttttgaagattttatcagccattaattttgaaagagaagatcaagaaaagcagaaaactgaccaacaacaacaacaacaacaggataaacaacaacaagactcgccagaattggctcatgatggaatcattgatgattatgattataattatgtcgatgaatatgatgaaaatatcaatgaagaaaagtatcgacaacttttaataaatgataatgattcattagttcattctaccagctcaactcatacaggttcttcaacacttcaaatgcattcacaaactgaatctgatccccatggcaatatcaaaaaccatgcaaaaaagaatgaaaagaaggggaaaagaagaaaagtgatcacgagaaagtatcatcattattcttggatatggtgtaataaagatgtttatttgaagaattattacgatttaaatgattatgatgtaaatgatttaaccaatgacattgataatattgataatgagaatgagtatgaatacaattatgatgaatatgggtatagtagtagttatcattatcgtgatggatacgacgatgatgaatatggtattggtgataatcatcaaaataaaatcatcaaacaaatgaatcgattattacaagacgatgtgaatttaaatcgtgtttgttatttcaacagtgatgatcatgataatgataatgattataaagatgataatgatggatatgaagatcctgaagatgtgaatggtgatgataatcatctgtacgagtataaaaaaaatactagcactagtcatgaagataataatgagagtaataattatgaagatgagaatagtaatcaaagttcttcttcatcaggaaatcgaacttataaatcacatcgtgatcgaagttgggccaaaaatattaatgcttgtataatttaa

SEQ ID NO: 12042 - DNA, 621 bp, Candida albicans
ccaattactactacaattattattatatatatactaagatcttgttattgttgtactacaattatatttaagatgtcaggtaatgattctccaattccaggcaatgccacagttaaaattgagcaactaaaatcgtttactagtcttcaatctcaagttacctcaccacaaaagaccatgaacgaaaccaatacccattttcgatatttgttacaaaatacaaataatgaaaccattctagaggtcaatgcggatgaagggccgtcttgtataggaccattatcaggaaaattcaggtatattgcagcacagcctgaagtagatgacaaaaactggagtttaccattgggaagagttccacccaaccaatctgttgatgcggaagttgatatgaatgatgatgatgcatcttacgagtttgttgatggggagaataacgcagacatacaaactgctctgaatactttttggcaagcttataacaacaaaagctccaaactaagtaatgatgaaaagcttgaaatggccaaagaagtttgcaacactttatatgatatggcagatcgatggaatggaaacacatcaaaaaaacaacgtagacataggtattctcctaagtaa

SEQ ID NO: 12043 - DNA, 186 bp, Candida albicans
ctgtctgctttaaatgtcaaagatatatgcaatgtgattacgagattccagagatcttcatgtgatttgtccctgtccaatacattactttactcaaactgttgcatagatgcatgcacttctacaatacaatacataaatgctacttactgttatgttagaacatatttattagttaacaattaa

SEQ ID NO: 12044 - DNA, 219 bp, Candida albicans
agatcattggcgtttaatcatttcactcaatgttactatatactgaaaggttcagtcaaatacaggaaggcaatgagaaatagctatattatttcacataatgagtatccagccaagtattcatttttaactgcttgcttaaactcaatggatccagtaaagaacattggaaaagttaataaattggaaatctggttatacacaatgaatcaagtttag

SEQ ID NO: 12045 - DNA, 207 bp, Candida albicans
gtatggtgttatcaaagaactgcatattatttggctgcggttgcatttgctggtattgttgctgctgctgttgttgttgttgcagctgttgttgattgtaatgatgaggtggaactacattatttgtcgttgctgacgaagaagacggttgttgggtttgaagaggtggcatggcataaagcatttgttgaggctgggtttgggtaa

SEQ ID NO: 12046 - DNA, 285 bp, Candida albicans
aagatacagatttataataaattcacaagggttagcagaagtataaataagtatagagtacgtaaattaatgagtgaaataagcattattggtattgtaagaattgaaatagcaacaataatgatgattgttttagtggtcatggaaactaagatgtattattattgtgttacccgacttgttccaggcccaccaaccaaccaacgtgctagagtcgtgcatggcgtgacacgttctatttttcagttgttagtttctctctttgtattcttttacttccattga

SEQ ID NO: 12047 - DNA, 300 bp, Candida albicans
tgtttaactcgtcgtagcagaatcgtcaaacatgtaacaaatggtttattgttcacaaccattacacagactacattgaaaatttttcttggatccaaaaaagagaagaggtatgcttacatatcctacaagctccgtcggaagttactagtttttatatccgcttccgcttcatcacctcataaaaagaattcgttagaaaataagaatggctttgtgtttacttttcaattaagcatcatttttttacaagagtataaatacaaggctatactgactgggtattgtaacccattttaa

SEQ ID NO: 12048 - DNA, 210 bp, Candida albicans
ttcaacttgcctgttgctttggagctggtggatttgggaaatgagggcaaaggtcttgaagctcctgtgtacaataccacgtttttgtcagaatatttgaatgcaatctcagcagaggtttccacaccagtactcccacctccaattacagcaatattattggctgctttgatctcgtcaccaagctccaaaattgcctttatagtgtaa

SEQ ID NO: 12049 - DNA, 192 bp, Candida albicans
atacatcaaaaaaagaaacataaggagatgttcctattggctgagcttttcttggtaaaaataaaaaggcaattttgtttaaaagagatgtacggtgacgaaatattcaaaaacaagtatgaggcaactagttacgttgctttaccatacagtctggaagttgaagctaaacggacaggaggaaatttttaa

SEQ ID NO: 12050 - DNA, 234 bp, Candida albicans
aaatttgctgtcgccgtgtttttgacagattctccaactgacaactctcaacttgatttcataaattgtcaagtcaatcatcgttgccaactggaagctccttatacctacaccaagaagcaattcaatttacatttcaatcagttgattagtctccgattacttcgtttaaagaaagcaattcttggagaacttgccacaaaattggatattaacaatatagtagaattataa

SEQ ID NO: 12051 - DNA, 195 bp, Candida albicans
ccacataggctaagggaaaatagcgataaaacgtgggaagaagttgaagtagttgaagaagaacaaagattctcaaaacaacacaaaaaagtatatgcagcaacgccaaaaactataaatgaacacaaaaccaaaaacagaacccagatcgaagtaagatcgtttcttcagccacgggctggaaggacccgcgct

SEQ ID NO: 12052 - DNA, 1329 bp, Candida albicans
gttctgttacattgcaaaggtactatcataattcatttgttaccaatgagattattcaattcaattatacttttagcgggtattcaaatcccattagtcttagccaaattagttcaaaatgttgaaacatttgacctcaatgaaaactcacccattaaatgtttcaacctcgacttgattcatgggaaaactcaattaaaagtcgaagccaatggagtaccacaccaacaattgccattgaatgttcatcgaaataccaaacttttacatatggataaagataaaggtgatgacgatttccaagttgaactgcaatctttcaatatttatgaaactttggttgatggatttgagaaggaagaacttcacctttatgaaccaggacaatattgtgttctgttcaatgaaaacaaggaatacattgcaacattccattcaaaagtcacgttggttgaaaacattgatgtaattgatatttctaatgaagcttataaacatgctatctctgctattattggtggattaattattgctggaattgttgccaagtatcaaattactggattatccaatatttctcctatttcagctagaattttttcacttttggtagtttattttggtttcaattctgtgatgatgattttggaatggtactgttattatagcccttcctcatttagttatttgtttgttgaaaactatttcaagaacattgtcggtagcattatcacctgttgggatacttatgtcactattatggtttattttggaagtgggttcaaaaaccttggctacaaggctccatctaatatttcttgggtgaagagaataatcttgggatcacttttatttgtgtcggttgcctcatcttctaaaatcacaaaaactgttttgaagagatcgattattgttgatgataaactccaagatgtctttacttattttgatccaaaggactcgtttttgaaaaatagctttatctcagctgttttcaattcgattacggttattttaggagctggtcttttggtttgtgtgactgttcttccatttgtttatggatatgtcatctacaatagatttaccagaactggtgaacatgtgaatcagcaattgatgaaaaagacattgttatatcatggaatctatgcctggattattggatcggccttgtactattattttgatgcaatgaaattggtcgaggattatgttcctttggttattttatggctgatctggtactctgagagaccatacgttgcattaaagggtcttgaagatgatttaggacatttgaagggtataaaggagttttatttgtaa

SEQ ID NO: 12053 - DNA, 297 bp, Candida albicans
tcagacattgaaggaaggattaagagagtcctgtataggattgtagttgctttctttgttaccttaccttacaccctgtgtgatggttacgtaacgctgaaaatagcgtgtatttgctctagtgtggtatatagaaagctattgtttcgtaacatttctatatttttggtttattttacacgactgtttactatttatagagaagcttattcaagaatacttttatgtagttttatatatatttttaatcaatcattaacaatcattcatcatttcataattaaagtatatatttaa

SEQ ID NO: 12054 - DNA, 183 bp, Candida albicans
cattcattccaaaaaatgaaacgaaacaaaaaaaagaataacaaacaacacagtactactcaacattctcactcacatagcatgaagtgtaccccacagttgctactaacacctatcacttattcttcaagttgtttgtttcactgcatcgtgctatatactcggaatcaaataaatgtctaa

SEQ ID NO: 12055 - DNA, 195 bp, Candida albicans
cacaatttaaacttgatacttgactatttttttttcttttttactttacaaagaaatacatactatacacacacgtacgaaaaccctccacttacaaataaaactcctttatacccttcaaatgtcctaaatcatcttcaagaccctttaatgcaacgtatggtctctcagagtaccagatcagccataaaataa

SEQ ID NO: 12056 - DNA, 234 bp, Candida albicans
catgaagtgtaccccacagttgctactaacacctatcacttattcttcaagttgtttgtttcactgcatcgtgctatatactcggaatcaaataaatgtctaaaaaaatcacattcaaaagtaatatttaaagtaaaaaatctatatgaattcggaatgttcactaaagcttatactttgcaaccgttaaccgtaaccgtatcggatttgaaataccgaacaaccagctattga

SEQ ID NO: 12057 - DNA, 645 bp, Candida albicans
agacttgacccactattcaaattgtcactgactgaatatttttcattatttgatgataatcgattatacaaacgaacaataacttattatcccttgaccattcccaagaaaagaaaattatcacctgaatcaccacaagattattttgaggagaaagtttttgatgttaaagatgttaaatttgaattgatatacaagaacatctacgagttcaacgaatatttgaccaaaatcaaaaagagtctggcccataaattgttatataccaaattggcaggtaagtctagtgccatcattgacacaattttcaacaacgaaataaaaaagagaaaatatttaataaacaagcgtaaggagattcaaatggttaacctattggcagtacgtaaaagaagttctcgtttagaggccaaaaagcaacggcaagaagaattagacagacagagagaagaagaatcaaaatatgctgccgaaagaagatttgaacgaagaatgaaattgaaaaatactgaaaacatagatacgggtaaattgtcaagagatcaaagaatgaagttgagacaattgaataatgagtcaaccccagaaacagaaactaatcccacaccagaaccagaacaaccagaagttatcgttctcgattaa

SEQ ID NO: 12058 - DNA, 258 bp, Candida albicans
ataatgagtcaaccccagaaacagaaactaatcccacaccagaaccagaacaaccagaagttatcgttctcgattaaatttattttttatttgtgtcaaattagtcatcacttcttctttttcttgcctcgccacctacaaatgagtttagcaaccccgctatactatatggtatcattcacttccaaattaaactcagacattactagtgatgaatatacccaagtggcagaccttatggtatctttagccaaacaa

SEQ ID NO: 12059 - DNA, 900 bp, Candida albicans
ctaagaatcacaaaccctggtgctaaattgcttccctttataatcaacaaaaaacgtgtatcgatgttacggagtcaattaccatgtattcaaaagcgaacattatttcaaaagtacagtaatcctccaaggttgtcttatgttgcgaataaaagttacatcagtttgatttggaataatctcattccacaaccattgaagttaacatgtttagtggcatcaggcatagttacatttgtgaacgtgcacccacggtattacatcactctaggtccacctgttggattgctaggattctttggctatcaaaaataccgacattggcagtatcataaagcagttagcaaattggacgtaacgaaatggcaagataatgaaataatcagaattgcaaaatatgacgagaagtctcttgacaatgtaataatgggaatagataatcagtatgattcactcagaagacagattattcaactactggagcaacgaataatcgaatatatactggagcatggcgttgaagacgagataaccagatcatttatatccgacgataatcaattcaatgtccatttgcccgaattggagatcgagagttgggttaccacaaacgtgaagcttgaaaagaacaatgacacagtctctgattttataatgctatcggtcccctattatgattcaaaaaatgtacacactagaaaacgattgggtgtcgtgctgatttatttactacaaatccctcaacaagaatattcaagttttattgattataagattggcattgaagtcactcgtttgagatggatcaacccacaatcattatttttcacaaagcttgaaagtaaagcattaatgcaaagtgacatatacaaatctctcaacaaagaaaatcagaattag

SEQ ID NO: 12060 - DNA, 300 bp, Candida albicans
ctcgatagtaagtttacaataattgtaatcattctacgaactattctaaaaccaagtcaaccacttgcgagaaatcaagtggtaccaaaattatcagaattacctcacggtgagttagacagcgttttgcaacaactagtgattaaaattggaacagccccatatacatgtcaatcaacagagacctatctagctgctattttctatgcatctttatttcttgagagctcagttcattgcgagatatacattccactttgcaaaaatcaaaacgtattaagcatggatgttttcttttga

SEQ ID NO: 12061 - DNA, 222 bp, Candida albicans
gtgaaagttgtattacaagtgggagttatgatctgtgaacaaaattctggtgaatcaaatggactgaaactcagttttggtaaaactgctgacacaggtgatactgcaacagtggtatttatgataaattgtacgattagtagtgaaaataatctgaaaattttcataatggagaatagtgatttagaatgggtttttttgttgttgtgttgtaagttctaa

SEQ ID NO: 12062 - DNA, 195 bp, Candida albicans
tctgttttactttcaaataacgtgtcaacaaaaataaagtttgataagagattttgtcgccacttgtacagatggatagaattgaatgcaaattccggcataaagattaaagtgaaaaacaatttccgaaaaaagaagaaaaccgaagacattagaaaaagaaacgaacaaaagaaaaaaaatttcaaattgtag

SEQ ID NO: 12063 - DNA, 273 bp, Candida albicans
ctgggacagaagaaccagatcagaaataacgacaacaacgctggcccatacgaatccgccaagtacccaagtaccggcaagcaaaagtacattcccaacgccgacaacgacgagatcatgttgatttgcaagtacgatagccccaacacttcatggaacgacgacgtatataatgtaaacaataatatcgaccctgccacaagacaagacaaaagggaaatcaaaaacgccactaccttaaggttctccaaggctataagagtggataaatag

SEQ ID NO: 12064 - DNA, 366 bp, Candida albicans
aaaaaaaaacaaattctccaacaacagtctttaccaatcatggcatcggactgggctgctaaattgagtggtgcatcagcatcgccggagaggaaaccaagaaagaaagacactgagtttaattctcgtgaagtgatggactatttgcacaacaactacaatacctacctcacccacgcaagagaggacaaggaaggcgaaaagtataaggtctacaagtcgctagaatcccctaaccaatggacaagcaagcccaagaatggccccaaggaggtcattagaaaccgtaatggaagcaacggcactttggatttgctctttgagatcaaccggtcagtataccagcaacgcgagagaaataagtag

SEQ ID NO: 12065 - DNA, 255 bp, Candida albicans
atacagtcacgtgaaaatatgtttagggctatagccctaatatacgtgtccttgtacaaatttttggtgtgtctttttttactagttagcaacaatgcgcatcattttttacaagttatagaatgtatgtatattttttctgcttcaatgagaaagcgagaaactgacattttacttaaaggcaagaagtttgagctcagcgcacacacatcttcaccaggcggctggacggtaatacgcttccacccgttggag

SEQ ID NO: 12066 - DNA, 207 bp, Candida albicans
tgcgcattgttgctaactagtaaaaaaagacacaccaaaaatttgtacaaggacacgtatattagggctatagccctaaacatattttcacgtgactgtattcaccaatctttatacaagtttacattttgtggattgctggagtgttgcaaaaaaatatctacaggcaacagtcatagatatgattcaggggaaataaataattaa

SEQ ID NO: 12067 - DNA, 237 bp, Candida albicans
accccaattaatagaaccaccaaatttatgagccaaaacatcccaaaccaacttaatttacgatattcaagaaatcctaccttggcctttcttattgaataccccccctcaaatccagattgggaagtgttaacactttgggatcctttattaagattggaacttaaatttacgaatgaattggcaaatccttatgggaccttttggcaaaaaaaatcttcccgtttagggttcctt

SEQ ID NO: 12068 - DNA, 246 bp, Candida albicans
atcaatgtttttcaatttatcacctattatatttttattgtttattttttgaaaattgctactacaaatagtcgtttatcttgccctacaaataaacaattaaaagaagggaaattgttttgtaaaaaatgtttgttattatttccgctctattgtattaatcactcttgttctacaaagaaatcaaccaattcctattgctccgaacccttgctgttggctttaatagtaactcggaatttttga

SEQ ID NO: 12069 - DNA, 201 bp, Candida albicans
tctaggcaaacatgtaatcaatgtaccaaagaattgaccaaggacttgattctgagcagtctagttataaaatatattgcatttgcttacaatgataaacgtaagtacttaaaaaactgcaagaaattacaaaaactccactacttttcagttaacaccaaatatgtataccatatagctttttctaagttatataaataa

SEQ ID NO: 12070 - DNA, 642 bp, Candida albicans
atcaatcaagaaaacagaaagaacagaaaagctatggattattctgggattacccgtggctcaattcgtgctgaagcccttaagaaattggccgaattgacggttcaaaatccatcttcaaatttaaaagaagttaatactggaattcaaaaagatgatttttccaaattattatcggccactcccaaattactcaactcaaggggtaaattgaacggcagtgtaagtaatggtggtggtgctggtggtagtagtggtgttcgtgatagattatctgaagttgccattgctaaaaaggaatacgaagtgattattgcccttagtgatgccactaaagaacccatgaaagttgactctcaaattcaaactttaatcaacaagtttaaagcttatctctttgaattgccagatcaaaaatttgcttattcaattgtttctaattcagccactatttcaccatggaatttattaggggaaaaattgactactgggttgatcaatcttgctatgcataatatccaacaatatgtacatgaagttgttgatattttccaagagtttattgagagatttttcgactatatgaatctacatctgactcatttcttgattttagcacgggtctgggatgagttgtactag

SEQ ID NO: 12071 - DNA, 192 bp, Candida albicans
tggttctgtagttgttgtagttcacttaaatgtcatatccaatctattttcaatatgtatatctgtatatgtaatcaagaacatactttttacttactgaataagaaacaaaagaaaacctattcaaatttcaaatctgaaaatttttttgtaagagtgcgaatgttcctctcccataacggcatagtgtag

SEQ ID NO: 12072 - DNA, 216 bp, Candida albicans
cgaatagccacaatatcaaaagcgttcagtacggagacttgtgctacactgttgcttgatattgattggtttatgattgctgtactttatttgtgtcaacgtgtcatcgtcaacttattcttatctttgaaacttcaaaatataaacacattggtaaagtgtagacacaacattttaatgactataattagaactgcaaaagtatataaaaactaa

SEQ ID NO: 12073 - DNA, 198 bp, Candida albicans
gtgtgtgtgtatgggtgtgttgttggtatggttttgattaaagtggatataatcgacttatatgtttttaacattcttcaaaatcagctaataatttttctgttgtttctggttttgcctaatgttgtcgcacttattggaaggaatctaattggtttggaaaaacagctagtcacgtgtagcgctcggttcagataa

SEQ ID NO: 12074 - DNA, 195 bp, Candida albicans
ctatcgtcaggaccatattttaaaaaaaacgaaaatcccattacatttactgagattaacagagtaacaaaaaaaaagcttgatagctattttatcatgttcagttcagaatatcttttaaaacttggtttgcttattcgttgcaaatcaatacctgtacatcacttcttcaccgccgaccgcccggatcagcaa

SEQ ID NO: 12075 - DNA, 441 bp, Candida albicans
  unsure (381): Identity of nucleotide sequences at the above locations are unknown.
ttttcaacaacactaaatgttgctcattcaactacatcattacctaatttagatgcagcaaacccatcatcaatcttacctcaatcagcattaaatcaatctgaatattataaagtcactaatggttctatgtgtaatgatccacaaccaagtacatttttatacaatttacataatcattctgctgatttggtcatgaataatgatttggaattcagtaatgcatcgtttgattctattggtggtgtcagtgttagtgctgctgcaacaggtgccggtgccggtgccggtgattatagtcatactaatatcacatcaaattttgcccaaactaatttgcattcttcatctcaacaaagtggcgtattaccaccaccaccnttttcttccaccaccaccaacatctttaccatcacaacaatctcagaatcaatatcttga

SEQ ID NO: 12076 - DNA, 270 bp, Candida albicans
tttgaaaatttgctgaaattaataaagattgattttaatataattatttcttggattgttataaatcaaatcaattgtttttttttaaaaaaatcaatcaatacaatcaatcttccaataattccttataatcaagaaaataaaaatcagaagacaattaataagtgggtacaatttgatatacacatataccatatatatattgcctacaaattattaatcactcataattttagggttttaatatcatttcaccaaaacaacaaataa

SEQ ID NO: 12077 - DNA, 270 bp, Candida albicans
attcaaaaaagaaagggaatagatttattgagatataataatattcattcaaaagtacctaccatttttcattattatttgcttatcttgaataatttggttgggttaagtctattattattattattatttggttttttctattttttaataagaaggttctatttgtttgaaaaaaatattatctatttttttgaaaagtatagaatttcccgggagttgtttattattgatattaataattcaataaatcttcattttgaaaaataa

SEQ ID NO: 12078 - DNA, 249 bp, Candida albicans
tcctccaccccactattcattatctccagtaatcagttcatcaaactaggagatagagaagttagacaatactatattgagataaaagcaaaaccagagaaaactaaatacaaattcagtgaaataaacgggttgagaaatctttttttttttttttttgcatttggtgtccctcaaatttacccctcgtcgttagtatcgttgccccacttttttcttaccgttaacggatatccaagtttttcttaa

SEQ ID NO: 12079 - DNA, 669 bp, Candida albicans
atgattacccatatggttacacccgattcaacttcttcagcaccaaattcgccttatggagaagatacaataaagttgaactcgtcagtgattagttcgtcttcaccagtacgatcaacaagctatctacagaatctacaattgcagcaacaatttctgcaacttcaatttttacaactacaacaacagcagcaacaacaagaccaacaattggctctacagcaacaacaacaacaacaacaacaacaactgcaactgcagcaagctcaaccttatgcaaatccatatttccaaacaccaatagatcaattatttcaatttgataataaccctaattcatcattcaatcctactcgtccaccaaatatccatacaaaccaaccatatgtgtctccatatttacatctggctccacttacaaatcatagtgatttgcaaccacagccacccccagcgctgctactggatctggagttgggactaggattggtaaagcaacaacaagactcattaccacctcaacaacaagcacaatcccaaccaacaccattattaaatcaacaacatccattttataatgaatatattaatgatatgccatcaactcaacatccttatttgattttcaacaacactaaatgttgctcattcaactacatcattacctaa

SEQ ID NO: 12080 - DNA, 930 bp, Candida albicans
aaatgtaagcttgccatcgatgtattagctggtagtgttacgaaaaccatgtgctttattaggaaaacacgaaaaataaacaaacaaaatagggcgcgccttcaaaagtttttttttttcattaacacttgtcaacttttatctctacaattacatacccagctccagtacgaaatgggtagggatttaataaaaatagaagattttcctgagataatggatggtcaaaaacaaggcccaagagtaggcttctgtggattggttgtaagattttatcctagcaggagagactatattggtatggatgtcactgatttcacatcacatcctcgagtatgccaaaaccaagagtactataatggtgggttgttacttgccagaaacgaattacttactataccagtaaaaattgaggcactaaaaaggatccaagtgagttacccaggaatatttggagaacaatataaccttgcagaggaatattattcagccagtggtgtactagatgtacatgacaaactcttggtggttaagatgaccttgaggaccagactatatcaaggattttatgagccgtattcatatgatcaggagattgttgattatgaatatttgggcaacaaagacagactcgtggtagatgatttattccgaaacattgtttcccgtaaagaatatttttcaaaagtctctcacttggctcctaggcttatgcccgcaaaatttttgatttcaacaggccattcttccgaagttagcgataaagtacaacatttgaatgccatatcatcagttcccgacacgaaaatcaatagtccaccccataattcacagtatattcatcctcctgatccaaatactataagattgtctccaacccagattctatttcccgatattagaacttggcgatttggaatcctgccatag

SEQ ID NO: 12081 - DNA, 342 bp, Candida albicans
tccaacacatcatccactactaacagatgcagattccagtggcgcttacagtcactttattctaccttcaaacacttgttagctgaatccagggcactcactgtgtggtcgctaaataaatctactagaaaccttggcattgcatttttgttttcaccacacacttttgcacacactattgttaataaatttagcagccaagctattacacaccaccaatgcatatcatggaccaactcaagaactaataacaaaagaacaggtaatcttcaattcaataaagcaacttccacatcattaactatgcccaacaaatcaaatgcaacaactagtatacaataa

SEQ ID NO: 12082 - DNA, 186 bp, Candida albicans
aatttacatatttccaaccgacgttcaaatgtactattgcaacataattctattttacattttccgcatagtctttttattagtaagattagtaacatgaaggttaaattttgtagttgtagtccatcgacattgtcaattgtggttcaatctatcactatgtgtgtaagccatcgtaagtgttga

SEQ ID NO: 12083 - DNA, 492 bp, Candida albicans
gcaagtcgcaatcagtgttatgaatttcacaatatggatacttgcagtggtgtttatcacatttatcatcatctttgcaatcatcgtgacacttatcatcaccatccttacacttgtcatcacattttttgtctttgcatttgtcatggcatttatcatcatcatggcatttatcatcatcatggcatttatcgtcatcatggcatttgtcatccttgcaatgatcatctttgtgtttgtcatcacacttgtccttgcatttgtcatcccatttatcatgacacttcttatctttgtatttatcgtcccatttgtcatctttccatttattatcgtcaccaccagcaaaaacatttgtacaatgtttacatttggagtaaggataggttccatcacatccatgatataattgaccatcttcaccttcataaactaaatccaaatcagtgtctttacagaacttctcatctttgtgatatttccattctttaa

SEQ ID NO: 12084 - DNA, 270 bp, Candida albicans
gccctttttttgataccccatatatattctgtcaataagcctcctggaatgttgcagtttaaatgtagtacattcacaaagaatgtaatatatttaaaagtggcggctctcattcttttgcagcatcgaatatcaagtgttcttcctttcagtgtaagtgaaaaaactgttgaaataactaaaaaagagtctcctattccaacattacatcttaatttgcaaatggatgtacgtaaacaattcataagtacaaacgaggcaagtgtgtaa

SEQ ID NO: 12085 - DNA, 321 bp, Candida albicans
  unsure (289),(312): Identity of nucleotide sequences at the above locations are unknown.
agaaaatcagaatcgtatcaagggtttagcaagtatgcacaagaaataaatgcatatcacaacccaaatcagcatgctggtttgccaattaattcagaacaaccacaacgagcacagtcaatgaccagtgctggacaggctgccgctatggcgttaaaattacacagttccccccagaaatcacaacaacaacaacaaccacaacagcggacagccgctcaaactcaatatgcaagggcacaatcattgacttcgggaagatccaattcaatgcgacgacatacatttnatacgcggctaaccgccggatgnggacatgtt

SEQ ID NO: 12086 - DNA, 207 bp, Candida albicans
gtggtaggatcggcttctaaaatcaaagaaacggctatcatggaagatgacgcacatgtcataacctcagatcacttactaacaataaatctaatcagaagaagaaatctactattaactattagtactgaaatgtgtagcaatcttgaaataagtaatatgcaggactttttattttgttttgattttaagggaatttcagtttaa

SEQ ID NO: 12087 - DNA, 348 bp, Candida albicans
gtgcaaagtgggggtacgagagccaccgctgggacggtttatccgatcctgggatacggttgtgccggttgccaacgcttgtaccattctctagtaccaacttacatcctggggactgatctactgccacccttggccagaaaatctgggctggcgggaacaagggctggggctgagatcaagcttgggccagagccagagccagagccagagccagagccagagccagagccagagccagagccagagccagagccagagccagagccagagccagggtcaggaccagggtcaatggctgacgtccctaagctcaagggaaatggccaatcccagagcagggtctga

SEQ ID NO: 12088 - DNA, 192 bp, Candida albicans
atcaaacaaaaatcattagaggaaaccgtagtggctaaacagaaaatgaacaattatctcttgttatacaataatgccaaatttaccacagacaataataagcatgtctattgtctgtgcatattttcaaatgcttgtggcggtaatgtaatactcttgagattgctgttgtgtctcacacctattatttga

SEQ ID NO: 12089 - DNA, 204 bp, Candida albicans
atggacattgatttggaaaaccgctttaggagtcttataatttatagcagcaactttattatgagtctttttttatgcttttttaatttttatttttattttttgattatttatttggtttcttttcctcataatgatgctccaataatattccaaacagtagtagtgagtagcgcccaggttatccactctgttacccgatga

SEQ ID NO: 12090 - DNA, 189 bp, Candida albicans
ttgaggttgttcacttttggtacagcaactactgttgttgttgctgatgatgatgacgacgacaagatattcttgggagatgtgttttcagaatgtggagatctgggtttgaaaagtgtggatcgagtatcactattattaccagtgttatgggtagggttggtattgacattaccattcaaacgttga

SEQ ID NO: 12091 - DNA, 198 bp, Candida albicans
agtatcgttgtttgttgtaattcttgcaactaccttgtttgtcacacatttgtccctccctcctttagcgtgtcgttaagattaattaagtttactaagagatattggaaagaagtgtttgtagctataagcccaaggttttattgtgggtatgaatctacgaaaaggaagaatggaagtggcgtaggtgtggaataa

SEQ ID NO: 12092 - DNA, 219 bp, Candida albicans
tacatccaaccctctccatatccatacttctacaatatgataactgatgaacaattgaataccattgcattgacatttggttttgcttcaataatattaatcataatatatcatgccatatctactaatgtacataaattagaagatgaaactccatcatcttcatttaccagaacaaatactactgaaactactgttgcaagtaagaaaaagaagtaa

SEQ ID NO: 12093 - DNA, 303 bp, Candida albicans
ggttgtgcatggtgtaacaatttccaatacacacacaaaaaaaaaagaacttccattatcaaaacaatttttgaggttgatcaaatcgtgagaattgatttttggttgcaaaaacttatacaacaaccatcaactaagacaacgatcaatacaaagcacaaaaaacagagggtaatcggtatcaagtactatactggaaagaataagaatcagttaattattaaagtatcgttgtttgttgtaattcttgcaactaccttgtttgtcacacatttgtccctccctcctttagcgtgtcgttaa

SEQ ID NO: 12094 - DNA, 234 bp, Candida albicans
tgtgaggacatacagattttgatcaaacgagttttttttttctctctctcttctttttcctcccttttagttagtttattcgttgaggtctctttttattacttcctggcacacctgaaaaaaaaagccgcattagattctaatttaggaaaaaagagaccaattgaacgaaaatcacaacaaatgaataaactcaatcaaaaaccacttagagtacggcgaaaagtaggataa

SEQ ID NO: 12095 - DNA, 258 bp, Candida albicans
attagtatttataatcaattagagctgagaagatgtgatactcatccattacaaatctttactaaatatttccgctcggttagtaatttaagcgatcacgcagagcttgctcttcggaaatacttttttatttgggtttgtgtgcaggatattgatagtttggatttccgacgcatcaccaatcaggaattagcttttattaattatttcatcgctatactaactaagtacacacacacgctaatggaaatgcaatag

SEQ ID NO: 12096 - DNA, 420 bp, Candida albicans
  unsure (205): Identity of nucleotide sequences at the above locations are unknown.
gaattgaaacactcaagttctttaaataagatatccgagtatgaaaagaatgggattattattggaccaaaaattgaaaaagtcatccctgtaaatatcccctcatctcctgtgaagccagaaccaagtcataagaataaaccgactgaagaaaagaaatctagttcaagtctactttcatcatacgtgtccaggaaacaagaanagaaactacaggatacaagatctggaacattatccaattacttgttacgaaaaaccgaacctacaattccaagtaaaagatctaacacagaacctgctacaaaaccaacatatcaatacaaatcacggaaactcgaagctaaagcaccaaaagagagagtgattattgcagaatacaatgataatgaaaaacaagatgaattatactatgaatag

SEQ ID NO: 12097 - DNA, 462 bp, Candida albicans
ccagttttagcctcacgtgctacgaatacatcagatcttcagaggatgtttgatggtgacgattttacttttagtgacgatgatgaatcaccagaaaaggaagtcagagagacagaagaaccaaaagatgaagataaaaaagatattttacctgaatcaccgaaggaagaacaacaaagcaaggaagtcaatcctgagaatgagccaggactttttgttaatgaagaagaagaagaaaaagaggagaaggaacaagaagaaactcgctctggagaacaagaagaatttattactgaaaaagatgaagaaggatatcttattacaagaaaagtgaagcctataaccaaacaagcaaaacccaagaaacaggttgtcccaccaaaagtcactaaaccttcaacggggaagaaaacaggaatgaaacaatcttcattaatgagtttttttggaaagaaaaagtga

SEQ ID NO: 12098 - DNA, 1419 bp, Candida albicans
actacaacacactttatgaattttgcactttcatcaccacaaactcctccgcccaaaaccaagcttcccagaataccaaatgcaccacaatcaccaacaaaattacacaccaaatctctacctacagtgttagaaatgacaacatcaacccctgaaaaggtcgctgtgctgtcacaaccagtatttccaccattacgtgcatttgatcgtgcttggtctttaaccactgatgatagtcatattccagtttatgatctactcaaactattacataatttacgattagagtcacttcatgacatgcacgaagataatgaactaattcacatggatgatatggtgattaaatcacgaatagttgagcaaacagagtttttggccaatgtccataaagaacaagcataccagataatataccagagtttatacgatgccaaagaaattctgaaaaatactgggagtctaaatttgcaatatgatatttttaacaatcaatatgatctgatgataatgatggcaagtaataatgggagtcaggaagataatgacgacgaagattatgatgagacagcaacgttaatggaaatgacccagaactctccactacaagaagactatgaggatattcttattccacaacaaatatcaaattgggtaaaaccaaatataaaactagcattaacagaattagaacagtttcatattaaactaaataaccaatatttgggtttagaaaatgatttacgacaaataaaactgaaaaatgatttagatttaaaggagttgcaagttttggttgggaaaaatgatcatttgataagtaaattaaatgatattagagatgaactatccggcatcaataattgtttaatggagtatagagaccaatttgatatggatagtttcatagcatgcgataatgagaaaacaaaagaatggcaatcacagttgttgaataataataatgatagtaataataatgaggaattaatggtttcctgtttccaatctattgacgtaattgagaaagaagtattagaagtcgatatcaaactgagttggtcccttgataatacccctcttacaacagaaataagaatctctgccaaggatcatattttagtgtctgagaccaaagaagctacgcctgacgtgcaacaagttgcagagactgtacctaaaactgacaatactagtggtattgagacagcagatacagtacagcaaacttccattataccgataatgtctgacaatggaagtagtgacgacattaaagagtcaaatttggtaaaatctcacatttcaaatccaaatgtcacagaaattaagaaaaagggaaagcttagtaaacatagtcactacattgttattgtggctataggtgtaatttttgcttatgttaaaagtatgctctaa

SEQ ID NO: 12099 - DNA, 1392 bp, Candida albicans
aaatgcaaatcatccgaactcatccgactaattcatgaaatatcagaacgacgaattaatagattatgttccacttcgtttataatattacaagagttggaacacattcaattgaagtttaaaagttgggagtttttatcactagatttcaattcagataatcatttttcaaacgatgataataatattaaagatttcaatgccggcgttgcaaataaggttataagtgcttgtacagatttgaatgtcaaaattgctaaaatatcatccgatatcgatttaatcagcaagaattctagaaccctttcaccaaaagatctaatgagtgatgcagggacaatgttgacttcattgctactacgaataatcaaattgaagaacgatgtggtggagcagctaagtatttcgtattcgaaagccagattaattataattggagaagagttggaaatgtgggaagatgaaaacacagtgatgtattataaatcgttcatcgttgcattgctacagcagctaaatgatgccgtagaacagggagatggtgatgcaaaatacgaatgcttagctgttattaacgatttggaaaaaatgtttgaaaagtgtagaatagagaaattaattgataaaacattagaagacagtcgccacgagcacgatgttcaagaaaaacaaaaaggagaagaggaagaagaggaagaagcagtgcaagcaaaagcttccgtagacgaaactatgacaacaatggcaacaacaccacaatcgactatttcaactcatggcaaaactcaagaacatctccagcaccatttccgatacgaagatcatttagatagtgttgattctgaaacagattattactacaaacacgaaactagtcctgatgacatgtattccgaatattcaatgttttcaagctcaccacaattaccaatggttcattcaatcactagtgtcaaagaccaagattccatcagcaattaccatggaagtattactgaagaattaccatatttaatgactgcattcagttctgctaaaaattttacaaacgatgttaaacattacaaattagaagaagaaaaagagaataaaccggtgaaaacaaaaccaattcctgtagcagttaacccatctcctcaacccaagaagccatttttccataaaaccaacttacccaattcttccctctactccgagagtaacgtcattcaccctccattatattcaagctcagttttgagaacatttggtatcaagccccaggtgattagcgttcctaaggatgcagtagagaaaaagaaaaccaccaaagacaagccattattgcttaccgaagaaaatatatccaacttgacacaacaacaacttcgacatcacgattatatatattga

SEQ ID NO: 12100 - DNA, 969 bp, Candida albicans
aaaaagtttttccctcctccaagcctggcattacaaacaaatcaaaaacacgttcatggtataaatataaaaagtcccttaattcagaatcgtgcaaatacattcgttcttatgtcgtctactagtatggatattgatatctttgctaaattggcaaaattgccactggagattattacaattatccttgattacttgcctaaatgtattttgccaaaactcttgtatttgtcgccaattaggaaaattgttgcttctgcaattttattggacgtggaaatcactgaacatgtcaaaaggcacgaaaggagtaacgagccaggcgttggattctccaagtgtgactgtgatcatatgacattccaaccagaatgtttgaaacagggtgtcaaccaatggaagatatttccgaggattatccacttagagtacttttttgcatttaaattgacttataaaatttttccagaggttttatataaagctctgaaagttaatgctactttttttggttatgatagttgtgaccctgattcagatttaaagcattttgcagaatcaaaagtcaagtttgattcgcttactttgcaatcttgtgagcatgtaagtgaattacccactgttgttacaagtcttgaattagacgagacgatattggataactatgaaattgatgggctaaaaaaattgatattggatctgtttggttacgagaatacaacaacagagtattcgttcgcttcatctttggaagacttgaccatcttagactacaaaataactaaaataactttgcctccaaacttacgcagattgtatatcagtacattcctaaaatcagtagattttgtatctgaggaaatgcctcacttggagtatttgctgctttcgttgccggatgtcaaaagccttgaagatactggaatacatgctcctaacttgaaaactcttgaaataaacagtcgttag

SEQ ID NO: 12101 - DNA, 195 bp, Candida albicans
tttatctcactcacttggttacccattttaggggatgaactcctgtacaggatcagacaagagaaaaaaaaaaaaagagaatggaataaccccgaaattgtaaaggggacgaatcaactaaacaacacaaggcggttttctcataccaataaatcaaaaatcaaattagcaacaccaaaaagatgttgcaaatag

SEQ ID NO: 12102 - DNA, 219 bp, Candida albicans
ttgttatgtatatctacattgaactatcctaaaataatcttacttaaatgtttcatgaagacaaggctttataggactttgttgaatatattgaaagaggatgataagcctcggaaaataatgttccatctcgcttctattcgtcacaacagtattactcaaaggatgagtaaacatcggttaatgttgctaatacaaaacaaattaactatgtattaa

SEQ ID NO: 12103 - DNA, 231 bp, Candida albicans
gcggccattgttcatgtttttgtattgccgttacttgcaaagggggccttccagctacatttacaattgaatcaacaatgggttatggatgtttttttccttttttttttttggttgcagtcaacatctcaactacaattgccttttacgagtgacatactattaagcttagaaagtattcatgacctgctaatgccaaaatctaaaagcttttttttttcctttctctaa

SEQ ID NO: 12104 - DNA, 195 bp, Candida albicans
caattgggagtaacaatttctccgaaaaatcactccacggcaggtcgtgtcgaaaaatgtgcacaatcacacaatttcaccgaacaaaagattctggggagcagagtaagccagttctcctgtctacacggtttagttcgccgttgtttagctctcttacgtagtctatttcattttaggtgtatatttgaataa

SEQ ID NO: 12105 - DNA, 219 bp, Candida albicans
ttgcagaagagtcctggcaatgcatcgaacgatgtgattgccaaacacgtcataaccgacgctaacgtgaaaaaacgagtcacgggaggtattctctggatgttttcaacaattgtattagccatggtggttagtggtgaagaaagaaagaaaaaaaaaaaaaaaaaatttccaaaaaaaaaaagttgtctttttgatgatacacacaccacaacatga

SEQ ID NO: 12106 - DNA, 216 bp, Candida albicans
ctgaccaaatatttgacagatcgagaaaagttcattaacaacgaaatattgccaatcaaacccaatgctaatgaaactgcattcattacaactacttttggtatgtcagggacatttttcctggtaataatgtccactttccaatgctcgactaaagcaacgatcgatatcatatttgccaagggacctagacatgcggcaatcaatggaaaataa

SEQ ID NO: 12107 - DNA, 192 bp, Candida albicans
aaaaaccagaatagctctattatcacaattggacaaagaaaacagacatttaaccctgtaagaaagctttcacgaaatgagggtgctaacacgcaaagtaaaatccagacacaagaatgtatcattagcattgactattgcagtattcatgatattttggcttattggcgcgctaatatttcaaaaaattga

SEQ ID NO: 12108 - DNA, 228 bp, Candida albicans
gatgatgatggtgatgatgatgatggaaaatgttgtctatatttttttttatgggttttaattgattgggtttcacaattgggaaatttttctaaaaaaaaaattaattgtatgcttattggagagagagagagagagagaaaacccaagatgttttttattaggagtttattaaaagaatattggaatttgggtaaagcaggaaaaaaaaaaaaaaattttgcgtaa

SEQ ID NO: 12109 - DNA, 183 bp, Candida albicans
gtttttattttacattttgttattttgcatggttacagggttgattatatttcattttgtttccagtttaaagttatttcctcaagtcaatttatagaaacttttaaaatacataacatgcagacatatatacatataaaagtatttaaagtcctgaccaaaaatatgatttctctatggtga

SEQ ID NO: 12110 - DNA, 210 bp, Candida albicans
ctgtttctaatcaagaaaattacgaaatattttaacatgtattatatactgatatatatatctttgaagggagatgttgaatcaggaaaaaagggtacaaaaaaaaacattggtcaaattaattactaccataatatacaattatataaaccctttaaccttcttcatttattctttagtaacattaataaagaacaagataaattataa

SEQ ID NO: 12111 - DNA, 183 bp, Candida albicans
catgctttattgctgtgtgtaaaatattcgagatgtgaaataatttttcacattcaaaatatccacgaaataccagacaacacacctattctaaatcatataacaatcttttcttacaagattaattcaatgttcaagagcggtacagtaggttttcaacgagacgtgccggatccgatggaa

SEQ ID NO: 12112 - DNA, 225 bp, Candida albicans
  unsure (50),(51),(144),(185): Identity of nucleotide sequences at the above locations are unknown.
tcacgtgacaagataataatgggtaagcataacattgccgagttatttannagaagacaacaacagcgattgggatcggtaatgaattggtctagattgttaaataaacgtccgataagtcgaatgaaaatccgatttctgtcntattgtttacacagtgtttcattttttgtttggtcggcatntgattcgttctccttttggttaccagttcactttaagtag

SEQ ID NO: 12113 - DNA, 315 bp, Candida albicans
tcaactccaagaaaggttactttttgcttgccccccctccctttatttctatcaaacactttaactatggataaattacaagaaataatagaatttccagtgacgattcctaatcaaaggaaaccatatcaattaattcaaacggcatcaataattaatgttataacatcattaataattggtataattactgattcaattcaaaaaatatgtatttcatttataattcaatttattatattattattattggtttcaccaaattggttatttcaatcggaacagtcattggaatggttaactgtgaaattttga

SEQ ID NO: 12114 - DNA, 234 bp, Candida albicans
cgaccattatttccattcccaactacaggtgcggtaattgctgataaggcaccacgtttaaatccaaaaaaatcactttcaataatgtcactaccatcattaaatgataatcttctatctgtacccgaagttaatccagaagtatgtcctgttgttcctggtcctgttgacgaagataaccgatcaaatgattttgaattggcgaataaccgatttacatctggatcaacttga

SEQ ID NO: 12115 - DNA, 225 bp, Candida albicans
aatcaaggaaaatgtatcatcgggacgctacccggctgtcctctttgcgaaaatttcaataaaacaggttttctggtagtttacagtttattttaccaaacaggtctgaaggaattccccatagaaagctcgtttccatgttattatggtatagcaaagagatgttcaagtgtctttaatctacacagtcatacactattattagcagagcaggtcttaaattga

SEQ ID NO: 12116 - DNA, 297 bp, Candida albicans
attactatcaaaatttggcaaccaaagatatatacaaatatttttttccatataaattacaatcaatttaatattccaaaacaactacaacatattattataatagtaacaataattgcagtaccaatgggtcatatggatgttaatcatacttacactttatccatgcagctatatatcgaggttttagttcaacaaattatcaattttattacgtgtaattgcttttcaacgatcatagttaatacaaatctttatcaatacaagattttactggatttatattcagaatcataa

SEQ ID NO: 12117 - DNA, 276 bp, Candida albicans
caaaatccaagtcccatatatttgctgaataaatattttaattttgttatgaagagcaacaaagaatgggttactactattcacaaagctaaattcttagaattaggttatggattggttaagactactttggtactgtggataatgcttttatacctgctgttcccaatccatgacaattcattgttttggccgtatggttttatcctatccaacagtggtgctgcattaatagatgtcttggatttggttccagtgctagcttttggtagatga

SEQ ID NO: 12118 - DNA, 219 bp, Candida albicans
aatggcagccaatggaatctatactctattggcactaatagtattaacaatcattgtcattttgttactaataacctcaaaagaaatagttcatatctcataactactgaatattatagaaatattgacattctttcccaatttgtaaaccatgcttcattgaatttagagggactctcattcttaatactcaatcatagagaaatagtcttgggataa

SEQ ID NO: 12119 - DNA, 321 bp, Candida albicans
ttgttggcactgcttgttctggggacacttagggaagatcctgaaagtatagtacaattaaatagaaattatcccgccattttcctaatatttctaatacttctttcaaacaagctagtatctccttcattactaaatagctttacaagttattttgtttcaaatttgtgcatctatttttatgctgttgaaatatcagtttctttttgttatgccagcacaagtgttcggggtcacttaaatatacaaggtggtattagatgtctcttgaacttacacttagctcaagtaccagtgaacatcatggtaatatgtgaatag

SEQ ID NO: 12120 - DNA, 225 bp, Candida albicans
gttcttagcttcaataaccaaagcaaggtgacaacaatctggccaaatccagaacatcatctaccaaaagctagcactggaaccaaatccaagacatctattaatgcagcaccactgttggataggataaaaccatacggccaaaacaatgaattgtcatggattgggaacagcaggtataaaagcattatccacagtaccaaagtagtcttaaccaatccataa

SEQ ID NO: 12121 - DNA, 741 bp, Candida albicans
aactttttattatttgctatgctgaagaattgggacataaacacatataaacttagagaattctctgattcattttatcactattgttgttttctcctcttttatatagacccttttatagcttggttactgtttgattttttcgtttccataaccactacaatgctttttccaataattttaatcttgtcaatttttgcaaattttatacaatgtcaatttcaaccactgtctgaaccattcattttagctgcttatgatccagattattccccgtatgatgataataaaatcatgaatcaaaacattcaaagatttggttataataagacaaaagtcatcttgtcgaaacatatcaataccaccaatatttatcttgaaggaagaatattggataattcaagttatcaaattgatgctactttaaaaggaatgtttattcgagttgataaatttactcatcgattgaaattatgtcctaatgggaaaacatcaaaatatttttctattgaaaaagatatgttattttataagaatgatactatttggtcagtttgttatgatgaatttgaagatgtttcatatatttatcatggtagtattgatgataataaaaaatattgttgtcctgataatggcaaagaaataatcttaagaactttgggtaaatatgatgcaagcggagctctacctgactatacaaagcatcctcataaaaaaaacagtaacgtcttaggttag

SEQ ID NO: 12122 - DNA, 540 bp, Candida albicans
ctgaggacgaagttggtttggtttaacttcaagatgaacaattacttcacaaaatatatacctaatataagattatctaatacggttgattctgatgatcatactatcggcaactcgaccaacagtctaccgcatataaattacataattatttttaatccaacatttgtgtcacccaaagccgaatctgatgaagagttaattaaacaaattatagtattcctacaaggtaaagacttgccagaatcacaattttcacaaatagaacaattgaaattaattggtttattgagaggaattgaatcgcttggtgaaagtttttccaattcaaccacgtccacaacaacaggtaaaaaaccaacaattcttaaatcattggattcctcaactgtaatgatagaattggaatccaactattttttagcttgcaatatcacaatcagctctcaaatcaatgatcaaactgtcaacgggattaaccaacagttactaaaatcaattatgcaatcacaacgatatgttgaattattcaataagtcc

SEQ ID NO: 12123 - DNA, 222 bp, Candida albicans
ttaaaaatgataatgtttgagatttatctttatgaacaaggagttaataatggaacaaaatttggtttatatttattggaattggaaaattttatatcatatggatcagaaggtatactagcattctttagtagtataacattagtcataataaacaatggaggtattaacttcttgttaaagtctttcgagggaaaagtatattatttgatggtttggtaa

SEQ ID NO: 12124 - DNA, 192 bp, Candida albicans
ctaagcaagacgttcattgttttctgtttatcgttgccttgttacattttgtctatgacaatagaatctaaaaataaaaacctgggcagtagtaccgtaattgcatcaaacctggaacaatttgcatatttgaatgaaaaaataccattgtcctatttgattagggctttgtttcatgtacttattcgctga

SEQ ID NO: 12125 - DNA, 219 bp, Candida albicans
aaaaaaaaccctcaaaaaccaataatactctatatatttggtaaattttcgggtcagaaatcattatcattatcatccatcatccccaaatctattattattattattattattattattattttgaaccacactaaaataaaaaaaaaacaaatatgtcataattatgattttagtcaaactctcttaaccttcttggttttgattgtatggttgtaa

SEQ ID NO: 12126 - DNA, 237 bp, Candida albicans
acacacaagccttgggagttaaagaagaagaagaagaagaaaaagggggcgagagagagagagagagggagagaggaaactatggtagtaaaaatagtgagtgagtgtgagacgccgaaagtgaaagaagggtcgtgtacatgttatgtagttgttgtacacgacttagatagaaaaaaaatttcttttttttctttacccttcccgtttagttattcattgtttttgtgtgtgtga

SEQ ID NO: 12127 - DNA, 294 bp, Candida albicans
ctaactaaccacattccacctaacatatattctacatcccattacattcgtttcaacaatcattttttaacaacacaagaatcaatcaaacaatcaaaacaagaaaaaaaaagaagagaatttaaacaagaatcaagatcaaatacaattagtataaattttttttttcttgtttttcttgtaatttctttcgactattctattctattctattctattaaggaaatctttatacaagaaaatcagttactttctttgttgttcatcatcattataaacattttttcaatttag

SEQ ID NO: 12128 - DNA, 666 bp, Candida albicans
ttttttctccctattatcatggtttcattaaatattgattcaattggtattattggtgctggtccaggtggattagcatctctttatgaatttttacatacaaacaaagatggtacttctacagtaggtactggtaaaagagctgaaaccccagctttttctaaaattgttgcttttgaacaaaaagatcatgctggtggaatttgggctcctgctactcctgatgctgatttacctattccacctcaagaaattttaaatactgggaaatttaatgatccagctataattagaccaagaaatgaaccacctcaagaaattaatggtgccactaaagaaaccccaattgttgttgctgttcctaaatctaaatctaaaaccaatgataatttacaaaatgaattagaatggaaaaggagtggagtttatccatatttatcaactaatattcctagtagatttacaagatttagttatttacccgatgaagaaaaatatcatgataaatcaagacctatttatccatttttatatcatcaagaattatcacaacgattcactgattttgtcaataatgaaaatttacatgaatttattcgattaaataccactgtggaagatgttcataattcttcaacctacgggaactggacggatccgcgctta

SEQ ID NO: 12129 - DNA, 213 bp, Candida albicans
  unsure (171),(192): Identity of nucleotide sequences at the above locations are unknown.
catcttacacctgaaaagttcttttgcaacaagacaaaacaagaaacttataaaaatatttatttcaaactatataaaagcttcattcaatctaatggtgccatttctggcaaaccatttttattgagaactaaattgctattcaaaccaattgctccgtccttttttctnttttatgaggactggcagcanttagtggctcggcagagatta

SEQ ID NO: 12130 - DNA, 237 bp, Candida albicans
gaaagagagattgtaaaatttcccctttttttttgttttctcgatctttccttcaaaagagtttccatcgattgcttttatacccttgagttagatttttcaacagcaaaagagacaacgccatctgaaaggaaacaattactccatatggaaagaatatgcggcgtagaatttgagagaaaaaaaaaagaacgcgggaaacgaaaggatattatttccaattttagtgcgggataa

SEQ ID NO: 12131 - DNA, 219 bp, Candida albicans
tgtctgcattatcagatcttaaatttcaatgaatacaacataaaagacgatacctttgttctgtccaatcataaaatttgcgcccaaaatagtttaccagatgttttatatgttcattatttgccaccttcagatcacagtggtagtctcttcttaattagtaatcaatcatcatgccaagcatatgtcgtttcaatttctgttgtgaattctttttaa

SEQ ID NO: 12132 - DNA, 222 bp, Candida albicans
tacacgttctttcaacttttcgtaattcccctcaaatgtattgactcacgtttaaatgcaccaatatttcatcaagaggatacccgtcttttcagttgctatcaatttacccgtttgtacattccaatggaaggttcttctaaaatcgaaagaaggatgtggttaactgtcttattggtgtgttgtcccgctatatatagatgtcctttttttttcttttga

SEQ ID NO: 12133 - DNA, 186 bp, Candida albicans
tggaaattaagtgcgttgttgttgtggttgttgttggatgctttagatggggtttcaaatttcgatggatcaattgatcctactgtacctgacatattgttgatgttgttactgcgttcacgttcaagttcaagttcaagttctaataatgttgatagtttggacggtgaattgttatatgattga

SEQ ID NO: 12134 - DNA, 954 bp, Candida albicans
  unsure (110),(116): Identity of nucleotide sequences at the above locations are unknown.
aaaatcttatccttttttaatattttattttcattttccttttattttcctttttccccttttttttatcttcttataatgagtgatatagagttgattaatcctgatcnatatcnacaaaaaaaaaaaaaaagatatcaagagacacccatactacacaccctacaacaacaacagcaacagcaacaatcatcttcaacgtcaccaaagcaaccacaccaacagcaacaacagtatagtataaatactagcagttttccttatagacgatcacctttacatccaacatcaaaattatattcacaaccacaacaatctttcaattcagagtgggtagaggatcaatcatataacaattcaccgtccaaactatcaacattattagaacttgaacttgaacttgaacgtgaacgcagtaacaacatcaacaatatgtcaggtacagtaggatcaattgatccatcgaaatttgaaaccccatctaaagcatccaacaacaaccacaacaacaacgcacttaatttccactacattaataccccagtttctcatcacaaattagatatcaataataccaccactaataaggacaactaccattacaatgacaatgacaataacgatgaatatattgaaaaggcatcgaccacatcttcttcaaccaccataacaaccagattaccaaaagttagtaattgggatattttttggtcaatgcttaatgatcttgttggtaaagacaaaatggccaaagttggtcaatatactttacgattattagtttatcatgctgggaaatcacaaacttatttatctgataataatataaatatcaaagtcattaatgaacggtataatgatactacaaaaaaattgaatgtattgaagaattttttcaatcatccagctgatgtcattaaaaatcattgttattttgattctttcaatttttaa

SEQ ID NO: 12135 - DNA, 279 bp, Candida albicans
agaattttttcaatcatccagctgatgtcattaaaaatcattgttattttgattctttcaatttttaaacaaaaagctgccgggatgattaatggattatcaatgtatagacaatttcttcgaattggtaaaactacattcagaattagagatgtaattgttaaatttcatcataatgtgttcaataattcttccgataatcaagttcaaattaataaatcaaaaatatttgatcgtaaaactttgggaacaattttaactttaaattatgggaattaa

SEQ ID NO: 12136 - DNA, 456 bp, Candida albicans
cctgggcattgtgaaacttgggttagcctttatataatgctttatgaaaatttacaaaatttattacaacaagaaatggatttaaaaattcaaattcaagttaaagataaagctaaacaattgtcaaaacaaattttattaggtgggaacgccaaatgtaatgatagtggtggtttacttgggtttaatatttcaactattccaacggtgaatagtgaagatgctaaaaatttgacacaaattcaattcaagaaaaataatgcttggatagatatttataagaatttatcagatttggcatttaatacttatacagtgtttaatattgccttaccttttgatacttggcaaatatggatgggtattagtgcttcagtattgagtactattaaattatatagagaaacaaagcaaaaaatgattgaaaaagaattgacaaaattgaaatcagattga

SEQ ID NO: 12137 - DNA, 210 bp, Candida albicans
gatctcccccaaggagaagcagaagcagaagcagaaaaaaataatcaaatttttaatccacatggttttaagaaaaagaaaatctcaaatattgcatttcttctttcaactaataaacacaaaataattcaattgcaattttttttaaataagtcgcgattacaactaatttctaatttcaatttcttgaaaaatcttatccttttttaa

SEQ ID NO: 12138 - DNA, 612 bp, Candida albicans
aaaagatcaataccggtaaatctacaaggtctttttttgttattggtttccaaggcaaaaaaattccaaagagaaagagtgtttatgaaaggtatatatttaacgttggcgctgacaaagacattttgtgatagctgcagaggagttggtcatagcagatgggattgcaagtcggtaaaatattgtcacagatgcaaatctactaaccacccaacaggaaaacacaaccaattcataaaacaacaaaccaaaaaacaacaacaacaacaaaactcaaaaccctcaaacaacaacaccaccaaaaccaacaacaacaaaagacaacgtagggataaatcaccaagtacacgtgtcggaagaggattcattttggaaaattcatcaaccattgaaccaacaccaagaacatatgaacaagaacttgatagttttgttcgcaggaataaagcccaacaacaacaaacacaatcacaagaagaaggggataccaccagagtcataggtcaacaaccaatagttccaacacaagcagatgaaatagtgaaaatcgttgaagatgaaaatatgagtgatgacgagccgatcagggtcgttgccaatgctagacaatga

SEQ ID NO: 12139 - DNA, 552 bp, Candida albicans
accaacaagaataattttatcacacctttatttccccccaccatgccagaaaacctccaaacaagattacataactcactcgacgagatattgaaatcatcaggatacatatttgagataatcgaccagaacagaaagcaaagcaatgtgataactagccccaacaacgaactaatccaaaaatccataacccaactgctcaacggcgaaatccaaaacttccatgctattctagaccaaacggtgtcgagactcaatgatgcagagtggtgtctcggcgttatggttgaaaagaaaaagaaacttgacgaattgaaagtcaaagaagaagcggcaagaaagaaacgtgaagaagaggccaagaaagcagatgaagccaagaagtgttttattttacttttctgtcaaatttgcactacttttaatttgtgtgcaaatattctattttacttgatttttatatacttttattttacaatacttttttataggactttttatatcttttctttatcaactcatcttttatacaatatattcttacaattataa

SEQ ID NO: 12140 - DNA, 309 bp, Candida albicans
aacaaacagaaagcagaggccagaaagaaagcagagaccgccccacaaaagtttgacaactttgacgactttattggctttgacatcaacggcaataccgacgaagacatgttgtccaacatggactacgaggacctaaaattggacgacaaagtacctgccaccacagacaacaacctggacatgaacaacatacttgaaaacgacgagctgatactagacgggttgaacatgacattgctcgacaatggcgaccacgtaaacgaagagtttgatgtagacagctttttaaaccagtttggcaattaa

SEQ ID NO: 12141 - DNA, 801 bp, Candida albicans
acaatgaaatgtttcgctgcagttgaacaataccaattgactttctgttctatcaatatcgaacggaccaatagtacttcagtaatgaatactattcttgaaaaatatgacattatctttctacaagatatatccccaaacaacaccaccacattacaaattcttaccaccagactacccattactgtcattcaaagtcactccaacgacaagacggcaattgctatcaaccacaaaatagaaaacttgataaaaataattgagacaaacactttaaaccttactgaacaagtgagtcaatatgtcaatgatgttataatccaaatccaaaatacacgaataattttggtcagcgtatactatccaatagctgataaagcaccaatgcaggtgacattaactcaacaacttaataatgagttacccaaaacatacccaatcatcatgggagggaatttcaaccacatactaaaccttgccactgatagacaaacttatgggtgtgacaaacaaggggaagacaaatcaagacaagaatcacttgacttgtacaacaatcacaaacttgttgacgtctttagggaattttacccaaacaaaatctgggctactaacaaaaacccacaaaacaatcgacgtattgatcgattccatgtatcatcacaactcatggtacagataccacgatttcaacaaatcaaaatacccaaattgaaatcaacacacaatgctataacattcagttataatcttgaaaaaacacaactaatcggatattggtccaggaagggttatcgttaa

SEQ ID NO: 12142 - DNA, 201 bp, Candida albicans
gaccgcatgtttttgggtagcgctgggttaagaccacatttttttttgttagaagaccgcagaaaagagagcgcacatacaaaatcaagaccgcagaaaagagagcacacacatttaagaccgcagaaaaaagagcacacttttaagaccgcagaaaagagagcactcatttctaagaccacatttttgtcacgtgagtaa

SEQ ID NO: 12143 - DNA, 201 bp, Candida albicans
gagtgcggtctttcagcgcgtggtgagcatgatcgttcggagaattctttaagattcgttagtacttgtcgtcctttaactctatctacgaacgccttagcccaaggctttgtttttcttcatgaattcgtgctaacccagattacataccagaaactctacactatcataccgcacaacatacagacaaagtattcatga

SEQ ID NO: 12144 - DNA, 189 bp, Candida albicans
tgtgtaatgaccgagatctataatattggaaaccaatataaagatttaccactacaaaatgatgaagtgcccagtgttttttcgacaagctggagcttgttcatttgttcaggattaatgataataattgctatactagtctcggataagaaggataaacgaaacattgacgatatatacagcaagtaa

SEQ ID NO: 12145 - DNA, 198 bp, Candida albicans
acgcgccaaaaagagaagatactgcataaaatggaatttattttttcaataatagaatcgactaatcaaaaccaaacaaaggggaagaaaagaacaaaaaaaaaaaggaacactagaaaatatagagcacattcaatcgacaattttcaggcacttcgttcactcattagcccattcttattgtatagaccagcataa

SEQ ID NO: 12146 - DNA, 189 bp, Candida albicans
tgctccaatatttacttttatttttatttttccttagttttagcaggggaaaaagacaaacagaggaaaaataaaccacatttatattttctacacgcaaccgatacacaccaagaagatggtaaaagccatgaagcatcaaaccaaacctacttttttttttgtaacatatacactactatgttataa

SEQ ID NO: 12147 - DNA, 237 bp, Candida albicans
tttcatttttcttggctgatgcatttgtttgcctttgtttctcgtaaaaaaaaaatatatcgtgttctccccatttccattggaaacgttagtcactgtttagaattagcctgctttatttatgagctaaaatctttatttaacttacaaacgaaacaagaaaaacaaactatcgattcacttgttcttattttggttgagctttgtctaagacggacgatcgtaagtgttaactga

SEQ ID NO: 12148 - DNA, 210 bp, Candida albicans
aggcgcactggcacgataaatcaattttgtgttaagaatatattaatgaatgaacaccttagggtgataataactattgttaaagtctcagttgatttgttatatatatgtggagaattaagaatgcactccacatttactccatgctctactgtcatcgattactcaactatatttcttgattattgttgccatccagcagcaacatag

SEQ ID NO: 12149 - DNA, 249 bp, Candida albicans
agaattccatttgtttttagtctagttttttttttagttcattcattgtttttacctgtcaataatctaatacaccaaagaagagctcatgttctaccaggatttttaaacaacacacgtgcaaatacacaaaataaatgcttcaatacttacttgaccgtatctgttgtacagtatttggttagtatcccgcttttttttaatcctgatgatttgcggaagttaggtagatatgagggaagaaaatag

SEQ ID NO: 12150 - DNA, 237 bp, Candida albicans
acaaagtattttttagtttcatttcttttattatcttcgctgagtttcaagatagatcaacaagatcaataccttactaccaccaaccactacatcaaactacattctctatgttatgttactggggcaaatggcgttactattaatgtgtcaaccagagttgaagtgatattctgcatcttacaacagaccaccccacacatccggttcccatttttcttttttatgtcgatttaa

SEQ ID NO: 12151 - DNA, 198 bp, Candida albicans
ttacatataccagtaacttatttagtagatctatacttgttgtattactatactaatctttttagatttattttagatttgcttatttgttatcaatattcctctgatcgtatacctatccatatatggttgagaagcactacaagtgatatagagatccactacatacaatttttggaaatgtggctggctggctag

SEQ ID NO: 12152 - DNA, 210 bp, Candida albicans
tgtctgattacaaaaacaaaaaaaattattaatatggacaatttctcggacataaagttgtcaaattcgaaacaaaagaattctctcagcaacaaaaaaaatcaaaccaaactaacttcgaagaattctatatttttttttttggatgtgaaattcgattatattctaccaccctctaactcacagatccaatacattacatacaagtaa

SEQ ID NO: 12153 - DNA, 330 bp, Candida albicans
tctatcttgaaactcagcgaagataataaaagaaatgaaactaaaaaatactttgtttattatattctaccataccaaaaaataatagaaaccaaattaggttcagggtgggccgaagagatattattatcgcaagttaagaattataatcatcaagatgtttttgaagaaaataaaacaacccacccacgcaagtcatgtcatagcttgtcactgcagtacatatcactacatggttatatatacatgttttgtagtgctaacctaccagctagccagccagccacatttccaaaaattgtatgtagtggatctctatatcacttgtag

SEQ ID NO: 12154 - DNA, 207 bp, Candida albicans
actaaaatgaaaaataatcaaaagaacaatcaactttgttcggttaactctctattttatatatggatgtatattataatgttaattttgtttggtaacaaaacaaattataaggtgattttttttctctcactctttctctcactctttcttttttgttgttttgaattcaaattcaattcagtattgtcaatcagaaaattgtaa

SEQ ID NO: 12155 - DNA, 390 bp, Candida albicans
aaccaacatcgatacatcaagaagtcagccatcaactatcccatcctactagccatgactcacttaatcgaagaaataaatataaatgggattgattatacaatagtaatcaccttcaattccaaaactcatagcaaagcaccaatgtcaatatacatcaaccaacaaggcaatcaagaaatgggtgattacatatatacaatttcttcttattcgacatacttgaacaatctgacaaataacgatcaaatcaaactgcttaatcaactattagtgaagaaattcaatgtgccgatatttctaaatatcagtggggatatagggacaacttccaatgtggaattgtttcgatccattgtggatttagtagaacacctgaaactgaattaa

SEQ ID NO: 12156 - DNA, 288 bp, Candida albicans
tggacccctggtgaacacccatcaacaatacacccaactgatttacagtgtgattccccatatgtagtaactttaaataatgttccaaaagacgacatgttgttgcttgttgttattgatttatctttgataactgatgttgatatgttcaaaaataaatttttcaaaattttttttttttcaactgcaaagagtgtgctcataatgagaaaaaaaaacggaaatgactcaaccaaaattttgtcaccatattattattcttgtaagctcacacacaaacacccataa

SEQ ID NO: 12157 - DNA, 189 bp, Candida albicans
aggatacaaatcaaacaagaaagaaaaaaggatatatatatgagagtgaaagaaaggccagttataattttgaggtttaaatcgttggtgattgaatgtggggaaaaaaaaaatagaagcaacggattaaaatggagaaacaaatttgaactaataatgtgtgggtgggacacgggagaaaaaaattga

SEQ ID NO: 12158 - DNA, 186 bp, Candida albicans
gattataacttggcttttaaggttataataggtttagagggtggagagagaaggctacaacaactagtaaaaaagcttcttcctccgggtgggaaaaagagaaataataaggaaagtaaaaaggggaaattaagttttgcaaacgatagaataaagaataatatagaaattccctttcttttttga

SEQ ID NO: 12159 - DNA, 183 bp, Candida albicans
tttttttttagctctgtcttctttatgcttcaaagtcaaaatttatcaccaggaaaaggaagttttattttaaaattcaacgttgctacatttaagttcttatcgaaagatattatcgatagtatatcatgcttttctctattgcaaaactgttgctttttagcagcaagtgtggaattgtaa

SEQ ID NO: 12160 - DNA, 252 bp, Candida albicans
agactctacttgttaaacatctcaagatccgaaagtccaatggtcgatagagatagagagatctttggcgtgcacacctcaaaagacatggcaccgctagataatggtgttggtggattttcgacagtaagaagatctatgcaaatcaatagaacttcggaatatgacaacgaaaaaagtgttggattgagaagatttgatagttttgaaatagacagcggtgatgaagatacaaggaattatagacattga

SEQ ID NO: 12161 - DNA, 204 bp, Candida albicans
gttaatgatatatggaataaagaaggtgaaataaaatcagtaaacagacgagtttttaggcgtgtttcaaaacaaaacggtataattatgagagagcgagaagggggagttaaagaaaaaaattacaaaacaaatttcaagttacatccactgtcagaccatcaactagagtattcctttaataatgtcatcaaaacaaactaa

SEQ ID NO: 12162 - DNA, 330 bp, Candida albicans
aattttgaatatgagatggataatgacatacagttcacagaaaatgaccataacgttcatataaaacaactggatttaaactttattgtagttatacgactatcacgagaggttttatctgctatgaaactatctgaaattaagataaaatcacccaccaaaaagcaacaaatttcaactaaaagagaagcacaaatactgcaatacaatgctcaacttttaatggaagagagacaatctcgttattccaagagaactgggttgacaattgattcgccgacagcatctccttcggggtctcccaaaaagaaaaaagtcaaatttgtatga

SEQ ID NO: 12163 - DNA, 282 bp, Candida albicans
  unsure (45): Identity of nucleotide sequences at the above locations are unknown.
attttatcactactgaaacaccagttgggaagaacgctatacttncaaccatttggaagtggatgttgggtggtctttgaaggaaagcacactacaattgaagccaaattggagaatagactgttgggctacttgactgctgaagctaatgaacaaaagattacagatgtagtgttgggtgaaattgatggtaaaccaggattacaacaagttaaagaattgttgagtggagaaagagagaaggtcaaaagacaagctcaattgaacctcaaaaacaactaa

SEQ ID NO: 12164 - DNA, 999 bp, Candida albicans
gccgatactaactatactccaaacctagatttcgatccaaccactttcacagcggcgcaattgagaaaagtattgaacttgcatgagattcaatatgatagctctgctccaaagtcctctttgattgaaattttcaacaaggaaatcgctcctaattccaagaagttactttcagaatataatgcaaaagtcgagaatatgaatgatgatgatttcataaacgctagcgactttgataaacctagtgagaaatcaacaacttctgaaaaggcatctgctttgtttgttagtgacactgaatcagatggtgaaaatgaaaaaattgatgtgtctaaaacaagaaacaaaaccaagaaagttactaaaccaaaattaagagcaagttctgggaatcagaaatctacttctaggtcatcttcgagaacaaaaagtcctgaatcggaatctgacacagaaagcaaagatgatgaagcaaaacctgcctctagatcgtcctcaagattatcatctagaggtaatcgatcaaaaccgttgaatagtttatttgatcttgatgattcggtactcaatcttagaaaaccttctaaaaactccaaatcaaaactgagaaccacactgaaactgaagacgaaaaagacagccgaatcaactccggaagttactgaaaccagtgatactgaaaaggagaaagtcgaagaaccagttaagaaggaaactggcaaagaaagcacacccgaaaacactaatttcagtaaagaaaatgttttccaatcacctcctggttcgtcaacgaaaaaaagaaaacatcaagatgccgaagaagaagaagatgatagcactcttgtgaaaaagattaaaccttctcaacgtactgctgaagaaaacagatcattatttgatgacgacaatgatagtgatgttgaattccttgaagagtttatgcgaactcaaaagaaaacgagttcttcacgccgggatggccgatccgcgctgaagggg

SEQ ID NO: 12165 - DNA, 198 bp, Candida albicans
tttcttgattgttcttctcttatgagcgctcgtatatctggaatgatgtacacgacccaatgcgccaacgaacctaaaaaaaccaaaacaaacacaaatagcaacgaaagaaagaaagcaaaaaaaaatagcatcatgctttcaaataatcatcatcaagggcaaaaacaaaaaaacataaaaaaagttatactataa

SEQ ID NO: 12166 - DNA, 201 bp, Candida albicans
aatcgtgcagttttcttggttgtctatttaaatctaatggtgatcaacaaccgaacacaaccatcattagccactctacctctacctaaaagttacaaaccaaatgaaagggtggttaattggttagtcttgctaaacgacttcaaggtgggcaactactcatttagaaatttcataaagttttggttgaaatatttataa

SEQ ID NO: 12167 - DNA, 279 bp, Candida albicans
cattactactgccaaaatcattgtgtttctgaacacggtaagtcagtgatattattcgggaaagaaggcacgttatcagcagctggagaagaagaagaaaagaatacgtatgctctatcattttttgatactggaggaatctgtgtatccttagttggaatgtatatttggggattagtggatacaagcagagatccaccagaattattgtatcttcctaaaaacttgagaattgcattaagattacccattgcaataattattgttctttttagttag

SEQ ID NO: 12168 - DNA, 201 bp, Candida albicans
gctgaattaaatacaacgttattgatgggattggtaaatatgttattggggatgttgttaatttttgaaagtgttgttggaactcctagatcatgtttatttgattcaacaagacctaagaaggataccagcaccaataccaataccaataatgatgccaataacaatgccaatgtcaataccaatgtcaattccgattag

SEQ ID NO: 12169 - DNA, 240 bp, Candida albicans
gaaaaaagacatgaaaatccgaacagatgctatagaaaccatcctccaatgaatccacaatcaacaactaaaataaggccagctaaaagattaatggaagctagtggaaaatgctcctcagaaggcttagcttatgggaattgtgttctaaataactatactactataaagaaggatttgtgtggacaagaatttatcaagtttaaaacctgtgttaccaatcaattagcaaagaagtga

SEQ ID NO: 12170 - DNA, 210 bp, Candida albicans
aatattcaaagcctggttttagttcaaaataacgtccatcacactatacaattgaagttcatttgcaaattacaatcaagaaaagaaaagagcaataacgaagagaaactgataaagaaaaacatgcaatttgaacaattgataacaaccattatgaaatacagacaagctaatgaaactagaaaaagacagggaaaaaaatgtcattag

SEQ ID NO: 12171 - DNA, 198 bp, Candida albicans
gtgttagtagtactagtggtgcggagttcaccctcccgtgatgagccagggcgtgatgttgtagatttattcgatgagatgagcaatgatacaaatgattttacgcagaaaaagaaattaagaggtgaagaaaaaggaacgttaatgactggtgataaggtcaactacgagacgataataactgaattttgtaagtaa

SEQ ID NO: 12172 - DNA, 189 bp, Candida albicans
tgctcattcaaaacaagaatattccacgaaatgaaaaaaatgaacagggtcactagtaataaagcaagcaatggaaaagaaaatgaaggagaagaagatgatgatgatacggatactaggtcaatggggtcaaatagaggaaggattatagatcaatatatatatttacaatataatgtatttatttaa

SEQ ID NO: 12173 - DNA, 279 bp, Candida albicans
tcaactaaacaactccttaccaattcacaatcatttcttccaaaatatatcaacgatacaacaccaccaacaataacattaaaagaatatgataacgcatcgtgggcttcaactacttgtttagatcataatccaattaagaatcaatatattgttgtagttatggaaaatcctaatcaaatagtagcaattattgatcaacaagataatatgattctagatattttatttaaaaatgctcatgatgctcattcaaaacaagaatattccacgaaatga

SEQ ID NO: 12174 - DNA, 189 bp, Candida albicans
ttcattgagttcactaatgctaaactgattagtgaagtgatggccactataagtgaaaaacatcgagtttacaccaagcagagcaatagagtgaggtatattgatttatctttagaaactagcatattctttctaatctcgaaatttgatcaaaatttcaactccaaaaaaatactcccaaccggatag

SEQ ID NO: 12175 - DNA, 333 bp, Candida albicans
aatcaaattgaggataatattcacaatattttaacctcttggttgctagaaatcctaagcgaacgtatcactattacaggatatttcacccgtaatattcgttcaactgtcaacgatttagataagttagattttaattatttgtatgtagtttttgaattccagggaggtattggcatgtttgtagttgctgtttctcttttttctcgtcaaataagaatttgccagttatatatccattttattcggaacagacacacctggactgcgttaggtggtgcaacgctcaaaccttacccacatacaatagaaatgatgacattggactactag

SEQ ID NO: 12176 - DNA, 219 bp, Candida albicans
aacaaaggaacttctagtggttgtcaatttcaaggagggaattatcataagaatatatatacaaatgcatatataaaacctatgatctttaaagtttatctttattgggaagaagaagttattgcaacgagccatacaccacagttttttttttttcgttcggcaactatcttcaccaccaccacaattttttttttctcgctcgttatcttgcattga

SEQ ID NO: 12177 - DNA, 339 bp, Candida albicans
ctgttgatagtatatattgttttgtattatgctgtgttgtgttgtgttctatcttgtttttcttttgctttatttgttggaaacactttttttcgcacaacaacaactattgtaatttgcagaaaggctatgtatagaagaacacttgatattatggtaaccactacaagtacgtatgtagatatatacttcctcactgttcatggactagccgaatacagccaaaggaaatgtaggccacctgggtcgtatacccatccaggtacactgcatgtggatatacatattgctcaacaatatgttgttcgactgccagcatgcaggaaacagttatcttga

SEQ ID NO: 12178 - DNA, 219 bp, Candida albicans
ctcattctagttatcaaattagttattggttttatagaaatatgccactttaaaattctactattaatttgccattattattgttttcatagaataacgaattatataacacgtgctaagcaattgaaactcatgaaaaaaataaccaacccaattgaaattctagtacaagacttcaatacccttccttcttcatacattcatttatataaaacctga

SEQ ID NO: 12179 - DNA, 906 bp, Candida albicans
ttgttgttgtgcgaaaaaaagtgtttccaacaaataaagcaaaagaaaaacaagatagaacacaacacaacacagcataatacaaaacaatatatactatcaacagtcatgtccgatagcgagaaagaacttacagttgaagacaccaatgtctccgacacagaattgtcaaaggaagaaagattagaagcagcacgtaaaaaatttgaagaattgaaaaagaaaaataagaaaaagaaatccaaaaagtcaaaaaagagtgaaaccactgaaattgaagacagtgctgaaggaacacctgcaccagaagacaagccagaagacaaatcagaagaaaaagcagaagacaagtcagaagataaagcagaagataaaaaagacagtgatgtaaaagaagataccaaggaagcaaaagaggaaatcaccgaagaaaccaagaccgagaaagaagatcaaccaaaagtctctgaagaagcaattcccgagtctctgtctctgtctctaacatcagagcttgaaaaacaagttgaagagttgaaacaaacaattgaacaacaaaagtcaaccattaaaaaattacgtgatgaaaacaccgatttgaaactttccaaaatggatttaaatgataaaatactgtcattggagttggaaaataaaaacttgaaagctttgacttcttcagcatcttctgtgcccggtggatcacctatagccacctacaaagaaacatttaaacctgcaaaaccagtttttacaaaaaacgattatgcctcgtcttcacaacaaagctttagtaaatccaacgcaactgaagatttcagagagaaattaatggtttggaaaggttggcaggttgatatgaccaattggaatggaagtggagccacccaaaaggttgccttataa

SEQ ID NO: 12180 - DNA, 1041 bp, Candida albicans
atatttgggggctttgaaagcgacgatttcaaaacaacaacatctacaaccagctcctcgcctcagatattattaacttccattgaagcatttacagcaagagttaaagatgaacaagcccataattcaggtccattattaaaatgtatcgacttattaattgataaatatcaaccgttgttagtagaaaaattcaaaatcgatccttcattaatttcagatccttatgttattcaacaacgaatatgggataatttgaaaatcaaacgttcacaatcattagatccaaatatcaaaattcgtcaagaattaatggagaaaaataccaatgaaatgataattgatcatcaatcaataccgtatcgaaatttcattaaacaattatatccattaaaatcattacatagcaccaacaataaaagtgaatattttgattttgttaataattccaaaaaatatctttccattagtcacgaagaattatataaacgatatttagatttacctcatccagctccaaggtttcttacatttgatgatttacaaaattttatttataaatttgtattactgaaacctcattatagtaacagaaacgtcattgaagcaaatatttttaaaaatgattatcaatcagctataaattctttaaatttagagattgaaaaaagacaaatttatcatgatatgtgtggtaaaataattaatgatttaaaattggcaaatttacccataactcaacctgaacaaattcgattaatttatttatcatttttcaaagatcgtcaagatttattgaaaaattttaatcctcgacaattaaaattattaaattatcctcaatttaattgggggaattatcaaatgttaattaaactgtttggtgataatcgtcgtgatttattaagtgtgttattattattgggtactagacatgatcaatttgatataattcaagatattttacctaaagttaatcttggatgtatttttgaccgtgccaattccaccaccaccaccgcaaatacatcattgaaatag

SEQ ID NO: 12181 - DNA, 426 bp, Candida albicans
  unsure (26): Identity of nucleotide sequences at the above locations are unknown.
actgataattcattaagacatttgtnatattatttcacttggtatattgatcgtccgaattttgatacttatttggcccgcacaattgattatattactaataatataccagtcttaaccacagatatagtaaatagtatatctcaaacattaattgaattaggatacatcaagcaagccgaaaaattatttgaattggcatttttccaagatccaaaaccaacaccaccagaatatgaaaattcggaatcaatatcttataaaagattaaccactgaagattcaataataaatcaagaatggcaattcatatatacaaaattgaaatccatcactaatgataatacaattattcacaaattgatccctgttgaattaacttttttgaatttaattgataggatattgcatatttggaaactttga

SEQ ID NO: 12182 - DNA, 678 bp, Candida albicans
ttgataggatattgcatatttggaaactttgatcaaatcaaacaattaattaatattatggataatattgcaaagcaaccgttatctactagaatttatattcgaatattcaaagcatttattaataatagcagtaacggtactaaccagcagttggaaaacgattggacattagatgatttatcaagtatattgactagattgattaatgatattgacaccattgatgaagccaccaccaccaccacttccaatacttctatggtgaaacaattattaaatgaaggtagtttaaatttcaataaatacgaacaggagattataaatcgtaaatcaaattccgatatttatcttgaatatcaaaataatggtggtctcaaactattaagaataagtaattatttattggaagttatttttatcagtttagaaaccaaattacatcaagttttcaaatcaactcgatctaacgatatcgaacaaacacagaaccaataccaatcagcaatacaaaatttgaaaattttgaaaacaaattggttaaatatgttggaacaagatgttaaaaaaaggaataattcaaattctatcaattcctcatattattattctgatcaattatcatatatcaacaaggcagttttatttgaaatattttctatcatttcacaattatag

SEQ ID NO: 12183 - DNA, 210 bp, Candida albicans
tgcaaaattgacaaaaaatgtaaaatacaacactatttaaatctaatggtgatcaacaaccgaacacaaccatcattagccactctacttctacctaaaagttacaaaccaaatgaaagggtggttaattggttagtcttgctaaacgaattcaaggtgggcaactactcatttagaaatttcataaaattttggttgaaatatttataa

SEQ ID NO: 12184 - DNA, 771 bp, Candida albicans
tccgtccagtgggctgtgaagaataaagaagtgtttgaagttaaagaaggagaagaaaaacaaaggctggaaaaccttaaattattacagaatatagctgagttacaaaaacttgaaaccaaagttaatgagttgactaatggaaacaaatcattagaaacaaaaaatacaactttgaaaaaacttaccaaggagaaggaaaataaaattgacaaattatcttctcaattgacatccagtagatctaaatatgccagtaaattaaaatctttagaactggaaactgggaaaaccattgattccttattggtagaattgaaattggtaaaagatattaatgaaaaattgttagccaaagatgcgtccactatggaaactttaaagggagttctgacaacaacttatgattccttatatgattggttatttaccgatagttctgctaattgctatcttgataaagtttatgaaaatagatatctttcattactaaatgttcttaaacaaactaaagattccaatgaaatttatcataatagtatgcattcattgttgatgcgtatttggaccagtatggagaaattgcaatatttgcctgcagaaaacttggctttttttagagctttgatcaaggaattttatcagagaaaattattgaaacaagatgatcttatttttattaaaaaactactggatgtatttgatctcttgatggaacttatcaacgaggaggtggttatgagtagtagacctagtagaattgtaaaataa

SEQ ID NO: 12185 - DNA, 216 bp, Candida albicans
actaatattgcatgtttaataaacctacctgattccatagagattttagatttatcttacaacagatttgagacattgttggtcaacaataatggcgatttttttgttttcccaaaaaatttgaaatatttgcaaatggttggttgcaatcttttgccacctcaaacaattaaaaattatatggaattcccagaaaatttagaaaaattgaattag

SEQ ID NO: 12186 - DNA, 327 bp, Candida albicans
tcgaaattcagatcattgaaaataaatagttggtttctttactttagattgaaacatttacgttggtgtttcagttttggtcttcataaccaattggttgggaatgatagtgtgagagatgccttgaaggaaccagagaatgagtttaattatgggacacaacctgatttcgatgatagtttggtagatgatgacaattccgaactgttccatgactatattgatcaaaaacattcaaatgatgaaaaatatagaaaggaaagacggaaaaaagaaaggttggttaaattgaatgaacaacttgatgaactaaacttgcaccaataa

SEQ ID NO: 12187 - DNA, 210 bp, Candida albicans
aaaaaaaatggtgtactattaattagtattagtcgtcggaatttgttactgtattctcacaaatacacacataacacattaaacatatacaatcactctaacaaatctgacttacttactaactcacctgtcaagacagtaagaaaatctgatctctcttattttgatccttcaattcctcgctttcactctccctttgtaacccgccct

SEQ ID NO: 12188 - DNA, 216 bp, Candida albicans
ctcataaatagaataagctatggaattggaaaacacattcagcttcgaattcagttgaatgaagtgggatctgtgactgttaatagatcaggcaaaacctttttattctcagaaactggaacggtatctggtatacgaattatattttcaaatgggcatattacggcaagtacgtcttctaccgacgggccggaaggacaacagatcaggggcggg

SEQ ID NO: 12189 - DNA, 834 bp, Candida albicans
  unsure (239): Identity of nucleotide sequences at the above locations are unknown.
cactctctctaccctttaatcatcaatgatatgaataaagaaatacatgaaggagagaagatacttctgggaacaattttgcgagtccctttgataattgaagacaaagcaacatctgaaacaataaaaaattcttcattatggcttcacgtatcaggagctgattataaaccaagtaataatcccctcttcataaataaatctttaactgccatatgcagtgaaggtattttccatangacactaacgacagacaacagtaatcgagttatccgaaggtatattcctaatatagatcttagtaatgataaacatttcgaattattgaataatcttttcccacttgatttagaaagtttgatagaggctaaacaaaccaccaaggatccaacacagcaacagcaacaattgaagttaatggctaaattgattagtgataaatccaattatgatgccaataatgaatatttagacgatattgaacctaataagaacaacatcgttttatcaatcaaaacagatgccaaatatgccgtgaccattggaacgatcgagttaccacctactgatattgaaaatcatccatatttaaatgatgaagaaaatttacttaattggatggaattatataattctcagaatgaatcattattggaattattgattgaatcaaataataatttggatcgattaaaatcggaaaatcaaaaattagaactgaatcttgaattgaccaaaaatgattatgataaaataattgaggatttagaactgaaattttatttggtattgaattctaagaaagataagatttatgaattgactcataaatag

SEQ ID NO: 12190 - DNA, 183 bp, Candida albicans
ttgtatatagagtggactggttttgaatattatttaggaaaaggaaaaataaaaactaaaaaaaaagagttgcataaaaagttctcggtcgtgccaattcacagtaaggctcgggggacagttaggcgtaaacggaggcttttctcgttcttttgccacatttcaatgcggtaccaatcttga

SEQ ID NO: 12191 - DNA, 207 bp, Candida albicans
acagaaatcgaatttgtctttttctttttttttcctctttgtgcattcacctggaacagtgtaattcgactaaaagccttaaacgaggcagtgttaataatgttgatgttgaggttggcccgaataaaagttagagttacagtctttctagttcaacaaaataaatgggatatagaggctcagaaatcagccttttgctggctatag

SEQ ID NO: 12192 - DNA, 270 bp, Candida albicans
  unsure (94),(99),(100),(252): Identity of nucleotide sequences at the above locations are unknown.
ataaagaaggttgggatcctaaccaacatagttccattgctgatcaggacgtttaataaaagaacttcaccaacagaaaaatattttaataatnacagnntattttctgcctttaaaaagccatttaggctcaaaaacctcaaaataattcatctcccaccttggcagcagagtagccataacacagccaaatcaatttctatagtttacataatatataaaaggtttctaatagccagtaagcttataganattacccttttcaagtga

SEQ ID NO: 12193 - DNA, 240 bp, Candida albicans
aggctcagaaatcagccttttgctggctataggattttatcacacagatacgacttgaatagtggtagtaatgtcgatcagatctatcaaattgaacaaatttttaccgcaagaccactcttctttctgtttcagttgacgaagtcgtcgtctatttatgtggtttatttgattcataaccttacttacagtcgaaaggaatacgagaatcagagtgggaaaacaattttgtcgttttag

SEQ ID NO: 12194 - DNA, 225 bp, Candida albicans
aagcatgagctgtgtcctagttttttatcatttacaattgaatttccctctgaaattaaaattctaaggtattcatttatctcaactttcttagatgctgttagtgggttaaaacttggtaatgaaccactgacggaagttatttttgtgagaattaactataaatatatcagcttggttttttttaacaacttagacagcaataaccaacacccaactaattaa

SEQ ID NO: 12195 - DNA, 234 bp, Candida albicans
aagacgtgtttaatgatggtgacttttttcgttgtctcgcatttatcaaatcactctcaattgtcctcaggaggcctgttttttttcttctctttatcactgtcacaacaaaccgacaaaaaatacacacagttagttttaccaattgatccgactacaattcaaattacacattttcttatacaccaactacaacccatttcttatgtcaatacattttatattagttcttaa

SEQ ID NO: 12196 - DNA, 228 bp, Candida albicans
ttttctccttcttcttcttcttctggtggtggagtagtgaaggaaggaaagaagtttaagagaaagaaacgtgacatactaaagattttattattaagtgcaaatttaaaaattagtcgtgtaatttgcgctaatttgagagatttttttttcttgctttcttctactacctcaacagaactattgccacacaaagtgattttaaatgaaacgacgcgcaacaattaa

SEQ ID NO: 12197 - DNA, 345 bp, Candida albicans
ataatagttcacaatatttacgtcgtgatagttattcggccaatgaattctattcaacccccactacaaatatattttcctaatgatttgaaaattcactatcaagatcaaggttattggttaggttataaattgaataatatttatattgtattcagtttagtggttaatgataaagatttgaaattaccaccagaattatccgatttagcgataattggaacccataaccaaaagacgacaaagcaacgggaaggtggttattctaattatgatttaaatttgatttacgaccacactaatcaattattaataaatcaaaatcaagattttcaaagaccatag

SEQ ID NO: 12198 - DNA, 249 bp, Candida albicans
actttttcaaagaagctgatcaataagaaccgcacacaaaaagttgttattattaggtccaattggcttagtttcgccgtggtggtggttatgtttcatttgaggttgtgtgctctatttggttcactttatagcaatttcaatttacctcataggtttataatgaaccttgtattagttgacagaacgccattatcattactttatcttttaggtttttgggggtcatcaccgagtggcataatttga

SEQ ID NO: 12199 - DNA, 336 bp, Candida albicans
cttcatatggaatttattgcatttacatttattgaagattccatactactacgactattcttggtattattcattcttttggtcacatatgccgttattatataccttattgaaacattattcattaatcgatatccatttgtaaacattaacaccgataaggttgaagcatcagatttatttttatcagttagtctggctagaaatcaaaccactaaattacttaatcgtgaaacattttataagaatttaaataatagttcacaatatttacgtcgtgatagttattcggccaatgaattctattcaacccccactacaaatatattttcctaa

SEQ ID NO: 12200 - DNA, 201 bp, Candida albicans
tttgggcactattggaggtacgggcctgtatttctggggcaaatcacccaaacaaccaaccccgttcaaccccctaattttgctggctcaatcaataatccgtcaggcggggttattgatcaacctgaaatcaaccccaaagaatttccaaattgggggttcccggttccccccatgaattggggaataaaacggaaatgg

SEQ ID NO: 12201 - DNA, 594 bp, Candida albicans
gaaatgaaattcaccagtttaatttgttcatctattttattaatcattcctactgttatggctgatgatgcatcatctgatactactattatcaataccatcaccattactaaaactttgtataccccagaagaatcaagtagtttactttcagttcaattagaatcagaagcttccgttgcctctgttgcttccgctgcttcagaagcagccgcttcagccgcttcaatcgcatctgttgcttcagaagctagtgctgcttcccttgcttctgaactttctgctcttgcaaaagttactgaagttaaagctgatgtgattaataattataatgctactattaattcaactttgagttcatcaacaattgcaccaaaaatttcatcatcttcatcatcttcttcaaagaaacatgaatcaattactagtgtcattactagttctaccaaagataatgctagtgctgctgtgactacaaaaactggatctactacatctaaagctggagcagctgcaatggctggacctgttccaattttgactaattcaatattcactgctggattacttgcccttgctgcagttttattataa

SEQ ID NO: 12202 - DNA, 183 bp, Candida albicans
gaagcgtgtataataggaaaaaaatgtaggacaaacttgaatttcaacggtaattttgcgtatgtgctattatactatccagtagttcactccattaaagagaaatacacaaaaaagaaagttccaaattcattcttggatggaaagaaagaaaaaagaacaaatgaatcaatgaatcaatga

SEQ ID NO: 12203 - DNA, 189 bp, Candida albicans
caattttttcgaggaattgaagtaaacacagtattgatgaaaatcaggtctacccattcattggaagattttttagtatctattaactatacaaaacatcttacacgacaccttcaccacctcctttcttctagagcagataaattggcatttccagggttattgaatctaatatcaatacattattaa

SEQ ID NO: 12204 - DNA, 309 bp, Candida albicans
aaagcaaaaaaaaaaaaaaaaagtatgaaaactctttccttttataataaaactgcagcaagggcaagtaatccagcagtgaatattgaattagtcaaaattggaacaggtccagccattgcagctgctccagctttagatgtagtagatccagtttttgtagtcacagcagcactagcattatctttggtagaactagtaatgacactagtaattgattcatgtttctttgaagaagatgatgaagatgatgaaatttttggtgcaattgttgatgaactcaaagttgaattaatagtagcattataa

SEQ ID NO: 12205 - DNA, 294 bp, Candida albicans
tgtggatatgtcaaagataatgaactgcttgaactcaatgaaaaagatgggacaactaatgtagaaaaactagatgaagtcaaaatatcactttggtcactggatggcagagatgatgaatcagaattcaaactagaagatgaatcaaaactgcttgctgggtcacttgtaagagacaccgaatcactagaaatctcaacagtagatgttataaatgagattgattggctatctgactccccagctatagtgtgtggaaaatcgtcactcggcagaatggtgctagatgggtaa

SEQ ID NO: 12206 - DNA, 435 bp, Candida albicans
gatgaagataatagagaatctacaatttctctgttctccctgataccgggtagtgctgctattttcgtttgctacatgaaaacactgtgtcctgatattgtgtgtttgtttaggaacacgtctgtgttgtgttcttcgggggtttgttttgtaaatgtcaatgagaagaacctacggtgcatccgctgtatttggcatgtggacgtttctgtagctgaattactttgtagcttatctgctatagatagtaaagatttgccactaacaactctgaaaggtgaatggcacggtgatgaatggtggtggccatctggagtccagaaaaacgatatactttcagttttgcaaccaaataaaaggaagaaaataaatgattacccagtagtgttgataaccgtttttgactttagggtgttcgtagtggcacacaagtag

SEQ ID NO: 12207 - DNA, 183 bp, Candida albicans
aaattgatacaccaacgatggtcatcgtttcagatggaaaaaaaaaattatgcaagaaaaaataatctgacaaaaatgaaatgggaaacgaaaaataagataaacaaaaccacggtgttaattgccttgcagaatatatttataataacaacaaactcgttaggttctaaaaatcccttttga

SEQ ID NO: 12208 - DNA, 204 bp, Candida albicans
gcagggcaggtgtatcgaattcgacagggaatgccaataatttacaagtttattttctatgctagttgttcattgattgaagccattattagaattgtagaattgatattgatttatgtatttttgtggttatcgcaattctgctctgtgcattattccactgttctgtatttggttaagttgaataagctcggtgtattgtag

SEQ ID NO: 12209 - DNA, 198 bp, Candida albicans
  unsure (56): Identity of nucleotide sequences at the above locations are unknown.
gaccaaaagctggtttgcaaaaccaatcaactaaacgcaatcaagaccaaactcanacagtcacataacttgcaattagaggactcgcgatattgcaaaaagtattattccattactttcaaactagatggcaagactgattcttacaaaaccattcaattaaaagtttgcaaccacacaaacatgtgtctcgaataa

SEQ ID NO: 12210 - DNA, 1335 bp, Candida albicans
ggagaagatttcaagaattattataatgtttttgattatttgagttttctggcattgaaatctacgaaatctgaaaacttccagaatattgagaatgctgtttttaattattatttacagaactatttcccacgtcatgctacagagaatgtagcagcattgaatgccaaatatgatggtggtaaaaaagattggttaatattttttaaaaatggcgatgggttttgcaattacaaatcattacggaatataaaacagatactatatttaatcaaattgaagcaaccactatcaaccttccccagtgaggaatcattctggaagaactatgggtttggcatctcaacttcaccaatgttccataaagttaggatcaatagattgattgatgattttaatttattgtttgaaggtttgacttttcaagagtcgattaatcaatctgaatttttcaaaacttttctcactgaatatactaaagaaaccctgatatttgaactgaaacagagaatcggtgaacagcttgattttgacaaacagtccttgggagaggtaacttacaagctaaaccaaatccaagaaatagaatattttttggaatattctttgaacaatttccaaaagtatgcatatttgtttgccaggcttgcaaaacttgtatgtattggtgacagcaagcaggtggattgtaggaatgtgttagatacaattatgtatcgattcaacaaaaccacagtttttgatgatatatttacttattcagaagtaaataatcaagcaggaactttgggtgtggcccgagaatatttttattggatccaaatgcatggtgacgagttgctacatagcattcaaaaacttgtttctgacattaattcatggaaacaaatgtactattcgatttgtcatataaacctggagttaaagctaatggaaccccacaatacagtatcgcaagaactgcaagataattccaatggccaagaacttctctctagacgcgatagctcattatctattaatcctatccctgaagaagagcttgaagacgacaatttgggttttttgtcaaactttgttggaacaagtaaaaaggcaaggtataagaaactagtagtagaaaaatcagaaattgtcaaaaatataatgaagctaaatttggaaatcaaatggtcacatgaattaattgctgcagagatatctgatttcttaaagtttagaactgaatttttaagattcggtataaagagatatatttctgaagaaattaaactgttgaaacaacgcagcactgaattatcaaagtatgtatttttagtccgaaaagacaaatag

SEQ ID NO: 12211 - DNA, 216 bp, Candida albicans
ttttctttcttactaatagcaacacccaatccattcactaaccaaggtttatacactttgattcaaagaataaactatatactcttcgtaagcattaaaatacaatcacacaatcaatcaatcaatctctctattcatgcattagaggcagaatctattaccactggggttaaattcttcttttatcttttatctttcatcagtttcttaaagtga

SEQ ID NO: 12212 - DNA, 231 bp, Candida albicans
cagaataaaataaaaacggatattgaaagcaacccgttatatatcaatacaattttaagctgttacattggaaagcatacaaaacaaaaaaataatatcttaactaacaatcaacagctagaaaataaattttggttttttcccaaacaacatggtttgcccttgtggacaaatatagaaatacaattaactaaatcatgtggccagttttacaatgaagtgtatcattga

SEQ ID NO: 12213 - DNA, 279 bp, Candida albicans
cttcgccaatggcgcaaagaacgttggcagttgggatttgtccggttgatttacataatcatcaccttcttcaacagccttgggttgcaagtgcatccgtgtgaaacgctacaaacaatcgatagtcatttgaagaatacaccgacctgtaaatataacctggttatacaatacttgtgttgctggtttgggctatacgggttgcctagtatatttccacaatttagtgtaagaccaaatatatatattaataatgtacaatcatgcaaaataaaataa

SEQ ID NO: 12214 - DNA, 378 bp, Candida albicans
ccttttgtagccaaaccaatgattacaaatcaacagttcaatgacaatatagaagagttcatttcgattatgctagcaaacttgaagttaaaaggcactgattttgagttttctgttaataacaactacgtgaataaatggaatattgacaaaatgtatagtttcgtcagtgtttctgtgaagcagcttcgtatagattttacaatttcttttgatgatttatatggtgttccattgttaaatatgagattatacgacaatgacacgtttttaacttcgccaatggcgcaaagaacgttggcagttgggatttgtccggttgatttacataatcatcaccttcttcaacagccttgggttgcaagtgcatccgtgtga

SEQ ID NO: 12215 - DNA, 213 bp, Candida albicans
accaacaaggaagagaaaaaaaaacccatacaaaaatttttcagtatcaaggaattagaagagacgtttaaatcaacaaagttcaaatctatcaacaatggtatgtttaatatcgatattatccatagatgtacatgtatcctaatgggtttcattatttggaaagttatgtttatgggagttctatttattaagatatgggataagaattaa

SEQ ID NO: 12216 - DNA, 648 bp, Candida albicans
attcaagataatcaagaaatcacaaatatgtcttcacaagttccagaatcagaagctcttaagataaaatacaaggaaatagcagccttgaagaaagcaatacaagaaaagcaagaattgaaaaggcaacaacaacagaatgcttccaagattcagaaacaggcatataaaagaatattgaaattgccagtaaacccaaatgtttttcttcagcaaaagccaaaattttctaatatgacattggtagttaataatacaggtggtagtactaacggaacaacttcgacaacaaaagaaggcacaagttccactgaccagcagggatatgtaagtgttcagtcatctggaggtaagtcattttacaacataaatgtgtatcagcaagaagctgaaaagttgaaagccaaaattttactaaagaaaaaacaggtacaggaacagaaaagattagagaagattagatatcaaattccaaagttccgaactatgtctgacaattgtgatcgaatcaagattaatggggacaagtacgcagtgacggaaaacggacgagcacttgtacccattagaatgtttcagcttactaaccctatagagtgtatttggaatggaaacaaataccaaaggaattcacaagggagtgtttaa

SEQ ID NO: 12217 - DNA, 189 bp, Candida albicans
ataagcgcgcgtgtttattacttgagcaataatattattatatttaatgtggagcgagagaggagaagaaaaatagaagatgaagaagggaatcttaaatcttgtataataataataataataataaaatggagacaatataactacgcacaacaaaaaagaaaactagaatcaccaattactacttaa

SEQ ID NO: 12218 - DNA, 216 bp, Candida albicans
ctagcattaattgctttaggttcgggaacaaatggagttcctaaaattttcaatattttccaaatctggtctaattcattagaaccaggaaatagaggaacaaaattggcggtctcaactgctaccgctccaaaagcccaaatatcaatcggacgtgaataccatttctgtctaagtaatatttccggtgaccggtaccacctagttgacacatag

SEQ ID NO: 12219 - DNA, 282 bp, Candida albicans
atagttatattcgtagtagtagttgttgtgttaattgaaagaaaagaagaagccttgtttgatatattaacacactccgacgacatattcattccatactacacacacaaaaggacacgcccgaattctaagtttcaagatcatggaaagaaaaagttacagcctacaaaaagagtttattgtaagaaaagaaccacccgcgacaaacaacaactgaagaaagaaaaaaaaagtccaccgcgacatttcatgattaattattgttgttgttgttgttgttga

SEQ ID NO: 12220 - DNA, 213 bp, Candida albicans
acaataactagcaagaaaactaaagacaatagaatgagagagtttgattgtttaccccataccattaccttaatcgcaaaagatatttctaaccaatacagttttcgtatgattacaggttcccagtataaattgagaatgaaagaaatgtacaacaacttcaaatatcagtgctaccattgtcaagcttcttggtgtaaaccatttagttga

SEQ ID NO: 12221 - DNA, 234 bp, Candida albicans
aaagtgtccaagatgatgaaaggatttaaaaacagattgacccgaaacaagggtcaatcaacaaacaaaaaaacagaaaagaaagacaaggaaagagaaaaggaacgggaaaaacccgaaaaaagatcttcttcaccaagcagtttaagcttgaatacgtcttctttcttccctgcaaagttcaaagaatttaatgacaaatacttctggatcgttgaaatccaattctcctag

SEQ ID NO: 12222 - DNA, 186 bp, Candida albicans
tattcactcaagaatatgataatgaaaacctcggtagtaatttattcattttataaaaaagaatttcaagaaagagttgaaatcgaaatcaaaaaaaaaaaaataaaaaaaaaatattgtggttttgtaaatatcaaaagcatggaaaacaaatatttttataatgcctcactttttcattcctaa

SEQ ID NO: 12223 - DNA, 249 bp, Candida albicans
tcgtggttgccactttctagcataacgaatctaggcaagttgttgacagggttggtgttagtagaagatcctgatacatttgtagatgacactgcatttgatctagttttgactgacgtggctctagatggtggtgttctaaaagatgatgtacgcgatactgttggagaaggtctacctgtcgatggtttgtcatttgaagaaattgccacaggttgtgttgaagatcctgtaggggatgctatttga

SEQ ID NO: 12224 - DNA, 192 bp, Candida albicans
attattaatcggaaaactaaactagcggataaagatgttcaaccgggcgcaaattctgggtcaggtaatttctgtgtcatgtatacaggtcgtcaaaaattttttttatttatttttggattactaattacttcaccaagtgatgacgatgggaggcagtattctaattacgagccagtctatgtaaactga

SEQ ID NO: 12225 - DNA, 216 bp, Candida albicans
attactagcaagttgtacattgatgaaagggtttggagtttatcaattcataataatgatgatagtaacagtttaatagagtccatgcatgtgtctagtactattggaataatgtcttcaattaaagttcgattgtttaagttagtttctaacaggtccaaattaacaagtattttcttttccttcagccattaccagttgagccacagacattga

SEQ ID NO: 12226 - DNA, 186 bp, Candida albicans
tggtattgttgggaatgtaatctagtaatttcttttaaagaatggctcttttttgaaagagtgtttggtaaaatattaagccacatttggcaaaatacaacgcgaaaaaatgttaaaaaaggtcaactacatgctatcttgcagaaacccaactcttcaccacgcactggaagatcccacttgcgt

SEQ ID NO: 12227 - DNA, 216 bp, Candida albicans
gtcaagaatattcttatggttacgaatcagatgatgaagattatgagtgagcacgatcaaaatgggttcttttatttatttattttttatatacacataaacttctatttaaatagttttttcaaccaaataaatatcgtatttatctttcaattctttcataatagaatcgttaatgtcggaactcattggagccaacaaaccttttttggataa

SEQ ID NO: 12228 - DNA, 213 bp, Candida albicans
tttatccaagggaagaagtcgtggttgcttttactatattttataaagttaagtagatttcatttaatgacaaaaaagttttctttatttcatgacaaatacatttatgatcattcgaaagattctgttgggtttggtccagtacaattatctacggagtttattatttcattttcaaattccattattctatattcttgttgcaggatttga

SEQ ID NO: 12229 - DNA, 441 bp, Candida albicans
cttatctattttgagaacgaatacaaggggatattctcatgtttaaatatcgtttcagaacggttcattttgattattaatacaacgaacaataaattgaacaaaactgaattttctagtggctttctaaatgccgagtatttttttcaagacacaaaaacacccaatagcgtgttaataatagtagaagtttgggcaatcctgaaattattgaatctccctaatcaatggtcaatgttaaagcaatattcaaattgctactactaccactacaactactcctcgttattgattaatcaatttcgtcattttgcatctattgcagaaaatattacaaaccataaagttctcagatcttgtaaccacccaccccccttttttttccaacttaatggtgaattattttatcttctggtttattcaatagcttacatcgattaa

SEQ ID NO: 12230 - DNA, 225 bp, Candida albicans
agaaattgcaatggtcttagcgaattgcaactacaaagcgataaccaaacttcttggtgtcagactaatttgtctaaaacatctactttacttgtttacgatggatttagatattttaaattgtttttttttttgaaaaccctaccggttgtgttttattgttacttccaattgtacacaaagccagtatacgtattcaaatcctgcaacaagaatatagaataa

SEQ ID NO: 12231 - DNA, 222 bp, Candida albicans
actatttttagaaatcaaagattgctcaattcattcattctaatatacttcttggttttgctggaaagggaaaaagaaactgctccgaatagtgagttctccatgacacatgtccggctcggctcttcagtggatacccaactacaaaacagctccataaaaattgatcaaagtttagttagatataccatgacttttgtgcatgaattaaatcaattgtaa

SEQ ID NO: 12232 - DNA, 666 bp, Candida albicans
tcattcttactcttattctatttgaaagcttcctttatatatttgttttcaatttgttttcatttctcattctttttatattcacttttgcagccgtttgaaacactacaaagtttactactacaatttttttttttggtgaaaccaatttgcttcagaatgtcagaattcatagttgatttgtttccttcagaaatctccaaactttatttgttcacttcattttccgtcttgtgtggagcagttttcttttctgccaaagtcaacaagaccattaactcagttttagtattttgttgggcttgctttatcaaaccgttaattcagaaaaagactaaaggtccaaacaaaaatcaacaacaatctttagagtcattctacaagaatcaagctcatatttatgataacactagagaatttttgttgaaaggtagacaagaatgtcttagattagctatttcccatttacccaaaaagaaagatcttatttggatagatattggtggtggaactggttccaatattgaattcatggatgaaattagtaaaatatctgaaaactttaaagctgtttatttggttgatctttccccatctttgtgtgaagttgctaaggcaagatttgaatcccatgatttgacaccacgggactggaaattcccgcgc

SEQ ID NO: 12233 - DNA, 204 bp, Candida albicans
agtatcaagggggataatgcattggtatttagtattggagaaaatataggttccgggaaatgtaaatctgtggttagtgggattaaatcagaacatgacaccagtgggtttttttgcactttcttgattcttttagatggtttaaatgatgttggatttagtatttttatttcgttatattcacaaatcaagtctctagtatga

SEQ ID NO: 12234 - DNA, 225 bp, Candida albicans
atttgtgagagccgttttatcggcccaaaaaatgtgtattcatcaacgtgtaacttaaaaaaaacatcaccaaatcaacatctcaccaacggccaaccacccaatgatcaatctattcgtgcaacaccataccatcccccatctactagcataccttccatctccttaccaatgacacaaaacttaaatcccgcaaagccaagcgtatggctgaaccacaaataa

SEQ ID NO: 12235 - DNA, 192 bp, Candida albicans
ttgttggccgggttgtacaaacagcagaagccaaaacctgcagccaatcctgaaaagcatggaccggcccaggatacccaagtgtatgaagaccaggcaaatgcaaaaagaccaacaggaacaaaccagcatgcaatcatcatggggattaatctgagttctggtggtggcaactctcctctatctctgtag

SEQ ID NO: 12236 - DNA, 255 bp, Candida albicans
cctaatacgcacgacttatatcaaggtgatatttccctgacacaaacgtcgcataaaccaacaaaatttgaagacgacaaaaaaaaaaaaaaaaccacagcaactgatactcactcctttactgataagaccaaccaatgctggaagaagaagttcacgacacgtcatcagaagcaagtgaggttttcaccaaccagccaaatgcatttgttcgtggtgttaggtctatttttggatacaggaagacttcgctaa

SEQ ID NO: 12237 - DNA, 210 bp, Candida albicans
aacggctctcacaaatttatagccgacatcggcaacaacggcgagatgtataaatcgcgtgaattagtcacagaccaactgggcgatttttcaaccgatgctgaatttttcaacagatccgacgcaaatccctttcgggtaaaggactcttatttagaaggccactgtagcttatcttccctttggttgagcgttttttttggcttgtga

SEQ ID NO: 12238 - DNA, 189 bp, Candida albicans
ttaactgttattggttccgggaagtttcaaaaattgaggagaataccatacgttgagagtagtcaaagattccttgttggtctatacgaagaggaggggagcagcttatatggtaatacaagttcattgtattatcaaactccgagaatttcataccccccaccagatatacaacaaaagattttataa

SEQ ID NO: 12239 - DNA, 678 bp, Candida albicans
gttattttttttttttctgggtatttttacacacacataatatattattataaatacagtcatcaattttcaatggggaaaactgctgtttcatcttcaattcaacaatctaatcatcaacaacaacaacaacaacaacaacaggaactgtgcgcacaacttcaacaattgcaacaccaacaacatcaacaagaacaactgaatcgtttacatcaagtagaccaaccttatcaatcaatacaattcgcacggttaacaagaccaccaaggataaaatcgcctaaaattaaagatagtactttgtcgactttaactcaaagtgcgaatgatgaccaaaaatttctatttagcaatttaaacaataataataataacaacagtactaatacctataacaaccctcaaaacaccacttatactttaacttccgcaaaagaaactaattaccctcatcaaccgagttttagtggacccagtttaaataataatttcgcgtatttgaatcctacaaataatcgcaattctatatttaccaatctgttcttccaacaacaacaacaaccacagtcacaacagacacaagtaagaaataacaatatatcaccacgggatttgaataataagaacaacacaatgatgcattgtcttcacccacgggggctggaaggtcccgcgatt

SEQ ID NO: 12240 - DNA, 396 bp, Candida albicans
aaccgaaaatatgtaaaacacacaacgaaacactggtttcaacttagactttataataagttcaatgccaaagcaactaaagaaccaaaagtcacagttggaatagtagcagcaaaaccaccagatcttgtactggaaccagaacctgaacctgatccagatgaagttgaagagccggaacctgaaccagatcctgattcagttgaagatgagccggaacctgaatctgagtcagaactatcagcagatgaagaagatctggaacctgaacctgagcttgatgaatcagagttgcttccacttctagtagaagagcctgaacccgagcctgatctgctgctggttccattagtaaatcctgaacctgttgtaatactggtcatactaccagaatga

SEQ ID NO: 12241 - DNA, 213 bp, Candida albicans
aaatttcaggtagtagaaggattttcagtcaccgtgacttctctattaagtaaagtaagacacgaaaatgtactgaaattaccaattctgcggtttgtctcctcctctgctttgtacgcaacttatgcaagaagcatgctgaaattgccgtgtaaacaacaacagtgtgacaaacctcacgttgctcagtctaagcaagcaccatcaaattaa

SEQ ID NO: 12242 - DNA, 1239 bp, Candida albicans
ccaaaaaagctgttaaaactttcttttcaaatactaaaccaaaacctttaccacacagtcatcatgagaccaactccattattctttgcacttttacaaattgctcttgccgcaaaaagagctgaccaaatttgtaacgaccactgttctaacgcataccaaaagcaacaatcttgtggtggtacagatgatgttagttcccaatctgctactttgaaatgtttgtgtgctgatgaaagttattggtctgaattggctctgtgtgattgttccagctatgattccaatgtttctgctcaagaactccgtgcttactactgtaacgttggtgtaactggtggctctcaaggtcaatctacaagtggtgatgctaatgctgccactaattctaatgatgctactggtactgccactgatgctgccgccgctactaatggtaacgatggtgctagtggaactgccgatgcaaacaatgccaacaatactgatggtaatggtgctacaaatgcttctaataccaacaacaatggctccactgatactgctggttcaagtggaaatgccgcttctgagacttccagtggcagtaacaatgctgctgctggtgccgctgctggtacaaactctgcatctgatcaagcaaatgaaactggttctgacgctactaatgctgccacaggctctgatgcctctggtgctgctgccaccaataccgcatccactgcctctggagccacttctggctctggttctgacactgctaagaagacaggtactaatactgattcagactcagatactgctactaaaggttcagacgctactgctggtagtatgacaactgctgcttcaggtttaggtgctactaatggaacaagcaacagtactggttctcattctggtagtatgaccagtattacaacaggttcaggatttactaatggaaccagcagcagatcaggctcgggttcaggctcttctactagaagtggaagcaactctgattcatcaagctcaggttcaggttccagatcttcttcatctgctgatagttctgactcagattcaggttccggctcatcttcaactgaatcaggatctggttcaggttccggctcttcaacttcatctggatcaggttcaggttctggttccagtacaagatctggtggttttgctgctactattccaactgtgacttttggttctttagttgctttggcattgaacttattataa

SEQ ID NO: 12243 - DNA, 219 bp, Candida albicans
attttacagtatatgttgacaaggatctggaatcgcttctattctacttcagccacacccaaagctaatcaaactaagatccttttttttttcaacatggagaaaagaaaaaatgaatggaaaaggacaaaaatatataacaatagaaatcttactcacaaacgactagaccagattagagatgagatgggacagacggaggaaaggacaaaaggataa

SEQ ID NO: 12244 - DNA, 216 bp, Candida albicans
actgtatatgacgaattggtttccgactttatagatttggttttatgcccgttggatgacattcatagaagatatagaagttgtggtttagttgaaatgaatggtaagcttagagagttgtttggttgtaattattttttcttgccagaaaataggtatggaatgcaaacattggttactacaaataataatttgttctacaccccaaaagtctga

SEQ ID NO: 12245 - DNA, 264 bp, Candida albicans
caatacaaccttaaccaagaaaccagggctgcaaatgctattcaacaaaaaatcaaatcatatattaccaaacgtttgattggaatgactataaattcaaaaaatcattacataataaacattggttctttttcatacactccttatggaacgcatgatggcaatttggaaaataaacaaagttttcttgtactaacaatttaccacatttgcgacacggttcacctggttctattatggccaaaattgttttctttttgttaa

SEQ ID NO: 12246 - DNA, 420 bp, Candida albicans
cacaatcagtcgtcatctatgaagttcagcatctccttagatcaatttcttcagtactataatgaacatgggaagcatcctgaacttttgaagtcatcacaatttgattcaaataaaataatagactcattagcaagtaatataaatgattcaagtaaccaactacaattaccaccaccgcaagaagtaaacattaatgatctagaacttgatgttgaaaacctacctcaatgtatgccaccagcaaatcaagaagaatatgaaaactatttaatgatgaagaaaatccatcatgataatttccttcgagaagtcaatgaaaagggtttacgattgaaaaatcaaatgacggattcaacacaacctccatttgattcatctcgatctagtattgaatttcttagaatgatggggaaataa

SEQ ID NO: 12247 - DNA, 267 bp, Candida albicans
atgtcatccaacgggcataaaaccaaatctataaagtcggaaaccaattcgtcatatacagttcattcactagatcaacaacaggcgtcaatatgtgataatctacaacaagccaaatttgaattagagccggtacatttgcagtttagtttatcaaacaaacttaacaagctattggtatcaagcaatataatgtatatcctattagccaatgttgtttataagattgatttggataatccttcacaggtggagaattatgcgtag

SEQ ID NO: 12248 - DNA, 318 bp, Candida albicans
aacgttccaagtgtaaatcctcaagtgatgaaatcttcaagtgcactaagtcaatgtaatcagtgtcaagatcatacccagtggttaagtcctgatcagcttcaatttataggagatgattatatgttaagacagatccaagatattgaactgccagataacattgctgatttttatgttattaataataataataataataataataatattcatcttcagtgtgagaaagaattggttcctccttctcctcttcttgtagaatcccgaccggtttctcaactaattctttattggtttcttgtattggcattctag

SEQ ID NO: 12249 - DNA, 261 bp, Candida albicans
aactttttatttctgaacatacgtaaaacctataacctaaaaacatcagaaattataaacctcccccatacaaacaatatttacatatcaaaaatcaaaaatcaaaaatcaaaaacaaaccaaaaacaaataaagggggttaaaactcaaacaatacttttgaatagaatgaaatctgctcacaaaaaaacatcattctcaaatgccaattacttttttgcagctgctttggaaataggaatgttgacaatcttttcatga

SEQ ID NO: 12250 - DNA, 678 bp, Candida albicans
gttttacgtatgttcagaaataaaaagttttacttcttacttatttttgcattgtactacactaaattaaaacttactcatctaatgtcgaataatcctgtgctaatgaaacaatatgttcagaatattttcctgaagttgcaaatttttttcaatagatactcaattcctcatacaaccaacaatgttttcgagcataaccggttattttctcgagaaggtttggtttcatgtttggaggattctgttgatgaaattccaaatcatttaactactagcactagtattgatttaggtactagcgagttttacaacagtagcacaattgataccactcacaacgaaaatccaaatccaagtatatcaatcgaacaaatttgttccatgattgatgaagaattggaaattatcaatgaacatgatttaaataatcgattagagtcaagaggcagttttctaacaatatcaagacaaatgaatatgttaggatttcctactttgcctcgaagtcaaccttgtgcttatcaatcaacgaatcaaaacttatggaatgtgaaaagtattttaccacatactactggtagcgctttatctataaacagtgctgccactcctaaaaaaaagaaaatgatcaaaattctcaaaagtaaaaagaagagagttcaaacggcatattag

SEQ ID NO: 12251 - DNA, 219 bp, Candida albicans
atatcaacacgacaaccatcagcaagttacaaaatcaaattaacaatacaaatgccaggaaccaagtcagcattagacaagtcattgcagttattgtataattattcaactaattttcaagtatcaattgaactaattcaaaaattggcacaacaattaaagttggaaacatttattgatagtctgtattcgaccacggaggctggaaggaaccgcgct

SEQ ID NO: 12252 - DNA, 204 bp, Candida albicans
ttttttattgcccgtgtaaagccagagttgaaggaatatagtggatgttgtagcaggataatggatacagaagaagacgaagagcaatgcatattcgagcttattagtattggtaccatgtcgattaagttgataatcaatcaacgcactaactctccgtcatctaactggagattaatttctattttgtctatgaaagattga

SEQ ID NO: 12253 - DNA, 201 bp, Candida albicans
atatttttatttggttctggatcacctctgttgtttagaaaagtcaccacaaaatcgtacagtcaagaacagtacagagaaagagtagtaaagagagagagagaaaaaaaaaaagacggagtgagaccagaagcggaagaagaagaagaatctgtacaactaaaaaaaattataaaatataaaacaatctacaataactag

SEQ ID NO: 12254 - DNA, 183 bp, Candida albicans
atatttttacataaaagagaagaaaaaacagttttttggggaaatatttttgaccaaagtcttacaaaattatttttaaacagagtctacaaggttgacccttttgaaaacacagtcaagcaaagtacgaaaccctctttcattgccaagaaaagttcttctacaacattttcaatcgagtga

SEQ ID NO: 12255 - DNA, 408 bp, Candida albicans
  unsure (92),(96): Identity of nucleotide sequences at the above locations are unknown.
ccattaaggcgaccgagtatagacgactcggaaaaaaaattggataacacagactggattgaatatattcaaaatgagaattattactttanaganagatacagagacacaaatatcaaggcccgtgactttaagttcttgtataactttaccattaattcaattcgcaactccaccgaggttctaacaaacaaggaggataatagcaatttggccaaattaggaatttaccccgagtatgtgaaccaatcgagggggaaaagaccaaagttaacgtttgcagcattggctaaatttgtgctagcagccgttcgaataagacaaagaacccgggatcaagctgagagatacagagagttgacacgagttagaggagaagtagacgtggccagacttaaatacaattaa

SEQ ID NO: 12256 - DNA, 654 bp, Candida albicans
ttgttcttaaccatgtctagagacggaaccttttcatatattcatttagatgatcccaataaagtgctctatattgaaaggtggaaggatgagccaataacctacgatgatatagaaaccagtaacttggttgaagctgctgtaaatgtatatccccaattgtttgccgaggaagaagaagatgacgggatcctaaatttcccatctcaacaatttgggtcaaagctttataaaaatagacgatcaataaagcaaaaacgatggatggatttgaatattgaaagctttaaactggataacaagaatgtggtggataaaactttggttccacctgtggctggtgaacccgatttggccgaatttctaagtaatggatacaacaaggaagagttgctggtattacaattgtcgccaggaaacaatacggttttgcataatagtgatatgtccttgaactcgacgtcagactatgttggaaactcaaacaatacatttattaacatgagatcaaattctactagccatcaacagccctcgcaacaacaacagcaacaacaacagcaacagctgcaattccaaacacctagacctggaagagtgagacaagtttcaaccgataagtttcaaactcctgtgagtcgaatcatgagatga

SEQ ID NO: 12257 - DNA, 255 bp, Candida albicans
acaaaaagaatcattatgtcatatgaaagaattgaaactatagataatccatttaatgatgggaatattattgataatgatacctcgacacttttcgtaaccgaaaataatgatgatgacgatgataatactattaccaccaccactaccaccatgcaaaaaaacaacgacgacaatcagagttctggctttcaagaatcatctaatcaagatgttactactgttagttcatcatcaccgtccaaatggccataa

SEQ ID NO: 12258 - DNA, 306 bp, Candida albicans
aagatattacgaggaatatttgatgaattttatgccacaagtccaactaaaagagttaaaattagaggattaagaacaaaacgtaaagataaaggtaaaagatcaggtgaaaaatataaagcaaaatataatcctctaagtgggggtggtggtaccggtaccggtaccagcagtagcaccactactactggtgatttcattgatgaccaagaagcatttgaaatgcgggcattgaatgaatttgatttcgaaagcgataatgatgatgatataaatgtgagtcatactagacgacaaatgttatag

SEQ ID NO: 12259 - DNA, 330 bp, Candida albicans
cacgagatagagaatgtgtttaattgtcggcaatatatttatagtgaggtcatagccacaaaatatacaagaaaccccttttctcctgcatatagtgttaggcttgcttttcttgcttttaaattagacaacaacaacaactacaactacaactacaactacaactacgagccaagccaagtatctttccctcccactacagtttatattaatttattagtctttgaaacaataaagagagaaaactcccaaccattcaataacttgataatatttttaaattgtttaggtcttccccccccactccttcatttcctcatatttagatga

SEQ ID NO: 12260 - DNA, 201 bp, Candida albicans
ggagtagtgcatcatttactaaaattattttgcgttattttaggtgtcattccggaggaattgctttccaccacccaccccaccccacctcccgccatcataatcttagaattgaaaaacccaaacccaacacaaccaaacaaaacaatcaaaaaatatggtgccattcatattagggcctcgaatcgccacgttacctaa

SEQ ID NO: 12261 - DNA, 231 bp, Candida albicans
aataataataccacaataacactcaaaacacaagaactagcagggaataaatacattgcccatttaatttcttgttttaaaataggggtcattaatccaacaacaaaattactaaaccaattacatgatactgctaatgatgccccctttgatcttactgataatggatatgattcactcagtaataaaaatgggataggaccaaacccaaaaccaaatgatgcattataa

SEQ ID NO: 12262 - DNA, 204 bp, Candida albicans
gaaggaacaatcgtagataaaatccctacacccatccctgaaaaaactcttccaatggccaatataaaaatattgggacaaaaagcttgtaatgatccaccaatcataaatataaatgttcctaataataatgttcgtttccgaccaaatttatcggataatttcgctaccataattgaacttatcatggccccgatttcttga

SEQ ID NO: 12263 - DNA, 198 bp, Candida albicans
ttaattgttgatacattacacatttcatctgtatattataaacatgggattatattttgtaagagagagagagaagcaacattagctttgagtaattgtttgtgggggaggtttaaaataatatatttttctaataaagtaaaagtaaaaagtaaacaaaaagaagctataaagtctaacaataataaaccaagctaa

SEQ ID NO: 12264 - DNA, 207 bp, Candida albicans
atatattcaattattacacaaaactcaccagttatagtttggaggaagaagaagaaaaagagagggaggggaggaataccaattcctaaactacacaaaatgaataataataataaagatgaaaaattgttgaaaaaaaatttgtttcaattttaccattatcttcttattaattctatccccacaaataattcaaagtataaatag

SEQ ID NO: 12265 - DNA, 252 bp, Candida albicans
aaaagcaccctttctattcttgttttcaaactcgcggaactaaaaaagcaaaaagtatttttgatgtcattgggttttataaaaactaagaatagaggtagacttggaaaaagggtgcgttccattttacaccgtgttgcaatgttttgtattgtagtttcagttaagtccgtcacacaagctctgtttttttttttggtggggggtagaccaggtgacaataatagattgggagagcggggttcaatgtga

SEQ ID NO: 12266 - DNA, 753 bp, Candida albicans
gtcatgccaattgagttgattctttctccgctcatgagaccggcagtccatgccaaatcgattttatttgctcctcatcgtaatgcttcacattatgtcccaagaattaaagaactccctccaccagaaactatttcacaatatgctgtaataagaagaataggtactggtagtaaagtgtttgatgtttttgatactcaaagaggaaaatatcctactggtcctcaagatcccaacgaaagaatcttttggttcaaacgttcacgtgctgctaaaggtggttatacaatgttttcccaagatattctacacacgggaccaaatggcgaagatgaacccattgccaatgtcagagctgggttgagaggcaatgttctattaattcgagcttcacaggctcctgctgctgagttaggctggcacataatcaatcatcgtgtggatgctattgacacgtatagaatgtttaccctatgcgatggtaatacctatcaatggacctatcgaggtcaatggcttgagaaggtttccaatgttggtgaaaaggaatcagaagttcgagaaagaatcggccgtgtggtccccaatggtgattttgggtttaccttgtttatcgatgaatcgaaaatggttcgagaaatggcattaagtactgcgttgtgctcatacattgatcagtggaatactaatcttgaagtcggagggatttactatggacgccaaaagggacaagtacgctggaagagagattga

SEQ ID NO: 12267 - DNA, 201 bp, Candida albicans
tctttcaccgtatatatggaaatgagtttccattttggtgaaaaaaccaaaacgaaaaataaattagcccaagatgatgagtcagtctgtatacttagaccaattcaaacagtaccggttatgagacacagattctcctgtaccatttgtgcaatagcaagaattacagataattatggacctgtcaggttctcgatgtaa

SEQ ID NO: 12268 - DNA, 297 bp, Candida albicans
aaaggggttgaagtttgtgaatttggacatgatggatcagattgggaaaatccttggttagtgtcattccaaaatattgaccatgtggaattaatcgcagcttcaaatgcatcatggggatcaaatgaagaagaagaggggagggatccacgtttgagaaattttgttgttgatattgttaatgcaaaagtggtatatgatattaatgaaagtagtaataatataaaacgaaggaattgttgcattttattttattttattttatgcttaacaaagaattgtataaaaggagtgtga

SEQ ID NO: 12269 - DNA, 186 bp, Candida albicans
agaaacctttttgtcgacaatatatttgctaaaatcacctttgttgaacatgaaattggtaatactgtacatatattctatcaatcaatgaaggtgaaattgcaaaaaaaaaccgcgaaaccttattttgcattgttcatgaatgtctttgagagtgctatctatatatatataattgctatttga

SEQ ID NO: 12270 - DNA, 210 bp, Candida albicans
  unsure (187): Identity of nucleotide sequences at the above locations are unknown.
acccaaaaatggatacgacaacacattacaacaaaagataaaacaaatcagcaacaggtgtgtctcaatagatatgtatcatctcatgctttggtgttggtggtggtgtgtgtgtgtgcatttaaaaatcaacggaattttcggattcctttctaccatcattatcatcatagtaagaaaatctgtnttcaccacgcgtggaaatccacg

SEQ ID NO: 12271 - DNA, 207 bp, Candida albicans
tcggaaggggaaacgacagagagagagagacagaaaagaatgtttcgtgtagttgcggcaaaagaaacaaaaagaggcaaaaaaattttttatctctcacttcaaacaaacaataaacaaaacaaaataaaacgaaactcgcccgcaaagggagagagtagtgtacaatttctttttttgttgttacacaaaatcgtaatacgttaa

SEQ ID NO: 12272 - DNA, 270 bp, Candida albicans
tctacactttttttttcttgtactactactattgtttataaattagacgaatttcgcactaatactattgcagttaaaacacaacacaaaattgacatttatacacacacacattataagttattccaaactatatctcccataccttacagatttagttatttacattttgcctactttgtcttcttagatatattaactttattatgtatctccttctgtctccttctttctggtttagtgataggttgttgttgctgcattatctaa

SEQ ID NO: 12273 - DNA, 240 bp, Candida albicans
ctcctcctgtctccttcgagtgttttgcctgctgcacatttacacttcctacaaacagctgctactactactgctactcctatttctttctcgcctgctaccacgaccactactgctatcgcctgttttctcatgtatgatcttaacttgcctcttctcttattcaacaaaatttttcagttttgttttttgattttaacctttttcataatatcggcccatcatttcattactaattaa

SEQ ID NO: 12274 - DNA, 213 bp, Candida albicans
  unsure (20),(22): Identity of nucleotide sequences at the above locations are unknown.
aaatatatttggattttttnanaaaacaatttgagaaaatattataaatggtatgttgaaaaattaaattatccattgttaaaacatttattcctttccggaaaacccatgtcttattccaataaaaatttaggtttttttttggcagaatggaaaattttcaaaaatatcaggtcgaaaaaaaacaaaaaattcctgggttatttatcttaa

SEQ ID NO: 12275 - DNA, 213 bp, Candida albicans
agaatcacgtttttgtcttttattaggactaattgtcattgtcgagagagaatagtggatgtcaatgatggaaaaacaacaatgctgaataaattttttagatttgaaggagaaggatttatgacatgtttatatagttggatttccaaaataacgaaatttcaatcaacaatttgtaataatgaaaaaataccacacaatcaaaaatgctag

SEQ ID NO: 12276 - DNA, 207 bp, Candida albicans
ccgcgagattacttaatttggttaaataattccgcaccaccaccaagaagaagaagaagaagtttgttaataaaagaaattgacttctcttctatttgttcgtcttattgtttggttaattcgcattttcaacgaatggaaaaaaaaatggtaaaaaaaaagttaatcagtcatccatccaacgttgttctcctttataaaccctaa

SEQ ID NO: 12277 - DNA, 198 bp, Candida albicans
tacatcataaacactccagggttgaatcaagctatagtagaaacacgtcactttacaaaaattaataataagctcccaagaaagagcgctcctattttgtgtagtcatatatattcatctaagtacttcctccatcctaagtttttccaaatttttctttcaaagtcttttgtaacttttcttcaaattcttctttag

SEQ ID NO: 12278 - DNA, 249 bp, Candida albicans
gaaaataaagttgagagttttatatattttgaaaagagaacttgggaaaatttttttcttttgaaaaggatggtaaagagaaaacagtatttttggataggtgaaaggaaaacaaattttttgcaggaaaatatttattattttagtttaaaaaagttcagtgatattctaaacattgaaaccacaacaacagacaaccacaataattggagtattgttaaagacttaatattgtatatgttcagataa

SEQ ID NO: 12279 - DNA, 336 bp, Candida albicans
caaataaataaaaaatataatatgtctacaatgccaccaacttccaaacgtactagaaagagaactagaaccgatgataatgctgaaccaactattcaagatccttcaccgccacttgctaatgttgaacccacaattcaagagactccaccgctggttgaagttagtgatgagactaattcaactgaaatcaatgagacaaatagtaatactcatgaagaaacaaatgtattaactaatgtgcactcctctccaatcgagacagttactgagaggaacttcaattttcaacaggttattgcctctatctccactgggacaatcaaaatctcttga

SEQ ID NO: 12280 - DNA, 228 bp, Candida albicans
caaatgagaaaatcactcaaacaagaaaatcaacaagatagtaaatcaaatttaccaaaaaaatcaactgcaaataacgaatacaccactgtcgaaaagttggctgaggtggtaactaagttagagtcaagggtatcagaattgacaaatgctggattagaaaaagataaaaagttagaagcattagaaaagaaattagaagagttgttaaaaagatcaacagcatag

SEQ ID NO: 12281 - DNA, 183 bp, Candida albicans
tttttcttagttggtgagaccccattgcttgagctagttgatttgaacgacgagacagtagcagaaggggattcaaatttagttcttaatagtgatgttgcagagccttttgagatggaagtaggagtctccggtttacttggagtaatgttcaaagctcttgccaaagcatctaaatcttga

SEQ ID NO: 12282 - DNA, 2940 bp, Candida albicans
gcagctatgggaactgttgagagtttagtgaaactaagaactctaaccaaaaaatattgtgaagatgatactcaagtcaatttcaatgaactatacaatcatgtttttagtgatgggccaagcatacaatatcttgatgttttactcgattgtaaggttctagacaaaacaatacttcttatagtggaaggcaagtatttagatactttgaaattttacaagttttcattaaggttattagtacatgaatatttcaggcgaaatggtaataaacggaaagtcaaagatgtgttttttttccaattgaataataaacttcgatggaaatttgtcgacaaattggcaaactttgtaattgacaaatctataaaggactatgagattaaaatagatattttgagattgttctcgattttacagctaagtgaagagtttggaagatatatttttgtgcattgcatctatgacaccgacatacagttgaattactcattggaggatatcgacgataacttgtccgaagatgttaaagaaaagagaaagaatcagcattggttgttacagctaattaatagttttggaatcaagaccgatgtatccctcacaaattggcaatgtgctattgtcaggtttttactttcttggtgttcaagccgtaaatacggggaatatattcaattgtttctaaaggcggtaggtgcaccgtcatactttgcaatatatgctagtcaagggacaattgagctggtaaatcttttgaagcatgttttggaaatcaactattgcagtgtcactttctctcaattcaggcaggctttacgtcttatgtttaaggatcatacacaacttataaacaaggttgtatcatatacttcgctttatgatagttcttttgagagcttctcggtattgcttaatcaatatttaactgtttcagaggcaaaggaattgcttgatcgatttattcctactgaaaagcaagctaattttggttctttaaagcaattgacagacgcaaatgataaaaaacaattttatatcgatttaatattgacgcaagtatatcaatcgtcgacattcaaacatcgtttttggaaatttgtcacagaaaagagctttgacgatattcctcaagatatgaagtttgtgactcattacccaacatttgaaaggtttgttaaagccatgagtttcgagattaaagatgatgggcttcgtgaaatacacgatcatttaaaggtcgtaatgggaaggataaaaccaaagaatgccctttcgtatactggcacaagtaaatactttacaaaaatcgagagccttgttaccttactgccacaggaatatgaaatcactgttgatgaacgatttgaaggagatgaattcaaatttgctgctgctgtcactatctgtaagcctgtaaaaggcgaaaatcttaagaagttaggtattggtttggttagagttggcaggatcacaaagcaaaatagaactttcatattcaagtgtgaaaatcttgagggttcaaatgttactcatttggtatttttgccaaatactgccattttgaaggctttaaaagtattgtcctacaacaacgagatgatttatgtgcaaaacataacaaatactctgttggtcaccaaatgtctttttgacaataatatgggagacagtactgaagattcaaacaaaccgttgtcggtatctcaaattttttctgtgaagaaatatggtgacatatcaatggtacttcctgatgtcacggattttcacactatagttctcacgccatcaaagactttccttcagcaatacaaagatgtcttgttaattaggtatggagatgcacaatcggtcgatgctgttttgagatatgccagtgaatattttgaaaaaatacaaaccgttcttgggaatggagatgttttagaattgaagaaaatttctctgcctttgcaacttgatcggattttagacaattgtcttaacaagtgggataacattattctgaccaacggcaatgagttacccagtgagtatttaaaaattgtgagaaatcctatatctaattcaagtgatgctgcaagggaaacgacatttttaaagcaaactattagagttataaagaaagcatggtttctatttggtaaagatctcaacatgacggtgtggaattatatttgcaacagcttttctgttgtaatgacagtggacgattggataaaggtctttgataaaatacaggttgacacttccttcgtgtatataaactgtgatgtgctggtacttttaatgtcttacttcaaagttgattggcagaaacaacgatctggtagcattaaaattattggtggtgggttggaagatttgttttcattcaaaactccagaagaaattacccacaaaatccagtctaatctgaacattcccacgtttaatccaggattgggttgtacaaagcaacttatatctgctcaaaaccaacttgaagaagctgaactatgtgtgttattatatcgctacatgcgagctttaggctatccacgtgagtcgattggtatatgggtatcgtgcaagcgacagttggatctaatcaatgaaattgcgaaagaatcagatttagataaagatgttgggctgccaattgtgcttttcaataaatctgggattcatgattatgatcatgttagttattctattgtatctctcttcactgattcagggtataaggagcttgattgccctggtactttgggaaattactacttcagtagtaacatcgaagtagacaaagaattgcttgatttatctgattctacaacagattacaggctaaagattgttgaaggagaaaagtttggcttaaaagagaggactaatgaaagtaccgttgctgtacaaagtaaagtccaatttcaaaagttaatagatcgtttataa

SEQ ID NO: 12283 - DNA, 312 bp, Candida albicans
cctttttattgttcctggagtactggtattaactcttcctccgaaaaatttttctttgtgaattgcgttcgttccagagagttccagagcaaaaaaatgaccccaacctcccccatacgcaggaataatgcaaatgctaccaaaatttacatttcaagtatccatattaagaacttcttgatctacaaaccaaaagatagaaaaaacaaatcaaggagaaacgtattcggggggcttttgattagctttataaacgatctattaacttttgaaattggactttactttgtacagcaacggtactttcattag

SEQ ID NO: 12284 - DNA, 198 bp, Candida albicans
  unsure (188): Identity of nucleotide sequences at the above locations are unknown.
gcaatggataatatcaattacacaaacctgaagaggatatctgcagacataaaacaaattacaatcgagctaaaaactttggaagcacaaaaatctattcatcgcaaaaaaagtgaaaaaacaaaacaaaacggaaacggaaacggaaacaaaagaatggcagtttgtcgagtaaatatcgtgtgtcngaaatggtaa

SEQ ID NO: 12285 - DNA, 417 bp, Candida albicans
  unsure (375),(377),(402),(404): Identity of nucleotide sequences at the above locations are unknown.
tcaaactttaccaccatggctcatccaggtagaccaagaggtcgtatgaataaaaagacattacaagcgcaagctgaactagctcgagcacaacaagcccaagcacaggcacaaatgcaagctcaacgagcggcagcagctggtcaattagccccgggaggaaatggaggaggaatccctccacccaatggacaatctcaacattctgccaaagaagaaactcttggtgttcaattacatgatgaagctgatttgatttcgtttagaaatgatgcattattccgatacataaccaatcatgaatatattgagaatgtgacgagtaagttaattcatacttcaaaaattattcctccaagttcatattgttccccntnggaagagaccgtaagcgaccaaatngngggaaatccccca

SEQ ID NO: 12286 - DNA, 183 bp, Candida albicans
gtatatttattggatatgttattgatgttttctaggcttcacggtgtaaaacttaattgctttttagattcatcgcagtttttgctgcaccacagacattgggcaagaaagttatctactaacctcaaggatcccatagaatatatacaactatcagctcatatatttctatttctatactaa

SEQ ID NO: 12287 - DNA, 300 bp, Candida albicans
aataatcaaaacccattttactcagtattactagtgtgtaggcattttttctctcgcttcaattctactaatgttaaatcaacagagagaagaagggaaagaaaaaaaactttccaacatttactatacgaaacacctacctactctataacgcaaattcccacaatgaacgtgtttagaggattaatatctattcctcgtatatcgtgtgtgtcacagatatattcagctagacaattatcatctacattgccagtctcaacgtcttcactcgggactgccggatccccgctcatttaa

SEQ ID NO: 12288 - DNA, 219 bp, Candida albicans
cctcaaggatcccatagaatatatacaactatcagctcatatatttctatttctatactaataaattacacatatatcaacttaatcaaaactaaaaagaatggcttggagaaaaaaaaaaacttgagcccaatgtgtggggagaaggaggaaaccacaaatgaaaataatatatatattgaaacagtcaaaatcaaaatcaaaatcaaaataagataa

SEQ ID NO: 12289 - DNA, 267 bp, Candida albicans
gtgaagtccattgtcaatacgtcaataaaattgccagaggtaccatattgtttgaaatttgatttcacatttttgtcattacctctaccattaagcattctaacgtcaatatcagatccaatagggtatcctccaaaatgtgctgctgccactaggaacgaaccagttcctgtgaatgggtcatatgtgattttgcctggtgctatttgtgcgagattgcaagtaaccaacgatagttcggcttcaaaagacgttgttcctatgtag

SEQ ID NO: 12290 - DNA, 195 bp, Candida albicans
gattggagatatctcggagtatttatactattgctacggacagaggaacaacaactacataaatttactagaagcccccacggtatcccccaaatatgtgggggatgtgctcgcttactttttttggtggaacctcatcaccccccacacccatttattactactactcaaattgggcaagcagagagtttataa

SEQ ID NO: 12291 - DNA, 192 bp, Candida albicans
tgtttttttttttccttgttttcttttgtcgttgtagcgagaaaaaaaaaagtgtcttcacaagtcttggactcaattttcactcctccacaaactcaatttcaattaactatcaataatccaatatgggtaaacagtatatatctacagtcagtgcatctcaggctcataagctggatattcttggtgtag

SEQ ID NO: 12292 - DNA, 645 bp, Candida albicans
gtaacgatgaaatctggtttactacttgctgtgattttaccagttgcttttgctgtgaaaaaagaccaacaaagttgtaactccagttgtgtcaaggtcttacaaaaacaacaagaatcatgtccttcaggttcagatgccgattgcttatgtaaattatctgactcagattactgggaaccattgactgactgtgattgtattaacccagataaaaaactttcagcatcagaaattaaggttcaaatatgtggggctccatcatcatcgtcaacaccaacctcatcaacagaaacaacttcatcaacagaagcagaaactaccgaagcagaaaccactgaacaaccaagcagcagtaccagcagtaataccgagtcatctaaaactactattcttgaaaccccctctatacaagagctcaatgctgaatcaactactagtgttattacccccttaacagaatcagctgtggctgccgtagcaaatactgacaccagtactttaattgaaccacaaaacacagaagctacaccagaagttgctccattaattcaacctcaactaaataatgggtctgatttggcccaagtatctgttcaagcatttgaaatattgcccacgaggggcgaagaaaccgcgtgggat

SEQ ID NO: 12293 - DNA, 225 bp, Candida albicans
gggggtgagaaagagagtaatacagttttcgaaaaaattaagaatggaaatcacaaaaataattggcctaaatcggtcatatatttttttttgcataaacagaacgacaatctaaaagcccaacggtattttaaagtccaaaacgtttcaatggacaatgtagaatttttttcattctcaaaccgttacagattccaaagtatccagttttacggctgtgattga

SEQ ID NO: 12294 - DNA, 936 bp, Candida albicans
aatttcatttccatacatcgaaacatgagtgatttggaatatgatagagacgtggctatggaagaaccccagccttatccacaataccagagacccccacctccaagaaaaatagattttatcgggcttgacttgccggatattgcagatccaatgtacaagtcaaaacctgaacaagatctcgatgtccgttacgaagtgaaagaggagaatgaattccatgagacaagagcattgtttattggtaatttgcgccgtcctatcaatgcagcacactttcagctgtacttgagagatttggcacgggaagaaggctcttttataatcgagagggcatggttaagcagagctagaacacatgccattgtgttggtaagcagcgaacacggtgcagtatacatccgttctaagctattgaataccgtgtatccgcctaaagaagaggaaaagagattgagacttgagtttgaagaaaaagaaattgagcgtttcgaggaacaaaagagattatacgagcaggaattggggaggttgaatgaaaaggaaagagaagctttgcctcctccattagagccaagggaatatgttaccgaaagaattcccttgtacgtggagtacatacctgtcaaggcgatcaatcaatggacatttgaagaagatagaggaccaagagatggtaagtggaaattggagtttgagcacagagacggagacacagttgcctcacatacattgttgaacagtgattacatcccaagatacgtgccaactagaagaggcccaccaagacgatacaacgatagaccttacaatgctcctccaagaagagctgatagctacgtgccaaacgggactaatagaagaacagatacttatataccatcgagagatagaaatagatcgagatcgccttcaagatcaccaagaagatactag

SEQ ID NO: 12295 - DNA, 291 bp, Candida albicans
cccctgaaaccaatgagcccagcttttcaaaaaatttcatttcttggaaaaagggggcatggtttcttcagaaattcgagtttccaccagttgagaatagggagaggacgaatggtcggaacaaaaaaggggttttggtttagtcgtggagaagtgttcgcttgtggaaatccttggttaaagaaatctaagaaagacgaggttacccatgctaccattaatgattcgccacctcttaagcgtaagggagaagaggaagattgtatcgtacctaaaaaaggtaaaagttag

SEQ ID NO: 12296 - DNA, 204 bp, Candida albicans
ctatctctgctatttgacatttcatttaggttggtagataaagtacaaggtgttgaaatacagaacggagaaagaaaaaaggttaacatcatgagaagaggattagagtttctccgcgaaaaaaaaaaaataattaaagtttgtttccgagatccttcaaacagagaacattggaaaggcgctaagcaaaaaacattttcgtga

SEQ ID NO: 12297 - DNA, 186 bp, Candida albicans
aaaggagatctccaccaatttatagttgaaagagttttgaaaaatccaatctttgattcggggttgtccgagacaaacttcctattgatagtcgcacagtttgccgaattagatgttagattggtagcgccaggtacaccacaattggaaataaatcccgccaacaattgtttggcaattaagtga

SEQ ID NO: 12298 - DNA, 375 bp, Candida albicans
  unsure (237): Identity of nucleotide sequences at the above locations are unknown.
ggaggaggagaacagcaaaatgatgatgaaaataacgatatagccaacgcatatttccctgatggagatgaaagaaaccttataaattcaatattggatgaaaaaatcgaggctaaacctaccttgtggagaaaagttcttgacgtgatatggccaaactacattttgaaccacttggattatgcctcattcaaaatagtctgtcggagctggtgtcatgtttggtcttgtgctgtnttaaaaattatacccacaacctattattggcttgggaatgctgcatatttgattgtggtattggggttcttttcgatatctggcgggtcatctatcatcatgaacttctgggtaattgttggggacttttcgggatga

SEQ ID NO: 12299 - DNA, 186 bp, Candida albicans
acatttttaacaaagaaaaccaacaaagtactccccattcttttttttcaatatcctgaaaaattaatacagcctcgatatgaatcgaatgcaggaattatgaaccaaataggaacaagaaaaaacaaacaactcagagaaagtgtatctaacagacattacgcagactttatagtttctttttga

SEQ ID NO: 12300 - DNA, 231 bp, Candida albicans
aaatatttttttctttcttgttcttcttctttcagtatcaccaacacacacactctctttctaattagtattattaaatcaagaagaatgtggtgtttaagtaaacctgtaataaaaaaaaaatcaaattcagaatctgaaccaacaaccaaaattcaacaaaaaaaaaatttgtatgagaacaaatgtatggtgtgcaaaaaaatatttgtgtgtgttgtgtgtatataa

SEQ ID NO: 12301 - DNA, 210 bp, Candida albicans
atccaaacactaataattagttctatctgttatgaatcaaataatactaattggaaaagctccagatctaatttatcgtcaaaaaaatcaaccaacctgaaaaaaaaatgggaagtggatgaatgggttaaatttattgaaattataaatagcagcacagatataacttcaaaaaaaaaaaaatatgggtctccaaattttgatgaatga

SEQ ID NO: 12302 - DNA, 225 bp, Candida albicans
  unsure (87): Identity of nucleotide sequences at the above locations are unknown.
atactatctagtgaaaagtcgtgtgtaaatcgatttgaaaaatataaaaccatacacgtaaatgaaatgtgtgtgaaagtacaaccnaccacgaaaaagaacgcccaaaacatgttgtccgccccaaaaaaaaagagaacaaccaatccaagtttcaagactatctcaaatcttgttgtcaccataactatcaattgttcacctcttgaaccaacatcaaattga

SEQ ID NO: 12303 - DNA, 333 bp, Candida albicans
ttttgtgaagtatttcttgaagttgacgacactgggaactgggaaatttccccaccatttccttcagtcgaagatattaagcttgcaacggggcttgccggtgttgttgataaatcaaggtttcgtaatttcctaggtgatgtgatagaaggtgtcccagaagcaactggtgaagaaaatggattgggagggctagtttgtcccgaagttgaaaattcatgtttcaaattaggactgtcgttgctgctgattggcataaattcattttggataatttgtggagattccacgggtgaaattataggagtaatcaatggggaatccaagggataa

SEQ ID NO: 12304 - DNA, 213 bp, Candida albicans
ccgattttgtgtaatttattattatggaagaaccctctatcattttcttcttctccttttacacgttttcggatattaataaaaaaaaaacacggatttaatatattcgtagaaaaagaaaaagagaaagagaaagagaaagagaaagagaaagattctttccgaatgaaatcaacacaacattcattcaatcatattagtttagatttgtag

SEQ ID NO: 12305 - DNA, 318 bp, Candida albicans
ttgaatgaatgttgtgttgatttcattcggaaagaatctttctctttctctttctctttctctttctctttttctttttctacgaatatattaaatccgtgttttttttttattaatatccgaaaacgtgtaaaaggagaagaagaaaatgatagagggttcttccataataataaattacacaaaatcggttatacattagttgtccagttgatgaagaagataattgttggaagttcatgcccaccaccatcaatgttaactacgactactactactactacaaaaacaacaacaataataagaaatacccattga

SEQ ID NO: 12306 - DNA, 297 bp, Candida albicans
tctgtattaaatataattcgtcgtcatatttatattataagtaatcataataactcacctctttattcatcaattacacatatacaatccttagcttatccaaggataaatacacttaaagctgctaacatcatggcccataatgaccaacttacacttgttaacaccccactattaactttcattgattcggtatcattagtagtaccttcagtagtaaaattaatattgatagcatcagcattagttgttagtttaccatcccaacaatatttttcaaaacattttttacattga

SEQ ID NO: 12307 - DNA, 315 bp, Candida albicans
tgggaggaggaggatttgtttgggtttttgtacttttttctttctttatttccaataacacgagagagagagaagagagagagaatgaaaaaaaataataatgacgataattttattttgtgttggggggggggggcttatacttcttcttcttcttctcaacttctattttattctactaaatattttttttttctcttttcttttggtcccacctttgctaccaatccccaccgtcccactaccaccaccaccaccatcccatcccatcccaccaattccaaccaagccacctccttcgaaggtcatgtttaa

SEQ ID NO: 12308 - DNA, 231 bp, Candida albicans
tttatctgtaaatttctgtttgttaaagcacgaagtgtgtgtgtatgtatgtatcgggttgaagttttaatctcggcagaaaaaaaaaaaaaaaggaaaacaaaagaatctggaaaccatgatcatcatcatcaccatgatgtgatctcaagaagaaaaagaattattcctttacacttatacttgcatcaacagatttcaatagatgttatttctacaaatctaaactaa

SEQ ID NO: 12309 - DNA, 627 bp, Candida albicans
atacacactgttctttctttcctcccgcccccccatttttcttcactatattttaaacacaccatgacaatacaatcatcaatttcatcttcaaatcaatcaataacaccaaaaactaaattaacaaatcttgaacttgaacttgaacttgaacttgaagaagaggaaggggaagaacaaccacaagaagttcaagaaataaattcaacttctttttcttcttcaattacatttggattatatgatgaatcagatggtgataaagcctatttagccaaatctaaattaatagctgaatcaattcaatcaataggttttggaaaatatcaaattggattattttttgttgctggatttggttggttaagtgataatgcttggcctgtagctacaagtttaatattacctcgattaaatgaaattaatggagttcatccaccaccaccatcatcatcatcatcatcatcatcatcacccaacaagggaccatatttgatgttggcacaaaatttaggattattattgggagcagcattttggtcaatatcatcagatataattggacggaaatgggcattgaccttaacagtcctcactcacaaggatgtcaagatccgggccctaatg

SEQ ID NO: 12310 - DNA, 189 bp, Candida albicans
tccactcgcatacacgtgactattattactagtttattcattttttttcggacgacagtaaatttctttcgtccagttttaacatttcctacacgacctgattacatcaccaattacaccaagaagttaggcatcacgtccatcactcgctcgcccccatgtagtacaaaaaaataccgcaaccattaa

SEQ ID NO: 12311 - DNA, 753 bp, Candida albicans
attaaggaaataatgtattcagaagcccataggttattactcacatacataagatcagtcagatatgttgaagctggcgttttgcttgaggcattcaaattcatgcttggaaatttacaactggaagttcaacctctgaagaatgtactagatcaatacattgccgagattaattccaaaatatcaggacaaaactttaaaattgaaaggaaaactcatgaaataacaggggacttgtattatatatttatcaacacgttatccgacgagattgtacaagaaagttcagtttacacgacagctgaactaacagtaataaaatatttaattagaaatataattgaggccagtgattatcgttgttcgttggctagagtcaatgctaatcaaactatttcaactaatacaaacaagaatttaatggaagcagactcaatggttgatagattgatagatgatggctggtttataagcaccatcgatgacagattgatgttgtctatcaaaacactttgtgagttgaaagaatatttaattgaaacatatggggtcaatggtgatgatactgatgccgatggcaaggtgttgttgtgtacacaatgcaaagaaattgtcacattgggctggattataccttctggtagtaaaccatttcatagaaaatgttacgatgtatattgcagaacaaatcaaatctaccccgaagatgaatctgatttattacgtgttggtccagatccttctacattataa

SEQ ID NO: 12312 - DNA, 201 bp, Candida albicans
tacaaaaaaataccgcaaccattaaaaactaaatcttcctacatactgaaaaaaaaaaattttaatagtacaataaagaaacatttctatagtaacaacaccacgataactaaaatttctgcaatcacaacactactgaaagatgtggccaatatacttgaaacacctgatttgaatcttgaattttctttccctggatag

SEQ ID NO: 12313 - DNA, 594 bp, Candida albicans
aggaagaggaaaaagaagaaaattgaaaatgatattaaagataatgtaaagttcattgagcatggcaatattttacgagaccaaattcctatcaaatataagaatgcgttatattatgaacaatatgaatacacaacaaccaaaacaatggagcatttactcaatccagtcacagttttcggggagaaggcaatcatagaaatggatgacaagaggaaaaatataccggtaattccaaattccaagatacgtttgtttaagaatggagtggaacaagagccaataaccgatctatattcatttttaccaacaaacattgaagatcacgaggatattaatttgggtcccaatactaaacaacaacaaaatcccaattaccgaaatactgacgatggaacactagggtattatccaatgctttcggctttccaatttggtgtagtaaatttaaatgctggacccaattttgagttcccaccactggaccctgtcaagccattgagtgatcgatacaatgaacaagtggtagaacaatattactgggatcttgttgatgaagtggaagctgaatatttagatagttttgatttataa

SEQ ID NO: 12314 - DNA, 213 bp, Candida albicans
atgaataatatgtatttaaaaaaaaaggtaagatatccagaagtggggatatctaatccctatttatacattacaaaaattagctttccgtcgagtaaaggtttgtataattggtgtttgatttacttaaccaaaaatatatttcctgatatgaaaaaaaaaaaaaaggaaactatcgccaatgttccgttttgggaaactaagcgcgtttag

SEQ ID NO: 12315 - DNA, 183 bp, Candida albicans
atatttatggtgataatttatttcatggaacaagtattaggagagagagaggtggggttatttatagggggacatacttccgatttgttctctcagatttcacttttattcctcgaagttatatttaaatcaccctgtctttttgtatggttcttttttttctccacacacggaacaatttga

SEQ ID NO: 12316 - DNA, 348 bp, Candida albicans
tcatcatggttgttgctagagatcgttgactgctactgctgctgctaccaccacgggccaaataatgttctgcaaccgagaacgcacgtgtatgccacaatttcaaatgacattctctttttatttctcataataatcaatcatacattatcaggaggaacggatatgccgaagaaaaaagcccctttcgccattcatcataatctgatgaaattccattaccaaaagaatactaataataaccacagaggttttgagctggaatggaagcaggttacatttattttagtacacctctttaaaaatactctagcggataccatgtgtgtgtgtgtctgtcaaaactaa

SEQ ID NO: 12317 - DNA, 186 bp, Candida albicans
gattggctttttgttaaggtgaaattcacctctacttatagtaaactatcatttcaagatcctaattataatcaaagtcaaatttcatatgttctagctaaaaacggggccagaaaatgtgcatttccgcgaaaaagttacaaaccattttgttgtctaggttactgtgtcaacagattgctataa

SEQ ID NO: 12318 - DNA, 189 bp, Candida albicans
atggcccatatgatagtttttaaacagcaacaattctctaatatggtttgtatactattcattcttgttatcaaacgtggccaatgtcataaaattcgaatattagagccgttcccgaagtttccattaattaattaccccctccagggaaaagaaaagacaatgacagctttaacaaagaacatttaa

SEQ ID NO: 12319 - DNA, 213 bp, Candida albicans
caaactcaagggcgagttgatcttgaaaaaccaaatcatcaaaaacttgacggaccagataagtatcatgaccaagaccgaccagccaccaacgtttacggcaccgaaaaaccactaccaactattccaggatttgctgaaaacattgcaggaaaagtcaacggagttacaggaaaccaaccaacgactcgaggcagtgttagttgcaaatag

SEQ ID NO: 12320 - DNA, 195 bp, Candida albicans
agaacgactcattcgcttaataaggaattgttaaagagatttccaaaccggacatgcgttgcggaagtatcactctgtcccgtgaactttaactgtggagaagtcccagtcacccaaaaatatgtttacgacgaagaattactcgctgctttggacgacccgttcttggtaaagttgcagtcgattataggttga

SEQ ID NO: 12321 - DNA, 309 bp, Candida albicans
aagaattgcactgggtcattgacaagtttggaaaatccacttcaaatccgagtaccaccagttcctaaaaaccaaagtcagcaactggtcaacccacgattggcaatacttcatttcgcacaacccgtgctttatcaacaccgccgagtctaccgaagaaaacccaaaaagagaaaaccggacattcaaggcaatacaattgccctacgacaactccgtccaaaacaagtgtatacgttttgggatgatgtacaagaaatccaaagtcatgaaaagctacactcgttgctactacgtcttgtcatgtaa

SEQ ID NO: 12322 - DNA, 225 bp, Candida albicans
ctttttatgtggcaaaaatttagaggacaggatattaaagttgccagacacggtgttaaacacaccaaatgggcagctattacaacaaatgctaggacaaaattttgtatagaaaaaaatatacactttttctttttttttttacaaccaacctcacccctatgctgtctaacgactctgctgattaccgcaacaagttctggtcatcgaccagccgacaagtag

SEQ ID NO: 12323 - DNA, 258 bp, Candida albicans
ctgtggagaagtcccagtcacccaaaaatatgtttacgacgaagaattactcgctgctttggacgacccgttcttggtaaagttgcagtcgattataggttgaaaaaccaggtgattatggaaaactacatgtttgcatggtacttaaacttccaaggtattgcccggaatttgttcactaacatcctaaaagaattgcactgggtcattgacaagtttggaaaatccacttcaaatccgagtaccaccagttcctaa

SEQ ID NO: 12324 - DNA, 219 bp, Candida albicans
ttcagtttaatatctggaaacacaataatttctacagtgcgtttgtgcgagacacaagtggggttagaagtttataggagagctcaaatatatatgtatattcaatggttttcactaatcaaaacagtaggaataggaggggtgctgccttcggcgttggcatctgccgcttcgccaaggttaaatactattggcttgtcggaatggtgctttaaatga

SEQ ID NO: 12325 - DNA, 216 bp, Candida albicans
atgaggattctagtctggaatatagtagaaacaaagtatcaacatgatatttctttgtacagtaatctcaaacaccaccgtggaggtagagtttatttcttaccatgttatacacatcctcttttcgaatacatacaagataagtatatatccactttatcaattcatgagaaaagaaaaatagggactacgagacaattttgtctatacttttag

SEQ ID NO: 12326 - DNA, 282 bp, Candida albicans
cccacacatacttatttaggtattatatataactggaaaatccccctcccaaaagtcttacacgaaacaacatttgatttttatttgtcagaaaatcaaaccaatagtatcagtgttaatcttgtggataaatttcgttgggggaagaatagaatctataaatttttgtggatcttatttcttatgactggatatatccatcgtttatttgtcaatacaattcaaaatggatttggctctattattttcgatttgtacttcaaaatcggattttacatctga

SEQ ID NO: 12327 - DNA, 201 bp, Candida albicans
tttaattattcaatatcaaaaatcacctatataaaaagtataaataaaatacggataacaactaagcacgatccagtttactcaaaaataaaaaaaaaagccaactatccagtacatgacagtaagtatttatggagtgtatttggggcctgtttacgaagttcggtttctgggatcaattcaagtaaaccattctcgtaa

SEQ ID NO: 12328 - DNA, 198 bp, Candida albicans
tgcaatccagaagtatttacggagacagaaatgacactttatcaagctgtgagagcccgagtgttatatttcgaaagttttgcaatacaagcattgggtggtagagtatttagtaaatacgtagcagaatttcaaattttatatccattcatcgtcaaagaaatcaaagtggtgactcccttttcttgtagagattga

SEQ ID NO: 12329 - DNA, 192 bp, Candida albicans
actacgataatgtcagatggttcttttaatggtcacccttttactattgtacgtcgagacgtcgtatttggtgtagctttgtataccattggttatctaggaggagggtatgaaacacttccagcacttactctcaaattccatgcaccacaagcaatcaaaaaatttaaagagagaagtaaaaataaatag

SEQ ID NO: 12330 - DNA, 216 bp, Candida albicans
aagattcacgaactagacacctcaaaaccagtcatgatgcctgatggatcgatcggtgttgcatatttcacaatcattgaacatcattataaaagaagaataatgtactttactattgaatttgagaacggaaacactaaaacattactggaaacgactatcatgcaatatgagccaaaggcaatttttaaatattttggaagatttttggaataa

SEQ ID NO: 12331 - DNA, 186 bp, Candida albicans
agattgaaatgcaaccacaaaatttatcttagtaacttaccctttccaaccctgttgattaaagtactaaagagtactcaagagttatacatcttgcatatcacatgccccacacaatgtatcaaacacaatcaaaatgtaacaacaagagaccgtttcaaaaatagaattactaattggtactaa

SEQ ID NO: 12332 - DNA, 192 bp, Candida albicans
cttcaaactacaatgccccaagaatacttcaacggatcagaatttagaattttatttcgtgatgtcatcaagggaaaggttttttatgaaatccgttacgagaatggtttacttgaattgatcccagaaaccgaacttcgtaaacaggccccaaatacactccataaatacttactgtcatgtactggatag

SEQ ID NO: 12333 - DNA, 201 bp, Candida albicans
ccaacactatttataatgccagatggatactggcgtggtctatcttttactattatgagtcgtcagcatataaatgggaaatcctactacacagttttttatgaaaatggtgaatatgaaagcttgttaaaagagacacttgaaaacgtttacccaaaggcagttgcaaggtttaatgagaaatgggacggagccaaatga

SEQ ID NO: 12334 - DNA, 192 bp, Candida albicans
caatcatatttccagctcgcacaagacactaccaaatgtccaataccagcacctaattttttagctagccccaccattcctacatgtgttcttaatgtcatcactaatatacataaatctattcttaatttgatttcattaactaatatacacttttatttattatacaaaatttttccatcaaggaaataa

SEQ ID NO: 12335 - DNA, 189 bp, Candida albicans
agaaatatcttcttttctttatgtttttcgattcatgataactgtatttttagattatgtatattaggcaataaattagttttattcggtttaacttttattcaaattgaagattgtaggttagatgatttggcaaggcaagcaaattattttcggtatcttatttccaccaattttttactattttga

SEQ ID NO: 12336 - DNA, 471 bp, Candida albicans
atatacatattattattattattacattacattaattattgtggttatttgaacgggctatttttgctccaaaaaaattcccttccatacaaacctgtattgaataaagctaatccaccaagtccaagtggagttattcttcccttgaatatgcccagaatggattctttaccattgacaataagatacaatgccagccatgcaaaattgaacccactggcattcactggatcaccatcatacatcatccatgcacctaaaagtgatgctcctccaaatgtaaagcaagataatcgtgttggtcgagcgagagctactttacgacccaatttgaatgcactaccagtaccgccagtggcaccgacatttactggggtagcattggttccaaataatcctttgagaacaagagatccccctaatgcagcagcaggaataggtgataccgataatttatcaattgaatcataa

SEQ ID NO: 12337 - DNA, 207 bp, Candida albicans
atgatttggcaaggcaagcaaattattttcggtatcttatttccaccaattttttactattttgattttattggtcagataaaatggtcattcattgaagttcattatcaaatatcaaatataataccaatctacattaaaagtacccctggctttttttgtacgatcaaacaagaattgaaacctaaaatcaagaaatatcagtaa

SEQ ID NO: 12338 - DNA, 423 bp, Candida albicans
  unsure (213),(232),(250),(265),(284),(289),(295),(378): Identity of nucleotide sequences at the above locations are unknown.
tataaccccccttacacaatggctaaacaatttaaaagaaagtccaatggtgtgtctgaaagtaacagaaaacgtggaaggcaagaattaagaaaagttacacgtacagctgccagaaaacaacaacaagatgagaatcatgaagatgacttgaatgtgaataatgaatctgaagaagaatattctggaaaagagattgacgaagaagatgangaaagtgagagagacgatnatcgaggaaaagcatatnctgctttgttaactntaataaagtcagagcatanagaanaaccanagaatgttacttttggatcatcatcacaagtcgaaaaaagccaatgcatcttgattctgaaaatgaccgcattggtggtggcntggttgacgaaaaagaagagggtgaaatggattctaatgtggatg

SEQ ID NO: 12339 - DNA, 222 bp, Candida albicans
atggatgaaaaagaatggaacagatcaaacaacccaggattggggggcagcgaagactctatttatacttttgaaccagaggttatagctttattgggggatacagaggagaaagcgaagaagattaaaagattttcctatttttttttttctttttatagtttaaatgaatttcggggtgtttgtgttattaaattaagtaaatgtttagtatggttttga

SEQ ID NO: 12340 - DNA, 252 bp, Candida albicans
aatctgggggatccttgtattttagatcacaaaagatttcagtttaatcgaatgattccattaaccattactccacattatttgcaaattagcgagaacatcattcatttatgtgagcagcagagagaattcacacccgaaactttggatgcaatttattatttttccgagcgtgtcagaaccaagatgttccgagatctagccgtccagatcttggtatcatcgatcactcacaccaacaaatcaccttaa

SEQ ID NO: 12341 - DNA, 192 bp, Candida albicans
acttttggtgaattatgttatgatatgttgaaaggtcaatatcaaaaaacagagcgaattaattttaaggtagcctacagactaaaaggtatcagctcattagtcacttctatatccctatcactaccattaatacaagactacaacttcctcaaacctttatcaataaacaaacaactcatccatcaatga

SEQ ID NO: 12342 - DNA, 204 bp, Candida albicans
aattttgagagtataaataggaaaagggaaaagggaataattttgaagattgaagatgaagaagtaagaagtaagaagcaagaagagggggggggtgtatgtgtgcaacttgtggataaggagattataaaattattatgcaataacacaaaagcaaaaaaatatttagtgacacagcatttgagtacacactacaaaaattaa

SEQ ID NO: 12343 - DNA, 861 bp, Candida albicans
ttcattatcagtatcattattagcattttaataccctcccgctcatattataatcttagctttactgcattctttgcatatacatttttaaatttatacaaatctttctttaagaagataataactatcatttatacaacaactccctccccccccatattatcatttataatgtctgacgctgttgaaaaagttaaacaggctgttaagccacaacaacatttcaaatccattaccattgaacatgtttatcattattcatttattgaatacattactcaatatttattgtcattccaaattgtcaattcaatttacaaatcatttgttttacctttgattgattttgtcaatgtcaatattttttcagtttcaccaatatttgatttattatcatttgttgatcaattgataaactctgggttggttacttttgataaatatattttggaaatccccgtacaaactataaattcattcggtaaaacttatgttactccagttgaaaataaattgattaatcttaataacaaatatttaaatactgccattgaagttaaaactagaagtgaaggtgaattttacaaagttgttgaaactgtccaacaagtcttgatcaatttgaaaaactttacatttaataaatcaattgaaattcaacaagatttagttgctacttataataaagaattacaatctactgacccacagggaaatttgattggtaagaatttacaagctagttataacactgcttctaaaactattaacaagttgaatgacgattatttaactccattgaagaaccaaactcaagattatgtcgatcaatttgctactcaaattaaacaacgtgcctga

SEQ ID NO: 12344 - DNA, 195 bp, Candida albicans
ttcaccaaaagttcaacaccaacaatattgaccgattttaaaaatatcaaaaaaaaaaaatccaaactacgagtaaaacatattcttcatgtatatatatatattgaaaaagatataaaagataaaatatgtgaccgactccccaaaaaatattcaacccaaatatatgtatataaaactaataatataacctga

SEQ ID NO: 12345 - DNA, 246 bp, Candida albicans
tccatcccttacgtgaccaatttaaggccggggttttcccattttgttttggctccagaacatagaacttgtgctaaaaggtcaataagagccgggaatggccaaatcagaaaagaaaaattggggacccattcacctttgcataaattccccaaagaagaagagcaacccgtgtgtggggagaatttcatccggatagggttatttcatattaaggggtatctgaaatcaaagtttgtgtcgtaa

SEQ ID NO: 12346 - DNA, 186 bp, Candida albicans
gcgcggatccggccactccgtggtgaagacatgagaaatgcagttgaagattttgatgagcttcgtcgtagtaataatgaaaaatatgatgatctaaagctatttaaattagattgtcttcgtagtagtgatatgagcataattgtattaccccatgcaacatgggactatatcgataatgaatag

SEQ ID NO: 12347 - DNA, 225 bp, Candida albicans
aattttaacaaatttggaggaagaatatgcaaaaggccaaagagaagaagggaattaatgaaaattttcagaatagggggggatattcaattgattttatacagtttttttctaaaatatgaaaaatttaaaaggtgtgggagggaaattgaacaattcctaaacgaggagtgggcggcgaagactaagagaaactgtgtgtgtgtgcgtgtgggcgtgtattga

SEQ ID NO: 12348 - DNA, 231 bp, Candida albicans
tgcagaaaagttttattacgaaacaggtgggttcaaggacgaaagattatccacttttattttttatggtgtcttactatccacatttgggatactatttgttggaaagtatgtgccatggcgattaatatttattcaaaggaagatggacaggggcaattttatgccatcccaactgtaaaaaatttctcgttgatgccagcaaggccagaaaagccagagcagctatag

SEQ ID NO: 12349 - DNA, 192 bp, Candida albicans
atccgaatctatttattgtcaaaaatgatgaatctcaaggctggatatatgataatatggaaggcattgtttatctggatattgtttacgagtttaggagaagaaggctataccgagaatgctacagatatggtcgtcctcacaaacaacccagcaagtattgaactatatttcttgttccttccttattaa

SEQ ID NO: 12350 - DNA, 183 bp, Candida albicans
atctatttactcgtagtaaaagtgatcctctccttacaggaaattaacgacccaattaacccgtgggatgatgtttttttaggcaaagtaattcccggcggggcacaatcggtcgaattacgtcccgacgtacacactaaaatgcttaaacttgaaacaaaaacctccccatttattccttaa

SEQ ID NO: 12351 - DNA, 660 bp, Candida albicans
tccacaacaagttgtacaatgtcatctccaacaaatagattaaacataaggaaacggaaaaaggtttatagcaatgaatctaatctgtccagacagcaacagcaacaagagtttctcccgttggaattgacaaatacttcattagaacaaaaacctacccaacctttagaagatgataaattgataaactacataaataaaatgcatcccagggtagatgtttcacaaccagataaagtcacttatataacaattttgctaactttatctgagcctcaaagaatcttagagcagaaacagaaacttattgacaatttcaaaattggagatattcttgtgacaaacccagttcctggttctatcgaccaatacctcacaatttacgggaagccaacatgtatcaccaaatgtttaatgtatgtcatttattatttaaacgtgataatgcatataaattatgatttattcacatttaagacggcaaactataaatttacaatcttgttaaatagccagaatttaaaatttaaacataacttgaaataccttgatatagctcaatatagcgaaagcatttattcagggtttattcagggagaattgcactctaactttaaatttgttccacaaacaaccgagcaaggaaataatgttcaataa

SEQ ID NO: 12352 - DNA, 951 bp, Candida albicans
cttcaacaggaaactattgtgacaagtaaaacaacttcagctaccacaccaggttcatctagtgttgaatccacaccaggatctagttctgctactacaccaggatcaagttctgctaccacaccaggatctagttctgctactactcctggttcaagttctgctaccacaccaggtttatctagtgttgaatccacaccaggttcaagctcagctactactccaggatcaagttctgctaccacaccaggttctagttctgctactacaccaggttctagttctgctaccacaccaggtacatctagtgttgaatcaactccaggttcaagttccgctaccacaccaggttcatctactattgaatccacatcaggttccagctctgctaccacaccaggatctagttctgctactactcctggttcaagttctgctaccacaccaggtacatctagtgttgaatcaactccaggttcaagttccgctaccacaccaggttcatctactattgaatccacatcaggttccagctctgctaccacaccaggttctaattctgctaccacaccaggtacatctagtgtggaatcaactccaggtactagtacaggatcatgttggatttctgtttctactggtggatatggttatgagacaactgtgactatttgctctgatgttacttctggacaaagtgttaccactcctactaccatttcagttcccactacattctgcaccactgttccaactgctggtactgatgaaacagttataacttcgtatgtcaactcaactgcacactcaactgaagtcattactgtcactagttgtgctgataatggttgtcagacgcacactactcatactggtgttgtcgttgttactgtgactaccactgatgttgctacaacatacacaaacctactgtccattgactacaactaa

SEQ ID NO: 12353 - DNA, 291 bp, Candida albicans
ctaccactgatgttgctacaacatacacaaacctactgtccattgactacaactaaagctgtgtatcgtgttgctaaacttgcaaactacaagagagatcaaactgaatttattgctactgaaaccaacgaagacactagcaattggccagctccaactttagttccatatgttggtatttccaatgacagttctgcagccgttagtacttttgaaggtgcagctaattcagttgttccaagattaggcctcattgccggtttcctcagtgcattgttatttttgttttaa

SEQ ID NO: 12354 - DNA, 1329 bp, Candida albicans
gaattgcttctacactatcaacaatcaacaaacaaattcacattcgctatgaaattggaatcaattgctgtctttgctggtattgtttccactgcgcttgctggtgtttatcataagccaccaccagctactacgtattggactacaatctatgctccttcaacatctgtcgttactgtcacttcttgttccaaaggtggatgtggcactcaatcctatgctactggtgtcactaaaaccaagactgtccatgaaggtgtgactactgaatatactacttattgtccattgactacatcccacgaagttgttaaatccacttgctcagatacacttgttgtttggtctactagatctttctcctgggtttggtcattctcaaaaccagacggatgtggccaaagtacttccaccattaaaactactgctcaaaccgatgtccctactactgctactgctactccatctgtttctactacttgcaccactggaaccaaaaccaaatggtggtgggttataaagactactgattgctcggtttacactgtttcatctacatcatcttcccttatttccactagtcaagttaccagtagtagcagtattgcatctactacagctactgcaccagcaactccatctgtttccacaacttgcaccactggaaccaaaaccaaatggtggtgggttataaagactactgattgctcggtttacactgtttcatctacatcatcttcccttatttccactagtaaagctaccagtagtagcagtattgcatctactacagctactgcaccagcaactccatctgtttccacaacttgcaccactggaaccaaaaccaaatggtggtgggttataaagactactgattgctcggtttacactgtttcgtctacattatcttcccttatttccactagtaaagctaccagtagtagcagtgttgcatcatcaactgggtcaactccagctactaccccaggttcaagtattgagtctactccagctactactccaggttcaagtaccgagtctactccagctaccgctacaggttctagcactaaatcgactccagctaccactccaggatcatctgttactactggtaaaacaagtactgattggattacttcatttaccacccacaccgctcatactactactgttatcactgttactgattgcgatcaccatagctgtacatcaaacgttgttaccacaggggttactgttgtgacagtcactactaccggtaccgtcactgaatacacaacttactgtccattaacttcaacaggaaactattgtgacaagtaa

SEQ ID NO: 12355 - DNA, 240 bp, Candida albicans
ctctgttctatgcaagagtcgtttatatttcacatttctttatatagttatttattcatttatgtcattgtagatgtcttgtctgtttttattgacgttcaagaatatttaacggtgacagacaaagccaaaggtgtagtagttatccataatggagatggtatttacaataagatgttttttttctatcctaattactttcctccctctgcttgcttttaccttcgaaacttactctaa

SEQ ID NO: 12356 - DNA, 231 bp, Candida albicans
cgagaacatttattattttttttattaataaatgaaacagcaaaaaaaaaaatatacagatatgtctcggttcatacacgacctcgctgcatctatacttgcaaaactactttaaatttttttttttttttccttaagattgaaaatcatttattttcctcaggcgtatcgcgtcaccaggacgtttatggaaaaataaatactagcagctcttcattaaacttcgcctaa

SEQ ID NO: 12357 - DNA, 186 bp, Candida albicans
cagtgcagccatgattacaaacctaccactttgagtacaaaactgtcaaaatcagatataaccttgaaagacttgcagtttcaatataacacaagagctggatcaaattttaatcacttcaatatgaggcaggagcaccatggatacttgttcaattatccacggctacaagggttcacaaagtag

SEQ ID NO: 12358 - DNA, 276 bp, Candida albicans
aattcgcgtcaccattgtactactttaggtcgcacggcatccggccagctacattttgcctttcacatggccctgtttgcaaacatctacttgatttctaaatcagagtcagaagttaagaaaagacaaagcactaacactacaaataaacataaaccaagaaaaaaaaaactgtggcatatctacaatttttcaggcttgtcccttgacatatttttagcaaatcttcttgggtttcataagtcacagtacgagccaagaaaaagcgtaatatag

SEQ ID NO: 12359 - DNA, 210 bp, Candida albicans
aactgtgcaccaaaccaaccgatgtgggaattaccagaagaaatacatcttgaaaaagagcagattccgcagcaaccacaacaacaacaaaatgtgattgatgatttgtttggtaccagtcataatcatgatgattttttcagtaatcacaatcaagacggtctaaacagtgctgaaatagaaacagaagagaacgtggaggtgccttaa

SEQ ID NO: 12360 - DNA, 198 bp, Candida albicans
ctcctatactcgtgtgctttaaagttgcaactgacaagatgctggtataaggacttggttatcaaggaaacgttagtacaaacctgccttgataatatcagtaattcgaccaaggtacttttttgcaacaccttttcatccaattatgaattaaatgtacaactagctaataatcccttcattttattcagcaattaa

SEQ ID NO: 12361 - DNA, 270 bp, Candida albicans
agccaggaactatcactgccggtaaccagcgaggagccagtggctaatgatagcaatgatttgtttggtggagacgatcaaagttcttctaatccacaaatacattttttctcccacattcagcaaccagatcaactagaatcacccattatggaaaccaatgaaaaacttgaaactgtgcaccaaaccaaccgatgtgggaattaccagaagaaatacatcttgaaaaagagcagattccgcagcaaccacaacaacaacaaaatgtga

SEQ ID NO: 12362 - DNA, 909 bp, Candida albicans
gtaattaaccagtatattgaatttttggaaaatgatggcaaaaaagatactagtggattagcaccaatattacgaagtgtttcattatttggtaaaagggcaaatgatagtactttagaattgggtaaaaattctaaaatcccaatcaatagcgctaccagaataaccataattaaaggttatatgtgtatgttaagatgccaatatgtggaagcagaaaattatttcactcaatccttgaatgacatacctaatgaacatcatctgcaattaagtttattgaaatgttacaatcaaatgagggaaaccggtatttttaagaaaaaggaattagagttgatgttgcacaatgtacaaaaattagaacttgatgggagtttgaaacaacaaattttagctaagatttatcacgatttgcataatattgaaggtaattttaaatcaaaaaagagtggtaaaaagaaaaatggaattttgaggctcaaccaatggaatgattacttgaagttactggttgaaacatatattcaggctattattatggctccagtcgatgatttgtttatcccactgttgtatgatcagattttgttcttattaatagttaacaaaattaatattcgagtcattgcatttttctatcagattcggtatcattttgctattagagctgattatgaatatctttatattccaggagtgcttgatgattttgatcccacttctgtcggtggagagattatttatgatattaaacaatatttagagaaaggaataatcaatggtgcaactgtacttaaagaagatcatgctgattatgtgaaatactggatgaaagaatatcgaaaagaacataaagttacgcaagctattaaatattattatgataaagtgtttatggaaacatag

SEQ ID NO: 12363 - DNA, 201 bp, Candida albicans
ataggtgatcaagattacctacatatttgtgcatgggtagaaactcaccagataaaattaactcttgaaactacacaaagcaagatttcatgcattacagtttcccttaccgttcaccccctccaaacaataactaccacaactactgccactactgctactactaatcaaacaatgttcaagaaattaattcatagatag

SEQ ID NO: 12364 - DNA, 552 bp, Candida albicans
  unsure (398): Identity of nucleotide sequences at the above locations are unknown.
tacctactagtaacacaattccattaccaggagattcaccaacgaaaaccactaaacataaacttgtccatcctaaaccaatgttacaaagaatacaaacagaacccattaaagaagtttcaagaagaaattctaaaagaagtactgggtcagcatcaccaacatcaacaagaagtgatccatattacttattacaaaatgccccacaacatcatcaacatcaacaacaacatatttttaaagaacgaactcatgaaataccaccacaagttttcaaaactaaagatttacctaatttaccacatcaagctgaagaattaccatttattaatcgaagtaagattagttgatgcagtaagtgatgatgaatcagatatgataattccaatggaagctcntacgagtcattatactggcggtggtggtcatggtcatggtgttgataataatatttacagaaatcaaagtacaaagagtaaacaaagtgttttaggaaccagagcaaattatagaagatttgtatctaatgtcgataatgattatgagtattaa

SEQ ID NO: 12365 - DNA, 204 bp, Candida albicans
tttctattttctcttttcaaacacccgcaactatttttagataagagaaatgtggctgctaacgtacatgccaatagtaatattgaagcttgtacagttaacatttcactatgcacttggccaactaaccattacgatgactgtatccaccattcaaacacgttgacattatattatactctaaccattcgatcccaatattga

SEQ ID NO: 12366 - DNA, 234 bp, Candida albicans
gtagcgctgttccttcgagccgctcgtggtgaagacgatcaagagattggaacaaatgatgaagaagacaatgacgaaaaatttttaatcacatgtaatatttatgatttggatttgaaatcaaaaatgaaatataagcattggttaaaagttgaaaatgatttacaagaaatttataatagttccaaccctaattggagatactgtatcaaatatgatcaaattcaccattaa

SEQ ID NO: 12367 - DNA, 390 bp, Candida albicans
acagtacgaaccgcccaattatttcaccattcacccattatgacagatctcaccaaacaaccactcaaaggatatgacaatttgtcaacgcctactttattcaacgacaggaatttgcatccaactgcaaaatcattcaccacaaatattcttatagttggtggggcttatagtgggttgtctgctttaaggtctctacaactacatttggcggagcagatacaacgctttaaacaagagcagccatccacaccaataaagaaattgtcactaactatagtagagccaagaaatggacttttaaacatccttggaatcccgaaatcgattgtggattctgcatttgcaaaaacacaatttatttcgtttaaagacttaaacaattgctaa

SEQ ID NO: 12368 - DNA, 189 bp, Candida albicans
tgtcatttgatgacagacgtgaacaactttaataggatatatagagaggaaaaccttgaaaacaaaatacaagtttataatattaatgccataaagaatgcaagtctatatacgaaaatttcaaacaaacgaacaaacaaacaaacaaacgaacaaacaaacaaacaaacaaaatgtcaaatctattaa

SEQ ID NO: 12369 - DNA, 267 bp, Candida albicans
cctcttcacaaattttcaagcaaattctattatgaagttgaatataactactatagcaagctaaccaaatatattattagctgtttattggatatattgatcgtccatagattgacctcaattcactttttcaacttcccatccgtttttaaaacttttttcacagtattaaatattgttttactttttgtatatgcgggaaattatatgcgccaaaatttacatctccgatctaaaccgaagaaaataaaatgttggaattgttga

SEQ ID NO: 12370 - DNA, 189 bp, Candida albicans
gaaaagtggagacaaaagtttcctctggtgctacagttggaagagttttgtaaaaagaatgcaaatagaaatatacgcatactaatcagcatcattttgttttcaaataatttggctattattaaactatatacatatatctttaaatacaaaatgtttattcagttaaaaaaaaatctgcctatttag

SEQ ID NO: 12371 - DNA, 1575 bp, Candida albicans
tttcatttcggttccccaattaattggcctttgatttattcttccaaaacaccaagggtgaacaccggtgatacatacgtagcattactatttgtgctatcggggtcttgtgtttccatgtggatgctatccttattgctatatttatctccgaaatacaagcggaaaccgcttttaactcaactagcaactgttttttatgctataattacgacattctttttgaacaagcttacgcgagcatctgagaaacagtattacgaagatgtcttggatattgtggaactacatactattctatacaataatgtggagtatcgtgtgttgataatcattttccaagtgctcctattgctatcgtggttccaaataatacagaaactagcaaagcaaaaatataagcgcattattgcaattgttaccggtgttttgatggcagcattttctggttgtttcatctactatcaagtggaatataatacagaggggagaattcacatggaaaatatttcaggcttgtatcttcgatggaaggttgttaggagtgttatgaaattgattttggtactctggtttgccggtaacttgttgtattacacaacagttgtaaaaaatcctcgcaagatatgctattgcaagaaattattaccattagccatttttaattggtttcttctcattttgcacattattttgggcattctacacatcagcttatttgaagataattggctagtacgaacatggatggttttaataccatatttaattgaggccatattgataacaacagtttgggaatggatctttaatatctgggtaattgagaaaagaattgagttaatgggtgttctaggtagaagaatcagcattgacgatgttttaagcatccaactgcttcgagggaacaatactagaaaaggtgaaaaaacttttacaaaaaatgggtcatccagtgactcaggcggttttcatggccggagtggtacgcggaagccaatggccaagttccagaattggattatgaacagacctaaaagagtgactaccgagtccgaaatattatccaacaatgatataaatgaacttaaagaattctcaacgtttagcaatagctcgtcaaataatgatcccagtcagagaaattcaaacagccaattacagaatcaaacacaacaagttaataccatgcaacgaaacaatgaccagatactacaacagcataataatttacatctacaaaatcttgatacagattcagctgcctcttctagtcaactgcaagctttagctttacacacagaagatgacgatgtcgagtacgacgatgagtatgtggatgattatgaaatttgggacgacgatgaggatgaagaagaagaagaagaaatttcacatcatcaaagagtatcatcgacccacttggtaggttctactgtggaggaaaacgacatgcacttggggtctagcaataataggcatggctcaggtgatcatatggatttgccacctgcttttcaaccacatcctggatttgaagctggggattattggaacgaccgaaaggaaggctag

SEQ ID NO: 12372 - DNA, 186 bp, Candida albicans
gtaatccaaaatcacaacaacaacaacaacaagaacaccaccaccaacttcactaacaaatatttagaatttagccagtcttgtagtcatgttcctgcacaaagtttagtgttatctgttattgtaacattttctgtttttttttttaaattgtattgtattttttttttttgtttgagtttataa

SEQ ID NO: 12373 - DNA, 318 bp, Candida albicans
tcttttttcttcgttcagaagacctttgtcgctattgtagccaaataccatttaacaaaagtagtaggagatgttgattatggaaagattgaaaatgaaatttataattatgatagtgtttttatgttttccttaacaaaacctaatttgaaacttataaaagaaattaatttaaaattgttaaaagaaaagaacgaagttaaagagaagaaagggcaaacagaagactatttatatatatatacagcaaaggtcatcccagtcacaacactaaattttataaactcaaacaaaaaaaaaaaatacaatacaatttaa

SEQ ID NO: 12374 - DNA, 243 bp, Candida albicans
ccatttcgccacgcaggcttttcgacggttttggcttattttaataaatacataccttgtaatttgggaaaaagatatagagccaaaatacttaaaatgtgtactaatttaaactataatgtctataaagctgtatttcttaactctctggatgttttcattgtatttgaaattttaaaaagtaaattatttgaagttttgatagcttgtcattggctcgatttttcatcagaaattgagtaa

SEQ ID NO: 12375 - DNA, 213 bp, Candida albicans
attacaagcatatcatctatctatctatgccaagacatttttttttttgattctgttggttattccagtttcactttggaacactcaacaactatgtcttatcacattaccgacaagatagaactggacttatgttatcaccggaaaatattaaccccccaagcacaacttataacaaaattccagtgtactaaattacatgtgcatttccac

SEQ ID NO: 12376 - DNA, 210 bp, Candida albicans
tgtgaagatgatgaatatgaaccatttcttgaggttgtcggtattgaatttgaatccttcagatgtggtatagaacttgagcccgaaccattatttttgaagtctcgtcgcgatagtcctggcacggtgttagatgatatatgtgtatttgaatttaggttggttgacgacgttgttggggatgttgatgacgttaagtttgacgaataa

SEQ ID NO: 12377 - DNA, 246 bp, Candida albicans
aaattttctcccctcggatataacttattcccgaaaatggcaaaaaatgtcgtcgcctcaaaaaagatgacaaaaaatccccatacaaaattaaagatgacaaaaaatgtcgcaccaccaaaaaaagatggcaaaaaaaagtcgcacccccaagaaagatggcaaaaatatgtcgcatcaccaaaaaaaagtcgcatagttaaaaaaaagatggcaaaaaaatgtcgtaaaatcggccaaaagtga

SEQ ID NO: 12378 - DNA, 204 bp, Candida albicans
cttggaactctcctctcatttttgaaatactctgagtttgaacaacacctcgaacctaaactacaactctctcaaataaaccaatctctaattaaacaacaccctacccgattcaaacatccgtacggtcaatcaactatagaaagcatccgcacactcaatacatccgcacacccaattcattctcacacacatccggactaa

SEQ ID NO: 12379 - DNA, 303 bp, Candida albicans
cgacaggtgaagagaaatttgtcgatcaaatttcatcccgaaggttctttatcagagatagtgttgaattttcccaaaattttttggatatctttagatgtagccccagccaagactaaccaagggggggccactggtttaatttacggaagtctaactgccaacaagagcgaattgtacgtgctatcaactccgaattcaaaaatccctcaagatcaagctaacactatcaattgcctaacgaatttgaacaactctaaaactcccccctgctgtaatcaccacaacaagtcaaccatctag

SEQ ID NO: 12380 - DNA, 240 bp, Candida albicans
atcagtgccatcaaaaatgtggaaattgtatttctcattgacacaaaagtatgtaatttctgtaatgagagcaaatttcagtttttccgagaatcagctagaacaattaccactgaaaagtataaccatggcacaagtatatcagtgtcaccacagatgtacacaaccaccctccatattaaatttctaagttatttacggatacaaacaagtgcatttagattgcagatgctgccctaa

SEQ ID NO: 12381 - DNA, 210 bp, Candida albicans
aatattataatgggttgcacagaaaactgctggatgcaaattctgcgacgtaagagcataaggatcgctatgcgcataaaaaaaaatgtttatgcccagactcttgctgtaccacatacagaaatagacaatcatagcgcaattactagttccactattgataaattgatatcggttgttagtataaaattgaatacgcttgctttatga

SEQ ID NO: 12382 - DNA, 327 bp, Candida albicans
aatgtgggctcatttcgtaattattccttttcatttcctcgttacacacatatatatacctgtttttcgttatttagttatttagaaaattttaatctaatgtatattgtttatttagaactagctggcgagtttgaatcagtgccatcaaaaatgtggaaattgtatttctcattgacacaaaagtatgtaatttctgtaatgagagcaaatttcagtttttccgagaatcagctagaacaattaccactgaaaagtataaccatggcacaagtatatcagtgtcaccacagatgtacacaaccaccctccatattaaatttctaa

SEQ ID NO: 12383 - DNA, 354 bp, Candida albicans
gatgatgaattaaaagctgtactttggaatgacattaccctgatctttaaaagagacatggccttcagagatgaaattgtcaaacgttctaacggtaccattacatccttgccagtttcagattttattactggtgttgcaactgaaacttcggctttagatggtgctgatggcactctttcatcgttagacgttactgcattcatcaacactgtttcacattcctttataacttccaatgcttccagcagtgctgtcattactattcaatctgataatgccggttcctcttatggtcctggtttttactcaacaatttttgctgtttttggcttgtttgcaatgatgatttaa

SEQ ID NO: 12384 - DNA, 219 bp, Candida albicans
tttcttccccgtcatggtatgtgtgtgatgctgaattacaataagaaaaccagagataaaaccaccagaatcaaagaaagaagaaaaaaaaaaggaaagggtgaaacgaaaaaaaaaaagtttttggttgctactatagccacttggtattttaacttttctttatgtgatgatccaatgtatggaaaaaaccaaaaggggggaagagatagaaagtag

SEQ ID NO: 12385 - DNA, 756 bp, Candida albicans
accttcgtcgccgctcgtggtgaagacgatgtgtttaagaagtggaatcatttggacgaccacttgcaccaccaccaccctcaacagcaacacccacaacaacaatatggcggtaacatctatgaagctgaaaaattcttcaactccttatcgaattccatcgacatgcaatatcaaaacatgtcaacccaatatcaacaacaacatgctggttctacttttgctcaacagaaaccaactcaacaagcaagtggccaattgtatccttctttaccaaccattggcaatggctcatacaccaccagtggatcatcacacaaagaagggttggttaataaccataatggatacttgccatcttatcctcaaatcaaccgttctttgccatattcttctggtgtggcacaacaaccaccaagtgcattagagtttggcggtgtttcaacctaccagaaatctgcacaatcatatgaagaagacagcagcgacagttcagaggaagacgattacagcacttcttcagaagacgagcttgacaccttgtttgataaattaaacatcgatgacaataaagttgaagaagtgacgattgatgggttcaatttgaaggatgttgccaagcacagagaaatgatccatgctgttcttggctatttgagaaaccaaatcgaacaacaagaaaaggaaaagagcaaagaacaaaaggaggttgacgttaatgaaactaaattatatccaactataactgctttctaa

SEQ ID NO: 12386 - DNA, 216 bp, Candida albicans
tgtgggcagcataattacgaccaatacaaaggatctttctggcggtgtctaagtatttcaatgacatttcaagtgggtgtgttgataaatagtgaaaaaaaaaaagaattaaaaagtggagatataattggatctaagagaattagtcacaacgagaagatttcccgaacgtactatttcggagccgaaccaaaaagttatgtgtggacttgttag

SEQ ID NO: 12387 - DNA, 1158 bp, Candida albicans
atcaacacacctctctacatgtcttccactgttacccaaactatgaacaataatcccactgaaaaagtgacattcacagcatccaacagtcaagcagactttgacttgctcgacatcttctccaacgacatggacttcgaacaagcttacgatatgtacaacaacttgcaagaaaaaaacgccatggggtcattcgaacaattacaaaaagtccaagcattgaaccagcaatacgtctcaaacttacaaccaccatcgtcggcacagttcccagaccagtttgcttacgaaagagcccaaatcctaaatggcgaatacaacaaacaatcaggactcatgaacgatgccacgaacaaaaactactcattcaacgacgacacgtttgaccaattctttaccaacaccgaatccaacgcattagaaaagtttttagacaatttggccaaccccgttgcttcagttaacccattacagttctacaacaacacaagaacttctgtgcccgatgaagatgtcgatttgagttttgaattgcacaccatgaaagtgccgcaacagtttaaaccacgaagccaaagtctcgagcacaacccaccactacaacagaaagtaagattcactgaagaggaacacgctgctttaaagcaagagttgacagaagcatttgctcacccatgtacacaactaccatcaccaagcacaaccgaatacaaacccaaacccaccacccccaaagttgtcaagcaatttgtcacgccaccaaattctggagacgagctgagaaagagaaacagcgacatcgaaagcgacgagagcgaagaagaaaccacccccaccaccaaaaagagaaagagaacatctagcaagccattgcttagcgttgaacaaaaacgattaaaccactcccattcagaacagaaaagacgccagttgtgcaaattcgcctaccaacgctgtctcgaattgataatagacctagacgcattcaacaagctacctgaactaaacgaaagcgaacgcaaatcaaaacgtgcacgagttaataaagatggattacccaatttgagtaaacacaacgccttgataagaatcagcaatgaaatgattctaatcaaatcaatgaacgacagtttaaagaaattaatagaaaataggtag

SEQ ID NO: 12388 - DNA, 213 bp, Candida albicans
acttgtcgtgtaaaaaagtctccagaaaaagggacaacacacacaccaatttttcaccataccacacaattcaccaataagctctctcatatccatctaataattacagtacagcctcctattcccaatttttggcatttcaaccagttcaccttggcaggtcaaccagttcatcttgaaagcgtttgggttctacagcacccttatagataa

SEQ ID NO: 12389 - DNA, 462 bp, Candida albicans
agccttgaaacagaaactagttccagttgtggttccaaattaaagttgtgcagtggtggagagtgtaaagatccaatggaagccccaaattttggtcctacaattccaacccttccaatcaccagtcaaagtaagacaagtgtctcgtcagttgtttcaaaaagcactacagaagataatgagactgattgtgagacagacgttccaaccatcattccaagtgggtcagttcttccaacaacgtctgttcttccaactattattccaactgggtcaggatctattactgttctcccaacaaagtcaaccacttctgatgacgacgatgacgagactgattgtgaaactgaaattcctactatccatccaactgtgtcaaccactagaacatttacttccgatgggtgccaacaactcaaacactcaccgttttcacacacggggcctggaaggatccgccat

SEQ ID NO: 12390 - DNA, 279 bp, Candida albicans
cagcagcaaaaattaataacgggatttggattgtcctcaaattataacaagaccaactattggactctcggtagacgcttaatgacggttttaacaatgggaataatggagacttttcagaacaaaagaaccaaaacaattaaagaactaagaacaagaagggaacaaaatcgttggcgactaaggcatttggtggaattcaagaggtttaaaagtttaaaaaaaattgtgtttaattgcttcccttttactaatttgaatttcataatggaagcgtga

SEQ ID NO: 12391 - DNA, 261 bp, Candida albicans
aattatctaattgcacgaccagatatttggctgagaaatgtggagcaaaatgtacaaaacaggaagattattaccgaaaacaaaactccagtcttatcaactcaatgcatagaagaaatgccattgcattattatattagtgtactatggctgagccaaattcagagttttggatttatttctttttttttacacaaggataattggatcatctttgacaaatcaacacttccaataatgtcttatcctaatgaggagtaa

SEQ ID NO: 12392 - DNA, 192 bp, Candida albicans
gaatcttcatttgcagcaaaatctatatgtttattctataaacggaacgaattatgtgtttgcggacaatatgtactagcatttcagttatataattataagctaaccctcttagaacgttctagagttatcacggaaacagaaatagccttaaacaaagtagtttactttagattctattacatgtattag

SEQ ID NO: 12393 - DNA, 210 bp, Candida albicans
tcagtttttgaaataaggattaaaaactacgaagaacgaaggatacagatcaagatcaagaaatgttttgaactgacagtaccttatataaatgtgtatcttataagtttttgtgaatttccaaaagctttttgtttgttcctaactattcattatagaaattctatgttttatctatatctgtattacaggaagagagtaatattgtaa

SEQ ID NO: 12394 - DNA, 210 bp, Candida albicans
tttctcaaacggtttgggcagaggcaagtacaagatccattgggactgtttttgcatttttgttatttacagaatggaatccccgagccattcattggacggtggtccgattatgcaaataaagctgaagagatctatgacactgatcaacaacaacaacggccacaaccacttcaacaacaaacaccaacaaactcccattaccaatag

SEQ ID NO: 12395 - DNA, 237 bp, Candida albicans
tcacttccatcttcaagaaacatttcatcccgagaaagcttcaaaatgtggttaacacaagtcctatactataaattgaaatatttcgtcccagacagtattattcgagcacatcacaacccagccgcccataaaacacaagacaaaattatccactcttccagtctatactttattaattttttcatgattttcttttccttaaatactactgaaaagcaaagtgatcacatgtaa

SEQ ID NO: 12396 - DNA, 645 bp, Candida albicans
agttttatagatcttatgaatttcgatcagcttacagacgagcagaagcaacagctttatttgcaacatttgcaacaacaacagcagttacagcaacagcaacagcagctacaacaacagcagcaccagttacaacagcaacagcaaagttatcatctacagcaacaacaagcagcatatcaacaacaaaaccaagcacagttacaacaagatgatagttacatggatgaagatacgtcggaactcattaatcaaccaccagttcaattagatcatggatctcctattagacaacagccgcaaatgtcggcattcatgccatcacctcgatttgctcagctggaaagttttgataatcatcttaatgttgaccctaacaatactgaacgattcacatcgatggattctatgaatttccaaccaccagcatcgactttcactcagttgggtaatggtagtagtactaatctttctgaaataagcagtggccaaaactcgttgttgtcaaaccattctgtcaacaacttgccaaccgcattaactagtgatacatcacctccagttcaacaacatccacaattccaaccacaacagctgcaacaacgaccaccggtcttcacctcgggagctggcgacccgcattaa

SEQ ID NO: 12397 - DNA, 243 bp, Candida albicans
ggaccaagtcaactgtacaatgaatggcattttggtagacaacaacaaaacttgacttacacaagtaaatctgacattttctcaaaacaggcaaaagaaaaaaaaagtcaacaaaaatacacgcaattcaaagtgaaagaaaatgaaaagtacaacctttcgacacactcaaaatcaacacgacaaaatccaaaatccaaaaaaaagaaaaaatcggttaatttcctgaaacctctgttataa

SEQ ID NO: 12398 - DNA, 228 bp, Candida albicans
atattgctatactggaacatacccatcttgtctatgttgtcttcgaaagttactagtgaactaagatatgtatgtaaattttttttcaaagaaaaatctcttttctcacaatggaggttgagtttgttagtgcgtgagaataaccaattgaaaattgtgcatgtacacgctcacacattaatttttgttcacctaattaagttttttttcttccctcgttgttgttaa

SEQ ID NO: 12399 - DNA, 249 bp, Candida albicans
  unsure (175): Identity of nucleotide sequences at the above locations are unknown.
atagatgatcgaactgtcttgataaactattcctacaccgagatttctgaccaattggcagctgactattgcaacatgaacaactcatttatactgaaagcaagtcctgatcacagttctgcaacagtaatatcgggagagtctcatctacaacagcaacaacaacatcatcaanatgaactagatacagtagttactgcagctcaattacaatcttcacccgccggtggaaggaaacgagcttgcgat

SEQ ID NO: 12400 - DNA, 261 bp, Candida albicans
gggaattgccacgcgtacaaaagtcgtgccaaacaccagattgcaggatgtgccaaagaagatgaggctgcccaccccatcaacggtggtatagctcccacaactgcacccacccatgtattaatgattgattttcttttcatggatgtgtatagccatgcatacaacactatgttggaaaatcccaacaacgacaccgttgggttcacaccaaaccacaacatcccacaaccaataggtccactgacagcagcaaactga

SEQ ID NO: 12401 - DNA, 459 bp, Candida albicans
tcaatttacaagtatcaaatatattactcattcaaaactataattctgatgggattcaccggttttttcagaatacttcaattcattttcaacatcgtttgccttgccctttgtgcagcacattttagaacagcaaaagcatttgctttgggagtcagctcggctaatatgatttataacatctatacattgttcattgtgccgcaaatggagcaaaaaacgtttgctgttttgatttttgttgcagagttagctttcccgatcctataccttatttcctgtataattttggtggttaaaactaaagctgattatgtcacgagttggaccgtcaactttacactgcagtatgataagtacagggatgtcccttataacactgttgcaatggctggtgggatatttggacttgtttgtctgtttgggtttggtttcacttgctttgcgttttttaaataa

SEQ ID NO: 12402 - DNA, 285 bp, Candida albicans
ttgtgtaatctttgcggggggggggcgtgtcatgaaccaatctctttgagtcataggacgagtcatcctattgtgactcatggctcatcttactctcttactactctcttacttcatctgtttactataaatatgtctactactcctctattttattacctcgtttactatttttattcaatatatgatcttatctttaaatttcttttgacaaatacaatcaacttacaaaacaaaagaaaaaagactaataaaatagaattaatgaaaaaaaaaaaagactaa

SEQ ID NO: 12403 - DNA, 216 bp, Candida albicans
accatacgaatacatagagagctgacattagctttgaaattctatttcaacaaccattacttattagttataaatattacgtatggtttaagtcatttcctttttttttctacaaaattatttaaacataaccctatatatagacttgaacttgaacttgaacttcatcattatcaactctttttcaatgattccatagcttcacgaattaaataa

SEQ ID NO: 12404 - DNA, 192 bp, Candida albicans
ctcttacctaaatttaaatataattgcaaaagatgtttttcacttttttcaatctctttagtaattataattgatgatgaagaagatagagatgatgcggaagcagtagatgatgatgttgcaggtgatgatgttgctgcacttatacctggaattgcatttgtagtggaattagatgcagaagtgccctga

SEQ ID NO: 12405 - DNA, 213 bp, Candida albicans
atgatgcccttggaatatccaaatttaccaccaaataaaattgttgaagttcgaactcaaacaagtagaaatggtttaacatttttcatagtccggtttaataattatttaattagagaagtcactgaaacacaattgcaaagagcagcaccaaagttatatgcgaaaattaaatccgataaaagatttcctaataatgcaagatgcatttaa

SEQ ID NO: 12406 - DNA, 693 bp, Candida albicans
gatcgcgggtccttccagccccgtggtgaagatactccaggaacatcaggtggtacggtaccaacaacaccacaaataccacgatcatcaagtcaaagtggtgggtttgcttcaccttatttattagcttctgggttattatcacccaaatcaggaggtggtgccggtccaggaggaattgtatcatcgtcttctccaattaatgaaaatggacctttaagaaattcaacttcaaattcagaatattttggtgatattacttataaaagtttaaaaccaccatctcgacaaaattcccaatatgcaagtatcactagtggtggtggcagtattgggtttggatatggttccaacaatagtggcctatgtggaccagcaacagcaattggaggaggaggaggaggagtattatcatcatccactccatattctactggttctggatcaacagcaagttcaatgaattataataatcataacaacaacaacaacaacaacaattctgtcaatagtccgattaatgaatttagatcttcaagggatttgaaatcatcatcgtcaccaacgacaacgacaggtacatcttcaacatcagggaaaaaaccccaatcacgtagaacatcagataaaatgttgggattttcaagtgatgcttcaggtagtcatacttttgttattaaaccgaaaaaataa

SEQ ID NO: 12407 - DNA, 234 bp, Candida albicans
tttaatagtgtgaaatatatcatacatcatttcataatttatctatatcatagagttattttattgttattaatgtattttacttgtattgttagtagtgggattgcatgtctagtagattttggcgataccgattttcaaagagtatacaaatccaagcaagaaacactaaagtcaataaagctttccgtagtggtgcgctttttactagacacagttgctgtaatcttttag

SEQ ID NO: 12408 - DNA, 567 bp, Candida albicans
tcttcacagactatagacccaatgatatcgtcatctactgcgtcatcatcatcagttgagtcttccttatcaagcagtacagcctcggctgattccgattccaccagtagtaaattcacaagattaattcaattagcagtaattcttgtgatattctggggggtttatgtgctttatgcatcctataaatcaagaccatcgtcaataattaaaaaacctacgaataataccagcaatgtcactcgctcatcagctggtaagaaaaagaatgtccaatgggcagatcaattaaatcaatttgaagatgatgaaagaactcaagaacccaaccaagggatcattgctaaagcaattggtaaaatcactggatcgaaagatacaagaggtagatatgctcctgttcaaagaggaaatggtaatgaatacatagatgatattgagttgggtgaaggtctaagtgatcctaatgtcgatgagtttataattggcagcgatgatgacgaggaacaaggacaggcacattcaggtgctgctactcataatcaaaaacaaaaaccaatgaattag

SEQ ID NO: 12409 - DNA, 195 bp, Candida albicans
ttagtggtattaagatatcaattaatctttaattgtagttttctttttcttgtgtttttttttcctttttcttttaaatcaactgattcctttaaaatatcaattagatttgatagattgattaaaaagttgggttgctttcgttggaaaagattggataagtggacaaaaaaaaaggcaaaagaaaagaattga

SEQ ID NO: 12410 - DNA, 204 bp, Candida albicans
cctaaaggacacacactaaaaaaagaaatcggcaccttaactggacatggaaatacccgcgtattacggcatataaactgtaacgttgttgtcccatgtcgtgtcaaacttaatacacttgaaatacaactcagtatctcacctactaatatacatatttatggttgtattattcagacattacttgtagatataaaaatataa

SEQ ID NO: 12411 - DNA, 237 bp, Candida albicans
tataacggaacaatagcagaaaggatccctactgataccccagatacaaatctccccacacacattagggcaatactagctgatgcaatttgtagaatgttcccagtaatgaatattagtcctgatgacatcataatagaaaattttctgccatatcggtcagatgctaaaggtgcaatcaatgcaccaataaaagtacctaatgataaaattgccacaagaatagatcgttcatga

SEQ ID NO: 12412 - DNA, 267 bp, Candida albicans
atttatagagaaaaaaaaaacatattcacacccacatcatcatcaaacaatatccacttcaaatttacagccaacacaactgaaagaagtggactacatatcaaaccagatcaaacaaccactgctatcaattatcaatactcacaatattgtcaaaatcaacaaacttttccggagtttttttttattttggctttttcaattcacatagacattatatttgcttcattgttattgataagagttgttaattccacaaatgagtga

SEQ ID NO: 12413 - DNA, 228 bp, Candida albicans
atccaaaaaaaaacgaagcaaaaaaaaatacagacacacactttcaacaaaacacacttggtggtggttgtaaaaaaaaaactgttaactaagttggaggagggagaagtaagcaggcaagcagtaaacagtagtagtagggaaaagagtgagaaagtaaaaaaaaatttcttgattgtcaaaatttttgttcagacagacacgcacacacacactaaaccttgttaa

SEQ ID NO: 12414 - DNA, 186 bp, Candida albicans
gatcaaataatcaatatctataataccgttgaacttgtgatatatatatgtagttatgagtggatggtatcaattaggagttgtaaaaatttaaatccaaaaaaaaacgaagcaaaaaaaaatacagacacacactttcaacaaaacacacttggtggtggttgtaaaaaaaaaactgttaactaa

SEQ ID NO: 12415 - DNA, 339 bp, Candida albicans
caacggaaaggtacaatagaatattattatattatcaattgtatatgtgttttatacgtgtttcataagttcatgtttattgtaattagttatacgttacctttgtccctgtttagatttataattttaaacgagttttatcctaagaatgtcgcagtgatcacacaagtgacgacattattaactaagggggggggtgtacatcataatctttcgtgccttattgtattttctctctcacatacatttcttatgtttttttttcttttgtgtcgcctctctttctttcttccttcctcttcctcttccttttcctctctggttaataaaatccgatga

SEQ ID NO: 12416 - DNA, 207 bp, Candida albicans
aacatttttctctttttcttaaatttagttttatatatttataaaataaacaaagatttttttaaaaaagtaacaagttatatatgtaataacaaaaagaagaataacaagaatacaaaaccagatttccagatttccagaatttcactcttagaaacatttgtggtgaacaatggatggaccagattcgtcgtattcttgttttga

SEQ ID NO: 12417 - DNA, 195 bp, Candida albicans
tatctcatctcgctattaatttttttttttcgattttttgattttttgatttgtccttctcatcggattttattaaccagagaggaaaaggaagaggaagaggaaggaagaaagaaagagaggcgacacaaaagaaaaaaaaacataagaaatgtatgtgagagagaaaatacaataaggcacgaaagattatga

SEQ ID NO: 12418 - DNA, 1032 bp, Candida albicans
  unsure (999),(1001),(1010): Identity of nucleotide sequences at the above locations are unknown.
gcagttcgggcagaatgtaagcatggctggggtttgttggtagtggcatctcaaagttatttttttttttcttcttcgaggttaactgaaaagctcactatcagaaaaatcaacaaacccaccttcaacttcttcaaccagatgtcacactcaaatgctctaccaaatagtccattccggtcacctaaaaaacaacgtatggaggtcataggaccactcaatgcgtctcgtttttccttttcgccggtaaagacacctcctcatgggagagctggtctatcatctccagagaaaagattagtcaaagaccttgacaagtcggcgagaaaaagagccaacaatagcttatataaccgattaatggatgagtatctggacacagatgattatttggatgaacaagataggatattggccgacagaattatcaaacagtcgaggggagaacccgacgaagtcaattatggcagcgacgtggaattggaaattgatctaactcagcagagacgaacccgaagaagagaaaagaaagttgtttactcgagcgatagtagcaacgaatatgaggatacaggaatgccagaagaatcttcaagcgaggaagaagaggcagatgatgatgatggcaatgtggagtttgtttatggaccacccaaagaaagaaaaacgtcgttatcaagctcaccacccacagtcaagcctactgtgcgccgaaccaagcgaggtagaccaagcaagagtgagcttgttctgggtcaaatcaaaagtatattccatcaagatgacgtgttgttcagtacagatagaaaaacgttcacaccgactaaaccaaccgcagcgaaaaaaccagtcagcaattattggacatctatttttgatcaaaatttcgatagaagcaaggtgccaagtctaagtggaattcccaaatcaaccaacacgcatgaagagcagcaaacgtttgtgccgcttcctattcccaccgtggacgccatcttcacncntagtggagnagcccgcaacgcgattggtagg

SEQ ID NO: 12419 - DNA, 483 bp, Candida albicans
gccaacagttatttggcaaaggtgataaactgtggccatgtggcaacaacatatttgacataccaattccctattctagcaaagtccattttgaatgaaaagtattacaatgagcttgtagccgggatgattgaaagaaacacactcgacacaaacttggatcacgaattggaagactcccaaaaagaaaacctttactcctttgaaagaaacaacttttataaaaatgaaattgactatacacgatgtcttgcaatgttcccgatagataagcaaaaactttgccatgtcaaaataaaagtattacacgacatacagtacttgaaatcgtttagagagcggcaatccgacaaggtcgagaatgtccctcgcgactacatcctttatgactgttttgcaaagacacaaatcaatgcacagatagttggaattactgatttggatacacagttgtttacaatcgggttttgcaaaatgggataa

SEQ ID NO: 12420 - DNA, 228 bp, Candida albicans
ccccattctgctcagtctccgcctccatacttttacttcaaacctcagccacgtctttatattttgttatttggtcatttttctctttcatctagcaactcattgctaatccgaaaatatactaatagattactgttgattactactatgttatctaatccaatcataatggtttataaagttggagacaaattcgatgagcacaaaaaaataataaaagcaaaatga

SEQ ID NO: 12421 - DNA, 228 bp, Candida albicans
cacgcggattccccagcatgtggtgaagatggcgctactttaagcttgccatacaaaatggttctgaaagcaacttacaatagactgccatgtaatcattgtcttatacttttagaaaatctacgaagcattttattttttttatataaacaatctatcacagaaacaagaaatgacaataaacaggcattgatcatgataataactatttacaacatcattaaatga

SEQ ID NO: 12422 - DNA, 321 bp, Candida albicans
gttattatttgtcccgtttgtttatcaatttgtggaatagtttcaattttcaatttgaattcattagtgaaatcaatttcttctggtttactatcttttgataataatttatatgttttcccatttataatcgttttcgctcgactacatattctaatgattaataatgttttatcactacccattgaagaagaagacgatgacgatgatggtggttgggtattgtctatgttgggtccagttattaattcaattaattctcttgatactttaggtgaccaaaattttatatcagtattttcatcacgtcccacggtataa

SEQ ID NO: 12423 - DNA, 303 bp, Candida albicans
attgaaattaatgaaaatttacaaaatttggcaattgtggaaattgttgatttagttaatcctagaaatcgacgtaataaaaataagagtgttgatgatgatactgaatcgagatatgttggaaggaaaaatttcaagaaatttaaaaagaataaacagctatcatcaaataacaataataataatcgaagaagaattgggttatatactgttgaagataattcaaacgaagatgaagatgacgaggatgaggaacagaatgatacaactagagatgagaaccattataaaggttatttttag

SEQ ID NO: 12424 - DNA, 549 bp, Candida albicans
acctccttaggagtagacgacaagggcatccaagagagtatatatatacctgaccctggtggtatgatggtacttagtagtcagacattggaggaaggatcaagagagccctgtatagggttgtggttgtctatactaccttacaacctctattgtatcatcaaattctgttactccaatattatacaaaaattagggttattgaaatctgttttgcgatgctgccaacagaaactaggggcaaagattaaatgtagaacaatcacacaaataattacaaaatacctgtccttttttaacagtaaaaccgtttatagcagtaaggggttatgctattatcgagtgggaaatatttcaataaatgaaatttggatacacattggaatttacttggttgaagctttctgtcactttttcactcaatttccatgcagaaaaagaaagaaaaaagccacctccagattcttccttttaattacatcactgaacactacaactcaattactctcaattgttgaatcaatgcttatcaagatgattgagcaatga

SEQ ID NO: 12425 - DNA, 309 bp, Candida albicans
gatacctcaaaggaacggcagacaaacccatcaaatattacaccaacaacaagaagaaatggagtattggaatatgataaattgactaacaataaaaaaattaataaaccttcaatagaatgggataaattccaattacttgagtacatcaataaattggaaagatcccgaagagttgaacgtgcaagaagagtagcttatactgctctgataatatacaaattgaaatatcttgatgaacataaaaaaagatatgaatctatgggatcaagattaaatacaattagaaatttcaccacatcaggctaa

SEQ ID NO: 12426 - DNA, 237 bp, Candida albicans
tgtgatacggtgacagtgatggtgacattagtgagagtggtggtaggtaggtacggggctccaacagtggcaccaccaaacaatttaaccttacaactacatacaggcccaatattgattttttctgttttagtgcaatttaatcccaattttccaacagcgcgtttcaagttaaggggacacaaaattacgccaaccttcaatcaattaagtaagagaattttctttcctttttga

SEQ ID NO: 12427 - DNA, 243 bp, Candida albicans
ctcttcgttttatccgtcgtcattttcgtgattacgattttgtccgagaatttcattcacttagtaattaaaaaccgagacccgaaaaaaaagccgttcggttactttcctaatggagacagtaatcttccgaatacttacttagttactttacacttctcgccgcagttcttttgtttttttttttccctagttattgtagattgctgtggcgtggttcaatgttccggaagattctattaa

SEQ ID NO: 12428 - DNA, 1239 bp, Candida albicans
ttgttctttctacccgctatggataaagtactattcattattcacttcttattatataacattccccttatacattgtaaattattttacaatcaacaacacaagatttgtaatcctaaacaactgacaccatttttcccgttcacggggtttaaaatcactcgtcaatataaaatatcgggttatacattgcctgtttctatgcatttcattaccatatcacattgtaatcatggtcaagtagattatcaaaaagttattcgaactgattccagtgggaaaattgattgggggaaaccattttgtatgttgaaacctaaattaggtgaaatgttaacattaccggatcatgacaccattggagaccctgaaacccaagattatcataatactgaagaaactgatgatttcataattgggatatttgggtttataatgtataaggggaataaattatctcgattattacgtaaaaaaattgatatacaattagaaaaattgactaatgggaaatggttagaatatactggtaaaaataaaaatctccatcaagaagatttaatgatgacaaaagatcctcaagcttcattacaatgggaatcgaaaaatctagtatgttataaaatggctcgacgtaaaaaatatgctaaacggaaatttgatttttatatgcctcatacatttgttggaggattatttgaatgtatattaccaatggatttaaaacaacaaattttccatcaatttacatcactggatttaatttttcaacaaatacaaattcaatgtgatccaaatttatcaagaccaatatctccattaattgctgaagattctacaactcaatggtttgaaaataaattatataatatagtcaaccctgggatcattcaaaccattccttatttaaccactctgacaccattaaatttacgattttcaactagtgaaacccctgatatgtttaaagattcttgggcaacaaaaattgaagtcaatgaaaattatgtatatcttgaagccgatattcatttaataagtcgagccattgctttatctaatgacttattaaataaacttatatcaccaatagatttcaatcaattaataaaactgtataataaagctaatgaaagggaaaatcctgatatggaagaatttttacaagatattacttggactcaaaaaattcatttatggttatcaacaatagtagaaaaatatcaaatcaaatattaa

SEQ ID NO: 12429 - DNA, 282 bp, Candida albicans
tttctttttagctcctggtttcttagtgccacctctatgggctttattagattgttgttgttgttccatgatggtgtggcagattggagggtaaagagggagtttattaatgaaaataaaaaaaaaaatagttttatgtttcacatctcatctcattacaaaatattaaagaaaaaaaaatatatatatacatatatatcacgtgaatatcacgcgactaatttaattataaactttctaattttgttcttgtggttgcaaaatggattccaattgttttaa

SEQ ID NO: 12430 - DNA, 360 bp, Candida albicans
cctctgaacacctggacagtggtggtgttttcccagtttttggtgttgcctgttgtgccatttattaccaagtttaaccggtatattgtcttggggttgctggtggtaggtaagtttgggaacaattttaaggctatacccgatgggttttcaaaagagaagggcaactacatctacaaggagtatcatgttgggtatgcaggtggaagtggtgtgtttctggggagatatggtgccggcctaccaggaggtggtgcattacagtccgaactgggtgacttgggcgaacaaagagaggggattagtaggggtagtgaagcatgtagatgtatagaaagacacctcgaatggcaagactaa

SEQ ID NO: 12431 - DNA, 279 bp, Candida albicans
cgattcggaggagcctgcggtgtacaccacttttttgccacgcccatatctgccctagccagggttaatttggtgctacatgagcaccccgttgtcaagtataagaccttcactagggttagaggtggtgatgagccgttgttgagtggggaagaagagaggtatggcacagaggatgaacgggatactgaaacacctttggtggagcataactatgactggtcgttgcagtatttgcctggtttacaattcggggtgattagtattagaaggagttaa

SEQ ID NO: 12432 - DNA, 195 bp, Candida albicans
cctaagcgcggatccgtccagccccgtggtgaagacactcaaaaaatagattcccttactcctttcagtaaattctattctccagtttcttctttgaagttaattttcttactatacacaattacaagtctaaaactctattatttgctgtgcttcaattctttgtttgaatttccctattttcatcccaactag

SEQ ID NO: 12433 - DNA, 189 bp, Candida albicans
attaataatcggttttttcatttctatagttctggaaatttctcctcgagcaaatattctacaaaaaaagaaataccaaaacagcaagggatagttaataagacgtggagaagaggagaagacaaaggagggtattgcttgaaatctttgcaacacgtatccagccacttgtttgaatcgcctacgtaa

SEQ ID NO: 12434 - DNA, 297 bp, Candida albicans
gattattcagcaatggaaaaatcctcgtttttccgcaactcttctagttgcacaaaatgtcaccaaccgaatacttcgatggtcagtttaggtacaccgccgttattctatcaaaagttattagtaattatctccgatagaagaagctggatgtcaaatcatggcggagttaccatgaaacgaaaaatgaattacactcttgaattaataatcggttttttcatttctatagttctggaaatttctcctcgagcaaatattctacaaaaaaagaaataccaaaacagcaagggatag

SEQ ID NO: 12435 - DNA, 207 bp, Candida albicans
aatagtagtagtattatcatgttgtataaaaaaaaaatacaaacattactcccatttaaagtacaggaaaccaatgaaaagttaaaaaagaaagaaggggaaaaaaaaaacctgctaatgtattgggggcattttttcaaagagagactcagagagaaagagagaaaaaaatttttttcaaccataataataacgatcagaatttga

SEQ ID NO: 12436 - DNA, 342 bp, Candida albicans
gatgcagatactatggtatccctatcagtaaaagattcaaaagcaagctgctatatacatcaaagaagaattgttagtactaggcgactgagacgcataagtctatgctataatactacaaactcaattccattgaattcattacgtaggcgattcaaacaagtggctggatacgtgttgcaaagatttcaagcaataccctcctttgtcttctcctcttctccacgtcttattaactatcccttgctgttttggtatttctttttttgtagaatatttgctcgaggagaaatttccagaactatagaaatgaaaaaaccgattattaattcaagagtgtaa

SEQ ID NO: 12437 - DNA, 219 bp, Candida albicans
caattaaaaatgtctgctcctaaagttgctactcaagtttttttaaaaacctgttcatctggtttcattcatactaaagtcaatggggacggactccaatttttgaagtcaaagaagttccccagttccagaattaaaaggaggtcaaattttaagttaaagttgaaaaattatccaaggaacccaacccaaagaaacctggtaaggaaaagctggtga

SEQ ID NO: 12438 - DNA, 222 bp, Candida albicans
cttggcaaaccctccttacataccatatccattacaatgctagaaatgtcaattttcactgacgatataaaggatggaagaacttcaaataattttataaactcaggattggctggtgtatctgctacaggagctccagatttattgtccatttgctcactccatggacatacattattaacgtccatctttttccattcttcaaatttcttgttgaaataa

SEQ ID NO: 12439 - DNA, 996 bp, Candida albicans
ccattcgctatgaagttagatttcgccactgccaccttagttttagctgctatctcatccgtcgctgctgctccagctgctgacgctcaagttaaagtcactcaattgactgttagagaatcaaatcttgtcaacagtgccttagcaaacttacaacactacaatgccaagagagatcttatgtcccaagaagaaatcattaaaagagaaaatcaaattgtcactgatgtcttgactgccattaaaaacaccaatttgtctccaggtattattaaatatctcattactgatccaacattgtccaaaatttccgtagatgtcattgttggtgctattaagaatggtaccattaacttgactaccttgttgaaatcattgaatgattctggtttagccgttgatcttattaaggatttgattaacgattgtgcattctacgcttacatttataaagccattttagacaaacttaccagtttgccaaacctcattggtaatgctttaggtcttaatgccaacacagtgtccagtaaaatggcttctgccaagagagaaattatggttgaaagtgctccagaaccaatttacgctagagatggtcaagatgttcttacttctttaatggaatcattgaaatcttctggtttagccaatcaagttgtcgaagctttggttattgatgatcaattttacaaatggggtggtgacttgattaaagaattgattgatgaaaaagccatcactcttggtcaacttattgatgccttggctgattctggtttgattccatcccttttccaagctttcttaaactttggcactttgaaatctgtcattgttactgctttggctgctgcatttggtaaatgtcaaaatgctactccaacttcatctttgaagactactccaactggtactgctaccgtttcaatcccaacagctactggtacaagtggtccagttacctgtaaaaagaagaagagaagaaactactaa

SEQ ID NO: 12440 - DNA, 414 bp, Candida albicans
ctttgtctataccagaggttgatggtcgagtggacatgtttcttgtctggtgctgtttctatgcaaagacaatgttggaaagattcaaacctactgtataaaagcatttgtaccaagaaccaaattaaaattattcgtggaccaagaaagaagttgaagcttgatgttcaccttgattctgtggctttggtaattcgattaccccggaaagtggatgtcatgatacaaatcgacagaacacgcttgaacaatgcattggttttgaagtccgcagatattgttaactgtcgattataccttgttgattcaagcactaaattctgggccagattgttaatcattaaagaacctaattttagtattgaattccaccagttcgatacacgatggcttattttggcatatccaccagat

SEQ ID NO: 12441 - DNA, 186 bp, Candida albicans
agaaaaagaaaaaaaaagttattagatgtggtaaattttgacaagatcttcagggttggtatttgttttttgaaagaaacagaaatagaaaaagaaaacagatattataaagtggaacacacttatattactaaaagaagaaatgtagatagatgtatcagattcttaatttatacaaatctgtag

SEQ ID NO: 12442 - DNA, 210 bp, Candida albicans
aagatggttttccaacaccaatatataactgaaagtgaattagtttttggtgtgagaacaggaaaaaaaaatagaacgtttggtagaaaaaccgaaatcttgatctcatctccaatcatattaaagaggcttgctttttccttttacttgaagatacaacctagcaaagatatctcccgactatcaaaatggtctctaacatatggatag

SEQ ID NO: 12443 - DNA, 1227 bp, Candida albicans
ctcgtaccgcaatcgcggtccttccagccccgtggtgaagacagaacactttggtctaccgatatactcaagattaaatttggattggcttctgaagttttccttattgtttcaacatttattattgtatctgcaaatttgattttagctcaacgtttgttcacttggagacatcctgtaggaggttcaagaaaattattttggggatttatgtttgctacatatggaatggttttagtagttattgcaatcacaatattggcatcgtttgtaccttacttgtattatttgagtgaaaagtcatacttgtcatgggtaaaaactgttcaatttacttcagttttaattttggcatattgtttgacgtctgtggcattgattggtttgtcgttttggttacccactaagaaagatgagagtaggtacacttatcaaccctggtggattgaaagttttgctccgttttattttgtgaaaaaaggtgcagcgcaggaagctgaagcaacgtttatgaaacggaattctaatcatagacatgctactcgtgtgattgctgcaacacatcatcattttaaaatggtcaaaggattatctactgagagaggggacctcaaacataacgtgtcgatgggattattgattatatctacagtattgactttgtttggttccatagtcagagcaatagtggtatttcaggcaagagaacataaatttgcttctccagctgaaagtatttggtttggatacttatgttggggagtttttgaaagcatcatcagtattctttacattgtttgcagagtcgatcttagattctatcgtcctgatatattacctcaagcagtcagagctatcattactgcccaacaatcatactatccttcagacgatgaaagtggcgataatgatgataatcataattataaatcagaaataattgataaaccagaaccacagcaacagcatgtttatgctaaacacattggtgggtttagaggagatgaaaaactggttgttgatgaagacgaatttgatgatattgactttgatgaatgggattttggggaagtcaaaaaagatagaactaacacaagttcagatcaatcttttgtcaatagttcttctcactgggaaaaaggaagggcacatccaactcaaattcaaagcagcaaatctgtcaaatatcaggacactaaagaaccagatatggaatttcaattttaa

SEQ ID NO: 12444 - DNA, 1662 bp, Candida albicans
cttttctattgctttttttacccatctatcaatcacatctgtcatttgaactttcagttctattcaccgtcatcctcaaaaaagaaagaaacaataaattcaaaaatggtggtttctgattatagtgctacacaagggctcatggctcttttatatagccttaacaaaggagctacaacagggacaggtatcaaaaaattggtggatcaggcccataatttgatagggccaaatatccctgctgccgttgttgattataatgttggcacccagatcaatttatttggttcatacccaacaagagcagatatcgctccgtctatcgtatttgcagttatattcggtataattatgcttattcatatggccattctaataattaatacgtcgagaggccatcatttttatctttcatatatttggatcgtatacagtatgatgaaagttattgggtttgccttgagggccaaatggggtaccaatcaaactttagttgcaattgggttaacttcagaagtgtttttaattgttcctgcagtggtgattgtgtcggcaaatttgatacttgcccaacgtcttttcacttggagacatcctgttggtggttcgagaaaattgttctggttctttatgatttcattatattcattcgtcaccgttttagttgcagttacagttttggcatcgtttgtcccatacttgaactttttgagttggtggtcataccgttcttggattaaagctgtccaattcacaggggttttggttattgtctacagtttaactgcagtggcattgattgctttatcattctggttgccaaccaaaaaggatgagctcagatacacttaccaaccatggtggattgaaagttttgcccccttctattttgttgagaaaaatgctgcccaaaaagccgaagcttcattcatgaaaagaaactccaatcacagacacgccactcgtgttatcgctgccactcatcatcatttcaaactggttaaaggtttatctaaccaaagaggtgacttgaaacacaatatatccatgggattattgattatcactaccttgttaatcttgattggtgatattggtagatgtatcgttgttttccaagcaagacaatcaagacatgccagtcaagctgcaaatatatggtttatgtatgtttgttgggggattttcgaaatcattatcaatgcactttacatcattggtagagtggatcttagattttaccgtccagatgtgttacctgcagcagttagatctattgttaccgctgaacaaacttactacccatcttctgatgaagaagaagatgggttccatagagacagaccagaaacatatgggaaactccgtggaagagcagaatacggacatgccacaccaaatcgtcacccagcatatggtcgcgaagatcaagagctggcatttgatgacgacgaagatgattatttcgaagatattgattctcaagaatgggactttggtggagccaaagaaaaagtgtctagttctacagaagacacaggtcaacatccatttggtatcacacaacaagacaaaaaagacgaacctccatacccagtgtataatagtgataaacaacatgcaagatttgatgacgataatgaatcggaattcaacttttag

SEQ ID NO: 12445 - DNA, 639 bp, Candida albicans
  unsure (46): Identity of nucleotide sequences at the above locations are unknown.
gattattctttaaaaaaaaaaatgacagagcatagttcacgaaganattctttgacttcaatgtcaactactgcatcatcgcagaacaacatttccgtacatgatttatctacagacaacctaattgcagtggatagtaaatttgtgaaaaagccaacaaagaaatttcccaacagtaatggaatctcaccaaaactactaagtgatacaagttttcgtagtcctcctagtggcggtagttccttttattctaaagaaggagtatattatttccctaatggtgaagtattcagaccaagaacaacaccagcaaaaagaaatagaccaaacaagatacatactgattctccaccaacaaagtccgaaaatactttttcaccagttgacactatcgtaccgaataattcctttgcaacagattcaccaactcatagtccagtacattccacccattcttcatccgcaaatagtgcgtctactttacctagtaatagtgggaaaacttcaatacattcaaataattctttgacgtcgctacccaagtcagcttcccttcagaatattaaagtgttaaataaacagaatttggtgctgactataagcagtcacaaaggttttcaacaaccgccgaagacaaga

SEQ ID NO: 12446 - DNA, 936 bp, Candida albicans
ttccgtttttgcaaaccacaaacatttgataccaaaccatgtacagtagctatgaaaatacttctaatttattcaatgactccaaaacttgttatatggtttacgttatttgtactatgtttgcaaatgggtgatacatttgatatatcaataaataatgaagaaattgataatcctggcctaatcatcaaatctaaatttaaaaaatatttaccggaactacaagaaaatctagaaataccaatcactgaaaagcaacaaagtattaaagaatcatttattcctagacggataaattaccctcattatggattgagatcacgatttagaaaagatattgctattctggaaacaacgaccaccaccacccaagaatcggaaacatcaattgcaacaaatggtgattctttcgatagtgacaatggagaaaataaaagtgattcaagtgatgatgaaagtagcaacaacgagggtaatgataaatctgatgctacattcaaatcactttcttcttctgctcctacagtagtacattcaagacgatcttggattaaagatttcttaattttcaaagaacaaaaagtatctaccatgtcatcttcgtcttcgtcatcttccgggtcattacgagacaaatccaaactcaaacaagaaaataaacaactacaatctcggatcaagaattatgatgacacagtcagtgatcctcgagatttaaaacgatgggtaagattgattgctgatgaaggtaagaatgaatttggtaaaaaacattcatcaaaaaattatattcaaaaaaatgaaattgaattagatattgaagaatttattcattatttagtggaagaacaaggatttaattcatcagatttagaatttttgagattgaaaaatttggattatggattaggtgaaattggaaaaagaattgaataa

SEQ ID NO: 12447 - DNA, 237 bp, Candida albicans
gaacaaacaatacaaccccaaatagattgttatacaactaccaacaagaataacttcatagatactggaaataaagttaagggaaaaaaaaaaaacaatcaagaagaatttcaaatcaatctttcaaaacccttgaacacaaaatcaaatgaaaaacagtttcaacacgacgaatccttgcatttcttgtttagctttatgtcaattatggaaaaacttcaaatcttgaactactag

SEQ ID NO: 12448 - DNA, 645 bp, Candida albicans
agacaagtatatgattataagtaccatgcttattttaaagccatatcgacatattataaacaattcaaagctgaaaccaaagaatctttatctaaatgggatgatttagtagttccaaactatctcatttttaaatcgacaattttccaagacttggatactaatgaacctgttaaattccgtcaaataactcatcaattcaataagttaatggatcatattgttaatcaaacaacaatatttgataaatggaatgaaaatgttgaagatggattgatgcaagattatccctggtatatgtattataagaaattacagcattatgccgaatataaagtttctaattataaattggcatatttagagaatgatttactattaaatgatcgtgattatttatatttgagaacaggtgaaaatggagctataatagatgtccctaattattattatgattctattatttatgggcaacaatcatttaaccccaatgaatcgaatcaagaatttttcgataaacgatatttacatggttcttttacttatttgtaccaaagcatactaaatgaggatttcgaatttacagtgaaatggtttgtgatgatttatgaaaaattaaataatatagattacacaatgacataa

SEQ ID NO: 12449 - DNA, 573 bp, Candida albicans
gaaattacggctatggagccagagataccagatcctaacatgtatatcgaagatgggagccattttgaattgccaagggattcagaacatattttcaatttagaatttgactataatgatatcaacgatgagggagaagatgatttaattgacggagctaattccaaaaatgggtcacaacaaaatagtatgagttttgatggtagtggtgataatttaatgaccatggatagtaaattagacaaattctatcgatacataaaagccaggtcaaatgaatttgggaaattggttgttgggacatatctcatatcacaagcaattaatgaatacaatgttgtgcttgctgaacatactggtgattactatcaaactaaatttcaaattcttgtaccggattcaactcatgccttggacattgaggcacctcctgttccaagaagagttgctgcatatgcatttgcctgtgttttgactttagctacaaagagtttaattaatattgaagtaatacaagaaacagatgagctacaaaataacaatgatattaatataattctacctttggaatga

SEQ ID NO: 12450 - DNA, 279 bp, Candida albicans
atttcaagttcttcttcttctgccagtggacttttccatactagggtgggttttggctgtttaaagattgatgtgtgggtcaagaattttagagccgcacagttattccgttatccaattaatatgacaataaccgcctctgaaatatctccgaaataccaacttcctggaccaaggttcatgaaagcctcttgttctccaaacagcaaaagtataggacaattaaccactcattacgtaatggagtcgggtttcctttacaacattaagttggtatag

SEQ ID NO: 12451 - DNA, 222 bp, Candida albicans
gtccaacgaaagaaagaaagaaaggacgtttttctgtttttgtttttatatatactatatattatttttaatattaatttgaatcataatattgacgcacacacaaatccagtagcattcctattgtgtttattgttcatttcttttaaaggcgggtttgtttttcaaacaatagactggcagcaaccgaaatttaatattttgtgttctgtgtattcataa

SEQ ID NO: 12452 - DNA, 234 bp, Candida albicans
tttttgaaaatgaatttatcttatttttacggattgacatttgtgtctagtttattagtgtgcggctatgacgtaatatggaataatgtacttggtcatggaattattctacatcgtcttggaacaagtgtactttttcttttgtgtagatatgatttgctgagaaaaaaaaaaaaactataccaacttaatgttgtaaaggaaacccgactccattacgtaatgagtggttaa

SEQ ID NO: 12453 - DNA, 183 bp, Candida albicans
ataagaagcaataagataaagaaactgaaacggaaaccattatttttgaagtttgaagacgcttgttggttgtctgaatacttttcatcttgttttgttattttacatgaaaagagtttgaaattggttgtcaagtggttgctaaaaaattgtacaaacaagcacacacacaactactactag

SEQ ID NO: 12454 - DNA, 237 bp, Candida albicans
tgtctatcgtgtagtaggactaattctcacgaatattccggagagaagggcaactacatctacaaagaccgcaatggcatcaaccaactagaattgtataaattggactggaacaaagagtatcttgtcgggtttgagtggttgcccgatatcgatgatgagggggggtatgcgagtggaagtggagtgttattggggggatatggtgccagcctaccaggaggtggtgcattatag

SEQ ID NO: 12455 - DNA, 249 bp, Candida albicans; identical to SEQ ID NO: 9823

SEQ ID NO: 12456 - DNA, 291 bp, Candida albicans
tcgggtcttcaggccgtggtgaggacaggtaatccttcagaattaattggatatttgattttcttagatgaagttgatttgctgtcagaggaagaagtagtagtggtggtagtagtagtagtagtagaagaagaagtagaattggttggttctggagtagcacttccctttgacttctttgatttcttcttcttcttagaagaagaggaagaagtggaagtattaccttcctcactagaagatttatttgattttgaagatgaattagaaccaccagttgattgttgttga

SEQ ID NO: 12457 - DNA, 201 bp, Candida albicans
ccccagccaagactaatcaagggggggggcactggtttaatttacggaagtctaactgccaacaagaacgacttgtacgtgttagcaactccgaattcaaaaatccctcaagatctagctaacactaacaaatgcctaaccaagctgaaccactctaaaactaccccctgctgtaatcaccacaacaagtcaaccatctag

SEQ ID NO: 12458 - DNA, 414 bp, Candida albicans
taccctctaccccttctccgctccaacttaacaatcatgtcatcagataatttttttataaagaatagaactgctattattgtgactgcattgactgcattctctgcagctggtgcttattattattacactcaacaacaatcaactggtggttctaattcatcttcaaaatcaaataaatcttctagtgaggaaggtaatacttccacttcttcctcttcttctaagaagaagaagaaatcaaagaagtcaaagggaagtgctactccagaaccaaccaattctacttcttcttctactactactactactaccaccactactacttcttcctctgacagcaaatcaacttcatctaagaaaatcaaatatccaattaattctgaaggattacctgtcctcaccacggcctga

SEQ ID NO: 12459 - DNA, 360 bp, Candida albicans
accaacaagaataattttatcacacctttatttccccccaccatgccagaaaacctccaaacaagattacataactcactcgacgagatattgaaatcatcaggatacatatttgaggtaatcgaccaaaacagaaagcaaagcaatgtgataactagccccaacaacgaactaatccaaaaatccataacccaactgctcaacggcgaaatccaagacttccatgctattctataccaaacagtgtcgaaactcaatgatgcagagtggtgtctcggcgttatggttgtaaagaaaaagatacatgacgaattgaaagtcaaagaagaagcggcaagaaagaatgaagatgaggcttga

SEQ ID NO: 12460 - DNA, 201 bp, Candida albicans
ttatggtcaagatctcatagatttttttgttctattaaatatggttgcgcttttactttaattttgcattttcattgtaaacgtgtaaagttttatttctcccagtgttacaaaaaaaaagccaaaactcattgctactatgcattagtcaatttaattcaatttgttaaacttttcataattctttcaaccatgtgttga

SEQ ID NO: 12461 - DNA, 189 bp, Candida albicans
ttagtgaatgtcattgctgataacgaaaggaaagatcttgttctgattaccattgatggcatttcattagatagcgatttcgcacatactttttttcttgcaattttgtatgacgatctttttatcgcaacaatccgtttttgcaacagtaggagtttgcatgcagtcatatttagaggtagcaaataa

SEQ ID NO: 12462 - DNA, 222 bp, Candida albicans
tcttatttatcggtaattcttgcatcagagaatgtggatataaaggaaagctgtgaaaatgtgttcccagtactaagcacatgcaattataacagaccacataccagccgctcaaccaattacctagtccactactctgctaattttacaggacttggtgattatggtcaagatctcatagatttttttgttctattaaatatggttgcgcttttactttaa

SEQ ID NO: 12463 - DNA, 222 bp, Candida albicans
ttgcttttcaagccttatatcatcctaacaactttaaacaatcgtagacaatctaataaggtaatgaaagatgttgaacaaagaaacaagaatgaaagaaagagaacaagatttttcagtaatgaagatattccttgcaatcttgaaacacatcgtcaaacaaaaaaaaaaaatctgttccttttaccaactaactttctatccttgtttttgtttttataa

SEQ ID NO: 12464 - DNA, 222 bp, Candida albicans
tttgataagaaaaaaatgattatgaacaaagcttatttttatggatggcatttgggatcttgtagtttagaagtgaaagaacttattgtcaccatggctcaagaactccaactaaacttagctcaccctatctttttaaccatggctgatcaattgattgaacacactatattaaatcttattttgataggattcataacctccgatcaatggttttattag

SEQ ID NO: 12465 - DNA, 189 bp, Candida albicans
tatcttgaaacatcttcttttatttggcaatttaatttcatcttgttgcaaattttgcatatactgttatttgctacctctaaatatgactgcatgcaaactcctactgttgcaaaaacggattgttgcgataaaaagatcgtcatacaaaattgcaagaaaaaaagtatgtgcgaaatcgctatctaa

SEQ ID NO: 12466 - DNA, 234 bp, Candida albicans
gaaataatttcttcaactggtataacacaactacaacaatatggtaaggtaagtagaaaaaccccaaaaagtgaactaccgaccttacagtttggtttaaccagaccaaaagtaaagcattttcggttaaatgggggaaaagtattacgggatttattaattactgtggctgtattcagtttgaaagcaataatgggaaggtttgaaatttcaaaaagagccggcaaagattaa

SEQ ID NO: 12467 - DNA, 225 bp, Candida albicans
aactgtttgctaccaattgtctcaaatatatataaacttttcacaccaagaatattaaagttcaatattacgtttaagtttacttttcatttttgcacagttgttaaatataataatggtgatgcttatttagatgtaaaatactatgcgttctatattttaattttattattttgggaacgattattgttgtattatgcgctttttaatttttatttgatttga

SEQ ID NO: 12468 - DNA, 375 bp, Candida albicans
tttactataaattgtcttatatcttccctttgggttttttgggtttcaatttatcaatttttccgtttttttttttctttaaaagttaataactactattctaacaacaattccaatatgctgtcatttgttgaggtcaaaccagatttcgtgttttctcaatatgaaatatcaataattaaatcaatatggaggtcgcttgatttaaataaccctcttaatcttaaggatttttattatacagtctcagctgctattaatagtactggtacagttaccaccaatggtgttgttagtcctaaaagagataaatttacatcgctaatcataactcaacaagacattgctaacaccattagtgattatcaagtataa

SEQ ID NO: 12469 - DNA, 291 bp, Candida albicans
aaaaaaggacaattggaagaaagaagtataaagtccaaagtatttatcaaatacgcgaaaatgagaactttcaaaaaaatttctttaagccaaggcttggcatcaatttatataaatataaaaactattcacttcttgttgtttagatgtgcttaccaaaaggttttttttgtgagttcattttattcaaacaagataacaatgcacaatacaagtgggcaaattagggctgagttagctgcaaacaatagactacaagtaaagcagagtgtcatcgtttatcaaaaatga

SEQ ID NO: 12470 - DNA, 504 bp, Candida albicans
cttgtcattttgctattttcaatttctccttcacttgtgattctgtcgttaccggtgatggctctcaatcttttagccttgcgatataataatgttttgccaaaagtttcaggtaaagtgaaacacaacataacaaatgaaaacccagaaatgatacacatgaaccaaaaagtccatctccaactggctttgacagttaaaattgaaccaaagaatggaccaaaactaggaccacaaacagcacccaaactccaagcggctaacccaactggtaaattccaaaatttaaccacatcagcaacacttgcaccaccagtggccaaacaaggactagcaaagaatccacccaagaatctcaatatacataaaccggcaatattatttaccaaagcagtggggatttgtagtatgacaaataaaaataatgttatgatatatatggatgtacgaccaaatatagcattttctgacatcggactgaaaaccaatgggccaacaccataa

SEQ ID NO: 12471 - DNA, 1944 bp, Candida albicans
accatgggtaactataaaccaagtataaagcaatatgtcgtgacagtaaaggcaataaaatcctcacaatttggaagactcggcatctgcgcggtggttcttcttttcgtattgggatatcccttctatttcatatcaaataatccattcgacacatcaatacgataccagtatgtggatccatataatgataccactcgaaagtataccaccattgagaaacaacacacagatatcggcggcaatggtactactattctctatccgaaaaacttgcaattagaccagacggctttgctgcaactattgaatactaccgaaacaacgaatccctttgtccaatatattggcaactcatcatcaatagcatttagtcagttgaatcaaactttggtgaatcatagtatacaggtatttgatccattttcaaactccgacaactgtctggatttaatgaccgaaacacaattaactatttcacaaaatattattatcaaggaactgtttgaaataatggtgaaacgactaatgcatcaattggatacagaaccagcatttaaagaactagcaccatttttccaaaataaactttcacttcatttgcgaatgagatcatatcataaacatttttacaagtttgctggaacttcagtatggttgaaagattatggagttcatttgatgatcagtagggttatatactcccagaagggtaaaaagggcgatcctcaaatttcgttactatatactcaattatatgatactaattggcaagaattgacaaatactgatctccttgtatcgatgcaagacatcactggtgaatataaattagaaaaattgcagtttccacgattattaccaatgcccttttattataatcccaaattgacaaaaggaagatggtatggtcccgaggatgctcgtattatgttggttaaaaatcaattagacatggaagagccgatggtaatttacaactcttatcaccgtcaaattgcaaatcacaccactactggaaagacagatggttcagttgaattaaattttgaattttatagatcgatgtttgttggatggccatttaggtaccaattgggtaaatcaaatacagatgggtttgtcgacgataggtttgataacgtaaagttcacaagagtggcggaattgaaaatccacaaccagacccgagcttccattgagaaaaattggacaccatttgttgatccttcagaacgagaccctgaagataagagtctttatattgtatatcaatgggataaattaagaattttgaaatgtgacattagcaatttagttactgatgatgggtttattcattatagtgcttgtagattcaagcaagatactaagcacgatgaagtggaaaaagtgggaccaatcagaggaggcacagaattgataccaacaattataaacaacaaacagttatgggtcgggttcttgagagcacatattgataaatgtggttgtgggaaagctatgtatcgcccaaatatggtagtattacaaaagaccgacatgggaacattccaggtagcttatttatcatcatacatatcgtttaatatccctgttcctggttggaaaactcatgaaatacagtgtggcaaaagagacccaaatgttttgatccctaatggtatttccaattgggaagtggctactattgatggaattgagcgagacgttttaactatgactctatcagctgctgatgaagataatattcttatggatatccatgggttaaaaacagttatcaaaaatcttattacaaatcagaaacatggcaacgagtttaacagtgatctggttcaaatgaaatgtgttgttgcttactctattgagttttgtagagcgtatggtgaagaacaggcgagattagggttgaccggaggttggctaccactgcataattag

SEQ ID NO: 12472 - DNA, 1023 bp, Candida albicans
  unsure (39),(964): Identity of nucleotide sequences at the above locations are unknown.
ttggtaagtcccgagatcagttttatcttgctttctttntaccttcttttaatgctacaaccactactaaaaagaaggctctccctatacccatggaggcatgtatatatccgaaattattcaaataagcaatcacagaatgcagaacctacaccggaacaggaagtaacttcagcgatagttgatagaatgaagcaaatattggaagaaaagatatcgtctcaatctgcaagtacaatccaaactatgaaacgtaccgatgaatcattaaatcaaatactatccaaatatgacactccatcaacatcactacccaatagtaaacaagcttcatcgtatataagaagtgaaccaatacttgctcacaacaaacatgcgaaagatatctacaattctattccatggagtggagccgaatctgtttatgattctaatctaagaatgattgttgattctaaacccaaacctatcaatgatccggcaagtcttgcctacaaaaagagaaatccaacaaaaaatgagaaattagccatggcaagagatatatcattggattataaagtcaacaaaccacaagtaggtaaaaataaggacaccgatgacgatgggtttagagaaatgtatcgtgaacgattgttgggcccatcaatgcttcttaatcatagttctacatcggttgattttgtagaaatgttagctggtaataagatcaatgccaagattgatcaaacaacggggaaatttgagactgatgacatgcaaaaagttcggggtaaaccgttggagaagcaacatttagtgaattgtactgattcaaattattttataaatcaagtgttgaataaacaagaagtgttacctccatggattgaaagtcaacagaaattgaatagaaatatagcacaatttcgagagaatttagttgaaatgtggagcaagtcgaaacaattacatgaatcagatntgaaatatattgaaacaaaaataaatttgttaaatcacgacataagacattataatctc

SEQ ID NO: 12473 - DNA, 204 bp, Candida albicans
tgtaccacgcagaaaaaaagtgacaagacaatattgaatttgattcaattcttactcaaaagcttgatgtttgtgagtagtttaaatccaacaaaaaactacaaacaacaaccacacattgatcaatttagatctgacaaagaatattataaactagatgatatagatctggtcgtcaattcaaaacgcgttgatagtgtttga

SEQ ID NO: 12474 - DNA, 261 bp, Candida albicans
ttttttttcaaaaaagattggattgacgaagcattatatattcgtctaaaaaccatttttgctggttccgcaataaatctcggagattatttctcgattaccaatttatgttgttttgtgacatttcttatattttgttctattttacacgactatttattgttaataaatatgtcacctaaagaatatttctatttagttttacatatgttttttgacgacaatcaactattacaaattaacctacattttttaatttga

SEQ ID NO: 12475 - DNA, 243 bp, Candida albicans
ctgggtttatttaaatttttgctttttttatttttatttttaacattgttattcctttttcctttgattatttctttagtggttggtgttattttgatttttgcttacatttttgcttacattgttatatttgttattcctttgttagagtttttttttttatttttgcccttttcccttttggatttttttatcattgtctgtcttattcaatggttttctagtctaaaaattttggtctag

SEQ ID NO: 12476 - DNA, 1059 bp, Candida albicans
cttaagtctttcgttcaaaaaacaactacaatgcgtgccaactatttgttattattagctgccacagctgttcaagctgctccattcattaagagatatgaaaacactactgctccagccagtcaattgtccacttcattggctgatggttccactaccattcttggttcttcatcatccagtgttgaagaagatgaaaccatcacttccactatcgttcaatatgttactgtcacttcttctgacaccacttacgtttctgccaccgacactttgactactactttaagtactaaaccaaccccagttatcaccactgaagctgaagatgacgaagaagacaatgaaaccattacttccaccatcctccaatacgttactgttacttcttctgacaccacttacgtttctgctactaacactttgactactactttaactaccaaagcagccgaagctactgaatccgaagaagaagaaaacgaaactatcacttccaccattcttcaatacgtcaccgtcacttcttctgacaccacgtacgtttctgccaccaacactataaccagtgttttgactaccaaagcagcagtatctaccaacgacgtcagtgaaaatgccaaggctgctactactgaagatgatggtgaaaccactacctcaaccattactagtatcgttactattactgatgccaatggtaacaccgaagtgttgaccgaagttgcagctgagaccagtggtgcagaagatgcttcctactgtgttcctactactgtcactgttactgtcactgctgaacaaacttccgaagttgtttcaactattgttcacactacccaagttccacttactgctgaatttacccttgatgataccactactacccttacatcttgggtcgacttgacttctacagatctcgtcactatcacttctacttcaagtgtctatgattcatactcaactggcgcttctcaatcccatccaatttcctcatactccaactacacaatttcggactatgccccaccaatcagttcttactactctttgtaa

SEQ ID NO: 12477 - DNA, 237 bp, Candida albicans
ccttccatatttcaatattcttttcagcttctgtttcagacattctcttgttctattccttttatttgtctattattctggtcttgtgtatattcaatagtgacagcaaacaaatctgaaaaaaaatttatacctactgaactgttgcaacagatggaacgaaaaaaaaaaatttttaatacacaaggtcgtgtggatttgtctcatctttctaacagagaaatctggttagcttaa

SEQ ID NO: 12478 - DNA, 258 bp, Candida albicans
aataaattagtgtattactgtataataatatatgtagaagaaagaagagggaaactaaaatatgctaaacaggtggtaaaaacaaaaataaaaaatgaaaaacataaagaacacaccaatctaaataaaactgtcatcgtcatcatcataatattcgtcctcactcgattcatctgccaattgttcaaaattaaccttgtatctcaatatagcaccaataccaccgaaaccttgtacgaattgggcaccttcagatga

SEQ ID NO: 12479 - DNA, 369 bp, Candida albicans
aaaccctcacaccagagctgtccccaaaagccaaattctacatacatggctaaaaagaaatcacgatcaggtttacttaaagcacctaagacaattacaggaaaacatggtgttcctaaaagtctaaagccacaaagggcgagagaaattatacgtagatttcatgtgctacaaaagagtaaagactctgttctagccaaacttcagaagattattccacaaatttccaaaaatgactaccatcagattgaagaaatgtctatttaccaagattcctttaaagggtttgttttgcctttgaaatattcggagaatccaatctacaaaatagaccatacccttaataagaatgatctcatcacaacattg

SEQ ID NO: 12480 - DNA, 228 bp, Candida albicans
ccctacatagaagggcaattttttactattataattaaaggaatgcaagcaaatgcaatatttcgcaataacatacagaaagagcactttggtgcaccagcaaatggagtattgaggggaacagagaatgaaagaaaagaaagaaattgcaacaatttgtcaatcatacataacactaaaacttatctgatgtcttttttttttcgtagacacttaatgtattgctag

SEQ ID NO: 12481 - DNA, 186 bp, Candida albicans
ctcgtatgtatctgtaaagagtgtcaagaaataaacggggacagaaataaagaaagagaaaaagagaaaaaaccgactgcccaagctgcatgtcttgttgcaattcactactacaatagatactacaaaatcttattgaaacatgatctttttgataagttattgctaatgatacgtattctatga

SEQ ID NO: 12482 - DNA, 192 bp, Candida albicans
aacatgttttcgtctaaaaaatgggtatacgttatcaagtttcccacttcttttttttcttttagtagtataattttgaattctgaagtggctaatgatcgccatgtcctgtctaatatgggtacaactacatgtaaaatgccagaatatactgaaagaaattgtcatttcaacataacagaatgttattaa

SEQ ID NO: 12483 - DNA, 201 bp, Candida albicans
atgatttgcagagagttttggagattgttttacatttttgagaaaagtttgtcaatcagtatggctctttattcacaaagttcctggtatattatttttagcattcatttcgcaacagttttagttgaaaaaaattcatctacaaaaatactcaacagaagtaaaaatatagtcattttaccaaattatcaacccacttga

SEQ ID NO: 12484 - DNA, 306 bp, Candida albicans
aaacattatatgtctacaatgccaccaacttccaaacgtactagaaagagaactagaaccgatgataatgctgaaccaaccattcaagatccttcaccgccacttgctaatgttgaacccacaattcaagagactccaccgctggttgaagttagtgatgagactaattcaactgaaatcaatgagacaaatagtaatactcatgaagaaacaaatgtattaactaatgtgcactcctctccaatcgagacagttactgagaggaacttcaattttcaacaccttcggcagatcgaaaccctctag

SEQ ID NO: 12485 - DNA, 228 bp, Candida albicans
ctaatgtgcactcctctccaatcgagacagttactgagaggaacttcaattttcaacaccttcggcagatcgaaaccctctagtgacgaaaacaaattaattttggcattaaagactaagacattactaatacgagttttcagactccaaggattaactattcaaaatatattgtttaatatcaaattcattaacgatctatactcaatgcaacttatctatagatag

SEQ ID NO: 12486 - DNA, 207 bp, Candida albicans
aagctgtgtaaactttctaggttatgtgtacaatactttaatccattcaaagaaatctttgcatttggttacaattttattgtctctgatatgaatcaacttgtttcttcaagcaactcttctaagaaaacttatggttcaaatctcaaatatagttttcaatgtcttcaaacctttggcttttcgtgtaatgttactccaaattag

SEQ ID NO: 12487 - DNA, 195 bp, Candida albicans
ttggctataaaaatgataatactgaaagaaagaattgaaagaagtattgctgatatttttttctatatatatggtggattcaatttagttttatatagtttgataagatatttctctcccaccgcagataaccgaagatcaaaattgctctctccgcaaaatcaccaattacaaataaacccacacaaatggtaa

SEQ ID NO: 12488 - DNA, 195 bp, Candida albicans
aacagacataacaatatccttgtacttgaacacatatttacaatacaattgattattctatcagttgatacttttgttgaaagaatgatagaaagatttaacacacaaacacacaatgaaaagagagaaatctcactttattgtacgtgtacaagtgatcaaaaactaataaaagtggcgtgcaaattgacctga

SEQ ID NO: 12489 - DNA, 1788 bp, Candida albicans
aataaatattataagaataatgatactactatggatagatcaaatcgtttactttatcctagaactaaaattgattggggtccaggagaaaatcatatatgtttaagaacatcaactaaaaattattatgtgattgaattatttcatcaatcaccaactttagataaattaattccattatttataaatgatattaattcatcaccaaatttatttcaaatttattatcaaattgccgaaaatttaactcaaatagtattaattaataattaccccgtgaataaagttcgaatagttgggaaaatcattaatgaaaaatataaatcaaatgataattataatactaacactaatactagaacgaaatctggtaatggacaaggtattaatgatgtgtttttaacaattgatgatttcgttggatcaagttcaagaataattgttaatttaaaccaatcgaaatttagatctcaaggatgtaaattaaatatgtccaatcgtgggaaaattgttgaaattgaagggatcataaataataaatatatatattataatagatataacaactacaacaattataacaatgatgacttactacaacgagaaatcgatgttgaaaaattaacagtaataagtcataatggtaatgaattccatattgaaatggaaaattggaagaacacattcgaatttcgtaatctgaatttattggaaccatgggtatttattccctcaccacaaagaaataaagattgtcaacaacagcctttaacttatagattcacggaagcagaattacggaaacggaataatcgtcagaacttggttatttcatcgccgtcgccaattaatgaaatacaaccagaagaattagcatttgaagatagtttattagttgatgctgtacgtaaatcaagtgataagacagtagttgattctattgataatgatgattggccacaggaaagcgggtttgaagaattaaaggatgattcagcggtagtgcaacaacaacaacaacagcagcagcagcagcagcagccgaatttaccccagattccacgttcatcactgacatcacgacaagccacccttcttactagcgatacagccatcaatggcacatcactgggtttattcaatcaattagaaaatatatcaaacaagaaagatgtcactctgaagatggatgacgacgacaaccacgatgatgatgatgatattataattttagcggtgaatgataatcctgttaaagtagtgacagaatttcaagtaactttggaaattataaaattcattatcaataaaaatttcaccaaattcaaacttgtggaaatatatcgtcataattatatttcacaattattaaccaatttaacaacaattcaattgagtactttacaacaaattccaaattttaaaaatttgacttcatttgacgaatataaatcaataattttccatcgtattcgtcgtgttttacaatttgattatgaattaatcaccgttagtcaaacccaactggttaaactgaaaaatttacaaaatttattttatagtttgatacaaatcttacataatttaagtgatactgaaaaacaactgaaccatgaattgaatgtaatggattatatagaattattaagacaagaaaaattaatatttggtgggattaattataaaataattaatggaattattgattacattttgacaatggttttaaaacaagatcgtttatggaaatatgatacaaaaaacatatcatggaaatatataggataa

SEQ ID NO: 12490 - DNA, 318 bp, Candida albicans
ctcggaattaaagtgataatacccccacatttggttacagaaaaagaaaaagccagaacaccgtcagcgccgcagagtgaaagaaaaaaaaaaattcctcctcactttttggtaggaaacatacaaaaacaaacccaaagtggtggtggtggtggcagaaataggaacggttttttgctaaactcgttatgctgtatctctaatgcaaccgtccttccctctaatggtaaacttctctgggttatgaatttttcgaaagaaaaaattattttccttttacatgtgaaagttttccattcaaagtatgaacaacgatga

SEQ ID NO: 12491 - DNA, 471 bp, Candida albicans
ctcccaccttcactgggcatttctggcgccaaaccaggcagcagtggtattgaccctgaggtggtattagagaatcaagataacgaagtatatggtgtgatacctaaagtgccactcccttcatttaattcacccacaagattttgtatgaaaacaggatacttgatgatgcaagttaatcagccgtcagaagaggagtataaggatgacattaagaaaacttatctagtatacgaaatcaatcttttaagttgctcaaactattggaatttggatgttttgatgaaattgataatgctgcagtacaaacaaatgattgcattgaacgacatactctgtatgaatcctattgttggagaactggacattttgggaactcattctagaaataatgccatagttccgtggcatataaatgctgtagggaaattattggattatttagtgcacatatatgtagataaagattga

SEQ ID NO: 12492 - DNA, 198 bp, Candida albicans
  unsure (97),(98): Identity of nucleotide sequences at the above locations are unknown.
ttctctaataccacctcagggtcaataccactgctgcctggtttggcgccagaaatgcccagtgaaggtgggagctatgaaatcttgaagagaatannaatttgctggtgcaatgaaaaattgttgttgcggaatgccacttcaaattgtttgggggatgttgacaagagcccctccttgaagcaacttggcgaataa

SEQ ID NO: 12493 - DNA, 219 bp, Candida albicans
ttgaaagatcaaagaggtggaattactgtgcgtacgtgtatactcaacacaacaacaacaacacaacaacaacaccacaatcaatcaatcaatcaatcagtgtgcttaattgatcgacaaaaatacacgaccaacaaaaaaaatatagaaaagttaaaagacaccaaccaacaacaacaacaagaaaaattcaatttcaacttgggccactctatttaa

SEQ ID NO: 12494 - DNA, 363 bp, Candida albicans
aagacaccaaccaacaacaacaacaagaaaaattcaatttcaacttgggccactctatttaacatacacttttgttcatttaaaacaactaatcacatatatatatatatatactatccaataatgtttagagatagaactaatttatttttatcatatcgtcgaacaattcctcgtgattcattccccactaggcgaacccgattcagtgatttaaataatgaagaagaaaatgaaggactaatactatcgtcaacaacaggaaatcaatataataggaaaagtaagaataaatcaaatctaaaacaaggagttaatgaccttgacattcttcaaccacggcggctggaaggaccagcgctc

SEQ ID NO: 12495 - DNA, 207 bp, Candida albicans
ggatttaaaaaagaaaagcaagttgaagttttgtggaaaaatatgaaaaaaaaaagacaatttgtcttctcatctgcactcttttttttttttctctttgagatgaggactgaaagtttagttgagaactttttatatgagacttcatataagcgcagatctcactctattaaaaagttctccaagtgctaccacttttgttcataa

SEQ ID NO: 12496 - DNA, 234 bp, Candida albicans
tgtgtctatgtatattattcaagcttattcttcttagaaacaaatcttgctgttaaaaagttgttaccaaatatttttttttcctattttgactgcaaaaatacacaaagtagattggaacattttatagataatatcctctattcattatatttttgggatcttcctttttttttctttacttttatttattttttttttgttttagagggttgcttatccactgaattataa

SEQ ID NO: 12497 - DNA, 186 bp, Candida albicans
ttgagaactttttatatgagacttcatataagcgcagatctcactctattaaaaagttctccaagtgctaccacttttgttcataaaatacaattgttgttgcaaaataaacaacgtcaaatatcatacctaattgagaatggtcttaatgtgtctatgtatattattcaagcttattcttcttag

SEQ ID NO: 12498 - DNA, 210 bp, Candida albicans
aaagggggacctactttaaattgtaatcctgatctaggagcaacttttgatttggaattcaaaagttccaatacagaatcagacttgaaatcaaggttacaagctttattctttgatttttgtttcctatggaaggagaggttagtcatgaacaatagccgcccttataattcagtggataagcaaccctctaaaacaaaaaaaaaataa

SEQ ID NO: 12499 - DNA, 222 bp, Candida albicans
aagtcatccaaatgtattagaacagagctaggaattaatagcttgagtgcttttgcaacagtagttttaccagaagatgacgcaccaccaagggccactaaaatgacctgtttttcactaccagtagtagtcattttagaaaaaggggggggggggggaggagggaaaactaaaacaaaaagcaatgagatattgaagaaaggtggagttcaacagaattag

SEQ ID NO: 12500 - DNA, 210 bp, Candida albicans
ataaataatggtatacagaccacaccatatacaaaccagacttttcttgctccttacaagggggatgaaacaaagaaaacaagctatttcaatgaaacattcaaaaaaaaaaaaagaaaaagaaacgaaaaaagcacagttataatacaaacctacttacctgtgtttgataccaatctacaagaaagtaaaatagtctttaatgtttag

SEQ ID NO: 12501 - DNA, 228 bp, Candida albicans
ataaaaaaaaaaaaaatagaaaagaaaagaacagcaaagacaagaaagcaaaagcaaaagaacgaaaaaaaatttcacgtctctcttatattacataatcaacttactactattactatttacttaaccctcaaaattttatataatataacattcaagcaacaaaaaaataacaaccaacaaatatattattattattattatagtacaagaactttactgcaatag

SEQ ID NO: 12502 - DNA, 609 bp, Candida albicans
gttgcaatatcatttttcagactggaaggatgtaataataaaattgacaacaaaagatcgatatatgatattttggtaagattattattgcgagtattaattgacgcattgaagaacctagcaaaagttgacttatacgagaaaatacccgaattggaatatcatattaactccatgtttacattattccccgaagtgtttgccaatcaacaagatcaaattatttctttgatgtcagagagaaactctaataatgagaatgcaaaccagcattctaacatgattgagaatggatcaagctctataggttgcagcagcagtagcaccagtagcagcaatacaattatagacagtgattatcaaaaaatggatcttgatgttaaaaattcaacgtcattaccacaatcatttatgaacacacctggtatgttgaatattgataatgggaacatgatgttaatgaatggtaactatgatttattcagtaacataaactttgagaatattatgagtgatgaaacatttaataatatgatattcagtgagcttaatgaattgccagactttttcaattcaccgtctttaggatttaatgagcaaaatatataa

SEQ ID NO: 12503 - DNA, 213 bp, Candida albicans
tgtgaatactaccatttaaaattaggggaaacaatagtgaatctgatatatctatcgatgaaaagaagaagcatgtgtgatttatccagtccaagtttagttccctctggttttagtccattgttttggtatatacaaatttatttaaccctaacaacatttgaaagtgaaagtgaaattgaaattgttaatgacggttctaccttctcttag

SEQ ID NO: 12504 - DNA, 678 bp, Candida albicans
atttctttaagtttttttaaaagtagtaaacaatggaatagttctaatgacagtcaagacaaacaacaaaatagtacaatatgtgtgaacaaaattgttgccattgaattgattgttagattaatgttgagagtagtgatcaaagtttatgaacttcataataatgtggaaatcttggctaataatccagctttacaaaatcatttacaagaagctgaagagaaattccctgatattttccaaaaccatgcggaattcacgtccaaaatgattgcattggttggtgcttcaccatttggtggttgtggtagcaggaacaccagcagctgcaatttacgagataatagtactaatcatggccaaaataacatgaacccctctcctacaatcaccaataatacttataatagcaatattaatacagggtcaaactcaactggagagcctcaagtttgctatgctcagtcaccaagttataatgcttcgttgtcaaatataatcaacaatgaaagcacaggtcgttcaccagcaacattaacatcgataaatcaaccgatgatgaatgaaaattatgatttgttcaatgactatttgattgataattcaactgtaaatttgccatttagtcaatttaataatttacccaatttttactttgacaataatttggggatttaa

SEQ ID NO: 12505 - DNA, 327 bp, Candida albicans
cggcagaaaatgaacatgaagagtcaattgtcaaggatttggatgatgcatccgtcaatgaggcaataccagcagcgcaaccagagactgacgagaaaaccacaccatgaaggagatcatacttccatagaagaagatggggacgaggacgaggaagaggaagaagaggaagagccacttactttaatatatactagattgaataaattactgcttaattttttgttaaggacccagtctccaccagtacatttcatgaaacagtatttatattcgccacacattcaggtattattcatatttgtaaacccaattttgaaacaataa

SEQ ID NO: 12506 - DNA, 189 bp, Candida albicans
gtctacaataattctagaactgttttaagacctagattaggaaaattgatgcataaacaaacaggttgtatcaatcacccttttcttgcttatcaagtacatattgttgcagctaatttgctcagtagttcatgggcccatatttatcaccagcttttacattactcggagatatcaaatactatataa

SEQ ID NO: 12507 - DNA, 183 bp, Candida albicans
ccactagcaataatcaatcaccttgccaaactaatgacagataccaatacctccagagaatcgaatgaaataacggcagaaaatgaacatgaagagtcaattgtcaaggatttggatgatgcatccgtcaatgaggcaataccagcagcgcaaccagagactgacgagaaaaccacaccatga

SEQ ID NO: 12508 - DNA, 285 bp, Candida albicans
acaaactgcttattttgcctggcgtttttctcaactttaagatttctcctaattttgctgattcataacctcaaggtggattgtagaagtcatccacaagaggtgatttcaaacttaagggccgaagcaaatattattgatcataaagtacataagacaactagggtttacatgtctgttatgaaattgttgataattagaacttatgctgactcgacttttggaagctctaattctacagctatttatatgtttaaacttattcttttaaggggtcaaccttga

SEQ ID NO: 12509 - DNA, 840 bp, Candida albicans
accaaagttcagtttttaccaatgtattcacaaagcagaaatttccacaaccacaacacacatttcaatgagtgtatgttttttaatccggaaacgcctcagcaaatttgtccaagagtgtggttaggaccacacaacgcgttgttaaacaatacagataattatggcagtaacttcctagttcagcgtaatatcaagataatcattaattgtggcacgacactaccgttcctcgacttgattgaaaataacagggacgtagcaatatcgtctgatgtgttgattttgagtttggatcctttctttcagagtcacgatgagcttgctgccaactttacgcgcaagtatagtcgaatattagcaaactacttgaactatttttataaaagtaatccaaatgctgccaaattgatacaccaattaccgaactcaactgatcgtatccagatatcatcacctatattgtgtggagcaaacttgatgatgcaatttttcagtttaattaggttgatcaatttatttaagctgattaatcaagagatggaggttttaattatatcacaagatgggaatgataatttgctgacgggccttatgatcgcgtacttgatggatacttatcgctacaatttattgaattcattcaacatgatcaaaagtagaagaccgtcgatttacgattggtcaagtgttgaatatgatgctttgttgaaacagttttatactcagaattgtgaaatcaaatgcactcctttaatggatactatcaaaaggtcatctcaggaagatgacagcgagttaatggctggtggagatagaaagagaagattcttacattag

SEQ ID NO: 12510 - DNA, 279 bp, Candida albicans
atgactgaaatctctcaatatttttttccttgtgccgaattttctgttttgccattcgttttgtatgaagagaaagttgttgcttatcaagaacctgcgcctaagaatccattctatgtcccgtggagacgatttttttctttggtagcaacagacgtcaatggcccaaacaccactgataaaaagataaagccttgcgctacaatacatctctctacaatggaaagttattgtctggctacttattttagctttttcattgaaattgtctcaacataa

SEQ ID NO: 12511 - DNA, 195 bp, Candida albicans
atgatgagtcatctacatgtttacaatgacacggagctgacattattattgaatagttatagagttctaccaattggagaagaagttaggaatcatattgggagtcttcataattttttttttctaatttttctttggttgaacgcaatggagataaatgtagttcacgtgggaatcagtaatagagaagtttaa

SEQ ID NO: 12512 - DNA, 183 bp, Candida albicans
gttatacaaatcaatcaattgggaaacattaaaaggtcatgctttgaaatctacgaaaaatcctttaaagtgataagttatgttctattgatattacacttgcactttacactatacaattattcttgtttaactaatgggatacctgcaagtttcattttaacggccaactctaataaataa

SEQ ID NO: 12513 - DNA, 978 bp, Candida albicans
ccacaacatcattatcattcacaaaccttacatataatgaagttcgttttggtactggcaagatgccgtatatcaattatcccaaaattgacatttcccagaataccatttcacaagaattattcacttactcctgagacatctctcaaccgtagagttggtaaggaaacagtcaaccctagactcaaaaccttggataattttgatcctgagaagcaaccaaatgaaacgtcagcagtttatacaagatttggttggttttatattccaacagagttttatttagatggtaaaattggtgttgaaatacaaaattctttggatgataaaggtgttactttggaaactcccaagtcagaaattcaaaaattgattttggaatggtgtagacaacaaccttatgaaccaaagaagaagataaaacaaagagtgaaaagacgaacacccgatgtgatattgaataaatttttcagcaatggtaaaaatggatctgtggaagaagaaaaacctgaaccactagtaatagaacaaaagcgtaaaccatctgatgaaactttagcccgtagaatagaaagggaaacgtatagagtgacacctagaagtatatttgccagatatgatgaaaatactggtaaatatgaaattaaaggacatgtatctcaaaatgctgcattccaatattatttatcaaaagaatgggataattataaaggtcagtttaaaactaaagtagaaacaagagttgctttaggagaatcatggaagaagaaaactccagaggagaaagaagcattaagattagaatttttggagatgttgcagaatggacaagatttagcttcagggaaaattattccattggaatcaagattaagtacagcagttttcaatgatggatttagacttcgagttcgttctgatcatactaagaatcttatgaaaatcaaacagagttccaatgagtacttaaaaaactag

SEQ ID NO: 12514 - DNA, 1101 bp, Candida albicans
ttcgatgaattaaacatgaatattgaagcagaagatgacgatgatttattgaatgagttagaccatgaattgaaaaatacacaaacaagtaaagttagtttcaaaaagaaatctttcaacaagccacaaaaaatccaacgaaacaaactactgttcaatattgatgatgaagaggaggatgaagagaaggagggacatgatggagagaagaataacatcaatgagctaaaacctgttccaagcaaaggagcatcgttacttcgattcaacccacgaactaaatttacaaaagaaaaatcatcagaaacagaacaaccagttaaaaaaccaatcaatttatcaagatatcaaattgacaccaagaccacaactactaccgataatgctgatcaagaaattataccatttgagttggatgaagaggatcctgaaaataatccagtaatcaccaatatagatgatctcaatgatgaagataatgaagagtttgctaaactaaaatcaaagctaattgccaccaccaccacatcacaaatttttaatcactctgaagtcttaacttctgctaataaagatacaccaaaacgatatgtaccaatagaaaccaatcgtgttccagaatccctgaaattatcaattcgacaatataccaaggctttagtgaacgaatataaagatgacaagaattatgatgatggaacagaacgacaaaaccaagaagatcaagatctacttttgcatgatatcaatgatggcgatatagaattgaatgatgaagatatggggatattaaatattggtaaacgtgctaattttgacgacaataagtttaattttgaaatacatagtgatgatgacgatgaaaaagaagaaagtgatgatagactacatagtgagaatgagagtaatgacaatggtaatatagatttcaggataccaactgttgaagaacaaattatgaaaatcaacggattaattaaacaacttgaagtcacaaaatcagaaaaacagaaacttgttcaaaatcttaagattgaacgagatgaattaaccgaaacaaaactggaactactagagaaattaaataatttggttatttag

SEQ ID NO: 12515 - DNA, 1023 bp, Candida albicans
tccagagcaacccaggaaaaacaaggagtttctttaaaatttaaacaatttattgcctacggaaaggcaattatcaatttctacaaatcgggaatcaaaaatgtgtggcagaatcagagtatattaaagaagctaaagcaagatttttatttgactcacgtcgccccatcaggacaagaaataaaaattaggattccatcctttaaaaaattaacggaagaaatgagtcaaagaatatatatgaataaagtagaatcagaaactttggaaaaaatgactaaaggtgatattaagagatcgaatgatatgaaaactcattctattttcaacttgacaagagagcagtttcaactttacaaacgtactccaaatgactattacaaaataccattatttgcacttgtgtgcttgatatttgaggaactcactcctgttttatgttatatgattccagaaataacgccatctacttgtatattacccaacatccttcctcgggtctggaatccaaacgcaatcggtaagatgaaatcactcaatcaaaacctagacgagaatagtatgattgatttgtctttgaaaacaagctataatttggacattgagcatgttcggttgctatctcaatcattgcgtttagtatctcggtatatacccccacagttttatcctgacggatatttacgtgataaactacaagactactacaattacatagttattgacaatttttatttgtcaggcttgaacggagatggcaacatgtggaatctcaacgaccaagagctagtgttggcttgtttagaaagaaaccttattcaaaatattgtctacgataccaaattgttcaatcaaatatccgatcctatccaaaaacaaatgtttcaggacaagtacatgggtaaactaagagttaaactattccaatatttggtggattttgatagttttaatattggatatcttgctgtgaatcatgccatcccaagggaagaagaagtaaatgtaattgcatggaggtaa

SEQ ID NO: 12516 - DNA, 249 bp, Candida albicans
tacaaacttttggctactaaactacatatgaacaaatcacctagattctacaggttgcctagcaaaaaactggtattcttgaacgaattaagtaagtcaccaagattatcatcaatttggcagtctgttgattcaagatgtatgaatgcaacaaaaaccttacccattattatacagaccaaacaggagattttcaaccaggtagtccagagcaacccaggaaaaacaaggagtttctttaaaatttaa

SEQ ID NO: 12517 - DNA, 333 bp, Candida albicans
aaatccacattgtcattaaaatctgccatcccaaagtttttaacaattggttgcttgggattgtgtactagtgttccgctggttgttgttaatccatatccattgcaactttctacatcaaaagagtcacttataggtgttgcagtcaacgatccaggtaaagcaaaaaccccatctcgaggttgcaagttcaccaatacaggtgtattgttcatcttgttggcgtacgctgataatattttcagcacagttgtcttaccagaatattttgagccaataatcaacacttttggaccactttgttgctggtcaatagaacttgaaaaattgtaa

SEQ ID NO: 12518 - DNA, 192 bp, Candida albicans
aaggaaaacaatataaattgtttatttcatctcaataacaaaacaaaaatgtgggaggaggaacgtaatagttataatagcagcagtaatagtagtagtaatttgttgttgttgttgttgtttttggtcccagatataaattattattttgtatcatcaggattagcaacttgtagtacttttcgagaataa

SEQ ID NO: 12519 - DNA, 231 bp, Candida albicans
aggaggaacttcaaggcggggtatatcaaacgttttctaagacaattttctgcttatattggtttgttttcaataattcgtgttgtcgtcattcagattttaatatatgaacttgtttcaaaactggaaacggaaattttactgcaatatcccttaaatatatatctgactaattggattcaaattataagggggcaaggcatgactttaaaacttaatataatctattag

SEQ ID NO: 12520 - DNA, 183 bp, Candida albicans
agtacgttatactttgaacaagatacacaagagttaaataccgtaaaaacgcaaacttcattcttgactgcaaaagcgcctaaacttgtaaagcccgcccacaaatcttacatacaggtgatattgagtaatcactacaaaccctataatcgtcaacaattcaaaacgaattgcacccaatag

SEQ ID NO: 12521 - DNA, 540 bp, Candida albicans
ggagagggaaactcttcatctagaagagataacaacaacaatgaagtatatgaaggtcccaccgatgaggttgattctgagtatgcaaatgaagaattattagaagaagtcggtgcattagagaactataattttaatgatcttttggaaaataaatctgctaacaagttccttcgttccgagcaaaaaataaagcataaaaatagaccaattcatcaaagaatggataatagttctatgatatcagaatggaatcgtttaggtcaccaacagcaacacatgcctgcagattatccgtatcaatggtctagtaatgttgccaacttggccaaaacaagtaaaatcaatcgtagaagggaaagacttcatcgattacaaggagcaagtattgataataagaaacaatttgaattgggattacatggaagtccagaatcaaaagctaaaagtgcaaacttggtcaaattagctaaatccattggtttaaatgaagtttttgatttaataacattggatgctcaacagaaactatttggatga

SEQ ID NO: 12522 - DNA, 207 bp, Candida albicans
tgtcaatggacatgcatgtataagcccaaggtccaattgttgacagctttgcaagtgttaatatttttgtgtcaattttacggctttgtgttatctccttttttttaccctagtaattatatgaaacatgcccaagttgtaacattcaagaatgttaattggattacacgagcattcaatcaccattcatcaccgttattaaaatag

SEQ ID NO: 12523 - DNA, 213 bp, Candida albicans
gccgccgccgccgctgctgcatctgcaacaggcggtgctaatggaaatttgcaatatgatacaccaggttgtccaccttctggtgtagcgaacgtagttgctgggagtcctgaattttctctgattgcttcacacccttcatatggaggaattgctaattatatgtattatccaaatgaaccggagatgaatataaatgataaaaaagtttaa

SEQ ID NO: 12524 - DNA, 195 bp, Candida albicans
ttagcaattcctccatatgaagggtgtgaagcaatcagagaaaattcaggactcccagcaactacgttcgctacaccagaaggtggacaacctggtgtatcatattgcaaatttccattagcaccgcctgttgcagatgcagcagcggcggcggcggcttacgccgcggcggcagcagcagcagttgcaagataa

SEQ ID NO: 12525 - DNA, 204 bp, Candida albicans
tttagacgctggtccgttaatctacctaatagtcatatttcaagtgatattcataaatctataatggaagtgtattttagagtaatgtgtttggcagaattagtcacacttggtattggtgtcatagtcgttacttggtttgttgtgtcagttgttgcaaattattgtctttctgaaaattggtttagttatagtaagagttga

SEQ ID NO: 12526 - DNA, 267 bp, Candida albicans
caattattgtacgtagatctgcttaaagtcattacaattgaatctagagcacatgctggatatcaaagaagtataaatgaacaacttaatagacaaactagctcaatttctagacatgtaaattctacgagcaccacctttgattcccatacaaaaacggccttttttgttgtagcatctccaatcattcgcctacctcaatcaccatctgtgcgtataataaacatttgtcttggcttcaaaacggtattagtttggtctttgtaa

SEQ ID NO: 12527 - DNA, 1179 bp, Candida albicans
agtttccccaagaatcaaagcagtcggaaaccagatttgtttttggatactagtagcacaataagcgaagacaattcttcgtttcggaaagtaataactggccatctgttaaatgagatgaatacaccaagaaagagctcaatgagctcacccatgagtgccacatttcatagtttgtttcatcgatcccatcataatggcagcaactttcaacgagacaccaaccaggttgcgactggcacgacacctttgtcgggtaagtttgatgacttctcaaaaccatccaagacaactttatgtctttcctcaaatagctcgaattcaataatcagcaatcctgaactagctcagatatataatttcgccaacccaaatatttcaattgaagatggagaaaccaatttggatcattcaaacagttcctttttggatattcataagaaaatgcttgtgccagcagatctgtttattcagaataagttaaacaagtactaccaaaccgaagtaggattggacatatacgaaagtgaattagatcgtgacaaagataataagatatattccaacctttatcattacttgaaaccactatttaccccatctttttcaatatccgactctggtcaacagggtaggatgcgtccaatattgggtgctagtgttgaagaaattgcaaattttgtaaaggagagtttttatttacaccagcacaaccacgataaaagttttagactgaaaacaagatccagtgtatcaagcttgggtcgtgataaggtagaggattttgattaccttcagttatcgaatttgtttgaaaaattgatgtccttattgagtcataacttgcaaactactgaaccatcggaagtatctttacaagctttgatattgaacgcatggaaatattataatacttatgttaggttttatttgctaagtatatttcaaccattgcaaatctacttaaacgagctatttacgagaaatcataatggaagcaaaattatcagaatagacgaccttctacttgtttcttttcgaaaagtttttattactgaacaggggattggaagtggagatagagagacgtctcaatttttggggaatgctgaaagtgaagatcttacaggaaatgggctgttgacttctactttggctgtgttgtcgagtatatcatag

SEQ ID NO: 12528 - DNA, 195 bp, Candida albicans
tgtttgcatccgagagttttgatttattcagtgttgttttcattggttgagggcaaaaaattcgcatcgagcagaaaaggtcgtgcccggggcatagtggatagacaacgattactggtgaaccacatgtgctacaaagaccaaactagggccgttttgaagctacaattatgtagagtattgggtgtgaattag

SEQ ID NO: 12529 - DNA, 186 bp, Candida albicans
tcatctaacatttcagttcatccctcttcaagcgatgatgatagctcaccaaagacacttcgagaatttacatctccatctgaatcaagcaagagtgttagtggcaatgggttgagaattgccaaaaagttgaagtttccccaagaatcaaagcagtcggaaaccagatttgtttttggatactag

SEQ ID NO: 12530 - DNA, 225 bp, Candida albicans
  unsure (106),(108),(109),(110),(144),(159),(164),(177): Identity of nucleotide sequences at the above locations are unknown.
gaatctttggttaaactagcagtagccaaaccacgaactgaacgtggggctctcaaggcggttcttgaagcagacaacattgtgtttgaatgtttaagaaactatntnnnagaaaagaaaagaatagaaaatgataggataaantttagtttgaagatnagatnaaacttcgatacnattggctgggggtgggaggttttgaacaatttcaatttttttttataa

SEQ ID NO: 12531 - DNA, 270 bp, Candida albicans
  unsure (232): Identity of nucleotide sequences at the above locations are unknown.
aaggaaaaaaaaaggataaacccaaacattgtatattactcattctgtaaaactttgaatagagattcaaacattgataaaactaaaatgctcaagattatggaattttatatattgctgagaaacgttattacgtactttttatctcccgtgcctgagaaaaaatgtattcatgagtggatgtgtattaaaccatggaatgaggttcatgatttctacttgaaggatgtgntaccatttccgattacgaaaaccctaaagaacgcataa

SEQ ID NO: 12532 - DNA, 210 bp, Candida albicans
attagagtgagaaatatttctgaattcctccttttggtagaacttgttgtttcaacagaatttgcatataagaattgtgtgcaatggaaactattaattggaaaagagaagtcattgttgaacatgtcattgaataaatcattacctacctatcaacctataaaatcaaaaaataaccgtcatagctactttgccatccaatcccaataa

SEQ ID NO: 12533 - DNA, 381 bp, Candida albicans
gagagtactttccgtaatccagtttcacaatttagcatacttcttaccctatatactcaatttgaactattatttatacaagagctcacacaaccgatagcgaaaccaatacatccagttttctctcagttagtacagcaaaaaggtatgagaaagcgtgttatatctaccatgtttcacgatatttgcaggccctcgcttccacgaaagcgcctagctagctcaatcggcttagagcgtgagacttttattacaagagtgatctcaaggttgcgggttcgagtcccgcgttgggctttcttttttacttctttaagacaattatgggttttttttgcacggtgttctttttatttcatcactagaccaagatcgttttga

SEQ ID NO: 12534 - DNA, 240 bp, Candida albicans
aatgtttctatccttgtattagcatataagtgtatacatcatttcatatttgtcaatgaagctcggttatacttttttttttgtttgcaaaagagaggaaattttttttttttgtggagcaaagtggtgatgacgcccgcaaattattataaatttactagacttaattggctaaaatctcaattaggcaggacttgtccattttatggatccgatttttttggtgattttttcaactaa

SEQ ID NO: 12535 - DNA, 267 bp, Candida albicans
attgtcaatgataatgaagagttcaccaacaatcctaaagcatataaaagttttcgtttaagcatagttttttgtgggtatcaatattggtatggtttcttgactagctttatggaaacagatgattttgctgggtttatatatgatggaggagctataagttatggtattagtcatgaaataatctttttgcagcttaatttcgtatctcccttattttccttgatccatgaccattgcatgtggcttgaaaagaagtttccatag

SEQ ID NO: 12536 - DNA, 1743 bp, Candida albicans
tacccacaaaaaactatgcttaaacgaaaacttttatatgctttaggattgttggtgaactcttcattatcattgacaattcattctacttcttcaagctcaattgcttctccgtctgttgctcatccactagatgataacacctatttttatcctcgtccaaccccaatttcaaattgtgaattaactttttcaactgatgaatatactactactgtgactttttccgatggttgtccaactggatcggttgcaccaccaccaaatttcccaccaacggttccatatggttgtacttattttgcctccaaaacttattgtccttacaattgtgacacatctacagttcattattatgattacatttattcagtgactagttgtccagaacaactgtgtatttttgacaagtctggtggaagaccatcttttaaatgtgaacctacaaccctgagtgaaccatggagttcgtatattttatctgatgtatcatctgaggtatcagtaacctccattgttgatagtgtatcccaggataatagtacttggcacgataataattctaatcaaaatgctgaagtaactgaatcaaataatgatgacacaacagagcatcatccagaaccaactcatccaatgacaacacaaatgccagttacttgtgaagttactcaaacacattcccatggccattcatggaacgatgtttcatgtaattatttgccaattgaatgtaccaaaacaacaacattcaatgtccataaccaaactttaacatacatttggtgttcttcaacaacaattgaattattcccatctggagaaactacaactacattctgtccttatgatacttgttatgactacctacaccacactgaaaataatagaaatactagagttgaccaaggtgggcttgagggtaatacgggtactggtaccactgtcgctcctgctgctcctgcttctactacaaatgctggtaccgccatcattacgaaagttgctacctttattgataccaattgtgatgaaactaaaactttgaatgataaagctgagggaggacatggtcatgccggcagtactgctaatggtgatcagaaaacgatagccacggaaaacattccaatttataaaactatagatggtactaatactgattgtattataatcaccacctgtcctactcctgtcacattgacagtgactcaagaaattacgaaaacagaaacagtgactgcttacaatacaattactattaatgatgatggagatatttgtattgttaccacaactacaaatgaggcaaaaacaactgaaccttcgtatgaaaatcaagttacaattacaacacatgctgttgaagatggattcaatcaagagtattcttctaaaccaaatcaacctaatactacgagtgagcacggtactgaaaaggccactaccacggaaacacctgaatcttcgaatcagaagcctgatgacaaatcagaaacttcaaatgatgagcctgttgatgaatctgtcgacaaaccaggttatgaagtcactgacaagccaaaggacgaaccaatttataaaccaactggtaaaccagataaggagtcagtcgacaaaccaactgataaacctactcattcatttgagcctataacttccacaattggaaattattcaattgattatagtagtacaatgtggagaaactcgtcaactttagcaactacagtagtaaagtaa

SEQ ID NO: 12537 - DNA, 462 bp, Candida albicans
  unsure (361),(423),(424),(430): Identity of nucleotide sequences at the above locations are unknown.
acaaaagacaatacagcaaaaggatttcaacgcgtactttctgattccattatctacgatactaccatgagtggcgatcttcataacgatcttcatcagatagaattaacggcacatgctttactaagcgggtcactagacaatctcaatgagaattttgaactgttgaatcaatcacaactcattttattaacaagattgaaaattatagaggagagattaagtaatttcaaatccataataaatgataataccatcaatgaaaaggaattggaagaacaatttaacaaaattaagcaactacggaaacgattggatagatgtttgaaaatgactgaaagtatagagatgagagtcgacnagctagagaatcaagaataccggattcatgcttcttttttttttcatttatatgtgtatatnntggttnataaagggagcgtggctcttacagtgttataa

SEQ ID NO: 12538 - DNA, 270 bp, Candida albicans
ataacaatggtaattattaaaagaaatagtgtgatttggaatttgaaagttgaatgtctttggttgaaattaaagttgaatgtcaactccgttacaatcaatgaaaaagcgattgagttaaatttagcatgtgaagtttttttcttctttctccattgcttcaatccaactttaaacgagggacacaacaataaagatagacaaaagacaatacagcaaaaggatttcaacgcgtactttctgattccattatctacgatactaccatga

SEQ ID NO: 12539 - DNA, 222 bp, Candida albicans
cgatcctgcatatttcgtcataattcacacattcttaaaattatgcacacatccttgaaatgtgttaatattcccaacattatcaattatatgtgttcagaattggttgcaaagttatcaactcaattcacgctatataaaccttacaatttctctacatttttatatttttttatattggcttttcttttagaatcaatcaatactttttttatcatttag

SEQ ID NO: 12540 - DNA, 417 bp, Candida albicans
aatcaatcaatactttttttatcatttagatacatctttcatctattaatagattatctttctatatatcaaaacacgacacagtcacgtgccaaaaaggatataagaaggaacttcactgaaatgcaatcacttcgcattattcaagatctttttctattgtggctggtttttggtgattgctatgtttggttttttttttctggaacacaagcaaccaaatttttcaactgttacgtcacacatttactgtcacactcacttactggcacacaaagaacaaagcaatcatccggcgtaaacttttggtctttgagatgcaaaagttgcaaagcaattggcacttctactaagatggttccagtaaaaattgtgttttatagtacatcaataatcaaacaatacttaatgatgtaa

SEQ ID NO: 12541 - DNA, 759 bp, Candida albicans
aaggaagtatttctaatccaaagaaaacaaatttataaatatcataatcatagccatagtcatggtcgacatcatcgcatggattcacaaggttatgaaaaaaggaaaatgaatcatcaaagtacaatgtcaacttcaactactataagttcagcagcaatgaatcaacaacaacaaaaacaaaaacaaaaacaaaaacaacaaccccaaaaatcagtatattctgattcaatattaaaattgaatatctttatccaagattcaaacaacaccaccaataacagttctggttcatcgtcatcatcatcttcctcttcttcttcctcttcattattacaatcaatgatatcaattaaattacggaaagataaattgaaaaatcttgatgaattaattaatttaataatttataaattaatgaaaaaattaaatcgtcatgatgatgatttaatcattgataatatcaaattattaatcttcttcaaaaacaacaacaacaacaataataacaataataataataataataataatagtaccagtgatactaattatggtggtggtggtggtggggatgatgataaacatgttttaataaatccaataattttaaaagataaaattgatcaatcaataacaaagaaaaagaataaacatcagaattcttcttcttcattgccgattaataattataaagatgatttattattggaatatattcaaatgaaactgaaattatatattaaagctataatttga

SEQ ID NO: 12542 - DNA, 204 bp, Candida albicans
cacatgtggagaatcatcatgtcaggtgtgtttttgagttgctataagttattaatagaaacttgctgcaacgtgtgtattttgaatttataccttatttttttttactcatcgtgcataggtaacaaactgcaaaatgtaacgttgcgcccaaacgttacaaaaaatgatgcaaaaaaaaaaaaactgacatctactaaataa

SEQ ID NO: 12543 - DNA, 243 bp, Candida albicans
attattaaattaattaattcatcaagatttttcaatttatctttccgtaatttaattgatatcattgattgtaataatgaagaggaagaagaagaggaagatgatgatgacgatgaaccagaactgttattggtggtgttgtttgaatcttggataaagatattcaattttaatattgaatcagaatatactgatttttggggttgttgtttttgtttttgtttttgtttttgttgttgttga

SEQ ID NO: 12544 - DNA, 195 bp, Candida albicans
tcattttcattatctgcattaccaattgtcatgataaaaccaaaaaccaaatatgcaactaatcaattctccctaagatttagttttagttttagttttggttttggttttagttttagttcttttatgaaaatcacaagtttagttgaatttcttttttttttattttacatttcaagttttaactatatttag

SEQ ID NO: 12545 - DNA, 573 bp, Candida albicans
tccatcaatcaatcaattaattcattaattacaactactatcacaatgtacaaattcactgtttttattgctgcttttttcagtttatttttccaatcagtcattgctgctccaattcaacaaggattccgtggtaatgtgactttatacattaaatccgatagtgaagaagtcaatggtaagaccctttatactcttactaaagacgttggtttcaatgaaatttacattggtgattacgttactccaggtgctactttctacatagaaccaaacttaatttaccaaagatatgatgatgagaaatcacgtacttcttatgctttgacatatagtgaagatggtaaaattggtgttgctgctggttctgatggtatttacatttctgattttgatcaaaagagtggtgaaatcaaattttctggttatgattacttatatgctgttcatgttgttgataaaccagcttattctgctagtcaatatgctatccaagttggtaatccaaatctgccaccaaagaactcctacaaagttagtatctacggtcgtctcaattgggctgtcttgtaa

SEQ ID NO: 12546 - DNA, 267 bp, Candida albicans
tattacagaatcatgggtttattgactatgggtaaaaccatcgatgaagcggcttatttgttcatgttgatggaaaaaacatgtcatgcacaattattggctgatgctgctgagtcaaaagataaaccaaaacaatatattgctgatagtgaagctgaatatactgctcgtatcactagtaatcctgctattttatatactgttttccaatcagattacaagttggaagaaagattatctaatggtgatttcaaatttgcaggttag

SEQ ID NO: 12547 - DNA, 183 bp, Candida albicans
gtgagtttaatgaagcgttacgacaatttggtacgaccatcgccacgtatcagcaaaacctccagtgggttaacactttcatggaaagggatcctaattggctataaaatattagaagtgtatataaagggaagaaatatcaaaacacaatctaatcaaacaagtgtatatgattgtatataa

SEQ ID NO: 12548 - DNA, 207 bp, Candida albicans
gcagatgtgaatacgccagattctttagaagatgacaacgatgatccaatagatgaagaatcaaattctttaatcaatttactagcttcgtcaatgtttaaaccgtaccaaaacaagatttggccattcttggcaaatgaaccatctgatttggagaaataccaaggtaagttggcatcgttttcattaacaacccaacataattga

SEQ ID NO: 12549 - DNA, 186 bp, Candida albicans
aaaaaaatttcatttattatcgcaataattaaattgaatataaatttgatcaaaaagagtaattatttttggaaaaaattttctttaccgcgatgtaagatcagtgtgcacgtgacctcaccaatttgcgtcctctttttttttttatcaaagcaaaagcaatatgaattagtactaatggtttaa

SEQ ID NO: 12550 - DNA, 264 bp, Candida albicans
ttcagactacatcaccctagaaatctgtcgaatagtattatgtatccagatcgtcgccgtggcagtagagttgccgaaaaagtatatgatgaaacattggctctcagtgactattttcttgttgccggtcatgacatgtgggtggttgattgttgggctctttatctggtgtctcatcccccatttcacattcaacgatggattgctagtcagtgcatgtgtcacagccaccgacccggtcttggctgctgctgtcgtcggtaa

SEQ ID NO: 12551 - DNA, 279 bp, Candida albicans
gacgttctatcgaatattcagggcggtgagactaagctccaagtgcaagcttatcaaagacgcgcatgggtgtttttctatccagttgttgtgcaagaaactaccgttgagtgggtactcggggacactagtcaccatcaacatgatggagctcaaccacgacgagtttatgattgggtggatagaggagcaagagaagccggtgttgtttacgtcgttcaagaaggtagaggtacagtcgagcgtagtcgacaagcgcaatgtaaacggggcagttga

SEQ ID NO: 12552 - DNA, 204 bp, Candida albicans
ccggctacagcaaggaggtaccacggtaaacaactgctttggttggctgtaaaaaagctgttcaagaagttagacaaacgtggtaaactgaatagtcgtgtaggtttgagaataagacgtggcaaattttatttgacgaggaaaaacactataaaaacaactttacaaaataatttgagaaaaaattgctttagagaagaataa

SEQ ID NO: 12553 - DNA, 813 bp, Candida albicans
tatcggaaaacgacaaatttaggggaagaacatggaatgatcaacaatttggtcaaagttttcaacaaatatgaattatcgccaacacaaagagaggtggttattgatttgattttcatgattaatatacatgattcctatcatgattttattaaagtgttaactctcgattactttgacagtgaaaacaagaagtacttgcatgtcttgagaaacacaattggaccaacaacacgaattttacaatttgatgacgaagagttgatatcaatgctttccacatatttagtaatccatggtagtgaacaatttactcaatctgactttttattcatcggatcagtattggagaatattcattgtcgacttaaattaaaagacgatgatgacgaagaagaagaagaagagtttgatgcgaaagattatgaagatgattctaagttaaatctgaactccgcctcaaacacgactacagtgtatattaatgacaagatatctgattctttggacaaattatattcccctgtgttcattcaggggactattgatctattaaaaaatgaatcatcggaattaaaaaaccttgcattgaaaatattaccagcattgataaacttgtacccggcactcaaggggaaaatatgtatgttattatctattgtgcccaactgttataaatggtttttcgaaaccattaaagaacatgaattgtttcaactatttattaattgcaacaaggattatgtaaagactcaggaattggaaaacattgataaattcttcacgacgggctggaacatcaacgcttgcgta

SEQ ID NO: 12554 - DNA, 195 bp, Candida albicans
ctttgtaagatttattgtcaatttgtgcttttagatcatgctggttgtcccatgatagttgtaaggggtataattgtcgttacacgtactctatacgggattttttttaatcggaaattgagtcaaggtatcaagtcaattaatacacaagatttattgctttcgcttatgaagtttgaacagatctggacttaa

SEQ ID NO: 12555 - DNA, 270 bp, Candida albicans
cttgagatgtttcgactgatttcaagaataacacggtcttgtcaatcatatcctcgacaaacacatttccgacttttccatagtccgacacgattaaagtttaatcaaattgttgataattttctacaggatttaaagcaagatgaacaagagaattcaggtggaaataaaaacaatggtaaaaaatcaggttcaggaaaagatagcaatgatcgatttgaacaattcaaaacttgtcttcacccacggcggctggaaagtcaacgtcaa

SEQ ID NO: 12556 - DNA, 1374 bp, Candida albicans
ttaacctggatccatcaaatagtggtgttttgtttttgtttttttattgtgggtttcctttctatctgttattcaaaaatcatgaaagtatcaacattaataattgtttctattccaattgttctgggattacaaattaaagataccgtgggtacaactacagaaaatacattttggtatcaattatttggaactccttcaagatcccaaccagcagcagtagccgccacagcagcaggtacagaagtacaaggatttacaccgatttctacgtcttcttcttcttcttcttcttctgcggctccttggtatcaaggattatttggggttggccgtactacattaggtcaagtcacaactccatcaagaacatcaacaacaacaacaacctcaaatccaattgctcctactacttcaatagctaatagcaacaatttatttggaaccgatacagccccaacaaccacaaccacaactaatgctagatctagatctagatctacaccagtaacagtttcgggagataatgttttaactttatttggtaatccaaatttatcaactggaaatgatcaatctaattctgtttctaagacaacagcagaaaccaccaccacttcactggcaccttcttcttcttctagagtacaaccaactgttattaacggtggtggtagtgatggagtattgacattatttggaaattcagaagcattatccaattttgattcgacaactgtggttgattccgatagtactgcaagaataaccccaattgcaagtgcaagtgccagttctggatcaagtactaaggataatgatagtgatagttctagtgctcgtggcattaaatctattcctaattcatctgaatttcttgcatcattgatcaatggtttaggcagtggtggtggtggtaatggtagtggttcaaatactaattcttataagaatcattcaacaacttctacaacatcaaaatattttaattccagtagtactgctaccaaattatcgtcaagtaaatcaatttattcaaattcaaccacttcaagaagttctttatctgtgtctagtagtagtactgatggtggtggaggagctaatttatttggactgcttttgaattcagttgctgctgtttcaagaaccttagctgctgaatctacattaagtacaggtacaaccacaacttcagacagtgccaattctaatacaaaggattattcaagttattctggtactattacatcatttccttcaactacggggagtttaagtggtgatgggaataaattaattggtggtaataaatatttgattagttttatgtggacaaatttgattttaaccatgattatgcttttcacataa

SEQ ID NO: 12557 - DNA, 282 bp, Candida albicans
  unsure (87),(230),(235): Identity of nucleotide sequences at the above locations are unknown.
cgagagatatgcgtatacgtatggtattcggctggtgatagcgatgctatatcgaatgagatatggcaatccgggttggatataaangttgagaaacgaatattgcgttcaaacaccgcggagttgggtatggatatattccagtgtggcgaagaagtgcgtgaaaaaaagggggaaagggaaagggaaaatttgggggagggaaaggaagggggacgagagaagccccnctatntaaataaaagaattcttttactatgcggagggaggagagccttttaa

SEQ ID NO: 12558 - DNA, 195 bp, Candida albicans
ttaattaggagtagaaaagcccgcgttaaaaaaaaaaaaatactactaattaataggaagatgaaacttaacaagtgttacacatggtttcccctcactatattttatataaccaccattgacttactttactcaaagattactttaattattaatttgaattttgtgattaaattttatttacttggcggttaa

SEQ ID NO: 12559 - DNA, 264 bp, Candida albicans
tttgcttacataaggaaaaaaaaagggcaagttaaccaaaataagattttagatcgatgggatggatcgatccaccgacggacccgatgggactcttcttttaagggaggggagggggaggggcacgataaaacttttatcagaagacattttgaagaacagagtgcacgtgacctatatcaacttttcaaaataatattgtataattttcctctattaacaatgtacatacaaacaatctatacaacctgtataatcttctag

SEQ ID NO: 12560 - DNA, 2094 bp, Candida albicans
tattgttttgttgttttttttgttaacattcatatttgcattcaaatttggttttacaaccactcaaactcaaaactcaatccatattctcagcataaacacagaagtatacataaagttacacaagaaatgttggcttggctaagacatcgtattacatcttataatacttccacttattcatcaattttaccttcagccctgtttggaaaagtgtacaaaataggcacaaagttaaactttacactacttgccctttgcttacttttggcatgttcggttttctttaattatttttacttggccgataataatggtcttgatattgatactaaaggagaagaagaagaaaatgttttcaaagatagaaaaatggttattttccctaataattttgaaattactgataaaaacttgcttgaatattatctcaaaactctagaagaaccattacatccacaagatacaatttatagaaaccgattcatttataaagtacctgatgtttcttatacaagtcaaacaataaatttatttagtggtctttcccaaaatagtcaatcttctaaatgtgaagacttatcttcaagttatagttttgacgttagtggtcctcaaaataaaaattgtgatttatataaagtattagggaaatttttaaatgataatagtgaatatttccaagaaatttcaccacttttccccaaattaaaagagatgcttgttaaaaaggagattgaaaaacattggtttcaattaattggatcatcagtatggttagaacaatacggtgttcatttaatgacatcaagaattttctattcaagcacgggtgataaagtgaaaccagtggtttcattaacttatgtccaagtatttgatcatgaatggcgtgagattgaaaatgtcgaattgatagttcctgatggtgaaggtaaatataaaccaatgacatatcctacgtttttaccaatgtcagtttatcataatgaaaagcaacaacaaggtagattctatggagtagaagatccaagaataacattagtgagaaataaattagggtatgatgaacccatcattgtatataattcccatcatcggaaaataactgatgccaaatctgataatgatggtgaaagtaatattcatttcaaagcctatcgatcaatctttatggcatggttatggcaaaatcaaaaggggaaaaacaatgttgaagaaattgaaactggtaaaatgaaaaatcgggtttatgtcaagagtaaagaattaataaaacctaataataaaagagaagataaagaaaaaaattgggctccatttattaattatcaacaaagattacaacaaggatttgattctcatgtttatttcatgtatcaattccaggatttaaaaattttaaaatgttcacttttggatgaagaagattgtgtttgggaatatcaatttaatgataaaaatggtgctggtagattacgtggtggtactgaattagtcaatataaatcaattattaaccacttttgatcatccagagattaaacgagtgaaagatttaatgccgcaaaatcgagaaatttggattggggtcgctagagcagcattagagaaatgtggctgtggtgataaaatgtatcgtccaaacattgtcattttaatcaaagatggtgatgatcaatatagattatctcatgtttctccatttgttggattaggaattcttattttaccatggtggcctgataaagggttatgtgatggtaagaatttaattatccctaatggtatttcatcatggcatttgaataaagatgaagataattccgttcaagattatttgacccttagtatatctagagcagattcaactgttgatcttcttcatatcaaaggattattaaagtcaatactatttgatgatccaaacctgaaattattacaattgaatgattatgggtttaataataagaatattgaatgtgctgtgaaatcttcagatgcattttgtaaaaaatatggaagtgagtataaactcaataataacaaagaggaagataaagcaaatggaaatggaaaagggtcttcgagttag

SEQ ID NO: 12561 - DNA, 198 bp, Candida albicans
  unsure (133): Identity of nucleotide sequences at the above locations are unknown.
aaaaccagattaaactatcgaaagataattctcttagtttatattccttccaaatccggaaaattaattaaaccccaattgaaaattttaaaaattaagcatccccctaaaaagaatgaaatgtatccccccnattctcccctgtattttattatactccatttccccccctctacccattccggaatccctttttga

SEQ ID NO: 12562 - DNA, 204 bp, Candida albicans
aggaccttgacccatgattgcttgcttggagtatgggatatacaaataatgtttgatttggaaaactcgccaccaagaaataagaagttcgcagagaaaaaaaaaaattcccaaaaggaggtgtgtgttgctcaaaaagctgatgctgttgctaccaaacgttacacccccaactttagaggtcctggctgtagaagcaaatag

SEQ ID NO: 12563 - DNA, 240 bp, Candida albicans
atactgtcaactacaagtataaacaccacaacctctttagtattttttcaaggaatagcactttggtggttgtcaatttgttacaaacctacttattttacagtgttcaagtttaatttaatccaaattgtttccaattatattattataggcctctcaatttttttatacaaatcaaattttaataattataatgatagaagttttattaatgtattatttaatacgtcaatcatttaa

SEQ ID NO: 12564 - DNA, 234 bp, Candida albicans
ggtgccgacctattctcaattgaggaactatttgtgacaacgccaccatctaaaaagtacaagttgaaaaaaaacttgaattgttcatacaatattattggaataaatgttatgggattgtatttggcatttgaaattgagttacttgggtacatattgtttgcctttaagtttgttgttttggcagatatgtatcgttcgtctgccatattggaatggtccgtgtttctatag

SEQ ID NO: 12565 - DNA, 222 bp, Candida albicans
gtgaaaagttttcatcgaaacaattcatataaattgaagatgacattccttcaatattcattaaagtcttgtttggttttcctttcttcttctcaagcatactttgatcttttgattaactactcccaaccaaaacaatataagttgaataaatactttcctgctattgcattgtcattgtcacaagttcattcaagacatttcttacattttcaaatttaa

SEQ ID NO: 12566 - DNA, 306 bp, Candida albicans
tcaaaagatcaaagtatgcttgagaagaagaaaggaaaaccaaacaagactttaatgaatattgaaggaatgtcatcttcaatttatatgaattgtttcgatgaaaacttttcacttagggttcttttgtttaattttcgcagtcatttagtcttatcgttatcaataattaaaaacatctcaagattgtttctccaaatattgataatcttcgcttgtttgattttttattgtatgatttttgaaatttttattattaaacatcgaaatagtactaatttaagtctggttgcattgttgctgtag

SEQ ID NO: 12567 - DNA, 345 bp, Candida albicans
tcctgtggttcaaacatgatagctaactcaaccaatatatccaatcgtatgttcagatctcaaaggataatcatattgagtatcttagctgcattccttgtgttacttggaattacatcattatccggtcaccatcaagttgtggttaactcagttaagtccatgtctaataaggccagcgattcaatttcggaattttacaataaagttgattcctcgttatcgagtgatgagaaagaattaatagaagagggaaaagctgatgcggaaaaattggctgaacttgctgatgaaaaactgaaggaaattaaagaggaagagaatagtaatccacaacagaaataa

SEQ ID NO: 12568 - DNA, 183 bp, Candida albicans
ttaacaaagagaattaccaagaagcaaactaccttctattgtttatctttaattttgcgctatttatgtatttcatgcatgtatggggtcataattcactattcagtgaaattaattattgctatttttttttttgattcgaaggatcacgatccgaattcaaccgtggtgacccataagtga

SEQ ID NO: 12569 - DNA, 186 bp, Candida albicans
tgccataataaaaaccagttcaaattattacaagttttagcacatgaaattagttcattgaattttataaaacttgcagcactaaaaaactgtcataaattctctttacaaaccaaaggctggatttgttcgaggacctttgtgcaaatgataaataactatatttggtttatcaggtttgattaa

SEQ ID NO: 12570 - DNA, 264 bp, Candida albicans
aataaatctgcaaatgcatctttttttggaggaaccatagtccatagaaatgacaacaaactttctatctatcttgttttgaaaaccgaaaaagattcaaaaaaaaaggaaaaaaaagacaccagcaaatataaaactgaaaatgtgcacgcaaatgtcccgcgtagaccaggagatctctctctttctgttttttttttttctattttcccagttgaggaggttgtacatgcttttctttccagatcttgcgataaggtataa

SEQ ID NO: 12571 - DNA, 228 bp, Candida albicans
gctttcttaaaggaatattatactttttcagtcgagtttggtaagcaaatatcgttttcacaacgaatcgcgcacggttcaagtcaagcaagaaaaaaaaataaacaaaataaaatggagagctttaaaaccacaataaccacaaccttatccttttacattgaaatagtgctgatacaatggaaaatcctcacgaacagacgcataacgcgtgattgtcaagaataa

SEQ ID NO: 12572 - DNA, 189 bp, Candida albicans
aagagaaatagagaaaaccagagcaccactgttttcgagttacaaaacactatcatgcatgcctattcatatcgtgtattactatatattctcttcctgtttaaatgcctcccagcgcttattcaaagtgataaagactccattacatatcaaccccagttccctattgtccttggtttgggatgctaa

SEQ ID NO: 12573 - DNA, 339 bp, Candida albicans
gccgtcgcgacaatcaatcagaatattaaaccctggctgtggcttgggtcgattggttatggagttggtgataagaggattttggacacaaggaaacgagatcagctaccacatgctattggcatcaaattttatattgaatcacagccagtttcctcacagccattcgatatttccgtttttatcgagatcgtcgcatttggtaaagcgaaagtatcaaacaaggggcatcacaatccccgatgtggcaccgtttgcggtcctctcagaattgaaggagaaaactcccagtattgcatacgaagaattgatgtcaataactgccggctcgtttcttga

SEQ ID NO: 12574 - DNA, 264 bp, Candida albicans
agcttcatattcatcggcattttggctcatttgcgtctcgaatgttttcctgtgctaagtaaatcaaattataccttatcgcaagatctggaaagaaaagcatgtacaacctcctcaactgggaaaatagaaaaaaaaaaaacagaaagagagagatctcctggtctacgcgggacatttgcgtgcacattttcagttttatatttgctggtgtcttttttttcctttttttttgaatctttttcggttttcaaaacaagatag

SEQ ID NO: 12575 - DNA, 198 bp, Candida albicans
attgccaatctgaattatttgttgaaattggactaccgagagaaatacttcgagcactgtttggttattttaagagaacgtacacttgacaacactctgatcagacacccaatctcacaagtctttgcgaatttacttatacttcatgaatacaaaaacactttaaattataaaataacctcaccagctccaaaatga

SEQ ID NO: 12576 - DNA, 204 bp, Candida albicans
gctttcagagtcaatttgcaaataattgaacctgtatattatactataaagagtcaccaccaccacaagaaaaatttttcttttttccttcccatctctttagaaagcaagaaaaaaataagagagagtaatttttacaccaccaaccaaccaaaccaaattaatacattgcaaaaaataatacaagaactaattgcgtactga

SEQ ID NO: 12577 - DNA, 183 bp, Candida albicans
cataaagggggagatatgccgaccaactaccactttgccgaacaaccacgtaacaaaaatactcacgttcaagttccagaacaatttccatttggtcatattgagaagcaatggctcaattcaattgtacaccaaaactgcaaactcaaaatactacactttattcaaggattggaagaataa

SEQ ID NO: 12578 - DNA, 1497 bp, Candida albicans
caatttttagttgtcaaattatcgaaaaggtctagcgagacattggacattgacataaagggggagatatgccgaccaactaccactttgccgaacaaccacgtaacaaaaatactcacgttcaagttccagaacaatttccatttggtcatattgagaagcaatggctcaattcaattgtacaccaaaactgcaaactcaaaatactacactttattcaaggattggaagaataatctaatgaacagccacaccgacatgattgttgctcttgatgtgttgaacaatcagtatctttatagctgttcacgagatggaaaattgattataagagatttgataaatgacgacgccgataaaagttatgaagtgttcatgctcatggatggtatcggtaagattgatttaaagttggataaatttacaaacacaatttcggttgctacatgtgggaaaaatagtgaccttagattgtatacaattgacttggagctagacaatgcaagtaagggaaattcaaaagatcctgatcaatcggattggacatatgtacaaagtttcagaaatagaccacttagaagatctttcacgactttgagtttggaggctccctttttgtcagccgtcataccaccaccgcggaataccgagaggcgacattcaaaagtattgacgccgtattggcagtcgattacaccattgtatgaatatgtttacaatctggatcccacagaccaaatttctcaatggatgtctagtgtatgttttgttaaaggaaatgactacataatctgcgggagtcaaatgggagagctaataatttacaatcccgtcaaagatatctcaccagtgttcaagaaacggatttctcagttttccattcaaaatattgaacaaatcgacagtgatttgataatttttagcgattccatgagtagaatcattatttttctgataagcaaacggaagattgtattacaattcctgcaattagattttggtccatttcttcatctaaaatacatcttgccaaatgcttttagaagaaaaactaataatcaggtggttacttttgatgatatctacgtgttgagtacaactatagatcagcggttagttgtttataaattgacagatagtggttccagtgaactattgttgtcagccaaaatattgaaaggaatgatattttcagcaacgttattgcagtcggtgtctgagtatgatcaattcaggaatttgtttggcggtgacgacgaagggccaagtgctcctacaattataaaaaagcgaaagctttcatcaaactcatatgctttgatgacaaacaacaatggtctggggcatagtcagaagagtaagatgtcttttattgaaacgcaggataatacgctagcgaacacgagctcgtcgtcttctcaaactgaatcggaggatgataatggtgagagttttgagtacacaaatgtggagaaacacaaagaagcaactaagtga

SEQ ID NO: 12579 - DNA, 186 bp, Candida albicans
agagatgggaaggaaaaaagaaaaatttttcttgtggtggtggtgactctttatagtataatatacaggttcaattatttgcaaattgactctgaaagctcaaatgacagaaaatacaacaattataaacataatgtagttcattttattgtaacaacaaaaaatcgagtttatataaatatttaa

SEQ ID NO: 12580 - DNA, 405 bp, Candida albicans
ccgcaactttgtcaacatcttgaaattggcaatgtgctccaaactgaatatgcggttgatcgtggtggtggtggtggtactgctgctggaaacgatctctcctggtacttgtcgcgtatcttgtggttcaaagtacaacgtaagctgctgcaagttgtcgtcttggcggtacttgagccagttggaggagaacttgctgttgataagcaaatgtctcaatctaggcaagtctatcaacaaatcgctaaagatgtccatgttccactctccatacgaatcgcagtcgactatccgaagctgggtcaccaagtgtctatgttgtttgaggaaacccgtcctcccgtctatttcgctcctcatatcgctccagctggcacggatccgcgaaaaaacaatagcttttag

SEQ ID NO: 12581 - DNA, 201 bp, Candida albicans
gtttgtctacatattttgtttttgcaccaattgattaatgcatatcggttaagctatgcaaatgaatttcatattggaaataccaaaaacagaaaacaatttatgcaaggaaccttcagattaagaatagttcccaaagttaaatactttatgaaaaacaataatttaatcatgtctaacaagtacatcagtcacagttga

SEQ ID NO: 12582 - DNA, 255 bp, Candida albicans
ccgaggagtgccgtcgacgtgacattaaagtactcgtcaaacccattggtgaagggcggttcaaacgagtccgggttgagaattagtagaatcgggggcctgttgagaatgttatttttcaagtcgtctgcgatgttgcgtgacacaatggatatcaactggagccagctgcgctgcatggttgggggagtgtggtgtagttgggctgtcaagctagaaatggtattgcaaacacaaggggggacacaaatgtag

SEQ ID NO: 12583 - DNA, 294 bp, Candida albicans
tcatccactacatatgaaacgacagcaagaggagccagcgtcccagaaagaggagccagtgcctcagcgaaaggcagtcaagtacaaccaggagttgacgttgcttactctccccacagacatactagatctcatttttcaggatttgtcaaggcaggacgcgataaacctatcgaccctagatcacaagcacagaaacgtgctaaaagctattgttttttcgcggatccgtgccagctggagcgatatgaggagcgaaatagacgggaggacgggtttcctcaaacaacatag

SEQ ID NO: 12584 - DNA, 258 bp, Candida albicans
acggtacagagagtttttgcaatatggaaacggagaagacttttcaagtttggaggagcttacggtcactgtggcgagagggagtctcaacagcagcgtgatgtcacggttcatgaacactggcaactttccgagactaagagcattgcgggttcttgcaagggaaggcgcatacaacctatcgcattggtttggaaagttgccgacaaacagtacgttgcgggtactagacatgcaggtggattacgaagctcgtga

SEQ ID NO: 12585 - DNA, 507 bp, Candida albicans
accataaaagcacaaggctgcgaaatatatacgcgtatagactctactaataaacatccaaaccagagtgaaaaaaaaaaaaaatacaacacaaaccagaaaaaaaacaaacgaaccacttacaagacccatctctaccacaacaccaatgtactgggtgctactccttttcgtgtcgatatgcatggccaacacggagacatgcttggtacgggtgcccgagtactacaatattgtactgcacccgtcacccatatccagggatgccaggttcagtcgcgagctccatcgtctcaacaccacccacacagtactactagactaccccattggatccatcgacgaccaggatatgtccaacataatcacagtcacatacgataccgttgcgcaaccacgatcaacactactagtgcgcgtgaacaactacggagacaatacgtttacgaacggcgacatgctcaacatcaagctatgctggccggccaccatgccgtacgactttag

SEQ ID NO: 12586 - DNA, 765 bp, Candida albicans
actctactaataaacatccaaaccagagtgaaaaaaaaaaaaaatacaacacaaaccagaaaaaaaacaaacgaaccacttacaagacccatctctaccacaacaccaatgtactgggtgctactccttttcgtgtcgatatgcatggccaacacggagacatgcttggtacgggtgcccgagtactacaatattgtactgcacccgtcacccatatccagggatgccaggttcagtcgcgagctccatcgtctcaacaccacccacacagtactactagactaccccattggatccatcgacgaccaggatatgtccaacataatcacagtcacatacgataccgttgcgcaaccacgatcaacactactagtgcgcgtgaacaactacggagacaatacgtttacgaacggcgacatgctcaacatcaagctatgctggccggccaccatgccgtacgactttagcattgaccatgtgtatatgcacagcaacgagttggttgagagtgtggaggatgagtttgatttgtatgtggcggtcacctacgagttccatgcctttagttatgacaatgggaggtttttgcaagaagaaacggcattgtccttccaattgtacgtgaacaaattgcccagtagattcttacccattccattggagttgtacgacacaatcgtgtatctagtagatatcacaatattcattgtctggaacatcttgccatatttggttaagggtgtattagaagccgtggggcagtag

SEQ ID NO: 12587 - DNA, 336 bp, Candida albicans
cgtgttctactagtttgtcacactacgacacaagtccttgaaatgtcaattgcaaggtatatctactacaccattgcggttgctgttttattaaattttgtcaaagctactgaaaataacaattttaaacttgaacttgaagcgtcatggagcaatattgatttccttcctagctttatagaggccatcgttggcttcaatgactctttgtacgaacagacaattgaaacaatttttggtttaggagacactgaagtggaattagaagatgatgcttcagatcaagaaatatattctaccgtgatcaactcattaaggttaacagatcaagatttg

SEQ ID NO: 12588 - DNA, 339 bp, Candida albicans
tgttgttgtgataagataaaagaacatgacccttttcaagaaaatggcttagaagaagaaggtgtaaaccagtgtgtgatgaatactaccttggcattatcaactctatacaaaaatatcaaaatagacttaaatttttcatcttcgaaagaattcaaatactttcctaatagagacaatctacagtacttaattacttcattattgtttaaatctagtatgatgatgacgatgataattgttatcgtcttgtttttcttttttctgaatgtcctttttttggagatgaggctagacaataacaataaggacggacttttacatccgaaagagatttga

SEQ ID NO: 12589 - DNA, 1854 bp, Candida albicans
atcaatctaattattactagtatcattgtaatttttatttattggctaccattagttatccctgtggttgaaatattgcctttgagtaaaactctggataataaatatgggatatttggaagttgtctgacatcaaacagtgataattgtattgttgttaacccacttgattttactggttccataaaagataatctgtcaggttatttatttatgaatgatactagaaccacattggcaaaaatatttgttttagcacctattgcccttggatttgatttgattttattgattgttatatttgtaattcattttggatctcgtgtaacggtgttgattggaattttcgttaatgtacttgccacgattgcaacaattattacttgtgtggttgtaattttatgtttttatccttatgtaacttgggttccttggactttagtggcagctggagctattacatttatttcattgattcttttaattttaagtttgacagttgttggaaatgacgacgatgatgatgataatgatgctaaatctaatttcgataatgaagattttggaagatttactaattatagtcgtattgatgataaatttaatcatattcaaacatctactttcaaaacaagtaattcccttgataatgattatgaatataaaccccataacaataacaataacaataacaatgctaccacagccactactaccaataatgttggtagtaccaatttcactggtggggcaatgaataaattctcaaaccctactaataattctcgaggtgttatgaatggtggatcgactactactggttctggtgttggatcaggaggtactgttatttctggtatgaatcctcctgctcataaaaatgggtccctcaccagtaattcatcttcctattataacaatccacaaactgccactgatttcacacaaagaaataaacctaatgcttatcaaccaagttcattaagtggttccggtagcaataatggtaatactgcttcatcatcacttccttatcctcctggtacaccaattgttgataataacagtaacaatagtagaaataattatcaaccaggagtttttgatcatcatcttggtgttgaaggtcataaaccatttactgaattggatgatgattttgacgatgatgatgaagaagaagatttggctaataatcgacgtgaaattgttaatattaatgattctgataatgattctgatttcactagtgtttcacaacgaccacctaatcctcaatattatggaagtaattccggaagtggtactgggtatttaccttcaaatgtggttaatcaatactgtcatgttcagcaatatcaacctatacatcaacaaggtatgccaccaccaccacaaccacctcaacaacaacaatataggcctactggtcaatattctccgtcaccaaatatgggttataataatactccaatgagaagtggtggaggtgtaccaccaccaggagcaggtccaggtccaggtccagttccagtgtcaggatcttatttcccaaatcaagggcctgtacctgtaccaccacaacaacaacaacaagttagaggaccaactatatctgaaaatgtattgaataataatccagatttccaatttagtcgtggtggtcaacaacaaaaacgtagagtgaatccaggatttgtacctgtggcagcaagatataataataataacaacaatagtactaccggtagtctgattggaggaccaggtaataagaatcaaaatgctagtgctttaatgggaagaagagaaaatactggacctagaagtggtccttatggtattactagatga

SEQ ID NO: 12590 - DNA, 333 bp, Candida albicans
attgaaaataatagtaataatgataatagtggtgataataataataataaacttcttgttgtaaaaccaaattggaataatttacgattgagacatggagttgtcgaaattgaaaaacataaagcactcacaaaagttaacaaaaaatcaaataataaaaagataaaaaaaacaagcaatcaaagtggtaatggaactgtcaccaaagtaaccgctggtttaccaccaggagttggaaccagtttgattaccgtaactgccaccgctgctaaagttagaacgttggttattgttgtaaccaccaccataattgctgttagtgttggagtatga

SEQ ID NO: 12591 - DNA, 192 bp, Candida albicans
agcttatataagatatacaatttcattttccttggttataacagggctaataatacagcatttcatgctatctctgatttaagtacagccaaacaaatactaatgaccactacaaagtcatgtgatcagtcatgtgaacaaggaagtgatggcaaaaaaagaaaaagaaaccaaattcataaagaaaagtag

SEQ ID NO: 12592 - DNA, 366 bp, Candida albicans
attatgtctgatattagtaaacaaatgaataatttgagtgttaacgatggtgctaacacagtaaacaacaacaacagctttagaggcggccgttcccaatacgtgccacctcatttaagaaacagacaaggtggtggtaatcaatcaggttcctcatcagaatcatcagatgttccatttggaggatctcaacgtggtggatttaactcaaatggattcaacaacaacagaagtggattcaacaatggtggctacaacaacaaccgaggtgggatcaacaacggtgggttcaataacagaggtaactggcaaccaatcctttggaggcagaggtggcagaggtggtttcaacaacggtggcggtag

SEQ ID NO: 12593 - DNA, 195 bp, Candida albicans
  unsure (192): Identity of nucleotide sequences at the above locations are unknown.
acgaaatttttccccactgtggtcgaggatgctgaccgcgattttattgcaagaattaatagtttaattgctcaagtcttggagtttaaagacgatgaaaaatcctgtgatatcaatcaagtggtgtctgaatttgtttcacctacaaagtttgctactgtcttaaccacgccggtcgaaggatccagtatntaa

SEQ ID NO: 12594 - DNA, 345 bp, Candida albicans
cagctttatttggaaacagacaacccgactacgattaaatacagaaaaaaaataatcagaattgccacaaaattgtgggtcctcatagactccaccatggtaataactaccaaaaaaaaggaagttgaaaaaataaaatttgaacggtacgggaatcgaacccgtgtattgagcttggaaggctcatatgttaccactacatcaaccgtccagttgacgagctgctgcactacagctgttaccgttgcgtttggaaatttgcagcattattatattcagcaagttcaagtaaataattgcatatcacttttagatactacggtacttctgaatgtaaataattga

SEQ ID NO: 12595 - DNA, 231 bp, Candida albicans
aagcaatcaaaggagctctcgttagacctcaatgatattgatggaactttgaaggaaatatccaagaactcttctcgcttgagctgtgaatatgacactcaggatccttacaataagaaacctgaattttcaagagtagaagaggtggttatttcagagtacaattcagatgatctttaccaaggaagtgagtttagtacgaatgatgaggacagtggtgatgatgattaa

SEQ ID NO: 12596 - DNA, 1182 bp, Candida albicans
atcaaattcaataacgagtataccaaccacctcatcaaaatgatcactaggagtagacatataagtaaaagattgtattcaacaaattatctggcaatactattcaatgctcaagaaaacgttaatcaattgttggaaagccaggatcgatcatcatatatattagcccaatatatccctgaaccagtacgaaacacctacctcgcgatacgtgcattcaatttggaaatcaataaaataaatgaaggtggttccaatgtacagtctagagcagcaagggcttctagtcagatgtcgaatactttgggagtttcaactgctgatttgaaattcaaattttggagtgatttgatcttgagggtgttcacagaagattctcgaaatgaaactgatcttggagagcccatagccatattattgagagatggattgaagcatgattttaatctaaatatttcatatttccaacaatttcttcaaacgagacgtcattttatcaaaaataattctagtttccaaactgtcaatgacatatgtagttatggagaagggacattttcacaattaaattatttgactcaaggattgttattatcaccatctatttctccttcagttataagactattggaatattctacagaattacaatcacaaatgagtgatattgcagcccatattggtcaagcaacagcagtcagttccatgatccttggagttcccttttatgctcaatcaagaaatcaaataacattaccagtagacttaatgacttctagtgggttatcacaagaatctttacttcgtttgtttcaaggtcatatcaaggattccgctgaagagaatcaaataaaggaagcattaaagaatgtggtttatgagactgctattactgccaatgatcatatgttgacagcaaaatcgaaattggaaatggcaagacaagaaatcaaaaagattgtccaagaacaacctcaagatcaattattgaataaattctctaagaaatggagaaaaggtattcccgatagtttgtatgttccaacaatggctggtataccaacttcacttttcttgaacaaattagaaaaatgcaattttgatcttttccatggaagattacaaaaggaatggagattgcctatgaaatcattttattattactatatgcgtcttatgtaa

SEQ ID NO: 12597 - DNA, 249 bp, Candida albicans
tatatactacttttgaatacccgatcggaatataatgggaaaagttccaagaatgagacaattaagggggatgcaatacatacacagcgagatactcataatcaaacttccttttatcaaaaaatccaattattcagatttatcaaaataatgttgtcttctatgaaagaaaatgaatataaaatagtggctgatactgttgataatgacgattatgttttttttgtttggaatttgtttattttctga

SEQ ID NO: 12598 - DNA, 237 bp, Candida albicans
atcgatatattcataaccattgaaattgacgatattccaattaaacagggttacagtgataatttatcgaaaaaggggaaaaatcaagggagtgggagaaaaaagaaaaaatttccttgtcaaacttgttcattgaatagatcggctactttttgtgacgcgtctttttcatccctccctccctctatttctccctcctcctcccccctttcttccgacaaagtttttattgaatag

SEQ ID NO: 12599 - DNA, 207 bp, Candida albicans
tctattcaatatgaacttgtcctcttgagttcaattaatcaatcaccaggagcttcaaaatatagatcgggtgctaccatgtgtaaaaaaaacgtgactttgcacacaaattggttgcatgaaaaaaaaaaaaaaaaattttttacttttgattcctttgatccccttcatccttttcccccccccctcttaaccatttataactga

SEQ ID NO: 12600 - DNA, 198 bp, Candida albicans
gatttaccgccgccttaccctggcgccttgaccgctcggccatccagtcacgtgagaagagctaactgtggtaagctttttacaactcgaccaaacaactcttttcatgttgaaaccataaatccacttatttatatagggcttataattcaaaacccacactatcatttacgtcttgttttgctgatttatatataa

SEQ ID NO: 12601 - DNA, 186 bp, Candida albicans
ttccgtccgaggttgtgcttgtctttctatgcatgggctccatccataccagccagtttatcaacgatgcctgaaattacttatgatgtaatatatatgtctacttcttcttctccttccatctatgcaagtctacgccctagtacactagtagtcattaatttcttcagcggatatcatacatag

SEQ ID NO: 12602 - DNA, 192 bp, Candida albicans
aaacaagataacgaaaaccaggaaaaaaaaaataccaaagatataccaatcaataatggaaattgttccccatttatccttatctctacaaccccaacaacaaatgtaatgaagcaacaaaaaagaaacacaaaagatacgcagttggtagcagcaagaactagactttcattttttcggcgtagagaatga

SEQ ID NO: 12603 - DNA, 189 bp, Candida albicans
cgttcaaatatactttcagctgatgaattggcactgattaatggtggtggtgaagatgctgagaaagttgatgatggtgatgatggtgaagttgcaatgttattgttgctaatattgttgttgttattgttgatcttgttagttacagccatgattatttatcagttattattatcaaaatacaaataa

SEQ ID NO: 12604 - DNA, 1995 bp, Candida albicans
ggagtggcacttgtatatattgtattttctatatttgattatttagcttatttgttgctagactttgcatatttgatttatcatatagattgcctatgtgctcctattgaatcagaatcaactgatctcaattttgcattaaacacaatggcgttatcagaagaatcgataccaaagttgtatcctagttcaaccccattatccaatggtaatgatagaaacccaactgtcatacaagccacatctacccctcctcctcctcctcctcctccagcactacctgatatatcgaccagcactccaatagaaaccccttggtattataaaagatctactggatctgaaagtgaagaagaagaagaagataccaataatggtaacgacgattatgatgattattatcaagatgatggggaaacaatacaaaagacaccatctccaaataaactgaaaggatatagattcaataatcaacttgactttgcatcgactccattaaatccgagttgcacgctttcattttcatcacccatgaataaactcaatcaactacacttggaatctcaacttgatatggacggatttgaggaagaacatctaatagaacaaggtgaagaagaagaagaagacgatgacgatgacgacgaatattcattagggaataaaacgataactacacatgaatctgaatctgaatctgaacaaggtgagagtaacgagattaatattaaacactttgaaccaaaatatataagttcacgaagaaaacgattacatctggaatctcccgatatgatggttttaacccctaatgtcaattacaaaaataacgttaatgataaaaatgatgtcaatgatataacttatggtaatgatatgtcaatttgtaacaccactagcaccaccacaaataccaccgccactaatacttcagcttttaaatttagtttctcaaatattagtgattcaacaccttgtcctcgacaacctaaacggaaaagattgaaatttaaacatgaactgacaagaaatatattagatttgaattatgctaaaaaatccatactatcacaaccactgtctttcccattatataatgatggaggtgaaggtgaattgccaaatgaaaaatattgttatgataatgatgatgagaataacagtggtattagtagtggtagcactgataataaaagtattaacagtaaactagaatcaactccaatttcccagtcaacaccagcatcactgagagcttcatcgccacctccactacagcaacaacaacaacaaaaaccacgagcacaaccacaaccacaaccacaacaaacatcatcatcatcatcatcaaaatcaggtcaagaatatggtgagacaatcaatggatacaaatttgttaaaccgaaaaactcaatgaacaatactaaacttccacaattcaaatatgaaacacctataaataataatcgttatcatcaattgtgtcaaggttataatagtaacaattatcaaataatgaacgaattgccagtgacagcagctggattgatgcctcatggggacgaagatgatgatgatattcatattggtgatcgtcgaataggcgatccttatttgaatttgctgagagatgatgataatcattgcgaccaggaaactcatgatgatggtaatcaattacgagagatatatttcaaagagaatagattaccattaccgacaccttatttttatcaattgaaatcattatcagttgatcaaatattggcattaataaattatgaaaatctattgaaattttatgaaacaattttgaatggagatgaaactttatatgaattattaaaacaagaacgaattcgttggcatccagataaatggattggtaaattgaatcaaaaaaatgaaatgattatggatgttgattatgaacttactattaaaatggtggatagtattagtcaaacgataaattcaataattgaatcattataa

SEQ ID NO: 12605 - DNA, 204 bp, Candida albicans
aagaatggaatatacgaaatgaattattatttttttatgaattttattaaaattaaaaatacaaagtacaaagtacaaaatgaaaaagactactatatagagttatgtttagctattcttttggagtatttacttttgtttcttcctctacaccactttcctaaaagacattttcttcacataagggctggaagatcccgcgct

SEQ ID NO: 12606 - DNA, 237 bp, Candida albicans
tttcaggcatcgttgataaactggctggtatggatggagcccatgcatagaaagacaagcacaacctcggacggaattactaatattaattacttttcggtcgagaaactgaggtggttggtgtgttggagagaatacttaaagttaattcagagtgctaaactttaccccaactcctttttaatcaattgctattcttgcattactgatctgatgctattaacaaccatcaattga

SEQ ID NO: 12607 - DNA, 222 bp, Candida albicans
aagtcacttcatcttcatcccttgaaataccaaacttatgatgttcatctaccaatatttgactcagttcacgattattctgcgtcgagtaaagtattaggtaagcgcatggtacaaattcaaaagacattgctacaaaccagactagcgcaaaatgctaaagctagcaaaagctacttttcttgtttccaattgagttttttattcatgtgtcgccactaa

SEQ ID NO: 12608 - DNA, 267 bp, Candida albicans
caattattgtacatatatttgttccaagtcattacaattgaatctaaagcacatgctggatatcaaagaagtataattgaacaacttaatagacaaactagctcaatttatagacatgtaaattctatgcgcaccacctttaattcccatacaaaaacggccttttttgttgtagcatctccaatcattcgcctacctcaatcaccatctgtgcgtataataaacatttgtcttggcttcaaaacggtattagtttggtctttgtaa

SEQ ID NO: 12609 - DNA, 213 bp, Candida albicans
attaaaaaatacaaaaaaagacgcataatatatttattgttttataagattagtctcctcaagcggttaacaaaatcatcatcatcgggtaacagaatggttaacctaggcgctattcactactactgtttggaatattattggagcatcattatgaggaaaagaaaccaaataaataatcaaaaaatgaaaataagaattaagaaagcataa

SEQ ID NO: 12610 - DNA, 1548 bp, Candida albicans
tattatacaatgtctgaagttcctaatcaagagtctccgagttcatcgattcttaaacaatcgaatgcttcaacatcaacaaaaatacatggtgctccatctagttcacaaattgctaatgtcgacttcaacaccttgagaaaactaaatacgaatacttcgttttcgtcaaacctaactaactcaaccactaaaactagcaatgctttatccaggctattcactagaaataagtcatcatctaacatttcaattcatccctcttcaagcgatgatgatagcttaccaaagacactccgagaatctacatctccatctgaatcaagcaagagtgttagtggcaataagttgagaattgccaaaaagttgaagtttcccaagaatcaaagcagtcggaaaccagatatgtttttggatactagtagcacaataagcgaagacagttcttcgtttcggaaagtaataattggtaatctgttaaatgagatgactaaatcaagaaagagctcaatgagctcacccatgagtaccacatttcatagtttgtttcatcgatcccatcataatggcagcaaccttcaacgagacaccaaccagattgcgactggcacgacacctttgtccggtaagtttgatgacttctcaaaaccatccaagacaactttatgtctttcctcaaatagctcgaattcaataatcagcaatcctgaactagctcagatatataatttcaccaacccaaatatttcaattgaagatggagaaaccaatttagatcattcaaacagttcctttttggatattcataagaaaatgcttgtgccagcagatctgtttattcagaataagctaaacaagtaccaccaaaccgaagtagggttgggcatatacgaaagtgaattagatcatgacaaagatagtaagatatattccaacttttatcattacttgaaaccactatttaccccatctttttcaatatctgactctggtcaaaagggtaggatgcgtccaatattgggtgctagtgttgaagaaattgcaaatttcgtaaaggagagtttttgtttacaccagcccaatcacgaaagaagttttagactgaaaacaagatccagtgtatcaagcttgggtcgtgaaaaggtagaggattttgattgccgtcagttatcgaatttgtttgagaaattgatggccttattgagtcataacttgcaaactgctgaaccattggaaatatctttacaagctttgatattgaacgcatggaaatattataatgcttatgttaggttttatttgctaagtatatttcaaccattgcaaatctacttaaacgagctatttacgagaaatcataatggaagcaaaattaccagaatagatgaccttctacttgcttcgtttcggaaagtttttattactgaacagggaattggaagtggggatagagagacatctaagtttttgggaaatgctgaaagtgaagatcttacagggaatgggttgttgacttctactttggctgtgttgtcaagtatatcatag

SEQ ID NO: 12611 - DNA, 276 bp, Candida albicans
  unsure (267): Identity of nucleotide sequences at the above locations are unknown.
agtcccatgctgaagctgctatcacaatttgaagatttatcaagtagtcaaagtgttactgaggtgttatttaataatttacaccaagaagttatattatcgaactgtcaaatgaaaacaaataaaaaagatgcaaaaacgcaaaacaaaataaaaaatatgcaaaaatgcaaaacaaatttaaaaaagacaaaacaatataaaacaaattataaacaaatacaatacaagatattaaaaatagaaaaaagatcaaaaacgatcaanaaaaaataa

SEQ ID NO: 12612 - DNA, 183 bp, Candida albicans
aaaaagacaaggagtgaaaaaaagtgtgagaatttgctaaacaaaaaagagacagaaaaagaaaaagttaacgaacaccaaagacaggaagaaaaaaaaaattccaacaacaggaacaaacatcaacaaacattaacatcagcaacaagcagaagaccaatatacattaaccaatcacactga

SEQ ID NO: 12613 - DNA, 216 bp, Candida albicans
tgtgggtgcaaattaaaggcaacagataaatttggtaaacattttctaaaacgtattgccgcttccagagtcaaaaaaaagaataaagctaatatattagtgctaataatagtagtaatacaaaacaaggtttcaaagttttcgctcaaaacatcaagccattgcttatataggatgaactattcaattaacaggcaaaaaaaagccatcatttga

SEQ ID NO: 12614 - DNA, 393 bp, Candida albicans
  unsure (259): Identity of nucleotide sequences at the above locations are unknown.
tccaacttcttggtggcaaaactaagtggcaaaccaggtggcaaactagtaaaactcaaagctgaattgaataggacaaaagtatttaaccaacacgattcaatatcccccaaaaattccataatgaaattttttttcattcttcttttgttacacgaaaaattaattgaaaatcaatttcaaaacattttacattatacattatacattttacatttaaattactctaaaacaaaagaaattctttgtaatagaaaantagtaagacaatcaattccctccccccctctattgttcttgttattgtggttaatgttgcataaaatgaaacacacgactactactactacgacctcaattacaaccattatcataatcacattacaatcatag

SEQ ID NO: 12615 - DNA, 252 bp, Candida albicans
aataaatggtctttgggagtacttggtttattgaaattgtttatattgactgggcccagagaaacaattcttgaagacgaaacagtacttactgaattcaaagatgaagttgattgggttgaaaatgttctgagagctgctggtggatgttccatggttttggatttgttgatattaagatataatgagtggttctatttggtttctatttcttcaatatgcagcaaaaaaaaaaaaaagaggaagatatga

SEQ ID NO: 12616 - DNA, 363 bp, Candida albicans
catagtgaatcgtataccccacattccttgataagagtgacttaccttaacgatgacaacgaatgggttgttggggtgtttgcttataagtacaggtttcgtttattcatgacttggttgttaatctggttgtcttatattgtagagaaactgtgtacgtgcaattaccaaatagttgtaaactatatcaagcttactgtaaaagccttctcagatgatctatggaaccataatgagctggaagtagcctatttacgtatggggcaaacattttggattgctagtttttacaagtttataaattgcgccctacatactgaacaatttttgttgatattgtcttatttagatcttgatttatag

SEQ ID NO: 12617 - DNA, 240 bp, Candida albicans
agttgctatttttgttacatcaattttcattttaggaaatttaccgagtttttagctcgtttagttgttcccattcgcatcaatcttataaatcaaaatagtttactcaacagcccgtcgccatcgccgtttttccttgccgtggcatttttccgtggctactttttaaggttttgttatctgtttttgtacaacaattatgggtgttgctaccagttaatcacaacggtaaaatcctaa

SEQ ID NO: 12618 - DNA, 219 bp, Candida albicans
attgaaattatggaaattattcgaaaaactccaatgactaaatggagtaacaataaacaatggcaaattaatttatttaaaaatgttatacaattaccattagttttacattggtcattaagagatggttgtttaactccattttgggttggtctttgtggatcaggagcaagttggtggaattttaaagacatgtggctgtcaatagatttatcgtaa

SEQ ID NO: 12619 - DNA, 447 bp, Candida albicans
ttaaaacaaaaaaaaagagatacaccaatcgccaaaagcaaccaacaaggcacgaatagtgtaatatatatatatatcaatatatatatatatatatatctgtatgaaaattgtaatacttttttttatagttttgtatatttttttttaactgctgaagttttagtttattttattgttgtatcaacacctaacctaatctacttttttttttgcctttacgataaatctattgacagccacatgtctttaaaattccaccaacttgctcctgatccacaaagaccaacccaaaatggagttaaacaaccatctcttaatgaccaatgtaaaactaatggtaattgtataacatttttaaataaattaatttgccattgtttattgttactccatttagtcattggagtttttcgaataatttccataatttcaatttataaataa

SEQ ID NO: 12620 - DNA, 201 bp, Candida albicans
ttgtattttacccccttgtgcaattactatgattgcaaaaagataatgacagttgttaaacaaattgtatatttttacatatattttatagttcaaacaaattgtaagttgatgtatcttttatttagttttcttttgtgtgatttaattggctcaactgctttgcagcaaatggcccatacttcaattcaagttatataa

SEQ ID NO: 12621 - DNA, 204 bp, Candida albicans
gttaagtatggatggggtggtggaaaatgtggatttttagtctaccgttctcgtcatccatccatcgtcagtaattcacttttccggccattacgactaaaaaaaaatagtagaagagtttggggccagtcacgcatgattattgttgttgaggcgcacgaacattttgttaagccaagtatcaaatatgatattttaatctaa

SEQ ID NO: 12622 - DNA, 786 bp, Candida albicans
gatcttgtaacattctgtataaagtcaattttagttgttcatctaataatgttgagatcatttgtaacatctattagtccaattgggtacaatgctgtatcattggttctgatgagagcattggcaacaaaagctgcaaccacaacaactaaaaaatccacaaccaaagcatcaccaaaaaccaaaaagactactaaaaaatctaccaaacctcctaaagtcgataccaaggctatcagacttcagaagaagatcaatgaggctaggtctgctaagaagaacttgcagcaacaaattaaagatatttccactcaacacaagactttgagtaaacaaagaaaattcgaagaaaaagcaagaagcaagatacataaattggcaccaggtaatttttattccatgttccaaaagaagcgtgctggtgattcagttgctgaattctatcaattccccgaggaagagaaggcaaaatggatagctgctcgtgatgcgtattgggaaaaggccaaaagctattttactcctaaaccaaaacttggtgccaacgggtttgcaaaatatgtacaagaaaattacattagaggtgattctttaaccgaaactatgaagaagttagccgatgaatggaatgcgttatctgaaactgaaaagcagcaataccaaatcagtaaagaagataaagaaaaatacaagaaggctcttgaaaaatggaaagaacttagattgaaggaatacagtgattatttgaaatttaaggaaaactacaaagtggaggatgacttttga

SEQ ID NO: 12623 - DNA, 543 bp, Candida albicans
actcgaagcttttttttttttgttttcatttttatattgccaattttacaacaattagtaatttggactgttcagttacagttttttttttataatatacatatcaaccataggtatttattgctatttatgttcaagtttaaaaacaaattgaaatttggtacttcatcatctgagaagcagcaaacccctactacaacaacagacacatcaacaccctcacctgcacctgcgtcaccctcaacatcaacatcaacacaacacagtagcacctcagtaaaagacagtcccactccaagacaatcaactgattcgagaaatacaatatctgtcaacaatttagctgacgatgtttccaaattgacggttgctgcggatagatcgccagaaaaaagcttgggctccaataataaagccggtggcgaaccacctttatccacaacagctacagacaccacctctaactcctcctatagggcttcaccatcatcatcacaagcaacttcattattgggaacaacttccactgggttcgatcactga

SEQ ID NO: 12624 - DNA, 303 bp, Candida albicans
acgagaaaaaaaaacacaacaacaacaacaatccaaacaaacgagatcagagagagaaagtgtgtgtgtgttttggagaatttaattaggaaagagagagacaaacaaatattaagtaaaactcaaattcgtgtgcgtgttcttaatttttatccaaatttccgcccaaattcaaatttatcgtcaattttgcctagttgctaccaattggcgtttttttttttcaccccaacattatttttctctttcacacccccctctccacaaatctacaacatggcatttagaggtttaacattataa

SEQ ID NO: 12625 - DNA, 1953 bp, Candida albicans
agtctgtggtgttaccaattgtccagcaacatgacgtccttaatttatcccacccagagtgtgtcattatctcctaacgtaatcagcaccacctcctcaggaatacatctacatcaaaggacaccatccaacccatttgaagtcatatatgattcacaaccagtacacaaaccatccaacacacaatggcataactctcaaaattatgaggaaatatcaaagaatatacatcacagaacaacaagctcgggcctaccaattaaacctgccccttcgtcttcttctccatcccctccacctcccattttgacagttcttgatgatccacttttcactaaaactactgggtccctcatatcacgtctggccaccttaagaaacagaaacagaatcaagcgacgcaacaaaactgtgaagaaagccgatatcaaacagaacaaaccattaaagttccccatacggaggaaaagaagtctacagtacaagaaaaggccacaggcgccactttttgataataagaaacagatgatggactttttgatgaactcaaactatcaggctttagttaaaaactttataccacaatcaatgcgaatttatctgcatcaccgaattttgcaacctaaacctgcgttgacttatagcaccaagaattttgaaattgacgagcttgacaattttgttattgtaccaaccgacaagaaatcaaaaacagggtcttacctaaggggagcaaacttgactgctccggtgtccaatctaagtgctggtacaggtgttggtgttggtagtggtggcggtaatacagtagttgagttgatatatcaaaaatataaggaagacatctataccggtgggttttccgttccccctccaaaatttgaagagctctatccacaagatgccaagttattaagcagtcgagaattgtctgatttgaatactaaaattttgtttgacatattgataaggaaaacagtagcagcaaaaatgggctatcgattaaaaccagctgggaacagtttcatgggtcaacatttaactagtctgtcatcttccttctcttcatcttctccgtctttttcaactcaggattcaggaaacttatcagccagaacaacaccatcagctaggtcacgaggattattgccgtcttcgtcttatctgtcttcccattcaacaaacatgctggagaccaaaccacttttcctgggtttgacagtgtcacacaaccaaaaaccacaaagagatttacgtaacgaattcattaatgactttaacaaaatatatgatcaacgatataaacacaacactaataacaagccaagtttcgaaaaagatttgtttgctagtacagtatatcaattaagtcccattaataaatcaaaatcgactttaccttcttacgataatgaatatactggtagagttggctttggtgataacaacaacaacaaaaataacaacaacaacactaatagtagcactagcaacagtaaatttgatgatgagcaaactactacccaaccggcatcttctacccaaagaaaatcaactagtacttatacctcgaccacttcaggcttgcaaaacttggacgattttcctattaactcatataatataaaaccttttaattcctttgatgtatggcaatctaagaatattgttcccaaagacataatttccccagaacaattaattgatagtttgaataagtccgatcagttcggatacattagaagtcgttccatcgtagaacaaaatgtggcaccaagagttgagtcaatgcaagcctcggttttgactcatcatgattctgtaagaactaaatggagtgctagtgttggtattggaggaggcactagtcaacatgatgaaaaatctcaagcttctccaaggttctctcaagtctcaagactaggatcttataaatatcagggggtgatttag

SEQ ID NO: 12626 - DNA, 210 bp, Candida albicans
ttagacgatcagattaacaaagggagaatgcatatttttctagtatccgttgtagatcaaatgagaagatggctggctagtcgcgatgtgaaaatcttgctgagaaaaacgaaacaaaaaaatttcgcaactgaactagcaagcatagaaggcaaatttggaatccagttcttgttgactgaaaagttaaaacaaccatacaacggataa

SEQ ID NO: 12627 - DNA, 528 bp, Candida albicans
aaattccctctcctcactacgatcacagccacaaagccaccaacaactacacagccaccacaggaaccacaacttcatactttcagaccaatgcagcaatcgcaacaacagttacaccaatcgttctcagcacacccgcaacaaaatcagaatcaccaccaagaggtccaaatgagcatagaaattgagaatgccttagcttcagctgccaaagctgcatcagactctccatccgcaagagcaaacaaagactctacaccctattatcttaaagatgcaaaatggttcaataagttgcttcaactttatgactcgggtcatattcgtgctgatgaggtattgtgcgtttgtgaaggggtacgagataataaaattccattatttatgttgaacgtgttggaccatgggtattaccccacaaggacccccaacaaccaacccgcaagagctcatagtgaagagatactggacgaggaaactgcgaacagaattagagattttatgttgccaatggtatataatagctga

SEQ ID NO: 12628 - DNA, 1224 bp, Candida albicans
tgcgtcttccacaggacgcggatctcgcgggtctttccagccgcgtggtggacaccaacgaaaagacaacagaaactacgacaaaaacagaaactaattcaaataagagagaaaaggaaacggaaatcacaaaaacaaaagaaagcatcgtcaagatcgcaagcacctagtcaagaacatcaactacaccagcagcagcagcagcaggttcaaacaggaaatcaggaaatagcaaatgatcagcatcatcaacaacaacaacatcagcagcaacaacaacaacaacatttccataaccaagggactggccataattatgcattagggttcatacaacctacatttgattctcaataccccaacaagtcaccaaatgttttggcttctacagactcgctgttcccaagactttcatcatacgacttgaaatcaaaagattcaaaatataaacgatggacaccaagaatggatcaacttttgatcaaattgttgagtgacgttgtccattcgtacccaagaggtgctgaaccggaaatgaacaaaaaagcttggttgtatgtatgtaaacaattacggtatgccaacccggagacggtgtactcgacatattccaaatattcagttctgcaacatttgagtaatgtgattcagcaccgttataagatctggtttcaattaatggttcattctaaaaccattactacagggtattcatacaaatggaatctgaccttggggaggtttgaaataattgatttgatcactcaaagtttgatattagattcacgacaagtgaaactgattctttatggcaatacattgagtttacctgacttgtcacaatacaacaaaagtgcaataatcaccaatgatttcttccttagtgacaatttggggtatatgtcggtttatcataatgaaatactaccagtattggcaaagttagatagcaaatacattgaagatattgggatagatggagatatttatactaaagtgccaaagttcgattatcctgagggtcacaatgagtattttaaacctctagttccggccaagaaaccctcgaataaacgcaagataccggaagtattccgacagtatctgcagaacaacgggtcgcaccagtatattgaggaacaagatcaagtgggtagttcttctactggaatgcttcaacagttcagaagaactctggaagagcccattcctctagtattttaa

SEQ ID NO: 12629 - DNA, 420 bp, Candida albicans
agtcttaatactaaagaccttcttcttctccacaagcatttccattcattattcgtatttgctacggtgtctacaccgatattcctaaaacatagcacggagaaaatacaacaacttcaagtgttatgtatgtccctcaatatcaaattatttttaattccaccacatgatttaattgtttggatattacaagtattgagagtggaaggtccggaaaagtctacccatttcattgatactgacaatccagacggtaattttctatctgaatgtggtttatcatattttcaagtgaatcaagttttacaaagatgttcttttaatgagtttcttgttatggatactaaagaaaagataaatcaatttcgggaaatcgttacatctgaactaatagtatgtataattgtgaccaacatttag

SEQ ID NO: 12630 - DNA, 1476 bp, Candida albicans
aaagtgggcactctttaccaagtatcaaaaataatgtttgactatgtactgaataaagtaattctcgagcacttcaaacatctctcacagcagttgatgccgagttgtgatttaccaactgttcttccagttaacttcatgaccgaaactttaaagataaacagaagcacatcaatagcattacatgatctaatacagattaaacctgttcgtgtcagtctcagtggacctattccttatgaattaaatgctgtcaagtacactgtgaaatgtgaaaatccaatatccaaaagtaataccggttttaaaaacacaattagacgtacccattggtaccccgatatcaccataaactccacatacaatatcaaagaccttcaattggagtttattgaatcttatttaccaccaccttgtcaatccttgcaaagtgaaatgaaaaagtggagacacctaaatttcaaagtagacatcccaatgattgtcaatccttcacacaaacgtctactaatacacccaccacctaaatggtctttgcctgattctattgacttgttcgatgtttctcatgataatttaagttctcatattccaaagcactctattcctgaaagggaagtattgttaattgaagataaaagtgctagtagcaagtacttttgccaacaccagtttctctttacaccaccccaaccctgtattaataggatgaggtaccatacatgggcatacaacgacagttcacttgcaaccccttgcacagaaaatattactcagtatttgcttgaccaaaatagagttaccgaaagtggaaaatacttggtactaccagttgcatgtccgaacatcaaaatgaaaaatagtcccgcaacaaccatctcacaattcattttcagtcatctcaagcttgaaaaacataattggaaattgccaagccatgtattaattgaaaatatgtcttggaatccattcaaagtggatgttgccaattttgttgacaaatatcttatggaaactataacccgaaagaaatcctttatgactaccactgataaaacaatcatatctagtgtacaaatggtgttactccccaaaaccacagctacatttcctaaaatatcaaaaattgaaagtagtcatgaattgaagcctgtaaatatcaaatactcacaaaaaaataataccccaacaaagtccgatggattaaccaatacccaaatccaaactaatattgccacgtaccataatgacacagatataatgaatgaattaatatcttcaagaaaaaggaaaaggaaaaagttgggcacagtttcaaatgtagtgttgccacctgagatatcaacattactgtttgttgaacctaaaactcccccacaacataatgagaccactgaagatacacaaaactgcgctgaattgtcaatttccaccaacaaatctgcttttgcagcaacacaacacatcataaattaa

SEQ ID NO: 12631 - DNA, 246 bp, Candida albicans
gttttaattttcagtggaacaaaaaccgtggaacaaaacccctacaatttctttcaaccgggatttttaagtgattgggcacaaaaccccggttatggggttccgaaaattataatccaactgtggcaattgaaccaaatgccattaccaaaaccccttcgggtaacttggggtgaaactttgaacggaattggggttattcatgttcaaggattattacttgggaaaggaattaaaatttcatga

SEQ ID NO: 12632 - DNA, 255 bp, Candida albicans
gtaagatattttccatctagaagtgatagctttttattatcaaattacaatccctattacatgtggacatcaactccatttctttgcgcattttatagtagagttagagttagcttgtcacatctcgttgcttccttttgctgcaactgtttccgatttcaaaatgaaaatagcttaaagttacccggagggcctgcacataatcaaaatatagtaaattcccaaaagaacagtcgtgtgcagtttccaaagtga

SEQ ID NO: 12633 - DNA, 405 bp, Candida albicans
aatgtccttccccttgagtgtcgtatgtatatagttaatcatattttactaattgaatttgttaatcttcgccggtttattgtagcaatcacttattctagccttttgttggtaacaattcatagccacactaagacttcaaaaaagatacaaaaaaatatcaacagcaaaaaattaaaagcagaaaccaaaaaaaagccgagagaaaaccactcttactcccaagatacaaatactaataacaaactaagtttctactcatccactgccacatcgtttcagaccaatataacattttacaattctttgacgaccctatttgataagaaaatagcattattttggccaactaccacattttatttcgttacacttagtttgagattgtttccccccataatttag

SEQ ID NO: 12634 - DNA, 315 bp, Candida albicans
ataaataaaaataaagagagcgtgtactttacacaaagtcaaaatggtttgggggagaagcggaaaaaagaaaaaggcacccgcaataagaacactaatagccaccaccacgcacccacgcaaccaaccaaccaaccaactaattacaaagaaaggagtaaaatgaagaagaggaggaaggagacgcaaaaacaaaaaaaaaattcaagttttttttttttcgcgtcggtattgttttacttagatctttattcttttgcagtaataaaacaagtagaaagaagaactatgagaggaagaaaaattgttgtatga

SEQ ID NO: 12635 - DNA, 186 bp, Candida albicans
agtacaataataataattacacaatactgtaaagtctttgtaatagaatatctactattgcactattacactaataaagagtctttaactttgacaaataagagctacaccaagaagtcagtttgttacttgtcgggtgatcatttgaataacgtagtagaccctttgattaaagtgtcaatataa

SEQ ID NO: 12636 - DNA, 252 bp, Candida albicans
ggattttcccttgactttaaccccccccatttgttggccggtgatatttcatgccattttcaggggcccgaatttaggattgggccaaccttccggaggaggttaaccccaaggaagaagtttttgccttcgccccttaaattatttttggaagaattgggggaggaacattttaacttgaaggattttttgaaacacctggacgatatgctcgtgccatgttatatttcaccaaaagggatatgcagataa

SEQ ID NO: 12637 - DNA, 294 bp, Candida albicans
ttatatccacactttcttggtgatttaagtttcgattttcataatccatcttcacaaatgtcatacctctcttctgcatttaaaggattggttgcaggatcaattattactccaattgtgaccaaggttttcattgtcccactatattttgattcccaaatacacaaggaaatacactatatccaacaagagatggaatatgtagggtggcatattagacatctagaagaagaaaaggggtttcaggaagaagagctatatcgaccagcaacatattatggtccagttccataa

SEQ ID NO: 12638 - DNA, 222 bp, Candida albicans
tggggacagaccagtatgtgttcaaatgtggcttcagaattacactggtttctgtttacgaatgagaccacacatcttttcgatgctcactcaaacaatggtgttgaaaaaaaaaatattagtgatatatttgcaaaaaaaaaaatttgcccgttgactcataatactttaaacaacaacccaccaaacaacaataatgtccttggaggtatatggagctaa

SEQ ID NO: 12639 - DNA, 186 bp, Candida albicans
gacgttgtcttccactgcgttgtgaagagtacttcatggtgtgagattttgccacttttttttattattagaagagagcaaagagctattttagttgatactctctttcctacacatatacctatacccattttgtttaagaaattgtattatttttggggtgtttatgtttttattctttcttga

SEQ ID NO: 12640 - DNA, 510 bp, Candida albicans
ttatggttaccaccactaccactactatttcttgaacttggtaatatcactttagcattgattggaacccatttgttagtaattggtttaatgaatttttgtgattgtggtttactagtaggttgttctcctaataatggagccttatcaggggcaggccattttttatcatcaactgacaattctttaacaccagcagttacatcaccccaaacagattttgaaggtacaggtgctggagctaaagttttctttgaaggtttggaaggtgaaggtgcagattctgttgttgaaaaaactttgtttgattctttagttgaatcttcttcatttgtggattccttagtagcttctttttcaacgggttcactagatacagatgttgattttgaggttggttttgattcagaagaagctgctggaacagaaggagatggtgaagttccaatggcagccacattagcatatgaaactggagaagtcatttggaaatctttgaacgttgtttaa

SEQ ID NO: 12641 - DNA, 219 bp, Candida albicans
tctcgatacaaatcttataaaacgcttgtcccccactcgacaattaacactctaactacattatgtactaataataccttcatgggcttaatagttgcgaatcaatcatctttgaaattgcggataaatctttatagttgtagtgagtcaagttttatccaaattacacatacatctgcacatcgcgatatccatttaccccatacaggaaatttataa

SEQ ID NO: 12642 - DNA, 207 bp, Candida albicans
  unsure (62),(63): Identity of nucleotide sequences at the above locations are unknown.
tattgttgtttgttgttgaaccacacactttccattttacatattaaaaatttggagagtcnnagaagaaaaaaaaaaggcactcctgtaattattgtgctagttggttatttggaaatcccaatttattgttatcgatcttccttttttcattacatttatctatataactctatttatccaagctcaatcatcaccaatccgtaa

SEQ ID NO: 12643 - DNA, 186 bp, Candida albicans
gtaaaacattcaatatttctccgctgtccacactctatatccatcgactacaaatataaagctctagctattttcggagatatttgtaaaaaattatacaaaatactatctgaagaaagaaaagaaagaaaagaaagggaaaatgaagtgaaatttttttatttttctggtttttttatttgctga

SEQ ID NO: 12644 - DNA, 324 bp, Candida albicans
tgggaaaaccgagaattggattgtggacagaaagggttcttttggtctgatggaagagtatttgattatttatttggtaaagaaactttgcaagaagcagaggcgggtattccatatgacaaacaatttggtattataaatcaagaagtgaaaaagaagaaacaacaattgagggaaaagcatggagtattatggagatacaagatggcagctgaggaatttggtaaagatattaaaaaattgggaggttatattaccaattcaaaatcaatcgataataaaaaaaagacagataacggaaagcaattgccaaaggggaaataa

SEQ ID NO: 12645 - DNA, 1017 bp, Candida albicans
tacaccacctcctccaccaccattacatcctctccttttcttacaatgttgatgttgatgccagctagatttggctatcatatagcaaaaaacagtagctcgatattacgacctatttctattttgagattcaaatcaaatgttccttcagcaaagcaaagcaagaacaacttaccagcagatgggatccccaaaaaatcattaccttctgaaggagaatggaagcatttaaaattacatattccaggtgagaatgtggaaacgaatgatttgaaagacagaatacccaaattccctttaggaaaggaaaatgtaccaacattattaccacgtccaggagtacctcaagtgggtaaaaatttcacatttcgacaagttattgggattttgaagaataaaactcaaccggaattgatttatgaaagtgaacctcatcgattgtattttttaatgtgtttttgtgcatcaatcatctttgcaatatacggatgtgtgttatttgaatgggccacatggatagccaataaggaatacgatgaaaatgaaaaagaagagaccaatctagcaattcgtaaacgagaatgggctatatctttggctatgtacttggctccttcagctgcattgtttctgttggcttatggtgccgctcttttcccaacaaagcttgtcagaataatctggtacttgcctggaccagttgaacatatcaaatttacatcgtatccgtttattcctggtagaccaaccccggtgtatactgtgccattggaaaatttaaagaggaaacacacatccagagtatggactggtaaaggattttatggtactgctgacaaaggttttttctactatactttgttaaaaacattacctaatgggaaaaccgagaattggattgtggacagaaagggttcttttggtctgatggaagagtatttgattatttatttggtaaagaaactttgcaagaagcagaggcgggtattccatatgacaaacaatttggtattataa

SEQ ID NO: 12646 - DNA, 957 bp, Candida albicans
aatttcatcgaaaactccttctttttttatttttatttttttttttttttacaacagacacactcacacacacccatatacacatttttcaccatggcagctgggttaagacaaatgaagttacataacaaaagaaagttgaatgaattggaagatatttcaaatattcataaaaagtcaaggacggtatcgtttaaagatgaaaatgaaaccaagaaacccataaccagactgaaccttaaccgaaagcgttctcattttgtcactccaccatcgccacctcaacaacgatcgtcaccgccagcaacttgtttagaagatgatgaacctcctcatcaccaacaagacaatgacgatatttctgaacaacaacaacatcaccaccatcaccaccaccatatttcatttcccgccacgccaccagagtccataaatgacgaaagcacaaccccaatagcagccgccaccaataccaacagaaatgacgactacaaggaatacagagatgtcaataatatggatgtggaattgtttactgcaaatactggtataattccaaacaatagcactaatagctcaaccacaacagttactacatcttcaccaaatgacggcaagtcattcaagcaagacttgaatgagaatcccgactacattgcactcacatcctcattacgaatggcaaagataacaaataccaaaataaatcaagatattatcgaattatcgaaattgcaacaatattattcttcaactgcaaataaagaagaaaccattcaattctttctcaaattaattaacaacgaattggatttgccaaaacccacaagaatcaccaaatgtcccatcataaattggtctaaatatcattcttgtttatctcaagtcaataaagattttgagaatcaattgcataaatgtgataaaaaaggaacaggccatgaattcattgtataa

SEQ ID NO: 12647 - DNA, 246 bp, Candida albicans
ggttgttttaacacagaccagttctcattactaaccaaatatatcaatttagcatcacaacaagaattagatgacaacaatgttcccttctttcacagagataaatgtgcagctcatttaatcaactattataaatgtctcgataaaggtacttccttctgtaataaaaccaaagatgagttttacaaatgtcaatatttagcattaaaggaaagattagataaccacactaaacaaacccattaa

SEQ ID NO: 12648 - DNA, 183 bp, Candida albicans
aaaaatctgaaaacaacactaacaccaactctagtggtacccatcttagtaacttatgatagtcaaaaaaaaaaaacattattagagaactatatatctttaaatgaatggggttgcgttctttatgtttctttaaatagctattttacaaatctcgtaaatgttttgaaatttgcaaagtaa

SEQ ID NO: 12649 - DNA, 183 bp, Candida albicans
gtctttatctttactttgtcatcccaatatgaggtgaatatatcaacccacaccctaattatgatatttgattcccaacaaaaaaagttatggtggtgttactttaacaatttaattctagacgaggacccctccttggacttgataccttatggtttcctattcaatatactttgtccctaa

SEQ ID NO: 12650 - DNA, 831 bp, Candida albicans
cgtattgaaacaagttctatcaatgtaccatatctacactcattcttatttataccatcacaaatgtttaaagaatgtattggttgcacgcaaaaacgtttagatgacgagccacaagatgatagatcacaagtgttgtgtccgatatgcagaatgtcaagatattataaggcctacaaacaatacataacttcaagaatgaggtcaaaatcaaatttaaaaagtacaagtatcgaacggaaactacgaaaattcataacaaacaaattccatattataactaaactttatgcgttaaaacaattaacttcgtctcataaactgaaagaatacttacaagtgaaaaactttttgttaaacgaccgtcaaattaagtttattttcagtagcaaaaaagccatctcatcaagattgtgtcttcgtgaaattgaaagattggaaaactccaatgaggctcaagaagaattattacagcttgaagtgactagtactagtagcagctcatcttcagatactgagaataatgaagcggcgacggaagtttctgataaaacgggtgatttggctgatgagcaacctccacaagatagagagcctaatatcgatacccacaataaagacacttctcctaaagtgacagaaaatgataataacgaagatgtggtaatgaacgatgttgataataataacaagccacacctgattgtatctcaaaataacgaagaacacgaaacaggtacaaatgacacccctttatcggccaatattacattagagaatccaaatactgttgctactgaatctggcacaccaactgttactaagccttag

SEQ ID NO: 12651 - DNA, 186 bp, Candida albicans
catgtaatgtcatgttacccagaagattccatttattatatttgtaaactaacgactactactactaccaccgctaatgctttgaaaaaaattaccccaaacaagaaattggcggagatgaaaaaaaaaataaaaacttttatttttagtgaatttcttttttttttcttttgctttagattgtag

SEQ ID NO: 12652 - DNA, 279 bp, Candida albicans
catcctactttccgcgtccgagcgcgtagaaaacaattaatggatggtgtttatcaaatcaggagtatagaattccacccaacaactagattttccgaatgcgaaacgacgaggacgacacaacaacgactaaagaagaagaagaaaaaaaatataaataaattgatcacgcacacattagaaacacaatattggatcacttttttcgataatactaccaccacacagctcatgcaccactcatgcccccacgttctactgctcaaaaacgtttactaa

SEQ ID NO: 12653 - DNA, 252 bp, Candida albicans
ttaatattcatgcgcaaaagaaacggttgcagccataaacgcatattcatttcggattcactaaagagagttgtctacgtcttagcaatgcaattaacggtggaaacttttattaaaacaatcacacaaacaccatttaagccttttactggaattcaaagagcacgtttcgattttcatgataatcataacaagcttgaaaaaaatcaatttccaattcaagagattttacaaatgatttttcacaaataa

SEQ ID NO: 12654 - DNA, 201 bp, Candida albicans
gaaatccgacagccgcacaatctacctatttggacaacgtatcccgataaccgaagatcaattgaaacaaacaaatcagaatcttacaacgtgttcatgcagaatatcaatttcaatgcgatacccacaataagaatttataatactttacaaaacaaaattcattttggttatctacttctattttcatttcttcaatag

SEQ ID NO: 12655 - DNA, 204 bp, Candida albicans
tacgagtgtggatgtcaattatcctctcatagagaaaatcatcatcaagataaaactataaatagggttaccaatatccttcaaattctacaattcaatcttggtttttttttttttgttttagttcaagttttttcaacatcatcaaataaagaaacttcttcttcttcacccactccatcactgaaaaatgaagttttctaa

SEQ ID NO: 12656 - DNA, 1206 bp, Candida albicans
tgttatcactaccaccaaccggtccagctactaacccatctgattctgaatccaaaactaccccaactggcccatctactgaaccaaccggtccatctactataccaaccggtccaagccgttccgtcgtcactgttactgttcaccgaatcaactgttgaaaccaccactggtccaggtttctccaccaccgttaccttaactccaggtaccaatgttatcacctccccaactggtccagctactgaaccaaccggcccatctactaaaccaactggtccaggcggttctgttgtcactgtcactgttaccaaaccaactgttcaaactattactggttcaggatacactaccactgttactttaacttctggtactaacgtcattactacaccaactggtccagctactgaaccaactggtccaaacaccaaaccaactggtattgaatctaagacttctccaactggtccagtcaccacccttaccacttcagttccagaacaatctgttattactattactggtccaggattcaccactgttttcactttaactccaggtactaatgttattacatcaccaactggtactgctactaaaccaactggtacaggttctgaagctaccccaactgatccagccactaaaccatcaggttcagccactggtccatctagtccaggcggctctgttgttactgttactgtcaccaaaccaactgttcaaactattactggttcaggatacactaccactgttactttaacttctggtactaatgttatcaccacaccaactggtccagctactaaaccatctgaatctaatactaagacttctccaactggtccaaacaccaaaccatctggtactgaatccaacaccaaaccttctccaactggtccagcaggtactgttgtaacagtcacggttaccaaaccaaccagtgaaactattactggtccaggatacactagtactgttacttattctgaaggtactactgttgttactgttccaactggtactccttctacagacaaaccaaacacttctagtgcaccaattccatctccatctaaatctactggtactggtactggtgctactactactactacagatgatggtttcccaagtggtagtggtggtgttacatggactccacaaccaggttggatttgtcaatgtgttagagtataa

SEQ ID NO: 12657 - DNA, 273 bp, Candida albicans
aagtatgtttcattaagcctgacagaaaaaaaaaacaattgtggcaaatctgaatgccaatcaaaaagtgagtataataatgatttacaactccaatttattcttcaacaagacaatactcaacaacaggagcaatgtagactcatacttaaacagaaaataaccttgctgctgtcaaccaatattctgaaacctgtggctctttgccttactcatttgttgatctatgcctatacgcaacaatacaccgaatttactaacgaattgagctga

SEQ ID NO: 12658 - DNA, 183 bp, Candida albicans
gtttcaggtttgttttatttttcaaatttaaaattgggtaatggtaaatctttgctgattgttataacaaagttccaattagatttctttttatggtggtttaattcacattttaagatgttgcaaatgaagaatagccagatcacacgactatacatacaacaattggtaggaaatttgtaa

SEQ ID NO: 12659 - DNA, 897 bp, Candida albicans
aaaatgaagttttctaacgtcgctgcagcaactgtgcttgcttcaacatcatctgcttgtattcttccaattgttgaaggtcttcttaactgtgttttcccaagaccaccaccaccaactattcctccaagtccatgtggtggtaaaaaatgtccacctccaaaaccatgtactaccagaattcctcaaactcataccacaattgtgattagtacttatactactggtgttgtcacctggggtggtagtgttactactgttactttaactccaggtactactgttgctactattccaccaactaccgttacaattactccaggtactgaaactgtcactcttccaactccaactgccactgttccaaacactaaaccaggtactgacactgctactgttccaactggtccaaacactactacaggtacttccccaactggctcaaacactaaaccaggtactgacactgctactgttccaactggtccaaacactactccaggtacttccccaactggcccaaacactaaaccaggtactgaatctaccccagccactgaaccaaccggtccaaacactaagccaggtactgaatctaccccagccactgaaccaaccggtccaaacactaagccaggtactgaatctaccccagccactgaaccaaccggtccaaacaccaaaccaggtactgaatctaccccagccactgaaccaaccggtccaaacaccaaaccaggtactgaatctactccaggtacttctccaactggcccagtcaccacttcagttccggaacaatctgtcattactatcactggtccatgtttcaccactgttttcactttaactccacgtactaatgttatcactaccaccaaccggtccagctactaa

SEQ ID NO: 12660 - DNA, 279 bp, Candida albicans
ttatttttgcccccccttcttcgacagatttgtttaacagattttagttattttttcggtttttctttatacatatgtataactactattacttattactggatagttaacattattatttttggtttaaaaagtatatattatatgtgtataaacttattcacaatacaaacttttctattttatataaaatatgtctttcgtcttcttctacaagtagattatgctaccaaatgcggtggcatcaaaactataagaattatatttaagtctttttga

SEQ ID NO: 12661 - DNA, 225 bp, Candida albicans
attatctccaacttcttcaaatcacactcattatcaatcaatgtgttatcaggaatctccgacggaacaaaattatgtatggattttgatattgtacgtgtgtctgatattatttttttttcaacacacgcagacaaacaaacaaattccgtgataaacactaaaagaataaaacttaaattaataaacactttctttatcacttatctcattgatatatattag

SEQ ID NO: 12662 - DNA, 471 bp, Candida albicans
actatgagaagtatattttaccttaatcttttgaaaaatatgaaaattaaaaaaacccactacacccaaatcttcatgtgtttgaagttctctaatagcacagaattcagtgttgataatgaaatacaccaaaagttttcccgtcgaaggaaaataactgtacctatttgctctgttgttctttttgatcaagtttccacaggaacacctccaacaactgagtgtgatataactacaatttacacagaagttgttaatctaaaagcagttccccaatcacttttaatttcttgcagttatatttgtgtgtgtgttaaattatctccaacttcttcaaatcacactcattatcaatcaatgtgttatcaggaatctccgacggaacaaaattatgtatggattttgatattgtacgtgtgtctgatattatttttttttcaacacacgcagacaaacaaacaaattccgtga

SEQ ID NO: 12663 - DNA, 204 bp, Candida albicans
ataagatttgagaaaaagaggcttgttaatgcaggttatttgattactttaatgtcattaaacagccatagccaaatgacaaaactagtgaatacgaaagctaatgatcaatctttcacattatcatcatttgcagagtgcatagggatggacaaacaagattgttatgaaatactcaaccacaatgtaaacatgttcaattaa

SEQ ID NO: 12664 - DNA, 297 bp, Candida albicans
actaaagatgcaattaagcttttaacattagagattgattggtattcatctataaagcaattgaataaggggttgttgaatgaaacttttaagcgagtggagtggactaaatgctcaagctcaagggaacggctggtaaggaccagtttgagcaaacatatttttgttttgtcagggatatctcaattgggattttattcagctcaattcgttagtaaattcggtgtattgttgcgtataggcatagatcaacaaatgagtaaggcaaagagccacaggtttcagaatattggttga

SEQ ID NO: 12665 - DNA, 258 bp, Candida albicans
cccgaatctacgttttcttcttacttcaaagaattaagtcaagtctatcttagaaaattcaaccaaggaatattgaatactttctatgtttgtggacacagtccatatattttgaaattcttcgaaaacactaaatcacaaatcaaacgacacacgtactaccacacccctagtattaataaacaaggcttcctattattatctttcagattccaatttttgaattatccccatggtaattgcaagaccagacgttaa

SEQ ID NO: 12666 - DNA, 279 bp, Candida albicans
ttcaagatgacaattttcacaacattaggaatgtttatagttgatgagaatcgatacgttgacagtaacaataatcttttacccccaccacattgttcatcgtccttacaacaaacaaacattattggtggggctggaacatatgctataatgggagcaagaataatatgtgatgatcgtcaagatttaattgatcaatatctgggatcattgatatgggttcggatttcccttttgaaatcaaacaagaattggatacttggaaaactagaggggtaa

SEQ ID NO: 12667 - DNA, 186 bp, Candida albicans
gagtcaacagcaaaagtaattgctgtggttgacgccatagaactgccaaaagacatagcgccaaagaaaatcacaggcgctacccatggattatgtacttgtgatgaccatccatatcccataagtccaatagcaataaagagagtcgatggaataatcataactaatctgaattcaggttcataa

SEQ ID NO: 12668 - DNA, 207 bp, Candida albicans
aaaaaaaaactatcttttaaccacgaaaatacgcgtttttccagaactcaaacatacacagtcattgaagagaatagtaagaaaagagccacagagtacgtaatagatgatttgtgtgtgtgtgtgtgtgtgtgtgtgtcattgatccatattcgttggcatcggtcgtttccaaagagggggtattctaccgagaggcgattttaa

SEQ ID NO: 12669 - DNA, 207 bp, Candida albicans
  unsure (199): Identity of nucleotide sequences at the above locations are unknown.
ctgtacataaaggcattacttccaaaactaagtaataatcaactaagatttaattataatatcaaacgatcaagggaagttggtattttgcaaataatacctctacatatagtattagtctcattggatgacagactacttgctgaactcattcaccttaaaaagcatattcggcgggccggtagaagatccgagtccncgccccac

SEQ ID NO: 12670 - DNA, 216 bp, Candida albicans
ttccatacacatttatcagtaatgtgtagtgtaaacaaaaacctgtacatagttgcttggttgaagaaaaaaaataaaatagaaatacaaaacaaaaaaacttttttttttctttctttcttgctttatttaattacctatactttaagaaagggttacccttctactctttatgtgtttatcttatggttgtttagcttgaaacagacaacttag

SEQ ID NO: 12671 - DNA, 264 bp, Candida albicans
ggaatatatattgtggttgctaaaatctacgtacttttatttagaaattgtcgtctccagcttggtccccattttaataagataactacaaatacaattcccaatatattggttaaacctaatccagttaaacaccaaccaaatcccatggaagaaataagtgggtctattactgccgtgcatatggtagcagatatgtttcgtgcaaaattgccaattgcaacatttgtcgctggctgtccagtagtgcattctgtcaaataa

SEQ ID NO: 12672 - DNA, 195 bp, Candida albicans
ttattacttcttattgtaattgctcgtctttgtcactcaaaaatttatacaaatcaagaggtacttgacatgccatactatgccattaaggaaactgtaactacatctggattttcatgttctacaaataggaagaaggaagtgggaaacaatgatttacaaatgcttggcttacaggggtgtgttttctgttag

SEQ ID NO: 12673 - DNA, 333 bp, Candida albicans
tattacaactgcaaaatgacaaacactgacgagtcattgtctatgtattttgacgatgacttcaatccatccagctacattgacaaacttgtgaattcaataaccaatctgaatccagctagctcgacaacaccagtttcggcatattcaaaacagtcgttaacaaaactatccaacgacatatcccatttgataactcatcttgattactatacgaacatgttaaccaatgatagcttacaaaagaaactagacgcattagataaatcaaatgaaataattgatcatgtgttcaccacggggaaggggcaaccgggcttagatgatgggaag

SEQ ID NO: 12674 - DNA, 1140 bp, Candida albicans
actgaattgacaaaaacaagccctcctttggaagcatctgcatcatctctggaataccccttcgaaagtacttcagatcagatttgtcaatgtactccagtaactgtcactgaatatattcctcaatcacccatcccaaaggaagttgaatctacaactcaatctacgaaaagttttgcatctgaatcaagttcattagaaccaaccgtgtctgtgtctttatccaaatctgaaagtaccactgatattacagctgaaaccagtcatgaatctaccactgagcaaaaatcagaaactttggatcaatccacttcagttgtaacacctgcaacaaatcaagaatcaactactgacacttcttcagacaacaatgttgaatccacctcagttgtaacacccgcaacaaatcaagaatcaactactgacacttcttcagacaacaatgttgaatctactactgctggaacacctgcaacaaatcaagaatcaaccactgacacttcttcaaacaacaatgttgaatccacttcagttgtaacacctgcaacaaatcaagaatcaactactgacacttcttcagaaaaggatgttgaatctagttctcaatttgccactccatctaatccagtacatacttcattatcaaccgagtactacactactggtgtcacctcttactacacatcgtatgtaactgttaccgctgaaactacagaagttctcaccttgacttcctgtgttgataatcattgtcataaaacaacagcaaccactggtgtcaccgttgttacactcactacttctgatatccaaacagtcattacaacctatgccccattgactcaaacggtgactttgggaattgctggttcaaaaattgttgatttaggttgtccaattggtaactttggttacaagggttatgttggcaaaggtattaaggctgacgataaaggaatcgacgccaatgctcatgctggtttcaagattggttttgatgcaatcaaacgtgatcaaaaagtagccaacaccactaatgttactgttcaatcttccaaaaacgctggtgccattaactccgtctacagcagtattgaactcttgtgtgccgttgcagctatcatggttttaattatttag

SEQ ID NO: 12675 - DNA, 231 bp, Candida albicans
agctcagtaattacattagcaattacattagcaatttcattagcaatttcaattattccttttgccaaggatacttttctttgctgcaaatccgacaacaaaaatttcttaatacctctatgttatagaacagaatgtttaattattaagatagattcaattgagcatcgtcgttctatttttaggtctcagggatttatactagaagaaaaattttcacacaaaaattag

SEQ ID NO: 12676 - DNA, 318 bp, Candida albicans
aaatcattgcttaatttagttttctgcttgaggggttttcctatttctagcgaaactactaaattaataacacaggatagcaaatccactaatgttgtaaatcatggacacgttcaaagtatagttaaatacaaattaactaacaatgtgaccattataaataagacgagtcctctacccaggttacaagctggtaaaccctgtgcaaaaaaaaactttatttattttctagctttaaagttgaacttgtcaacaaataaaggggaggaggagggggatggggaacataactataatccacgcttgttggagggttga

SEQ ID NO: 12677 - DNA, 204 bp, Candida albicans
tgttgttgttgttgttgctgcaaatctgtattcaggtctactagtttttcattcgatttttcaattttgtgtttagtcgtgtttaatgacgagatttacataagtaatctgcgttttgaattaaataagaaactaagcaagtttagactatcaactattggttttcatcataataatatattttgcgtcaatttcattttgtga

SEQ ID NO: 12678 - DNA, 318 bp, Candida albicans
acaatgactcgtcagtgtttgtcattttgcagttgtaatatcaatccaagtataataagtaaacaaaaaaatggaaaagtgttaaccaaaattcaaaatcaaccaaaaaaaaaaatctggctcgatcaattttttcaaaacaatatgttaacattcaaaagaattgggggtttaagacgtgcccacaaacatggtcgaagtttatttttctttacaattattcgactaagtatagattcggcattttataatatacttataagctatagaaaaattaatacttttagtaaagagaaagaatatacaaaaatatcataa

SEQ ID NO: 12679 - DNA, 201 bp, Candida albicans
acaatgcaagctgtaatgctgtattgtttcaggtacagttacttttgtttaacaacaacaacagacagtatgtctaactccagaaaacaagaagcagaatggtacacaaacaattacgctatgatagtgtctacaattaaccaacagttgttatacttacccgacccgataatcaagaactacccatgcctcctgtcttag

SEQ ID NO: 12680 - DNA, 183 bp, Candida albicans
  unsure (157): Identity of nucleotide sequences at the above locations are unknown.
acgatagagttgtcgagtgtcattgctaaaccagtaggaagagcaccagtttttcagtcaatgaagcttgttaatgataatgtggatataaatggggggtggagcctttatattaccaaaccgggaatgaaaacccgccttttcatgagtcatattnatatcggggattgtgttcccctttga

SEQ ID NO: 12681 - DNA, 207 bp, Candida albicans
ggtctgactcttcttcaactaatgattgttcaactggttggtatgttgtcatttgttgattattcaaaaggattggtgaattgtgagcgtagaaaaatggccgaaaaatcaaaaaatagatcagcaaaagaaaaaaagaaccttgaaatggagttgctccaagattctgtaactacatcatttataaagcactttacatatgcttga

SEQ ID NO: 12682 - DNA, 540 bp, Candida albicans
gaaatctgcttttatcgtttacacgatcatagcacacttacacacattcataccacccataagaggaaacaatcagtcccgtttatgaccccattcagtatgtatcctgctagctccaaaaaaaatcgatttgaagagggtactaactcttcaaaatcagtaccgttatcagttaaagtcgctttgggattaggcactctcgtgggtgcaaccatagctgtgataaataacaaagaagctatatatgagactgcagaggcttttttcacgagaggagctgagtattgtcgagaaaagatagaagaagcaaagatcgcaaacgaaacgaattttgcagaccattatcaagacgaagaattcaaagatgtaagtaccggtaagtcaacaggttcaaatttgagagatgaaagtgactacgaagatgtcagtacccctgaaacatctgacttttctgaaatagatacagattttcaagacgatgatgatctcagtgatgagaaagaacaagctgatgattttgatactgctagtttagattag

SEQ ID NO: 12683 - DNA, 183 bp, Candida albicans
aaccgaattcaaacacacaccaagagtggttcaatgtatttttgtaatggtgttagtagtacaaagttaaacaactcaattaaaacccgcatgtggctcaaactaatattccgttcttcaacttgcaaatacattttaatttatagcgaacccattaaaggggattacgtcaagacaaagtga

SEQ ID NO: 12684 - DNA, 273 bp, Candida albicans
actggagacactataaaggttaaggtgctttgttctgccatagtatctaatatggagcttcaatatacgactagcaaatataatcgctatcaaatttttcgtctatttgactgcaaggtgggaaaaaaaaggaatagagtatctagtcgaactactatcacgcctaaactttgtgttgcctcgacttatatagtccgattacttttagttataagtaattgttctgaaaataaatatagatggagtttttttttttttattagtggtacttaa

SEQ ID NO: 12685 - DNA, 228 bp, Candida albicans
gaaatgtatagtagaagtatttgtaattattcaaaagacatgcaaatggaaaagtattttttttttttgcctcatcacaaatatttgctcgccattaaaaaaacaaaacaaccagaaaactctaaccacagctctcacccaatcaacgcacaaccagaatgtctaacaatgttatacgacaacagagagatcgtaaccatgaagaagagattcccgccagctctatga

SEQ ID NO: 12686 - DNA, 600 bp, Candida albicans
ataaggggggagagtttaaaaaaaaaactttgcgtgcaccttgcaaattttgttgtggttcttcggcaactttttcctacacaaaagagagaagaccagagaagagcttttcaaaaaaaaaaaagtcgatcgagaaagtcttcgttaaacaagaacaagactcacaccacgaagttacagatgttgactttagatgatgatcttaagttagtcattttagaatatcacaattatcatttatctatatccttagaacactctatagacaaaacatggaattattttcaaagcttgattccacaactaaccaaacatgcccttcaattgatcgttgattcgcaaggtgtgattcgtaagaattcaattagtcgactaaatgagtacactattttggagtacttgatcaagttatggactccggagttggatcttaatgatgtgattgatttggtagctaatttgagttccatctccccattgaaccaggacaatgttattaatggggttgaaaggtatgaggacttgtctagatcacttactattgaagaacaagtttcggctatttttgaaaagtcgtattcaaataatgatatctactag

SEQ ID NO: 12687 - DNA, 1149 bp, Candida albicans
ttggatgaaataaatttccctgtgaacggggagatgaccacaatcacattcctggggaacctttccggtactgatttcttggatccgctagtggttacatctagtgttacagaaacattcaattactatcccactggtgtattaaacccatatcatctatatatctatttgctaagattgaatttccagttgcaattgcagggcaggaaaattttattagttctacataacaactgttggatgaataggttttttaccaatattgagatactttacattagcaaacaactagatgggtattactataaagatggtatgaagtttcctggcgactatggtttgaagaattggttaagacagtcgttgagccacgctgatattattcctaatcttctttttaattacaaccaattgatccaaaaactaaagtcagatcccgtgatgtataaatttaaccagctttgtattgggaaagcattggatactgttggaaacgagtctttggataattatcccattaagtttgaaaatggtatttttgtcgttgagggagaaacgaggggcgacgagtttatactagactatcattatagtattaaggatgttatttcgattatgcttagattgaacaattttgagaagttcaccccgtcactgccaaatatggattgggataaagtaagtgatgtttttgtgaacgaaatattcccttcaatcaggaatagtgacttgtactttaagtttgctattctatataatgagttgcatataaaaaatgatcaaagtgctattgataggctgattcaaccaccggaagtgttttctattcctccggatcatgtgactttggttgatttgatttgtaagatcgacgatagctttaaacgaacggttgacaaatctcatttactatcaacattgcatcctgaaaagagtggtcctagtttggtgagttcgaaagatgaggatacgagtgcttcagaaagtgaagatgaatctagaaagcgaccaaatgattctgaagaggaagttcgtacaatcaagaaatcaaaaatattgcaattattggaaaagaatgacttgcattttgttgacgcatttgaagaagatgaagtcttcaccacgcgctggaaggaccgcacttgcgta

SEQ ID NO: 12688 - DNA, 357 bp, Candida albicans
ttgtggtgctctcctttggtggaaagttgggaatatttcttgaaatacagtctttcatcagccaagtcactgaatttgagatctattttggtactagacatggtgggtgaggtaagagaaagagaagggtgtttggataaaagacgcgtctggagaataaataaggggggagagtttaaaaaaaaaactttgcgtgcaccttgcaaattttgttgtggttcttcggcaactttttcctacacaaaagagagaagaccagagaagagcttttcaaaaaaaaaaaagtcgatcgagaaagtcttcgttaaacaagaacaagactcacaccacgaagttacagatgttgactttagatga

SEQ ID NO: 12689 - DNA, 228 bp, Candida albicans
caggtacagccaccacaacaaactcctacttcagaccaatttccattccaatgccaggaaatgttgcttttaaaaactaatggcaaaactctttcagttgttgctacttatctaattttaatgcttaatttgattgttcaattgtacgattcaactataaattttatctatatatatctctggggggacgggaaccaactagacatattttaccattgctattcttga

SEQ ID NO: 12690 - DNA, 510 bp, Candida albicans
aatagtaatatgatttatcagcgtgacttcaaagatttgtatgaaactttgagttcattaaaatcacaattcagacagtccaccgaaatatcatcctttaggtatgataatagcagtactttggaaggtcctaaagtaaacactgaaaggcaagttttgctacccctgacaaaccaaaatcttagaggccataaacctgtgggtgtctctgaaccgtcaaccaaaacaacccaaagaattaaaagtagaaagaaaataccaaaatctaaagaattggatatctcacaagagccttataaaacacacaggaagcacacaaatatcggttcaaacttgggagctaaccaatgcaaagatactataacggtggaaaatctgctggatcaaaaggaattggatttgaaaagtaggaatcctcaaaagactttgaacaaacaaattgctgaggatgtgttttccctctcccatattacaagttcacctccttttaagaagtccaagaaaaaatga

SEQ ID NO: 12691 - DNA, 189 bp, Candida albicans
caggtctattattcatacaaatatgatacaggatgtaaaaccgatgatatgcatgtgtcaagagagcagtaccaggatgataataatttatttagtggagattcattgcatccaaattgtcaaggtgacgaggtacaggttaaacgatttaaaatgacaccgaatcaaccaatctctggtatcaagtga

SEQ ID NO: 12692 - DNA, 189 bp, Candida albicans
acaccatcaacaggttattatctaccccacaaattagcgacctacaaagtaccaccacattcttttatatgggataattatgcacagcaacagctttgtgcaacacctttatttatacgtatgcttacatgttgtaatgtagtatgtagtattacttacaaaaaaaagagactaaaaaacttgtgctag

SEQ ID NO: 12693 - DNA, 261 bp, Candida albicans
tcatttttaattgatttgtctacgaagtcatttcaatacgatgttgttgttgtggttattattttgcaagaaacaagtactactattcaggtgaaattattttacttttttagattgttacacaatcaagtgtgggggagagagtggtgttttattttgcagcaagacacgactacacccccacaacagaagaagaaaattggacacacgcttcccatcaaaaagtttggcaccaccaccacaactacaactttaatctaa

SEQ ID NO: 12694 - DNA, 747 bp, Candida albicans
attagaacaataatcaatactaaagtatttgtggagagtggaaattgtgttacatacttgaagatgctatacaaaaacatacagcaaactccgacaactatacagccacacacaaaccaattcaggaatcaccaaagagatgaagacgaagaaagaggtagagctaaaagtaaggatccaatttgtcagtctacaaaactacacttacaacaggaccaaaccaatcctatactagggcatgcataccaaggttcgatacgttctagatcaacaaacgatacaagtatattagcaaatctaagaaaaccactgaacaaaaggacaggaacagaacagctattatttacggcgattaatcagaaccatcaatcaaaatctaaattaacaagatcaatatcgtcacaaggagtcaatgcactccaacaacaacagcaacacattcattggtcaccacatctacctcctcaaaataagaaaaatatacctatggtaaataacgaattaccaacaacaaaccagagtcgtccacaatttagacgatggaatctgtataatgttccggaaattacgttaaaagacccggtattgagaaacgataacaaaccagaaggtatcaccgaaaaaaatagtatatcacctttgactgtacttaaagaccaatatgataccaagagacccatggtcaacaatgttattaccaatacatcaaccgataattcttttagctcattatctaaagctaatgca

SEQ ID NO: 12695 - DNA, 594 bp, Candida albicans
atatggacgacaacccccaatgacacatgtttactttcaattcaatttttcaagcaattgaaaaccttgaaagagaaattggggaatcccaaaaaagcaaaagagttggatcaaaaaatcgaatggttggaagagatagggtatgaattaattaatgaaatcatcagcgctgaagacatggaacataatcacgatgaggaggattgtcaagatgaaagttgtgatcagaaagatgcagaagttatttttcccgagtcatggcttctttccatatttgtaaagaacatagatggaagttgttcaccacaaacttatgcgattttgaaattaattgaattgaaacacccttattttgttcaaaaattagaagccattgataatgaaaaaatactaattaaaaacattcaaaaatatttgttgaattatactgaaaaggaattgaaatcattcaataaaacagtgctgaattggtgcaaaaatagattacaaaagtacccagattcaatcaggtcaagcaaacatagtgaacagatatcaacaatcatcaatcaagaaaaacgcatcttgcataaatttatagacttacatagttaa

SEQ ID NO: 12696 - DNA, 231 bp, Candida albicans
agaatacatacattcatatttacatatatatatatttatttaaaatatagaaatcaaaactatctacagaatagaggtgacttacaatcacttttggatttcatgtcaatttttctttgcaccaaattttgcaattatgaatcagtaaagatcaccaagatatacaaggctttagtattgtaccaattgaagagaagattagtctcttttgttctttctcaaattgactaa

SEQ ID NO: 12697 - DNA, 216 bp, Candida albicans
tattgccgaaccactgtatatatgaacaaatggaatttaaatcgctcaatagtgtctgatagtgtttgggggaattgtgtggaggaagagcacaataagaatacatttatcagttcatatctccttgttttgatatttatgtcatcatacttgaaaataaactttcaagacaactatgctctctggcgtgggttgattttaagtatcgattgttga

SEQ ID NO: 12698 - DNA, 285 bp, Candida albicans
tacattgacgatcttaacatcctagtcattacggataatagtatctggtcattagtttctccgtatcagttgttgtttccggatatagcaaagattggtacacaaaacgagaaatccgcacacgtatcctctttctttatcatcatctcctatttttttcttagtcgtttcgaacacattacacaaaaaatgtccttgaaatcattggatgagagaagatataccttgagcttaatcaataagaacctggagtggatgattaaaaaaaagagcggtacgttatag

SEQ ID NO: 12699 - DNA, 261 bp, Candida albicans
tgtgtcccagttagggctagggttggtacaaggaacaaggccaatattgtttccaaagccagtttagctgctttgttgtgttgggaaggtgtacttgttttagtatatctgaccagagacagagggcaacataggtctcaggactggcctacaaccactatggtaagtgcaaaattcagttatagggtcggagcaaaagctatttcaagtacagggagaagggacaactgttgccccagttccaaatcatgtacaggttaa

SEQ ID NO: 12700 - DNA, 189 bp, Candida albicans
atggcgccatccaccaccaccccatgtcttgtttctggtcacaaaaactttgaaaattggcgagaatatatacacacacacaccataaaaaccaaaaccagaattaaaaagagaaaaaaaaaatgggtgacctataaactgaccaatctcgcctcatcattctcattatttatccctttatcaagctaa

SEQ ID NO: 12701 - DNA, 261 bp, Candida albicans
agctgctgtcacaatttggagatttatcaaatagtcaaggtgttactgaggtgttatttaatatattataaagaagttatactatcaaactgtcaaataaaaacaaataaaaaagatgcaaaaacgcaaaacaaaataaagaatatgcaaaaatgcaaaacaaatttaaaaaagacaaaacaatataaaacaaattataaacaaatacaatacaagatattaaaaatagaaaaaagatcaaaaacgatcaaaaaaaaataa

SEQ ID NO: 12702 - DNA, 330 bp, Candida albicans
gtgcaaagtgggggtatgagagccaccgctgggacggtttatccgatcctgggatacggttgtgccggttgccaacgcttgtaccattctctagtaccaacttacatcttggggactggtctactgccacccttggccagaaaatctgggctggcgggaacaagggctggggctgagatcaagcttgggccagagccagagccagagccagagccagagccagagccagagccagagccagagccagagccagagccagggtcagggccagggtcaatggctgacgtccctaagctcaagggaaatggccaatcccagagcagggtctaa

SEQ ID NO: 12703 - DNA, 363 bp, Candida albicans
  unsure (78),(91): Identity of nucleotide sequences at the above locations are unknown.
atcctcaggcataaacctaaaatgatgcttgccatgcatccatacgtgcccttttatttctttgtcggagtcaagatnattgttcttgtcnacgcattcttcttaccagaattaaaagttcgtagtttggaatcaattgaagaagttttcacattaccttggtataacttgagacattgtaatagacttattgcagatcattctcaaattcacaaaatcaaatacacccatgacgagcaaggtaatactgatttcaaccatattcaatatgaactcgatagtggtaagccaacagatcaatttgttgaaaatttaatggaaagtgaatctgttaatagagaaagtgttggacataaagtttag

SEQ ID NO: 12704 - DNA, 336 bp, Candida albicans
caattcttttctccaccatatttgatttgtttttcactttcaaatttttcaattgaaagctatattaaacaaataagtataactcaacagtcaagaaatggaaaaaagaaacaaaaaaaaaaagataacattggttctatggaatacaaattttcagttacagtcaagatcattagtcgagttgacagtactccagcaaaaaaaaataaaaagatgggtgtggctttattacacagactgctggccgcattgatcctattggtgattagaagtagttgtcttgcatcaaccgaatacatatacatatatgttagcttgaaaacaacatttctttaa

SEQ ID NO: 12705 - DNA, 339 bp, Candida albicans
attagtggtgaaagttttttttcaatcaaacaagaaaaaaatctgtactgtttcagtacacggattatgcgtgagaacgttatttggtgcgccattgattttcaatcagatatgaagccaacctttttagtgtatttccaacatcttgagaaaagttattgcaaaacttcatggacacaagatatcacatttatagctaattcaatcagtcatgatgtggcctctatcggttttgatcaattgagtagtggtttcaaatgtcctcaatttgggattacaatgacacaaaatgatttttctccaatttccattcatcatttttgtgctatatctatgtaa

SEQ ID NO: 12706 - DNA, 711 bp, Candida albicans
aaagctattcacaaccctcaattctccataatgaaattttttgcttattttgcagttattgctttatcttcagcaagtttgattaatctattcaaaagagccactgccaatggctgcgaagtggaatcttgctacaaagctcaccaaactttaatcaacagttgtaatggcgctttcgatttcaactgtctttgcaacttaccacaatcttattttcaaaacttgtacgattgttccaaaagctgtgatactttgcaggaaagtgatattcatagtccgtctgacataagactgatttattgtgaagctgcgtccaatagtatatacactttttctattgattccatctccttggatatgattggttatagtgattttgaaactgacactgaagctacaactggaagtgatacaagaactaaagcagcaactggagcaacaacttcagctggtactggtgttaccaaaactctggaaactggtggcgtaagtagcactgctaattctgaggcaaaactgggaagtgtaaccaccagtaaatccggtagtacttctattagtgaatctaaaactacaagcgggtcttctagtagtggaaagtcaagctcctccactagttccgcttcatctcagcagactagtagtcatgcgggtggtgcatcaggtgcctttgtgtctttgttgggcttgtttgctgctttattggtttaa

SEQ ID NO: 12707 - DNA, 276 bp, Candida albicans
agtgcaacaatgaataacctgataaaaatacaatacctggccaagtacccactaagtccacaactcaacattagagattgtctaaattgtagatggacacacatcctccgaagaggagtagataagaaactagatattttctattccatcccacaatattggctaaagtatatatttgcaccacaatatcgcatgaaaattggtactgaaaagtacataattagttctaaaaaaaatagaaacttgaaaacgtgtcatatctacttttttggttga

SEQ ID NO: 12708 - DNA, 303 bp, Candida albicans
  unsure (62): Identity of nucleotide sequences at the above locations are unknown.
agtttaatagcattacactacctattcttgcatatgcttagatattaccattttgaacaaanacaaaacaaaacaaaagacacgggtttagtcgagctctgtgatttcgtggtagccagtagcatctttacaaacttaaaaacaaacaacatttttagagtaaccagtaatgaatttgaaaattataaaagtcaacccgtttccttaattttgtttttatttgttgcatcctccaataaaacacggtcaagtttttgttttaattcaattagaaagctattcacaaccctcaattctccataa

SEQ ID NO: 12709 - DNA, 201 bp, Candida albicans
gagggggggggcgggcgatggaactgggaaggggggaggggtgaaacagtattgctcctttcttgggtaaaacggataaagcgaaaaactaacaaagaaaaaaaaaaagaatttaacttatttaaatcacaagaattaattttaaacgcctttttatacttgaaactttatatattgataaactttacgaactctagctag

SEQ ID NO: 12710 - DNA, 1272 bp, Candida albicans
ttcgcacaatcaaatcaaactgcagttataagtaacagaaccgaagtttatttttttttttgcatcatgacatccactaaatcatcaccactatcgatattgtaccaaaaatttcccttcgaccaatgtcttgacgatcatttgtttgatacaacaaatttgataaagcatggcctcaacttaacaattcaaatgggcacattgacattaaatgatataccgtctagtgaagaaaacatacaaacagtggacaagttaccccaagtgctatctgataaccaaactcaaatgtctgaaaccaatgatgaagaaattgattatcacatacctccaagccccatattaatccctatagagccaccaaaatcatctataaagagaagaaatagtagcaatagcagtattggcagctttaccaccaccaccagtagttcacccataacggaaaattccacaacacgttcttcatcatcatctgacatgtctttactaatatgcaggaaaaaacttcaaaatatgattgaagagtttttcataactatttgcaatcaaaatgaaaaattataccaagaaatcagtaattacgttatcaactcaattgtacagaatgaatccaatttagaaagttttttaagcaaaattgttaaccataaatataagcgggaattagttgagatcattcaaacattatttatggagaaatatgaagaaatcaaattggaagagttgattgattttcttaataatttgatcaacctacgattagatgcaatcaaagatttatataatccctcagtctacaaaatgtactataaaatttggaagctaaatataaataattatcgatattacgatgaagaatatttttttgattatttcaataattcatttagcaatctggaaaatgttctattacagaatggatttctactaaattacaagaaattcactcactatttcagcaaagacttaacaaattatgatgatgacgaagaagaagacgaagaacaagacaatgatgaagaagaattggacgctaatgataaaatcaaagatgatagtttatgccacaacgatacagcacctagctcccccaattatgcttataagtgtgaagatactgataatcaacaattactgttagatccattggaccaagaccacattccaaaactgttacgattcaatgaagatatagatatcatcaatatcaatcggtacctaccggtggatcatgttttatacaaccagtttttaaatcaactagaatag

SEQ ID NO: 12711 - DNA, 195 bp, Candida albicans
tcatcattgctagttggggtgctttctgtgttggatgaaggtgagtcaagcggcggcatttttcactacgagaagaataataatattaacaataaacagatttcccaaaaaacaaatctcgattctttttctattgtcttcaatgaactaattccaatgacgacttgggaattaagtcagatatacaatctttaa

SEQ ID NO: 12712 - DNA, 624 bp, Candida albicans
  unsure (623): Identity of nucleotide sequences at the above locations are unknown.
atccaaaaaaaaaaaagaatcgaattccatatgtcgcataagactcagagccaattatcttcacaaatgaaaaacttgaatactccaccaatagacttcaactcaacttcaagtaacaataccatgccttctgaaccaaatctgcaaccgcaacaacaacaatcacaaccagaagcaaaaacggagccacaaaccatacgccctgctacttttacaactagtggcaattcatcatcttcgtcgatatctaccttatcagcagatatcattcaaccacttcatcaactactgataaataacaacaattcaactgtgacgcaaccagcgccacaaagctcatcgtttcaacgccgaaacaatccacaacgtttcaatcggaatcaactcaatgtatacactgacttcaatagtactacttcatctgcttcaagcattagtagttcaccaaaagatttcttcaccagagagccaccacggatccatagtaaattgatatgtgaagagattgcctctgccaataatcgagctgctaaagaggttttatcacgtgtatctactgatgaattgcgttcagttaaatcacatactgaattagctgaaactgctaatggagtgagaatgtna

SEQ ID NO: 12713 - DNA, 204 bp, Candida albicans
aggaggggttttgcaacacatataatgttaattgcacagtgtacaaataaattgtggagaacagaacaggggaaaatcatcaaagttgaaataataataacaaaggaggggggaagtagagactggggtagacgaagtagaccaaacgcgttccccggaaaagtacgggcattaccaagagtttgttggtttcttcttcaatga

SEQ ID NO: 12714 - DNA, 204 bp, Candida albicans
atacaatcaaaatttccctacgtcttgattgctcttttgctggttgaattgattttttttagttttacaattaaagttcattcgaaaggttatttttacactgaggctgctgctattaccagaactacaacaactgtcagtttcaattctgaacaatttactatcttactgctcaaccaacacttttcttccacacttagttga

SEQ ID NO: 12715 - DNA, 183 bp, Candida albicans
cattatatgtgttgcaaaacccctcctctagttgcaaattatagttcaacaagttcgacatttattcatacgtttcaagctataacacctaataaatcacattcaaaaagatttttcctcttttttaactcattcactttattaacagcaatctctaccacccatgatcaaataacatactaa

SEQ ID NO: 12716 - DNA, 189 bp, Candida albicans
tttttagttcatagatgttgtagggaaaaaagagggagtgattttccatgtgtgtttaccttatgcattgtcagtgttgcgttgtttacttttgctgcaaaaaaaattgtctatttggagactactagcacaactttgaagcgtaacaaagatatgaactccgtatcttacataatatcgttatcctag

SEQ ID NO: 12717 - DNA, 711 bp, Candida albicans
accaactcagtccacaattatctatcaacaatgaaaccaaaattagccactgccatcaagcttatatcagtgcttttgttataccctcttgagtgttttcctgcaatagtgcctttcagagattccattgaattggtgtttacacccgaagatatcaaaaaaagtaccgactatgcattgtggaaaattcctgctgtgaaaaagaactttaagactacggtcaagcaaaaactacttaatagattactaaacaaagaccttcaagaaatcaatccgaatccatatgacgaggatatttttgaggaacaacaacaaaaagtgaaagcaaatgaaatttcaaacacttttcaaacagtggaacttgacatcaagaaacctaatggtgttatgcgatcagttttgaaaggtccatcatcgacagagaaaaagcaggcaaagttggttgtccaaagtactagaaatacacttctaaaaaacaatttcaatgacaatagaacagaaaatgaagtaaagcttgagttgcaagagctcagtggtgaacaccttggatatctgcatcctagacgtgtcaagaatatcaaacatgacttcaacaaaatgccctcagaaatacacgaaaatgtgcctgattcagattccgacagtgaagaagatgaaaaccaaagtggtttacaaaatgagaagccagttgatccattttatgacgattag

SEQ ID NO: 12718 - DNA, 186 bp, Candida albicans
tcatctttgcaacaccaaaagtttgtaaaggaaaaacgcgcatactatatttttatctttcaaaattattcttttatgtttactttttctttctcatttattactcaatacaaaagcattcctatatcaattcaaccatgccaatcattccattggaagatgataaagacgatgactggattttag

SEQ ID NO: 12719 - DNA, 255 bp, Candida albicans
ttacaccaggcaatacaacaccagagatacttccaatacttcaatatgtctcaatcaacagaaaacagcaatatacacgacaatacaagtaacccatacctggtgctcacacaaaaaatgtcaaacttgaaagaaccaataaatgagttgctacgtaatcatgaagagctattggtgcagcatcttggtatagccaacaaattatcaagtattcccaaattaacagataaaatcgaatcttctatcagagaatag

SEQ ID NO: 12720 - DNA, 186 bp, Candida albicans
aaatgtgggattgtggacttaaaaatgaccaatagatttaaatacattcacatgattaatccggctaatcgtcataaaatggatcaactggcttctcattttgtaaaccactttggttttcatcttcttcactgtcggaatctgaatcaggcacattttcgtgtatttctgagggcattttgttga

SEQ ID NO: 12721 - DNA, 192 bp, Candida albicans
attctagaaccagacgagcctgaatcaatgacaataccatacttttcatttgaattatcagaccttcttaaattcgacattatgaagatgggtggagaaatcaagatcactggatcggaagtcgaagaagtatcaaaatttatgaatgtgttgatagaattgagtgtgtgtgtgtatggaaaaactaattaa

SEQ ID NO: 12722 - DNA, 684 bp, Candida albicans
acaacaatagccttgtcgaccactgatgttcacttgtgtaattatatatcatcaatgattgtcttaccagatacaccaccagtggctataaaatttaaaaactccaaagtttctccacaattgttatcagtacgagcagcaattgagctccaacaacaagtgactgatagcacctcctatttgattcatttagaagagtatttaaagtgtttattagcctatatagaccaaaatggaaccgggaactcgtctgtgctatgtgaaggtataccatggacaaatgttatctctccaaaacaaaggaagataccaaaattagggccaagcaccgacaataagattacctggatagcccaaaatgaattgtacatgacacttatcggaataacattgacatatttgaaaaaagctgcagaaatgaccaatgcaattattgacgaggaaacagataatgtggggcaatttaatgagaattggaaacatatcatgtcttattacaaaactgggatatcttatattttatatgcaatgaatttaccaccagtgcaacaacaagaacctccacaactccaaatgaacaatgtcttgttgagtataattcataaaatatctcaagtatccattcaaatagttattttgattaaattttcttggatcaatagaaactcgttccaattcaaagga

SEQ ID NO: 12723 - DNA, 252 bp, Candida albicans
  unsure (196),(197),(198),(200),(229),(239): Identity of nucleotide sequences at the above locations are unknown.
ttctttataatcatgcattcattaatatccaattatttgccaatgtcatcatcatcatcatcatcatcatcaactattcatcctttccatccagttaaagattatgaaattagattagctgctaaattagtcaaagatgcttatccagcatcagctaatgttcatttcgttcaaattgatcgagttgatcctcctnnnanagatatgaaacaatttattgttgctgaanaaagaaaggntaccattaactaa

SEQ ID NO: 12724 - DNA, 183 bp, Candida albicans
ggtggtatcaataatatttatttgcgtcccccctcctcacagataagagtaattcattctatcaattgcaataatacaaagggagggagggagaaattcataggtaacaatcaaggatctacacgattgaatatattgataactccatcaatgaaaaacaaactgggatatttaaaccgataa

SEQ ID NO: 12725 - DNA, 201 bp, Candida albicans
aataattggttggtttggaaggcaaaaagaaagaaagaaagaactaaagaaagaaagagtttgtttatgggaaagaaatttttttttagttgtgaaggtgatccactaaatggagagggagagagagacaaactttacttagtaatactctttcttattatttgttgttgtcgttacgatagtaaatatatatttatataa

SEQ ID NO: 12726 - DNA, 243 bp, Candida albicans
caaccaaggtgtcaatgtagtcaaaacgaactctaccaaaatagacgattcataacctacaacaactcagtcttccatctcctttcaatacccataaatatatatgtaaaatttactcatgtattaaaacacaaaaaattactctataaactaaaaattatacgtcactatatactatcactaattaaggcgggaaataataatcatatttataaaaaaaaaaacaaaatactaacgtcttga

SEQ ID NO: 12727 - DNA, 201 bp, Candida albicans
gccacctcctcttctcttgaaagattggctggttggttggttggttacttagtaattgaatactcttgggtttgtggttttattcgtcaattgcatttactgttatcgtttaaaattcgtgacgatcaaatagcaactaggacatggataaacagttacgacgatagaaaaaaaaagctgtacacgatattggtgaaataa

SEQ ID NO: 12728 - DNA, 201 bp, Candida albicans
agggaaatacaattgctattactcagttactcgtttcttgatggaattatagatcccaaatataatcttgcatatcttaaccatcatgtgttgcacaaactgattctctacgtcaaaaaaattccagcttatattccttttccttcgtctaatcttcaatattgtaataaactttatataaatatatatttactatcgtaa

SEQ ID NO: 12729 - DNA, 240 bp, Candida albicans
ggtcagtatttccatttttttctctctctctcctccgcctccccgccttatcccttttctaggctcccaccacacccctcacttctcccacacactgacacgtactcgcataaaataacattcgattttattgcgttgaaaccggagcctcctaaatatatgcatagactatcgggatggacagagcccaactcctattcacttattcttacatcacaccatgtttttaacatcccttag

SEQ ID NO: 12730 - DNA, 198 bp, Candida albicans
gatttaccgccgccttaccctggcgccttgaccgctcggccatccagtcacgtgagaagagctaactatggtgagctttttacaactcgaccaaacaactcttttcatgttgagaccataaatccacttatttatatagggcttataattcaaaacccacactatcatttacgtcttgttttgctgatttatatataa

SEQ ID NO: 12731 - DNA, 183 bp, Candida albicans
tttttttttctctgctccaaagagggtgtgttcttctatctgattttggtcccgcccccaactaggattactgccaaaagtttaaaaaaatatgccatattcaataaagaccaaaaaaagattgaaagtaaactattaaaaaaacattgtgtgagtagagttcacaacaagtgttacaattaa

SEQ ID NO: 12732 - DNA, 396 bp, Candida albicans
tgtaggtgtctaacttcttggtgtacttacaccgcgaatgataaatattgcaaccaatcacaaaaccgattgaaccttaatattttgctaagagatcatgaatatcctgcatatttcctcatagattacactttttctaggatgtgttcatatttgcaaactatgcttgttcagaattggttgcgaagttatcagctcaattttttactctataaacatcacgtttctctccgaatttttatattgatctttcattttgaagcaaccaatactttttttcatcatcaatatatatttcatctattaatggattgtctttctaatatatcaaagcacgacagattcacttgccaaaaaggatataagaaggaacctcactccccttttcatttttag

SEQ ID NO: 12733 - DNA, 573 bp, Candida albicans
tctaattccaactacaaattgtactcccaggagatctgtggctgtagaaatttttacttttgtttattcttgggttcaatagatgatcatttcactatatattcgaggacatatcttatctttttaacattgcatgacataatgcagttttacactatttatcgcaacaacacgaaggcaaaaaaaataaaaataaaggaggtttacaccacgaatgataaatattgcaaccaatcacaaaaccgattgaaccttaatattttgctaagagatcatgaatatcctgcatatttcctcatagattacactttttctaggatgtgttcatatttgcaaactatgcttgttcagaattggttgcgaagttatcagctcaattttttactctataaacatcacgtttctctccgaatttttatattgatctttcattttgaagcaaccaatactttttttcatcatcaatatatatttcatctattaatggattgtctttctaatatatcaaagcacgacagattcacttgccaaaaaggatataagaaggaacctcactccccttttcatttttag

SEQ ID NO: 12734 - DNA, 447 bp, Candida albicans
tttctggtgcagctggtgatgcccctgggagtggaaaccgataggtggtgctcccgccatgggtgccggaaacagctgttgctggaacaagaaatttttggtccaggaagcttagttggtggtctgggctcatctaatagtacaattccttttggtggctcaggttcatctaatggtacaagttcaggctcaggttccggctccggagctggtgtcggttctggttcaggcagtggttcaggatctagaggtagcattactggaaactcagttgctactggtgctagctctggtccagcaggtttaggcatttcctcttctattagtcaatctaccactagacaattgcagacttctggttcctcaaattcaagtagctcagctggtatgggtaatgttgtggtcggaatgaatgctgttgccttagcagcattggttttgatttaa

SEQ ID NO: 12735 - DNA, 183 bp, Candida albicans
aaactgaaaaacacacgtttggtccaacccccctttcatttgaaagcacaaatttcaatcgaaaggcaaaaaaatcttatacaagagacaaactacgcattggttcattcaataaataagaatgagggcacagtcgatgcttttaacgagttaattcattgtttgaacctgaatttttattaa

SEQ ID NO: 12736 - DNA, 579 bp, Candida albicans
gttgtaattttcattttgatcctgtttttctttatcacaattcatttgttgttaacttatcaaaaaaacatgaagtattcgactttagcttggcttgttatagcatcatatacagtatttgctcaagatggtacatctgtgaccggatataccacgactatagtgattcctggctctcctcctgctggtgcaggtacggcacacggtgatacagagaatacgggaactgttcatacaactgagcacttgacaggaactgaagaaacacatacaactggtgctacaccagaaacaacaactattgttgctccaaccactacccatgagaatacaactactcatgagacgtcagtcgaaaatacagcaaccgttcatcataatacaaccacacttcaccataatacaaccacaattcatccaaacgccactggaactgaaacccatactgaaactggaactggtaccttaacaggcaccggaaccgaaggaccagcacttacaacaacaactgttgctgaagccttctcattggctgctggtgcatctttgggatatttggttgccttattgttcttatag

SEQ ID NO: 12737 - DNA, 201 bp, Candida albicans
aaaaattttttttcttcctcttcttcatcacttttctttcgtattgtctttaaccaatcatatgagtatgcattacatttcctttctaattgcaaaatgtttatattaaaatattatgtttatgatgataaccttactcagctcactcagagttttgacgatgctgataacatttcctttttccaacattcatcattttag

SEQ ID NO: 12738 - DNA, 264 bp, Candida albicans
atcatgaacataataaatgcagaaaatataccagagattgcaagtgtggaagcaataatttgtgggaccttgacaatttcggtactaatcacttggttctttgaaaacccaaaattccatacaacaaatgcaatgagtaaaactgggcccaaaacaaaacaagaaataactgcagcagaatcccaagggaaatcagatgtaccaaatgttatagccaataataatatgacagagccagcaatcaacaagaatgtaccgaaataa

SEQ ID NO: 12739 - DNA, 198 bp, Candida albicans
gaagaaaaaaaaaaccgaatccaatcatatcactcacatcaaagaagaaacaataatcaaatttccattgaaacagttacaatgaaaactgcagctagactattaaaatacgttcaatcaataaaatttgtgggtggaccacatccagcaccaagtatgttgcacaaacactttctcccgatagttgttcaatactaa

SEQ ID NO: 12740 - DNA, 195 bp, Candida albicans
aaactaaaaggagtaagaaaatggcgtgtgttgaatgcagacaacagaaatctcgctgcgatgcctttgaaaagcggcctgatccctgcacaaggtgtgcaaaaaaaggactacattgtgacgtcaagtctgattacaaaagaacctataaaagagcacgtatggcacaaattgaaaaagaatttgaggagttga

SEQ ID NO: 12741 - DNA, 375 bp, Candida albicans
attccacatttatttgagtatagatttttccggaagattgtgaatattgattttagattaagatcaaaaatcattacattgatgattggggattcaggggctagagataatggcgataacgagtcgattatttatttacaaacacctattgaagattttgctttggggtcatcagtactggaagaagcaggaggttctacaccgagatgtcatgatcatgatgagctttcggcaccagctaacaatttcagaaagattgcaaatctgttgctacaaattaagcttcaaatataccaccttatggaagttgactctatcccaaagtttttggaaacattaggtgtaacaagtaataggataattacaactttctag

SEQ ID NO: 12742 - DNA, 306 bp, Candida albicans
aatgtccatcaatcactttcaacaaaatcttcttcctcgtctttatttatgattagaaagccagtagtgacaattgtggctccaaatacatacaatagattcaatttgaattgtttaaatacccaatcacccaccatagccaaaggaattgtcatcgacaatcctactgtgactgtcaaggggcttgtcaataatacagcattacaccaacagaaatcactcacaaaagtgatgactgcattcgcagctataatcgtcgccacacttgatgttggtggtagttcaaatttctcaactctaaaataa

SEQ ID NO: 12743 - DNA, 318 bp, Candida albicans
attaatgcacccaacaatgcaagtatattgccccatagtataagtagagctgaattatcagtattggggttatcctctgttgcatctgcttttgtaacaatcaaaacaccagcaaaactcaataatatacccaatatcttattttggttaatcttttcaattgataccaagtatccaatgattaaagtaaagaaagacgatgttgacgacaatatagtttgtgatgccaccgaagtatacgacaaggaagcattaataaccaagttggccgaaaaccataatacgataaactgtaaagataacttggctgtttcgtaa

SEQ ID NO: 12744 - DNA, 264 bp, Candida albicans
gtgtcatcctcaacaactgcattgaccaagaaactggacagcacccaaaatataaccactgcggcaagattaatcaaacctagtatccatttttgtcgggaatgtagcgtgctatctggaataaaaaatgcacgtatataccttagaattgtgagttttatgttgtcggttgttgacattgaatcaatgtatgtgatcacacaagtaagtaaaggaagaaaccttcttgtaaaactgtggtgtcaacaagtatatataatgtaa

SEQ ID NO: 12745 - DNA, 201 bp, Candida albicans
ccaccaaaagcattaccgctcgacccaaataaaccaccacctgctcctccagtgttcgtattgccaccaaatgccccaccagaagaaccaaatcctgtagctggtttaccaaaagtgctgttagcaccacctccaaaagtattggatgcacccgaaccaaaagttcctgctgtattggaaccaaaaggtgactggttctga

SEQ ID NO: 12746 - DNA, 267 bp, Candida albicans
tttgtacctccaaatgcacctgttgtagaagcagccccaaatggagaggtcccagctggcttgttgccaaaagttgatccaaaagcagacccaaaagctgagcctgaagggtttgctgctccagcagtgccacttccaaaaggtgaggcaccagtagcagcaccactaaacccaaacccccctcctgtagcattagtgcctgcagcgccaccaaagccggcattagcagtagcacctgctggtgggaaccttcttccttgttcgtaa

SEQ ID NO: 12747 - DNA, 366 bp, Candida albicans
tctttcaatctcaattcttcaaaagagaaatttttatattccggcatgcaacaaatgttttggaaaacgttagtcatgttagccgaatccttttctgtgaatggagtaaattgctttgcagctgtaccattattgacatttgggtcgacacttgcgccaccaccaaaagcatttgtggtagatgctccaaaaggtgaagatgcatttgcagtagtggacccgaaaccaccaaaagttgacgtagctggcttgctaccaaataaaccacctccagtagctgatgacccaaaaacagatcctgaattgttggaagacccaaacgcagatgtagtttgctgtggttgttgttgttgttgttgttgctga

SEQ ID NO: 12748 - DNA, 330 bp, Candida albicans
ccaaacggagatgaaccggtcccgttggccgtggaaccaaagagtccacctccagtattacctccaaatgccggtgtagtatttgtattagagctagcaccaaatgcattggatgaaccaaaccctgttgaggaattggcgttgctaccaaagataccaccacctgttgtgtttgtattagttgatccaaatggtgatgccccagtgttagttgtagcggctccggctccggctccgcctccaaatggtgaattgttggttgtagtactagaaccaaatcctccaaaacctgatgatgctcctcctccaaacatttcgatattcaattga

SEQ ID NO: 12749 - DNA, 342 bp, Candida albicans
aaagaaacaagtaaattagaatcacccaacgttattttctttctttcaatctgttttgtgcgtgtttatgtgcagtgtatgtgcgaaaataatgatcagctgaagttcaaatattttccttttgaaggcaacaactcttcatacaaccaaaaaaaaggaaagggtaggaaaagaaaaaaaaaattcttaacgattcatttatcaactcatcaccaagttaacgccacaaagaatagttacagatatcaagtttataaaaatcgttcgagtttatctgattttgtattatttagattatacggttttttttccttagtttttgtttatttcggaattacataa

SEQ ID NO: 12750 - DNA, 384 bp, Candida albicans
atagacaattgctcaacaatgggtcaccatgcatccaaacataagcataaatcgggtattcattcaactacagcaaaagtaggcaccccatcctcaaaacccaaaagttcgaccactgctgctccttcaagcactctgaaactgaaattgggatctaaactcacgactagatcaacgtcaagaaaatcacaatttacaaaagagtcaagaccattaggcagtaaagatgaaaatgatcatcaaaataatgttacgttaaatgctaaagaagcactggcaaaagctgcggaagaacgattacaaaaactacaaggacaaaaatcaggacaacgtgatagactaaaagataaagctaaacaaagcaagaatgataaaggattatag

SEQ ID NO: 12751 - DNA, 333 bp, Candida albicans
agacaactgcttgcgatgggtcaatcattttatgaaaaggaacaaaagaaaattaaatcaactatcaaattgcctttgttagaattggtattgaaattcttaccacatttacaaccaacaatacaagagaaagatgatatgtgggaaatagtcgccattgaattaaccaatttacaatattcaaaaatcttatcttcgtcctcgtcatcagcagcaacagtaacaactgcaggaacaatggcatcgggtggactgaaaaatgaaaagtcgtattcaatactacagcgtacaaaactacttgcgggccaaaaaccatcgagtaaagtagtataa

SEQ ID NO: 12752 - DNA, 378 bp, Candida albicans
gaacttgaatctatgcctgaattaaatgggatttatgtacgtgattattatgaagaattatttaacaagtttaaatctgattttcaattctcgattgccatgaatcggccagatgtactagatggatctaggtcaggtaatcctatgatggcaaacattattaaagatagaagtgatgccttgttatatgaattatatcgtttggaatttaaagatattgaattgatttccaagttgagtcaagaacatttagaaaataagttacgtaaacaattgaacaaactatataaaataccaaaccatgacgacaagcagcaagagggcgatgacgatgacgttttcactcacagagggcgaaggtccgcgctattggtaagg

SEQ ID NO: 12753 - DNA, 216 bp, Candida albicans
ttatctctatcaaaggtgtaccgcatcaaagctctctattacatgactaattttacaaaggataacagactttggtatataccaacaattaatattggctacgatagaggaatctttattgtctttcttagcacaagttgtagaaccagtaccatgggtatcgccgtcccgcgctatcgcctaaaaataaacaagtccgctaaagaaaaaaaataa

SEQ ID NO: 12754 - DNA, 336 bp, Candida albicans
atcccatttaattcaggcatagattcaagttcttatactactttactcgatggtttttggcccgcaagtagttttgtacgctgtagtattgaatacgacttttcatttttcagtccacccgatgccattgttcctgcagttgttactgttgctgctgatgacgaggacgaagataagatttttgaatattgtaaattggttaattcaatggcgactatttcccacatatcatctttctcttgtattgttggttgtaaatgtggtaagaatttcaataccaattctaacaaaggcaatttgatagttgatttaattttcttttgttccttttcataa

SEQ ID NO: 12755 - DNA, 243 bp, Candida albicans
tacttctcgtttatttttttggattaccattcaacatcatccatgtcatacaccggaacgacaggttcaatacctcaacgatatccaatatcagctagtaatgaaaattctcaactattgactagcagatcaaaacataatacctattcaaatatcaatcacaccaacaatgagggaaatgctaactcaatagaaaagaatgataaggacaaagctcaaaagaagtttggaggcaagcgcgcg

SEQ ID NO: 12756 - DNA, 264 bp, Candida albicans
aagaaatacagatttgttatagagaagcgtcccaatacaaggtttttctcgcaagttttgaatgaatcagaagagtttattgatttaattgacaagtttggaaaggtcgccaaatttacaccagaagagttattgtttgttaatgaaccacagttgattgaacccccgcaaaatgaagcccacgatcatcaaataaattcgaatttcttgggattccctgttgatattgatagtctaaaggaaccaacaactactcaggattaa

SEQ ID NO: 12757 - DNA, 1323 bp, Candida albicans
gcacaagagtctatattgggactttctattaatttagatagtcttttaggctctggcaacaacaaaactagaaattcaaatggatctacagacaaattacaagatttggcccctgaaacattgtcgttacaattatctctgcatcaacaacaacaagagcaacccatggcaggtttatccattctttcatcattaccattcacctccattttagcacttaccactgatcaacctccatcaatagatcaacctcaacctgtatggagtcagaataacactttgaacagtcaaaatcatgaaaataaatcactaacttctgaccagtccacacagcatgataagcaaatgcaattaaccacccgaggtccgttagaagttacacgaacacgaaatccagaacaggacccggatccacaaccggtgctttcaaccgatcggccaaaacctttggaagaaaatgatggggtgataacatattatccaatttttggagatcaacctagtttggtaaataatgggtctttcagacacccaaggaaagtgtttagaagactggtccaagctcaatccattggagatctcactttggagtatatccctgaattctttaaacaatatgagatcgatattaatcttccaaattttccaattccaaaccggtttccaaattcaaatcagtttccagtcattccagagtttagagtaaatgaaacaaatttagatagttcgtcaatcagcaatggcgaccaagttctacaaattgaatatcacaaggatacaacagaaaatgggaatacagaactagcaaataacggggaatcaattaaagagtcagaagtaccgaaagagcaaccggtggtatcaacaaacgaaagtcaacctactgttgaaaatgacacatctgctgcaaatgaacaggaggtacatcctaccacttctacagtccaatcttcaaatacatctactgcaaatgaagaagttgaaagagcgccacaaactgctccggtcttaccaccaagaaaactcagtttgaatgattatagaaaaatcaagatgaaccaagcaaatttgccccattcgccaacatcacaatcattaccacctccaccgccaccgccaccgccaccgcctccacctccaccagcatcttctcatagctcatctaataataaatcgtcagagagatctcgtttaactgatcgtcagtcgtattcaagtttggccattccatctaatcgtcctaaatcaaatttaaagagaaagggaacaaatgatgagccaaatagacgagctaaacaagtaaaatttgccaataatatctga

SEQ ID NO: 12758 - DNA, 198 bp, Candida albicans
ctacaatacaaaatggctcttgctccaatcacaggtactttaaaaagaaaaatcataactgacattactatcggttttgccgctggttttggtttagcttacttatactgggaagtcgaacataaaccaatcattgccaagagagatgcttattacgctcaattaagaaagcaaaaagaaatcgaagaaagtgcttaa

SEQ ID NO: 12759 - DNA, 204 bp, Candida albicans
agaccaattcacctgctaaagatagaaaggccccaaataagcttgagttacaataacttgagtttcaaagatagacaatggtttccaatttctatcacatgtgagactattaaccgcggtaatggagacaaaacacataaagataacgaaacacgtacaagagttgacagtcttaaggagatgaggaaaaaaaaaaaaacttaa

SEQ ID NO: 12760 - DNA, 234 bp, Candida albicans
cgcactttttctcctccatatttgttctttgaaataaagtataaaaataagattcaagtcacgattacttttcctttactttgtcaagtttttatctcagcaaaaatcaacttagtttgtacctatcaagaatgtttgagtataactacaagtttggggagacagtcgatgtacaaaaagagtttggagtcactaaaatatcagacaataaatatgttggggtcaaacctttga

SEQ ID NO: 12761 - DNA, 396 bp, Candida albicans
agcagagccaaacagaacacaggaggagcaatgtatcagatgtctccataccccactgaacaatttccgggccaactgcaacctcaactatcacaacaacaacaacatcaaccatacgcacagcctcaacagactagcaattatgcacaacaatcacaaacagtgccacctcaattcacccagtctcaacagacacaaccacagtatcaccaatcgcatacaaggacaggctcacaccaagaagttccacaatatctgggatacaatagcaacaatatcccaccaccagccacaacttttaaccagtacccaccaagtcaattgcaacaacaagatacaagtgcaggatttgggaatgatgtatataatagagctgcacctggacaaccctactga

SEQ ID NO: 12762 - DNA, 312 bp, Candida albicans
acagtattttacaaaagaatgaattttaataaaactgaaagtgaggcacctgctagtagtcctgaagtaaaaccgaagcccaaaccgaagccggtaccaaaaccgaaacccgagatgattactaagaagcaagaactgccggaaaccagtatacgaatagcaacgacaactaaaccgccaccacccgtgcgtcgtctttccacaccccataagtcaccttctccaccaccagttcctccagcgagaaattatagcagggctcctgctccaccacctccaaaacaatctggccctccaaatttggatatataa

SEQ ID NO: 12763 - DNA, 453 bp, Candida albicans
  unsure (140): Identity of nucleotide sequences at the above locations are unknown.
ttatcgagtggttggtatgccaaaaccagtggaccattgcagttacccaaagtatttcatggaatcaatcacaagttttcgtacacgacatcatcaggctcttatgggaagggtaccacaactgtaactgtgagacttanagacttatccatagtcacatataaatttgaatacagtaataatgacattagtaacgtaaatgtggttattgagaaatatgttccatctccaatcgatacaattcctttcaaacaagaactcattgctaaccatcaaagattcggggagtatatagcatcttggtgtgaacatcacagaggtaagactgttggacgaggtgagtgttgggatttggcaaaagaagcattacaaaagggatggcggaaatcatgcattcgtatcatgttataccatccatggttatccaatattacaaattgggaatgctggtaa

SEQ ID NO: 12764 - DNA, 453 bp, Candida albicans
catcttggtgtgaacatcacagaggtaagactgttggacgaggtgagtgttgggatttggcaaaagaagcattacaaaagggatggcggaaatcatgcattcgtatcatgttataccatccatggttatccaatattacaaattgggaatgctggtaatggagtctattttatcaacaattcacagcaactcgatgaggtaagaagaggtgacattttacagttcaacgcttgtacgttttatgatgcaagtactggtgtcacacaatctgcaggtgccccagatcatacgtcagttgtgattggtaaactgggagataaattgatggttttagaacaaaatgttggtggtaaacgatatgttgttgatggtgagataaatttgaagaacttgacaaaaggtgaagtttacgtctatcgagcaatgccacatgaatgggccggtgaattatag

SEQ ID NO: 12765 - DNA, 273 bp, Candida albicans
aaaaaagacaatttcaaaaatggtgtctatgataatctaatctgttttccgagattggttttcacacgaatgagaatacacccgatagtcgatgatcataatacttgtttatgtttatcattaaatattctgaaatgtatagtgtcaattgacttaaaacgagtcactattttagccaattcatgtatagctactattaacaagggcagttataaattgtacagccaccggcaacgttacatgaaaaaaaaaaaaggaaaaccaagatcataa

SEQ ID NO: 12766 - DNA, 258 bp, Candida albicans
ggagagagaagttggttggtctcttttttattcttgtttttgttccaggttgtcgtccctctctctcccactccctctcacttctttgtcgcacttgttttcttactctgttgctatttctttttgtttagtactactatcgtgatgagtgatggtggtggtggtggtgagtttactttgttctattttttggttgtgatgaagaaagaaattacattgtcacatacaactaaatttcgtttaatacagtttacttaa

SEQ ID NO: 12767 - DNA, 195 bp, Candida albicans
  unsure (73),(194): Identity of nucleotide sequences at the above locations are unknown.
tggagccaatttttcctggtggcaaattccattggttccaggaaaggttccgggattgaggaacctagttttntgcccctcaaaaattttgttggtcggggccgtgggttccaattaattcctggaacattgatcaaacgtgattgcgcatactggaaaatatttcatgttgtaactagagaagaaattttttng

SEQ ID NO: 12768 - DNA, 423 bp, Candida albicans
gttataaccaatccacctcatcaaccagcaattattacaacatctggactgtcttttatgttacatccgccattgaatcaacaaatattttccttacatccaagtaatgaaaatgtgaacccacctcacagtactttattacatagtggctccaccaatagacaaatggatactatgccactacagggatctggagggaggcccgtacaaatagcaccatcactggtccctcctggtcctcgatctgcaccgtctacagcaatatctatttcactgcataatgggccacaatatataccttatgaaaattatcaagaactatataattatactcaatcattacaacaaagtataaattatttgagtggtaatttacaaaaattggaagatcgaaagtctggtagtgatgaaaaaccattgtga

SEQ ID NO: 12769 - DNA, 312 bp, Candida albicans
tataattgtgttagaaattgcaaaagccaaaacatttgtgaggatttttttcaactgtatttattctttataaatttgacattttcagctagaagactagacactgatttggttttgaaccgttatttattggtttattctctagctttgcttgcacttgttcattccttcaccaaactcattcttggcgttctattgtattcatacaaaactaactttagattaagtaaaggtactgaaatttttaattcaagtaatgatacaccactttcagatataaaattgataagattttatctttccaatagttaa

SEQ ID NO: 12770 - DNA, 198 bp, Candida albicans
cttcactacactacccaatcattatcattactactaactacacacactttctcctttgctcaccccccccttttttttgtattccttatcattaatcatttacaaataactactcttttcattactacaacaactattaagataatattatatttgttaatcgatcacttggcttccatatttgttttatctgattag

SEQ ID NO: 12771 - DNA, 1773 bp, Candida albicans
agtcccaccgttccgccacaccctccaccttatcatatccagataatgttgaaaacaagtttatccccaaattataaacctgatttgagtgattctgataccagtaatgataaagtgaagaatgatactgctgaggttagtaaaaccactggtaaaaacaatagtaaatctacatctagattaactacaccagtagatgaagattggtcaatcatttcgtcatcttctgatcttgatattgatgatgaacggtctactactagctcccaagattatcctcaattaataatcaacgattcaacggacttatctattttaaaagtacccgaacaacacgtacctcaaacatccttaaaaacaggtaccaccacgcaccaaaatgaagaggggaaccccaatcttgaaacttcccaaactacaatatccacaccttcagactcagatttggaaatggaatcagattcaaattctattttgagtggtgggagtagtaacaacaacaatgataattctcttaatgttggttctaaaatccggtttttcgaaaacttgactcaattgaatgattcaataaaacaaaaatcaaatcaattttattatgattttgccaaaattcatttagataattatattgatgatcaacaacacagacaagaagaattgacaaatgaagaaacgaaggaaggcgaaatagaagaaaatttggatgatactattgaattagtatctaatattgagtcgatacctagtgagaatggtgttattgattcatctttgtctacaataaaagatagtcaagttggggatttaatactgaaacataacgataacaataacaacactattgttgcaaggaaatctaaaccagtattggttcgtgcagttcaaaacttgcaaatctttttagataaccattccgattatctttattattatatgatggcagctatggtggttggtattattccagtgatttatagtatcaagtatgttttggttcctaaacaagttgttgagaaacccttgacagcttttgataaattgaatcaaatgtgggaccatttgttatatgaagaagaacaggaagtgattaccaagagaagtatatttttcattggtagtggtggtagtaccactactgggaagcataaaactaataaattgatcaaatttattaatactttgcaatacaattttcatgatagagctctccctcagtattatgttatggttgataaagtgaatttttatagtaacaggttttggaaacaatctcaagatttgggagcagagagtttaatcaagttgaaattgtggggtgatcaaagtgttgtcattctcaacaagtattcggttattggattgaggaagtttgattattacagtcaagttggactagataattttattaaatacagagaattaagcttggataatttacagagattttattctagagcaggtttccttggtaaaagatacggccataatgtaattgtgggatcaaaacgtatattgaaagatatcactcatcaaagtcaacagttgaagacttttatggaagaggttttcaatagtgattcttatgatgatttgaaagaaaatactcatcaacaatggacacatttgattagtacttataatttcaatgcagcagctgctgtttccaccgcttccaaattcaaatcaagattggataagaatgctgttcaaatttataaatttggtaagaatttagctgattctatcaaaaacgaattagctggttcttga

SEQ ID NO: 12772 - DNA, 216 bp, Candida albicans
gtggtaatttacaaaaattggaagatcgaaagtctggtagtgatgaaaaaccattgtgagaaactaaagatgttggttaaaccaggaaaggacaatagtttgaggattgccaatttattagaactttttaaaattagaactaatataattgtgttagaaattgcaaaagccaaaacatttgtgaggatttttttcaactgtatttattctttataa

SEQ ID NO: 12773 - DNA, 228 bp, Candida albicans
gccaacttaaattgctcttttattgactctttctgttttttttttgttatatctatacttgataggaaactgaaaactactgatgtgaaaagcacctcaaaagccttacatatgagcatattacaaaaacaaaagaactccataatgagatttgttctcagtttaaccgtttgtcatttatatggaccatatagtagagtattattttttttttggtattattattaa

SEQ ID NO: 12774 - DNA, 234 bp, Candida albicans
aatttcatttcattgttgttcattatggcgaaggaaaaaaaaaatactgcatacgacagaaagggggctttcagaaaatggattttgtgtactaaacggaaagatagacaaaaaaaagacatctcattcgacaaacaaacgcgtcgtcgtcatcatcatcatcgtcgaactacgccaggacagccacacaggctaatttcaaatttattttggccaaaaaaaaagaattccatc

SEQ ID NO: 12775 - DNA, 231 bp, Candida albicans
aggttgttccattatcacagattaaacatttatacttttaataatcaagccagtattgtttttacacatcactgccacacaacgaacattgtcaccgcaaaatacctgctatctgttaacaagccactacagacttttaaaattttaagaaacaataacatacagatccaagctcagctcaagacacaagcaaaaagaccgctcatactttatcccaccacatgtgtatga

SEQ ID NO: 12776 - DNA, 333 bp, Candida albicans
aaaccaatctgtacagcaatggatacacaaactgggaaaggagtaaggagaagacgacaagaattgatagatgctgacgataatgaggaagaagaaagagaacaaataacgcaacagggacctttaaaggccacttcaacaatagaaacagcaaaacccacacctgagtctaatactcccccactaccactaccatccccaccagcaccagcacaacattataagagaccaaaactgaaatactatcaattcaaacaagaacttgaagaattagaaattcaagaagatttatcaccaaggcaacaatcacgattagaatattttaacaaataa

SEQ ID NO: 12777 - DNA, 354 bp, Candida albicans
catacagatccaagctcagctcaagacacaagcaaaaagaccgctcatactttatcccaccacatgtgtatgaatcgaccaaaatatcaagaatctcagtcagaaccaaacaaacttgaacttcctttacagatgccttccactaaatttgatctagaaaagcaacaatcacagtcacatgacaaacaacactgtgcaaataagagaaattatctttataagttgatttttttattcaacttcattagtttgttaatactagggttggtatattattccacagaagtaaatcctcagatttctgccaacctaaacgaattattatataagatggagaaatgcaatgatttataa

SEQ ID NO: 12778 - DNA, 183 bp, Candida albicans
tttcatcttatccaccacagtacagctaataccatagccaacgattcaagacttgaaatatgtacatcacttaccactgttgttgaaaataaagataaaaggttcataaaacggaatttccaatctcagaaaggcaatgcgcaacacaagtttattacatcatttgaaattagcgacaactaa

SEQ ID NO: 12779 - DNA, 201 bp, Candida albicans
aacaatccaaatttcatcttatcaaataagcaaaccatctcgccgccactgcctcccaacaataacaacaacaattacaaccctagccaacacaatgagtcttcaaatgtcattagttttttgcaccttgattggtcaaatgattacgttattagttttagttttaccattaccttatgtcgtccgacaaaaaatcgttga

SEQ ID NO: 12780 - DNA, 225 bp, Candida albicans
atcgttggctatggtattagctgtactgtggtggataagatgaaattatcattgttaacaaagaaaagaaacgcaataatggagattacttttattattgtttttataaacaattccgaggctccatttaaattattattggtcttattattgtctttgcctattgatcacaaaaggataaagagtaaacgatgttatgaaactagtttttttgtccaattgtaa

SEQ ID NO: 12781 - DNA, 207 bp, Candida albicans
tggttgatacgaccgatgttaatatccgtgttttggtttactattaaccgtggaaatacaataatcagaaaacgtgcacgaagacaaaaaaaatggagagcgtccaaaaccaaaacaaaaaaaaaaccaccaaatgaagggaaaagaaaattttgttccccgattgaaccggttacaataacggcaacgaaagcaaaaatcaattaa

SEQ ID NO: 12782 - DNA, 183 bp, Candida albicans
cattgtactgcagagtccaactcgtgcaaattagacactcctaaaactatgccagatttatatttaaacaaccattctttaattgcaaatcgagtagccaagtcaggtaattcaacattttcttatttcaatttttcggcaatatcagcaagtcgttgttttaatgctggtgatgcaggatga

SEQ ID NO: 12783 - DNA, 195 bp, Candida albicans
tttcttttttgtctttttgcttcatttaattactcgcctcaattggaattaatgaacgaacgaacgaacaaacaaacctaccactttggaaagaaaacgaaaaaaaaaaaattgaataatcaacatttcaaaaaatttttcaagtcctttcaagctccacacacacctttaatcacccaacacacaattaattaa

SEQ ID NO: 12784 - DNA, 219 bp, Candida albicans
ctgaatatcaacaaaatggtggtggtcaattcagtaatgcccttgcttcattccaataaatgtataacatatagacaaacatttataaagaagaagaacaacaacaacaacaaaaacaataaggaaaacttcaaaatcaattgctcactgggattacattataggacttccttagaaagacttccacactccaacccctcttcttgcttcattctgtaa

SEQ ID NO: 12785 - DNA, 240 bp, Candida albicans
acactagttcatatgtataccgagtttcggaacttaacctcgagatgccatcaggctaaactacacattgctaccgaagtgggatctactttttttaaggtgcactgccgatgtctcgtctactacatattcatctcttttgaacccaatcctgaaagtgtgattgaagaacatagatgtcacagctactattggtattacagtgccagcactgctcatcagccaagcatgattctatga

SEQ ID NO: 12786 - DNA, 1026 bp, Candida albicans
aaagatatgtcaataaatcccaacttgaaactattcaaattaataaacaataggaaaaacaacaacaactcaactgatacaatgaatagtcaacaacagcaaaaatcacaacaacagctgcagcaacagcatcaacaccaacagaagaacaaatacaattcttttgatgcaacttcaagtatattatccgattatgatgatttggaagtaatcgatgatgatcagtcactgtatgttttatttaatcccaaatcattagcactgtcttcaagagggaaacaaaagagccaacatcatgattcagatattctttcctttactaatacttccaacaccaatgacgagtaccaatcagacactgaaaaagaggaagaaaatagtgagattgaagaagaagaagaggaggaggatgaagcgcaagaagacgacagagtttctattgatgatgaacataacgatactgaggttttaaacagagataggttgtctcataaaataaatagttggtataccgccaacgttgtaagttcaagtcatcatcaactgttaattgacgagagaattgctagttgggaattagatgaagaagcaaatattttggaaagtagtcaagagtcgctgaaactgttggaagaaagcaaatctatattaagagagttttatggtgatgatttattcaagtatttgaatcaagatgaaattgccaaagtcaaaaagttccataaaatggttgatatcaagaattatttattagataagacaaacaagaataataattctttattggatcaattactttataaagtattattattcaaagagaaaaagcacaatgatacaactttccatcgacaatataatattggtactactgattatatcaattatttaacaaaagatgttccctcctatagtccagcatttgttgcaccatcaacaatatcagatacaacaactggagggtcatctttaatcatgtgtggtggtgttggttttggtgggtctgcttcttggaatgacatatga

SEQ ID NO: 12787 - DNA, 2082 bp, Candida albicans
ttagatatgaattcatctgccactacaacttctacaattgctaatccaccttcactcaatagtggtgtgtattctcatatttcttctgaaaaaatgctgcaaacatccaataaatctccgtcaccaccccaattgtttcctcaaatgcaaaaactatcacaatcaaatcaatctcaagatgtcttgttcaaaatattcacctataccattattatactccccacgttaacttcaatattattccccatcaagacaactatgccacctagcgaacatgcagggaatcttattatagatttattgacggtactattgctaagcttagtagtcaaacatacaattgaatggccctataattggttgagacaactacaaaagacaaaagtaatgttattgcaagatatgaatcgagaaaataccgataaaactattttattggtacggaagatttacacttttgaaataatagcattgatttcatgtttggtgtcttgtatttttagttcaattttattaatatggacgagacagtatactataattgatcaaaaaagaaagaaagtagttttcaataatgtgaatattgccttgttgcaattttggtcactttttagagtgattattactttcactgacagtctccaacaatcatcgatgcatacaaatcatctaagttgggaaactccacaattgaaaaattggtatcaagatttgtctcattattttttaccaaatgctagtaatcaaatactattggatcatttgcaacaacacaatcgacaatttgatcaattgaaaatggatttaatttcgttacaaaacgaattagaagaaaagaagagtcttagtaatgattctcgagaaagctcatttacaccattcccgttgaatatgtcacccactttgttatcaccaaatccttctgtcaatttatcacccactaatagtcgcaattatgtgtcgttcccattcaaagctccaccttcttcagaactgccagtctcttcacctccagtaccaaaacgtaaatcatctactatgaagtcatcatcgaaaaaatctcaattaaatacgataatcgaggaagatgattcaacattatatgactccaaagaaaatacatttacaaattttgatgaaattattcctggaattggtataactacaagaccgccgactttacttgatgagatcagaagtatggtgacttcggttagacgagaagtgtcttttcttgacattattaaacaccctaatgctgtctgtaacttgttattaaaagaatttgcacctttgttgaatcataattttgaattaggtgaatatgatattgttagaatagtggctactgaaatttttaacaattatttacataaacttgttcatgatataagagaagagcttgggaaatattggaattatccattgtactttgtaaagaaagcggttatattttttgcattaagactaccaatttatgctatactgttatattttagagtactgttttatgtaccttgggttttgttccgaatgcttgtattagaaccaattgtgcaaataagtaatttaatgttgatggtttttaaatttgccttattaacaataactaccatgactcctaaacttactatgagtgctccagtactgacttcttctccatttccatcaccattgctgactccatcatcttattcatcttcattgtcatcttccttaccaccatcaccgaaaacatcagagaaatcatctaaaattattacaaaaaaatctcaaaagaaactgtcacattcgaatcagaaaaaactggttgtagtgcccagagttgcaaaggagacagtgacttccaaatttgctatgaaacctttccatctatcacctattttggctgacctgatgacctttgaaaatggtgtcaataacaactacaacaacaataataataatcacactagatcaagaaagaaaatcaatttgcaatcgattgatacaataccagaagagcccaataccattagcggtgggaaaaaacatgggcgattctacaagtattcaaacagtcttgctttatacgacgattag

SEQ ID NO: 12788 - DNA, 636 bp, Candida albicans
ttctatacacgaccatctatcacattcgcttgctttttttacacactaaccactgagagacactcacaacgttatcgattattgacaaagagatttttccggtatagaaaaagagagtgcgaaaaaaaaatgaaagtttctcaaattttaccattagctggtgctatatccgttgcatcaggtttttggattcctgattttctgaacaaacaaaattcaaattcctacccaggccaatacaaaggcaaaggtggctatcaagatgactgtggggatgattacaagaaaggttataaaagcaaaacctactccaaggtcaagcccattactagcactgattgtaccactccaattcaaccaacagggaccaccaccgggtatacaaaagacgttgttgaatctacctcctacacgactgacactgcttatactaccacagttataactgtcaccaaatgtgatggcggttcttgttctcatacagcagtaactacgggtgtcactatcatcaccgtcactaccaatgatgttattactgaatacactacttattgtccattgacatcaactccagctactgagtccactccagctactgaatctactccagctactgagtttcactccagctactga

SEQ ID NO: 12789 - DNA, 1674 bp, Candida albicans
catcaactccagctactgagtccactccagctactgaatctactccagctactgagtttcactccagctactgaatctacaccagctaccgagtccacaccagctactgaatctaccccatgtactacaagtactgaaaccactccagctactgaaagtactccagctactgagtccactccagctactgagtctactcctgctactgaatctacaccagctaccgagtccactccagctactgaatctactccagctaccgagtctacaccagctactgaatctaccccatgtactacaagtactgaaaccactccagctactgaaagtactgcatccactgagacagcttcaagtacaccagttgagtctacagtaattgttccaagtacaactgttataacagtaagttcgtgttatgaggataagtgttcggtttcatcagttaccactggagttgttaccatctcatctgaagaaacaatttatactacttactgtcctattacatccagtataactattccagttcctaacacgtccacaccagctgctccaggtactccagtggaatctcaaccagttatcccaggtactgaaactactccagctgctccaggtactccagtagaatctcaacccgttatcccaggtactgaaactaccccagctgctccaggtactccagtagaatctcaacccgttatcccaggcactgaaactactccagctgctccaggtactccagtagaatctcaaccagctactacaccagttgccccaggtactgaaaccactccagctgctccaggtactccagtagaatctcaaccagctactacaccagttgccccaggtactgaaactaccccagctgctccaggtactccagtagaatctcaacccgttatcccaggcactgaaactactccagctgctccaggtactccagtagaatctcaaccagctactacaccagttgccccaggtactgaaaccactccagctgctccaggtactccagtagaatctcaaccagctactacaccagttgccccaggtactgaaaccactccagctgctccaggtactccagtggaatctcaaccagctactacaccagttgccccaggtactgaaactaccccagctgctccaggtactccagtggaatctcaaccagctactacaccagttactccaggcactgaaactactccagctgctccaggcactccagtggactctcaaccagttaccccaggtactgaaactactccagctgcaccaggtactccaggcactgaagctactccagttactactcaaccagtttcagtacttagtactctgcaagttgttactgcaagtggcgaattttctacagttactgctcactcaacttcaattgtcgctagctgtcccgaaggtggatgtgttccagaaggacaacaaactgaaaccagcccatcagttcctaccaatggtcctgaagttgaagcttcttccagtgttctttcaatcccagtttcatctgttactacaagtacaatagcaagttctagtgagacttctgtaccaccagctcaagtttccacttttgaaggatctggctctgcacttaaaaaaccatactacggtttagcagtggctgcattagtctactttatgtga

SEQ ID NO: 12790 - DNA, 210 bp, Candida albicans
gtaaacacatatatacctttattgaaattggaaaaaaaagtgaaaaaaaaaagaaagcttacaaatttttacaaacaaaattttattctttttaattcacccaaaccaaatcaaaccaaacatctttctcatgtagcacacatacacgaccagacattaataattgacagtgttgcgttagccctaaaaaaaaaacaccacacatggtag

SEQ ID NO: 12791 - DNA, 336 bp, Candida albicans
agagggatagttgttgtggttttttttttttttttgacgcgtcacactttttttttattttcttcaacaatggagtctagaaagttacgatcgaagagcctgaaagtagagagcaaggcgttgtttgattttgataatgtgaatgagtatttgtataacgataaggagattgcgattggtggtaatggggcggtgtatcaatattatgggtgtggtatacccgagttgccgaaactcaagtccaacacaaagataattgaactacaattgccgatacgaccccaaaggaggatccattacctgatactacctacgatattttttaccgccgaatga

SEQ ID NO: 12792 - DNA, 375 bp, Candida albicans
  unsure (342),(366): Identity of nucleotide sequences at the above locations are unknown.
gacgacgcttccaaggcaattaccgtggatatacaaattttcgggttggcaaaccccaagtccaaagcaacctgtacgaattggaatggcaagtacgcaaacttgcccttgtcggaaaggcttagtaccaaaattttctcgatataccgttggacaagaccggggcacgcgtcgtcaacaatatcttctaaactagaggatgcagatgactgtttatctctttcctgtataaagtcaatcattgtttggagtaggcccttgatgacgtcgggggttgagtccaatgcctcgtcaaacactgaaagtactggtggcgacatgagaattcgtggggagttggancaaactattaggaagttattgaanggcggtgga

SEQ ID NO: 12793 - DNA, 186 bp, Candida albicans
tctacgcataccatacacatacacctacaaaccatttgtgcacaatatatatacatacattcaaacagttattcaaatactataaacaacagtacagttaaaataataaaaaacaaaatcagaccaaaccagaaaagcacgaaaggtaaaggacaacgacgcaaaaaaaaaaaggagagcaattaa

SEQ ID NO: 12794 - DNA, 201 bp, Candida albicans
ttaaccgctcgttttcaattgcaatttgtggaaaaacatttgcgaaaatggcaactcacacagaaccaagttattttttcggaaggtgacaccacacaactaagcgaaaatggcaaaaacccatcaaaaaaaaaaagaaaagaaattgagtgccacttgacgcgctaccacacgcacccaagattatgtcaaattttttga

SEQ ID NO: 12795 - DNA, 639 bp, Candida albicans
aaaaaaatttttcactttgactttctttcatcaatcatagtatcatccaagatggagttgagttatagatcgtatcaaaaggtgttgaatatttcattgaagccaaaaacaactcacgcctgttccaaaaaggctactgctgcggcaaccacaaaaaaaatcgccaaaccaaagcgtgacgaaactcaaatcaaacgcagaactaaaactggttgtttgacttgtcgaaagagaaagaagaaatgtgatgaagataaagtgaatggcaaatgtcaagcctgtaccagaaacttcttggattgttgttggccagacccaaacactattaagaccaaaaataccaaaccacaacaacaagcacaacaatctacagaagtgaaaccacaaataagtccagtagtaaggcccaaaaaatgtgatatcaactatttactacactctcaacctgaaccttcaactccagtggctacagttgttgctactcaacctaaagtgcatataccatacccaagtcccacattatctcctgtatttactgaaagcaagcctaatagcgaggttagttcatttgctttgcctccaatctatagtccaaactacaaacttcaaactaaagacagtaatgtgaggtcagtatag

SEQ ID NO: 12796 - DNA, 279 bp, Candida albicans
tatatattcaataatatatgttttacgttgatttcgaaatcccggggtaatgtatatattgaacaacagagagtaagaaaaaacgatgataggcaagaattgttaaaaattgacagaagagataaacagaccaagcaaaaaaaatttactattatttttgttgtcgtccaaaaatttcttcgattttttttttttttaattctccaattttatggaatattctccacaataaagctattacaattccaacagaaacaacaccagccatggattttatga

SEQ ID NO: 12797 - DNA, 213 bp, Candida albicans
atgatttgtaaaatatcaaaaataaacccccctggtggtccattcgtgactgatgtagagcccgctgatgatgaagtaactgcagcattggagttggagttagtgttggctccagatgtcactctaggtgcacttgcagttgtccttattgttaaagagtcagcattattggccagattctcaccaacattaccacttcgtaaactagcttga

SEQ ID NO: 12798 - DNA, 216 bp, Candida albicans
aaagtgattttcaacaaacgggaagttaaggaggaggaggaggaatttaacttcttggtgagaacaaaattgttttgtaacggaaaacttttggtttctaagttgatcgagagtaaaattggcgacaccaaacaacaacaagaaaaaaatgactatacaattaataacggggcaatcactgtcttgtttaaaattatgaattgtgtgaatagttag

SEQ ID NO: 12799 - DNA, 249 bp, Candida albicans
gctttcccaacagaggatgccgtgtttaaaactggtgattggttagttaagttggggataaaacctccattggcaatgccatgtttatttaatgaatcagacacgtcgcatggtgtgaacttggataagattgagatgacctctttggatgacaatgacttggtaatagacatatcagatggcggttttcaattgagtaaaaatggaagtagagatatctttgaaacaattgtgattgtcaaaggttga

SEQ ID NO: 12800 - DNA, 501 bp, Candida albicans
ctaacgaaatccatcaatcaacgtattattcagacaatttctccaggtatgccccttaatctccttttacacgaagacaatcatcagaaacgaccaatgatagttttagatagcgcctacgacgagctacgtttcagtatcatcggtaataaagacttaaagtacaaattagttggtaatgtccaattcataaaacagctcaccacagattttgaacatcttatcaatcaactcactgaagcaaccaatgtttcattagaggacactagttatttactcgaaaatttggagaaacttgccgtgatcaccaatattttatgtttatttagtattgaagttgacaacaaaaaagacgaaaacattgccgaatgcctttcaacaatgaaactagtattgaacccaataattaggctattaaattatttcatccaatcttttgttcctgctttatataggcacaacagaaaatccatcgtatttagatattcaaagcaaatttga

SEQ ID NO: 12801 - DNA, 252 bp, Candida albicans
ttgataactttttctgccacgttggctctgatggtgtttgccaacttggttccggaaaccactacggcatctaagttgatacacgaacggtggaaatttctactcaacgagcgtatagttggtcttaacctaagcattgctggtgggatagaaagtgaaaaaaaagaaaaaagaaagaaaacaaatagttgttcttttttaaggaagagcatcacaaaattttttagacgtgtatatgcagtatcggtgtag

SEQ ID NO: 12802 - DNA, 471 bp, Candida albicans
ttttcttttttttttgttctggtttgttctttatctgatctacttagcacgttggactcaattcaaacacacaactacaatcaaatgcctaatgaatctatagacaattcaggtgaagttgtctttccgcaacctaatattgatcagaaaccacctcctccgcccccaacttcaaatactaatttcctcacacatgtcaggtctcgcctgccatcacggtctgtttccccctatgcatatagaactcgatctgacgataggcagcccattacatattccggcgataataatacaataatcagagaaacagctagatcagaattaattacgcggcatcaattacagaatgtccatctggatcaaagtcgtcgaggaagaagtagatcacgagaaaagaagaaagttgatacaaaaccacatgtaatcagtctaatgggatttgacactacaacgacactcaagaagaaataa

SEQ ID NO: 12803 - DNA, 474 bp, Candida albicans
ctagtgcccatcatgctgactagaatgtttataacctcaaagaacaaatacaataagaaaattgaaaatgctattaagaaaataaataaactcacggcaaatccagaaacttcatttaaatttgatgctgaaaggttcaaagaaattgaattatttgtctatggccaacgaccaattacttacaagccagcatggggactcaaattgttttggaaagataacttacccactttaagataccataatcctgatattcaatttactgtgaacaatattactgttgaaagtgagtctgagttatcaaagttaccacttaaattaaaggttcatggaacagatcaaagtaacagctttgaaattaattgcaccgacaaacctccttcaaaaatactcagtgaattgatagaaattacaaaggctagaaagttgactgaggaagaacttcccaaacttcctcttagaccagtcaaataa

SEQ ID NO: 12804 - DNA, 378 bp, Candida albicans
acaaataattcaatttctttgaacctttcagcatcaaatttaaatgaagtttctggatttgccgtgagtttatttattttcttaatagcattttcaattttcttattgtatttgttctttgaggttataaacattctagtcagcatgatgggcactagttattgtattgttaagatgaagaaatctaagctggaaaattttttttttttggctaacaaaaaaagacttgttgatattagcaaatatcacacgaccgccaactttaaggtcagtaatagctcatggttctcaataggcaaagcatactatagacaattattactagtcaaggtatcttctaaccaattattttatacagctgccattgcgatgttttaa

SEQ ID NO: 12805 - DNA, 186 bp, Candida albicans
ttgtcgtgtgaaaaattagcagaaacaaaacaaaaattgctacttagtattattttgctttttggtaattgtagtacgacctttagaagattctgtacactaccaccacaacagaagaaaaaaaaagaggaaaaaagaaacgaagaatttcaagtaattaattacgaaattatcaaagcaatttaa

SEQ ID NO: 12806 - DNA, 183 bp, Candida albicans
atttctagtccggttataattatcgaaaccctaggatacgatagcaatatactttggacaacttggctggaaggttgtgccctttcattaaggacattatcagttcacggctgtaaattggaagaacttagtcttgtaaaagctattattctttttttgaaaaaaatctctcatgtaaaatga

SEQ ID NO: 12807 - DNA, 183 bp, Candida albicans
catagccttgtattgacgaatatttttttgaagtcagggacgagagcaaagaacaaatgtttacactttttcttgaattatcatcaacctagtacttgcacccaacataaggtgaaaaagcaaaagaaagaacaacaatcgttaaacaaccctatatcacaaataatatctgttcttaaataa

SEQ ID NO: 12808 - DNA, 1275 bp, Candida albicans
ttttttacatatatatcaagttcttgcttcttggagtcatcatccttggttttaaattcccatattcgattaaacatgagtactcaagtacatttaaaccctactatgctatcgatactatctatatcacgagataagtattggatattcatcagttctattttgcaactactatatcattcagttgacaattcaaactttcaaaaatcaagtatcggtaatgaagatgatgacgacgatgatggtaatggcttagatgaatacagttcaaatacttctgcttcagatggtgatggattaaacacaaagttggttgataattcgagcaaattacctcctagccctccacttgaagaaccaattgaagaagacactgaaaccgaggattatttctttcatattgccttgactcctgttgaatgtaccattatctgttcacaaaaactaatgaaacaatatttccaacaaccaattgaaatttgcaaacaattaaactatcatgatgtccaattgctaccagaaaaatatttatgtttgagtgttgattgtgatgggagttccgataattcattaagaattttggaattaacgaaaccattgtcggaaaacaatatttctttatttttcatatctagtcacttcaatgatattgtattgatcccttatgatttaaaacaaaaagtaattaatattcttacgaaaaatagttttgaatttctggatgtttctaatagttatatccctacatttggtgcatcaccaattgctactgagtttgattttgaacaaggttcgaaaaaattggaagaaagaacttttgaatcattcaaacaatcacaaattcatcctatgatcaataataaagtgaaactattactcacaggttcaagacaaggtgaagttaacaatgcaattataaaatccgccagaatcttatcatccacagaaacaataccaaattattttgccattaccagaacttattataatgaagtatctcttgtcttgccaaaatcaagtaagcaaagaattagattaggatttgattctaaatatattattggatcaactcaagatataattatacccattacaatagatttttcaaaactccccttggattctacgggtatagttgctggattagcaagtaagttgattactgctggtgaaaatgtttctgaattgtattatttctcaatggccaggtctggtgtggttatgattccacaagaaaatattgagactatagctaagattttacatgacgtataa

SEQ ID NO: 12809 - DNA, 288 bp, Candida albicans
aacatgactacaatcaatcttgattttcatccaacagaacttgttaaacgaattaccaaacgaatcccacgttcattaccgtattataataatagcgacctggaagctgattcagatgatcccattgtcgcagaattaatgaaactacgccctcatagctcaagatttataatatcaaatgtattatataatgaagaaattgtacaatattcagccaaattacaagaattgttatatttgttattggaagaaaaagagttggacgataatattcgcattaatccttga

SEQ ID NO: 12810 - DNA, 1428 bp, Candida albicans
tatcaaatgtattatataatgaagaaattgtacaatattcagccaaattacaagaattgttatatttgttattggaagaaaaagagttggacgataatattcgcattaatccttgaaaattcattgtctgagctaacttcgtccttacctgctctgaaaccagacgattatagatacaacaacgtctcagaaccacaaactaaaaaacccaaattacaacaaaacttgcgtacaccacacctttttcaactgacttttcctaacaactatctctcgaaaatattaatagataactttgattctttactaaagttctcaacaagttattttaacctatcgcttgcatcccatattacaaaatacgtggttgaattgatttatctgttgaattattgggaggttgtccatttagtttatttgaactcgaatattattaattttttgcagttgttagattttgaaattgtcaacggttcttttggtcctattgtaagcccaccagaaaattacctcagcgatattatgttacaagggttgcaatatccatacccttaccctttctataattattcatatcattcgttcaacagtactgttgaagagcaaaaattcaaaaaaataagcattacaccgtatgtggatatcactttaaagaatgttgaagaaccagtgcagaaaaagaaacggggccgtggtcgtaaagccaagaatgccttaccaaacaaagaggaaaatgatccagcaacgcatattgttaaaacccaacatccagatgtttctaaacaaggtattgaaaaagatgatgcattaacagcagaagttagtggaactgttagtgaagtgtcagataacgagatggagaaacagccacaaccaaagacatcagtgaaaagttctgttctgccattagcatcagcaatgacccttaatgtgactaacaccgaaaccatgccagttgctctggatgcgaggaagatgtcaagtgttagtgtagtgtcatcaactgcaatgctacctattaatacaatatcgagcacctacacaaaccaaccttcatattatgcaactcagtctggacagttctttccaaaatttggagagtttgcctctgataagcatggaacgcatctccctgtaccacgaaatgatacgtctgcagatagaactggaagtttaagtgcttctccaatacctgctcctaataatccagcaactcattcgtatccctactatccatattcacaatcctcttatcattatcgacaccaaaccaatgatcaaaccaatatactgtcattgcaaaatccgaaatcaaacactatatcaactatgcagtcgccaaatgagatttttgtttcaggacaacaagctgagttctcttatggggaatccatcccaggagggttcagaaaaacaaagcggtcttga

SEQ ID NO: 12811 - DNA, 264 bp, Candida albicans
atttccccattttcaccccaactagaaccaacttttagctcagaatttttgcaaactcgagcccaaaattttcctctcctcggaaatgacttattcccgaaaatggtaaaaaatgtcgtcgcctcaaaaaagatggcaaaaaatccccatacaaaattaaagatgacaaaaaatgtcgcaccaccaaaaaaagatggcaaaaaaaagtcgcacccccaagaaagatggcaaaaatatgtcgcaccaccaaaaaaagtcgcatag

SEQ ID NO: 12812 - DNA, 210 bp, Candida albicans
acaacccccctagtttggaactctcttcttattttaaaatactctcagtatgaacaactactcgaacctcaaatacaaatttctcaaataaacaactctctagttgaacaacaccctacccaattcaaacatctgtacggtcaatcaactatctcaagcatccatactaatggaaacgcggaaaaaagatggcaaaaatttttttgctaa

SEQ ID NO: 12813 - DNA, 219 bp, Candida albicans
tgggtaagttattcgactgttttggaggcagttgattgtgtagttgtgaaaatcggggtgccggtgggagacccgtgggtgatcggtgagccagggacacgtcaacaaaaaaagatggcagaaaaaaaaatggcagaaaaaaacaaactattttacaccagtttttttcttcaacaaccaggcaatcaacaatcaatcaacaatcagtcagatatttaa

SEQ ID NO: 12814 - DNA, 198 bp, Candida albicans
ccccagccaagactaaccaaggggggggagaggggcactggtttaatttacggaagtctaactaccaacaagagtgatttttacgtgttagcaactccgaattcaaaaatccctcaagatcaagctaacagtatcaattgcctaaccaagccgaaccactctaaaactaccccatgctgtaatcaccacaacaattaa

SEQ ID NO: 12815 - DNA, 249 bp, Candida albicans; identical to SEQ ID NO: 9823

SEQ ID NO: 12816 - DNA, 219 bp, Candida albicans
agttgtgagtctaaagtttatttggctagtgaattgactggcaagattgttaaacgtggggtagaaaaagacaacgcgtcgacagctcatcgcaaaaaaaaactacgtggtcactttttttgttcaacaaaatattcaatcaatcagttagatggggctaaatctaatgctacatcaggaatggagagaggggcaaattcaagcaagttgtctaactga

SEQ ID NO: 12817 - DNA, 423 bp, Candida albicans
agcctcaacataaccaaaatgcctgaattcaaatcccatattcgcgctacatttgaacccacagacaccaaattgttgacaaataccccaacatcacgattactcactgaatccccaaaactatcgactgccttatcccaaattttcccatacttattgcttattgacaatttattggagattcttacatggacaaatgaagatcattatcagaactttttgttgttgacatgctattcctgtataatcgtgtactggaaatgggtaagccatgtcattttgcctatattgatgacacttgcattctccagtatagtgtggttcatttcttcaataatttatgattcccaatacgatgaaaaacctacaattgaaaaaatgtcgttcacatttactaatttaactatcagatgtgagatgtga

SEQ ID NO: 12818 - DNA, 624 bp, Candida albicans
ataacccaaaacaataatagaaatacagacggcaatcaggttccaaattccattctttttattttattttattttatttttttgaatagaatggtatcaagaaaatcatcatcaagctccaacaagaccagtacttcgactgataccatgatcgaaacaattggaaaaccacaaactgtcaatactagttacacaagcagtcacgattttatcccgtcaagaccgcctccaccccctaaaattggttcggctctggaggacaccgaagaaaatactagcagttctcaatcatcaaaagtatctaaacaagataaattacaagaattttccaaaaaattattcaaaaagacatcttcaagttctttgaataaaaaaacattttatcaaaaattacgaggcaaagagaagaaaaaacaaaggattcacggaaccggggttgacaagaatatacagacagacgatattactaattctttaacgttagatatgttggatgtgaaaaagaaacgggagaaaaaatacagagagaatgtgaccctgtctttaaaaacttttttggattccaatactctgaatggtgctgttgattcatttaaagattatgtagaaaatagtctcatatag

SEQ ID NO: 12819 - DNA, 270 bp, Candida albicans
aaaatgataaaaaaaatacacagtaaatgtgaagatacacattgtaatgtgttttattccaagataaggagtattattaaacgctgtttgtgtatggggctagaacaatccaattcttatcaaagaggagagattcttttaacatttcagccacacggaaagcttaagtggctggttttgatagaggggttctattcatcaatcaaacaaaaaaaaaaaatagccactgacaatttactgttgcaatacaataatgccattttacagtaa

SEQ ID NO: 12820 - DNA, 318 bp, Candida albicans
gggatggtatcaaccccaggagacgcaaacgtgggattgagttgtggagataaatacgataatgcgggaagatctgataccgtgttgttattatttgaaaaggaggcaccactaatgctttgtcgtttagagaaatctgggctgaaagctaaattattcttgtcatcctcagcgatagagcccaatccacttaggtgttcacctctggttgacggagaaaaaaactgtggatttagaaaagaggactcatcgttattttgtggtgatatgagttcatctaaattaaccgaattggatattgggttgacaaattgttga

SEQ ID NO: 12821 - DNA, 483 bp, Candida albicans
aaattttttttgttttatctcgtttcgcgatgcccaaaatgggccaacagattgcatgtacaagataaatttggtattagtatagctaggggtggcacatcccaggaagtagagcatggacagttcgtatggtattgctgtgcatacgatacaaaaaaaacagaaacgagaaaaaaaatcgatcgtcaacctttatcaactcatctacagcagcagcaaagttcgtccctaaatatgagtcaagtccaacagaaacccaaatcgtttggtagattgtataccatgtactactttcattttccatttgttatgcttacgacaactgaaaccatgctacttcatacgtttgtattgatgtttgccttattggttgcctatgggatctacgcttatttgccttcaagtatcatgtttgcaatctccagagcatactattatgtttttggcatggatattagtaccatcaacggttatgcaaagtag

SEQ ID NO: 12822 - DNA, 207 bp, Candida albicans
ttccgaaacctcagatatcctgacgagacatgtgatatgacccttacgttctattgttccaagttttttctagcaatagtacgcaatgataatgatgataatgaggaggaggaggattctctttggttacacaatagtgatggattgatcatgcgatacgatagagaccaacaagagaagcctgtgctaaagccctcttttggatag

SEQ ID NO: 12823 - DNA, 210 bp, Candida albicans
gattttcctttatctgtacggcaaacctttttttatattttgcaacacaaaagctccaaaggaattaatgcgacatggctaaatcacgctgtcacttgctggcgaaacaatctctctacagtattaatcgccacaaatagagattggcaaattccaaaggaacacacaatattgtgtttgttctatcccttttttttttttaccaggtaa

SEQ ID NO: 12824 - DNA, 222 bp, Candida albicans
ttgaaattttacgtgtgtttagtttcaagaagtcactcaagtctccagttgttcaagtttaaagcattaggcagtaagtactttcgtttgggctcaaaaaaaagtatatttcataaattagatttatatttattgttacgtagtaagaaaataaaaaaaaaattgattaaatatcatatattatatcatgcaccatgttttggagatgcattgacaaaataa

SEQ ID NO: 12825 - DNA, 297 bp, Candida albicans
aactatttgggtggtcctattttggatggatctggactcactggtggaatttctgcaaggcgcatattgcttgctcgtagatacagcaagaccaatttattgacaatgcgattgcacacaaagcacacctttagggttgatgacccagtgacccagttgtatctgatatatgctgataacacagatgataccaccgaatactcgataactttcaaattgggagctcaacatatcttaaagtatacaactcaatccaattttatcaatgtaaaatctcctctgtgtcctgctttatga

SEQ ID NO: 12826 - DNA, 294 bp, Candida albicans
cgccaaataatgaaaaaaaaagatggcatagacaatagagatatacctatatctcatgctgaatatatgaataaaaaacaaatcacgtcattcacaaaacaaagaacgctcattatagaagttttaacaataaccatgaataggaatgtcttagaaacaatattaatatctttccttcaagttcacttaccacggataattatattttttttcttttttttgagcatagcccgaatacccaaaaaaattgaaagcaagaaaaaaaaatttcatgcaacttggccactactttaa

SEQ ID NO: 12827 - DNA, 426 bp, Candida albicans
tacaaacaagagttgaaatcctctgtacaacagtcttgggctaaattgcctatatacatattatcatttacttcaagggtattatcgataatttacagtttagcagttttgacgaaatacattaaattcaaaaagtcttttaaatcaggcgatttgattgttgaatttcttgagacaaacgaagttagaactattgaaggttgcaacattagtgttctacaacagaaacagatgtcagatgtgtatgagattttcactgaaattcatatattgagtcaattatttgttttatgtgagtacgttaaattcaaattgagttatagtaatgaggatcttgctgcgcttagtatccaacgattaaacaatctaaatcaacatctcgatgaagttttacaacaaaactttacaaaaataaaaccggaatag

SEQ ID NO: 12828 - DNA, 195 bp, Candida albicans
tgtacgtattattatcatgtccaatatgcgtcatgttcggttgttattttattccttttaagtttgatacatgatattgctttgaaatattttttgttaacaaatgtttgtaaccaaaaaaaaaaaaaggtatgggaagatacatcaagggtccaacaaaaagttggtatcgaaactaaagtttgtggtggttga

SEQ ID NO: 12829 - DNA, 414 bp, Candida albicans
accaaaccaagatccgtgagtaaacaaattccagtcaaaagtgtgtatgtgcctcctaaacccaatgcacttattattttgtcaagaacaccagtaaacaatgctgctaaccaacatctcattaaattgacacacgaagcagatgcaccactctgtttaggatacaagtcaactcacattgttgtacaaatagacatcatgacagaagcagaaaaggaaatcaaaatggtggaaatgataattgatataataggttttttatattcgagacaccaaccaaatgctgaaagaccaataaccatcatggctaagggcacgatagtcaatgttagtctagatgcaaccaaattaaaaggtgggcgatcattcaaaggcacgtcattcatttgtttatcatacaaattctttctgtag

SEQ ID NO: 12830 - DNA, 312 bp, Candida albicans
atcaacactgctttgttcaacacatttttgggccttatggacccattccccactattctccgtgatgtttctgctaaaactaaaaaggcaaaaataaaagtgactcctccaccgatagccaaaaatataaatatagctctccaagtatggaaccctgaaatcaatgctgcaccaaccaacccacctattccgttcccagctaattgcaaaccagaaactgcaccaaccataccgccacggttagctggggtgcagatatcaccagcaacaccagaacttattgcaaatactggagcaatgccagcagcttga

SEQ ID NO: 12831 - DNA, 261 bp, Candida albicans
ttgcctgcgccaatgaccaacccactcgattttccagacgagtgtgccttctatgaatacaaagaatcaatcccgaaacttactttaagaaactggtacgcttcacacaatagctcatacatagatttacgttggttgtgtgtacaaattatgggttcggtcatcgcaattgggaatattcaactttcccgttgtcgcttgttgctccaagatgttcaaatgaatagtctagaatatattcaaagtagtcccaatttgtaa

SEQ ID NO: 12832 - DNA, 195 bp, Candida albicans
agaggtttttttttcttggctcaagtgtttcttgtgaaaactgttgtacacagcatagagagtgttttacgaactatcagtcctcctcccacatcaatatctatacgagcaatgacagtgagctatacttacaactgcacagactcaaaaactgcagtaagaagttttgccacggctatgaaaaatatcttgtga

SEQ ID NO: 12833 - DNA, 204 bp, Candida albicans
ttccatttatcgaattatcctcctactatgaatacacttaaagtcgttgttgctgtttttgtcagagttgtacagctagttgctaacattgcatgttttgtgatcagtcttttgcgttcacgagaatataattatctaactttgacagtcacctcattcttcttcaccacgaggcgcaagatccgcgctattttatggcccccc

SEQ ID NO: 12834 - DNA, 759 bp, Candida albicans
tcaacttataatatgtcttggaaaccaattgtaacatacatcatccgtggtgctcaatcggtattttgcattgttgtccttggtctttcagctgggtttttggctgatgtaggatataattacgaccgtgtcacttttgccttggtagtttccatactcaatcttatctattttagttacattttactactcatgcctactattctcaaaaacttttcaccttcggtaatcattttagttgccgagttcattttctttgtgttttatctttcagccatgggagcaattgcagccgttattccttctggaagttgtggagattatggcagttactcatcggcatgcagcatcctgaaggctttaataccatttactttattcaactggttattgtttgctactagttttggattattcttgggttatagctttattccacaagtcagtagtcgcggattcaagtcaatctttttacctgcacgattcgagtttggtgctatttttactgattttgctttaccatttggaaaaaaatatgcggtaactgatccagtaactgacgctgctattgcaaatgctgaagttactggtagtggtatagaaaatgatgctcctaaagttgcatctgttggtgataatgaggcaactgttggtttggcttcatccgaagaagataaatatacagagccaatttcggaaaatatccatgaagctcctgcaacccaagaatcaaccaatcaaaacaagccatacccataa

SEQ ID NO: 12835 - DNA, 264 bp, Candida albicans
tttacaaaaagaaagtatcaaaaccctctaaatttcttgtacacattcttttccttagcttcagtttatgtgctaccaatggtaggaactactcgagtttatttaaacgcaaccacggcaataagctatttttttattcatcgtcaaaatacaatgaatctcttagatggtatactattgactcactgtagacctgtaacaatattttctttaatctctattgaatgcaatgacatgcaactagtcaactctcactcacaatga

SEQ ID NO: 12836 - DNA, 249 bp, Candida albicans
ttggaccagtcattggcatttggactggggagaatcttaaaccttttgaatcatgctaatagtaagcagcagtctctcatatttgatttgatgagatacgaacacacattcattcaaagagctgattgctttgtggaagttgtcgcgcctgagtttatcaaagctgcaaagagttactttggtcagaatagtgagaaattagcaaaattcgaacaagatgttataagtgcggggaaaacaaatagttga

SEQ ID NO: 12837 - DNA, 204 bp, Candida albicans
gaaaaaaaacagcaaggcatttattttgcacaatgctttgtggtcttgtcagatgaattacaatgtaagaactttctaagaccttcacaaaatgatatgatatttaagaacaacacattctctatatttaatttgatttatttgtctttacacttgctattaaattcatttatgtttagaaatgctcatttcaaaatagtttga

SEQ ID NO: 12838 - DNA, 528 bp, Candida albicans
ttaaacatgaatatgaatgccaaaaatatccgttgggtagaaccacctgccacaattatagatgaaactatcatgaattccctggttccggaggcagacttgcctgtaaaacctatattgaaactaccgagaaatacaccatttccatttgcatctgaagacgacaacaaagaactggaagatcaagaagatctcaacaagacaaagcagatttcaaatctactacgtaatcattttatttgcatcatgaaaagtatttttgggttaataaaaatgttaattaataatcaaataataacagggtttacgaactttcttatatccgctattgcatttatatccattacagcgctcaggattattgcagctgtgggtagattcttaatagattttgatttttcattgttttttgaaagctgtctgtttctactagaagagcatgagttatatttcaccactgatctaagccaccaacatccaaatcgcaaatccaacaaaaggcgtgtcactacaacagccggcacataa

SEQ ID NO: 12839 - DNA, 216 bp, Candida albicans
ataatatgcagaaccagcaatatttttctaggtttcggagttgtttatgagagcacatgttacacaaaacctaatcggtgtatgataatgaaaaaagattatttgatcgttcctattgttagatttctttcagtcggaacgaacaagctatatagatgttcggatcattgcttgattcaaaaaaaggttaaaaataacaatcgcttagtaaaataa

SEQ ID NO: 12840 - DNA, 237 bp, Candida albicans
ttatcaactagtcaacagtcaactattataactcaattgaaagtggaggagaaagaatataaaaaaaaaccatgtcttcatatatattttatcactattgttttcattattattatggtaatgagaataaactattcaaactttattaaacacaattttgaatcaacgtctccccaccaacctccttctatcctttttcctaaaagtatattcattcatatcattcactactactag

SEQ ID NO: 12841 - DNA, 330 bp, Candida albicans
tcaaccatcatgagaaagatttggaatagaaaagataaagataaacgaaagagtgtttctcacgatactaattcaccaaatatatattcaaatcatcactttgattctaatgaacacttgcgtacacaatcacaccaacaaggatcggatcaatattctgaccacaatcagaatcataatcacaatcaccaccgcaaccaccaacaccaacatcaccaccttgtccacactgagtcacacgaggatacaaccagttttgattatgaagatatggcatccatacacgcacaaccatattcgtcctcagataaacgccccacaactaagtga

SEQ ID NO: 12842 - DNA, 240 bp, Candida albicans
atcttaaaattcttcctgggtttttttaaaaatttcttacaacctgttcattcatttcatttcattttagttcagttcagttcagttcacttcacttcaattcagttcactttattgattcatttatttaattgtttctttctttctttccttccgtctttgttctttataaatctattgggatcttacaaacatcatatccatttttttatatttttgatttttgatttttattattaa

SEQ ID NO: 12843 - DNA, 216 bp, Candida albicans
ttgtggggcgtttatctgaggacgaatatggttgtgcgtgtatggatgccatatcttcataatcaaaactggttgtatcctcgtgtgactcagtgtggacaaggtggtgatgttggtgttggtggttgcggtggtgattgtgattatgattctgattgtggtcagaatattgatccgatccttgttggtgtgattgtgtacgcaagtgttcattag

SEQ ID NO: 12844 - DNA, 198 bp, Candida albicans
aaaaaaaatgtcacatttttggtttcacccctgaacccctttgttttttggtgtaactgtttgtgttatctatgtattatgacaacattgataatgcaattaacaaatcgttttgaaatgattgataagtctaaccgatgtcaacaactctcaattataatcctgtttcctataataaatctaagcttcaaccattaa

SEQ ID NO: 12845 - DNA, 192 bp, Candida albicans
aataaccagctacacctccttgagtataaaaaagagacaaaaataaaacatgtatataaaagctataataaatctaataaaaaaaaggaagacaaaattatcaaaaaaaaaaaaataagaagaaataaaaaaagtatactaataatagttgtaggagcaattaacttattaaacctttatttatcactttaa

SEQ ID NO: 12846 - DNA, 198 bp, Candida albicans
ttatgtggccttttggaaatagttatttttggttggggtattaacatggaaagtggttttcaattgggtgttgttgcaaaaactaaaaaagtagaggactcagtaaatagccaaataagggaaacggggaaaaaaaaaaagcatttgggcccgcgttactacagattcaaaatacaagagccaccaaaacttgtttag

SEQ ID NO: 12847 - DNA, 210 bp, Candida albicans
ttaccactttcagtcaaacttttaccaacagtaatgttatttgtttttgctcatcgtgactacttaaacgaaccaaatgagagaaacaatagtaacttaacgggtatagctgttagtattattttaatattatcatatacttatcatagcataataaatctaggggatcatttgaattggctggagggtgaagattgcaaacatgtttga

SEQ ID NO: 12848 - DNA, 1038 bp, Candida albicans
aaaccactttccatgttaataccccaaccaaaaataactatttccaaaaggccacataatcaaaaactgttaactaaagctaaaaagttttcactgaaccagttgcaagatatatttcatgaggaaacaacagagattaaatcttttgtagaaacatcaactcctcagccaaagcaaaaagctccaagaaggaaatggccaagctataaatcaatagaaaaaacaacttttaagaaacagaaacaaaagaacacttttgccagtaaacatcgtgccgctcatacacccgaggagcccaattcataccaaggtgtgcatgctctgccacctctcctaatcaaagacatattgaacccagtaagtttgcaacaaccatgtcaagctcatgaaaacctatgccaaaatcaatatttagattcaaattttcacgtactggaagctaaatgcagtaactttatacccatttcatccagctacaaaccaccgcataatacattcactagatcatacacttgcaagtcgttttctgcagcagaaaatcatcaatccaagcccatccattcagattcagaaaacgagtatgcatctactcataagcttcctgtgaatattccctctattgatgaattacgtagaaacatatatttgaagaaatgttcactaaattacatattgaaccccaaacggacagccattgatctatcttccaatatgcaattaagtaccactgcaccttgttattcggtttcttcctgttcatttgaccatgagttattctcatttagtgacaagctatcagaaaacatatctacattaacaaactctgatggaaaggaacaagactatacattaaatgatattagtagctacataaatggcactagtgtgaggatgtcgtcgttggcaaatggtaacacaaataacaaaaacgactggctaaaccaaatcaaacatgtttgcaatcttcaccctccagccaattcaaatgatcccctagatttattatgctatgataagtatatgataatattaaaataa

SEQ ID NO: 12849 - DNA, 1179 bp, Candida albicans
ccattatttccaatgtcgatccatccaggaactaaagaggaaattaacggagtgaccaaggaattgagtaaggtagggattatgcaaggatctaaacaagagagtaaacctgttttggagaaccatcaacaacaatcttttactcctaacacgtctttgcaaagtgctgaaacaaatctgcctgataccccgaatacatcaatttcttcagcagatacaacacttggcacatctacccaggaacttgttaaatccattcctccacctcgtgttgaaaacaatagaagattaattgcaataccaaaaccacattataatgttgtaaaacccactgaatatactcctctagctgagtattatgctgcacaaagtcctcatcatcccaaattaagggaagttagaagattagagtctgctaaagctccaattgacctttaccgtattgccaatcgtaacaataacatcaacgtccctgcaaccaaacttacagctgacattagtgccatgttcaaatattccactaatacagaagttcgaaaggttatttccaaccttttagttagtactgaaaaactgcttaagaaaaaattggctgatttaccaacatactttaagaaactcgtacatgcatttgaaaagaatccagaagtatatttacgtgtaaatgccgagccaatttttggggagaactatacagtttacgaatactttgacgatcgtgatttatcacacttgtactaccgttgtcgttattttcatatcgatgatgatcatcgaatttatttccaagcctttaatcctgacacaattggtaagccagaatatgctcatttaagacaacttttagtttcttctttagaaaaattggttttcgaaattggaggtgaaaagtttctgattaaaattgatgaaccggttgagcatatgcatgtggttgcttttaaattaccacctacttcgttagtggacactgttgaatatttagaatattttttagacgaaaaggatgaaatagttgaatctcgtattccggttttctctcccaaactgatgattcaggattcaactccagtaacagctttcttcattctcaagttgagaggtaaacaactccctccagagcggaaatatatatttgacgaagaatattcattcaatattcttacagattatagttag

SEQ ID NO: 12850 - DNA, 402 bp, Candida albicans
ctaactaaatcacccattataggaatcatatggacaatattttttaatcggttatttggtcccataacaccagtgacaaacgaattcatgaatgtgtcgtatcctatggctaataacttacctgatttggattcattgattgacgagaaagttaatagaatacttaatcaaataactgaagtatcaaaccaagctaaaataaatgtgcagtttttaagtaaaagtagcaacaataagaaaactgggtggtttggtaatagtacatataatgctcacgatgatttggtagtttgggagtcctggttgataaacgtggagtcgttaccgctcgatcaggtatcgaatggcgaatccaaaaatgtccaaacttcgattcaaaactttgcaaataatcttcactaa

SEQ ID NO: 12851 - DNA, 279 bp, Candida albicans
  unsure (128),(134): Identity of nucleotide sequences at the above locations are unknown.
aaagaaaataaatacaatgtaatggaaatgggaaatgaagaaataatacaattggttcaaaaaggaattaaaaaaaaattgaaccaatgttgtctcacagttttcccccgccttggctgtaactcatnatcttnatctcataattgtcgttcaatttttggactctcattttattatgatggttattcgttccttaataaagataacacaaatgtcagatttcctaatctagaaatatgtgaccaaaaattatactatttagttcttgataatgtataa

SEQ ID NO: 12852 - DNA, 264 bp, Candida albicans
acgtggagtcgttaccgctcgatcaggtatcgaatggcgaatccaaaaatgtccaaacttcgattcaaaactttgcaaataatcttcactaaaatatatgacattgcagataaattcaaagaacatataccaccaatcacatcgcttgatagtgctccgttcccctacaaaattattatcccagagaaaaagtcacatcacaatcgtgactaccacacaggcgaagaaggctggggaacttatataaagaaaatactagattga

SEQ ID NO: 12853 - DNA, 198 bp, Candida albicans
ttaagtattctattaactttctcgtcaatcaatgaatccaaatcaggtaagttattagccataggatacgacacattcatgaattcgtttgtcactggtgttatgggaccaaataaccgattaaaaaatattgtccatatgattcctataatgggtgatttagttagtcatacatggcttacaaataaacctgtgtaa

SEQ ID NO: 12854 - DNA, 432 bp, Candida albicans
atagtgggagttatttggggatatcccaaaacccaccaaacaataattaaaattgggggaattaaatttaccggaaaaaggaggattcaagtaactgattggtttcaaacgaaaacagttggtcccgttgccatactatacggggaaaaaaatttggaaaggaactttgaatttattaaaaaattgaaccatattgggaaaataaatcttacagctttatcgcaatataataacgattgtgatgccgcatcagttgacaaattgtttaaaatcggttcgaaaactttagagggtcaaattggtcttcataggtttaatttgaaacctgaagagaaggaaagatttttagaatttttattgtatatatttgtgtgggatcccagtgaaagaagaaacacacacgatctattaaatacgtcttttttagagtag

SEQ ID NO: 12855 - DNA, 369 bp, Candida albicans
tcttccagtcattccaattcaccccaaagaaacagaaattttggggtaaagaaattgtctcaaatgttcccgctaaccatcaacgctattgaaaaacaccaggacatttctaattacaaaacttctggtgttgatggtttgagtatttcattcttgaccccacctgcagtaactgtggcaactttggaagaaattggcaaaattgatggtttcgacaaggtcattaagggtttatggtttcagccaggaagttacgacaatgaagtattagaattagctgaaaaacttggcgagtttgacaaagtcgtacatgaagatgaatgtattttggttagaggtgaagaaggtatgatttctgccaacttgtaa

SEQ ID NO: 12856 - DNA, 213 bp, Candida albicans
gtattcatggaactatgtgtcggtattaatgcaggaataggattatgtagatttgaatttattaaatgtgacggcaaaggacctgaattatttagggatggtgtgaacgtacatggagcatttagcacaggtgttgtaaatggtagtctcgtcgcatggttattcgaatctatagacggtagtttaaacgatggtagttttggcacaaactga

SEQ ID NO: 12857 - DNA, 186 bp, Candida albicans
actctcactatcaatatgtctatgacatcaaagataaaatcatttttcggtaaaaacacacaatatgcggttgctggcgcaagcaacaatccatcaaaatttggttacaagattttgaattggtacattttgcatgatcttccagtcattccaattcaccccaaagaaacagaaattttggggtaa

SEQ ID NO: 12858 - DNA, 195 bp, Candida albicans
aaaaagccaacaaatgtatgtatgtatgtagtcgcctgttcatcagccacagagaattcaggtatgaaaaaaaaaaaaattgaaataatcgaaccacttttgcttgaaaacaatcacattttcgcgcgaaatttaagtaaatcattgttttgtttgttagtcagtcatatttttttcattttgcacccaggttga

SEQ ID NO: 12859 - DNA, 225 bp, Candida albicans
cttataactattcataaatacactatacttacaatgtcaccaactgctattagattgtctcaaaaaataaccgtcacccctcaatacaaatactatttacgtcgtattccagattttgccatgtgggccactggtattgcttgcttttttggatggccacatgtgatggttgatgtcagcaacaagatggttggtgccccaggtaacagaggattcttctattaa

SEQ ID NO: 12860 - DNA, 192 bp, Candida albicans
ggaatcctcgtagtttttaaggatgtggtcgtgtgttgtggctttattgtttatcaaacacttgatcaattccgcaatactaaaacgagaacaataaaaaaaacagagagaacttggggagagagagtgtgtcccacgtcaactagtcaaccctttatcttaaacacaaacacctacacgaaaccaacataa

SEQ ID NO: 12861 - DNA, 381 bp, Candida albicans
aaatttagtgatgaaaatagaggaatatctaggggtatttatagttttttcatttcctttttggaaagaaaatattttattataaaactgaataattataggagattagcttgcaagagtgatcgatgtacatgggagattaggggggaaggagatagcagagagaatgaaaaaattgaacgcccagcgaataagatggatgaggagcagcagcagcagcggagtcggtgggggtgctccagattgtgtcacaaaacggaattattgactaggtgtattatactccactacgtatttctctttttaattcaacgtgcttttaatagttggagtgtgggagtagttccttttactttgcatgcacaacatacatttctttga

SEQ ID NO: 12862 - DNA, 303 bp, Candida albicans
  unsure (234): Identity of nucleotide sequences at the above locations are unknown.
ctacgctatgtagaaccggccacatacaaaactaacgtagtttacataagaaaaagtttgtcaatgcttatttctatgaaaaatacacccctattaaaaccatgtgccgtttgtatcgtaatcacaccaaacgcttcaacaattgccgaaaccaacaagaggcaaataaacagagcattgctggcgagtgaaaattacaaacaaagaactcaaataatcaatatgcatcagatnacggtatatatatatgaaaaacatttaaaatatcctaattgggaatggtcaccaatgttcttactctga

SEQ ID NO: 12863 - DNA, 240 bp, Candida albicans
ggagacgatttcaagaatagggaaatctatacggcagatcgacaatgtttccaaatcaagcaagaccagacccactataaatccccatcgtcgtggccggctactccacaaaaccaacaactacttgcccaacgaaaaactttcggaactcaaaccactctacacagatttccaaagaaaagtgttccaggactttctcaaaccaatagagatccccaacttgaaaacgttcaatgctaa

SEQ ID NO: 12864 - DNA, 258 bp, Candida albicans
agaatcattgaacttcctatttcagaaaagcaaccaaagcccaatcaaccgaaaaacaaacaaatcttaaaagttaaaactccaacaaagggccctaaaccaccatgtgggtcacattcaccacccatctcaataccgaatttgctagcggtatatccacaaaaaggtgtgtttgctgatatatcagatgctactatacaagctagcaggtcaaacccacagtcatatggttcgggagatattttgggaaggaggtag

SEQ ID NO: 12865 - DNA, 216 bp, Candida albicans
gttttatatccaaatttaatcaccatacagtgtgttttagataataagaataaattgcaaaattatttctttgttttttggcaatctcatttaactaaaagactatttcatcaagaggagagaaaaaaaaaactcatcaaatctgaaatttcttttatttacagtgattgtcgtttattcaagagtaatttttatgttgttttctttagcaactaa

SEQ ID NO: 12866 - DNA, 483 bp, Candida albicans
  unsure (411),(434): Identity of nucleotide sequences at the above locations are unknown.
gctaaaccgtacgctatggatttgttagatgggatagaagactattcagctagtcaattcaagccaactcaagttaatgctatggctactacccaacaagacaatgaaaactcagattctgataatacttctcaaactcaaccaaaccaatcaatattaggatttgattttaatatcacaacaatatctaaagcactcaattcgactaatgataaccaagacaagggtgatgatgatggtatgccaaatctaagtattttagataaagttaagaatagattgttaggaggcggtgacgcgtcggatgaagatgagaacaccaatccagatgatgaagttctggataagacccagaagatagttcatccatctactggctctgcatttcaattactaccacaactagaagtnggggggggtgggtgggtccggtnatctgtcaacacaggtcataccaaagatgaaaccaacccaaaagattga

SEQ ID NO: 12867 - DNA, 198 bp, Candida albicans
attgaattcaaagatgagaatttgatttctaaatcatccaaggtgaactttgatgttctatacgaatgtcttacacacaaggagactgtgtttcagtcttttttactaacaacatcagcatatagcatctacatttataatatatatatacaatttagttatcgtttattaattatttattcatctcgtaggatctag

SEQ ID NO: 12868 - DNA, 195 bp, Candida albicans
aaattaactttgatcaagccctggagtaatcgtaaaaaaaaaaccgtcattgatctagacgtgcaacttgccacagttgattggtcgcactgtcaagacccgatctcaagtaaatcctcaactctcattgatgggggacaaaaaaataataaaagaaaggtgatatccagtgatttatataatctggggacctga

SEQ ID NO: 12869 - DNA, 234 bp, Candida albicans
cttatttcgtcgtcgacattcctaccatgtggggatcttgacagaaagacaaaacccatcaaaataatttggtgtagatctgaatcacaatttattttacttctgttaattcaacgccataatactactttgcccgagagagttgacaccgggccaaattttggcattttaatctgtttcttttataaccaacgtattacagccttttttttgcgtggtgttaaagattattaa

SEQ ID NO: 12870 - DNA, 261 bp, Candida albicans
gcaaaatcgctctcaaactctcaatatatgggcgattttaattcgatggtcgattacaaaaaagatactgttgtaaaacaggatctgcaatattttatgtgcagtcctttcgaattcaactcagagagttcgacgaatcctttatcattactattttattattctctattatatactacttctcttaggataactattcatacttttattacttacaattattatatactgataattagcttcgaatctatagaaagttag

SEQ ID NO: 12871 - DNA, 195 bp, Candida albicans
ctcccaaataataatgatccactattatatctctctttcattctcttgattggactagataaatcagacattccgccgaaacaaaaactggaaaccgctagccgctatcacaaaatattgaaactaatggcgttaatgggattgctaatacattttcaaaaggatcttaattcgaataaacaattgttggattaa

SEQ ID NO: 12872 - DNA, 273 bp, Candida albicans
caaaatccaagtcctatatatttgctgaataaatattttaattttgttatgaagagcaacaaagaattggttactactattcacaaagctaaattcttagaattaggttatggattggttaagactactttggtactgtggataatgcttttatacctgctgttcccaatccatgacaatccattgttgtggccgtatggttttatcctatccaactttggtgctgcattaatagatgtcttgagtttggttccaggtgctatcttttggtag

SEQ ID NO: 12873 - DNA, 270 bp, Candida albicans
acatgcagatatgatgataaagtaattcatcgaataaactgcaagatattattaatccattttcacaaatatcctaagatttgcctatcactttacctgaaagatttgaatattaaatttcagttacaatttattgcatgtgccagtttcattatcgttatttccctagtcaatcttccccttcttgttaattacttatcaagttattgtaacgttagcaactgtggtcaaatattaaacttcctcagttgtttcgggagcgatctgtag

SEQ ID NO: 12874 - DNA, 276 bp, Candida albicans
aagagagatataatagtggatcattattatttgggagttacagagagaattggtcaatggcgtcaagttataataggtcatttggtattgtattttgaagttcccattaatttagacgctggtccgttaacctatctaatattcatatttcaagtgatattcataaatctacaatgggaattgtgttttagagtaatgtgtttggcagaactagtcacacttggtattggtgtcatagtcgttacttggtttgttgtgtcagttgttgcaaattga

SEQ ID NO: 12875 - DNA, 204 bp, Candida albicans
atggaatatgttgtggtcaatatcaaagagtggttatttttaaactggatcagaatccaaccttccttagtcacctggttataccgaaattcaggtgtttgtggatattactactttcgcatggttgatgttttaggtaataagaatttaaaatatataccattggatttgtcctgtaacgtgaaggataagaatgattattga

SEQ ID NO: 12876 - DNA, 219 bp, Candida albicans
ttccatcaagtttctatggtgtgccactctatgcgaatgtctacgtccaaaaaaaccagcacaaaattttctcatacattaaaatttattcttacttatcatccaccttactctcttctagactacatcaatgaatcaacatattatatacactcgaagatagataacatggtattgataaaaatatgttttatcctggttctctgtatcaaatattga

SEQ ID NO: 12877 - DNA, 252 bp, Candida albicans
aaatctttttttggcgtcaaatttgtattgaattatcatcaaaaattggcaaccaactatttttttttctttgtttgtggtttaaattctacaatacatacaaatacaaatgccgtttctatagatcttataatgattaaagaagatataataagtaacaagttgttcgttatatacaatatcaatgaagtagaaactgatgccaaagacagcgcttttatgatcaatccacaaagaacaatcaattcttga

SEQ ID NO: 12878 - DNA, 330 bp, Candida albicans
cgtgagtcccaaattgttatgtcgaatgcgatagattttggagttgttgacgattcggaggagcctgcggtgtacaccacttttttgccacgcccaatatctgccctagccagggttaatttggtgctacatgagcaccccgttgtcaagtataagaccatcactagggtcagaggtggtgatgagccgttgttgagtggggaagaagagaggtacggcacagaggatgaacgggatactgagaaacgtttggtggaacataactatgattggtcgttgcagtatttgcctggtttacaattcggggtggtgagtattagaaggagttaa

SEQ ID NO: 12879 - DNA, 270 bp, Candida albicans
ttgaacaaccccctagtttggaacaatcttcttattttgaaatactctatacctcaacaactcctcgaacctcaattacaactatctcaaataaaccgatctctaattcaacaacaccctacccaatttagaactctcttctcactcttaaactactctgagtatgaacacctccctgaacctaaattaaaacgctctcaaataaaccactctctaattcaacaacaccctacccaattcaaacatccgtacggtcaatcaactatctaa

SEQ ID NO: 12880 - DNA, 219 bp, Candida albicans
attgcacaatatgtaacttcggccaatggtatttcgaccattttctgtagaccactaaaaaaagtgcatgcgaaatttgaacacgacaaaaaaaaaaccacagcaatctatcagataagactaatgctggaagaagatacgtcatcagatagagtacccccaccaaatccaaatgcatttgtatgtggtgttagatctaggaagacatcgctaatttga

SEQ ID NO: 12881 - DNA, 192 bp, Candida albicans
ggctatacccgatgggttttcaaaagaaaagggcaactacatctacaaggagtatcatgttgggtatgcgaatggaagtggagggatatggtgccagcctaccaggaggtggtgcattatagtccgaactgggtgacttgggcgaacaaagagagggggttagtaggggtagtgaagtatgtagatgtatag

SEQ ID NO: 12882 - DNA, 459 bp, Candida albicans
acagggggtgcgcttttttcaaatggcagattttttacgaattggaatagtcgtgtggagcacaatttcttgcgaactctaatcaggagtgtagttagacacacaactgtcatggggtatattcgagtgatctattatacaggccccctctttgtttttatttactctacatatagtttttgcatagtaacttgcaatctaattaataagaatgtagtgacaatgtttagaagaggggttttgactgttagctacaccaagagtagtaaagctgtcactgcccaagatcttacttttacgctgggtatcacaagagtgttttgtaaaagttttaagctgatcaaacgattgaagactttttgtttaagaaattggtcaaaatttccaccaaaaaataaccacctcaggatagttgttgtagagtcgactgactcaagtaaagaacggagtgcaatttaa

SEQ ID NO: 12883 - DNA, 303 bp, Candida albicans
cgacaggtgaagagaaatttgtcgatcaaattccatcccgaaggttcttcatcagagatagtgttgaattttcccaaaattttttggacatcttcagatgtagccccagccaagactaaccaagggggggccactggtttaatttacggaagtctaactgccaacaagaacgacttgtacgtgttatcaactccgaattcaaaaatccctcaagatctagctaacactaacaaatgcctaaccaagctgaaccactctaaaactaccccctgctgtaatcaccacaacaagtcaaccatctag

SEQ ID NO: 12884 - DNA, 225 bp, Candida albicans
caaccccaattcaaccaattcggcacactctcaaatgaaccactcggtaatagaataaccttcttgagatttacaccagtgaaagagtgtatagctagtttcaatgaatatactaaccggatggcaaacttgaataactgtacaatcaatttggaactctcttcaaatttcaaccactttgagattgaacaactacctgaaccaagaactcaacccttgatttaa

SEQ ID NO: 12885 - DNA, 225 bp, Candida albicans
atcggtatttttccatcctgctgtgttgattcgctgctggcacaaaagctaatgttatggcaaacatggcgagagctatttgtatttgaagatggtgaaataattgccctagttgatgaagactctgaccctgttgttagaagacaattggatgatctgctgctccgtcaaattgaacagagctatcacgggattcttccattggttctaagcagccgcaaatga

SEQ ID NO: 12886 - DNA, 447 bp, Candida albicans
aagaaggaagaagaggccaaaaagaaggcagaggaggccaagaagaaggaagaagaggccaagaaagcagaggaggccaagaaggcagaggaagccaagaaggtagaagaagcagccaagaaggcagaggaagccaagaaagcagaagaagaggccagaaagaaagcagagaccgccccacaaaagtttgacaattttgacgactttattggctttgacatcaacggcaataccaacgacgaagacatgttgtccaacatggactacgaggatctaaaattggacgacaaagtacctgccaccacagacaacaacttggacatgaacaacatacttgaaaacgacgagctgatactagacgggttgaacatgacattgctcgacaatggcgaccacgtaaacgaagagtttgatgtagacagctttttgaaccagtttggtaattag

SEQ ID NO: 12887 - DNA, 294 bp, Candida albicans
aaagaagaagatcgaaaaccaatagtacagctttatagaatttccatgactgattgcgaatggtccaaattagaccatgaccatatagaacgttatccagagagtctgaaggagaaggaaaatgaaaacgaccccattccatcagaagttttggttatttggaaacaattgaaatcagttgttgacaccgttttggttagaaaagagaagagaattaatgttgagcaaatgttgcaaatggatgaatttaaatggattaccgattgcttacctgatttcattgttaatgtataa

SEQ ID NO: 12888 - DNA, 195 bp, Candida albicans
gcctcaacaacaagaaccacaacaaatgaaaaagaaaattcaaagactacatcaaaagaaaatgaaacagttagacctgatgatatattgattaaattaaattatgactatttattatcaatgaataatttacaattaatgataaatgaaatcacaaaaagttgttttcaatatttacaacaacagcaagagtaa

SEQ ID NO: 12889 - DNA, 198 bp, Candida albicans
atttggtttggatattattttgttggatttgaatgtactcatactagctatgtgttgtttgttggaggtatttcgcagggcaataggttaacaattaaattgatatctatagttacaaaaattgggaaatcaaacagatataaattgtcccaatacttgctaaatcttcccacgggccggaagatccgcgatgcgtat

SEQ ID NO: 12890 - DNA, 183 bp, Candida albicans
tggtaccttaccagatacctggtcattggggttattatttactcaattctaggaaaccgattaccattggatataccaccacgttcatcaacaacacattctaattcatctacatctcctaatagaggatctcctacagtcataaaaagaagaagatcgaaaaccaatagtacagctttatag

SEQ ID NO: 12891 - DNA, 219 bp, Candida albicans
ggacgacattgttctttggtacggaaatttgtctcaccaatagtttacccacatggaatctactcacacactattaaggtgttaatcacaattcactattcttatattttagttgttacactttttcgatatatatataatagtacaacactcactctattgatatatctacatattctaaattctgcttctaatatcgaagttgttctctatatataa

SEQ ID NO: 12892 - DNA, 2019 bp, Candida albicans
cctattgccctgcgaaatacctccaacaaacaacacatagctagtatgagtacattcaaatccaacaaaataatatccaaaccaaatttacaaccagtcaactcaccaacaatctcagaacaatctccagcaactacaaaagatcagcaagcacaaatggatcgtatccccactctggaatcaatcttacccccaagtaatttgacagatattgaatcatttgatcaaaatcacgaagtttctcccaaatcccgtcgtacagaaagttcatctgtatatgaagaagcagttgataccacttatcaatatctccaacaacaactgccacaacaaccaactaacactagtatcatctcaaaaaattcaagcaatgaagctatcccagtgtcaattaaactttcacagttaccaaataattcttcgtcttcattgtttattaataacagaactagacaaccaaactcaccttcagttaattcacaaagagggcatagtaaatcaccaagcaaaaattcacatttttcaaccagagatgaaccaattaaagaaaatttgaaaccttcttcagagtcatcttcggcttccacacattcattagaatctccaattactccattaattagaaaaactaaaccatcatcacaatcgatacaaaaccaacaacagaaaagtccatcgtcatcaatggtttcacctgggcttttaattacgcaacaagaatcaacagactctcagcatcaaccatctccagctttatcgcatctgtcagtatcaacatttggtcataagaaacgtgaatcaatgttgtccacatactcaggagctgttgaatatgatgctgtgcccatgacagttaaacgatcaagtagttccaaaatcaaatacgtcggtaatgcatcgcaaggcaatgctaataataataataattacaataatatggtttcttcaagagctcatcaccggaaaaggtcatcattatcatcaacgtcgacatcaaacaagtatagtgatcttaatacagtttccgatacaaaactgattgaaacaagtcaattattaggaggtgatgctaataatagcaacaataatagcaacaatactagtaatagttctagacgcaatcgtagctattatgatggcgacgaagaagaagaagacgatagttctatattaatggggaaattgccaactagatcaagtaaagaagatgagttaaaggctcaacaacctgataaaagtgtgaccactaatattgaagggtcaattcctgctagatcaccaagaagaccggcatctgtgatgtcacctaacttttctagtatcgatatgattaacagcagttccatcagtaacaataccactggttcaaaagataaaagtcgtcgtaaaagctatgttgaagataataaaagaagatcaatccagattaatgatgggttagaaaaattaatgttagatgctacttcattcactagccaagatgagaatgaacaacagggagacgaagaagaaccagactatgataatactagatttattagagatgtgacacctaatcatttaaatattcatcgtaaaaatggtgcagatgaatataatgaagatgatgatattacacctaaattcgatccatctttagtgacggcagggtcacataatggagttggaatagatgaattagataataatattccaatatcatcaagaaatagctcttatgaactgtggtcacgacatgagtctaagagaaaatcattaactcaaccacttaatttaccaccacgtccaactaaagataatctcaccaaggcaagaacaatctccaataatttacaacaacaacaacagcaacagcaaaacttacaagaacattatgacactttggatggaaatcccgataatcttaatgccattgaaggagaagagatttttccatcaacaaataattatgttgatgatgaagaatttgaacaagaaggaatgcccagaagccagaaaacccacccaccatgttgttga

SEQ ID NO: 12893 - DNA, 1251 bp, Candida albicans
gctagcgcggatcttgacccccgtgggcaagacaaaagcggatcaggtctaccaaataagaaaaaaagacgaagatcaactgcaaatatcgattctgaagaattagcaaaacgtaaaaatgaaactaaacaattacattcaattattgagaaaagacgaagaataaaaatcaatcgtgaatttgaagctttaaaatatttgatcccggcctgtcgaaactgtaatactggttccagtggtggttctgccacaccaacttcgtcaactaaaaaggcttcaacaaacagtaataacaatggcaataagattgatggaatgtataaactcacaattctcaaatcttccgttgaatatattttatatttgcaccacattatacaaaagcaacaccaattattgtcactgattagtgcaaaagacactaatggaggaatacttgctgaaaaattgaaggcattcgaggattttgatattgactttgcaaaagttccattgaacgttaaccagtatcgaaatattgataaagattttaatttcaaagatttaatgcaagacctagatggtagatcagtgaatacagaatcaccagaaacaataatagaagagaatgaacctgtttctgagaccagttctactaacaatactaccacgttgcattattctaattcttctgtattaccttccagaacatcaagtattgtttctagtcgtcaatcactgctgttaccaacacctgagttgactccaatactatcaatattgaacaagtattccaccagcaataatcaattaaataatagaaaaaattccaatccaatctcaccacaaactgtttgtatcaaatctcaaaacccatcaccatttaccatgccaatgaaatcttcattatcaaccagtatcgttaattcaccttcatcgtcttcctccttaagtggtagcaaaagttatatggctggcaataatgcggtaaatacagtaaagttttcattaccagatcctgtagtcaatccaaactcaactttaaatgataacatacctagaaagggactcataagtggaataccagaagaagaggaagaggaaaagataaataaaggtctggcaaacacagaaactgtgaattcaggtagtgcaagcagcgacgaaaacaatgataatgatagaggagtattgctcaaattaactgatcaagacgtttccaaaactttacttgctttgaggaaatcaagtatagatagccttttgaattaa

SEQ ID NO: 12894 - DNA, 189 bp, Candida albicans
gtggaaataggaaagagaggtgagctcgaaatcaaaacaacacgcttgagattgtatgtgataaaatataaaccacaacagaatttagttcgagatgcacgtcccccccctcatcttgtggccaaaaaaatgggcctagattttgtttgcgacaaattgtggtcgcccgacgtacccaaaaaaatctag

SEQ ID NO: 12895 - DNA, 231 bp, Candida albicans
caagctttaatagaatttgagtactcgataatcgagtatttcttgaatttagatatagtcaataaacttatcgagcaagctacaaaactttatgaagctgaaccagcaaataacaacaattcatatcaactaaaaagattgtttgagtcaagaggagaactcaagttactgcagagatctagtttgatcaaattggcacgtgaaaatagcatcgaaattaaaggtttggat

SEQ ID NO: 12896 - DNA, 195 bp, Candida albicans
ctaggtctagatattggttcagcaatagtgattaaaaaatcttgtgcttgttctgccaagggcgaaaatgattctaaaatgattcttccatcattcggtgatatccatattggtcttgaaaaatggtctggttttagtttcaaatatgaaaaatcacctttgccaaaatttttggaaaccgcatcaggaatataa

SEQ ID NO: 12897 - DNA, 201 bp, Candida albicans
acttacaaacaatttgttactacaacaacttcattgcaaataatgtttaatcaatcaatcaaaacacctttattaaatagtcttttcctttattccttagtatttgttggaagtagaagaaaagctcaaactatgaaaaataaatatatatccaatctatatctgcatctaatcttcgaatttataggacccactagctaa

SEQ ID NO: 12898 - DNA, 555 bp, Candida albicans
gaaaatagcaactatcttcaacagtatatattttctagcatatcattagcaaagatgtttagcagacagttggcaagacaaattgaacgtaacaaacacgttagaaacttttcattgacccaatggttcaaatcatggaaagaagctgcccaatcacagcggttgatttatcctcctccagcctcgcaattcaccacacagaacagaattattgacacatatatcaccaacaagcaagaattatacacatacctttctgtgaagccacccttgttattaaatttcacgtttgctaccaaggagaacaacaaagttacgcaagctttatttgatgttttgagtgacaagtccaaatacccaaataacgaaccagtttaccttgtaaatattttagcagattcagaaggtggaagagagttaatgctagattacgttgtgggatccaaaatacctagcattattgttttaaaacatcaattgccgagtgggaaatatgtcccagatttagagacttttacagaacaagatttaattgaatggttgaaacatatttga

SEQ ID NO: 12899 - DNA, 219 bp, Candida albicans
tttgatttgtactttaatatatacacatattttttttcggttcaatttattaaagaagtaattgaatgggtgagtgtggctggggagagggaatatttagcagccagaggaaaaagagaccaagattcgtttttgggctcatctctctcttactcacacaaaagaagagctacgattaaagttggcccaaatgggttggaaaaaaaattttttttttaa

SEQ ID NO: 12900 - DNA, 222 bp, Candida albicans
ccagattttagtaaggtgcaaatattattatttcatctgttacacccgaaaaagaaacacacccaaaagcacgagtggtctataaatgaatcattaaacactactgttgaaaataccatctttggtgtggatctgaagatcttattaaattcaacactcaacatttctgattataacatcaatttagcattccttgtagattaccattccacgaaagagtaa

SEQ ID NO: 12901 - DNA, 204 bp, Candida albicans
agttgttgtagtaacaaattgtttgtaagtttatcgcgcacgactatacataatggcattttgttaacaaaacagagacagaaacagaatattagtcttcatgatttgcttaagaggagaaaaaaaactaccaaaatcaatccatttttcttagtaatcataagaaattatactttcttcttgttagtatttgcttatcactaa

SEQ ID NO: 12902 - DNA, 198 bp, Candida albicans
cctataatacaaaatttcagttcgtctaaagatgccatgaagtcttttcaaaactctttgttaatacagacggttccattaatgatcatgactgtcttgtcatgttcttccacagaaacgaaattgtatacgcaatataaaatatgtgttgttttcattttgttaggtgatcgggcgggttgcctaatcgagcaatag

SEQ ID NO: 12903 - DNA, 198 bp, Candida albicans
  unsure (73),(74),(142): Identity of nucleotide sequences at the above locations are unknown.
aaaatcaggaaaaaaaaaaaaagtcgagaattctgttgtttaagtaaggaagagataatgggtgagaaaatannatatcaatacaatttccacgacattctagaaacacgagacatgggatgttctctcttactcttgtctnaactgcaaaatttatattctaatcaacactccaagcataagggcttctacttctaa

SEQ ID NO: 12904 - DNA, 192 bp, Candida albicans
agtaagagaacaatcatttatgacactagctttaactttacaataattttttatctattgtatttatcaaaccaatcaaacactctgattagtattcaggcgagttggagatgtctaaaaaaagacagcaaacgtatttgtactacaacaagaataacggaaattgattattttgcaaccaagctaacgtga

SEQ ID NO: 12905 - DNA, 303 bp, Candida albicans
aaatatatgaatgttgaaatctctctgatattacagcgtgaagaagaagaagggacgaacgaaaaaaaaaaaattaatcctattctactaataaacgcctgcagttttacttcttttttttttttttttgttttcaacaaagaaaccagtcaagtcctgtttcacatattcttttccttccaatacttctttcttctttttagttttgtacatatttcaatcagttttttttatcgtcagtcacaactatcatccactattagaactcaaaagttttcattgttcttgttagctgtattttaa

SEQ ID NO: 12906 - DNA, 192 bp, Candida albicans
ttgattaaattattgttagaacagaaaaaaatagaaggaaaacttgaaaacttgaaaataaaggatctgtcactttttatattaaattattcaaaacattacttgatttacacttttttactccctaaaatgttattggttttcgttaaggttcttttgaattggactgtacggacaggttactggatttaa

SEQ ID NO: 12907 - DNA, 267 bp, Candida albicans
gcagtagtggcagtgaactacgatgggtttgttggatttgtatttactggttgccagcacaaaaacaaaaaatacacgattacacgtactcatttgtctcaactagtaaactttttatctcaaataggatttttggctttgcaacccgcgcccgccttgagaaatttttgtagatcggcaaaacctgaaacaagcacaaacacaccttcaaacgaacaacaacgacaacaacaaaccaaactaccagcaataacaaagcaaaactaa

SEQ ID NO: 12908 - DNA, 204 bp, Candida albicans
tattttcacacagatcattcgcttaaaaatctgaaatcaaattcctttttttttctaaaaattccaaacaatacaaaaacaaagaaggaaaaaaaatttttagaactaaaaagagctacgttttcaattacaattaaaacattatatcccttgcattataccaaaacttatagacagacgacagacaacagacaacccgcttaa

SEQ ID NO: 12909 - DNA, 351 bp, Candida albicans
aaactagactttgcttgtgcaatttttttctctcctccacatcaaaagttcattaatttttttctttgtccagcggttcaaatttttattatcgagtggagaaacaaacaaacaaactacccatttgtagacttcttaattaggtatgttaatgcggaatactcttctcataagtttaactttagttttaattttatttttttttcggggttaattctagtttccattttgcaacaattggattggaaccacacaactaattttaaatattcaagagatacaaagaaaaggaaagaatttaaattatttctaaatattctagtagtttattgttttaaataccgaaaatga

SEQ ID NO: 12910 - DNA, 189 bp, Candida albicans
cgaatggttttaataaccgcataccatagaaaacaaagaaaagatgcaactgattccgatgggattagtaagtttattaatttaaatttttttttttcatttttaaaatttctgtcacataatgggatatttctacatcttatatatttatcagcaatgagatttgtttacttacaacaagtcaattga

SEQ ID NO: 12911 - DNA, 189 bp, Candida albicans
catttatacccctatctttccacaaatatgagattttctcaacatttctcacataaattgagactctactactactttttcttcttatcattatttccagagttctatattcatgaaactgaactagaaagatttaaaaagatcgaagaatacatatattcttttgataaaactaaggaatctaaatag

SEQ ID NO: 12912 - DNA, 234 bp, Candida albicans
acttttgatgtggaggagagaaaaaaattgcacaagcaaagtctagtttctagtactagtattggaagtaatagtagtagtggcagtaataataatttattcaaaaccattcagattttttttttgtcgttgttgacctggagtaatattagaatcaaacatcaatctaatagcaacttaattgattatttaccctcatctcatagtgttgacgttccatttacagatatataa

SEQ ID NO: 12913 - DNA, 255 bp, Candida albicans
catggaacaactttgaaacaacaaattgatagtttgtatttctatttaattgtatctagtaagttaataataattcattctctcttttcttttttgttttcattcaaaacaaaatttgaacctatatattcacattatggagccatttcttcatcatcagcaccagcttcttcttcttcatcatcatcttcttcttcttcctcttcttcagcaagttttctagcttgttctaataaatcatcagaaataaattga

SEQ ID NO: 12914 - DNA, 702 bp, Candida albicans
ctgttacctatggttgcttatagattaccatcacctgctccttctagtactaatactactaattgtttccctcataataataaacggaaaaacagtttaacctttcatgatgataccaataccaatgccaatgccaacaattatgaacattatattgatgatgaacgtatagtgaaaaatttaactaaacctgatcaaattacttcggaaactgaatggccacaattcattcatcccgatggtggtataataaaaatcactccttggggtacattaagacaatttgttgaccctaaaactaatgaaacaataacaaaatttgaagattgtagtttagaagattattcatttaaactggaatcaattgaaaaattatatcaaactccaaatactccacaatcaatatatcataatgctggacaagataatataatacatacacctcataatgggaatagaaatttgagtggattgataattagtccagaaagtgaagttgaagggtacgttgtggatggttatagacaacaacaacaacaacaacaacaaccacaacaacagcagcagcagcatcaacaatttcaccaacaacgcgattgttttgtgccagaacacgaaaactattttggaatgactgatgatactgtaaaattagaagatgaaattgattctagttttaatatcgatgaagaaatgttataa

SEQ ID NO: 12915 - DNA, 255 bp, Candida albicans
cactcaaatttaagagcacagaaaaaagaccactcatttaagaccgcatctttggtagcactcatttctaagagcacatttttaagagcactcaaatttaagaccgcatctttggtagcactcaaatttaagagcacagaaaaaagagcacacacttttaagaccgcatctttggtaggacttattcttgtaggggcacacaatgaagagcagaatcggggctacacaatcgacgaagaagttagacatccgtaa

SEQ ID NO: 12916 - DNA, 288 bp, Candida albicans
agaccacatgttggggaccacttctataactcgcccaattttggggatatcgcaaaactaagggtatcagaggaaactagagaagctctagttatcagaaatcttgtttgcaggtctgtagctctaatatacgtcgagttctggggcgttgaaaaaacgggtattttttgggccaggagaaaaaaagtggatttgccagtgcacgacccgaaaaagggagaatttttgaaaaatggcgaaatttggggtaagtttgagagagtgtggagcaacaacgataaggggtga

SEQ ID NO: 12917 - DNA, 267 bp, Candida albicans
gaccacatttttttttgttggaagaccgcagaaaagagagcgcacatacaaaatcaagcacacacttttaagaccgcatttttaagaccacatttttgtcacgtgagtaagaccgcatctttggtagcactcatttctaagagcacatttttaagaccacagaaaaaagagcacacacatttaagagcacatttttgtcacgtgaataagaccgcatgtttggtagcactcaaatttaagagcacagaaaaaagaccactcatttaa

SEQ ID NO: 12918 - DNA, 267 bp, Candida albicans
ccccgattctgctcttcattgtgtgcccctacaagaataagtcctaccaaagatgcggtcttaaaagtgtgtgctcttttttctgtgctcttaaatttgagtgctaccaaagatgcggtcttaaatttgagtgctcttaaaaatgtgctcttagaaatgagtgctaccaaagatgcggtcttaaatgagtggtcttttttctgtgctcttaaatttgagtgctaccaaacatgcggtcttattcacgtgacaaaaatgtgctcttaa

SEQ ID NO: 12919 - DNA, 300 bp, Candida albicans
ctatttgcgtttaacaatttccacaagcaccctgactttcgtctttttttcggccggttttttcgtaaaatcaacccaaaaaaacacaacttaaacttccaaaacaacgcaaacctaatcaaaacagaccctactaccaaagtttaccacccattgcggtgctccccctgtctcctgatctcccgtcattgttcctttctcggccagaatttccgtaaaactaaaaagcctactagatctgcacaacagggtgcccctaaacagacaaggctcgctgctcttcgatttacggatgtctaa

SEQ ID NO: 12920 - DNA, 1881 bp, Candida albicans
caaaatttgttagcaaaaaaatttttgccatcttttttccgcgtttccatttgtatggatcttgctgaagccatcaaggcagcacattgtaggatggaggagaccctcaccagagggtcggaattgagcaaagccgaccaggctttgctcgacttgctagattatacaatgggatacgtcgagtccatactgccagaaaagtggccatcaatgttaaacagacttgagggtgctagtaccaaattcattttaaaatctaccgctgctcttggtactgacaaatttactggcaaccacaccaacttgcagctcgctggagatgaaattaccgatattgctgaagctgaagagcaaatcgagaagcatctcaaagttgacttggtttcaatgatgcaacagcaattaaattccgaaatggaagacaagaagaaaaaggcaatcttcaaagcgtatatctacgccagtgaaagggatcttttccgtacacgttttcttgctaatgaagaattgagagtggtttacgacaccaccatccagaaattcagggaattattcccatcttttactgttagaaaagtagttgaacaagtcattggctacttcccaacttttaacgacggtgctaacaacatgaaagtatttggtactacttatgacaatgttggattgtttaaattgaagcatccagctgagaaatggaatgtgaaaaaatgtattaagatgtttttcaacgacgacaagtctgactattcagatgaattgttaagacttgcttaccttccagctactgattacaacattgaattcactattcttgacagtgaagttcacaatgctaaaaggggtactcgtaaagcttattcttcaagaaaatcaactcacagctacttcctcattggatataacggtaaatctgttccaaaacagacccgttactttttggacaaccatcgtttaacactctgttccaccacaaaattctgtactgcttgcagaactattggccacaccaggtggtcttgtgttaacagttccagttgtttaaaatgtggtgacccaagtcactccactggccaccataatgcttggtatgatcgtcaagagactgataatcaagataacaatgatggttacactacagttggtaaaaagagaaagagaaagcggaaatccaaatccaatactacttctactgccactgctaatactgccactgctacaactgccactgctaatactgccactgctacaactgccactgctactaaagccactgctactacttctactgccactcaggcaactactcaagctgacaccacaaaggctgtcaccactcaggcaactacccaggctgacactcagccttccgccattcaggcaactacccaggctgacactcaggctgacactccgccttcggccattcaggcaaatactcaagctgacgccaccgaggctgtcaccacccaagcagacactcagtctactgtccaaactctggacaaaaataacacacaaaagatttctaaagtagctccatctcaggatgttgagcaacttgacgaaatcaacaccccctcatggcttgctagtcaagctatgttaccaatccctgaagctccctcacaagaggttgagctcaatgaaggaccagacaaacttttgttcgatgaaaatgagtacattgagactcatgactactttgaaccttcggatttctacaagtccggagacgatgatgactacatggatgaggactcagaagaagagaactcagaagaagaggactcagaagacgacgacgaaatgtcaattgatgcggtttcggaaaatgaaatcgatgaccttcaaaaagagaatgagaatgatcaatactaa

SEQ ID NO: 12921 - DNA, 231 bp, Candida albicans
aagcgcggtcagaattcctctcacctcaaccttcaaaacattaaaattgtggcgaccaatggactaggagtatcccagatttcgataaaagcagcactacaaaaaaaatctgattttattagtcggagttatcaagtttatggctactacgcacttttaaatattgaaaataagcaaaataccgttgagaaagattattgtatttatattaaaagtaaattgttattatga

SEQ ID NO: 12922 - DNA, 219 bp, Candida albicans
atagatgtgaaaattacaatacgtgtcgtgtactggaagaagaaattggtcacaatagcattggcaattcatttttcttttcttttagtcaaattgtcctcacctcatcactatttctccttccccttctccctttctgaaaaagtcaccttagcacaaaatgagttacaaaatgccattcttaattgtagatattattattacatctgcttgaaataa

SEQ ID NO: 12923 - DNA, 192 bp, Candida albicans
cttttttgcggtgaaacttttgccggacatcccacatcgcctactttttatttattctgcttccactgctcacacactcacacacccacagttaccttcactcaagccgaaaaagacaagatagaagaagaagggaaaacaaaaaataagaaaaaaagaaccgaaaagagagaacccagaacccagaattag

SEQ ID NO: 12924 - DNA, 231 bp, Candida albicans
ttttactcattgacagactgcctttttaggacaagttcaaaatatccaagatcgggatttataaaaaaaaagacgcgtagtgggaaaatgaatagatgtgaaaattacaatacgtgtcgtgtactggaagaagaaattggtcacaatagcattggcaattcatttttcttttcttttagtcaaattgtcctcacctcatcactatttctccttccccttctccctttctga

SEQ ID NO: 12925 - DNA, 303 bp, Candida albicans
ccttgtattagtttgccaggttttttaaagatcatcgaaatattgcaatccattggaaatttagcaagccaaagcaggcaaagcaaagcaattaaggaaaatctcatttcggatgtaaagcaaaaaaaggtaaaatacggaaataaacacaatagaatttgtggcgatgcgcgaaatctcttcattaaaatttttcactttgttgctctgaatttcattcaaatacacagcaaattctctattgtaatccttagtcattcattactttttttggggggtgtacctgctgctgctcctacttga

SEQ ID NO: 12926 - DNA, 207 bp, Candida albicans
actggatctaatttagaaggattggtaccaaatataaatgaaatggtgaaatcacaaacacaagctaaaaagcaaaaggcaataaacacacccaccattgaaatgtgtacgggatggaaattcttggtattgaatatggcaacaaacacaattcccaattgtccaatagcagcacaaattatactagcaatggctaaacgaggttga

SEQ ID NO: 12927 - DNA, 237 bp, Candida albicans
aaccatgatttaaattttcaagcatcgtctaaaaaacagaagaagcaaattagtaaatccatggagggcaggtctaacagagaaagacagcaagcctggagaaaaagaaaagaagaagagaaacacgagatagtgataattgcttcaaattacaagaaaattgttatacatcttgcaggcttatcaattgttgaattggataaagaaagagctgaaaataatgagatagatgtttga

SEQ ID NO: 12928 - DNA, 198 bp, Candida albicans
atgactaaggattacaatagagaatttgctgtgtatttgaatgaaattcagagcaacaaagtgaaaaattttaatgaagagatttcgcgcatcgccacaaattctattgtgtttatttccgtattttacctttttttgctttacatccgaaatgagattttccttaattgctttgctttgcctgctttggcttgctaa

SEQ ID NO: 12929 - DNA, 246 bp, Candida albicans
ttgcaagtaaaccattcctcacattacattataaacaactccctaaactacaaatatgtcatcaaaaccacttattcgtttccaagtgatacactactatctcattccaataatagcactaatagtatggtgggggatgttaatcgccatgttgtcatgttggggtgcccaaggccgaccaatctattcatttatgaacggagaataccaaaacccagtatacatttccgatatcggtgccactaa

SEQ ID NO: 12930 - DNA, 189 bp, Candida albicans
gcaatggttgattccattttcgtttatttttggggccaaaatatttaccaatttctacaagaaaaaaaagtgcttaaggatttaatcaaaatcatatgggacaaattgaatttcttgttaatgccggaatcaattttacaaaaatcacatgatggtcaaaccaatacactcattttattaatacaataa

SEQ ID NO: 12931 - DNA, 294 bp, Candida albicans
cgcgtgtttctagcaaaagaatcagcatatctatcaattcaagcaacttttaagcttctattaacatttaatataaggattttacaatatctggaaaagattcttcttattgttgttgtcgttgctttcttttcttttcgggcaacaatcttttatagaattgaatactctattgctaatacacgtgtggttattgcaaattttaaaatattggcatttggcaccaaaggaattaactatgctaaacgagaaggacctgtcaatgaaccaataaatgaaggcaatcatgtataa

SEQ ID NO: 12932 - DNA, 228 bp, Candida albicans
tttgctttcaatggttggccaaagtatacttggttttcaggccacaagttgtttgtctccttttcaatatttaatgaacatctccaacgtggttttctcagcgtcattcaatttaatgatttgttcttatctacggaagtttatcttaaacgtataacgggaaaattataccaaaatagtaaactaaatcttagtagtagtagtagtagtgtaggaatggctaattaa

SEQ ID NO: 12933 - DNA, 564 bp, Candida albicans
gaaaagaaaagaaaaaaaaaaaacttggctatatatttgcaaccaaaaatcatagtcaatatgaatgaagatactacacaactgtctatccaagatgaaacatttcttgacacagcatgtcaacgaatattatcgctagatatcaaaggttctttattcggcgcttcatgtctcaatgttgagacaaaaacactccaaatctatgaagacagccaaataaatcatcctgaggtttatattgaatcattagtggatgaatttaaccctactattgtttttataagctctagaacgacgaccactgttgtctcgcttcttgaagacataaaaaatgtatatcaattcaagttttatattaaaattgttgcagatttcactaaatttgatactaaaagattggttgaatcattttataatctcgaaaataataacactgtacacatgttttccacttctgcattgaaatccttaaaccttcgaattgcggtatgtatttattcaagtcgatctagtgggtttttgcaacgactaacatttccacatatctcagttaggcacaattaa

SEQ ID NO: 12934 - DNA, 189 bp, Candida albicans
catcaattgctccggataatgtggctgggtttaatgagttccattggttgtaaacataaccacctacttttccaacgtattgcatatctcttgggtataatgcttaaaataggggaaaaaagaaagaaaaaagtgttgtacagaaataggaaagcaagaaagataaagagaattgaatttaaagattaa

SEQ ID NO: 12935 - DNA, 210 bp, Candida albicans
tgggtattatgtgtagatttatttgaaaatgaaaataaaatcataattcaagacagggacaacctatctatttatagtttgtcatgctctagtttattgttgataacaaaaattcattggagactgcatatggctttatcacagcattgcattccgttgggattccgtcggaaagcaaagggacttgccgatagcaattttaaaacatga

SEQ ID NO: 12936 - DNA, 1635 bp, Candida albicans
ttccataattactcagactctttgatatctattagagaaccattagtaaatacaatgaacgattatggaggactaggtatagttctcgaagaagcagagaacgaaaacaatctatcaaatctaagtcagcaacttaaacaacagatccaacaaaagcataccagtatatcatcacgacaatcaagtattgttagcttatcgaaaactatttcaagaaagacatcatcagcatcattgactcaaacaccagcttctcttactacagataatgaaagactaccacatcctgagatccagtcacaacagcaagaacttgacaatgaaaatgatcatgacaacgaagaagatgatgaagatgatgacgacgacgacgatgagagagtcaccagaggttcgcgaaaaaattcagcctccaaaattacgacggagattctattgccaccactacctggtgcacttgaagatctaattacgactacaccagttgcagtgaattcatttacgtccaatggttgtgatgacagtgtttccactggttcagataatacttcacatgaaagcttcaatttgggagagtttaaccaaatttatcaacattcaaaatcgacattttccaactcggctttgaattctccaaatttgttattgaaccaaaccaatttgcacgttttcccaagtgtttctaaaaatggtatcaacgatttttcaaccagttctaatggtgggactacgaacaatgtaacaacactaccacctccaacaactaacacaactacaacatccacagggaatgagaaaactagtccgttaaaaagattgaaaaacgggattagaaagctatccctcacttcaatcactagtagcaataacagcagtagttgttccacccctaccggtgccaagttctatgccaacaccaccaccaccaccactagtccagccaaccctattccattacgtccaattttgagtcctatacaagttgttaagccaccacagccactgcattctgtctcgtcgtcaacatcagccgattcatccttctcttctaagtttgaacgagctcgtgcgtcgagtcaaggaacaacaatatttactcctgtgactcctccagttactacttctcctgttataaccattggtgaagatttagattgcaccaaacggacattatccaagattgaacaatcttatttcgactcattgacttcacaaacagttaattcaattgaagaattgattacagttgaagatttattgaattacctgcaatatttgattcaacaacgaacagctttagatgatgttttccagaaaacaaaggaaaaattacaagcaagtggttggtgttctaatcacgatttaaacaatttacaattgcagcaagattcgtctcgttgtcaaattgatacttcattattgaaaattgaagaacgtttaaatcgtgagttttcctgttcagtattggggaataatactcctactaacctatcaaagagtggctcgaccactgctactcattctaaacagaactctattacaaagtcattagcaggtaacgatagcagagaaccaatggttagtccaagtttaaaagttttagaaagtagatgtgtttcattcacagaattttaa

SEQ ID NO: 12937 - DNA, 189 bp, Candida albicans
ccgcccccttataatcaggaatctttgaagatatatcatgaattagcaatacaagaacaattaccacgattgatgatgacaatattagatagagattgtaatacttgtcttcaagacatgtctcgtctcatactcttagacacaccaagcaacatattgttgcagtgtatgtcgaaaacccacccgtag

SEQ ID NO: 12938 - DNA, 195 bp, Candida albicans
ttgttgcttatctatccaaatgtaaagaattgttctctcgaggctcaattaaaacatattgtcgataaggaaaccaattcaccaagcgaacaaaggaatagctcattggttgaatctatcaagtaccctttttataacgtcaacttgtcagtttacaggcatggttctagatttgcgatagttacactaacatag

SEQ ID NO: 12939 - DNA, 243 bp, Candida albicans
  unsure (32): Identity of nucleotide sequences at the above locations are unknown.
gttggtgcgtaccggtccgctgtgatgaaaanctttatgttctgtctgcatcatggatctggttttcgatattcttacataaatgaaaatgaaaatttatactactactgcgatgacttgagtagtgaaaaaatttttttttttcatttttttgaagccatttacactaataggtcaaaaaaaaaaaaacacaaaaataatttaaaaaacccaccacactttaactttgttaaaaaagtgtaa

SEQ ID NO: 12940 - DNA, 210 bp, Candida albicans
cacaaacaaaaaaaaaagtattattaccaattaatgtttagtagattctacacaaacttgataatgcgggagttatttttttttgaagccactttattttcagccgacttatctagctacgagacagaacaatacttagcactaattcttaaaattccatactatttctatcattcaaaatgcattttaacaatcaattgtcaaatgtga

SEQ ID NO: 12941 - DNA, 249 bp, Candida albicans
atgcaacaaagtcctgaatttataaaaaaaagtagatcattgatgcaaaaagtgaattctttggaaagctttactttgaaccgaaaggagaaggcaagtcgtgcaacaagttattatttcgtgtacagtatccaattttggtttttcgacactaggtctagactccagaaacaaagtcctaataagaaaggtgttcaaaaacaatttaattttagtaaaaaaacacaacctgcatttcgcaatttatga

SEQ ID NO: 12942 - DNA, 225 bp, Candida albicans
gtgaacaggccattattcaggtattcaatccaaatctgctcttcatctgctgattctttaagtttatctttgtcaaaaaatatcaaaaacaagatgtatagaaagtatcctgtgatcatagtccaacactccaagtttgtgattttcccgtcagatagtatttccagaaacaaaatcaaaacaatcaatactattaccaaatctagcataagtatttttgggtga

SEQ ID NO: 12943 - DNA, 207 bp, Candida albicans
tacagtgggtaccaacgttacttcagagctcatgttcgactagaatggcgcttgctatattctatccagcctaaacaagtgtttatgttgtccagtggtttttatatgattagactaaaaaatctgttcagccaagttttaagtggagtaaaaccaaaatggtacaaaaatgacaaagataaaatacaaagtccaaattgcacatga

SEQ ID NO: 12944 - DNA, 633 bp, Candida albicans
tcaatggcggaaacaaatccaaacgataattctccaaaatcacttccattgcgacgtcattctgatgtgcttgttaatactggtactacgtatagcgccaccaccccaaattcattaaatgaaggcaattctattagttctcacagggaattgattatcccgtcatctgcaggcggaagacagcaaagtcctgtattagatttagtgcatccaatctcatcagggaacttgaccacgacttcgcaagagacacggacaagaaattgtattagttggtgctctgggttgttcaattttagaaactcgtctcaacagaccgccgagaatctgtctttgttgccagtttatcatgttaggtccaacacatcacccacagattcagctggaatgacaagcaatttatctgatttcatcagacgattgttaccggggttagcgcgggatcgatatccaaacacgttctcatggttgttggcaacattattaacaattgtattgattgcagccacattaggtctttacttttcgggcaatttgctggggctccttgttctattcagagctttggtttgctcggttttccgccaattccagccttcagatgtagctttaccgctcttttgtagaagctag

SEQ ID NO: 12945 - DNA, 693 bp, Candida albicans
tgccaaaagcacctactctccttacgttcgccgactaaaaaaaaatattggtacgcgaaaatgtttagatcggtttcactttcatcacttataccattcttaatcattgtgctgattgccatgcaaagacctgaaaatgacgttcccatgattatgcaatcaagctggttagttaatgaagtgattaaatctattaatagcaatgggcaatatatcaatgcactaatcaaaaaagattttcaaccaaccgttctaccagtttcgtttattttgagaatattaaagtttacggcaaccacagattcaaaagacattacggcagtattggccgattcgactcataagatatttgctatatttttgtttttccctgcaattgttgactttgagaacaagtatcatcacagaatgacttacaatacacgaagctgtttgatacgcatacataaagccaatttgaaatttatggacaagtccaccgtcaaaaagtgttatggtaggaagagtgatggaggcttagctattgcagtcctagaagtcttagagttcgacatattctttaaagatcaatacctgtttattaactcaattgaaaaccgattgaaatacgtttatgatgatgtagaatacaatcagctatgtgggaaaaagaagcataaaccagaatatgaggatttgatgtgtgacatataa

SEQ ID NO: 12946 - DNA, 258 bp, Candida albicans
ttttttttcgctttctttcccacaaggaatatcggtttagaaatgatgagagatcgcagtgaggattttttattggatgaaaaaaaagggcgccagtttacacgacctcacactatttctacatacaaagattttagactgtgggtatcaatttttcagtgtggttttgaatcaagcattcgtgaggcgagaaagaaaaaacgaaagaaaaattttcttcaataccaagtagtacatatacatttcagggacaactaa

SEQ ID NO: 12947 - DNA, 255 bp, Candida albicans
agaagattggttggtactggtaagggtggacaaaaacagcaaaaagctgatgggaacccaaaggggaaaggttataaagcatctattggaaagacaggtgataaagattctgttcctgctggtgctggcgctcctgctggtgttgatagccccaagggaaaagctgaacctgtacctgatgttgaagatgctgctgctgctgcaagactatctaatgaagacacagttcaacagattatagaagatactgcatga

SEQ ID NO: 12948 - DNA, 306 bp, Candida albicans
acttctcggaaccaacctaaaaccacgcccgagcaacactttaaagtgtttgaattaaaattccgtgcgaaaccacaccaaaaaacaacgccatcgagcgacacgtggtgcgagcaacctccaaataaaaaagaatcaacaaagcgaaaccatactacagataaagttacattaagatctccttgtttacagcttcaacaatcacaatctctaactatatatagacaagtagcaaaaaaaattaagctccaatgcggggaatcgaaccccggtttgctcggcgctccgttcctaaaaaagaaatga

SEQ ID NO: 12949 - DNA, 219 bp, Candida albicans
tccctggtacttataaacgttccaaacggacatatatcgacaagacagccaatgatcaaatcttcattgatacaaatgcatgttaaatttacagcatcttcgggacaatcatgggcaatttcattaatacaacttaaaaaacaagctggtggtgttgcaaggattgacttaagaaataccaaggcgatgactaatacaagcatgtcactttggatttaa

SEQ ID NO: 12950 - DNA, 741 bp, Candida albicans
tcattccaactgttattactatttcttattcatcttaatatactagcacatatgcaaggaagttacaacaacaatggtctaccaagaccctactatatgaaaccatccaaaaaaaaactgtcaccgtattcgaatttgaaagaaccaattgtatatttcaataacccaaaaagaaaattagtgggatatataataatgttcagtttaattgggatattaatgtggtggatctctcaagattttaaagggagaccagaagtcgaatatgaattagtcaagaatgaaaaatcaggtgaaaagaatactccaatggatcttaaaaatagtgccaatttggacaagattgtgaatgcagttggttcaaaagcagacaaggaaagtgaaaatctcgatttagcagaaaatttgtcagaaggttctaaaggacaaaagggaattggtgttactgaagcgtctaaaggaggaataactaatgaggccccagttgttgggctcgatgaagaagattggttggtactggtaagggtggacaaaaacagcaaaaagctgatgggaacccaaaggggaaaggttataaagcatctattggaaagacaggtgataaagattctgttcctgctggtgctggcgctcctgctggtgttgatagccccaagggaaaagctgaacctgtacctgatgttgaagatgctgctgctgctgcaagactatctaatgaagacacagttcaacagattatag

SEQ ID NO: 12951 - DNA, 555 bp, Candida albicans
  unsure (461): Identity of nucleotide sequences at the above locations are unknown.
tttgagtctccacacattccgtttacacacatcatgattagaacttcgatacgcagagtttcaacaaaatctattccatacgaaccaatacctaaaaacaaatataaccaagtaagatcagcatataatttcaaaccagcaaaaaatgatggatttgtgtatagtccaccagcagcaataatcaaaccacatatgatcactccatatatctttttaccagagaatgatccaagaagggaattagcaaaacaacatcgtattgatccaaaaattgttgccgaaatgccaattataagacaaatcaatgcccctcacgaaagacaatataatgttgatgcagatacaattaataaaattaaagaattacgagctgctgatcctgaacgttggacattgaaagaaatcagtaaagaatttaatattgaaatggataaattgcatttctttttgagaagtcaatntccaaagaaacctacagaacctgttaaagtggtgtcgaaaaaactattagatagacaaaagagaaaacaattatggttaagaaatcaatattag

SEQ ID NO: 12952 - DNA, 213 bp, Candida albicans
atcaagattttcccaattcttacagaacgacaacaatcccttaatcccatttccattgattccccagctcgaacaatagatacaccacaaattttacctaaaaatttggctcccttgtattcatatccaccatggcattttataattgcttcttcaactggtaattggttcaaaccttcttcaactaataaacgaatgattctatctgaataa

SEQ ID NO: 12953 - DNA, 216 bp, Candida albicans
cctctgataaaccaccaaacaacactatttaatattgtaaagcgcactcctttaagtttcgaaatgctttcacacatattaacaactattgacactaataattatacaaacttcggagtgcctgtcatattctatcatcatttaattattgctattagccatgtattatactttataaggggccaacaaaggtgttttagtggtccaatagtgtag

SEQ ID NO: 12954 - DNA, 189 bp, Candida albicans
ggaacaaacaagggggcagcacaaaagtctaataaccagccacaatatactgggaaaaagaatatttcaatggcaaatattaaaaacactttggcagttgaactgatttcgaacaatactttaaatgccttccttggagtgcccgaaattggttttggccctgatactaaaaatttcatcaacctgtaa

SEQ ID NO: 12955 - DNA, 555 bp, Candida albicans
ttaatattttgtggaggcgatgtcaagaaattaaatgctgacttatttcctgttagcgttaaagatctatcattgaggaaaatgagaatccagaaattgtcagactcatttgaaaatttggaaaatttacgcaggttgtctttagagggaaatcaattgagaaaagtagacccagtaaaattgccggtgtcatcattgcagatgctaaatctaaatgaatgtaaccttcgtttgatatctccatttttagtatcaatgctagaacaaaagaatagaaatcccaagttaaaaataatagcttggaggaatacgaatgttagtgtcactgatataagaacagcattgaaatcgattaagggacttttattagatcttaacgattttgataaaacattgacggaaatatctaaacgttcttcgcgtttggtctgtaaaggtgggttctttgatcctcgttttaaaaaaactgaaacggatgatctttatgatggaagcgaatctagtctggatgaagaagatgtgggtggtaatgctaaaagaaggagagaaatgtaa

SEQ ID NO: 12956 - DNA, 183 bp, Candida albicans
aaaccactaaagaaagaagaagaaaagtatccagagcttgtgattactgtaagaagcgaaaatacaaatgcagtgggattgcaccctgtaatttatgttcaaagaaacaaattgactgtatttttagtattgtggacaaacggacaaccaaggggtcgaaagtttacaagccatcttcgatag

SEQ ID NO: 12957 - DNA, 264 bp, Candida albicans
tttgcaatgaaatgtagtaataatctacaaccacacataaaaaaaaaggcgagatcagaggatattgaaaaaaacgagagaaaaaaaaaaaattacgatgagatgaaaaatacattcatcagatcctcgataatattaacgacgactagctcattagcaccatggccaaaagaaaagcaacagaatcggaacctttaccgactaagaagccaacaaaatctgtttctgaaacgacaatctcaatatgtataccttcaacagtaa

SEQ ID NO: 12958 - DNA, 198 bp, Candida albicans
aatttatttgatgtttatttaacactcaatttcattttttatcgtaacttggatttttcttatttcaacttttttttagcatttgaatctttatatatatatatatcgttgatactactgtatagacaggaattacttctatatggtaagtattttacattaaaaaaattaaaagtttttggtcaactcaataattaa

SEQ ID NO: 12959 - DNA, 327 bp, Candida albicans
cattgtataggaaattttcaaaccgaagttgtagcacctggggtacagcaacacacccgccctccaaggacattaagaaatagaccagccactttctcttgttgcaaaaaacagctcttctatacacaagttcaagctttacataaccaaggtttccctaagatcaattactctgtccataagcgaagttttagtttagaagtgatgatagtccggaaattgatctcacttttaatgcatatcggcaattttgaaaaaaaaaaaaactttattgcggaaccggaattgtgcaaggtggagaagatctcacaaaaaaaaaatcactaa

SEQ ID NO: 12960 - DNA, 201 bp, Candida albicans
aataagctacacaaaggtgatttgtatgtcgcgtttctcttgattattaaccaatggtgtgttgcaaaatggtatcttacacgatcaatagagaatacaccaaagacctatcgaagtcagtatgaactatcagtcctaataaaacctatcaagagtgagtccagcagtatcaaaagctgttggaggcacttagctgtgtaa

SEQ ID NO: 12961 - DNA, 213 bp, Candida albicans
atcaaatattccgccgaaacaaaactggcaaccactagccgctatcacaatatattgaaactaatggcgttaatgggattgataatacattttcaaaaggatcttaattcgaataaacaattgttggattatttgggatttgttttgtattatttgggatttgtattgtattatttgtggtgtttgaaatggttgtatcttatagtgtactaa

SEQ ID NO: 12962 - DNA, 228 bp, Candida albicans
attatcactgtcagtgatgttcctcagccaaagtcagggttggcaacaggaacaaaatccacattgtttccaaagccagctcagttgttttgctgtgtgaaatctcaacatattaagctagaggcaactgaggagacatcgcgagacagtaccaatgagaccaggaatgaatacgagtacctgtcatggaaaaattgttttacagtatttttatactatctttgttga

SEQ ID NO: 12963 - DNA, 195 bp, Candida albicans
tgtttgcatccgagagttttgatttattcagtgttgttttcattggttgagggcaaaaaattcgcatcgagcagaaaaggtcgtgcccggggcatagtggacagacaacgattactgatgaaccacatgtgctacaaagaccaaactagggccgttttgaagctacaatcatgtagagtattgggtgtgaattag

SEQ ID NO: 12964 - DNA, 1062 bp, Candida albicans
accatccataaggtgagagcaaggcttggcaatcaccacgatactttattcaagaaatttgctttgtattgtacaatgtctgaagtccctaagcaagagtctccgggttcatcgattcttaaacaatcgaatgcttcgacatcaacaaaaatacgtggtgctccatctagttcacaaattgccaatgtcgacttcaacaccttgaggaaactaaacacgaatacttcgttttcgtcaaacctaactaactcaaccactaaaactagcaatgctttatccaggctattcactagaaataagtcatcatctaacatttcagttcatccctcttcaagcgatgatgatagttcaccaaagacactccgagaatttacatctccatctgaatcaagcaagagtgttagtggcaataagttgagaattgccaaaaagttgaagtttcccaagaatcaaagcagtcggaaaccagatttgttttcggacactagtagcacaataagcgaagacagttcttcgtttcggaaggtaataactggtaatctgttaaatgagatgaataaaccaagaaagagctcaatgagctcacccatgagtaccacatttcatagtttgtttcatcgatcccatcataatggcagcaaccttcaacgagacaccaaccaggttgcgactggcacgacacctttgtccggtaagtttgatgacttctcaaaaccatccaagacaactttatgtctttcctcaaatagctcgaattcaataatcagcaatcctgaactagctcagatatataatttcaccaacccaaatatttcaattgaagatggagaaaccaatttggatcattcaaacagttcctttttggatattcataagaaaatgcttgtgccagcagatctgtttattcagaataagctaaacaagtaccaccaaaccgaagtaggattgggcatatacgaaagtgaattagatcatgacaaagataataagatatactccaacctttatcattatttgaaaccactatttactccatctttttcaatatccgactctggttaa

SEQ ID NO: 12965 - DNA, 552 bp, Candida albicans
aagggtaagatgcgtccaatattgggtgctagtgttgaagaaattgcaaatttcgtaaaggagagtttttgtttacaccagcccaatcacgaaagaagttttagactgaagacaagatccagtgtatccagcttggatcgtgaaaaggtagaggattttgattaccgtcagttatcgaatttgtttgaaaaattgatggccttattgagtcataacttgcaaactgccgattcatcggaagtatctttacaagctttgatattgaacgcatggaaatattataatacttatgttaggttttatttgctaagtatatttcaaccattacaacttcacttgaacgagctatctatgagaaatcataatggaagcaaaattatcagaatagacgaccttctacttgtttcttttcgaaaagtttttattactgaacagggaattggaagtggggatagagagacatctcaatttttgaggaatactgaaagtgaagatctaactggtaatggattgttgacttctactttggccgtgttgtcgagtatatcatag

SEQ ID NO: 12966 - DNA, 414 bp, Candida albicans
gtgcaaagtgggggtacgagagccaccgctgggacggtttatccgatcctgggatacggttgtgccggttgccaacgcttgtaccattctctagtaccaacttacatcctggggactggtctactgccacccttggccagaaaatctgggctggcggggacaagggctggggctgagatcaagcttgggccagagccagagccagagccagagccagggccagagccagggccagagccagggccagggtcagagccagagccagagccagagccagagccagagccagagccagagccagagccagggccagggccagggtcagggccagggccagggccagggtcagggccagggtcaatggctgacgtccctaagctcaagggaaatggccaatcccagagcagggtctaa

SEQ ID NO: 12967 - DNA, 198 bp, Candida albicans
tttataaaggaagttatattatcaaactgtcaaatgaaaacaattaaaaaagatgcaaaaacgcaaaacaaaataaagaatatgcaaaaatgcaaaaaaaatttaaaaaagacaaaacaatataaaacaaattataaacaaatacaatacaagatattaaaaatagaaaaaagatcaaaaacgatcaaaaagaaataa

SEQ ID NO: 12968 - DNA, 186 bp, Candida albicans
agtcattactatactcaagagaagtgtaaaacatgtagaaactggccagagaaacttatcacaccctcgccggtcagacaaacgaaggaaattaaattaataagcggttcttatctttatacaaagttctttaattcgtacatagttgtttgttttttgagtataaattatgaagacttaaaataa

SEQ ID NO: 12969 - DNA, 195 bp, Candida albicans
attgcacaacatgtaacttcggccaacggtatttcgaccattttctgtagagcactaaaaaaaatgcatgcgaaatttgaacacgacaaaaaaaaaaccacagtaactgatacccaccaaccaatgctggaagaagatacgtcatcagatagagtaccccccaccaaatccaaatgcatttgtttgtggtgttag

SEQ ID NO: 12970 - DNA, 330 bp, Candida albicans
tgtgagtcccaaattgtgatgtcgaatgcgatagattttggatttgttgacgattcggaggagcctgcggtgtacaccacttttttgccacgcccaatatctgccctagccagggttaatttggtgctacatgagcaccccgttgtcaagtataagaccatcactagggtcagaggtggtgatgagccgttgatgagtggggaagaagagaggtacggcacagaggatgaacgggatactgagaaacctttggtggaacataactatgattggtcgttgcagtatttgcctggtttacaatttggggtggttagtattagaaggaattaa

SEQ ID NO: 12971 - DNA, 282 bp, Candida albicans
  unsure (196): Identity of nucleotide sequences at the above locations are unknown.
ggaaaactggctaatgaaagctggtctttttttataaaaagaacgcatatccatcattctctgatccacattgttatggacacgagaaaagaaagagaacaggtttggactgctacaactacagctttaaaaatgaaaaagagttccgggaatggctcgaacaaagacagcttggatgtgtctgggttcgagaaangaaaactccccccaagggttcagcttatatcaaataccaaagctatatctgcaacaaatccagatcttatattccaaaaagcttaa

SEQ ID NO: 12972 - DNA, 189 bp, Candida albicans
cgacaggtgaagagaaatttgtcgatcaaatttcatcccgaaggttcttcatcagagatggtgttgaattttcccaaaattttttggacaccttcagatgtagccccagccaagacttaccaagaggggggcacgagtgagtgggggcacgagtttaatttacggatgtctaactgccaacaagagtga

SEQ ID NO: 12973 - DNA, 360 bp, Candida albicans
cctctgaacacctggacagtggtggtgttttcccagtttttggtgttgcctgtggtgccatttattaccaagtttaaccggtatattgtcttggggttgctggtggtaggcaagtttgggaacaattttaaggctatacccgatgggttttcaaaagaaaagggcaactacatctacaaggagtatcatgttgggtatgcgaatggaagtggagtgttattggggggatatggtgccggcctaccaggaggtggtgcattacagtcagagctgggttacgtgagcgaacaaagagaggggattagtaggggtagtgaagcatgtagatgtatagaaagacacctcgaatggcaagactaa

SEQ ID NO: 12974 - DNA, 222 bp, Candida albicans
ccccaattcaaccaatttgacacactatcaaatgaaccactcggtaatagaatagttcccttgagatttacaccagtgaaagagtgtatcgctaatttcaatgaatgtattaactggatggcaaacttgaataactgtacaatcaatttggaactctcttcacaaatgagcaactctgagtttgaacagctccctgaaccaaaaactcaacccttgatttaa

SEQ ID NO: 12975 - DNA, 183 bp, Candida albicans
acagaactatcacgggattccaatgactacttgttcacaaacaacgtcaatgtgttggatacatctgtggtggaaagtgaactgtttttgaaagtttttattccatccaattttttggtgagacggtacaacttttctcattttggcaaaaactttgcagtactaaatcagacttcttggtga

SEQ ID NO: 12976 - DNA, 189 bp, Candida albicans
ataaaactaaaattagttttacaaaaaactaaaaaaaatggaaaaaaaaaagtgaaaaaagaaaatatttcaattcaaccaatgagatttaaacaatctatacctcatctcatgcagacattaatatttaggagattgggaaagatagtaatatttttttttcttttttgtattgttaggtacatttga

SEQ ID NO: 12977 - DNA, 216 bp, Candida albicans
ctaatttggttatttttaaaaataaaaaatacaaaaaatgacaatagagaaacccaaagaaggaaaagagaaattgactcaatgttaagttgcaagagaaatggatttgcttttatattttatggaaagtcttcaatttctttctttcacctgagtgaaattgaattattattttggtggtgggggggaacaagatggcagagattagtagactaa

SEQ ID NO: 12978 - DNA, 216 bp, Candida albicans
cagtttgacaagttgagtatcaattcaatttttcagttgttgttgttgagccaacgtcaacctacaatatggcatatatttgcattatatgcatgcaatcctaaaagaacaagtgcatcatcatcagtatcaaccgcttacttaaacttacatagaatagcaaataaaccagctgattttaatgttttgttaatcccacacttcggttatttttaa

SEQ ID NO: 12979 - DNA, 183 bp, Candida albicans
tacgaactactattttttagccaacagttggccctttacttgtacaaaaataaagtgaaatccgataatatatgcaagtcaactagtttttttaggccaatgctgtctgacaatagactaacaatgtgttacaagaatagcctaagtacaattaatttgcaatttgacagtttgacaagttga

SEQ ID NO: 12980 - DNA, 225 bp, Candida albicans
atcatagccctttttgccgttatcggagacaccttttggtggcaaatgcgaaaaaccaaaaaatatgagcaaatttggataaaaatttcagcaaaaaaatatttacgacttttgcaacaccagtcactggtttttaatattactcatagatgtcaacatcacatatacaaagaaggaaatagtaatttggtacatacatacaaccaacataaacataaacactaa

SEQ ID NO: 12981 - DNA, 222 bp, Candida albicans
caacttatctgcaggagatgtcgaaaaaattactcattttttggttattgtgtaattgttactgaggttccatcaaccactttttgtatacttcttatatataaattatattttatccacacttttgtttatttaatattatcaaaattttcatctataaactataaacaactatcaaccatattactatttacaatactcgcatgcacattatctgactag

SEQ ID NO: 12982 - DNA, 210 bp, Candida albicans
tgtcggaccatcattacacctcaaatgcgaagtaatacgcggaacgagataaaatgtagatttggacacgacaatgatttatcgtgtcacgttgctcaaaaacaaaaaaaacttgatcaaacaaacaccaacaataaaaaaacccttcataatcaacacattctttcttctgttttaatacaatcatatataccaaatgttaaagcttaa

SEQ ID NO: 12983 - DNA, 213 bp, Candida albicans
atttcttttggtgtaactgggacacaaacttcacacgagattgcatcattgaccgggacagatcacaaaccagtttgtggagtaggacatttgccaccaaataatactattttagtgtttatgtttatgttggttgtatgtatgtaccaaattactatttccttctttgtatatgtgatgttgacatctatgagtaatattaaaaaccagtga

SEQ ID NO: 12984 - DNA, 234 bp, Candida albicans
tatattttcaccagcgaaaaaaaaaagaaaaaaagtataatcataataataacaatagatcttaaacaaccgattcttcatcaagacatggtggaaaaacagtttaacatagacctagagttaaatgatactggtcatatagatccattcttacaagatgagtatgtttgctttctaactttattggtatttttggttctgttttttagtttactaaccttgaccaagagataa

SEQ ID NO: 12985 - DNA, 327 bp, Candida albicans
gaccaattttcggccaataatggaatcaagtcacttagggccaaggaaataaatacaatggaagccattcctagtaatggatttgtgggtgttagtctaatcaatggaacttgcattgcttgtcccaataacacgatgaagcccgtcattgacaaagcatcaggatctttgattaaaaagaaagatatgacaaccaaggcaaagaccctgatgtataacaagattttagcagacaagaattgcatcacgattgattatttgatggaaagatttatgggagcaaacgaagaaagaaagttgaccatacctttgaaaaaaaaaaaatag

SEQ ID NO: 12986 - DNA, 219 bp, Candida albicans
ttttatgcaacaaaacctctaatatgttggacgtcaacatacaattggacaactaatgaactgtttgtcaatctaatcatcaatatgacaattattagatttgaaacagaacacgattttaagaacaatgtcaatggtattaacgttctacagcttgggttcagtgatttcaatgaaatcgaagaatgcttggattggtcgatccaaaattttgtatag

SEQ ID NO: 12987 - DNA, 237 bp, Candida albicans
ttatttgatggaaagatttatgggagcaaacgaagaaagaaagttgaccatacctttgaaaaaaaaaaaatagatcaaaagcaaagagtaaaaaaaagtacaggaatggaaaacgcgtgtagagtccagacattccacgttatcttaaatttatacaagttcatcagattttaccatactattgaaaagcagtctttaagaataaacctattgacatggaaccaaagaggtcgctga

SEQ ID NO: 12988 - DNA, 195 bp, Candida albicans
cccaatctatccgaatttaaagatgtcggtttgacaaattttgacaagtgtggtgaaatggtagattttgccaaacttggtttcactgaagatattaataaggatacaaaatctaaggaaagttgggtttcattaagtgcattgtttatatttttcgataattcaaacttgtgtttattgaacacttcttgttga

SEQ ID NO: 12989 - DNA, 222 bp, Candida albicans
tacagcggtgtcgccactgttaatcctttaccctcttttttttttttgcttatgacgaggattctatatattgtaacaggtttgtattatagtttgattaataggtttatgaaaaatgaaataataaaaaaaaaaccgaaactaaaaggaattaaagaggtgtatgaaaacgtgtcgtacaacgtttgtagtaaacgagtactactaagtggttctatttaa

SEQ ID NO: 12990 - DNA, 282 bp, Candida albicans
atttccccattttcaccccaactagaaccaacttttagctcagaatttttgcaaactcgagcccaaaattttcctctcctcggaaataacttattcccgaaaatggcaaaaaatgtcgtcgcctcaaaaaagatggcaaaaaatccccatacaaaattaaagatgacaaaaaatgtcgcaccaccaaaaaaaagatggcaaaaatatgtcgcaccaccaaaaaaaagtcgcatagttaaaaaaaagatgacaaaaaaatgtcgtaaaatcggccaaaactga

SEQ ID NO: 12991 - DNA, 198 bp, Candida albicans
ccacggatgtctaacttcaagcgagcacccgagcaaagcgagagtcacacaaacaagtttagatttagcaataattttctagccaatacaggccacacacctcgagtgagcagcacttctcaaactgccgcaccacaaccgtacggatgctcaccttttttttttttttcttttttggggtgcttgcacccccaatag

SEQ ID NO: 12992 - DNA, 192 bp, Candida albicans
atcccgaatttaacaaaagtccgattgaatggggaggaattagaatttattaagaattctcatttaaccaagagcaacgaatggactaagttgcaaaaagcagtccaaaaaaactttaataggctcagatcaagggagttgctaagaaatagatttgatacccataaaaagatgacattgtccccaaagtaa

SEQ ID NO: 12993 - DNA, 237 bp, Candida albicans
aaaatttgcactcatcgagagccgggaattagtataaaaagaagagaaaagaaaggtatttacgatatagagaccgagtttcagtcgacacttttagtgggcgtaaactttatttactctgttttttgcttattaaaaattaatgcctatcgtgtaccaggactaattctcacgaatattccgtgtatacaaacagttcccttcactcttttcgcagttcctctccagaggccatag

SEQ ID NO: 12994 - DNA, 213 bp, Candida albicans
cacattttatgctcgaaattaggatgtacaacatggctaattatgaagaataagccagcgttgtgtaatagtagtgattgcactgaagagaacaacacaccaatctattccattgacgatggaataagtggactgataattcacatggataattcagtccactgtgagagaaattttttctactatataaagggtagattccacacaaattaa

SEQ ID NO: 12995 - DNA, 189 bp, Candida albicans
tattaccacgctcatggattcgggttcagattgaacatcagtctcagcaaacatggaaagttaacaatttttgttgtctatgaattaccgaaccaggggaaatggcaaaacattacaccaagaaatgatgagacagctaaccctagaattatggcacaagtctcaaaggtgagtaagcgatgctgttga

SEQ ID NO: 12996 - DNA, 240 bp, Candida albicans
cgacaggtgaagagaaatttgtcgatcaaattccatcccgaaggttcttcatcagagatagtgttgaattttcccaaaatttattggacatcttcagatgtagccccagccaagactaaccaagggggggccactggtttgatttacggaagtctaactgccaacaagagcgacttgtacgtgttagcaactccgaattcaaagtccctcaagatcaagctaacactatcaattgcctaa

SEQ ID NO: 12997 - DNA, 198 bp, Candida albicans
aacaatgggggcacaattgaagagtataaaattaaagagaaaccaagaaatacaaaggacaaatacaaaaagattattggtggtcacacactgtgttgtgaagtcatagaatacactcaattgttattcttggggatcgcatcatttgctgatggagatcaagaaaaacaattgaaaaaatggctggatcaatattga

SEQ ID NO: 12998 - DNA, 603 bp, Candida albicans
acaaataagaaaccaatcaatgcaacaaagccaaaaaaggaggtagttttagcgacactaacggctccgttattttcagtagtcagaacagaaggtttttctgaagcagaggaagatggagcggcatcaccagttgagataaacacagtggaggcagtacttgaagcagctgaagctggagcagagtttgcaggcccactagtagtaccagctgcagtggaaacagatgcagatgtaggaacagaaactcccgaagaactggtaacggtagtcttatcacctcctttagtgccaatgaagacaatcacagaagcacttggaactgcattggatttttcgctggatgaagaagagcttgaagaggaggaggaagatgatgatgatgatgatgaagtggtagatgaaggtgagctggatgaagaactggatgatgcggaagatgtgcttgatgaatctgaagaagaggcggatggactggatgaactatcattggagtcaacagattgtccactttccaatttcttgatatcatcttgtgcttggtcgtatcttccattaactttaccaccatcggctttgatggattcccaagaaccagattga

SEQ ID NO: 12999 - DNA, 321 bp, Candida albicans
atgctattatcactgtcaatatattttgagtttttcttatctaagagtaccgacgaaattcaagccgagttatacatgccaatatttacgaataattactatagtgacggatatatagaactgaaaaaaaaaagattagcttccaaaggctgcaacgacagatttcgaatatttggtggcggcactcatcagtgtgacctcaaccgagacaccccccgaactattcacccatccacgaccaacacacaaaatgctattttagtgagaaggcaaaaaaagaacaaaaagaagaaacgagaagaattaattaatttcatttga

SEQ ID NO: 13000 - DNA, 534 bp, Candida albicans
ctttatattccaaaaatgattcaaaaatttacatgtgtgcctgctactgactatgatgtcattgttgtttccaatgggaccgaaagtcaaatcaaatctagagtaactaccgctaaaacggccagaataacgtatttacacgatctaccatccttgagttcatatctttctgaagtgcccaactttactgggaagattatatttatgttttttgacggagttcaatatattcaagatttcatttgtgatgctatagacctttatggtaaaaccccgttttctttaattcaaaacgcttacttttattttgataaactcgatcccgtgaacttggaccttcagtttaatactgttgctgtcatagtccatgatgtgttgaaaaaatcaaattatatgttagatagaattcgtggtgtttatatcgatgatctactgttggttggtgatagaagcattccgatgaaaagattgatctgcaatttcccaaatgtggaaaagtttgttttacaaagtaatgccaaaatcacattttga

SEQ ID NO: 13001 - DNA, 273 bp, Candida albicans
gatagctgtcgtgatcgctttacaacccaaaagattactaatgataatagtataaccaccactaatgacgcaaacgttatggaagatatgattaaaaatgtgactaaatcatcgtctgaggtttcttgtccatttgaatgtctaaatggtggcttgataactggttgttggtcatcgagtcctccattgtattgcgtaaagatagttggatgggccctagtgaatggagccataaataatactgatagaaacatatttgaatataaactataa

SEQ ID NO: 13002 - DNA, 198 bp, Candida albicans
ataaacaaaaaagccatacaatactataaagtggaaggaaaaggatcaaaattaaagtctaacaaacccttgtcaatccaatcacaacctgatggcgaaattggtgatactggctcccatgacaaattttcaaagtcatacagaccactgatgttgtcaccaggaattgcaccatcatgtatatcaagtgcactttga

SEQ ID NO: 13003 - DNA, 372 bp, Candida albicans
gatgatgatatagagtacgaaggacggcatgattctgatcacattaatctaacagaggatgaatttgaagaagacatatcaaggacttattttgattcaacagattcggtaaaatctaacttttttcaaactcataagtttaagactgtccctgtttattgcagtgaattgttattgttagagtacctttcgttttattctcccagtttttcaaaatcaattttaaagctctgtatattttgctttattggattggatatatttgtggttgaaagaaccaaacttagaaccatgctatttttgttggtatcagtagtattgtccatactcttggcttacgagttgggccatctgaacccttatatagtttga

SEQ ID NO: 13004 - DNA, 669 bp, Candida albicans
catattataatcgacatgagtttacagattgttttacttttggatccattggaaacttctggattgacttctaataatgttagagagtttttagagaagtgccaagttagagatattgtattttttgacgaaagtgttctgggatatgttgtgcatgaaggctcactagaccaagaaactggttttgttcaatgtgaggttgccattttacagctaaataacgtggaagaaaaggaccctttaaattatgtgaatctggaaaacaaaattagtttaactttgggtaaagaggaactcgtttatgacaacgatttaatccagatttggaaatttgaaataccagtcacttatccacggaaaagacttaataatccaaaattgtgtatcagttgtagtttggtgaatgaaaacaatgagactttggttgtggaaaatgaatcatttctggaggaaacattggccaactacgtcccatgtatgaagagaaatctactagcagaattggaccatcaaatagattttattgacacgtcgaatgatgttctagaaacgggtataactgttcaggaaaactcaataatagacaaaccaaatgtacgggcatttatcagcgttcctgtcactatttccctagtaataaaacttaagtctacgaaacgtcctcaccac

SEQ ID NO: 13005 - DNA, 330 bp, Candida albicans
atcttgaatatgtacacttctccaaagtcatcaccagcaataaacatgtttgatttgtcaaaccaggcaaaacaaaatatacatttcccttcgttgttagtatattcggaaaccacagaattactttgttggtccatcaagatgatttttcctcctgctgtggctaccaaaatccaatactcttttgagcaagaaactgcagtcaccaaatcctcattagagtggttgatttgcgttacattattatctactccccaaagatatatttttgagcctagccctaccgcaacacggtttgttttgaatgaccaacttactaggtttgaatag

SEQ ID NO: 13006 - DNA, 201 bp, Candida albicans
aaaactcatttcatctcagataattgtacaccaagaaattcaaatgccttttggctatacaacattactcccatatatatgtatattaaattcaaactacaaaacaagcctcaaaacttcaacgtattcacgttaaaaaatagaattgacaatgttactacctatcagcgcaccagcaccgaaaatggcagcattacctaa

SEQ ID NO: 13007 - DNA, 204 bp, Candida albicans
cttgaaagtaaaataagaaaaaaagaaggacaattgaaaaataatatcaaagaaaacccagaaaagcaaacaaattcaattttactctgccaagcaacggggaagttaagaagaatgaacaaaaaggtaaattatgaagctatgttggttttgatggaagatcttctagcaatttatgtattaataaaaaatattatccattaa

SEQ ID NO: 13008 - DNA, 318 bp, Candida albicans
ttgaagaatattggaaaatatatggttattagttgtaatttaaatgaagcaatattatcgtatggaggaatgggagtgagaagaggtgatttcatattatattaccaacaattgaaactgaaaaattacacaatactcaagtacactacctgtaattttatttggttaaagtgtaaaatttatgatttttatgcagtatccagatggttttctttactatatacagtcccaattgttctaagaaatgtaaggtcatcgttttcgtcaactcattccccttcaccaccaccactagatcttaactcacttgaattttag

SEQ ID NO: 13009 - DNA, 186 bp, Candida albicans
atcaaattgacaatttgcaggttggttctttttttatttatttattgttttttttttttggtcgtattctatcactcatttttttttctctcaatggtaattgattattacgttaacagtagttcttgtacttcaacttattatattacgatacaaatcaataaaaaacaatctacaaaatactga

SEQ ID NO: 13010 - DNA, 378 bp, Candida albicans
cagattttacccttgagtatcttaacattcacaaataacacccggtgtttgtttttcagagccatggatgtagtgtttcaccatggtgggataaatttatcgttatttggttcttcagagatcgatatccaaaatttgagtgagtttcctagtttgaaatatctaaaaattgataattcatatctgttgacagacaacttgatacaaaagttgatggggaggaacaaacaaagccttattgttcttgattacatgtatttacaagaaataatgcatgccacacttttcgaaggaaaccatgtacataaagaattttacgatagaaacactggttttgctacaaaagtgttaactgaattgaatacgttgatccagtga

SEQ ID NO: 13011 - DNA, 765 bp, Candida albicans
acccatcattgcttacaaatggtgttaaatattaaaaagtgcttggaaagtaattcattggcatgtatggaacaatcaatcttaatgcttcctcatgaattaattgctaggattttgagtatgaactactccatgtatggcctgctaaaacacatttaccattttgttgtcacttgcaaagagatgtactatagacatgtttttttattgtatacacttgaacccgttatggttagtctatgcaaatgcaataaagcaatcagccttgtggcaatgggacttcttaaacaaagcaaactttgttacagtattagatgccttgattggttcctaactccaaaatttacgacagctaaacattaccaaaaagccattcttgactctattaatcaattttcaaacctatataaagtgtgtttaacagctaactctttggatatgttaatgcaagtgaataggttaccaaaatgtgtttctgttttaaaaataaacttgattactcatgtcaaccctacacgtcatacaatgcgtttagataaagtaccgttattcagattgaaagttttaatctttgaaacactggctccattgagtttgactgagtattattatccctttttcagaagtattttgatatccaaatctccattgtattcctggatggccatagatgagaatgttcctgaagcccatgtgaaatctccaataaaccaagtttgcaatatattagccactttgatctaccatagcagattttacccttga

SEQ ID NO: 13012 - DNA, 186 bp, Candida albicans
aacacatttaccattttgttgtcacttgcaaagagatgtactatagacatgtttttttattgtatacacttgaacccgttatggttagtctatgcaaatgcaataaagcaatcagccttgtggcaatgggacttcttaaacaaagcaaactttgttacagtattagatgccttgattggttcctaa

SEQ ID NO: 13013 - DNA, 606 bp, Candida albicans
acgcctgaacaaaacaccaataacaataatcgtttcaactttagtatccggatatttgtaccaaattttttgttcttcgctctttcattccattcgttgatttctaaaatgactactaaactaattcaagatccaactggattcagtaaatcttttgaaactacatatcctaatgacacatcatcatcatcatcaacaaatgaattcttcttccatataatcaactacagtgacaaacaaattctcaatatatccatcaatggattaatggacactacatttgaattacccgtttcaactaaatcggctataacttatgcttcagcattggaaatccctatagatcaatttgatgatgaacatgaacaagaggaaattagagaacgagaagtgatacctgaacctattttattgattggagatcattctaatatgaaattactgattgttgccactcaaattagtaaattaattagtaacaattgtcctaaacctacaatactatcaataggttctaaatggtttggtaaaggagatgaagttgatgataatgattttgaaaaattaatgtttattctagcaaatgtaaaaacattgatacaataa

SEQ ID NO: 13014 - DNA, 303 bp, Candida albicans
  unsure (268): Identity of nucleotide sequences at the above locations are unknown.
acaattgaaaagaagatacaaatactgttaattaaactagaatatgccattgaagatttaaatgattaccatcgtaataaatttattggaatttgggagattcttttggagttaagaaaaaagcaagtgattgatcaatcactatggagccgccacaagacatcaacgaatcccacaacatatttatttattcatttccatcatatggcagtaacaatcatgaatctacaaattacatttaaaaaaagcattatactaactaaatttnttagctattgttgtaagaggtcgttacgctggtaa

SEQ ID NO: 13015 - DNA, 201 bp, Candida albicans
attttttttttgttgccctctttctggtatcaaactcttcgcacgagggaggttgtcgctgccgccgctgccatacaacaaatttgtcctcacacagacatgattggtgttccattggatcagttatacaacaccaatagaaacaggcacccacattacaagacagttggtccacatgaaattgctatacattataaataa

SEQ ID NO: 13016 - DNA, 183 bp, Candida albicans
tttcctactttgtgggtttcaacgaaaaaaaaaaaaacggaaggaattatcgagccaacaaatgaaggcgggcatggccccttgctcgttaataataaaaaaaagattatatccgccgttttcgttattatgtcaactcggtgtacttgcttgatgttatttctatgtgtcatgtcaccttaa

SEQ ID NO: 13017 - DNA, 273 bp, Candida albicans
ttggtttatcaatgctcgtcgaagaaaaatcaagttgttgaaacaacaacagcgtttgaacttttagggaagattaagagaagagaaggttgttttacaaagattttgggtactttttttttgtgtaattcgttttatattttatttcaattcgttttacatttggttgttgttttttttgtatttatttttacgtttctttcgtttataggttatcttttttttttattattcataattagtaatgcatttagtattgaatttgttgtctga

SEQ ID NO: 13018 - DNA, 192 bp, Candida albicans
cacaaaactgggaaccatcattattattattgttactctttaatcaagaaaaattataataataataatattattattattactttattatcatcaatcatcatcaagactataaggtttttcgcatgcatattgtcttatattaaagtattgtcaaagaaaagtaaaaaaaaaaagaaacttatttattga

SEQ ID NO: 13019 - DNA, 276 bp, Candida albicans
gaagaagaaatcagaaaagaaaacaaaggacgggaggaaagtaagaaaagtaaacatggcaaactgaaagtggattcaagcagtaaaattgataaagagaagaagaaatctaagaagaaatctaaagacggtatactatcaaaggagaagaagcgactgaaatcaagtaaaacgaagaaagataaagatacgacttcaagcaaagattttaagaaaaagaagagaaaatttgaaagtaatgatgaaacaacaaaatcaaagaaacgaaagatataa

SEQ ID NO: 13020 - DNA, 348 bp, Candida albicans
aaaagaacgaacggatattatagattgaagaaagaaaagctaaaagggttccaaaaattatggctgagtgctgttgtccaaaccctatatatttatacttcatttttcatcattcacatgcctaaatttcactgtcaatatgagttgacatttgaagtaaaacgaataacttgtaatatgtttaaaccagttgttgttttctttttgttttattttcgcatcatgtttgatactatctccgcaaaacaggcaccaaaaaaaaagcaaacaaataagatttttccggttacaatagtttcacacatgcacacagatgtaggtcgaagctggtccaaaaaaaaagtctag

SEQ ID NO: 13021 - DNA, 267 bp, Candida albicans
cgacgtataatcttatttatatatatcaactattttagtatattcaatatgcctcctgctgctaatagaactcgaaagagacaaagatcacaactggctactgaacctcaaagtgaagcaacagctctagctaccacaagtcctaacttacctacaaatactgatgcaaatgatgaagtcatcttagaatctccacaatataccaatatgcagtcgcatacaaatgatcacaacaacgagaggaattttattttccaacagttgtaa

SEQ ID NO: 13022 - DNA, 204 bp, Candida albicans
atttattacttgaacagtctgaggacatttaggatagagacattccagggtgacctaggtcagcctagccttttgtgtgagaaagataaggctgtatgtatattattttccttgagtaacactgctttaaacaagaaaaatttcaaatcaattgggattcagtatcgaatattgttgttcttatttgttactaacaatttttga

SEQ ID NO: 13023 - DNA, 1422 bp, Candida albicans
gagaaagtcgtagatgagaaagtgaaaatagataaggaagatactcccactggtaccaaaatcaacagtttatcgaaaacaaaaaatcttaagaactcaaatacggtaatcgacctaaatgataacgatatggttgtagatcccgatgaagaattagtacctggtatcactaagtcatcgggtttaccaaattctaatgttccaaccacagacgctaataattctaccaaagaagaatcttcaattttgaaagatttagattcctttgtatcctttgagaaatctccaaaaccaaagattgctgaaattcaagctactagtacatctaacaactcaagaattagttttgtagttgaatctgaatcaagtgataatgacagttactcaaattatatacaagatatcaaacagattgatgacgagattctgaaagtgatgttagaagatagtgaactgcattccttaaccaaggttgatacaaatgaaaaagaagagtcaattatgaatgacagcaactatgaagattcagagaagaagtcaattaaggaacaagatccggacggcatggatattgatgcttctgatttattggttgaagaagaagaagaagcagaggaagaattaattattgattcaacagaagaactacaatccaaccaaaaggcatctccaataagaaatagctctgaaatgactgcaggcaatgatcgatcactagaagaaattacaggtccaaatgattccccaccaaaagtaaagaatactgatacatattattcaccagataatactaaagaattaccaagcaaaagtctaacgaaggcatcagaactggatataacaaagaatcaagaaataaccaaagaatttaaggaaaccaaagttgaaagttctgctataacaaagaaacattccttagagattgacgagaaacattatccggatgttcttgggattggtggtcttgctacatcaccattgggcatgaattcttcattaacagaaatccacagattaaataataataataacagtagtaatgaaaatgacaacgataatggtggtgtggaggaagaagaagaagaagaaaagaaaaaattgcaaccatcactaaaatggcaactgcgttcaatgtcacaatttattgaacaaacaaaattccttgaaagtagtgcaaatgagttgaaagacttggcatgttctgaatatgatttgcatgatgatgtgacaggagatcttactaaatttattgctgaaatgcctgaagaagaagaagaaatgactattaaacaatggattgaacattgtgctgctaattgtaaagatattgttactcagtcatgtacagaaattaatgattttattcttgaagaatatgatcgtgcaattaaaatgatagaagagatgcccacagaagattaa

SEQ ID NO: 13024 - DNA, 198 bp, Candida albicans
gaaacaacccaatcccacaactattttggtcatttaacaacgatgtcgtcatttgttaaaggcttattcagtcatactagaaagtcaatagatttgacatcaaatccacttcatacaagtattcaaatccgtactgctaaaaaaaaaatttctggttcaaaaaccaataataaagaatcagcacgtaaaatattatga

SEQ ID NO: 13025 - DNA, 750 bp, Candida albicans
tcacacgagataatgaaacgaaataatagtgaatctcaattattatattattataataataccactcctactgctactgctaatcctactgctaatcctactgttactacattaagtttatccacttcatctcccaccactaacacgattgtgaaaaaatttaaaacacgcgaatttattaataaaccaccatcaaattatatctccttgaataatgcatcaattattcctataaatatattacaattattaaattcaataaatcccatgaatgatgatagcactagttctagttctagttctagttctagttgttattttaaatttatattttttttaggagctcaaggtaaagaattcattcctactatacaatatcaattcccctttaatatttcagtcacattcatcacctcaaataatgatagtagtggtggtggtagtagtggtggtggtagtagtggtggtggtggtggtggtggttgtggttgcacaaatgatcaatgtaaacaattgatgaaattttttgaaattaaagatcccatgggagcaggtttatatcctttagattatttaataattattcatcaaaataaagtacattgtaaaatacccatcaaatttaataacaactcgacctatactaagcatttcaaggttgttggagggatgtcaggacatcttaaatttggtattgatttaaatgaattaccttcattaatagaagaatatattaattaccaaccataa

SEQ ID NO: 13026 - DNA, 558 bp, Candida albicans
ttctgttctcgcccaatgtattatgcagtgcctcaacggttatattctatttctacagattttatggattctatactgttatcagattttgaagacgagagcgcaactattatgtcagaagcttcatcaattagctccatgtcaagtgtttcgtactcaaaccatgattcatccgaagctaaattaagaaggatatacaatggcagtaagaatgagattaaggaaagcccaatcacaaccaagccaatccagtatgaaccttttacgtttgaaaagcctatgagtttgacttacaagttgaatttgatacaaagcttttttgaaaagttgaacattaacaccgataataaagttttgaaaactgcaaaatacgattttagtggttatgaaccaggtgatttgtcatttaaacagggcgataatattgaaattttattagattttcagaatattgatacattgtatcattcagatgagttaaattggttgattggagtctcaagaattgatgatgagagctacagaattggatttgtacctaataactatgttgagtaa

SEQ ID NO: 13027 - DNA, 210 bp, Candida albicans
  unsure (5),(6),(56): Identity of nucleotide sequences at the above locations are unknown.
aatgnncaccttcgaaaagaaaggaaaaaactgtgtttttctgaatcagtaacctntgaactgagacgtaaaagttctcgtaacacaaacaaagtgaactacaaagatcaacttctgtccgaaggtgaactggaaggtgaggaaaaagatcatttgcttgacgatgaagttgatagtgagaatgatgaaagtgatgaatttggtatttga

SEQ ID NO: 13028 - DNA, 189 bp, Candida albicans
ttcaagcttatttgtttatcaaaaaaacaaaaggataaagaaattactaaattatatatatatatatttatgaagattagaaaacaaaaaaaaattattattattattattatttgtaaggagatgcagaaattttgttcaagatggaaaagattaattaaattgggtttcggcttagaagaaaaatag

SEQ ID NO: 13029 - DNA, 183 bp, Candida albicans
aaaatgacatacttaatatccactagtcatgcccaatccatatgtcaatctctttatattctagttcaatttttgaaaaaaaaaaaaagtaaatacttttccttaatcaatatctattacctttatgatcttcaacccatttttcagcactatttctccatgctaaatcagcctttggactaa

SEQ ID NO: 13030 - DNA, 273 bp, Candida albicans
ttgttgagccaaggaagttctttcattgtaagatgttcaattacatgtggtggtatatggtacggcggtgtgagtgtgagtgtgacaaaaaaaacggagtcaaattttcactcaaagagaagattacataaattattatcgcacacaacgaaaaaaaaaaaaactggtgaagattcaatctcatcgattagattcaaaatcttagaaacttctccaaaacttattcatttgagatttttattgaatatattccccaacacaattcagctttaa

SEQ ID NO: 13031 - DNA, 429 bp, Candida albicans
ccttctagccccgtggtgagcacatttgatgggttgttcctggtagtttctggaaagaaaacttctcattctgttgtttctaactatcgattccaaattttaagaaaacaattggcattaccaagaccaatttattatattgctataattattgattttatattaagatatatttggatattaaaattatttataattaatgaagaattgaaaaaagagaaaattaaattcatttatattttttcaacatttttatttggttatgatgcttattcattaggttatgctttaattgaaacattagaaatttttagacgttggatttggtgttttataaaattagaatctgattgggttgaactttataatgatcaagatttactgaatcaagatattgaattggaaactagacttcctaaacaaggttaa

SEQ ID NO: 13032 - DNA, 216 bp, Candida albicans
catattctatccgcgtgctggctgatgtttctactcttaataaaagaagagcattttaactccaaaataaggattaaaatgacaaaattattggtcaaattcttctggtatcaaaatactacaacacaattaatctacggtaataaaatctttccaacacaatgccaaatcttttctttccctccctctccctctttccgtctcgtaccggaataa

SEQ ID NO: 13033 - DNA, 594 bp, Candida albicans
aatcatcaaagtaacaaaatggtttcattcaagtcattaatcactttggctattgctgccacttccgtttcatcattcaatttattacatgatgataaaggttttgctattttaccaccaaccaacattgttttagatcatttgaaagaagttggtaaaaaagctgtcactactcattatgatgttcttaacactattaaagaagatggtgaaattgttcatgttaatttacatactcatgaaactaaatgtactggtaaatatgctaaagattatgataattccatgtataacaaattaaacaaaaaacaattatttattagaactattgaagatagttctttaaaacaatgtttgaacaaagaatttgaagctgaaactagtgaatgtggatttgaatttattgaatataattctgcttctggttgttctagtgatgctactaaatattcatgtcttttggatgttatgaaacaacaagatgctactaagaaattaaaagatatggatgatgttccagctcaagtcagatgttaccataaattagaacaagctactaaagctgaagtcgttggtggtgcttgtgctaaataa

SEQ ID NO: 13034 - DNA, 189 bp, Candida albicans
ttgatagttggtattcttttactaattcctcccctttccagcaataagactaaaatggtaagacttgttaatagtgagttgtataaggttttgttgaagagagagaaggaaaatattttcattaatccaaaatgctttaaaaaaaaatttttttttttttccttctcacatttgttccagcttacataa

SEQ ID NO: 13035 - DNA, 198 bp, Candida albicans
ataatcatgccccatgcaccaaaattaagttttgctgctattgcagttatgagttcagttgcagttatatatgttggtattaattcaccattaaaaaataaatgggttagtgacaatagaattagtccaaaggctgatttagcatggagaaatagtgctgaaaaatgggttgaagatcataaaggtaatagatattga

SEQ ID NO: 13036 - DNA, 231 bp, Candida albicans
ttcaccaaaatattttggggttcaatagttgcaaaaaattgtagcaaattacacgcacaagttcctttccctttcccattttatcattttaattttctaactttcattttatataataatttaaacatacaaaagcaagcagtaaacaacaacaaccaccaccacctcaatcgtctagttgttatatcaacatttcttattttctctaatacaatccatcaatattattaa

SEQ ID NO: 13037 - DNA, 297 bp, Candida albicans
aactcgttgtcgaatagatcaggacataaaacacttctcttacctatcgatcggtatccgcaattcacttctactatacagtctgtgttagaatcaaaaaaagtggattataatcctagttacatagatactatatacgaagttttactaaaatttaaacgatctaacacaccgtataaactttttcattgtattatattcccgtcaataatgccccagtcgattttgtcttttttatgtttagctagccattcgttacatttgaaaaaaaccttcagatcaaaaaaccctctatga

SEQ ID NO: 13038 - DNA, 288 bp, Candida albicans
tttatactagagctgcgtttcatgccgatacaaatgcacttcgatattcttctctcccaagtattttcaatgttattattttttttttcgctctcttatctcttcaacaaacaaagccacaatgacatctcaagagatttacttttaccggttcctagtgagcaagcaggtattctacaagtcaaggtatacgtatgcgctagtgaatctcaagccgttggtgccaggtcatgtgttggtggttcctttgcgtaccaatgtgttacggttcggcgacttgtcgcctga

SEQ ID NO: 13039 - DNA, 192 bp, Candida albicans
tcctccttgaaaaagaaaaaaaacgtaagagaagtttttaatttagctccattgaacttgccttctccgctaaattccgctacgatgttagctcgactaaaattctattatttctttttccgaattcttgatgtatctaaagaatatgagtatattactgaaccatacaggttaatgtacattttactgtaa

SEQ ID NO: 13040 - DNA, 195 bp, Candida albicans
ctgaggggggaagtactaccgctgctgccgtccactgctgagaatgtgattgcttccactaatgttaacccatcgcgaaagaatggattcaagatgtcgcgtaattctcaattcggaaagttatccgacaacctgaagtttggtcataaccatagaaagctttcatatcagtctctggctatccactgtttttag

SEQ ID NO: 13041 - DNA, 312 bp, Candida albicans
atttccccattttcaccccaactagaaccaacttttagctcagaatttttgcaaactcgagcccaaaattttcctctcctcggaaataacttattcccgaaaatggcaaaaaatgtcgtcgcctcaaaaaagatggcaaaaaatccccatacaaaattaaagatgacaaaaaatgtcgcaccaccaaaaaaagatggcaaaaaaaagtcgcacccccaagaaagatggcaaaaatatgtcgcaccaccaaaaaaaagtcgcatagttaaaaaaaagatgacaaaaaaatgtcgtaaaatcggccaaaactga

SEQ ID NO: 13042 - DNA, 339 bp, Candida albicans
aacgacgaattggacaaggcactctcggcaacaagagtgcttccaactcatctaaaaacagccattaaggcttggatagagttaaataaaccagaaactcgaaccccagagaatgatctctacactacaattgacgaatcatactcaccgaccaaaaattacatatccaaggatttcgcaccatcaacagatactaaatactacaactccagttccaaaaaactgcaacttgcaaaaagggaggtactaacaccactgggttggacagaaagactagatattagtactgaacaatggaaaagcacattggaaaaattacaacaaaatggtcaaaaataa

SEQ ID NO: 13043 - DNA, 249 bp, Candida albicans; identical to SEQ ID NO: 9823

SEQ ID NO: 13044 - DNA, 363 bp, Candida albicans
tttcaggtccaatctgtgtgcatcttgactatactgtttgcaatgtcaaataatcaaagctattccttaaaaaaccaactttacaaagccaaaggtgaagttttaaaattacaaagaattttgagaacctctcaaaacgaggtggacagattgaatgataatttggatagggtatatgatgaaaaacaggatgtgatagatgacttggagtcattgaaaagacggttttcagaacttaaaaggaactatgaaaaaatttcccgacagaaagaattttatcaacgatgttaccagaactgtgaggctgttttgaataatgatgggagtgccagaaagaaccaatcattaaagggggtcttttag

SEQ ID NO: 13045 - DNA, 201 bp, Candida albicans
tacttgaattggaagttagacacccgggagataaagagtttatggaaaagtcattttatttggaaaacttattttgaaaaagatgtcaaatcagtgggtactagcaagatggaagtaagtgaaggatttcaagtctattgccgagaaggagcaacgcattggagagaattcaaaaagttgatagataggagagagaattga

SEQ ID NO: 13046 - DNA, 282 bp, Candida albicans
  unsure (44),(45),(46),(69),(118),(217): Identity of nucleotide sequences at the above locations are unknown.
gtaaggacggaattcgatacatttaaccagatcaatcccaggannnaaacaattgatactttaaagaanaggaagaacattaagatagagaaacaattagaaatcgggtatgtgggtntctgtcatcccccctgtgttctatttgtgctttactactttttattctttttcttgtttaattgcggcattgcatgcaatcaatttaaagtgaaagganaaaagtgtgtacatacacaaattgaggctttgcaattccgacttaattacaataactctttatga

SEQ ID NO: 13047 - DNA, 192 bp, Candida albicans
atattatcacccaatttaaactttcttgtcgaattatctactctatccattatgtctgacatgtctttcacttatccaaagactttcacgaaagaaccaaatccagaaaaattagaacaacaactaaaaaataaaaaaacggggtggaaacgtagcctgtgtaaaaatatagtctcaactgaatatcgttaa

SEQ ID NO: 13048 - DNA, 285 bp, Candida albicans
gacaaattatgtgatttgaagaatgctgtcagttttgggtttttatttgttccccttttttcaaactcttcgttgtccccttttttctttctctctctggcggtgttggacctaaaaatatgtcgtcgtcgtcctaaaataaaaaacaaaacaaaacaaaacaagcaccaaatgtcgttgactttaaatgtcgttaaacgtctagcaatcaatcaaaaacatctgtcaactcattcaagacaagggaaagcatatcacaaaacattaccaaataacaatgtctag

SEQ ID NO: 13049 - DNA, 288 bp, Candida albicans
gaaaaaaaaaattcccaacatttaacaccactatcaacatgtgacaaatatgcaattattaaaaatttagtccaagagtggggggaggaagaggggccacaaatcggaggtggggttcagtcagtcagtagcgggcgcgctgatactaatggtgcagcgaacatttgtgttctaaaagatctgggtattcttcgattaatatatctacgtagttgttccagtagaaagagcttttcccctttttgcaatcaactaagtgtgataaagagatggaggattcatgtataa

SEQ ID NO: 13050 - DNA, 195 bp, Candida albicans
caagcgtattccacagcttctaatatcaacagtcgtccaacaacaccgggttctcgatctttaagaaaaatgccaactgtacatggcgattcgatggaaacatctagtaataaggaaaaaacccataaggtagatacttataacggcaatagcatcaatgtaaatgaaagggatgatgataactcaagagattga

SEQ ID NO: 13051 - DNA, 222 bp, Candida albicans
atgttgggaattttttttttcctattagaatattttcttgctgattgtttgttgttttggttttctttgatttattctaaactgctattgttgctgattgctgtgtttcttttttatctatcgattagattttcatttaaaaactttgcattaatttcgatcgttccgtggtcatcatcttctcctccccctgatactactgttgtacaacgaggacgttag

SEQ ID NO: 13052 - DNA, 255 bp, Candida albicans
tcgtattcgaaattaagattactactattaaaactaattacatttcaatcaactgattccgaaatctccaaagaaatttttcaatcaacatccttactagcaagcaaccacaacctgaaaagatttgttttttacttattcagtattctaataatcattgcctacacattttcatccaatagctttagagtattatacccaaattcttttgcacatattcctttcttcaccaggcggtcgagatccgacttaagt

SEQ ID NO: 13053 - DNA, 204 bp, Candida albicans
tgcttttttttttgtgtgtgtaatccttattgtgaaaaaattagtttcgggtttctcgttgtttccgataatttgtttaaatttcattcaaattttaaccgcagcaacttagcaaccattaatacttactcaattagccaagcaatcaattactcaataaatcacaaaaaagccgatattacaaaaatcaaggggacattataa

SEQ ID NO: 13054 - DNA, 234 bp, Candida albicans
atagcgtgtatttgctctagtgtagtatatagaaagcctatagaagtagttgatgacaagggcgtcaagggagggtatttatacccgagtctcagtggcgtggcgatagtccgattacggaagagtagtgcccactggatagggattgttatagtacgtattaccttacaaagaccattttttgttcatgtgtactatactggatactggaaaagtgtgatgacctatcactga

SEQ ID NO: 13055 - DNA, 195 bp, Candida albicans
tgtttgcatccgagagttttgatttattcagtgttgttttcattggttgagggcaaaaaattcgcatcgagcagaaaaggtcgtgcccggggcatagtggatagacaacgattactgatgaaccacatgtgctacaaagaccaaactagggccgttttgaagctacaatcatgtagagtattgggtgtgaattag

SEQ ID NO: 13056 - DNA, 195 bp, Candida albicans; identical to SEQ ID NO: 13055

SEQ ID NO: 13057 - DNA, 186 bp, Candida albicans
ttggagatgctacaacaaaaaaggccgtttttttatcccttttttcctaacaaattttcgacgaaaaacaccaagatgccttgccacctaaatccgttggacagaaaaacatcaattttgatgccagcaagctcattcaaagatcaatttgaagctacatgtgtggggaagaaaccactagatttt

SEQ ID NO: 13058 - DNA, 195 bp, Candida albicans
acaccaatacccatattcaacacttggcatataatgaatacaatctttgctaatataatctcacttccattatttttggttgatagtttggaaaaggtgggattggtttcattgaagattgcctttatagggttccataacaacattaatgtcattgtaactgaaatcacttgtaaggaattaccagtcatataa

SEQ ID NO: 13059 - DNA, 192 bp, Candida albicans
tcagaactactagcgatgtttttagtgattgccaccggcaaatgtgccactgcgaatataatgccaattataataggaaaccaatttccatatattcctgctaatattaccaaaagaaacccaaccgatagaattactgaaagaccaataattttgtttaaagggttcttttggagatacgaaaatgtttga

SEQ ID NO: 13060 - DNA, 1629 bp, Candida albicans
attgatatgctgaccctccctttggatttgattctttatatctcagatattggaaatttgagtatcaaagatatttttcacctcagtcaagccaacaagctatttagagagaaattgctgcacccatacttttggcatatggtgtacaatcaaaaaattggcaaaatctatgaactatacggtatatcagagcctatccctgaaagcaattattatcgactctgtaaggagcaccttcgcagattcaatgaaattgaacgagagttgaatgattttaatgaatccaaaaattataaaattcgagattacattaccaagtattcattagatttggtttttctaccaactctattatatttcctacgtcaagaagattttcaaatcaagttaaatatcagaaataaatccaatactgttgaattttcaaaaggcgtatttctagccaatttggttgctggtcaaagtttcaatattggtataaaaatgcttactaagttctctgaagagccattgaattccaggtcctacgaatcattttggtttgccttcagcttgttacagaaaaagagttttaaattaattaaagctcgaaatttgtttcttgaaggagcagcagagacactcagaaaacttaccatcgagtactatccgttaccacttgttgacaataagtatactttcaaaacagttgatgaatattctaataaggttgcactttatacccagctactttaccaatcttattgtgacattcgttgtgaggaaagcaactatatggaatccaccaacttgttatcgatgtacagtggtcgtcacaaaggtgaccaacttcttgtagcatcatcattgataaaagtggttgatgaggaattggaagctctagatatcagaattaccagtggtgaagataaacccaaacttttgttagctcctatgggaacagcattaattggtgactactgtgtcccatttttagctggacatccaagagtgttaaagaaggaaaagtttttaaacgtgtgcagatccatttcggaaccattggcaaatagagctttgttgccgataactaaggatgaaatacaggctatgatttgttattacggaactgcactcaaatttttagatgggctagatgtgttatcacctccatgtcatccaagtacctatggcgacgatacttttactttttttggccagttcatattgccatgtttattcagaaaggaagtgagcaatttcaatatgcaaatattactacaaaatgtcagagactttcttgtaaatgccaatcatatatactatcccatttttagtagattgccaattttgagtggttactcgttgctcattgaagatgcacctcaatacttaccatgtaactacctgccaagcttattacaaggtaaaatagtcattaccaatagatcagatgctcctgcaatagttgttgggacctgcaacgatagtctgttctatcaagtcttgaatgcatatggagagctagagcgactccgtgacacttcatttacagtagtggaccgtgttaaggcagaagaagttgaaacgtttgttgaattggttggcttagcaaatttgatatacgtgccgatcaagggagtaatctga

SEQ ID NO: 13061 - DNA, 255 bp, Candida albicans
cacaaactacacaggcattggtcgatacaagacttgcacctggattgtcaccgtactatgccacaaaacaagaaatggacacaaggaggactgtatacaagaccagaaactatgtggaaagaaagaggtataagacaagaagagccaattaccataaacactaccgtgacgaaattttgggtacatgattgtgatgctataacaagttttaagatgctaagcttttcctggcatgaacaatgtatttatttatag

SEQ ID NO: 13062 - DNA, 273 bp, Candida albicans
acaatcattactacttttacaataaacacattctgcctttttttatataactcgtttattattttctttttgattttccttttttttttttttttgcaaagacttgttgttctagtttattctactttaacatttcataacttattcccagcggcaaatacattagcttcaaagtcttacctgttccaaaagattagtaattttagtaataagaaaagagaaattgataagattttcacactaaaattatacaccgatttcaccactttataa

SEQ ID NO: 13063 - DNA, 315 bp, Candida albicans
  unsure (39),(42),(48),(55),(59),(77),(96): Identity of nucleotide sequences at the above locations are unknown.
aacaacgacaacatcccccccccccccgcccccccccanganttgtanatggatnatanaattgatttgaagaaagnattgctagggggagagatnactattccagactttttgaaagaggaccaatctttaaaaatatacattaatgtgcacggttacaagtcggttaataatgaaaaaggttcatgcgggagaaattgttggtactataagatcaggagagcccaaacaagtaaaggggttaggtgtgcccaacaacaaccgtattcgcaacggtattatagtgcaagactcactgcaacagaacgtctctaa

SEQ ID NO: 13064 - DNA, 186 bp, Candida albicans
ctgcaaaacaacaaatatcttcaacttgcaaaaatcatgtccaccaatactgatccaaagacaaataagccacgcaagtttgttgtggttgtccctgaactgtttttagaaacaaaggagtctctgtcacaactgaaagcacaacgaaaagaacaacagaaactactacaaaaacagaaactaatt

SEQ ID NO: 13065 - DNA, 606 bp, Candida albicans
aaatatacattaatgtgcacggttacaagtcggttaataatgaaaaaggttcatgcgggagaaattgttggtactataagatcaggagagcccaaacaagtaaaggggttaggtgtgcccaacaacaaccgtattcgcaacggtattatagtgcaagactcactgcaacagaacgtctctaaacaaacaatgtttgatttaaacaagtactctcggggtaatttgtttataaacttccatgtgaagttgcctcgcattgagaactttctggaaaatgatttggtacaattgaaccacatttttaacaatgtccccaacagcaatgatatgaataatgaccatggaaatattatagaatcaaatttggccaacttgccaggaagcagagcgaatcccatagttttagaagcaacacccagtgtatctgagagcccctccagagaaagcaatggctccatcaaactagatttcagcaatattggtatcaatgatggaacaaataccacaggcagggataatagctcacacccctactttgaagaagctcaaaacaaaagaagacggtttgagagcgatttgggttgtggaatagctaacccaatataa

SEQ ID NO: 13066 - DNA, 183 bp, Candida albicans
actgaaatgaccaacaatatacaactggccaagctcatttcacttattcaccaggccaagtgtactgtgaaagaagttaactctactgattctgcggtccataatcaattcttgaaaaaaaaaaaatggaaactatgtgaactatctaaagttagagctgtaatcacactcggtctcttgtag

SEQ ID NO: 13067 - DNA, 288 bp, Candida albicans
tcacagaaaacaatgacattgattattgggcaacggaaaaatggtaatagcaagcaagattttctaaccattactaatgtttgtaatatatccgatacttttttttttctacatgaatatctgttaggacaaacttcacaaaaaaggtattcatcgatacggtctatggggatttgtttctacgccagaagtactttaacaacttttgttaactccgtgattgttcttggaggacttaatgtcacgagatttttaatgtgtcaaacaatgcatcaccaaccattgtaa

SEQ ID NO: 13068 - DNA, 561 bp, Candida albicans
  unsure (97),(313): Identity of nucleotide sequences at the above locations are unknown.
acaaagctgtcttcagagatatcactattggtgctgaagaagacaccagcccatacattccaccaccaccaaaaggtaaaggaggtttcaaaggtanaggtaaaggaggatttgatcgtggtttcagaggaggaagaggtggctacgatcgttatgacagaggcggcttccgtggaggaagaggtggtttcgatagaggattcgatagaggtggatttagaggaggaagaggtggttatgataggggtggatttagaggcggaagaggtggatttgacagaggcggattcagaggtggaagaggtggattcanagggggaagaagcggatatgataaaggtggatacaatcgtgataacttcaacgacagaagtggatcatacgatcgtgaaagatctccaacccgtttttaatctacatcagctaagaatcaagtacgtttgggatgtgtttccaaagggaattaagaaaaagattacagtttgttgtgtttatttgttatattcaattatttttttgtttggccaagccattatattggatttttgttttatatgttaa

SEQ ID NO: 13069 - DNA, 240 bp, Candida albicans
ttttttttttgttttgattttcatttggttgtaataatagccaattgtgtttttcacttttctttccaaaggcaggacaaccaaacacgacataaatccgattcagatatttccacaaacatggctagaagactgacaagaagacaagctgctaaccctgtgtcctatagggagtccagtgattctgaactgagtcttcacctcgggattcgacaggtgccgcgcttatttctaatccac

SEQ ID NO: 13070 - DNA, 207 bp, Candida albicans
ccttccttggtgatgtgtgacatctccgtattagaatggcttattacaatgcaaatttgtgaccctcgcactaccccttctttaatatcttgcgtggaatttttttttttcagtttgttagtggaagaggaaaaattttcaagtagaagatcactaaatctttgtttgaccaacccactacaccacaatctaaaacatccattataa

SEQ ID NO: 13071 - DNA, 273 bp, Candida albicans
acgattttaaactttcatctcaattcagttcgtcaaataccatctacatgtgaagaacaaaggaaaagtcctaaattgatagaattgttgttgttgtggtggtgcaaaacaattcaatcagttgaagggtatggaaagtttttgccactaatcacttggaatggactacagttgtgcgagatgtccagaggaggggaaagaaagaaacaaaagtttatattgttaagtcctcttgcgaggatgactattgcatatgttatttctgttaactga

SEQ ID NO: 13072 - DNA, 204 bp, Candida albicans
ttattgttgttgttgccaatattgttgttgatgttatttgtggaaccggcagaaaacgacagtgatgaagatgacgaggacgacgatgatgatgttgatgacgaagcatgtggatttgaaaaatacgtgtttaatgaattagaagatatattactagctaattcattatcaaatgaatgtgcagaagtagcactacttatttga

SEQ ID NO: 13073 - DNA, 189 bp, Candida albicans
ggttttccttcattgtttattctgctagttctgttttttggtaatcaatcacttatctacttgtggcaattgtttgaagtttatttttataatttatgtcaatcttatatttggcatgaaaagatatcagaagtctattgttcttttgatattttcgtaagactctcttcgtatttaatgtatttgtag

SEQ ID NO: 13074 - DNA, 732 bp, Candida albicans
tcatatttatcgaattcagttgagtctaataatgttaaattggaacccacattttaccagtcgtggagtggaaaattgcaaaaatcgattgctcaagtatattctgggtttaccaattttattgtactttcatctaacagtaaaaaatctcagttgaaaggaaatgaaaatagcaaccctgcaactcgtgtgagtggagttttaaattggtcgttattttcactattaaacaccgtattcaacttacaacatcggaaaccattcttttataatttgataatttcaattaaatcattactccaaatgaataatagaatagcgggttcaatagatcgaattactggagaatttattaaaacgaaaattaatcaatcaataactcgagataaagttgctagaattatcaatgatttgcgagtatacctattttacctgtcactggacgatcaagacccagtagatatagacaaaaaagaacaagtgtcaattgatattttaactgataagatcatcaaagtttataaagcatatttggccaaatatctagatttatcatacaaagaagaaactgaacaagatttgaaagattcaatcaagctggttttgattatctttcaacagaaagaggaaaatgaaagtgacctacaacagtatttggacaatagagtcaacaaattgcttattataaagttattagattgtgttattggaaatttatatactgatatatag

SEQ ID NO: 13075 - DNA, 222 bp, Candida albicans
gtgaacactgtgttgatgaaaacagggttgtacagtttttttttctacttttttgtatgtggtaagagaataaatccatacgactttttgaaaagttctcactttcttactttttcgtataaagatttgatggatctatttttcaaacgacatgacataatttatttcttactgcaaaaaaacaaaacgaaacaaacagaacaaaatcccgaaatcccttga

SEQ ID NO: 13076 - DNA, 327 bp, Candida albicans
caacctcaatttgtccaacaaaaacaacagcagcaacaacagcagaaagatggtggattaccataccctaccatgagtaggacaacactgatatataacaatgatgataccattactgacgagcaaattccaaagtcaactgcacagcaacaaaagcaagatcaaggcaaaggtcaattaggtacatcgttatatcctggtcaagtaaatggtgaacgtccaggtcaaggaatatcacaattatctaatgaagaagtttctactttgaatagtaatgttgaatcaaatccaagaaacgctgtaaagaaaaatgaacatactggtgat

SEQ ID NO: 13077 - DNA, 204 bp, Candida albicans
ttaccacacaatagcattgacaggaaagtaattttagctgattcactagtagacgtttttaggttccttattttggtacaatggtcaaatattaccgaaacgtgtgttgagctaggtgtcacaaaaaacaaagaaggtggcttgcaagggattgtcgaaactaatccaatgataaatttcctatataaataccgcagcaggtga

SEQ ID NO: 13078 - DNA, 210 bp, Candida albicans
atacaatcaacaattattgaaaccaagaaaaaaaaagatagaatcttgtttagtggatgttttaatatttttgtgtgtactaaactgcgcctctctttattgaacaagtttatgaaaacaactaatacctcaacacaaatagtatttggtgaaacaattacaacgcactacaacctggtaaacaaagatgcgataagacggcaatattaa

SEQ ID NO: 13079 - DNA, 228 bp, Candida albicans
gttttgaaattgaatctgaaaaatttgaattttccattacacttggttggacttgccaattacacaatctacatcaagccttgtgaaagttttgcccaagccataaagaaagaagaggatggcaagataataagacaatccgcagttggtaatagatctcaagttagatacaagcaaaatttgatcaaactagctttaccgggtgataatcgaaagaaaaatcgttaa

SEQ ID NO: 13080 - DNA, 273 bp, Candida albicans
attgatatgcaggcatattttttttttcaacttcctcacttcaatctaaatctggaaaaaaaaaaacatccatctttagtcaatcaccaagaacaagaacaggaaccaccgtcatcatgtcaggaaacaagaagaaaaattggtcattacaactacagcaataataacgtcgatttattttggaataaatttttggaaaccaataaattaggttgtgtctatttcccaaagaatttccaaattttttgggatttcctaaatgatatcccttaa

SEQ ID NO: 13081 - DNA, 204 bp, Candida albicans
ttaacaagtctaaatttatcggaaaatcaagaaatgcaaaaaaatattgacatcgaggagattcgaactcctgcatcttacgatagtagaaaacccctgtttacacagaagaagaaaagaattcttgagtctaccgccttagaccaactcggccacaatgcctatttcgtgattgaaaaaatattacgcgtcacccggcgataa

SEQ ID NO: 13082 - DNA, 222 bp, Candida albicans
aaaaggtgtataagcactaataaattagtttattattatgatgacatcaattatttgattcctactgcacataagttgtcctgtactaacagtagtagtcgtggtagtagtagtgtgcgtctcttatcatcatcaaatattctcttctcgcaattagttagccatcttcctctttctatatatttttttcagatcgcaaggaaaaaaaaagaaaaaaattag

SEQ ID NO: 13083 - DNA, 402 bp, Candida albicans
ccaaaacatataattataccagatatgctgcctatcgagaaaaagacgaaggtggataaatcgcctaaagcgaatgtttctgctcctgttcccctaaagcatgtgccacatccagttcccaaggtagcttctctggaccaccttaaacaacaaatttttgaacaggatggaccattgaggtctttgactcccaatacaatgggccaggtgcaaagacatatggtaagaagaccatcatttggaacaattgttaccaccagggaacagcattacaatttggactatccagaagatcccgacgaattgaccaaattacaacttgatcccacatcaagattttatgcacgatccaaaccaagcacgttcgatttacccagtttattcgacctgcccacgggaaga

SEQ ID NO: 13084 - DNA, 393 bp, Candida albicans
aattgtatttttctccgtaagttgttgttatgtagtagaaaatctagatccatgttccaaaccaagtctcttgctgttgttgtcatcaaggatcatcggatgcagattttcaggaacgaggattttcaagacatgtttcctatttgtttacactctgtaagtttaaccggaaactcgaatgatcatgatgaaaattttgaaaggagtacatattattgcagcaccaacaggttggcagttactaccagagatataagagtattaaaaaagaaacgtttcagtaacacgaggagtgttcctggtgttgttgcaggaaatgcaacctggcaaaacactaacacacacaccattgcaacatacttacaaattacccactattctaaacgggattga

SEQ ID NO: 13085 - DNA, 198 bp, Candida albicans
attgttgtatcaatgaagtatctttccaaactacatgacgaaatagcaagattgaataaagataatgctggattaagaaataatttaaaagaacaagaattgaaacgggttgacgcacaacagggaagaccccaatttgcaaatacaacaccagccaaccgagtttcttcttcaccacggggctggaaggatccgcac

SEQ ID NO: 13086 - DNA, 309 bp, Candida albicans
gtgaaaaatcccaaaaaaaagaaaaattatagtaataacaataaaacaaccaagataaagtttgaatacccacttatcataaggggcctatgcgttaaatttcaaacaatcccaaaaaaaaaaggtaaaactgaaaagttaataaaaaataaatctaaaggggggaggaaggtaggacatggacaaggactaggtctaataaatcatttattgtggtctcaagacattttcagccatataagatttaccagtctttggatcagtacccataacgttaccagctgggtcgtaggaacaaacaacgtataa

SEQ ID NO: 13087 - DNA, 204 bp, Candida albicans
attggtaaaaaaatgaaaggtgtacttcctcacgctatcctctttttcttgtactacggtcaccaagagtttttggaacaaaatcttgatttgtatgtttataacttaaacaccacaattgacgacagcaataaaagcggtcaagtaaggattatagaaaatgaagttaataaacacaacattcttaacttgttccctttctga

SEQ ID NO: 13088 - DNA, 222 bp, Candida albicans
aagagaaaagaaatatcaaaactgaaacgacaaccacttttaccatccgtaaggaacagcaagggaaacaataacactaataattataataatactatcaatactatagaattgaaagatctcaataaaaaaggaaacaaatcacaattcaatggaacaaaaacaacaagcagctctagaaacaatttcatctctccaccatccatctcctctccttcgtaa

SEQ ID NO: 13089 - DNA, 243 bp, Candida albicans
ttcaacaattgtgtttataaagaaaagaaaatcttgtatatgaaaaacaaccaaataaattataaaggaatgactagagtgaatttatcaaaagttgatgaaagaaaaccgattaataaaattttattttacaaaactattgatattgataccattatatatagtgaacaagaaatggggaatatcgtttttatgatagtacactttttttctttctttctgaagctaatggtggcatcatga

SEQ ID NO: 13090 - DNA, 243 bp, Candida albicans
caaatatgggaaacacaataccaacagtattggaacgagaatttgattttggctttcctttcttttcttcttggtgccatggctttgtgtaatcactacaatattaatttggtgataatatcaattgttcaaaaagcgtggattttttcatctcaatttaggcagagtgcattaccacagttaacgtcattttccaataaccagttgtacaacaataaaactgtgtatactcaagcttgttga

SEQ ID NO: 13091 - DNA, 231 bp, Candida albicans
aaaaaattgacgtcagtatataccatctcatactatcaaatccgtctacattggatttcgatttgtaatcgcacaaataacagttcatgtaatcaaaacccagcagtattattacaatcattattgaccataggaattgataaagtacctaatatttatttgtatggaaaatacgttgtatttttgaacacttctcggattgtgcagattttatttttagccaataaataa

SEQ ID NO: 13092 - DNA, 189 bp, Candida albicans
gaacgttttatagtacatggtgagccttggcaagaaaagaagtattatagtaactctgaaacaccaaacagtcttcttgtgggttttctgatttcatgtaagagaacaagaaacaaactagaattgtcgatcgtgaaggatggtttaacaggggaatccagtgtcaaagtaacaaataaccaattttga

SEQ ID NO: 13093 - DNA, 198 bp, Candida albicans
atgttcaagataggattgaaaaaagaaggacaagaatttataataatgtgtaaaaagagtgcaagcttttttaaagtttatgttggtaatggtgttgacgttgttgtattagtattatttaagtatttatataaatatatatatatccaagaaagaaaatcagtaattattactagtaagtatttaaattccaattga

SEQ ID NO: 13094 - DNA, 309 bp, Candida albicans
  unsure (200): Identity of nucleotide sequences at the above locations are unknown.
gagttaaatggatcattccggcagaataaattagtaagaaagaacatgcaaatgtacaaatggttaaataattttttagttgtcgcaaaaacagaaacaaaagtggaatcagaaaaaaagaaagaaagggtaacaatagcaaatctccctttttttcttcttcttcttttctttctttccgccgccaccgccgccaccgntaaattgttcttccagtggagtttagtacaagaaagaaaaaacttaaaaatagaaccctgctttcaccccctccaaattccatttaattggaattggaattggttttaa

SEQ ID NO: 13095 - DNA, 234 bp, Candida albicans
tccccttcaaaattacagacacatcaaagcaaggaagaggatagaaccattttagccaaattgttattcgccaaaaaaaacattaacagcgctaaagaaaaagaaagaaaaaaaaaatctgatagtttgcgctaccaatcaaaatttcagcatgattccgccttgagttcgatttgcctatacttttcttgccttgagaatagtttatgcataaactcaaaatcaattaattag

SEQ ID NO: 13096 - DNA, 222 bp, Candida albicans
tttcaaaatccaagtttgtataagtatcagggcaaactcgtaattccatttacttattgttacttgatctataatgaaaaaaaacaattaaaagataattatcaaagattaagagttctctctctattttcaaataatcaatggtatttggatcttttgcagtataatgtagctgagaaatcaaaaaaaaaaattggtgattctaaattgattgataattag

SEQ ID NO: 13097 - DNA, 186 bp, Candida albicans
ctagaatctagttatagttgtaatactttttgtaagccacaacttaccagtggaggagaaattttatgtacgccttcattcaatcctcaacttatacccatcctgcttaacctttttttagacgaatttcaggaacttttacaaatcagaggcggcataagtccatggtttaatcaagtcttctag

SEQ ID NO: 13098 - DNA, 204 bp, Candida albicans
tactcagacatgtttgatgaaatttatggcgtgtttattgtcatcgctacagtcattgcatctattgctatttctattgcattcgctgctactgtcacgtttgctattagctttttggccggttttacatttattattttcattgctgtggccatagccactatcatgtccactgctattgctattccaattttattattttag

SEQ ID NO: 13099 - DNA, 192 bp, Candida albicans
aagtgggtacggaacgggaatagcaactttcggatattaatacgacattcaacagaaattgaaatgtcggattatttttttctagattcgagttattgtgtaattagaaaaaagacattacgacattatagcctgggcttagaagtagtagtagaagtagtaccagtgactagtcgtttctaccgccactag

SEQ ID NO: 13100 - DNA, 933 bp, Candida albicans
catcataaaccactaccgtcgccactactacttattcttcatttatttgtttccttcttcatagtatccatacacaccttatctccatattcactaattctacttattcttcactacatcaaaaagtttaatatgtctgccgactaccatgcaaagatgcaacaaatgttgttcaatcgatatacaaatccaacacctaatgttgcccaggaggcaaacgtgccacatatagcaaaccaaggaccaaacgcagctatcgccacgactacgaccactgtcaactccactatggtccctacaatgaacaacaactattatccacaaccaaacggcaaccatgcgtctgagatgagtctactaacgccaaacatatatgaatataagtcaaatgttattgaaaatcagggtggcaacgattttggatacttctcgagtcgagctgctgtgtcggtaccttcgtcacgaatagacagttacaacagcaataatagtaacacttttgaggaagaaattgagcggtttaccaaggaacatgactctaatgtcatacctattcatggatttaaccaccaccaagaacaattcgacaatcattctacgatagataatttagcatgtcacatggctgtacccccacaactacaacagctaccaatgccaacattaccacaacagacaacggcactaccattaccaccgcagcaacaacaaccagtgccacagcaaggaatgcagttttatgacaccaatcaagagttccttgaaccggtagcacgtcctcaagcatatagacaaaatacggcaccagcatctagtttatctatacaaaacttgcaacagcatcaactccaacagcaacaacaacaagcatattataaccatcttcaacaacgacataccctcaaatcgttcgatatcgagtctctgcccacg

SEQ ID NO: 13101 - DNA, 315 bp, Candida albicans
atagatatatctggattgcaaacaaaaaaaataaacacacctatttctattaacaaatacttgtatgtttatcaaatactctcaaatatagactgtttcatagttttcttaatatccaaatgtatgttattgtctattgcatatttaagtcacacaaacaaagaaaaacagcacagcaatcttaataatgatacgaccttttttcctcttttttattacgtcatacataaattggtagctttttgtgttattttaattttcacgtctactctactactactactactactactactactactgctaagaagctag

SEQ ID NO: 13102 - DNA, 309 bp, Candida albicans
aaggttctaatgttgaaactctttctttctttctttctttctttttgcacccaattagtgatatctatttgtatacattattattttacaagtttaattttgatcagccgtgaaatattttttttatttcaacgaataaaaagtcatatatcagtgatattactaacttacttgaaaaactacgatgatttcattactaatattatatttttacattactaccaactgttgatgtctattgactacgtagttatgttttcctccttattttcttgtcaatttcttccatctttctctaaatggacctaa

SEQ ID NO: 13103 - DNA, 192 bp, Candida albicans
tggaatttagtgtgtttgatttctatatttttgtacgttaatctggaagataagagggaaggaaataggaagagtaaaatctctacattagggaaacatttacgaagaccaatttccccccacccctactctccccacagtagttgtctatcacttttattcgtgttaggaaaccgcattgctacaatctaa

SEQ ID NO: 13104 - DNA, 213 bp, Candida albicans
ccttgttcgcttatttatttcaagttagtgaaatcagtttcaccatctctagtaccatcacaaatagcattagcaccacaagtacaacttgatttatttctttttccacaagcacaagcatcatttgatgatggaacaacattttctactgaagctttagaacaattacattttaaagctggttgtttaccacatgaacaagtggatttttga

SEQ ID NO: 13105 - DNA, 213 bp, Candida albicans
ctttccagctactctccacaagcaaaatattatggaaataccttcagtataaataacaaatctcttatcttaatccattcttgtatacagtttaaaagaaatttgttgagagagactactgggactagaactctgtcaatccacttcacaaattttcaatatttttatgctttaaattataaatatatttacaagacatttacagatttctaa

SEQ ID NO: 13106 - DNA, 189 bp, Candida albicans
agtaaagaaaagtacctcaaaaatttacatttacctttgagttcaagcccttatattaataaaaatttctctgttatgcacatctcagttcttgatgtaaattattacatttcacactacaataataaagtccacaagacagacatctcagataatttgatttatcaccacaaatacaacaaagtctaa

SEQ ID NO: 13107 - DNA, 1974 bp, Candida albicans
gtggaggtggaatcttttcccgtactttgcacaatttttgaatggcggactgcatatgagaaaagacacacgcttttgaagaaaattaacgcacacacacctacacgcaaaaaagaaaaaccacaacaaatcagaaaacaacaacaacatcatcatatcaacattaaccaactttctgctgcatcaaatatgaagagatattcaattgcaccaacttcatcacggaggaaatctgctattgatgcaacattacctgaatctaatttaccagcaagacaaatattagaacaattagatcaagatactacatttgttcttcaagaaattgataaaaatatctctcgagcaaataccgtgattaatgataagattaagcctatgatacaagaatatgcatttcaaagttggaaagtttgggaaaatactgggttttggacacattttttcgaacaatcagctaatgttgaattaggtagttatgttgaaccaattaatgaggtgaatccacaaaataatttcttattattgaatgaaattgaaaaaaataaacaaaaggggaggtatgaggatagtcgtgggagtaataaagtcaatcaggctaacaatgacgagaataatgatatagataatgatgaaaaagaggagccagaaatagcatttaaaaaaccaaatcttcgacgattagttgctgatgggaatacccctacatggtcaacagagcatactaaaccatcgatgaaatcaatacaattatcaccaccaaagagaatgcagacaactaatttcactggtggactagctcgagaaaacacaaaattgacagatagcataacattggaaccaccagcattatctgcagagacccgagctgtcacatcactgcctcacagtcgtcattatcaaaatcaacatcaacgactacaatctagagattcaccaattaaaatacataccattagacaatcgttagatacttatcatcgagtgtcaatatcaccaaagaaattgaaaacacctatacgttcaacaagaactagtataattgaaagtatacttaattcgtcacccatattaccggaaccaccagttttacaatccgagataggaagtgaaactccaaaatatatgtcatcttcatcacccatgaagaagcaacaaccacaacaaagagaatcattaaatttccaatcagataatgatcagcaacaaggacttcaaagatttcctaatactcctacatattctcgattaagtggatcatcagtgaatagtttattaagtaataaatcaaatttatctgatgatgaagatgatcatattaatcccccaccacaattagattctgataatcatggagttgtaattgataatagtgacactaataacaataatggtgatagttcagatgatcttgcagcattaccagtgcctgaattgaatactattgattttaaagataagaacagcaataacaataataagagatcaattcaatcaactccaagatcgagtgaaaagaagagacgatcaataaatactaaaaatacaaataataacaatacttctgctgctgctactgctgttgttgttgatgatgatgatgatagggaaaatgtatttttggatcattcctataagaaaactccagataatcaacaatctaataattcaacaagatttttttcaactggaggaagtaataatgataatcatactgaaactcaagataattcaaaatcatttagtcaaatttatgatgaagcaatttctaaaatacgaggtaaaaaaactaccagccaaagcaatgatcaaaatggagatgaagatggagatgtggtgatgtctcttgatatgacggtgactaaagatttaactggtgaaccaacaaaagatttatcaaaagatttaacagaaaattcaactactgatttaggtccatttagagaaagatggaagaaattgacaagaaaataa

SEQ ID NO: 13108 - DNA, 213 bp, Candida albicans
aatttccgcaaaaagttaaactctaataatagtgccacgattatcattgagtttatttctagatctactttaactgattcgatagtagtgtattctgctggtctatcacatgctagtcgcaaaatatatatgtatgcccaacaacaaaagggcgcatacaaagttgtcaaatcaaaaacaaggaaatggcaatccctattgttctgcatatag

SEQ ID NO: 13109 - DNA, 207 bp, Candida albicans
cctccgaaattgattgaagattcaacagcagtaggaggagccatgattgataattatttgaataagttaatgattgattcgaagaaagaaagaaaaaaatcaatcaagttttcaagggaatttgatggtggttttatactaatttatcagaccattaataaagacttgtatcaacgaattttgctggaaaattttttttctttttaa

SEQ ID NO: 13110 - DNA, 228 bp, Candida albicans
aactgttatttggtccattgccgtcaagcaaccaaaaataacaatggcggtcccggaagatgcagcgtaccaagaaaagaggggataaccgatgtgtttgtcaccactaagccatctagcaagtctatgagctcaaatcaacacagaagagaaaatcaaatccacacatgcttggtagcactaggcgaattagagttttcagttttcattcttattgttaagtgttga

SEQ ID NO: 13111 - DNA, 186 bp, Candida albicans
cttcttggtgtgggacatgtaatcgagaatttcagattacacacagagaggggtaaatttagctttgttttaggatcgtcgcaattgatggagaacaataaccattacaactccgcaacactccgagaagtataccagtattcgttattcatacggagtacatgtgaaaaagaagggaggcactaa

SEQ ID NO: 13112 - DNA, 240 bp, Candida albicans
atcgctcaaagtttatctacgcaaaactatgctaaaacaacaaaccacaaaaaaaaaaaaaagaaattgtcgacagccgtaatagagtctagaccatctgctcattacccgaatgagctggtcagtatctttcaaaattattggttaaccaacaataccgtcaactcaagtcctaacctcttcttgccaacccctctagcaccccaaggaacaatcgaatgtttcttccttctctcttga

SEQ ID NO: 13113 - DNA, 261 bp, Candida albicans
tggagaacaataaccattacaactccgcaacactccgagaagtataccagtattcgttattcatacggagtacatgtgaaaaagaagggaggcactaaaattatgaacatttccattgttcagcataaaaggaacgttcgtgtacttgtgcaaaagaaagcaccaaacctccttactattcgtaacacattttctatattgaggggttattgtaatgatactttgacaatcactttaaacagcaaaacaattgccatgtga

SEQ ID NO: 13114 - DNA, 840 bp, Candida albicans
aatcaacaccaatattccaaaaccgtgcattgctgtggtgccaacacccaccctcaactatcacaatccgacccaacgatatatatactgcgacatctcatcggttttgaatttgtaataaatgccaaatccaattatgatgtgaaacaaaaacaaaacattcttggtcgcaacacaagaaaaaaaaaatttcatttcactttctctacaaagatgagagcatacaatcaccctatactagttaaccctacacgttggctaagagggccaaagaaacacgctgcagcattgtaccataatgggtactacccgtccctagacaacaacccatttgcattggcattggcacgactcgacgcaaactcgccttcatcaactttacccataggcaatggcataccgttgacagttacccaacaggacaaccaccacgtcctcaccccaaccctaaacgacaccgccgagcccagtcgattaatcgttaatagtgccagatatattaaattgatcgtcgataggccaaaggcaattcaaaagttggtgcccctacagttcatacagcaatgcaagtcgtcaaaagcaaaagttagcatgaatagggatatggtggatgtgatagacaagatgtataggcagaggatagaggaactacttgaggatgtgggcaacgagtcaggagaatcaggcatcatcctcaaacccatggacgtgccagtacgtatcgagggaagcaccacgtacgtcaacaacatattcactacccaccctaaattcatcaactacacccaccgcgagctatcacaattaatactagcgtatactgattttgtaaatctataa

SEQ ID NO: 13115 - DNA, 198 bp, Candida albicans
tgtaaccgaaaaatgtcaccgtcagatatcaccaccataaaaaaaccgttggaatacaaaaccaaaaaaaaagtacaaatgccaaacaaacaaaaaaaaaaatttttactcaaaagagcgtcgggaaggggggggttagttggtgagcaactaaaatttgttggtggcgtgtacaaaacactaaaagccacccgatag

SEQ ID NO: 13116 - DNA, 330 bp, Candida albicans
atgtgcatcgcaaaaaaaaaaaaattttgttgtgttactcttttaccaatcatgacacaagctacacttcagactatatacgataggccgtatgagatatttaagactgatggagagttttttaataagctagtcaagtcgtttatagacccgttggcgaaaaagtattctgtgttggatgagatatatattgatgggttagactcatcgcaagtttttggacgaacaaaaatggttttagagggggtgggtgaggagttgttggggagtgttataccggagatacaagggatggtaagagatggagcagaggtcttcactacggaatag

SEQ ID NO: 13117 - DNA, 192 bp, Candida albicans
tgtggagtacttgcggagcattttgggtgtggtgtgaataggatgttgaaaaaaaaaaaaaaaaaaaaaggcgatgaaatttattggatagaagtcgcagcgcgacattctagattttgtgtaaaaaggggcggttcaggaaaaagtttaggacatgtgtgtctatacctgaacacggaaaggcagaggtag

SEQ ID NO: 13118 - DNA, 282 bp, Candida albicans
tcgttcgctattggtacatgtataggcactttattgaattgctcctcgacagatcctttagtcaaggaatcgtataatgatggtttgtatgttttggtgggttctgttggtttgactaataagttgagagctgctgctagtgaaatattctcttgtttccgatttttcgatcgtatagtgcttgtccaaaaaaaccttgtggcagactttaatgaagacgatgtcatatccagcttaggtggtctaacatttaacattgaacttgtcaattttgatttttga

SEQ ID NO: 13119 - DNA, 186 bp, Candida albicans
tttgtcgattatgattctaaccactattgtttcatacgttcaagaaaagaaacgaaacaatcaaacaatgccaaacaaaaccaagagaacgagaagtataaaacagtttttttaagcacgttatcttatgtggttattatttatatttggttttctctattacttttcttcttctacatacaataa

SEQ ID NO: 13120 - DNA, 309 bp, Candida albicans
aatgtaataaaaatatatttaagcgactccgagcaaagaaaaaagaaagaaaagaaatttgttgaattatttatggcacttgtacacgcgcgcgcacagttaaaatttctttttctttattgtttacaaatttctcaacaaaattctgttacagaagaagaagaagaattattcctcatacaacgacgacagttactaaatatttttttttttttgcaatacacgttaatcttcgaatgggatttcctcacacacgaacagaagcaacaacaacaacaacaaattaggagaccgccgccgcagcaataa

SEQ ID NO: 13121 - DNA, 192 bp, Candida albicans
atattttattttattacacgtaaacgattagaattcgttcatacagaatatgacatgttccattccattattactactttaaaaaaattttccttagctttgtgttattattatttaatgatttcgtctgttttcttccttataataaatattgggttggctatatgttgttgcatggtgcgtgtatcttag

SEQ ID NO: 13122 - DNA, 213 bp, Candida albicans
aaaaaaagattaactaagataaacgattttattactttaaaatcacaatccatttatgaattatcaattacaacgttaaaaattcgaaaagaaaaagattcaattctacaacaacaacaacaaataatcttattgctgcggcggcggtctcctaatttgttgttgttgttgttgcttctgttcgtgtgtgaggaaatcccattcgaagattaa

SEQ ID NO: 13123 - DNA, 228 bp, Candida albicans
tcagtgagatgccctaataatcaattaaccggcgtaacagttttcttttattcaccttcctcctattttttttttaacgagacacgtcataacggcggtgagttcaagccgatagataaaccaaaaggcactagttttccttcgacccctatttcttttctttcccgcccctccccattctctcccctcatttatcttactacacaaaattttttacaaccctcataa

SEQ ID NO: 13124 - DNA, 195 bp, Candida albicans
aatattcaaaattatgtatttagcgaattatattggagtatgtttggcgaattggttagaaagtacctagttattggattattcatagtgtattataatgtaatagcacctcatttgtggcccttgatactatcttgtcggcttaacttgatttggaaatatcaggatcaattttttcttaacgaaagacaataa

SEQ ID NO: 13125 - DNA, 210 bp, Candida albicans
attacaataaaaagtgactcagcttctagaattaaggtaacagttacacatagattaataattctttacattcaagaaaaaaaagtgaaaaaaaaaagtaaaaatagcataattaattgcattcttatcagcatcgaacctagaatttataaaataaaatttatcccgtgtcatttttgtttgtataaagcaggtggtatttccttataa

SEQ ID NO: 13126 - DNA, 207 bp, Candida albicans
tttactctgtgtggtacaaaatacattagagaggatcctctccaaacaggattgcaggaagttttacacgagaatgatttactacacgacgttgaattaaaaagctcaaccagtttgtcagcaattttgttctatctgttcaatttcttgtataaaataaagcaatatgagagagcatctaaatcaataatgtcaacacaatattaa

SEQ ID NO: 13127 - DNA, 315 bp, Candida albicans
aagaagaataatatcaaattgttcctgattgattgttgttatttattttttatctccgaattcctgcacaatggctcaacaacagccaacacggatcacacattaaatttttttttcgtgcaggaccccgtggtggtggctgtggctgtgattgtgatcattgtagtttctgccttgatgatgacaaaaaatgatagagttcagtatgaggaagaaattaagcgatatcggtttatgatgtgtttagttattaattgctctcaatggttttcaacaacgtatacaaaactggtggtgcttgaaacgaatgagtaa

SEQ ID NO: 13128 - DNA, 189 bp, Candida albicans
acagatgctggcttagatcagtcagtggttgttgttgaggttcctaaaaattgcatcacaacagcctctgaggtgttctgttctttttttttgaactgtagagacaaggcaaacttagaaaatcacagcttaattagatctgtattactcattcgtttcaagcaccaccagttttgtatacgttgttga

SEQ ID NO: 13129 - DNA, 276 bp, Candida albicans
  unsure (41),(43),(44),(46),(51): Identity of nucleotide sequences at the above locations are unknown.
gatatttatattgacatacactgtactagttttataaaatncnnantgggnggggggttattttttgcaggctattgttttaagtgttctattagtgttttatcaaccttgggtttaatgaaaatagctattgttaagattttttggctattgatgatgcacgtgtgtgtatcattgtctttacaattgggggtgatgccatctatttttttggagccgtttaataaaagtttgatagaaaagggggtagcggataaatatttcgagactttataa

SEQ ID NO: 13130 - DNA, 225 bp, Candida albicans
  unsure (25): Identity of nucleotide sequences at the above locations are unknown.
attcaaaaaacccaacataaacganacaaagaacacaaatttcatactttctctttgtcaattggtgtatgccgcgtgtttttcttttcttatagtaaatctagtaaatcagaattgttgatattactattggatgttgttgatattgatgatttgacattggcattgactgatgatgatgatttcggagataacaccatgtttgtgttaaatcctggtggataa

SEQ ID NO: 13131 - DNA, 312 bp, Candida albicans
agaagacaatttggaagaggtaaacatggtggtcaagcatctcaagaaatggcagctgctggtgggtttgacaatggtagaaatggtggtgggtacagagggcgtggcagaggcggattcagaggtgggtttagaggtggtcacagaggacgaggtggtggttttaggggtggatttagaggtggaagaggtggcggaggtggtggtggtggttttggtcgtggtgaatcttcagtttatataccttcaaaagatcctacatttgatgcgccaaccacattcaatccattggcagacatgagtcaaaattag

SEQ ID NO: 13132 - DNA, 195 bp, Candida albicans
gacataattctgcagagaagaaatatatggagctacaattcaaccagacaaagtaaattaaatgaaatagcaaagcttaatactgtaataaaatattccagctatttaaatgttttacgaactattacttctagaggttttagaccaagtcgacctatttcaaagtataatcatctacctgatttgactaagtaa

SEQ ID NO: 13133 - DNA, 234 bp, Candida albicans
  unsure (107): Identity of nucleotide sequences at the above locations are unknown.
ttgctggcacgaaagataatgttatggcaaacctggaaggagctattcgtaattgaagatggtgaaataattgctctagttgatgaagactctgaacctgttgttangagaacattggatgatctgctgctccgtccaattgaacagaactatcacgggattccaatgactacttgttcacaaacaacgtcaatgtgttggatacatctgtggtgcaaagtgaactgtttttga

SEQ ID NO: 13134 - DNA, 255 bp, Candida albicans
agatacgtacagatacctttattgctctacccagtcctggtgaaacttgaagtattaggtttcatcacttcaactaagaagtcaccaattgagagcatgtcaaacgtatacttgtataatcaacaactcatacgtcttgtcgggttaagccctctacatgttcattcatataacaataaacatcattctattactctgctaaacctattcactgttagtagaaatactcagatgcaaaacctggcaaacttgtaa

SEQ ID NO: 13135 - DNA, 312 bp, Candida albicans
aacaaacagaaggcagaggaggccaagaaggcagagaccgccccacaaaagtttgacaactttgacgactttattggctttgacatcaacgacaataccaacgacgaagacatgttgtccaacatggactacgaggacctaaaattggacgacaaattacctgccaccacagacaacaacttggacatgaacaacatacttgaaaacgacgagctgatactagacgggttgaacatgacattgctcgacaatggcgaccacgtaaacgaagagtttgatgtagacagctttttaaaccagtttggcaattag

SEQ ID NO: 13136 - DNA, 240 bp, Candida albicans
aaaatttgcactcatcgagagccgggaattagtataaaaagaagagaaaagaaaggtatttacgatatagagaccgagtttcagtcgacacttttagtgggcgtaaactttatttactctgttttttgcttattaaaaattaatgcctatcgtgtaccaggactaattctcacgaatattccgtgtatacaaacagttcccttttctcttttctatgatacgtatctccagaggccatag

SEQ ID NO: 13137 - DNA, 195 bp, Candida albicans
ttgggatggccttacaacgggtatactcatccattgaacgtcgtatctgctgcgtttcacgagatttgccacaattttggtgtggcagctagttccccaaatagaacgggccatgaagtcaccaccagctacaactacgccatgggaagaccactgccccaacgtgatgagtgtaatgtcattcccccatactga

SEQ ID NO: 13138 - DNA, 303 bp, Candida albicans
gaaaatgcgaaaacaaggagaaaattttgttttgaacgaccgaattatcagttgacggacaaattcatcagttatagtgccattctaagggttaatcgatcaaaaaaaagtgataagagtacttatacattggtccaccatccccagacaccattatttactgatttaaagagcatactggggtataaacttaacgtcaaacggccagttttttacatacttgttcgccacgcaccaccgacaacaacaacagaaaaaatttttctctgccattggacaaaagagcaagagagaaaatcataa

SEQ ID NO: 13139 - DNA, 186 bp, Candida albicans
gagaaaaactcggtgaaaggactcgttcaacagatattattggacagtaactatatacaggaaatacatagaaacaaagcgttaactactacaccattcttctacctacacatgtatttcataaatacgtatttgaggagtattaacattaaaccagcagttggattgaatagaatgtgggtctga

SEQ ID NO: 13140 - DNA, 225 bp, Candida albicans
ggcatgactgtcagaccaacaatcgcacaactcaaaaacaacgccatcgactccttgaatatttctttattgaccggtaaaaatcctttaaatattttccagccagatcccggctcaaagttacatttaaaaagttctaaaataaagcaaacacacgtggcagccaccaatattgataccaatatttcaaagaatttggtctgtttcatgcttccatccttgtga

SEQ ID NO: 13141 - DNA, 1518 bp, Candida albicans
tcgtctagttttaacgtctccagcaatttaactgggaaaatgatactaataaatcccatgattagcaaatgcttgattaatagaaatgttgctagcagacattggtttaaattattggccactaggtctattactacatctaccacaaatttcaccaacaatagtctcgtgtacaatttgaacaactacaaaagttcttttccagaagatttcacggtaaatgaggacatcagcaaatatatcaacttgaataagcacaaactagaaactcagctgttaaagattggaataatatatgccaataaagagactaaaactaactcgaaattaattgaagcattaatggctgatccattggcttctggtaatgaaatttggtttgataaaattgccaacagaaagtcttttgggaaatttgtatataacgatgcacccgaagtggatgaagaaagcggagagtttggaattccttcaccaatactatcaggcaactacagaaataaatttcaacagcaaattgagattgccaatgatttgattattgaagaagtttctgacgtcacaaacactggtgattatatttttttaatcaatgtttcaaacgaattaaagaatacagattatcataaagacgtcaagaataaaatactactcaacgttcttgacaattgtgaatttactccttatagttccgaatccaccccagttacttttgcgacaagctctcatagccatttaattaaaataaacagtcagcttgcttacaaaggtataactgaattcatatcaaaagacgtaatggcaactgatacgtttattaacagcatgacggacagtaacatttatgaactatacaaagctataaattggtttactcagacactggtgttggaagaatggcttttacataatataaaatcccaaatcaaagaacaaatatccactgctgctgcaccagaagagattaatgatatttccaatatggagattgctagatttacagatttggttaataccgaattgcaagacgagtttaaaccgaaaacaaccaaattcttccataaaaacctcatttggtggaaattgtactacaaaaatgataatgtggaatatgatataaaggatttttttatgaaccactttatgaacaaaagtatagaaaactacaattacttgaaagggaaaattagtctggttgacgccgaagtgattgacaatccattattgaaattgaaaaataaagtgatcaacaaacgtattgctgaagaaatacaaccatttgtataccgtgctttggcgactgcatttttatattaccaactccctatatcacttatatcattttgtggttatcaatattttggctacggcgctaatgaatgtattgcattgaccaccctaggtttagttttagggtttaaccaggtttccaaaatatggactaactttactgagaaatggctcaatggcttgtttgaagaaatcaggatttgtctaggaaaagagtgcatcgaataa

SEQ ID NO: 13142 - DNA, 189 bp, Candida albicans
aatcgttgcaaattagtaacaactaacgcgttgatagttagaaattgggatggtcccataaatgaggctcaattcaggaagtattttctgttgcagtacttgtttttggaaatctttgctgacctcgcatcacgtagagttaagaatagaaatgtatgtattccaatcaaattggcaacgcgtttgtaa

SEQ ID NO: 13143 - DNA, 453 bp, Candida albicans
gaaattaaattgggtaaatattatcaactattccacaccaacatagataatatatcaatgcaaagcttgaaactggttattgaaactaataaaatcaggccagcaaaacttaaggagtttgatttgatatttaccaatatggacttctatgttgaagtccctttcatccctaattcactgacgtacaagaatatgcctgtgttggttgcaaaagatgggactcaatatgaatacaaagaaaccaaacaagatgtagatgaaactgaagcatctgttataatatcatcaagcccgcgtatcaattcggacaagtggatactctccgatactgatattggtgatgtcaatgacactttaccaactacacaactggatttgatcttgacatcacaatccatttttgattcagaaggatttactaatgtaaaagaaaacgaaaacgtcaatatataa

SEQ ID NO: 13144 - DNA, 231 bp, Candida albicans
gatttttcttttttctgtttctttctttcttttttttggcttgaacaacaaatgtcgcaaattatacaaacgacatttgttgttcatgtcactttgttgttatcacgtgaagtgtcgcagatttatgtgttctcacttcatttctatggtcatcaattgttcattcattctctgttttcaaaaatctgtgatttgatgattttgattaaaagaaagcaaagagaatactga

SEQ ID NO: 13145 - DNA, 192 bp, Candida albicans
caaagtcccacgacggtcaaagagctgccagaccgcccctcaaatgcgtttaccaactatcatcatgataagttggagtgggaatcacacgtcatgatggtgatcaaaaatgctttggaaccttgggaaagcaaaaagtgtaaacaattttctgctatggaaaaagtagaattaattgaagctgtattataa

SEQ ID NO: 13146 - DNA, 243 bp, Candida albicans
aagatatatgctaaaagaccggtatcacaatttatttgtgggcaacttttttttttactccccctctcgctctctgtctctccctctcactcatttacttactttagtttctctcttcaaactcactcccaaagtaatttctcctttttctcaagaaaagcaaattttactcaacttagcaaattaactattaataataatgagatacataataataataataataataataataataattag

SEQ ID NO: 13147 - DNA, 198 bp, Candida albicans
aattgcgatgaagtttcagttacacacttgatcattatgaaattacttcttcataacaacaacttaaaaagacacaacagattatgtaagatcaaaaaaaatagaagagatataaatattattagttacggggaagtttgtaattatcgtggtcaattaaaaatccgtattgtccaatttgataaggtaatcacatag

SEQ ID NO: 13148 - DNA, 276 bp, Candida albicans
ttagaaaatatctctcgttataatgataattattggtgcgggtgggaaacccgcacgcacgccccccacaaagcacccacgcacacactttattcattaatatgcccccaaactctaataatactatctaaatttcatagcggcatagcaaatctagcttttcctaattttaaattctattgtttgattattaaaaataatatcgtaaaactaatacaacaacccattctcggggttcataatgctgaaaatcttcggagttatattctcctataa

SEQ ID NO: 13149 - DNA, 246 bp, Candida albicans
aaagaagaaagatgggaattacaccaagaagatagatgttgtaagtataagcgaatttatcatagtcgtaatataatatcgagatctggtaactccgacaataatactatgcagtcgcggttactatcacccgcaacctgtttggatgttttgtgggtgaaaatagtttacttctgtcttattaaaaaagcaccaaagtggcgaaatcttgatgtgactgtttatgtcattaaggaaaaaccttaa

SEQ ID NO: 13150 - DNA, 411 bp, Candida albicans
aatttgtggcatcgactgaagtgtactatgagcaatttaggaacaattttactaagtggtaatataattggaaccctgactgacagatcaacaaatcaatgcaaagctcaaaattctagtaataaggaaaattttaactattatcaagatcaacatgataaactaaaagcaaagaaactatttttgatccaataccaaaagaagttgcaaaatgaaattcgctgtttggaaggtaaacgagcagaattgcaagtttttgttaacaactatgaatcatcaaactttggaaatcaagattctttgaaagaaattactaacagtggctataatttatcttgtcaaccaactccatcggcaaattctttgggtgttgaaatgtcatcatcttctgatacgtttatttcccaataa

SEQ ID NO: 13151 - DNA, 339 bp, Candida albicans
cttcaaattaccgaggtaaaaacaaccgaggaagaaataatagaggaagacgtggcaataaaagaagagaaagagaaagatggcctttatcaactgatgctgttgttagtgaggaaagaaatgaatctggaactggtttcattaagaaggagaaatttggagcaattaattatgcaccaagaggacaaggggaattatggagaccaggataactcaactaagccaattttattttactataacattaaatttttgtttttttttggggggggggaggggccatttgggtatttgtatctattgccatttctatttgaacaaaagaaaatctgtggatga

SEQ ID NO: 13152 - DNA, 204 bp, Candida albicans
cttattccattgaataaattccagtttatcagattggttgccaaaataaaaattaaactgaacatttgcttacataagaaaaaaataaaactaaacgctgaacaatccagaaaagagatgggcagaaattgtggtgtaccacaaagttatctaccaattgatgctaattatatatcttctacactatatagttgcaaattataa

SEQ ID NO: 13153 - DNA, 186 bp, Candida albicans
  unsure (12),(14),(15),(16),(17),(18),(19),(20),(21),(38): Identity of nucleotide sequences at the above locations are unknown.
tctttcttccanannnnnnnntctctctctctctctcnttctctctctctttcttttattgtgtgttcttttgttcaatcacgtgctaatttgttgttcgcgtggtggctgtcggatgaatactatgtattgggtcgtgtatttggttcaactatatactttcatactttacagactataatataa

SEQ ID NO: 13154 - DNA, 210 bp, Candida albicans
atagtattattagagtttgggggcatattaatgaataaagtgtgtgcgtgggtgctttgtggggggcgtgcgtgcgggtttcccacccgcaccaataattatcattataacgagagatattttctaattagagctaattatcccgtatataaaagaatgcaatacaatacagactcggagattggtgattcattattcaacggacaatga

SEQ ID NO: 13155 - DNA, 435 bp, Candida albicans
acacctacacacacctacatatatacatcaatggaatcaaataataataaattgaaaaagaaatctattatcatagcatataatgaagaagatgaggacctcgaagaagaagaatttaagataaaaagtgtttatgatttaaataaacaagaatcgaatgatatagataataataccaatgagattaaacaattagataatacaaatattgaacataaagaaaagaaagaagaaaaagaaaaagaagaagaagaagaagtgctggagttgaagctggaggaagaggaagaagaggaactagaggaacaggtcctgtttccaaaaatcattaatagagatccatcaattgattcagattatgattccgatcttgatttaaataattctgaatcaatatcaattaatcaattaaaagctcataaatatttagggtga

SEQ ID NO: 13156 - DNA, 264 bp, Candida albicans
tctttcattaattttaattcagtagataatgataatggtattaatgatgatcttatattggaatcaaataatgtattattcatcttattggtaaaattcattgatgaacaattcacagtgattggcggagcagatgcaatgggtgtcactgctggttctaatttattcaaatacatatcttcaccaactttctccttaatagaaacaagatcagaaaacaccaacgaatttgaaataaaactgctattggtactggtactatga

SEQ ID NO: 13157 - DNA, 222 bp, Candida albicans
atcctctctttagtttttacaacctaccaatcaatcaatcaaccaaccacccacccacccactcaccacgacttgattaatgctccaacctttgaaaccttactactattaactcaaccctttttagttaataattcattacactctattaattctaaacaaacaaaaactagttggttctgtccaattcaagttcaattttctacatacaaattggattag

SEQ ID NO: 13158 - DNA, 207 bp, Candida albicans
aatggcatttgctggaagatgtggattatattaaatattaatggtaaacaagatgttttcacagaattatttaatgaagaattagagcagttttccaaattaaatttaaagattataccaaattccaacaaattttcttggataatggaattgatgaaaatttcatccaaattattggtaaacctaaatttgattctaaacaattaa

SEQ ID NO: 13159 - DNA, 183 bp, Candida albicans
gttatgccaaaaattgatgcaaatttaaatcttatcaaaaatgagccaaatcaagcagtttttgtaaaaggtcatgatgtccgagtggttaaggagttgccctgctatattcccgatttcagtcaggaaagcagtttgttaggcaatgggctctgccttcgcaggttcgaatcctgttcatga

SEQ ID NO: 13160 - DNA, 213 bp, Candida albicans
gatagatgccggagggagaggttaagaaatttgtggaagattgagaagagggatgttgatctccgagtaggagcgattatatgtgatagtgtaaagagtgaggagaagagtataggttaccgagtgatttgcggagagtccaatatccatattgggggagggggaggttatggtatgttccagaggagagaacgagggaatgttgagagctga

SEQ ID NO: 13161 - DNA, 252 bp, Candida albicans
actacactgacttggatgttattcctgacacgtaccttattaacacatcatgccgaattagccatacatatggttactgttgttatcaaagccatcaatttatttcatctaaaaaactatatatttgtttgcaactcaaacatgttgaaaatgcccagaaaaacgtctcaaacaatcaaactcacggaagcagttgccaattttgtcgatgcgcgcgcattttatgttacttgtaatcaattatttccataa

SEQ ID NO: 13162 - DNA, 210 bp, Candida albicans
ataaaactggtaataatatttacatatataatccgcttccgaagagatatggtggaaaggaaaatgcttttactcttgtctgcctattgtgttgactcaattgatagaaggaaaacagggttaactgtactagatttcggtgagataattgtatcacctcattttatacataaactgggccagcttcagtctaatcttgaaacaatttga

SEQ ID NO: 13163 - DNA, 402 bp, Candida albicans
attgatcggatggatatcctactgactgctcctcttccaaatacgcccatagctaaatttcaaaattcaagtgttatgtgccacccttctttcaagttattatgttcataccagctcaatttgcaaaatactgttgaatttgctgaaagagagtcgcagaagaaacaatggctgcatgtgggacgtgtccgaagtgcgaatcaatgctggtttttttttttcgggacccaaatctttttgtttactgcaaagaagaaattcattgtggccaaaactattgcggaaaaagctgttactgccaatattatcccgcaatcacggatatactccaaaaaaaaatacttgaatatttatctaaacaaatcactatacaacagtactaaatctttatattcgaactga

SEQ ID NO: 13164 - DNA, 207 bp, Candida albicans
gataattaccgattacagtatctagtcttgaattcaagatttttgaataactataaaaccaactcattccccttctatttcatcaactcacaggaagttttatcgtttaaaaaactccaagttagtaatgtccgaaaaaaaagaattgaaaaaccagaccgatatcgaaccgataatatcgttcaccaaagaagatatcgaagataa

SEQ ID NO: 13165 - DNA, 279 bp, Candida albicans
ttcatcaatccaaattacgtactcagaatgctttgtcaagtcggtttaaacgttaaagttccatttcattttttgttttattcccttacttttgggggttctgctttttattccttcattgtttccccactagtgtttaaaaaattaccaagagaagaatttagtaatttacaaaacaaagtattcccaccttatttcactggttccaacattggctccaattattttaggtttggctcaaccatttgcttatcgtccaatttacccttggattattaa

SEQ ID NO: 13166 - DNA, 207 bp, Candida albicans
ctcaagccaagtcatgtaaaattggacctaatgtctctattggtaaaaatgttacaattggcaatggggtcagaatggtcaattgcattgtttgtgatgatgttacaattggtgacaacacaatcatcaaaaatgcaattattgccaatggaactaaaattggaaaatggtgcagaatcgaaggtacgatcacagctagtattttag

SEQ ID NO: 13167 - DNA, 1083 bp, Candida albicans
acaagaattattctgtttcctgtacacaacatagaaacattcccatcacacgatggctatatctttctagagataaaccttaaccaaatgttgaggtccgtcagcagagatagtttcacaacattaatagaccaggacgacgatgatgagaatgacgatttgcaactgcagcagcatgagaacacacaggaacttacatctgatttgatctcattgatctcacaagaaacattgattaataccagtatccaaatcatgaatcgaaacatatcacaattctacaaacactatgaattaccattaatactgagttatttgcatacaggggttagtttgtatctaagtttgcaggatcttctcgataacaaaccacccatcctaacgagaacactgtccatgatgaatttcaataatttattacgacgaccatttagaaattcttcatttttgactatacacaagcatgactacatgaacaataagtttgaattttgccatgtcgatttcaaaatacactctaaccatattacatactatattttgaagttcccaacattagataaaacagtctacttaattaacaacaatagctctaaacctactgttgatttcgagtacaaaaaaacatgctttaggattacaggtgtgacaggtacaacttcagtgattggagtatcaccagagataaagttatatgtaatgaatcccaattccaagaatttattgacctataatacgactgtatcgaatggcaaaaagctccagataaataatagtttgagcaaattagttaatagtcaagaccagccgcgaataaacgagatgttgaagaatgagaagccagtaattagcattcccatgggcagatatttagatcaaggggatgtcaaattgaagctcgacagtaacagtgctaccaagtctaaactgaacataataaagcatggcgtaataagattgtttgattaccaggacgaagtaggagatactggaaataatgtggtaagtgatgacatgttggtgttgtgctgtgtattattagtgttgagagagcaagaataccggaaatttaaaagcggttaa

SEQ ID NO: 13168 - DNA, 201 bp, Candida albicans
tcagagattttcaaaaaagaagggacaacaaatacagagagaaaccaactgaaaaatttatgcgataagaatgaagggaaaaaactcagcagtagtcgtgcaattgtaccagttctactaaattatgaggtttcacaactatgcaatagcagggagacaatagtcattgtgctatcgctatttggcactagcaacgactaa

SEQ ID NO: 13169 - DNA, 285 bp, Candida albicans
ttcccttataaaacggagatcgccactaagaaggtcataccgcaaacgttcactgcacaaaagcatttccggagtagtgtctcttacaacaaggggggtggggagatgcaagtaatatgtacacccacacacccaccaccaccgcaataccatttcgtacaagtctaccaatcagtgtctaaatatactaacattatttactgtaattatttaaagtctatttggggcaccagatgcctactatcttttcaactagcaactgtcattcattttgctaccccctaa

SEQ ID NO: 13170 - DNA, 198 bp, Candida albicans
cacaatcatattgaattgtataatccaatgtataaagttgttggcatagtagttcatgtaatgaagttcacagctcctgaatgccctggaaacaattttattgtagaattggctgtcagacaaatgttggctaccctgcttttcttcgagtttattgaaaatgaccaagattgtcatttttttcatccaatgccataa

SEQ ID NO: 13171 - DNA, 237 bp, Candida albicans
tatcgcaacatctgtaatgtggttaatgtgtgtagtatatctgtcgtggtcatgcatgttatggatgaaatgtcctcaatggtaatttcattagaaaaaataggcgatgaattaagtcccagccttgatgcagcagcactagccaatatagatgattgggaggcatttgaacctggccccggtgttggtgttgcagagctgtctttgccattttcagcttcatcgtactctaactga

SEQ ID NO: 13172 - DNA, 210 bp, Candida albicans
agtgaaaaaaagggaattttatcaaaacttaaactgtcattttatttccagaaattagtatacaataatagaaatctacaaaaatgtatcaaaaatacttttaatgccaaaaaaaaatataaagaaattcagaaatcttttcccttaaatagttcctgcagcagcagctctttcagttctttctgcatcgaaaaggaaatcttgatatga

SEQ ID NO: 13173 - DNA, 249 bp, Candida albicans
gtatcaaactggtcattagtcagttacatagtttgtgcaaacttggttgaccagatgaaagcatgccttgatttacttcaattaattacaatgcaaaagaagtttctggttaaacttccaagtatttttacattattcatctgtttatcaagtttactacaaaatatgcaccaagttttgcttaaaataatatcctataccagtcatcttcaataccgattatttttttggatttatggtcacgtttag

SEQ ID NO: 13174 - DNA, 675 bp, Candida albicans
tttgaagtatatgttacaatggtgaacttattcaacaactcaaataatgcatttgatgccctcttcaataatgttggtacatttgcacaaaactcttgtcaaggcaataaccgaaattcgaacagaaatgacattcaagtgaaagaattgaacaagagtaatcagcacgagatccaagtttttaacaggagtggttatcaaaattttaagattgaggtagtcagacaaggaggtcaactttatttgcaaatccaatcaaaagtagatagatttgagagatatttcaagttgaatactgcaactgaggatattaacaatgtcaagtcatatatcgaaaatgattggttaattgttgcagttcccttcataaatagaggaactagatccccgcaacctaaaaatgttccggagcatccatctaagaaacaagataagaaacaagataaggagcagaaacagcagaaacaacagaaacaacaaacgcaacaaacacaacaagaacagcaaaaacagcaaaagcaacaaaaacagcaaaagccacagaaagaatcaaagtatgccagagttaagaaaatttttggaaagaagaaaaatgatagtaatcatcctgttagtttattagaagctgccagaagaaaaccatttttagaagaagttcctgatccgggtatttag

SEQ ID NO: 13175 - DNA, 198 bp, Candida albicans
tttgcaattcttgtttatgaattaaagtgggtttgtagagatattatttttttgtgtgtttatatttataagtttaaattaatcaatattttggatttggctgtgactaatcaaagaaagcggcttttttttcccataactgtaagggcacctcttcctcctccactaccaagtgactcattagaggcgataaattaa

SEQ ID NO: 13176 - DNA, 183 bp, Candida albicans; identical to SEQ ID NO: 7895

SEQ ID NO: 13177 - DNA, 225 bp, Candida albicans
aaaaaaagaaaattagtattcggagatgataaattgtggcttatatatagaaatccaaaggaggcgaaaaagaagaaaatagaagaatgcaaatcaagtgacagcaattttccgcaacacccacaatacaaaatgtatcacgtacatcagttagtactaaggctgtgtagatattgtatacgtttggcatcaaaattacaaagagaggggaatatagaacattga

SEQ ID NO: 13178 - DNA, 720 bp, Candida albicans
atgtatggaagatcaagaggctatggtggttatcgtagtggatatggctcatcaccatatgagtatggctcatcgtcgtcttatggaagaactgggtcaagcagcaataagtacaataaacagacctaccccaaatcactgcagcaacaacaacagcaaggagctccaacatacaaacaaacaagctataaaccacagtatgctaaacaaacatattcgcaaactccaagttcacaacaatatgcacaagcagacagaggaaagagcaagaactacaagccaaccactccatctaatcaatataagaaaaagactgtcaacaaaactgtcaacgtcaaccaacaaccaagaagaagtagacggggattaggtgggtttagaagtatgtggcacattccgatgatatttatgttttggcgtggattttcaagaaatcgtcaccaaccacaaccacaacctcaacctcaaccccaacagaacgagccaatcaatatcaccaatatgaattatccttcttcccctgagaatactactgctcctgttcaacattctcaaccgggcaccaacaatacagaagagagtttaccaaggtcttcacaaatcatcaaacccgaacaggatgaaacccaatcagtttcatcataccatagtgctgaagaagagaagaaggttgactcgtatgacaacaataaggttccacaagtacccacacaggactaa

SEQ ID NO: 13179 - DNA, 201 bp, Candida albicans
ttctggtttgataaaggaggtgaaagtcatgacagaataattaagaatggcaaattattgaactatattaatggaaaagaagaaggaaattcatgttctgcatcagatgggaaagaacaggtgtatatatactatttctgttctattccttttattatttttgtttttatgaagcatacaaaaatcatactaatcacctag

SEQ ID NO: 13180 - DNA, 198 bp, Candida albicans
gtatcatataatagtgtgaaaattcaagtattacttaaaaaaacaagaaatcagctaaaaatagattttttgatttctaaaaataggcaattatcactcctttacttgcctattttcccaaagaatttcttcaaaacttggggatcaagtctgttaagtgttgcttctttgtattttttaatggcaccattttcgtaa

SEQ ID NO: 13181 - DNA, 240 bp, Candida albicans
gcttttgtggaatgtgtcacaaaatttatattaaggcaatactttgcagcgagagttgcaaaagtttgttccgcaaagagagaaaaagtatactcggcaaatagagtacaactatttactaatctattagactttaaatcattcttggaagccaggtttttaaatggaaatgttaatttgataataattaagtcaaaaccatggtggtcatgcattacctgtcagtatccacaattttga

SEQ ID NO: 13182 - DNA, 192 bp, Candida albicans
ttttcttactcctttgtacatacagatacttttattacaaacaactatcaaaagctacgttctaaacatctacaaccacaaccacttgcacattcactattatctgtagtccaccattctctggcacatgccgtgtgcattatatgttcacacactgtgcataaagtgaagtttttagttactgccaattga

SEQ ID NO: 13183 - DNA, 213 bp, Candida albicans
aaaaaagaattaccaggtaagagattcacaatgccaagcacatcttccaaaagagaatcatgtgagatacaatatgcttacactgatgatggtgtaagatatattgctgttcgttacaaaagtggtaagactgacatccttacacaagctgagtatcgaagactttacccaattcaacgacagggcaccaaaaaaaaacacgacggtacttga

SEQ ID NO: 13184 - DNA, 279 bp, Candida albicans
gaaactaatcatgccctatcaatttctggtacttttatttttgctaatcaaaacatactccagggtttggtgaatattcaaagttatataacaactataatgtcagcaataagtggactatttaatggtaatagttttgttgttattggttgtggtacaaaagaaggtgaaaaatatgtaaccattcgtcttgaaaatggtcagattaaaacagtgaaagaatccgaagtcacgtatgatgaagtaacacagttaagcgactttttacagaatatttaa

SEQ ID NO: 13185 - DNA, 222 bp, Candida albicans
gagacatccactaaacatatcatttttgagaaaaacccactcatgtctaaaaatactccaaggggtaaaattgtcgatgttgtatcctatcatgttagaaatgatattggttacgtttcagttcgttacgaaaatggtgccattaaaaaatacaaagaagcaacacttaacagacttgatccccaagttttgaagaaattctttgggaaaataggcaagtaa

SEQ ID NO: 13186 - DNA, 192 bp, Candida albicans
attttaaacacgaattgtctaatgccaagaagctcatctaaagggaatatcgactctattagatccaattatactgagaatggaatagattacgttgttgttcgttatgaaagtggtgaaacggaacacatgaagctaattgatcttttattgtttcctcataataaaatagcaaaggttttgaagaaataa

SEQ ID NO: 13187 - DNA, 216 bp, Candida albicans
tataaattttgtgacacattccacaaaagcttatatgttaataaaaacccattacacctaattttacaatataaaagtagcccagtatatctcaaaataattttcaataattgtttacttgtatgtttgaatgtcaacagcaagtatacaactacactgaataatcaatattcaaacttttacttaaactattacaatgtcaagtggtacttataa

SEQ ID NO: 13188 - DNA, 207 bp, Candida albicans
ttcccaaaagtttctcttacagacttctttgtggctaatcaaattcaaattcaaatagaaatgccccatttacgtggaacctttgaaggtagacggtttgctgttgtcgctagagaacatagaaaaactggaatttatgtcctcatctgtttttcagatggtacttctacaactgtaccagaatcagcacttgtgtatgagaaataa

SEQ ID NO: 13189 - DNA, 255 bp, Candida albicans
acaaaatcaaattcaaattctacattcagtttgcctcccctcctaccatcttcaaacagaggaagaaatacaatcataatgtcaagaggagccttcgaaggtaaaaagtttcttgttattgatcgtcaacgtgtgaaaagattatggtatattacagtccaatttgaaactggtgaaattgacatattggatgaaaaggatgttgagtatgatgaagatgctccattaaaagccaaatccaaggcaaaaaaataa

SEQ ID NO: 13190 - DNA, 192 bp, Candida albicans
aaaaaacccctcgccattatgaatcttaatcaaaatttacaatcaaattctcgtatgtcatcgacatcaaatattccattattaaatacagttggatcccctgataataataataatactaataataataataagtttataaattgttcatattcacataatctcgctacagatataacatggtatctatga

SEQ ID NO: 13191 - DNA, 420 bp, Candida albicans
catggtatctatgactacgtaattcctcccatcatcaacaccaccaccaccaccaccaaaacaacaacaacaacaaccgaaagacaacaatgtttaattattgaaattggcaacatcaaattatatggtatatttactaatcaaattgatgataatgttaaacaaatcgtaatgattttcaataaagaattattactgtatattaatactgaaaatatcaaatttaatcgacttatggttgactttgttgatttgttaattgatgaatttgatattaccgatatgttatgcttaattgaaagactggaagagtcaagtaccttggctaggaaatttaatcaattgtttccttgtagtttggttcatgttgataaatatgttgatgaattccattggcttggattgttatgtaaaatataa

SEQ ID NO: 13192 - DNA, 192 bp, Candida albicans
cgatcttctaataaaagtttttgctgtagttcgaaatttttcaataaatttgcatcagataatgattgtgatgctgctaatgataataatgatgaactagtagaagttccagatgttgtaggtggtattggtgttgatgatgatgtcgaatctctggtagaatcagcttgtggtgctgaccccaaatgttga

SEQ ID NO: 13193 - DNA, 342 bp, Candida albicans
cacatttctcccggactagataggaaatttagaattgttacgagaattcccggttcccctcttttaatctcgctttctttatctaacacacacacacccaacaataataaccgttggcaggaaattttaaccaacaaatataacaactatctcggatactttatctatctgttcttctttcttttgatcttgattgatggtttaagcgagacgaggatcatcaataatagtaaagatattaaccccctccttttactaatccacccttctacccgtggtggtgatattattctaatatcttttttgaggttaaatcaaccgaaaaatgacacaactgtttaa

SEQ ID NO: 13194 - DNA, 195 bp, Candida albicans
ttgttatatttgttggttaaaatttcctgccaacggttattattgttgggtgtgtgtgtgttagataaagaaagcgagattaaaagaggggaaccgggaattctcgtaacaattctaaatttcctatctagtccgggagaaatgtgtcaaaaactttcaacctgtgggaagaagaggaggatgaaaagtggttga

SEQ ID NO: 13195 - DNA, 213 bp, Candida albicans
cggcatgttcccgcctggtgttattgtacacgactccaagaaaatctcaggattccaatatatttgccatgtgcaaaaaaaaaacgacgtgaaattatggataaattgactcccggaagtatttttccatcatcattggttgatttttttcggtctcaaaagcttgttaggaaattaaagcacgagagcaaattggccaatttacttggctag

SEQ ID NO: 13196 - DNA, 189 bp, Candida albicans
aactacactggaaactacattcaaaaacatcaaacgacaacttcttgcaggtataacaataaaagaaagaccaagtcgcttgcaatttatattcaaaaatacaaaaaaaagaaaagaattaatatattgcaccagatcttgaataatttacctattctttctttctttttttacccaccacaatattga

SEQ ID NO: 13197 - DNA, 219 bp, Candida albicans
tttattcaattcgccccaacctacgctttttggaaagttccatttcaacagagaggattatttattaaactcaaaaaccccttttcacaagaacaaaatattgattctattgtctccaacataaatatatgcaaactacacatactctataacttatgttttttgtattgttcggaggcaacttcttttaaagtctctaacacaacatcacttgcatag

SEQ ID NO: 13198 - DNA, 210 bp, Candida albicans
gtcatatttccggagtctggtttagtatctgttttttttttaatctactacgtgggggttagagttggacatcgcttcccgaaaaaggagataacgcgcgagaacaaacgccgtggcgagtcacaacagcaatataagctcgattatattctatataagaagcacttcttgcatgaattttcaatgttagctagttgccttctttattag

SEQ ID NO: 13199 - DNA, 186 bp, Candida albicans
aatagatttacagaattagtgaatacttttttgccaaaattttaccagctttcagatcttatagtgcttgaaactagtattaaaaataaacaaaaccacccatttattaatgtctacgaatatagaatactattaatacaaaaaaaaaatactacctgcttggtagattttcaagtggccaaataa

SEQ ID NO: 13200 - DNA, 228 bp, Candida albicans
atgctaaaatggcaaacctgtaaaccgtttgaaaagcaaattgagatagttagctcggtttttttttcacgtggccataatccaacaaaaaaaaggaatttaaggggggagagaaggaggcttgaatttgtaccacagagcgagcaagaaattaataatatacttggcttagctgaaatgagaatgaaaaagcaaatttcaagtgaaacaccactactagccaagtaa

SEQ ID NO: 13201 - DNA, 210 bp, Candida albicans
aatgacatcatgtcttctgtttcgcttgaaaactttaatttgaatctacagatttctcagtaccaggttaataccgccatcaacttagtaattgcttttggtgatacaaagaaatgtgatttaatttaccaaaacccctcagttcaattatctgctgtcatctactggtttgtgaccatctacaagcggggaatattgcgtattgtttaa

SEQ ID NO: 13202 - DNA, 183 bp, Candida albicans
cttggggacacgtcgctgatgagacatagaataaggaactgtattaaattatatggtctctggaatgtttgtcgagtaagctttgtgttgcagaaaatttggaaggataatcctgatggtagtaaagtagtcgattggcataatctattaaaagaattgggttgggatataaattttgcataa

SEQ ID NO: 13203 - DNA, 186 bp, Candida albicans
tctaattctggtgtaagcacccatcactttttactcatctgtcttgcccccccaccttcacttcataccaatttctactccacctcgccacaattagtccaaaaaattcagctttcttcaaatataatactgctatggaaagcaatcctttgcgagatgaaccaaaatgatatatataattggtag

SEQ ID NO: 13204 - DNA, 258 bp, Candida albicans
ggtgacacactggagccactaccatgcatcaagttatcagaatcacgaggcaccaataatccaaccaaggtcaatgatccaaggaaaagaacaattactctgaaatacaccaatttggaagcagctctaattgcagttttagggtgtttggtttcacttgcagataaactaatgaattcagatccacctaaactgaaagccccggaaacaaacactgaagccaaacctttaaaagaagtgaaggcacctgggctgtga

SEQ ID NO: 13205 - DNA, 234 bp, Candida albicans
gccaatcaaaacggagttcactttaatcttaactggcaaatttcagagattgtccacacaaaacctcttagaactactagttctagacatcgctacaagaacggtataaacttttgtggaactatttggttaaaaagacaaggacaaaaaaaagcagaatggaattgtaggtggagggaaaggaggcttgggtatgttgcttatttgattataaaagttggagagcctcattaa

SEQ ID NO: 13206 - DNA, 231 bp, Candida albicans
ttaactctaaatatatatcaaattttttctttcttagttattggttgtgaagaaaatactgtaagaataataaacatgatgcccgtctgtagtttgacatgtattatgctgttaaaatttgatcaaaaatgtattaatgtacaacaaaaatataaacataaaaaatataaaactcaactaatccttagacttcttcttctttttctttggagtttcttctccatcatctga

SEQ ID NO: 13207 - DNA, 363 bp, Candida albicans
cacagagaatacaatacaaaattcaaattgctagcaaaaataatcttattccaattgaatgatatttatatcttagaagtcttttgtttttttaaaataacacgtcaagagtttatcactggtaaacttattagtcacgaacgtgtcaagtatttaaagattttcaagataagtggcgaaaacaggaaaaaaaaaagaaagcaaagcaagaaaactaaaaacttaaatttttactatttagatctaaaaaaaacaaaaagtgagagtagagagacgttgaatgatgcctttttcgacgcaaaatcttcctgttatttgattgctgagtcattaaccaatgacagcgagaccaattgttcatga

SEQ ID NO: 13208 - DNA, 552 bp, Candida albicans
ctttattatacttctcttcaagaatatccagttttaatagccaacattaaattcacatccatgcccatacaaccattgcaatctagcactaagatgactctcctggtgaacaacactgccttaacgtatttgattcttaactccaatataaaacttactcagaatcatatatacaagatactaggattgtgttctgaaaatgcatttcacattgaaatctttaagctgctcatccaattaatcaactcagctgcaaattcaatattctgctccatcagagcccattcactatcacaatatcctttgacaaacatacagtacattagctatatgattgcagatgagtttccagaaatattctacgttcccattgcaaaaaaagttgaattcgaaattaacaatggtgtgtcagtgttagtggacaagtggtccactgaaacagtcaccttaactgttaaccggtcaaagtacaatgaaatgtggatcatcacatacttgttaaaaacagaatttgaaaaaataattcaacaaaaaaaaaagaagtttaaataa

SEQ ID NO: 13209 - DNA, 186 bp, Candida albicans
attacatcgatgttgcattctgataaaaaacaaattgaaaaaacaacccaatatacaaaacccaactttaatctatgtgaatcaatacttgctaaaaccgttaacaatcagcagttgtttataaaacatgaaatccatactaaggtcaacaacaaggaacctaataacaagctcaagaagatttga

SEQ ID NO: 13210 - DNA, 393 bp, Candida albicans
atattttttcttttttgttccactatacaaaaacacatagcatcaataactccttcgcttacaaaagacatcaacaaagaaatgataccgagatcattagtgattggacccatactacgatatcaggtcctcctggttacaagaatgataagtacaagatcgagccttggtgctaaatactctttcaaaaaggatctcaggtcatcaaatagaaattatattatagaggaacctaaacaatatcagaatccgaaggttctacatatttacaatgaagtggccacatatttatctggagatactgacaggatgcgtattaatatcaaaagtaaggttaaacaaaggaaattgttcttgttattgtcattagatgggggtcaaggaaaaaagtga

SEQ ID NO: 13211 - DNA, 1407 bp, Candida albicans
ttaagaaaattcccacagaatttgaacagagacttagtatgtgaaaaggtgatacaggcattgatgacatctaacatatctccaactgctcctattcttgacaggataatttcggaattgggtgttgaacaatctgtttattcatataaatatagaattgataaggcaatttcaaagaatgatcacgagctggctttgaagttgtataatgaaagtatcagcaatgttacacaatggcccgaatatacacatgacccatctgttgtacttacgttgaataacttaattcaatgcttggtcaacaatttgtctatgaaggaagcgttccctttgtttcaaaacgtcaaatcacagttgcaaaaggaaataaatattgatacaataaatgcgatagttccaaaaattctacaagaagatatgacgggagatataattgaattaatgaatcgagagttgcctaaaattcctaaggacctgccggttaagttgcccatcgagcagccttttgggtataaatattatcagttgtttgacaccatccatgaatactgtataacaaataccaaagataagcgtatggtaaataactggtatttatacacacattgctacaactatttttttattccacacgatcggatcttacccacaatgaaatttttttgtgaaaatgaaagatggaacggagctctcagaatttttaaaaaagtcattgaaatgtcacagttgcatggtgaacacaatcacaaacctcctacacgtgaaatgtatttatatttgattaatgagtttggggacaagttgtacgaagatggagtgattgaagttcatgaattattgaaaatggacttaaatctacccaagcaggataaggaattactgcatagtattatgagtgcttactgcaacttgcaagatgtcggtaaagtgcgagacatttttttgtcaatgagtttggaaccgaaggatgcgggtggagttgatgaaacaagcgcaacgataatgatcaaagcatatacatataatgacttgatctatgttcagaaattttgggataacctctcaatgtttggattggttccggattatcaaatgttcaagcaatacttgattgcttattcgtatcatgggtacattgaaaaatcaattgagatagtaaactcgattcaggattatgagttagaattgactagcgacttgctcatcagcatgcataatttctgctatcaaattgagggtcaagaaaagttgaaaagctgggctcagttaaatcatccagcaatttggcaacaagctgttgaatcaggaaaactaattgatgcttcgggatataaaccaaatgagaattttcttgttgatggatcaagtagtgatccaaaacatatatctgagccaatatttaaatag

SEQ ID NO: 13212 - DNA, 513 bp, Candida albicans
ttttgttcactttttctttttgttttgtttgcacacttttgcaaccagcatatccaagtcatgcaagtaatcaacgatacttctttattgtctgaaaaatatttaacagtcgtcagttatgatgatatgacaagcccaaattacatggcaaagttatcaaaattatcaaactctttgcacaagcaaggtttggatctccacaaggtatgcttgataatgagatttaaaatcaaattgaaaacaagtctacaaatagctggcgtcaattatcaagtgtatagcactatatcaaagctcaacggattgattctgctgctttatgagggactagatttggattgcgaaagctcaatcgacatcaaattcaatgattttggagattttggggattcaataaagagatgcatctcgattgaaaattttgatttctttatggaaaatgaattcttggtcagtcttgaaaatgactctgaccctgacacacgtttggtgtatgacaactttattgtttga

SEQ ID NO: 13213 - DNA, 204 bp, Candida albicans
gagaataaactaaatgtgaaaaatttaaatattttttcttttttgttccactatacaaaaacacatagcatcaataactccttcgcttacaaaagacatcaacaaagaaatgataccgagatcattagtgattggacccatactacgatatcaggtcctcctggttacaagaatgataagtacaagatcgagccttggtgctaa

SEQ ID NO: 13214 - DNA, 405 bp, Candida albicans
aaattaaaaatgcacttttcaaaaattattgctggttctgctttatcttccgttgctttagctgaatttcaaaatggaactgttactactcacgtaactgctactggctacactacttactgtccttatccaactactatcactttgactatttgtgaagaagaaaacatttgcacaaagagaccaattgttgttagtgaaccaaccacagtaaccgttacagagccatgtattatttctacttcctacgaaactaccgaagtcgttgtcactactactttaccaagcagtctttccccatctagtgttgctcctgccaatgtcacatcatttgaaggtgctgcttctaagaacgttgctggtgctttagttggtgtggttgctattgctgctgccatgatgtaa

SEQ ID NO: 13215 - DNA, 495 bp, Candida albicans
acaacctatttccttcttttattgtctttttcttcttctttttttataaatattcacattatatactttaaagcaaagtatatatacataattttttgtcaaaactcatggatcatgtcttatcactctgatgaccatagtcacaatcatagccatagtgtcaacaatgaacaaacagaaaccatctacaatcccaaggccaagttccctaaaacctcaagattctttaataactcgtccttgcctgatttgaaaacttttgaagttattaggcaaaacaaaaagatcttattcaatggtcaactgacaaatttcaattattcaccatttaatttgcctcagcaaaaactcaaagctagtatacctttggattatagaaatttgcctagcaagattttaacactgcctgctagcgactctgtttctttcgaaaaacgaagtcccatgtttctctttaacaccagagcagacaaaagaccccatagcattcattga

SEQ ID NO: 13216 - DNA, 303 bp, Candida albicans
caccgaaataataataaacaccaacaaatagttgatacgaaagatcaaaaaccaaaaagaaatataacagaaagaataagcaaagaattgaacaaactgaaatttaaggatatcaagactagcagtggaaggtataatttagcttacatcatggcagcagcaatagcaaccacaccaactaaagcaccagcaacgttcttagaagcagcaccttcaaatgatgtgacattggcaggagcaacactagatggggaaagactgcttggtaaagtagtagtgacaacgacttcggtagtttcgtag

SEQ ID NO: 13217 - DNA, 306 bp, Candida albicans
aagaaggaaataggttgttcagaaattgtcctctcaatgtgctttgagtacaatttttttttttcatatatttcatgtgtgggtgtgagagttgagagatatccagatatcagcactttatctagttatatatatttgttttgctttacatttatgacgcaaggatatacatctcattcagtcaaactggttaatccctcattattgattagttcctttaaagttcttgaaacaaaatacccaacaaagattactcaattgaagaatcaaaatcattttagacatatttctaaacttatttattaa

SEQ ID NO: 13218 - DNA, 366 bp, Candida albicans
atgattttttttgaaggatcacataacacacgcaccagagaaaaaaaaatgaaacgactaataagagtaaaaaaaatattcaatctagaagtaactaaaccatttcagtataaaccacactctatatccattaaatctttccttgatatcataaacatggccaataatcaacttccatttcacgttcgtgcaacagatgctgtgcatagattaactgttttaggtttggtgggaatatgtgttgttggaggtggttcaatagcttttaatatttgggccaattctgattatgctccatggaataaagaaaagttgaaattccaacaagaacaatatcacaatactaagaaagatgaagaagaataa

SEQ ID NO: 13219 - DNA, 375 bp, Candida albicans
tgggttgattattggttatcaaatttcaatataaagatattggtttgttatttgcaaccaacaactaacaaactattggttgtcttttgtgtttatatatatgcgggtgtgtgcctcagtaaaagttatttacgcgtttatgtgttcgtgtgtgtgtgtaaaagtaaacaagtcacgtttcattcatcctctattaatgttttgcgtcacgtttttttttgtcctgtgcgcggtttcttcaaattcatcacggacggaaaaaaagaagaagaggtaagaagaaaggaaaatcaaaacaatacttacgagatcttaacacttataccacctactcgtagttattcaccttttaatattaggggaaccaatttgtga

SEQ ID NO: 13220 - DNA, 195 bp, Candida albicans
caacaacaacaacattggtttgcactttgttcaaattatgatttcaatcttcttaaactgtcagaagaagaatctgaagctgtgaaagaagcattgactgtttcttcagatactacttgtgacacaatggttgatctgctaggtgaattagcagaaaagttcaataaatgtaacgctggcgactctccacgataa

SEQ ID NO: 13221 - DNA, 363 bp, Candida albicans
ttggaactagtgatagatggagttctttcgagaggagagaattcgaatatttccggtagtattgtttcatatgttggagttttgattaatggttctggtattggtgccgctaatgatgatggtgaagacgtcactattgacagcgctgttgacggaggaagttgtactcgtaagtccatttcagctactctatgtggttccctctttagaactgaaactaaaccaactgaaaataccactacaatacaagcatataaaataatggtattcacaaaactgtcttggttaataacaccttcatcaattgatgtatcgggagttggtaatgttaatggagtggcaatcttattactttctatttga

SEQ ID NO: 13222 - DNA, 222 bp, Candida albicans
cacaattctcttttttctttatctctttactgtctcaatctatatcagcctttttgttttgattatccacatcacagcgttgcattttttttttcatcacatctcaatcaaccaactatcatcccaaccactacaactattcataaaccaagtactgacttcgtcatgtcacaatcaccatcttctttatcacctgctaccgcgtcttctctcgggtgttaa

SEQ ID NO: 13223 - DNA, 891 bp, Candida albicans
tctgatcctagtgccttgagtgctacatcaagtacaactccatcacaaccaaccaatgtcgcaaatcatgccccacaaaattcagatatcgataggttgatagctagtataaacaatacgacaacacaaggctatcatacaatacaaaatagcttaatactgcgaagcacattaccaaatcatccaccaattttaagtgggcaagttacaacaggaaacattgtaaacccaagaatttgttcaatttgtcaagaagtacgagaatttgatgaaccatttttagcgacgcgattaccttgttgtcccaaatgtactttaaaagaagctttgttaaagaaacggggtaatacagtatttggttcaataaaactatatgctttaaaacaagtttacgaatggaaagactattcatctttccaattgaggactatgtttttggaacaagatgcgtatttatcccaatttactgtaagaccattcaattacgtatgtgaaatgattcgattacagggacatccaacgccatatcctgcgttccaaccccctccacttccaccatttttacaaagagatgcaagggtgtgtcaaaattgcaatactgtcatacttgatgctttcaatgaaatgaaacggtattcatgttgtgccagatgtcttatgaatgatgcactttcccgtggttatagtcttgcattgctgaatactgttaaaatcttagccctcaaacaagttcttgaaggtaacagtttagaagataatcaatttgttttgaaatttttgttcgataggtttttggaacaatacaaaggcaaaaagtttgattatgaaatagagttactaaagtataaaacaagagaagatgataattattatgaaattaagaacgagtga

SEQ ID NO: 13224 - DNA, 723 bp, Candida albicans
gtacacttatacttatcaaaatataatcttcactgccttaataaaatgtctatatcaatatcatatatacttgaaatgatacaattgagtatcctatttgtatttgaacaacttcgaagaataaccgttccaaatcccgaaaagtatactcctcaaatagaaagtaataagattgccactccattaacattaccaactcccgatacatcaattgatgaaggtgttattaaccaagacagttttgtgaataccattattttatatgcttgtattgtagtggtattttcagttggtttagtttcagttctaaagagggaaccacatagagtagctgaaatggacttacgagtacaacttcctccgtcaacagcgctgtcaatagtgacgtcttcaccatcatcattagcggcaccaataccagaaccattaatcaaaactccaacatatgaaacaatactaccggaaatattcgaattctctcctctcgaaagaactccatctatcactagttccaattattgtttaaattcaactatagatactactagagattttaaatatacttatcgtggagagtcgccagcgttacatttattgaacttttctgctaattcacctagcagatcaaccattgtgtcacaagtagtatctgaagaaacagtcaatgcttctttcacagcttcagattcttcttctgacagtttaagaagattgaaatcataa

SEQ ID NO: 13225 - DNA, 183 bp, Candida albicans
cggttattacaaaagtatagattcaacaaattaagacaagtaccaaacgataggccgaatgtgacttataccgttgaagttcaagcgtttttaacaaatagaaatgtgagattaatgagttcgacaaatgttttactagatactattaatttcgatgtactatataagtttaaccagctataa

SEQ ID NO: 13226 - DNA, 237 bp, Candida albicans
tctcatcttctaggtgtatactttcaatcacaggagagatctgataacgtattcttcccacatcatccattgtcaacaacctggccagttgaaaacaattttttttttttttttggtagttctcacattaatacacaaatctataaactatccgagatcaacgaatctgttgaaggtggcatgactggtgggaatgctaaattatctctatgtgccacatattcactatcagcataa

SEQ ID NO: 13227 - DNA, 225 bp, Candida albicans
ctgaaaaagattagtgctgctttgcacgaccagctcacttccaaaccatacccgccccaaaatggaaaaatatgcaggtcggacttaagaatccaattggataagttttggtgtaaacaggaagagtgtaaaactgcagtacttacttatatagggaaagagttattcacgttcatttctaaccgtgaaaccttgttcatagatgttgttaaactagttttttaa

SEQ ID NO: 13228 - DNA, 1002 bp, Candida albicans
ccaccatcatcagcgtttcaatcaaaaatttcacctacgcagagaaaaaaaaggaaagcaagttatcaacaacacctctcaacttcctccccctaccccccagatacacttatagatagattcatacatattcagttaatttttaatatggactttaaaagccgatatgaatcctcactaacccttacgaaattttttggttcattgcccttgctcgtggcgtttcccctagtgtttttatctcatagtctaagtacaacatcatttgaatttgcttatgaaaataccatactattgaatatatttttagcatcagcgtgtctttcaatagtaatactagctcatcgtttaaatgtcttaccaatcagcaatgctaccgccaccaccagcggatcaaacaagatgtctaccatgtatcttctttccacattctatgtcatctatacgtcagcatcgtttctaccggcaaatagagtggcagtattgtatttgggattgtttttgaactcttggaatttgtatactccattggcatttgttttagattgctataccaatttcaaggagttttatggactccacattgtattcacatatgcattggtaatacttggatattacttgttgtccagtaaattgaacctgtcatcgttgtctaatttattgtcttcgctcgataaaccaactgtttttggtacgtttattttcagtgcattagcacttgtattttacaatccatcaatgttcaattttagtatgattggggttaaccttgctacatttattgtgtttatgatatcagttcaagagtttcaaatgagagatagcagattgtcaagtgtatttgtttcattattgcttgaacttttgcaatatgttgtgttattacaacaaccatctttttctcaaataatcaatattgggcttgctgcagtagtgactcctgacaagtcgtatcattttgaacaagatgaggaaaagggaactgatctaggaacataa

SEQ ID NO: 13229 - DNA, 183 bp, Candida albicans
ctttgctggtcgaactgcttggtaatacgatgtgtgttagataattacaaaattacacgtgaggcaagcttgcattcctgtacagctagagcctatctcaaggggtttgctatagtggaacgatatacaattaggggggggggctgctttttttattatccgagatattgtcgtgatttgtaa

SEQ ID NO: 13230 - DNA, 273 bp, Candida albicans
tcttctttagtcttcgagatactcaacaataatgtcgatgcggttgattttattaaaggaacggcagacacaaaaatcaaagtggcaattataattgacgctataggatcaaatccatcccacgaaaagtattttgttaatattgtcgaaatcacaacaccgactgaacctaaggcatctgccattatgtgcaagaaaatacctttcatgttatcattcatatggtcgtgttcatcttctgagtcacagttaggagcatgcaggtgttcatga

SEQ ID NO: 13231 - DNA, 213 bp, Candida albicans
ggtggtgtaaaattactaactgcaactgattcgggtattgagttgatcgcacctgcgtactggtgctccactggtgaatgtggtgaggatgtagaaaatactgccggtgatgaattggaattcgatgccatggacgacgacctgcgggatgccacttcctctgcttgtggtgcttgctcttcttgcgttgacagacgatgggttccaatgtag

SEQ ID NO: 13232 - DNA, 192 bp, Candida albicans
gatgagaacaaaaaaagaaaaaatgagaaaaaaaaactaagcaatgctaaatgtagttggctgtacattcctattttggaagtctacctgttattcctgttacggagagctgactcattcttgtgtcataacaccaccgccaccggtgaggctgaaatttattcacctcgattaaatatacttttcttctga

SEQ ID NO: 13233 - DNA, 648 bp, Candida albicans
acacacagaatgaccaccccaacatccattttgtcaccctgtgactcgtgcttgacactttcagacaagtcccaacaatacaattcccaataccttatgaactatctatcttcgaggatccctgaagaagaaaccgaagtatcagaaatcacggtggtttacgatggtaatgccaatatcaacatcaaattatgctctgttgtgtgtttgatcaatatatatttacataagaagataactgttgaggatttaacagtgaaccatttgtttgtctatttattctaccaccagcataatttattcaataaagaaatatatatcgatcagctaaaactagttcacttgggaaagaaataccagttctcgacattgcacagcataccttcaccaagactaattcatgacttacagattgaacggtaccctacattattattgaacattaaagaagacaattacctaccatttaatctcgacgttgggtattatttgacctgtcagcaaacgtttgttgacaaatctacaggtgatgttacttgtctcgacaccttgataagaaaatggaaacgacttcagaatcataataacggaagcaatacatctaaacgaagagggcttaagaattttctaaaaagtattatggtttga

SEQ ID NO: 13234 - DNA, 348 bp, Candida albicans
atgataaagtatataatatcaaacaatataaataatatattaatacgtttgttgccacaattgtcagagcttacatatattaattctacttcgccggaggtactcctaaagattgaagggttagatcatagtttgatcaactacgaatttctgaataatctacagcaaatggtaggtgtcatcaaccgagacactatagttattgaaaatcttctgaaatacaatttggatgagttttcgttggtgcaattgtttaagaagttgggtgacataaagcagtgttatattgttgacaataggaaaattgggttcattgaattattgtgtgatgaggttgtcactgtttga

SEQ ID NO: 13235 - DNA, 198 bp, Candida albicans
gaattttctaaaaagtattatggtttgagagactaccatatacgatgtacttattatgtaacaattctacaattagttaaatactttgtaaaaatatatgaattactcgtacaattaaatgacatttatttgttatttgtgtgggtgtggtttccttttactaatacacccaatgtatatatatggggcgacaagtaa

SEQ ID NO: 13236 - DNA, 243 bp, Candida albicans
gtttccgtagttttaagcataagatttgttacccattttttttttcttgccgattgtggcacccctttgactaaaaaggacaagaaaaataataacacgacaatcaacaagaagcgaatgcaccagaaagcaagattgacttgtcttggcttgatctcaacggttggtgacgtacaagcacttaagatagaaagaggttggaccgaacgacaagcagatgtggaatatttccggagtttttaa

SEQ ID NO: 13237 - DNA, 237 bp, Candida albicans
tgtcataaaaaacgatggtcatatttttgccttatgttatctatgtggagcctacccggctatggtctttgcgaaaataaaaatgaagaatatggcaagtttacctatgtgaatgctacccggctatggtctttgcgaaaatttcaattaaaaccaaggaaaacatatggtctggaccctacccggcgatcgtctgtgggaaaatttgaacaaaaacaaataaaacatgacatctag

SEQ ID NO: 13238 - DNA, 201 bp, Candida albicans
accctacccggctatcctctttgcgaaaatttcaataaaacaggttttctagtggtttacagtttattttaccaaacaggtctgaaggaattccccatagaaagctcttttccttgttattatggtatagcaaagagattttcaagtgtctttaatctacacaatcatacactattattaacagagcaggttttaatttga

SEQ ID NO: 13239 - DNA, 204 bp, Candida albicans
tggctgactccagatttgatttctattctcacttcggggcatcacaaatgtcgtattagtcagatccgtcacgacatgatatcaccggagacattttcattgtatgtgcttatatattatcctcccacacaatttgtcatattagtaatatcacctcacattgtggattttgcttacatgggcggtcttagtgtaaactcttga

SEQ ID NO: 13240 - DNA, 195 bp, Candida albicans
  unsure (34),(40),(41),(49),(57),(62),(63),(64),(66),(67),(69),(70),(71),(72),(73),(74),(75),(76),(77),(78),(79),(80),(81),(82),(83),(84),(85),(86),(87),(88),(95),(102): Identity of nucleotide sequences at the above locations are unknown.
ctcaacgaatatttgtgctctattgaaaccatanagaaanntagaatcnggagcccnatttnnntnnannnnnnnnnnnnnnnnnnnncaaaaanattttgnagattacccggatatttcccagatttgttgactaagaaatcccaaaaaatgtattttgctgtaactcaatcaacattcattgggggggggtaa

SEQ ID NO: 13241 - DNA, 222 bp, Candida albicans
attatcaacaaaattggcaaccaactattttttttctttgtttgtgatttaaattctactatacatactgttacaaatgccgtttctatatatcttataatgattaaaaaagatataataagttacaagttgttcgttatatacaatatcaatgaagtagaagataatgccaaagacagagatttcattatcaatccacaaagaatgttcaatcctcgatga

SEQ ID NO: 13242 - DNA, 234 bp, Candida albicans
aaaggggaaataagaaaagaagaagaagtaattaaagaaggaaaaagtttttcaattcaatgtaatgaaatgcattgtgggaggaatattaacctgtttagtcataagttaagtatggctgcgaagcttcttgaaaaaaaaaaaaaaaaaatcactcacaaaacaaaaaaagaaataaaaaaaagcccgcatttctctcttgacacccgttgctccggtacaggagagaattag

SEQ ID NO: 13243 - DNA, 183 bp, Candida albicans
atagttacattcttaagcctgaaacatccaaccattcaaaagctgctggaatttgttgttgttgctaaaaaagggtttcaaaataggaaaagtctttctttatttggcaatctacagatcgctcccgaaacaactgaggaagttctttatttgaccacagttgctaatgttacaataacttga

SEQ ID NO: 13244 - DNA, 216 bp, Candida albicans
aataatgtttataatagtagtacatcatttaaatataaacagtttactatagaaggattacaaatcagtatatcatttgcaatcaattttcgaatagaaacgcagtatcttttttttttgtctactgcaacttacaagattagggctatcacgtgcaataaagtagggctattatatacaggttgtgaaagtataaatattactgcacacatttag

SEQ ID NO: 13245 - DNA, 198 bp, Candida albicans
gggtataaatatctgacttatttggatatgctgatttatttcggtagtattcaaccacgtaagtcagcaacaaagtattcacaagaatcgattcaaaatattatggaaaaatcaatctacttgagtatatctggaataatgactgtttacaagaatttcaagtttccttcttattaccattatttgtgtctgtactag

SEQ ID NO: 13246 - DNA, 315 bp, Candida albicans
tggtatgatttttatttattttcattttttggtgtagttgcgaagtttacgtgttacttcgttctgcagccacaaggtgatggtatgaaaatttataatccaccaccacgcaaaaaaactgaatctcgttccgtggccgcaaataaaaagcataaaatgaacattcctgcatatacgctggcttcaatagaacgaaagagaaaaataaaattagaggcacgatttatattagaaaaatcttcggtcattcattcatccatcattatcactcataatcgaacaaatttattacagcgattattaatcgacaattga

SEQ ID NO: 13247 - DNA, 207 bp, Candida albicans
ccaacggaaaagtcggttccaccactctttgggagatcacttgacgttgctaaatgtatttcagctgtggtgccgcaacaactacagcaaaacatggtgtcgggacaatttcatacaggaaagaagtatgcgtcgagctatggaggtaagaaaacagttaaagctgattatgcagcggtttggatacaagaccatgtcgtgtggtaa

SEQ ID NO: 13248 - DNA, 336 bp, Candida albicans
tcgcctttgattgtaaaagtttattttcttagtatccaactaatgcagtctgcacgatacgctagcgaacttattcaagaccgaataagcttatacctgagtgcatcctcagtgtctatatctggggtaagaccactcaagagaaggtattcccctcaacagtcgattcaaccaactgacactacatctacgtctatattagaatgcacacccttggaatcaaatatgaaaggtgatcttgttgacaaaaaaacaggaaggaaagtcacactcaagggaataaatgtcgattccacaaatgaaattacctgccactccctatatgccgagctatga

SEQ ID NO: 13249 - DNA, 282 bp, Candida albicans
atttccccattttcaccccaactagaaccaacttttagctcagaatttttgcaaactcgagcccaaaattttcctctcctcggaaataacttattcccgaaaatggcaaaaaatgtcgtcgcctcaaaaaagatggcaaaaaatccccatacaaaattaaagatggcaaaaaaaagtcgcacccccaaaaaaagatggcaaaaatatgtcgcaccaccaaaaaaaagtcgcatagttaaaaaaaagatggcaaaaaaatgtcgtaaaatcggccaaaactga

SEQ ID NO: 13250 - DNA, 198 bp, Candida albicans
ccacggatgtctaacttcaagcgagcacccgagcaaagcgagagtcacacaaacaagtttagatttagcagtaattttctagccaatacaggccacacacctcgagtgagcaacacttttccaactgccgcaccacaaccgtacggatgctcacctttttttttttttttctttttggggtgcttgcaccccctttag

SEQ ID NO: 13251 - DNA, 237 bp, Candida albicans
tgtctatcgtgtagtaggagtaattctcacgaatattccggagagaagggcaactacatctacaaggaccgcaatggcatcaaccagctagaattgtataaattggactggaacaaggagtatcttgttgggtttgagtggttgcccgatatcgatgatgagggggggtatgcgagtggaagtggagtgttattggggggatatggtgccagcctaccaggaggtggtgcattatag

SEQ ID NO: 13252 - DNA, 1968 bp, Candida albicans
tcaactatgagcgaccacgaaagtgacaactacgatagcgagccagatatttttgaaattattgtcagcgactctgaggacgatctggatatggaggatcttttcagtgcaccagcaacagggactcagaacaccactatggatgaggagtgccaagtcgaggaaggggtttcgagaagacgaactgttgaaggacaccatgttagtgaagacaatgaggactacttgcagagaacctatggtgtcaagagcacgcagtactgttttcggcttgggaagaagcacatttactgtcgaaactttattattgaagagcggtcaagtggcaatgttgtcatcaacccgaccgcgaggttttacaagcgggcgtcgaggaaagtgaagcaggatcttgagagtgttccggttcaccagtttacgccggacgagaaggagattcgggttgacgatgcagatctctacgagatggttgagtcaaaggaggagactgttcggggcatgcactgtgttagtactcaggcgtgtgttggtatcaagaaacatgtcaagttgtacatgccgcgggaagttgttgaagggtcgaatttcgacatgaaggttcgtgacgaagggtatgcccaggttacgagatctactgcagttttggaccagtttttcagtgtctatgagtttgacgacaagatgagcgagccagacagcactgcagggtacattgatgctggccgcaagatatacaaggcggtttacgatgatgttattgcgcagcacgatcttgcgaattttcttggtagtagtctcacgtatcattttcggaacgagcggtttgtcagggttttagcgccagagacggtcaagcagtatggcacgtgttttgggaggatgctatcgttgattatggcgagcaaggattttgatttgtgcgagagagttgacaccagcattgcgaatgagctcagcggtgcggcgtgggagcagatgatcaacccgttgttggaatggattgtttcgcagacggcggactcggacacgttgtgcacgatgttggttaggccgtatttgtataacttcaagacgaaggcatggcagtctgttgcgtggtgcttaaagtacattgatgcattgaagctgatgtttaagatggcgatgttcttgaagagccgggatgagttttctagtttttgctcgcagccgcaagagtatgggtgctacttttaccttcagacgatatacgcgcggttggtacagcaacggagggaggttgttgagatggaggtgtcggggattgacaagcgcacggtgtttgttcgcgagatcaaggtgacgacggactacatcagcaagttgtatcacgatggggtcaagttgtatatgctggagtatggcagtttgtgccgagttatggggcttgagtctagtattgacaggccgtataatgattttgttgcgcatgccaagtttgatcaccagtcgtacgggttgacgatgaatatggagaacaatgcgtacttgaagtatgatgtggcgagacacgcgagccggaagcacgcgattgtcgatttgatagacagcatgacgcggatattgtatgttttgatctttacggcgtcggcaaacacgtttagggctactgagttgagtgaggttaatgttgctgcgaacgaggttttgaaccggaacttgatataccggcacggggcggtcgagatagtaacgagctacggtaagaacaggaaattcaccgcgagggagcggttctacccgcttcagttgcagaagcttatagttaatcactcgttgtctatgaagccgctcttgctcagggcgatgacggagattggggagatggatgctatacatgttaattttcaccggtaccagttgtttgcgttgtcgagcaacaagctcgttgagcgtgggcactactacagcacgaaccgtacgtttatgaagagaaccgtgacgactttc

SEQ ID NO: 13253 - DNA, 219 bp, Candida albicans
tgggtaagttatttgactgttttggaggcagttgattgtgtagttgtgaaaatcggggtgccggtgggagacccgtgggtgatcggtgagccagggacacgtcaacaaaaaaagatggcagaaaaaaaaatggcagaaaaaaacaaactattttacaccagtttttttcttcaacaaccaggcaatcaacaatcaatcaacaatcagtcagatatttaa

SEQ ID NO: 13254 - DNA, 201 bp, Candida albicans; identical to SEQ ID NO: 13045

SEQ ID NO: 13255 - DNA, 198 bp, Candida albicans
caatggagatcaagttcaaactcaagggaaagttactacaatgaaacgaagaacaaggaaatcagtattaaaaagttgtttgggtacagtcaaagacaattggaaaacttgacttgtgtggcatgtcaagaaatatggagatcaaatgctgcgtctattcatgattggaactacctagcaagtgatagcaggacatag

SEQ ID NO: 13256 - DNA, 195 bp, Candida albicans
tgtttgcatccgagagttttgatttattcagtgttgttttcattggttgagggcaaaaaattcgcatcgagcagaaaaggtcgtgcccggggcatagtggacagacaacgattactgatgaaccacatgtgctacaaagaccaaactagggccgttttgaagctacaattatgtagagtattgggtgtgaattag

SEQ ID NO: 13257 - DNA, 192 bp, Candida albicans
cgctacaaaaatcaaactagtgccgatttatacctttttcttatgagtgctaaccatgcaagaactgttagaaacgaaatacaactgttatctgtggaacaaaaaaggccgttttggccatacttaagggagccgcagctatgtctgatcacaactacgcgaccaaattcaacgctacaaaaatcaaactag

SEQ ID NO: 13258 - DNA, 195 bp, Candida albicans; identical to SEQ ID NO: 9204

SEQ ID NO: 13259 - DNA, 462 bp, Candida albicans
acaattgttggattatttgggatttgttttgtattatttgtggtgtttgaaatggttgtatcttatagtgtactaataagattgattaaattgtgtaagaaaatagttgtaaaagaaaatagatttaatagaaaacgcagtgctagaaaagtactaaaaaatttactaagaaaaataattttgtatggcaataattatttccgcacccttcggaaattacacaaactaatctccgtttccctaacaaatttactatgtatttttgggctcgggtacacgacccttaactccgtctccgtgtcacgtgacttttcccatacaaaatcctgcacaatcccgccacaagtactcttatctccgcattctcgggaatacctcagacaaagagaagatactaccacactcattttccctcccctgcacgccccagcctcacactttcttgcctcatccccgatctaa

SEQ ID NO: 13260 - DNA, 192 bp, Candida albicans
atcaaatattccgccgaaacaaaactggcaaccactagccgctatcacaatatattgaaactaatggcgttaatgggattgataatacattttcaaaaggatcttaattcgaataaacaattgttggattatttgggatttgttttgtattatttgtggtgtttgaaatggttgtatcttatagtgtactaa

SEQ ID NO: 13261 - DNA, 240 bp, Candida albicans
ttggagatgctacaacaaaaaaggccgtttttttatcccttttttcctaacaaattttcgacgaaaaacaccaagatgccttgccacctaaatccgttggacagaaaaacatcaattttgatgccagcaagctcattcaaagatcaatttgaagctacatgtttggggaagaaaccactagattttgaaaacaatcgatggtatatttggaagtccaatagggttaaggtggaatattaa

SEQ ID NO: 13262 - DNA, 504 bp, Candida albicans
tatttctctacactcgcgagcaagcgagtacataaaaagtcttgttgtgatgaaaaaaaagaacaccgtacagtttcctctttaacaaggatgaacgacctgatatacgaaacggtggatgccaacttatacgtttatactattcaattgctaacgtcaaataataatgtccacaacattaatgcatattttcgattgttatcagcaaaagtgttgtcgtcaaactttgattgcttaaagataacaacaagagcaaacatattgaaaacactattgatctactcatacccgttaaatataccactacaggatataataaaactagcaaaattgataatttactctacacagagtgaaattgaatccaccgatgaagatggttttgaccttgaagagttttccctaagcttgaagtcagacatagcaaatactgtttcattaaaggcaacagcaaacgagttattagtcgacactaatataaaatgtcaatcactaggtatatag

SEQ ID NO: 13263 - DNA, 198 bp, Candida albicans
atttggtgttgtagctttgattctgttcgtgcaactaatattgttgaacagtttttctcatataatctttcggctaagttaactcctattccctgggatgcacccacaattaatgctgttttcccttcaacgggaaagttagttttagaaaaccacattagcgaaggggttctttgttgtattatgaaagttcgttaa

SEQ ID NO: 13264 - DNA, 192 bp, Candida albicans
aaacaaaattatgaaaggaaaaaaaagataaacccaaacattgtatattactcattctgtaaaactttgaatagagattcaaacattgataaaactaaaatgctcaagattatggaatttaatatattgctgagaaacgttattacgcactttctttctcccgtgcctgagaaaaaatgtgttcatgagtga

SEQ ID NO: 13265 - DNA, 195 bp, Candida albicans
aaaaaaaaaaatcacaagcgaaacaagtcaaaaaaaaaggagacacaaacagaccaagttgttacaacttctactactgatggtctactgatggtctactggaaatataatatggtaacagtacacacacacacacaatcacacaaaattagcactactaaatgtttgagaatgattcgaatcaagggaaactaa

SEQ ID NO: 13266 - DNA, 204 bp, Candida albicans
tcggggctagagtgtggtttgggtttagcaagcagctattgtttgaaaaaaattaaaatgactgcattaactattacaagtttaacttttttctttttggtgtcatctgtatttgtatttattgcatgggaaagacaatacagtagtaataacgaaactatcaaccacgaaaagaggaaatatccctcaactttccaaatttaa

SEQ ID NO: 13267 - DNA, 186 bp, Candida albicans
aagaagaaacaacaaaagacaaggcgagaggagaggagagagaaacataatttgaattgttattctttaacaatgagttcaattttgattcatgcatattttgttaaatgcagaagaaacacccccaaagggataaggaaaatggtaatagcattaactaattcaattcagttttgtatttcttga

SEQ ID NO: 13268 - DNA, 252 bp, Candida albicans
atcaggagtgtgttggtttgtgtgtgtgtgtgtgtgattgtgaatgtgaatgtgtgtatatgtgtgtatgtttatgatctggttatatttgatttatcaggtagtcccatttgtttggttgttgttaattctttgattcatgttttaatgctatttttttattttttattttctttttgttgggttattcaattattatcattcattttggtgtcttcttttgttgtcttgttatatattcatactagttga

SEQ ID NO: 13269 - DNA, 288 bp, Candida albicans
acaacagcagcagcaatagtctttgatccaattattaatcaatcaattgaaacagacaaacaaacaagcaatattagggggaaattgttcacattatcaagagacaatactcagcaaagaagtttgacattatcctgcatatccagtaacaataatgaaacaaagtttttagcttgtgtaaagttatattcgattaaaaaaaaaaaaatcacaagcgaaacaagtcaaaaaaaaaggagacacaaacagaccaagttgttacaacttctactactgatggtctactga

SEQ ID NO: 13270 - DNA, 342 bp, Candida albicans
ggcgataagactatggacgcacctttgaaggaagaagaaaaaaaggcactggcttatcttgtaattgtggtggtagttatacaaatgtcgtcattgacctgtcgtcctctcctctcgtctcctatttctattcattctttaattattatttctttatcggtgatcaaaatccaacaaaaagatgaaattttgaaaaaccatacttttaaaaaaaaagaggaagatcaaaacactatttctttccttaggttgttaagtgttcaaaaagatcattcttataatacaagtcaactatataaagagggtaatcacttcatcattcatcttataatccaattctaa

SEQ ID NO: 13271 - DNA, 219 bp, Candida albicans
gctggaacgtctctgaacaataagatgtatttgttagtaaattattcatcaaatatcattagatatattgcaaaagatagtggtaagttgataatgaaagaactattctacaagactactgtaatacgtggctgcttatggaatgggtacattagtgttcaaaaaacaatttccttttttctcaataaaacaagatatcattatgcttatttaatgtaa

SEQ ID NO: 13272 - DNA, 189 bp, Candida albicans
tttactctcaaatctattacattattaatattcttagtatcattaaacatcaaaagtatgaatatattggatttattatctatatacacattattttggtcaactaattcttatttaagtaaatcagccactgaaattttattaattacagcattagcaccagaagcagttgttgcaacaggaccataa

SEQ ID NO: 13273 - DNA, 222 bp, Candida albicans
ttgttttgccttgttttgtgtggacaagaaaaatccattattctaccgagttttattccgaacttaattaattttcatctttatttttcttttaatgattacaaactacaaaacacctcagatatcaggagaggaggcataaattggctattcgggtatttcttggtgtataaggctacacaaattcgccctgtaagtttaatcagaccaggatccgtataa

SEQ ID NO: 13274 - DNA, 195 bp, Candida albicans
atctcccaaaagtttcaaatcaatcttgaattttccaaaatctattttcaatttattaatcattatataatttgtgaatattatggttatttatcagttatcgatagagtcagtaatatttatgtagtgaaagttgattgtcgtatcaatgtgggtattatgggaaaaaggttaagattgggttttctcttgtga

SEQ ID NO: 13275 - DNA, 1092 bp, Candida albicans
tatttcaatcatctgcgtgtttattgttgtggcagtttaaatacacatatattactgtatccttttcctgttgagtttgtttcgggttttataaatttcttgtcagtttgtatatcatttccaagaaatcactttcagtacattttcgtcatggcaagtggtgagagaaaccttcattcttttgggtattcacccaacaacgttgataatagtgctacccataaatttcacaatatactagaacaatctgacttttccaaatattatagttttcagtatatattgtcagagaagaatttacttgatactgttaacactagtataataccgcagaatttgcctaatgaatttgaaattattgcccacttaaaattaataaaagtattgggtattttaaaagtcaaagtgttagctggagtagctagctatgcatcagcttctagatggaaacaatatgtcaccaacgctgtaagaagattcatggtatttttagtctctctcaaaaaatttatggatattgatctaggttattctttgaaatcatcatacaaccagactcatgagcaaagtcattttcaattcgcgtcaatgatgacacaattaatgccacctttggacgtgattatggtttggtattcctttttgtcacatccaaaatcattttacactgttttaactggttgtgatatggaagaatttgcaaatctacccttaccattgcatttaattaatcaattcattgataataccacatttgaatttaatgtgccgcatgaatacaaacacaactatcttcaaataatagcatgcacaaccatagatacgttggattcacaatatgatgttgatagatttgggtttgaagcaaaatgtgtcacaatcacttgtcctaattgtaaacacgttatatcagaaccaataaaattgcaaaacgaaatggaaactggattctttgataaaaagtttgcaacaaaaaatatctacttcggtgaacaatcactttgttactgttccaaaatcgaggttcttactcatgacgaattgagaaaacaacactatttgcagatgcatcaaaagaaaaatcaccgctaa

SEQ ID NO: 13276 - DNA, 258 bp, Candida albicans
aattcccagattttttcttgtcttccactgtcacgtcaaagcttaaaaccaacaaacaaatctacaaccttagacatttcgtctcccctcctctctagtttctcaaataatttgacaattcaaccagaaaacaaccaaacaatagttatagttcgtactttgtttttgccttggccatttcacaggtcatgtgcaattttctttggtacttacgaaaaccatgaaaagagattcctaaataaagggttggtgacgtaa

SEQ ID NO: 13277 - DNA, 492 bp, Candida albicans
tacatgctgaaacaatatcaatgtaatggtatcacaactaaaggggttaggtgtagaataaagtgccaactgccaaattcttactgtcgacaccacgagaggcaatcgtatacccatcacagcaataaccataaacctcaatcaaatgacactggctatatctacatgtataccatgaccaactttctattcccaccaaaaaattggagtttcaaagtaaagaatttgcctgacgcgtctaagaaaactgattgggtgaatttcaacagcaggaaatcacattacattcttatcaagattggacggaccaccaaaacaccagaatcacgtatacagcaatggcaagaaaagtgtcaacacccattgaccaatatggggccgcccaacaaacacttgataagaaaacgccgtgggttagttgaacgattggcgtgcatgagtattgatgatccagtgtattcttcgttggaaaaacggtgggttctattgtag

SEQ ID NO: 13278 - DNA, 318 bp, Candida albicans
ccaaagtggaaatttcacctggaactgggtctaattgttgcaatgttgacaatacaaaaacagcagttttacccaaaccagacttggcctgacacaaaacatcagttcccaaaatggattgaggaatacaaacttgttggactagaattcaaaaatgttagtaatcagcgttcaagtgaaagagcaaagcgccctcctttagtctattcacattacataccttcagaaggatgttcaaaaccacaatccccaattgctctcaacaattctggtttcaataaaaagtctctgaaaccagtggcatggataccaacataa

SEQ ID NO: 13279 - DNA, 651 bp, Candida albicans
ttcttcttgaccttcgtgagacatgattgtttgtgtgtttgtatgataaacagtgttaatggttgttgctgttgttttaatcttgctggtcgcctttcatatttttttttcagatgttggcaaaaatggactgaaaaaaaaatcgaaaaaaaagttgaaagctgcggtcgtgtctcatgtccaaatcaagcgttattggaattttggcttatattacatgaaaattctgagaagtttctccattcacctttttcttacaagtaccgaaatatgtttagaattgttgccagagcccctaggatactcccatatcgtcgatttaccactacccctagcttgaggttttttgacaaagggcctactgctgaagaacaggcccaggcattggaaaaggtcagtaaagtggttgccgaaaacccagagttgtacaagttgatggttgaatttaaacagttacttgaaaagaaaggatttgaaaccggggcaaaaccatctatgactcaaatgtttaaattgttggccgacaaagatatcagagaacatggtgccaaattcaaacactttttggaaactacagacacaggactcactcaaaatgagatcgcaactgtaagtggtgcatttttattcaaaaataaagatattaaatag

SEQ ID NO: 13280 - DNA, 201 bp, Candida albicans
  unsure (114): Identity of nucleotide sequences at the above locations are unknown.
tttgaaggcaacagagtttccacaacgacctacaaaacgagccaaaaagaatatcataaagaaaaaagcagcccaatcaaaactatgttcagaatgcgtttgccctatggaagngaagctgatacacggcaaactagtacttcggaaaaactctccactttaaaggaattgattgaagaaaccaaaatgaatcttgtatga

SEQ ID NO: 13281 - DNA, 375 bp, Candida albicans
tccatcaaattcaccaccggggttgggttttgtttctttaacttcctttgtttctttcttgaatccaaaccaagaagaagaatcttgcttttctactggtttctcttgacgtacgatttttgcaaaatgacgacaatatctgtttttagggacaaccttataggtttccatcttaaacgcagtattgagacctggatgggtagttggacaatgtctattaataaatatatgttagtaaatgataagcaaaaaaaaaaaacatgtacagtaatcattttgggtgaagcaaatctaatgcaatcacactcatttcaataccacacagttaagaaaggattgaataaaataacatacaagcctgttagaagttgttag

SEQ ID NO: 13282 - DNA, 216 bp, Candida albicans
agtttatttgtgtctttatataaaaaaaaaatcaacaaagtagatatatttatatttgaagagacaatgagaattcgttgtgaaagaagacagctagtccttctcaaagcgaatggcaaaaataagcacaacatgaaaaaatatgcaaaaaaaaaaaaacaaatgttacccagtttgtttcttttttatcaacatctattcatttttgttaaataa

SEQ ID NO: 13283 - DNA, 201 bp, Candida albicans
tcattaacagatttttccccaaactctaaccattcgtcaatggcaaaattcaccgcttcgttgaaattaaacccacaattgaaacctgcgtggtacactagaggatatgttatcacaaactcattagggttttggtctgcgtatacacagggtatgccatgttccaccaacttcagcggcgacatcaatgttaccaactga

SEQ ID NO: 13284 - DNA, 276 bp, Candida albicans
cagagcaatagattacactttgtttcgtttttcttattgacatatcttgcagaatacatggatacttcaaaacaaaccaataaaacctcaatgaatcctctacctacttcctttacaacttccgagcctattaactaccaagagcaaaatcgaagacaattaattatgaactcaatggagaatatggattatcttttaatgattgcctcccaacaaaacaagtctgttgaacaagtgaaatacgaattaaaactaaaactcatatacgggggataa

SEQ ID NO: 13285 - DNA, 723 bp, Candida albicans
caaagtactggtccaaaaatgccatttcagaacgatgattgtaattctgaaattaaggtgtatgttgtggcagttatgcattggttatctgaatttcccaattccccaataacaccagaatgttcattagaagaattcattcaacctactaaattatttgagatatttcaactcttattttcaaaagaagaatcgagcggttatttgacaaattgttttattgcaaacaaagatattcaaagtgacatagaatcgatatatatttctcaaatcactttgaaacaaattgaaattttaactgatattttggatcgtcatttgcgatctcgaataacgttaaatacctttccgtatctaaatctttacaagcttataatgttcaatgactacgctgagttgaaaaaattgtgtcaaattttattcagaattggcacttttacatcaattttgtcagcaaatggacttgcatattttgaatttttgactgataacgacaaacaggtaatcaaccaattcaaagaaccgttgatcaaaacaaagaaaaacaaatatccagggttacgagaaaaatcaatgcctccagcagatacaaactctgactacgactcagctgaccccaagagtgaaagttgctatttaatgcaagaagaagagctagaggctttgaattgggaaatatctatatttgaaaatttagtttataagttagctaaagaaatgtaa

SEQ ID NO: 13286 - DNA, 519 bp, Candida albicans
tcatttaaaattgaaattgattttgtattggcaacaaatattaacatttcatttaagccaccaaaaaagaaaacagaaaatacaagtaccattctcaagttgaaaagatatacatctacttttatattaacgattgaaccatcacactcattagaggatatcaaatatcaattgtgtaacattatcaacaactcgggaggattacctgcaattcaagacctggagatgaagaacgaagatgaagaagatattgcagtcccaaaatcagaatacatcgataatgtggatgaaatcaaggaagaagtacaagatgagtcggccataactaaggtactggtagatgatatacgagtggcctatccaaaagattcaactcagccttattccaataactggattgaattgagtgaagatagtgatattgctgaattaagtttaaaggatttcgatatattggcttttgcatatggttcggaagaacaaattgaaattgttgaaccagcttatgaagaaaactaa

SEQ ID NO: 13287 - DNA, 213 bp, Candida albicans
aagattctgatgcttagatttttcagaaatcgcaatcttcaatcgcgtcatatcccaatttattctacctcaaaatataacagacagcatggtatgtatagacagactaatcatttaaaattgaaattgattttgtattggcaacaaatattaacatttcatttaagccaccaaaaaagaaaacagaaaatacaagtaccattctcaagttga

SEQ ID NO: 13288 - DNA, 816 bp, Candida albicans
gtggtgttcttaaataacgttttcaaatacaaacaaaagcaaaagattccaatgtcctgtttactaaattgtaatatagttttgcttcgcacaacatttgacaatgcatggaaagctgccaaagttatacgagacgccgagaatgaaataataacatcgtcttgcaaaatttcaaaaaagcttctgctacttcggatattgtcaattggaaaatcctttgaactcttggataatcccaacatttttcttgaagcatttaatgattgcattgaaaatttggtagatatgggacttgttttcactatgatgttcgattcgagtgtggttttaaagctactattaatagaaagtttgctcacttatagctggtcacattaccgtttttatgactttgatgccaaaagcaatcttgtgaaattacaattcagtaactggaatttacctcaccctattgtgcaaacaagaaataccattttcaagatcttatgtaatttgcaattgggacttgacacaatctttgcggaatccaaagagatggaaaacgacaatgaactcaagttgggattagttatacgggaatcgataaaccacagtgtgtgcaatgattacattggatatgttcctatgattgcccaagcaatagatatttccaacatcgatagaaacaaattctttttctatgagattttgaaactcttgatagtgaaacatggcaactgttgcatgaaagagtatatacaagaatcaaacattgaattgaaaactttggtacaatatggactttcagatgatcaacacttggtgatacaagattag

SEQ ID NO: 13289 - DNA, 897 bp, Candida albicans
atttttccttctctccttcatagatccattcgtattaatgagtcgtataaactttttagcgttgttgttaatattgaaaagatattccaatacttaaatatgatagagcctcaggatctacaaaggaaagttaacctattcaaacggtctcctcaaaaaccaatttacaaacaaaatctcttgatggatcatgaagagcctcaatatattatcgacaattataaaaactcatatttgaaaataggtggaaatggagatggtctagataattctggcaacactaatatcatgccgttagccgccaatgctaaatctatccctatgagaactgataccgacggtttaattcttgcaaatgccttctatatatttatgacgataattgttttgctaatcctcttgagtgctatttcgtttggaataagagaatattcttttgcattcagaagaagaatcaaatcatcaacaagtgaggctttgaagttaaacaattggaacaacaccaacaaaaaagcaaacaggccactgccattatgcaacaaaatagacaaagctcaagttagagaagcaaccaatactgaaacaaataatcagcatgaaactccaatgtcaagtaaaaacaatgcaatctctggtatgacacagttcacggataaagagccaaaaattgaaaacgcacaacagtggtgctacaaagaagatacatcaccaaactataatgtgccatcgtctcacactgaatcagaaaaggtatactacgaaaatgagtatgacagtggtctcactgccaaatcgataaccaagttcactaagaaacaaacaattccatctttagtcacaattcaaccaaaatcgatttacagcatagacagtttaatgcccttgaacaaaacttaa

SEQ ID NO: 13290 - DNA, 186 bp, Candida albicans
tttctcacaatcagatttggagtttttcttggattgaggtttgctacagtagtgcacaatattcaaatcttacccgattcagcaaaaacaaaacaacaacaacagtacgcttccattcagcgatttcaaagaagaaaaaagaaatcaaaacaaaacaaaaacaaagtgaaacaacataaattttga

SEQ ID NO: 13291 - DNA, 276 bp, Candida albicans
ctcagtgacacccaaaaacaaaggataattcgggattggagagttttgagatcaatatcaaccaacaatgtatatagtcagcaatcaattcatattatcaagacaacaacaacaaaaacagtcaatgaaacattatcatgtccaccaggtacatcccccacgaatgttttgcgcgtgtctaaagccagatccaaaaataggatcgattctggaaactcacagacatcaagagcacactctggtggtgtgagaaagttaagtggaaagaaacattag

SEQ ID NO: 13292 - DNA, 234 bp, Candida albicans
ttgtacatgtatgttaagttcatttcttttgataacctgtttttatttgttatttgttattctttcttttttgcttcaccttcattaaatcaatgtatactaaaagtatgtaaaactatagacttgtttcgtatttatactttttctaaattagttttcttcataagctggttcaacaatttcaatttgttcttccgaaccatatgcaaaagccaatatatcgaaatcctttaa

SEQ ID NO: 13293 - DNA, 1026 bp, Candida albicans
tcacttcatttcttccattgccttattccaatgaatcaccctcggcatagagacagtatgagggttttcttcagaccagttgttgttgttacctgctcaatgatattattatgcttttatttgtttagttataagagtgttgcgactcattttgattggaatgatgcctttgactttacaagaaactcaaggcagaaaatagagaccaaattcttggagtcaccaaagcttgagcatgagacaaaccagcaacagccaatagttcaagatgtagagcttgattaccctttgaatagtatggtcagctcatttttccccatagacgcagtacttcagtttaatacttctgataacgggaatataaccactcacgagatgcttggaagatatgcttcttttagtcccattttgaaccacaggttgaagagtcaatatgcgatattgccatttaatgcctgtgatttagacaacttaacatcgctttctaagactaagtatcatactaaagtattgattgttttgagaggaggttgtacatttgttgataaggtgtccaatttgctagagtcagaaatggagccaactagtattttgattgctaatgacgagccttatagagggttgataacaatgttttctaatacgttcaatcaagatggatcattgcaaacacccatcatgtttataaccaacgaggattatcgatacttgaaaagtattgagtatcaaaatttgactatagaaattagcaccgcatatattggaagctggctcagtataattttgtcaatggtcttgtcacctccgctattaattatattattctatgcagttatcatatgtggtcaaaagatcaggagaaaacaagtaaatattcagaacgctaagatggttaagagcttgccaatctatatttacaacatagatcacttggttttggcaaaatattttcagcattatttgaaagtcactggtcagagtaacatggttccgatcttcaccacgcagtgggcgaccgcacttgcg

SEQ ID NO: 13294 - DNA, 189 bp, Candida albicans
tcctttacacatttattattaatacacaaacaagactacagaagtgtcgccacagtatcaccaatccagatttctattccaacaacactattttaccttgattattcttgctctagcactgattctaattactacattggtgatatttattttttaatcgctattttttcttgtatcttcccccactaa

SEQ ID NO: 13295 - DNA, 189 bp, Candida albicans
agttttgttctttcttttgttatgtacatgctcttcattttgtatagtgaacacgctacatttgtcaaaaaaaagtgtgtcttacaacatctaagtgaactaataaagaaacaagactattttatacatagagtggatgcagctttatatgataaatcaagatactctaatcataactttattttttga

SEQ ID NO: 13296 - DNA, 1716 bp, Candida albicans
ttcttaattgtgtgcatattgatggtcttttttttttgggttttctctctgttacaaactttcttttgcaaattcagcacatacaattatcttttgtcatcgtctaattacctacagttaacattccctgaaaaacgtaaatcatttgttgacatgacgatacaagccctaccactgactgcccttgttgaatataaaaacaacacacaagaatcatggaacaaaaatacaaaatcaaatacaaaatcaaattccccagtaaaaccagcagcaaacttggtcctaccaccgctcccaccacttcctccttcgactccacccagtaaaataactactaacaactgtacgcaacccacgatgagtcgagcttctttgacccgtttggaggttgaatcaggctcaagcaaatcattgccaatttcatttccttactactttttggaccaaggtgacccagaagatacttttaatttatggcaaagacaagaagattcgttaactaatattagtaatagaaaagacgagcatttaccttcacaatcacccactcctcaagttgacacagaaagaatcgacagcaccaagaaattgaacaacgacgaagttttcaacccagtaccaaaaagattttctcaatttatcatcgatcaacaaaatccatacgttagtcagagattggataatttgtcaactatttcaccatcaatgcaaagcgaaagatatataatgagaagcttgactccgttaacaggaacaaataaaaaacgtactgggctgctggtgatgaatcccgaacaacaggagaataatagcaagagaacctcggacgagttgataccacctcgaagagagatatccgattctatgggttctcaagcaacaatattttccacgagacaggaattacacaatgttcccttggtcaatagaaatgtgaaaaagagcaacactatattccgaagaagaaacaataagtcgaaacgtactagtaatgtcagagttcagacatcatcaagcgatgcctcagttcttacaagaaagaatgccatcagatcaaaacaggggagttggttatatagacttaaagtacgtcttcaaagaatggttgctaaatttaagttttatagttttaaagtatcctcaagaagatcagctagcataagacggtcaaagtcgacaaaattggtccgcaaacatcgagagaatccccagaacagagatatgaaaagaattcaaagcatacgtgtatcgtcttcacgtttcaatcatatttcaagcccgttaactaacccacatttggggaaacaacctgttttccaagttgctaccattgatgacaatttgaagtttttagctggggcccctaaagagagtgtttatatgggaaataataggagtgaatcacaagggaaattgaaccatctatcagagtacattcaacaacaagaacaaaattatatgcagaaaatgatagataataaagcgactagtgaaacaagcaaactgattttaccatctccagactttaatgatactcgaagcgaattactaaccgagtctgtaacaactcatgttaagacaatagacgagcctctgtccagacagcccccagcacctcctccgcacttagataacagtttcaataatattaatatgggcagccgcaatgtttcattggcacaacaactcttccccaccgggctggaaagacagcgt

SEQ ID NO: 13297 - DNA, 195 bp, Candida albicans
agaacaggctgttaccatcccggaaggatcttccggtcatcaccaacagcaagaagaatgggtttgaacgaaaagattgtgctggtatcagaagatatacatgatactgaacttacaactaaagtgaaacataacttatcggcagatatcccgctcacagaaactagaaagctaactacaaccgaagtattctaa

SEQ ID NO: 13298 - DNA, 1173 bp, Candida albicans
gtcatgagatttggacagactcagaatagtaacaacagaaccaagagagggacgggatcagataattatttaggttctgataccaacataactgataatgatttctccaattcactgtcatcattggcatcatcaatagagaaaacacctccagagtacatcaacaacaaaccgttcaaatcgaacaacactcagaaaggtatatatgttccaccacacaagtcaaagcgcggagcgtctagttatagaaagaagggatctaatctgaatgcaacattaactccagaagaacaggagaagaacaaacaaagattggctaggtttgcaaaatccaagtcggctcctaaagatgaatttgggttagtcagtagaggaaatgacaccagacttcgtaacaatgaacatgatagagtagagttttaccgccaaatactattccagtttgttcgattttgctcttgcagcaccccaaattctttacatcttggtctttctaagttgatcaatgaagaagattatcaaagtatagacaacaccgatagcgattttcccaaaccggaaaatataaccatggattcaatacttttatcaactcgaaaattacgtgaagctcttctttgtgatccacctagtgcatttcataaaaaagtctttatgttttcagttcgtatatcttcggtgttgggtcactaccagacatatataccgagtatcaattatttaatattacacagagcggaattggatctttctgacctagagttcgaagagatagctactatcctaatacttcatcttgtacatctaaatgaaaatataccacgagcgatccagttatatttcagatatattccccataaaaaggagattctaactgttattcaaagctggattaacgggaattactaccattgggtcagaatttacaatgaagaaagaaacgaagccattgtttcattaatgaaattgggtcatgataaaatggtacgtcgtctaataaaaactataagctgttgctattacacgttgcaaaaatctgatcttgaacagaactatttacctcatgacttgaattttgacgaacttgtttccaaacataagatcaattggaaactctctgatgacggcaaaactgtcattattagggagagaaagaagaaagtggtttcttaa

SEQ ID NO: 13299 - DNA, 630 bp, Candida albicans
cggcacattccattacaaagatatacaaaaccacaaatgtctgataaaccaaaaaatgagaacaaacttcctgatatactcaagatagatgaaataacttcaggaaaaatagatccacagttgatttatgatgagatagagcgtttgaaagcggaaataaatacattaagaaatgatatgtcacttttcctcaaagcgttggctactatacccccaaatcaatcacaaacggaatactacaaattggtagtatctaggttaaaaaaagtgcaagatagcattgatgattattgtgagaaatataacaagctattgccgatcattaatctcgctcaaataaagttggggcacgatgttgaagggccacctccaagtaaaataaaatccgaaacttcaactaataataatacgccaaatatggggaataagacgacacctgtaatggggaataagacgacacctgtaatggggaatagcagtacacccagtattgtgacagctaataccaatacagcagcatacctgacgtcaagcaatactgccgcgaaacctacaaagaaagcaaccaagagggcctcggtgagcaataaagatatgggaagtagtgccaatcaaccaattgtcatttga

SEQ ID NO: 13300 - DNA, 267 bp, Candida albicans
catctccactccatattccaatgtttaactggtttgtgtcgaaattttccaaataagatcccaagaaacgatttaccaagtttgctacgagtgactcaaacatattctagcgctgtagtaaatcaactaatctctgaaagttctttaatggataagtgtgatctatcgtttttgataaaaatggattggttagttttacaaattaaggagaaaataatgattgaaaaaaaaggtaaaattaaaaaggaaaaagaatttcaggaataa

SEQ ID NO: 13301 - DNA, 333 bp, Candida albicans
attaggaataatttcagcaatttatattctaaaacttttttttttcaattttcttgttttttttttcatcatcattcaacgatctcagcagtatcaccaatctctgaccatagtagtccggaggaggttgtcgtgcaaatttcaagcgttggtgggttgcgtaagctacaagaaaaagttttttttcagttacaaaaatggaaaaacatcaccccatggtctaaaattattccgagaattattaaatttgtttcgaaaaacatgttacctgctgatctcaataatgcagctgagcatcaggttattcccatggggccagaaaaaatactatag

SEQ ID NO: 13302 - DNA, 804 bp, Candida albicans
ctcatcatgaaccaaagaaatacaatacagccagtgaggagcaataattctacgaaattggctgtaccagctcgacattctcataccacctcagtgtcttcatttaacaatgccagttttacaacgcagtttttacccaaccaaccgaaacccacacggacaggttgtagcagtggtcattatagattatcacgaacaaccacaaatactattggtgacaattattcaacacaagatacacagagtgttgttactttagacaaagtaccacccacaaagccaagtgcaacttatctggataaattatggactcaaattgacgtattggatgatgtgaaaaagatggcagaggaagttagaagcaagggctcgttttttaatgacaatttcaatcagcaattgaagaaacttaaggaactgcaggataaactattgaataccatgtcgactcaacaatttaatgattttaattccaaagaacatcaaaagcaacatttttatcaattgaatactataagcccgacagtacacccttctgataatctatttaaagaagataaaatacttcatgaggatgaagaacaacaaaagcaggaacaaaagaagcaggcgaagcaagaaaagatcaattcatttttcaagtctgacgataagcaagaggacctagagtttaaaaaccaaacaatataccgtaaagagaattttgaggagataaaccagtatgttgcacagatcaagaaagatttaaagggacttggggagtctatgaaagaatttgacgaatctacaagagaaatctggtaa

SEQ ID NO: 13303 - DNA, 183 bp, Candida albicans
gcaagaggacgttttgatttgacttcggagttttattctcagttttttttcttccggttttgtagggctagtaggatttttcctaataccccgggggttaagggaaagttacaaaaatatataatcaaagaagctcatattttaatatgtaatgtaaaatttttaacctatttattcttatga

SEQ ID NO: 13304 - DNA, 183 bp, Candida albicans
caaagaaactacggttgtgggcaatgccgtataataactatatttgtcgacaaaaaccactctgtgtttttacatgctaccaacatttttttaaactggcaagacctattttatttctgcttggcattatacgatattaacatgattattgttggtatttgtttaagttacgtgtcacagtga

SEQ ID NO: 13305 - DNA, 189 bp, Candida albicans
caccggtatttccctattcggttttttcagtttaaagaatctatcaatgaacatgaggtcgttgatggtaattacatttatactccttattgtgtctccaatattgaaatcgctaacaaaatccacttcatcggactcaatttgggcaatttcctgcgtgttgtgtttagcaaactcgatatttcatga

SEQ ID NO: 13306 - DNA, 210 bp, Candida albicans
gagatacgagacttgaaaagacaagaaatcgaaagaaaggaacaacaaaagaaggacaaattggaaggtaagaaagacgaacttcgaagtaaagcatcagtagctcgttcaactagaagaaaaaatgcaaaggcaagcagagctgacgaagaatctcaagaacaagaagaagaatcaccaaagaagaaaaagaaagtatcttttgtataa

SEQ ID NO: 13307 - DNA, 309 bp, Candida albicans
tcaaatgtaccccaacgtaaaacggtcccagcagcattccaaagtgtagtaccaaggaacaacatccaagcaccacctggaattgggatgaaaaacaatccaacaggtgaagcagggaacaaaaaggaaaatacaccaaagacactaaatatagcacccgacgcacccaatgaggcaactgataaagatgatcctaaaaacataggaattgccaacgaagcaaatgaagaaataaccgccgaattcaagtacatgattgtaaagttagatacacccaagaatgccaccaaggtagagccgaatgattga

SEQ ID NO: 13308 - DNA, 390 bp, Candida albicans
ggtataaaaatttttgagttcacacgacttttgcgttactatttgtgtacatacactaataaaagacgatacacattttgttacgagtgtgtagtgtatattggctacgtagatgattatgtaatcatagttagtctagctaaagtccataagatcattcattcattagttaagtcgttcttcccaatccaatcccaggggaattccaacgtctatttatattcccgtgaggaatgtacaactgcccacatgttgttttctcccattctaccttgtggggggaagataaagactaggcaacccggaggcgcagtcaatgaccacaagtcggaggcttcaccttgtcaaccgttttatgctcgtgatgtatttgccactgaactaaactag

SEQ ID NO: 13309 - DNA, 207 bp, Candida albicans
gggacggtagtggataaaaggatgaatggggggaagttagtgcttaaatatttggcttttacaagaactttaagtaagggtttctattcagtttgtatatatatccacttcattgctatctacttgttgatcataatatgtcataaaacaacaacttatcaattcataaaacgaatactgaaagcatacacagtttgtatcggatag

SEQ ID NO: 13310 - DNA, 219 bp, Candida albicans
tttcttttattgttcacaataaaaagaaagctcattttatctttacataaaataaaaaaaaatggcaattatgaaaggagtagaagattgaaaaacaatagaaactcaaaaaaagaaccttgttatattttatcttcattaatgtatagaactactaatacaaataataaaatgacaaccttctctgttccaaagtgtatcacttcattatacttttaa

SEQ ID NO: 13311 - DNA, 777 bp, Candida albicans
aaaaaaaattacgcacaacaacaaacgcgcacatcacccctaatgggaatggacaaaaaaaaaaatgtcggctttggctttcaaaactcaactcatgagtatttggcaaaccacttcaagctccatcaaatgttcatacccggatttctaacattactacttactattttggcatcagtagaagccaaaaagatcaatttatatataaaaccaattgattctccttccaaaggtgattcaataggattcataaacgatgattcagtatacttgatagattctacaacaactttacaacctgatcaattctattgtgtgggaaccaaagaccttgacaatcatgaatgttttacccttatcaatggtgttgaatcattaaatggcactgttattgatgcctttatggatgaaaatggggttccgatatcacgattttcattaaatttggatgaatctgataataataaatcaaaattaagaaaacacaagtttaatacatcaccaattcctaatttgaatcctgattcattaaagaaacaaagacaaaaacaaggaaataaaggtggtcaaggaaataataaacaagttgaaattatcaaacagaaaaaattggtgaaatatatcgatgatgatgggaatgaagctgaaaaggagattgaagaagaaattgtagttgaagtcgataacagatcttgggtacaaaagaattggatgtatatagtgccaccattattattgtttttgattgttggcggtggtgatcaaccccaacagtag

SEQ ID NO: 13312 - DNA, 210 bp, Candida albicans
ttcagccttttacacaaatcctactgttgctttttttttttctttgtaaatattgattcagagtttattttactatataagccttcattttatggacaaccaactaacaaatgtactcctcaaacccctttcccagcgaccttttcagcctatggaaccacaagacacgtgattctaagatgtctaataaaggtgaacaagaacacataa

SEQ ID NO: 13313 - DNA, 195 bp, Candida albicans
catgttcctagaagtaagaagtcaagtttatggaatgcttggattgttaaagatttctatagtaaaaagatggatgattataatgctttttttttcactactggttacctaatgttgaaccacacacgactacatgttgagaatttttttttcctgcgattcttgtatatattgaaatcgttttttaatttttag

SEQ ID NO: 13314 - DNA, 318 bp, Candida albicans
ctcttcctggttgaattgaaacaaaaaatactaacaatgaaattcacagtttattcgtctgactatataatttcctacacttctatatcaccttcatcatcagtcaaaacaaactcatccaaaaccttctgtttctcttggttatcgttgcgatactcgtactttaattccaggctgccctgtaatggccagataaatccagtatctcctttaactccaccaagagttacagtacatccaaagcaaatatctattgggctatcactgttatttttgtcttcgttgtctggagacaaactggctctgaacatttcataa

SEQ ID NO: 13315 - DNA, 615 bp, Candida albicans
ccaaagattctcttcttgccttacaacgatcagctacagtattcgtttctcacttgttgtttcaagctaagcacatatccaaaggaagcaaatctgaaaattgtctcggcacaagacatgttggcagcattagaaagagcagaatttagtggctttatacccgaagtaaaacaaaaacttagtgttttcgaagctaatgttgcttcgaagaaacaattgaaagctgctaaaccaatttcgactgaagagggagaaaagagtgtgtcaaagaaaccaaaacttgacaatgaaagtatggaaattgatactgaagatggcgatggtggaaaaaatgctagtcgtggagatgatgatgatgatgaagacgatgaagaaaatagtaccgatggcaatgaagaagacgatgagaattcaaaacaagatatagagcatgaagacgagcaagatgaggatgaagacgacgataatgatgaaaccgaagaagatgtttccaatccgatatcagcattggccaaagaagagcaagagctacaaggagtagagactgaaactgaagctgaaaacaaaccagactcttcagaaaccgaagaagaagaagaagaggaagaagaataa

SEQ ID NO: 13316 - DNA, 216 bp, Candida albicans
tacattcgaagattaggacatttgggtaaacaatttgcttggattgttttgtttgtttgtttgtgttttgatttgattagatttatttcctttatagaattttttttcttcccctgtactttagttatcaaacactataatacccctacagtctcgaacctttattcaagtacttcatcattcacaatccatactaatcaagagttgaacatctaa

SEQ ID NO: 13317 - DNA, 267 bp, Candida albicans
gcaatggccacaacagtaatcaagtcacggctcccatcttggtttgatagcaactttttcatgaaatacattgagagttttatagtgttgctcgacgaaattggtattgatccaattaatgttttagacgcattgattaaacccaattcttgcgaaactatttctgagcaattgatattactgttgttcacgaggtgtactagattcgagttttcatatgtgtataaagtggttgagtttatagttaaggtacaatggatcacttga

SEQ ID NO: 13318 - DNA, 294 bp, Candida albicans
attctgagtcagaaaaaaaaaatgatacatacaatgagtaacgaaatggccgaaataggcttcgcaataattgctaagcgtcacgtgcagctagtgatagatccttcaccaccacaacaactccaagcacttaacttatctggggtcaaacatccccatctcaatgagctaattttagtttattttccgtttatatattttagcactataagggtagacttttcttatctattatacatatatccatgcagaaaaaaaaaaagctcagagctctttacaaatcagctctcgtga

SEQ ID NO: 13319 - DNA, 234 bp, Candida albicans
acacacatacttgatcatttacaaataatgtttcgtaaaaaagataaggataaagacagtgatctcaaagcaaaagatcattccgaagttccaagcgctaccacaacagaaaaaactaaacaagagatttatcatgaacaaggtttaatagggctcttccatactatgaaggaaaacatgaaaaaagaggatacaaaagacttagatgatgacattataaacctttttggctga

SEQ ID NO: 13320 - DNA, 1041 bp, Candida albicans
ccaatgataaataatttgcaagaacaagtggcttgggtgaaacgaacaaaccctcatataacaccacaggccgtaatagatttaataagaaaaccgttccccaaagataaactggcgccaatacctcaagtcccagattctatcccttcatctgataaagaaaacatccctatttcaaaatctcaacgtaaggttcagtcacgactaccgttgaaaaccatatctgccaatgaatctacattgcaaagcacacccaccccagtgaacaaaacacgtctcccgccagaaacaagtgatatcattgatttgacacacagcccgccaaaaaagagatcaccaccacaaccatcatctccaattcagcctacaccaaaaaaacagaagctcgatgattcagtgttccgcaaactcttagggctacacgaatcgaaaattaaaattcttgaagaaaagtttcttacaagcgaatccaccctgatttcgctagaccaaaagaaagagctatataagaaattagaacgccaaattgagttattggataatgaaataaacgcgctaaaactgggtttagatgatagcaccgagttgagctcctctccggattcacctgagtttagggtacctattacgcgtcccgtaagattagaagcagccagaacaattgttgagagcacagaaaacgaggaagacgacactgaggaccattttggtgaccagaccatggatggtttgcttacaccaacacaagagcgaatgtcacaggacgaccttaatgaaatggcaagttttattgatgacagaacattcgacataaccagtcaactgtcagatggcgagtttattgctgttgaatcagacaccgaaattaatgatatccgtctatctccagaaacagctaccaagtatggcataaagtataactcccaagtcataggcaaagcaagaacagaagtatcgtcacctatcagtagagtgccagccattccagagattgactcgtctgatagcgagccagaactaccaccaattagaagaagatga

SEQ ID NO: 13321 - DNA, 216 bp, Candida albicans
acgtctccttcatcgttattatcgttgaactcttacgacggaactatagaagaggttcttgaattggatcaaccgcaacttaaaaaagtgaagttggagccgtcagtttctaccagcaattcttcttcttcttctcctacccaattcagtttatttaacgattacaatttagacatgatatttgaaggtgtggtcgatgaaactgttaacgtttga

SEQ ID NO: 13322 - DNA, 282 bp, Candida albicans
caaaaaaaaaaaaaagttccctttgcctctctttcttttttatttgccccacaatcgactacactcatgaatgcccaaagattaaagaacctcatctcccttcgttcaagaaatgcttcaaacaaactacaacgtacattacaagagttggcacaaaatatacaacgacagatccaacagcagcagcaagcaccgattcccgtacctgtcccagtacgtcatagaaatacccatcctttaggtagaaggaattattcgacaatcacacagtcaagatggtag

SEQ ID NO: 13323 - DNA, 270 bp, Candida albicans
ccaattccgcattcgcacgatgaattgaaaaaaagaaaatttgataatgtcaacaacaacgttttccaaaaatcacattataaatataaactaattttactttgtcaaaaaaaaaagattcaactccgaaaaaaaaaaagaagagccattccctttttcctcttttgtagaaaaccactaaagttgcttaacttattttggaccgaatcacccgtgatcgacaccattcacaacgttgaagaagaacttatctatttgctaaacgattag

SEQ ID NO: 13324 - DNA, 192 bp, Candida albicans
acaatgtcagataaaggaaacatggctaaagatatcgcatcctcagttgtcggatcaattggaggtaacaaagttgctgataaattgcatcttggtggtgttggtcacattgttggtggtgttgctggaggcattgccggacaaaacctcgagcataaagctgaagacgaagttagagaacacaagggttaa

SEQ ID NO: 13325 - DNA, 639 bp, Candida albicans
tcaacattgtcgaagctaccaaataaccacagtaatactattaacgatatgagtttagtccagtcagccatgtttaatcatcatatgggcccttcacacactagatctcgaagtttcgagttattccaagaagctaaaaccttaagggttgctgcttgtaagagatcatacagcgacgatttgaatatcagcactaaaagagcaagaactgcaccaccatctcctccatatgaaactgctacacccaccagagctagtaggttggtaatttcaaatttggttaagccaacaagcaacttaagatcaagatcgctttctccaaataaaaagttttccagtccgttatccccatcgtcatcaccaatagcgactgtcacatcacctataagctcaccccaaaacataaagataaaactaccaagtatttctgatgcattaaatctaccaccaataacttctaaagagccagtgaaattgaagccaattgtgccaacagtctcattagattattttgatacatacaaacccaatgacaaaaattggaggtacgggcttttggataaaattgccaaagattcaaagcatttccaccttaatcaatacaactacctgaatgaccatgtcaaaacaagtttttga

SEQ ID NO: 13326 - DNA, 204 bp, Candida albicans
tccatattgtgtaatgatcacaaccagaccaggcttaaggttcttttagagcgaatggtaactgtctatgactacgctaagtatactactgctacaccaagtgtgggtaacaaaatcaaaaaaaaaaatttgtttccaccaaacgagagcagatcaaatgcgagtgggctggctagaaaatgtacatgctgggtgtatttttag

SEQ ID NO: 13327 - DNA, 279 bp, Candida albicans
tggttaggtaaaagtggaaatgtggagtcagagattcaagctactatttatattactcctctcagaaatttaagattgctatcaatttcagttgtagattatgtgcaggaatacacatgtgtgccaatcgatgaatgtgaaagacacaattgtgcttacaagaaagcgaataaaggactaaagttgtgtatcacggtagttttgagttgtaaaagcgttgcatggagtttggtgatgatgatgatgagaaaaatacaacgaaaaaaaaaaaaaatttga

SEQ ID NO: 13328 - DNA, 195 bp, Candida albicans
tgttgcattccgggaattttgatttattcaaggttgttttcattggttgagggcaaaaaatttgcatcgagcagaaaaggtcgtgcccggggcatagtggatagacaacgattactgatgaaccacatgtgctacaaagaccaaactagggccgttttgaagctacaatcatgtagagtattgggtgtgaattag

SEQ ID NO: 13329 - DNA, 195 bp, Candida albicans; identical to SEQ ID NO: 9449

SEQ ID NO: 13330 - DNA, 195 bp, Candida albicans; identical to SEQ ID NO: 9449

SEQ ID NO: 13331 - DNA, 267 bp, Candida albicans
caattattgtacatagatctgcttaaagtcattacaattgaatctagagcacatgctggatatcaaagaagtataaatgaacaatttaatagacaaactagatcaatttctaaagatgtaaattctatgagcaccacctttgattcccatacaaaaacggccttttttgttgtagcatctccaatcattcgcctacctcaatcaccatctgtgcgtataataaacatttgtcttggcttcaaaacggtattagtttggtctttgtaa

SEQ ID NO: 13332 - DNA, 234 bp, Candida albicans
  unsure (196): Identity of nucleotide sequences at the above locations are unknown.
gccacaaatcggcacatgattggctattgtagccttcctttacctcccacacttcaactttcctttttaactattgtagtttggatgcaacttgaaaatattggttttttgacaatatctccaccaatattggacttccttagacctaacttagattgtcagttgctaacaacatgtgcctttaaagtgaccagantttgggatgtggtcgcacggtcttcactacgatggtga

SEQ ID NO: 13333 - DNA, 252 bp, Candida albicans
ctgcttcatgtgcaagtggtgcaacatgttgtcaaattgcaagtgggggttgtggaagcagcggtggaggatgcagcagtggaggatgcggagcaactgcatttggtgggggtgggtgtggaggtggtggaggtggggggtgcggtggaggaggatgtggtggtggaggtggtagcaactaatcagtttattttatcaattacatcaatatccggtttgcttatatttgttaaattccatatttgtcattaa

SEQ ID NO: 13334 - DNA, 213 bp, Candida albicans
tttataaagtggtatatatacatatacgtaaatatatctatgtatttattcatttatatatatatgtatgtcttgcccgattttaaagttgatcctataaagactcaatttttatattggacttcttttttttttctttctttctttccgtatatatcaacaatttattcaaccttatcaactcaactgattccagttgtttttccttcttaa

SEQ ID NO: 13335 - DNA, 327 bp, Candida albicans
aaaccaatcatggctctcaaattaaaattgaagatgccatcatctagtgcatcaaactctccccagccaccaccaccagagtcacattcaccggaacaaccaaaactaccaaaactcaaaatcaaagcgccatccaagacaccagtttcatcgacgccagactcttctatggccttaaaacgaccccaagaagaacagtcgacaggtgaaaaacccaaaaaacttaaactaagtttatccaaaaccaaagagaatggacgtcccaaaggtctgccaccatttagaattaaacctacccgaattcctggccgaaggatacgattctga

SEQ ID NO: 13336 - DNA, 240 bp, Candida albicans
atcaacggaaaaaaaaaagtaacacataaacaaaggtgtgtttgtattagtatatcctatgggttgagaagtttagttttaagggagtttatagttaaaaatattaataaaaatattaataaaaacagtaaaaagtataagtataaacaattgcacccaaagaataatgaagcttggtatctagtgccccatatacaggattttcttagtagaaattctctaatctcatcactaaaataa

SEQ ID NO: 13337 - DNA, 762 bp, Candida albicans
catatcatagaccttttcacccagatcgtatcatgtaacgataaactggaattgcacaagatccaagttgaacttgacgagataagcaaaaattcaacaacacccgatcaaccttcttatatccagaaactaactacagacaagcttaaaatattgaataaccttttacagtcgaaacaaaaccagctaagcaaaaggagatttgaattcaaaggagagccagtagcacccgtattgaaatcgctggtggccaatgaccaaaatgtcgatgacacatccaaatcaatacaaaaaatcaacaaccagattttggaaatatcactgaatgaacacatggtagttgattgttttagcaattcttacgtacaaactacaaatgaaattccatcaatccatcttaaaggtggcgacagatcaatatgtaagttaacagtccagggtccagtattcattcatgatgttagaaatagcatactagtattgtcatgccaccaggcgagattacacaatattcacaattcgttagtcatcatacagtctgttcaaaataaccgaataattattgaaaattgcaatcaaataaaggtcagctctggaattgaagttgacgatttcaattttccaacaaaggaaataaagaatccccattttgaagttttaatgagagacgtatcagatgaggtgttgaatggagtgagaagaattgcacaaacaagcgatattgcaacagtaattaataagtacattgatgtctaccactga

SEQ ID NO: 13338 - DNA, 261 bp, Candida albicans
tcaacacatcatatcaatctgttacagattcgatcgttatgtgaaataatattagattcatttcttggaaatagtacgatattttttttaccgttgaataccccactttccttttatggctattttcagattatgtatgaacgattaacagcatcaagttattctacagtagtcactacatgtagaaatttacacgtaaagaagcaaatttcatctcgagatgaaattgtagatcgctacacgactacactatcaaaatga

SEQ ID NO: 13339 - DNA, 183 bp, Candida albicans
tgtcaccagtattttttttactcccgagtctacagaactggttatgattttctcaattataatgtggaattgtttggaagagttatgagcttatttctatgctttcctccaccacagcatcaaaaaaatatcataaccagtgaaattgtctcaatgcttccattactaggccagaataggtaa

SEQ ID NO: 13340 - DNA, 267 bp, Candida albicans
atacgggtgctcgccatctctgcttacgtagttctgtacttttactcttcatacgactatcctcctttatccccaatatacacactaaaaggactaatactcacacccagggttataacagatagtaaaaaaaatagtttaattagggatttcagtttgcaaaaagggacaggtgatatactgaaattcattttgcttagtgtttccgtaaatgcatgttatttttctggaagggattggaaagaatcatcagtgaaattgctatag

SEQ ID NO: 13341 - DNA, 222 bp, Candida albicans
gtcaaagcaaatagccatgaaaatgggctgtttgttttgtgtagcttattagtcattcatgcgtcactgaacatacctcgaggactgatgctagccagggtttacaaaccctgggtctcttttagtttccaactaaactattgcttttttccagtatttggttgtgtgcatcattcttttagttgctggtacagtataatttcatctctggagactgcttaa

SEQ ID NO: 13342 - DNA, 444 bp, Candida albicans
atttccagcatagttcttccatttatcagtactacctatatggaacaacaaatacatcaagcggttgaaatagcgttaagcgggacagccgatccaacattgaaaaaccaagcatttgagttcatcaaccacattaaatcaacagaggaaggatataaagcatgtgtagatattttgatcaaatcaagcaatgaaagcattaacgacgggttaaagttttttgtttaccaagtgatcgacgagaatattgacaaattgagtcaagaccaggtgtttacattaaatcaggaactttttaaatgcttgtcaagttatatcaacaataatttacaggaaccttactcatttgagaaacaagtttgcctcaaatttcttgcgaaacatttttgtcaagtgtatataaaacatttatccccacttttattacagatttgcttgaattaa

SEQ ID NO: 13343 - DNA, 189 bp, Candida albicans
tttagtactagagttttatatctgtgcctgtattgtattgtattgtacattggtgtcgatacgcgcactccagccaaaaaaaaaaatagaacacagccaacaattgttagtaacaaagcctcagaactgttttttttgttgttgtctttcttctggtttactcctttcataaataattctagaatttaa

SEQ ID NO: 13344 - DNA, 216 bp, Candida albicans
ttgtcaactttgaagcgagcagaagttttatcctttttacaaagaggaacacaaaattgtagagatttttatgatatgattgtttatactgttgcaattagaaatcacaaaatatgcacagtactagatgattaccatactgctaatattactaaacaaaaaaaaatacataatttttacagattcatggatgatatgagaaatactaaaaattag

SEQ ID NO: 13345 - DNA, 312 bp, Candida albicans
tggggaatcttggttgggaaatctttatcaattaataccggtagtttattgtcagttacatattgcatgatgttgggtggaaagttttgtggttgtgaatcggtaatgagaattgggtttgcacctgattctatgattgaaacgattctggtattggaaacagcagaatacccaatcaataagtgggtctccccggtagttatgttggaagttagcaaattagtcatgcttgagaacgagtgtataagaaacacaatcaaggtgcgaaatctgttgtttataaagatcaatgactttgaatcaaagatgtag

SEQ ID NO: 13346 - DNA, 222 bp, Candida albicans
aaaatatacaatgctggcgccaacaccaatgcaaccaaaattttccaggtactgatcacatccttagctttaatcttgaccagagaagcagcaagagcctcttttgctttccttacagaaattttctttgaagttatgaaaacaggactgaataaaattataccaggtaaacttaatcccatgaataacgaaaacttgaaaaacctactgacaaacatctga

SEQ ID NO: 13347 - DNA, 282 bp, Candida albicans
aagaaagaaaagaatacaatgcttgcaatcttttacttatttgtattatgtttatgtaccccagttccagctgatactgaattaaaggctgtcaccaatatacttggtcaaataagtgctccaccatctacatctacactcactgaacgccatactatagagccactttacaagatcgaccctagtgccaaaccaagtatatctttcaacaataaagatgagattttgaattatgaaaggagactagccaatgaaggaaaaaaatacttattgggcaaataa

SEQ ID NO: 13348 - DNA, 207 bp, Candida albicans
acttcatcttccccacacacaaaaagtatgaacacaagaaatctacaggtgcttatagaggagcttggtaatttgatattactacgaagcagagggaatcagaaaggtttaaaaactgattccgggtattgtttcatatttttgttagatatagagtttttgttcttttggttattattctctttttattttattggtggtagttag

SEQ ID NO: 13349 - DNA, 372 bp, Candida albicans
ataaactatcacttcctttccatgcgttcacaatcattgccattaccattaatagaatcaccaaactcaatagatttagaccccatcaatcatgagaatttggcggtatacggatatttgctactaatatcaacatggatgttattcattatttcaataaattcaatcttcgaaatttggagatttataattcaaccattacagtcatcgccaacatccttgttattatatgataaattaacaatttccttcgaaactattgattcctatataataaagttatggtgtatctatgtagtatgttggtggtgggccattgtatcatggagtgggttaaaattattccgtcattctaaaggtattcaagggtaa

SEQ ID NO: 13350 - DNA, 294 bp, Candida albicans
ggtcgcacgcgcccttacatttcgcaaatggccggagtcagatcaaattttaaatcaatagatagccatgaaaattattcgcgatcccggtgccattgtcgcggcccttttgcaaacaaacccgattttgaggaggtatataaaatatatcaagaacccatagcaaagaaaaaggtagatttgttgattgtgttagttttttattttggaaagtcaacattttttaaaccatgcctaatcctacttcgatacataactttcttgataaaagacatagcatcacccctcttctag

SEQ ID NO: 13351 - DNA, 231 bp, Candida albicans
accccacattgtggggttgacccttccgatggaggtcgggtggagagtgaatttatatgtaagatagttaaatataataatatagaatatataagtatagataaggtattagagagtatgattaacagtaaagtaggggaggctaaccacccgatccgcctcctaccgaaggtacggaggtacggatcgggtgtagtgggacttcaccctacctcctccagaggtaggtga

SEQ ID NO: 13352 - DNA, 186 bp, Candida albicans
tttatacttaaagtaggggagcctaacagcccgatccgcctcctaccgaaggtacggaggtacggatcgggcagactcgatacctcgaatagctatgatcctcatcaatatactattatatatataaataatcatattacatctaatacatgtaaatataatatagttgtctccgcacctacatga

SEQ ID NO: 13353 - DNA, 225 bp, Candida albicans
gttacagtaacacctgaagctaataatataatagtgttaagtaatggtaattcagctggtgatatagtagggatacctactggtggtcactgcatacctaaatccatagttgggtttagtgctgaatgtagatatgctcaaaataatgaggcaaatattaatatctcacttactacaaataataggaatccttggttaagtccacgtttaactgctaaagtatga

SEQ ID NO: 13354 - DNA, 195 bp, Candida albicans
attattatattaccacccgatcctacttatagtaggatcgggctcaggttaacttgtatagtggttacatatagatatcctcatattcatagttatctatatctatatataccacccacctccttaggtggtgggtggctagtactatattcattatatagagtattatattatttatataattatatattatag

SEQ ID NO: 13355 - DNA, 303 bp, Candida albicans
ggattcttcggtcaaggatggccctatataattgtgagattatatatgtattacactatatgctggaaattaatgtattatatagggatattgattactagtataataagcctaacaggccccataccatattacatatggtatggggcccatagaggaagttcctctatagcctatacagttaaaatattaatatcttatactttaagtatcattaataatcagcagataaccaataataataattatttagtaggaatctcagagactacacgtgtaaaaactatcaaatttaatcaatga

SEQ ID NO: 13356 - DNA, 249 bp, Candida albicans
gttataggtgtagttatatttatacttactatggccatagcatttatgggtaacacttcttacaatagccctaaatcatttaattatattaatcttaataaatctaatttaaattatattaacttatctccttttaataaatctattaattatatacataagagatatctgtctactaaatctaaatctaatgatatacttgaaccttcagatatatttaaagagataggtattgaacctgttgtatga

SEQ ID NO: 13357 - DNA, 252 bp, Candida albicans
ttatgggtttataaacctataactttcattatgggtacgttaatacttgaagtacaccgccagactagtacgtcctcacggatgaaatgcaatacattagacggttatatacaggtacagtggattatgctgtttaattggatgatacccctaacaccttaccaattcttgaatatatactcattacctgaacgagtatatacaggcgttacattgttgtcgtcagttcatgccaagtggtattttatttag

SEQ ID NO: 13358 - DNA, 237 bp, Candida albicans
aagagtgtacctacgatactaagctcgttgtatgtagtagatactgattccactatggctataggctcaaatgctatatctaatggtattaaaggtattaatattaatactattactaaaggatgcatacctccagtaggtttatattctatatttaataaagataatataaataagaataatattgctatggcacctacatatactaagatatataaaatacccataaggacataa

SEQ ID NO: 13359 - DNA, 186 bp, Candida albicans
tcagttaagaaccatagacagatatacttgctatgcttactatttaacggtaatttagtattacctactagattatatcaactaatgaaatttataggttatattaaccttatattactaaagaataatgttaatattataaagttcaaagattatattaagcgtcctagtttaaatgatacttga

SEQ ID NO: 13360 - DNA, 240 bp, Candida albicans
atattaggttatactgatgctaaaggtacatttagtgttaatatgactaaattaggtacttatagagtaaagtatatattaagagaaagatatgagtgtaataaaggagtattagagtacatattgggtttatttagtaaagagatgttacaccggccccaggatagcaaagctatcatggggccgggaagtggctctctcggagctgtaacccaacaccataatactcctaatatatga

SEQ ID NO: 13361 - DNA, 189 bp, Candida albicans
ctattatatattatagataataattgtaaatatatattatcttattataataaatataaacttatatctaagaagatagatacatataatatgtttagggatatattagtatcagatagtataaatctagaagatattaaatatataagtaagagtatggggaatataaatagagccttacaaggataa

SEQ ID NO: 13362 - DNA, 207 bp, Candida albicans
ccagaaactaattcagattcagcttcaacattatcaaaaggtggacgtgcacattcagcaacacaacctataaagaagataatagctaaaggtaataaagggataccatatcaaatagcttgttgtatttcaatatatttagatacattcatagtaccacctataagtatacataataagatgatagtagtaagaacaagttcataa

SEQ ID NO: 13363 - DNA, 249 bp, Candida albicans
cgtaactttgatccgttatcggcactctatgctgaagaaatcacctgttcattatactatacttacgtactaagtcgacttgtaagtctccttatcatagcacagttaggttattatccatatcatttaatatatgttatatacatattattatgtactagttacaatctagtcttactgtacttggtcatactattatattcatattcttatataatgaatagaatgtttatattaattatcagttag

SEQ ID NO: 13364 - DNA, 288 bp, Candida albicans
caatatagtcttatagtaaagctgcatagggtcttctcgtcaacctgttgctacatacagtatctacactgcaagtactatttcactgagctccctgtggatacatctatagcatcgtgtaatcattcatgcaggacgccaattatacgtcaaggaatttcgctaccttcggatcctcatgataagaccgccgttaaccagtatattattaattatcttactagcaccgggcaggtatcacctactatacttacattccatgttagcagtaggctatgtttttggtaa

SEQ ID NO: 13365 - DNA, 198 bp, Candida albicans
gcttgtataatagcaatacctacttctaagatagtaatagcaataacagccactattggtacaatacctccgataaatcctaagatagatgatgacattaagttaacaattaatgaacctaagattaacataagtaaatgtccagataatatattagcaccaagacgtagacctagtgatatagcacgtgaagaataa

SEQ ID NO: 13366 - DNA, 201 bp, Candida albicans
aagaccttatttaaatatattaaatatattataagatactcgtacttaagtacagtaataactcttataatagctagaggttcacatgcctgtacgcccgaccaaaggtcgggcctacatcagagacttaacatgataatacataagagatataaatctaaagttaataatagaaataatattattaataaagagaaatga

SEQ ID NO: 13367 - DNA, 183 bp, Candida albicans
accgtcggtcgtagtcctcttagaggactacgatcgctacagactgcctctatgatgggtatctataagatgcttaatgtacagtcgaaatctcacctacctaaaaggtcggtggtcatattaaatatgaaatatctattacatgagtataaagtaatagaatgtatatacattacctattaa

SEQ ID NO: 13368 - DNA, 222 bp, Candida albicans
ggttcaatcatgtcagtaatatcagtattaattggattatatagtgtattagttcaattaacaaatggtgagaatgagcgtgaagaaatacaagtaacacctgattacttagaatcaaataatacacgtgatgttagagattcagatcttgaattaataacatcaagaccagctcaatatcatacatttagtgagttaccaatattaatacaacaaatataa

SEQ ID NO: 13369 - DNA, 276 bp, Candida albicans
agcaatcgcttgaagcgtgatctgtctgagttcaagtctcagcataggcatacacctccacccgagatcatagatctcgggtggactctgacgcatagtataatggtagtacacattactacggataatgatataggtgttcgaatcaccttgcgtcgaatgttactattaaccttagttacatacatagtttatatcgcttataatcaacgagatatactacatattaatagactagctgtactagctttaagttttgtagcatatctagcatga

SEQ ID NO: 13370 - DNA, 189 bp, Candida albicans
ccgagatatataatgtataaggatatattcataactagacctgcacccgcccgtgatttaggatcacgggcgggttatgttgatatttatcttataggtgaacacacatcttatagattatatcttatatctcacctcttcacccgatcctacatatgtaggatcgggtctgtagcctatattatatag

SEQ ID NO: 13371 - DNA, 261 bp, Candida albicans
gtaacctataatatacttattttacttattatattcttattttacgatagtaggttaatggtagaccctggcacttccaatgctactgtgcgtgttcgattcacgtctatcgtatttcctcactatgttttagctggtgctgagaacttattgcaaataagtttattagggttcaattccctacatagtgttatatatagtttaaagtctaatacatatgtatcatattttcatattaacatagatattaatataatatag

SEQ ID NO: 13372 - DNA, 192 bp, Candida albicans
gcacctccactacacccgatccaccacttacagtggtggatcgggtctagatcccttattaccgtgaatatttatttatatacctattacttagatatattcgctaagggtgctccgtcacctgccacgtctatccttatcgtgtgtcctatactcttaatcgagtatcatatatatatactttatatttaa

SEQ ID NO: 13373 - DNA, 216 bp, Candida albicans
tacatagtggaagtgacctactacataatatgtctatttaactttagttacctaaaggatcggactataacttatcgtaatcttaacttaataagattattgatttccacgtttagtctctacggtatccttcatgcttatgaaggttaccacggtattgtctttatgaataataaacctctattaccacccgagatcgaagatctcgggtgttga

SEQ ID NO: 13374 - DNA, 210 bp, Candida albicans
tatttacttttatcatggaaggctacatctatactagcgttacttaacataacaccagttaaaccaccgatagtgaataagaataggaaacctaatgcgaataacattggaacagctagacgtaattcaccaccatataatgtggctaatcatgagaagattttaatacctgtaggtatagcaataaccatagtagcactagtgaaataa

SEQ ID NO: 13375 - DNA, 198 bp, Candida albicans
tatcgtcagcggtgtttgccacctcgattagatatagtcgagtataaatggggtgaattgcaagaaagtctaagggtcataaccacccgaccttcctggaaggtcgggtggtattatggaaggacctatgatgacttgcagcgaagtattatttatacatataactcaactcctttggagttgggttataaagaataa

SEQ ID NO: 13376 - DNA, 195 bp, Candida albicans; identical to SEQ ID NO: 13354

SEQ ID NO: 13377 - DNA, 189 bp, Candida albicans
gatcatgaatcttatatgttaccaattacattatattgcgttataacgaatatatataataatttagatccttgtcatatcatattaattataccattaggatataaaccatatcataatgttggtataattaaagctatcattaataaactctcacgatatgtacaatcactagttaatgcagtataa

SEQ ID NO: 13378 - DNA, 213 bp, Candida albicans
ggtgtacgtataccaccagttaatctattagtaacttttaacatatatgcagcagataataatactgagaatgcagatatacatcctaatatagttgatctaccaatagctccagttagactaagtaactctcctataaagttaacagttaatggtgtacctatattactaaatgataagattaataaatatatagctaagataggcatataa

SEQ ID NO: 13379 - DNA, 249 bp, Candida albicans
actacaggtgtatatagaacagtagcatcagatagagtaggtataattaaacgaataatagcatatacagctaatttaagtataacacctgctaatagcattgaaccagcaagtgggctttcactatgtacaacaggaagtcaagtatgtactggtactaaaggtgttttaaccattatacctgcggagatacataagaataggatacattgtagatcagttgacagtacaactagactaacagcttga

SEQ ID NO: 13380 - DNA, 234 bp, Candida albicans
caccgactgtacattaaacatcatttcagatatccattagtggtgcagtctgtagcgattctttatataaccgacggtcttatcacattaaccgttttcactaatgtcgccgtatccacccgacctaccctaagtaggtcgggtgactatactaatcgtctttcgattatacctctatataatattccctataaaagttattattatattataaattattatttatcaaggtag

SEQ ID NO: 13381 - DNA, 183 bp, Candida albicans
actaatacactatataatccaattaatactgatattactgacatgattgaacctcatgaacttacaacatttcaacctacaaatgcatcaggatattgtggtatacgacgaggcattccattcaatcctaagaagtgcattggtaagaagataatgtttactgatacaaataataatcaatag

SEQ ID NO: 13382 - DNA, 303 bp, Candida albicans
tgtaggcccgacctttggtcgggcgtacaggcatgtgaacctctagctattataagagttattactgtacttaagtacgagtatcttataatatatttaatatatttaaataaggtctttcatgcatcgaatgatattttttcgaacagcttaatcttaaccgttcaacctgtaccagctccagtttcaataagaactgaagcaataacacaaactaatgcaggaggtaaacatcagaaactgatgttattcagacgagcaaaggccatatctactgcacctatcattataggtaagaagtaa

SEQ ID NO: 13383 - DNA, 240 bp, Candida albicans
tgttttttctacacacacaaaaaaatattatgtaatccacgcaaaaaaattactagtattttttaccatacaaaaaattactatgtattgcacgcacacaaaaaattgccatacaaaaaattgccatacattttttcccatacaaaaaattactatgtagtgcacgcacaaaaaattaccatacaaaaaaattactatgtattctcacacacaaaaaattgccatacaaaaaaatgttag

SEQ ID NO: 13384 - DNA, 255 bp, Candida albicans
atgcacgtgacccacacaattttcaaccaccaacaacacaccaaaaatgtatgtacactcggagtggaaaatatttccccaggcataattgtggttgccaattatagtggagtgtttgttattagtataggagtactccttttatgtggaaaaatcgaaaaacataaaacagtgcagctatacactaacaaatggtatacccatggtcagacaacaccaaacaacacacccgtaatggttggtttggctaaatag

SEQ ID NO: 13385 - DNA, 360 bp, Candida albicans
ggttttttcccatacaaaaaaataccatacaaaaaaattgccatacaaaaaatttactatgtattatacgcatacaaaaaattgccatacaaaaaaatattacataatacaccatacaaaaaaattactatgtattttttcccatacaaaaaattactatgtattctcacacacacaaaaatttactatgtagtacacacacaaaaaaattgccatacattttttactatgtattttttcccatacaaaaaattattatgtagtgcacacatacaaaaaattactagtattctcacacacaaaaaattaccatacaaaaaaatgttagtgttttttctacacacacaaaaaaattactag

SEQ ID NO: 13386 - DNA, 210 bp, Candida albicans
gcgcaccgttgccagcctgctatggtccagcgactaaaaagtcttattcgtatccatctaaaatgtgcagggcaaaaatcatcgcgttctagcatggattctgacttagaggcgttcagccataatccagcagatggtagcttcgcggcgttgcctgatcagacagccgcaaaaaccaattatctgaatgaacggttcctctcgtactaa

SEQ ID NO: 13387 - DNA, 276 bp, Candida albicans
tgttttttctacacacacaaaaaaattactagtattttttaccatacaaaaaattactatgtattacacgcacacaaaaaattgccatacaaaaaaattactagcattttttcccatacaaaaaattactatgtagtgcacccatacaaaaaattaccatacattttttactatgtattttttaccatacaaaaaattactatgtattctcacacaaaaaattaccatacaaaagattgccatacattttttcccatacaaaaaattactatgtag

SEQ ID NO: 13388 - DNA, 240 bp, Candida albicans; identical to SEQ ID NO: 13383

SEQ ID NO: 13389 - DNA, 183 bp, Candida albicans
tctttcgcccctatacccaaattcgacgatcgatttgcacgtcagaaccgctacgagcctccaccagagtttcctctggcttcaccctattcaggcatagttcaccatctttcgggtcccaacagctatgctcttactcaaatccatccgaacacatcaggatcggtcgatggtgcaccctaa

SEQ ID NO: 13390 - DNA, 189 bp, Candida albicans
gggagaaacgacgctcaaacaggcatgccctccggaataccagagggcgcaatgtgcgttcaaagattcgatgattcacgaatatctgcaattcatattacgtatcgcatttcgctgcgttcttcatcgatgcgagaaccaagagatccgttgttgaaagttttgactattagtaataatctggtgtga

SEQ ID NO: 13391 - DNA, 288 bp, Candida albicans
tgcacccatacaaaaaattaccatacattttttactatgtattttttaccatacaaaaaattactatgtattctcacacaaaaaattaccatacaaaagattgccatacattttttcccatacaaaaaattactatgtagtgcacgcacaaaaaatttactatgtattctcacacacaaaaaaatattacataatacaccatacaaaaaaattactagtatttctcccatacaaaaaaattactatgtattctcacacacaaaaaatcacatacaaaaaaaatgttag

SEQ ID NO: 13392 - DNA, 231 bp, Candida albicans
tgcacgcacaaaaaattaccatacaaaaaaattactatgtattctcacacacaaaaaattgccatacaaaaaaatgttagtgttttttctacacacacaaaaaaatattatgtaatccacgcaaaaaaattactagtattttttaccatacaaaaaattgccatacattttttcccatacaaaaaattactatgtagtgcacacatacaaaaaatttactatgtattctca

SEQ ID NO: 13393 - DNA, 261 bp, Candida albicans
ggcctccggattggtttaggaaagggggcaacctcattctggaaccgagaagctggtcaaacttggtcatttagaggaagtaaaagtcgtaacaaggtttccgtaggtgaacctgcggaaggatcattactgatttgcttaattgcaccacatgtgtttttctttgaaacaaacttgctttggcggtgggcccagcctgccgccagaggtctaaacttacaaccaattttttatcaacttgtcacaccagattattactaa

SEQ ID NO: 13394 - DNA, 192 bp, Candida albicans
cggaaaggctttgtgcgcttgccggcggatagcaatgtcaacatgcgcggggataaatcctttgcatacgacttagatgtacaacggagtattgtaagcagtagagtagccttgttgttacgatctgctgagattaagctcttgttgtctgatttgtctaagaagacctgcccgaagggtgggtctgtttag

SEQ ID NO: 13395 - DNA, 240 bp, Candida albicans
agctgggtcgaacggcctctagtgcagatcttggtggtagtagcaaatattcaaatgagaactttgaagactgaagtggggaaaggttccatgtcaacagcagttggacatgggttagtcgatcctaagagatggggaagctccgtttcaacgtgcttgatttttcaggccaaccatcgaaagggaatccggttaaaattccggaacttggatatggattcttcacggcaacgtaactga

SEQ ID NO: 13396 - DNA, 264 bp, Candida albicans
ccgagtgctaccaaggtgggttccactatgggtgctacttgccctttacggaaagtggctacacaccgcaatgggttaccgatttgggaagctagtagggctaccagagctaccaaagtattgtgggagagttgggtacagtacacattgttacgcaatgagttaccaattcgggaagctagtagggctaccagagctaggttccagttaccaattcgggaagctagtagagctaccagagctgggttccagttaccgatttag

SEQ ID NO: 13397 - DNA, 192 bp, Candida albicans
atggtaaacaatcagcaaataggacaatttcttcgttcacattttatgcaatgtgtgtgtagaatccagcatatgatcataccaagtaaacaccccatacaaatatatccaaataaccttatacgaagtttactagattataaaataccgttatcaattaccgatactgtttacgatttatattggctatag

SEQ ID NO: 13398 - DNA, 186 bp, Candida albicans
ttgttgttattgttattgtttcaattagacgattggaaatgctatatacaagataatttattctgcaacaatgtgccgttcattgcattctatccaaaaagagaaaacagatactttagcattagtagtaatatatatcttgtattaccacctgtgaacataaccaattttatattgaccatgtaa

SEQ ID NO: 13399 - DNA, 186 bp, Candida albicans
cttgacattgatcggccatggctgttgaaaaactattgtttccgtgacagtttgacacaaagtcccaaacaattaagtgccgtgcggtataatttaaatcaattttcaaagtctgtgaatcaatctactttaatgtcaagttcgtggtattcgttgagaatattggtattgattgctttttattaa

SEQ ID NO: 13400 - DNA, 306 bp, Candida albicans
ttgtcttctctcgaaaagttaagttcatgttatgataaaaaactagttgtttggcaggcaaaaaaaataaaagctccaatgcggggaatcgaaccccggtttgctcggcgctctgttcctatgaaagaaatgaaagcgaaccgtgatagccactacactacatcggactacttgttgatttggaatcgtttggcttttttatactggttgtattattacggctttttgaattttttaaaacaagtattttttctacttcagtgtaaaacttatctgattaggaacttatttggcttcaagaaatga

SEQ ID NO: 13401 - DNA, 225 bp, Candida albicans
gtcctcccattcacaaaggaagaagttagatcattaatgcaattttggaaagatcaaggtgttttaattgttcgtgaagatttccatgaaaaagattatgaaaagatttccgattctccagaaataaatatagatgaacaatttgaaaaattagtacaagcactgtatgataataatcaaggtaatccatatggaatgattaaacaagcagttttaagttattaa

SEQ ID NO: 13402 - DNA, 822 bp, Candida albicans
gagcgcatttccttccagtccggcggtgtaagagttataatctattatgatcaaccaacaatagattataatactatatcttcaccatcaaaacaaccacaacaaccaaagcaaaactcacagaataataagccattagacaaaccacgtaatcaaacatttggaaccgtgattgattattctgatgttgaagatgatgatggtgatgatgatgacgaatatccggatctagatgatgatattaaaactaatacacgactaatcaatcaatggagaaccaacaatatccaacccaccacatttaatcccaccattaatcaaaatggatcaattaatcgacaacctacactcacaaatgtttctttacctgatcaataccctggaaaatttcctcacctaaagaacgataatgatgttaaacaagacaactctgttaacctactagaagcagataaggaatatgaatctttaattgatgcaaaaattcaagcattacaaagagaaatcgataataatgataatgataatgataatgataatgacaacttccctcaaaacgttgaaactactaacgtacttgatgagattaataatttacaattgaaaattacatcacaaactaaaacattacaagaattgaatgaattggttgatgtttatgaagatgaaatacaatcaaataataatactattattactactacaggaaaattaataattgattataaagattatcaaaatttgaaaaatgaatatatgaatgaattaaatcgagttaaaaaattatatgaagcttattacttattatttaatggctgttaa

SEQ ID NO: 13403 - DNA, 210 bp, Candida albicans
ataataaattacctcaattgccacaaagctgggaaagagtattacaggataaaggtgaattatagattaggaaaagctctttatataaactggttttataataaatatgttatatcaattggatcaatagagaagttcgttgtctctcttattaatttctacaccaagacgtcaagaaggaacaactactgccaacgtttgaaattgtaa

SEQ ID NO: 13404 - DNA, 828 bp, Candida albicans
agaaaggcattgctcaatggaatgtatacccgaagagcaattcatatggacgacaaatttgtatttagggatgttttggatactttccctaggcttttaaaggaaactctgagtattaatggtactctttctcagtgtgaaggtataaaagcagaagcattgctcaatttatttttcaatactaatcttaggtttgattctatgcaattgaatggtctctgggacccagctacattaccctctgttgccacaagcattcgattatttcataccacattgaacagttatgtgattcctggtgtaaaaaagttggacatggaaatgtattctaatactagggaaagtcaaacatatactttttcacctgacttagaagacttacgtattgatttcaacttcacgattcaagtgactttgcctccaaatttgcaaaaattatgtatcacaacttcattggattctgcgaattttgtgtccccagaattagtcaggttagagtatttacagcttcagttgaaaaatattcaatcttttgatgaaaccggaataattgctcctaatttaaaaattctcgacttaacagggtgttttaaaatgtccaatttcaatgggttgaagcagttccaaagattgaagcgtcttcgtttgaaatattgtgtttatccagttggtttatttgaagaatgttcatttaatgagctagaaagttttgagtacattggaaaaggctttccagtttcgtgtgatgtcagttgttcaaggttgactattccttccaatttgaaactgccactgatttttcaccacgggctggccgatccgcattga

SEQ ID NO: 13405 - DNA, 369 bp, Candida albicans
catctacaactgagatcggagtacaacaagctattaattgaagtgtcttacattgaattgatttttcttcattctagctgtattattgataaattatacaaatgtaaaagaaaaagaaatacttatacatatttatcttttagtttaggcttcgcttacaacaacaaaagaccagcaatggctgccaagctaccagcaccagcgacaggagcaaaaccggcaccacttgatgagccagatttggcagcagatgaaccaccggtagcagatgaagcaccagatttagcagctgaagcagctgaagaaacaccagatttagcggcagaagcaactgaaaaaacaccggatttggcacccaaaagcaactga

SEQ ID NO: 13406 - DNA, 594 bp, Candida albicans
  unsure (581): Identity of nucleotide sequences at the above locations are unknown.
gagttttcatataaggtacagtttttcataatgtcattcaagaatcaatttaattttaatatatcaaagtcgacccccacgacatcaacaaataatactaatacgacaagcaacagcaattcgacatctaatgataatccacaaccaactacagcaaaaccgccacctttcatactgaatatattgttgaaaagcaactttgacagttctgtatctaccaacaattctagtaagaccccgccaaagtcgtcgtctccaagattatcagctacaggagtcgttcctgcggtcgttactattgataatggagaaccaataggtaataatacatctaatacttctacagactcatctaaaacagatttaattgggttgtttgataaattcgatatcaacaaagatgataaagaacagactaaaccagagcatgaagagcatcaccctatcacagaaaaacacgaggatgatgaagtttcacacgaagataaattagaaaaaatggtactggatgatgacggtgacgatggagagtcacataaagaaaaggaagtggtgtcagtacttcaaccaaccgggccggnaggacaagcgaac

SEQ ID NO: 13407 - DNA, 477 bp, Candida albicans
  unsure (452): Identity of nucleotide sequences at the above locations are unknown.
aatgaacaaaatcaagatgaaattattaaggatcctgtggaaataacaagaaataatttacaaattttaaaagatcaagtatctaattatatttcatttgttaaagataataaaatttcattaagtcgtgatgcatttttatatttaaaatcaattaaatctttaggtgtgaaaaaagataccataaaggattattttcaaatcgtgaccgataataatttattgaatcgtgaaggtagttggaaagttgaacaattgagtaatagtactagtactagtaatagtaatagtaatactagcaacaacagtaacaacaacaacaacaacaacaacaatagtaagagtttccgatatactaaaaatttgactattccattgactatattaaataaaaataatgtcaatttattaccaagtttccaaagttgtcttgttggtagattatattggtnttcaccacgccctggaagatccaac

SEQ ID NO: 13408 - DNA, 486 bp, Candida albicans
gacagtgaggaaaatgcctcaagtgtaccattgacagatttaacatctccaagtacaggagaaactagttcacagcaacaacgacaacgagcatcacaacagcaaccaccacaacaaccagaatcaaatactgcaaccggatcaagatggctgaattttgtcgattctttcaaaccagcaattgaaaatgaaaaacttgccatgcgttatcgtgatgccaatgcagatgtcgaagcagatgctggtggatattataattccactgaccaattaaccgagattcaacgtatcaatataaatagttccaaatcaaatttgaaacgaaaattgaaaaatagacatttacaaatgattgctattgcatcatcgatcgggagtggtcttttaattggtactggtggtgcattagccactggtggacccggtgggatattaattgcctggatattgagtgggatatctattttatgtacaattcaagccagt

SEQ ID NO: 13409 - DNA, 318 bp, Candida albicans
ctacttggtaccaccaacattcattccaatttccccttaatcaaccgtattactaataacaacctttacaataccaattccgggcatagtattcaatctggtgaaatctctaatctgtataacagaatgggcgaaccttatataaccgtcaccaataatccaaagcccgaacatattagtcgatttggtacttccttgtcaccaaattccccaggtacaaatggcccaatttgcgatacccagttcccattaacccgaatggtgccctacttgatggaatccaatattttcattccggcgcacccccaagggaaataa

SEQ ID NO: 13410 - DNA, 723 bp, Candida albicans
  unsure (44): Identity of nucleotide sequences at the above locations are unknown.
gagatgatcattcacctctttcatcaccaacatccccaaatttngacattgagttggtatgtccacatcacaattcaatattatcgaaaaacaagtgagacttcaagttcaccgcctggaaatggcaaaaagaaaagaggaagaaaacgcaaattatcactggatgatatacagatacagattgacaattataagatctacaattgtcaaattaaattgaacatgtctcataacgatgaaaagtttgatgttcgtttacagtttgtgtataaaacaaaaccaaaagtgaccactactcatcaccataaccaccccaaaaacaacagcaaagacagtaattatattaatagtggtaaccacgccagaaatggatctcaaaaccacaatggaaacggtgtcagttccagggatgccaactccagtttcagtagtaacaacaacacatctcccaatggacttgctaaattacttaacccatccccaacaacagagacttcaaatttgagaaatgggaaaacaaatcacagtatagctgcaactggatcaataataccacttgaagaagaggaggcaccaaacatgtatattacatatgacgagttgattaattatttacgagacaagatatttttcaaggaaaataagaaaaatcttcgtggtatcgaagttaaaataaactatttattacatttatgtacattcaaatgtctgatcaatgaaact

SEQ ID NO: 13411 - DNA, 207 bp, Candida albicans
tttccccaaaagtttgtattgtccctgtacaacaacttaaaatatagggacagaatcaagataagctcagttagttttaacaatattttcttatatatttctaatactgtataccccctcccagataaaaccaaatcgaaaaaaaagaaacattttaatataaatctatatgtacagaaaggtctcaaatatacactgttctgttag

SEQ ID NO: 13412 - DNA, 210 bp, Candida albicans
tgctttaaagcaacatcaactcagatcatgttcaacagtatcaaatacaagcacactatcttagacaatgagaacccattaaagggcacatctactttagttacacttgtttcttcattgagaaattcattccaaaaagcgtacttttgctacatgaattttcaattgtatgtcactacaaataagtttcttgctatgacaaatagatga

SEQ ID NO: 13413 - DNA, 243 bp, Candida albicans
ggagaagagggagagaaggagaaaaagcgagtacgaaagaggacgggagggaagagagaaaaggaaccgaaaagaaggaaagaaagacagaaaggaggaggagggaaaagagaagagagaggagaggagagaggagagggaggaagccagaggagaccagggaaggaagaggaacaagaagagggagggaacgaagaggagaaggtagcaagacaggagggacatatcccccccactctctaa

SEQ ID NO: 13414 - DNA, 225 bp, Candida albicans
tttatcttaactttgttaaaaatgctatatatgtttctttttcaaatggcaaaacctttaattatatgtatttgcttatttattagaatttatacaattgtgcccctcaacttattaatgagtagtattgattattggaaatatggtattagaacactgattgaaatattaaggatgatatttgataaagtagtctcctttctttcttataacttcactttataa

SEQ ID NO: 13415 - DNA, 774 bp, Candida albicans
aacgaatattcaattatgattcaatcagtttatccattaatttattattgttttgatatgtttattcatcataatgctgatttacaagcagcaaaatattattatttaaaagttattcaattactggggaacaaccatagcattaacttggcgactgctaacgacaataatattgatgaaattctcgaaattagttggaattcttttattcaattattatttggagttcctagtcgatcagttgcaccaaaagggaaatttaatgaattatatgtatttgcaacattaaatttaacaattttattagattatgaacatggaattttaaaagataaaaccccatcatatgcaattcaattaaaacataaatgcttagacgatttacaacaagcttttaaagattcggaacctactattactaatgcatttaatcaaaatttcactttaaaatcagatattttacatataacttataatttagtacttaaagtattatttgaaaaacaagttgatttagaatttgatactaaattaagacaaatgttggaaacattaggtgataaatcatcatttgcatttttttatattttaataatgtatttattagattttaaaatcaaggaagaaggacaaaacagtactatggagaaacaaaaaaatttattacaacaataccaagagaaattaaaattcgataatgatactgaattaatatgtaaattattaatactgaaaattttatgttttcaccacgccgtggccagaccgaattga

SEQ ID NO: 13416 - DNA, 264 bp, Candida albicans
aattgccgtgttcttgtgtggttacatatgttacaagatgaatttacaggtacaaaacagatgaaatacaatcaacaattattgaaaccaagaaaaaaaaaagatagaatcttgtttagtggatattttaatatttttgtgtgtactaaactgcgcctctctttattgaacaagtttatgaaaacaactaatacctcaacacaaatggtatttggtgaaacaattacaacgcactacaacctggtaaacaaagatgccagatga

SEQ ID NO: 13417 - DNA, 468 bp, Candida albicans
tattggttttctcactacaaatacgctataattaatcctagcaaactattaaaaacaaggaaaattgaagaaagtacaccaccattaaccaagtctccaccatttttctttttcgaggacgaagaagatccccgtttacgaagaactccatttgaagatgatccggtagtggtactggtttgttgggtcgtagaaaatgtaccgccacttgtgtgggttttagctgcaagtcctgaaattccactaacactagagacagaggcagcgtctttgaatccaccagtccaacaatattcttggaaacattttttacattcatcggactgctcctcacctaaccgttcttgttgtcttctaattattgcacagccaacacacgttgaccaattttcgtcgtccgttaaattatatcttgttaccgtttcaaacccattcctgatagcaccaaatttctcttggtcagaataa

SEQ ID NO: 13418 - DNA, 306 bp, Candida albicans
  unsure (30): Identity of nucleotide sequences at the above locations are unknown.
ctaattactcatttactcatttaccctttngtccccgaaattgactcacacaaatttcatcatactactgttaactactcactactacttactaaccaacgcctaactaagaaaaaaaaaatttatttctccatattaacatattggaatatatttaaattaaatttttcaccctctttttttaaaaagcaaataaaagtaaattatttcaaattccttatttttctttttgttttacttcttcttcttcttctttcttctttacagattcaaactattaattcaaacaaatatgatttctcgtaa

SEQ ID NO: 13419 - DNA, 207 bp, Candida albicans
gcggggggcatcattccaacgtggtggtcatcctggtactggtggttctcccagcactttctttcaatgggattctaccagttttcaataattcttcacacaaccattagtttgaagttttacccagtggctgaagatatggcatttttaacaactttaaaagaattcccaaatactttttactgtgggttccattggctcccttga

SEQ ID NO: 13420 - DNA, 201 bp, Candida albicans
aatcgttacaattatctttttttcaattgttcacttttttggtggcttagcattcacgaccatcacctaccaacaacaacagcaataataaacaacccacaccaggtcagtaatacatattatcttttgtatccaagaattttattaaagtacacgatcagtaatgaaattttgcagatcaaaataggagtgtggccgtaa

SEQ ID NO: 13421 - DNA, 258 bp, Candida albicans
aaaatatttgatgtcttaatttacacgcacgcaccacccccacccatccatggtagatttgtatcttctctatccttcggtctttttctctcggagtttttcaatacgttgaattttatggaatctacacacacacacacacagacccaacaactactaaaaaagatctacaacttcaacaacttattaaccattgactattgtgtgtattattattatataaaattaaaaaacgggataaaagtgtatagaaaaggt

SEQ ID NO: 13422 - DNA, 183 bp, Candida albicans
tttgctgctctatcagattggttttcaaaagttgaattgaaatacgattcccgatatcttaaaagttctagacgaatactatttgtacaacgttcaattaggagtgtgaatagacttcttaacgaatcatttggtcaactggatttggcagtaactttgatttgcacaccttgcacgacttga

SEQ ID NO: 13423 - DNA, 231 bp, Candida albicans
agagacaatcaagtgaagactttgtattttgaaatttttttttttagatttttcagtcactatagattattagttgacagagtcaaattattgttggatctcgatttgagatggaaaaatacaattaacatcaatttaatcagaatttcgcatctaatccaaccgaaaaacaataaacaaactgattgtagtaatttatctagcaaagtttcttcccacaaggataagtag

SEQ ID NO: 13424 - DNA, 219 bp, Candida albicans
ccaacaacaataactgagaatagtgtcaatctatattgtttatgcaaaagaatcaacaaaacaacaactcataacacacacgcggctaagtatagtcgtatcatatttataattctacaaataaggtcaaaaaataaatataaaaaaccaaaaatacgaacacctaaattattgtttattgtaagatctatggctttgttattgtatatatacaactag

SEQ ID NO: 13425 - DNA, 567 bp, Candida albicans
acgttgatctccatcgctggtgaagaccccgttagcgttaaagatctatccttgaatgaaatgggcatccagaaattaccagattcatttgaaaatttggaaaacttaagaagtttgtctttatttgaaaaccaactaagaaaagtaaactctttaaaattgccagtgtcaacattgcagacattgaatgtttgtcgatgtaaccttcgtttgatatctccatttttggtttcaatgctcgaggaaaagaacaaaaatgcagaactaaaagtttacgcttcgggtaatacaaatattagtgtcattgatataagaacagcattgaaatcaattaaaggactttcattagaggtcgatgattttgataaaacattgacagaaatatcaaaacattcttctcgtttacaatgtaagtattttgtatatgatccttattctaaggagtctaaatcttctgcaacagaagaagttgcccttgactatgatccagatgatctttacgatggaagtgatagtagtctggatgaagaagatgccggtggtgatatcaaaagaagaaaaatgtaa

SEQ ID NO: 13426 - DNA, 204 bp, Candida albicans
cacaaatcaaaaaaaactgttttaacaattggcattgtcattgttgttgttgccttagttatttttgacgatgattttataaaaattcttactcaaaaactagattatcaaaataaaaaaaaaaacattagatgtgggccggtaaaagttgatcggaaagaatggatacttgcttacttacttgctagttccgttaatagttga

SEQ ID NO: 13427 - DNA, 183 bp, Candida albicans
cctttaataccactccaactaacacaactttcaaaaaaattcattcttggtgttgctgttgctgttatggcacttcatatgaaaattaacaagctaactttaaatccaaatccaataccacaattaagtacgcctcttttttgtcgcttatctccactaccagtagattatatttgtatttaa

SEQ ID NO: 13428 - DNA, 324 bp, Candida albicans
aggctcgtccttccagctgcgggctataagaaacactgcctaatggacgccgctggaaccaccaatgctgaagaaacttctgctaaagaaaccactgctgctgaaacttccaaggctgctgaaagttctgcaccagctgaaacttctaaagctgaagaaacttcaaaggctgctgaaaccaccaaagctgaagaatcttctgttgctcaatcttcttcttctgctgcagacgttgcttctgtttccgttgaagctgctaacgccggtaacatgccagctgttgctattggtggtgtcattgccgctgttgctgccttattctaa

SEQ ID NO: 13429 - DNA, 327 bp, Candida albicans
  unsure (8),(139),(145),(191),(192),(193),(284): Identity of nucleotide sequences at the above locations are unknown.
ttcaaatngaatgatggtgccggaacagaaaccagaatcgaaggcacattgcttgtatgtgcattggcactcgcattcaagggagttgaagatcctggtgataacgcaaatgctgctcctgtgcctgttcctgttgtantaaagncacaaaaagttgatggattattgtcatttggttgggaaagataccnnnaaacttacccgaaatttcttcttccatataacaacaattttcgaaaagctttgataaggcccaacttgaagaagacaagccgatgtcctanttatattggctggtggttaaatttatcgacccacacttgttga

SEQ ID NO: 13430 - DNA, 243 bp, Candida albicans
gtcttcaatgctgatccccatatactacagaaaaaaaccttggctggtaaacagattagtcctatttatgtgtgtttgatatttcttgctaaaattgccaaaaataaaaaaaaaaaattctcatttgaaattcgatcatcaacatctttcatttgtgattttagaagttttcacactaaaatattccttttcttctttacagtagttgtcttcaccacggcggctggaaggtccgcgacttgg

SEQ ID NO: 13431 - DNA, 219 bp, Candida albicans
ataggactaatctgtttaccagccaaggtttttttctgtagtatatggggatcagcattgaagacttatatatttaatatatcaatgaaaataatatatcaatcgagaacaataacaagagtaaatgaaaagctttcgtttgcaccccctatgtttaatagagaggggggtcccatacaccaagaaatgacgaatttcaagtttgtgatatgtaggtga

SEQ ID NO: 13432 - DNA, 750 bp, Candida albicans
aaattattaaccatgttatcaattgttggattacaattaactgcatttaatttaggtttggctcaaatcactacggcaatattatacccattatgttttttaatttataatttgattaatttgattaatgatttaattttcaattcattaataacaagtcataaaatgacttggttacaattaatatggataattattggattgattggtgtgttatgtggagtagtaatattaagttgggatagtgcattcaatgtgaatcaaaatcaaaggaatttgaaaaatggccatgaacgtgggattggaattggaattgataatgataattataatgatgctgatttaatcagtatgaaattcccctataatagtggtactggtaatgaacatgatggtaatgctgatctgaatcaatcgtatttgtttgatcgtgttgatgaacaaacggagttacttgaaggatcggggtcaagatcaggctcaactcctctttcttcttcttcctcatataattcagcggataatggttcattgaaagtctataaaccatatagtgatgaacccacaaaagatcagacatctgtcactattgcacgacaaaatgaacaagaagctaatattgaggcgttgattcaattaaatgatgaagctgccattgatgctgaaatttccatgttgtctaataatagtaataatcatcgaatgtcttttgaacaaaatcaattattaaatctgttagatttgaattaa

SEQ ID NO: 13433 - DNA, 186 bp, Candida albicans
cgggaggagacagtgagggaacgaggcggagggagagagtctcagggagatgagatgtggtatatgacaacacaatgtttgaagctcaaatgtccagggagcgagaaaatgggcgaatctcagagaaacagtggcgacacgatcctaaagaggaggccatttaaaggaacaaaacttgttgtttaa

SEQ ID NO: 13434 - DNA, 492 bp, Candida albicans
tcttctatcatgattggtatcataattcaccacattttagaaatcaatattgcggaatcaacaaattcagagactaccacccccaccaccacaatcgatgaataccacttgagattagtatatgcagtacacattatgatgtttcagatgaattcatcttctactactaattctacgaatcctgtattttttgatgctgataatgagttttacagtcaaacgtccgataacacatatgacgagctttttgacaaccacagcaataataaacaaaatcactatactatgatagatttaaatcaacaatacacagttcctgatatttcatcttctcccaacgttgaagatcttacaatgctaaatgcaaccaatgctgaatgcagttttatagttgaaaaaatcggaacccctacagctatagacactcatgatataatggaagattcggaagacgaattacctataatcagtacaaatagtatgtcaacttag

SEQ ID NO: 13435 - DNA, 405 bp, Candida albicans
agttggatccgccagttcgccggtgaagacgcctcatttccaattgtgaaatacgaatcacatgtgaattcattaataactaatatgaaaaataaatgtataaatctgaatgcaatggtatatttattagggtatttggacacaaaataccgaccctacaaagcagcaacaaagcaagaattagtagaatcatacaattcgatgtcgccgacaccgtcctcatcttcactttcatcatttaatgaaaagggaagagttgtattatcaccatttaaaactcacaaaagtcttgatatcaagttaatcttctatcatgattggtatcataattcaccacattttagaaatcaatattgcggaatcaacaaattcagagactaccacccccaccaccacaatcgatga

SEQ ID NO: 13436 - DNA, 285 bp, Candida albicans
agtgctactaccctcacaagtgtttcaggtgctaaaccatcagttgctaacgatgccactaacagtgtacacaccactgattatactactgccactactggcgtccaaaatggttccagtttgtcaattccatcagacatccccattgaaatttctgacatcacaccaactgattcttcttcttcggcagttaccatttcatatgaaaacggatccaataaagaactgattgaaaatattaaatacttgacattggtagttttcggattgatgatgtttatgtga

SEQ ID NO: 13437 - DNA, 210 bp, Candida albicans
ttttttcttctcaaatgtattattaggaaaattcaatacgctatggaagttgaaaatggtaatattcttatcggtagacaattagtttgggacattcctcttattagtgttagtgaactgacactgggtataagtaatagtggaaataattgtaagatatgtagagctattaatacctcttgcacgacatgtagacgtctgttctattaa

SEQ ID NO: 13438 - DNA, 402 bp, Candida albicans
ggtaacaattccagtggtaccgataattcgtcaactacatcgtcgtcttcatctacagcgtcaatatctgtattattgggtcatttgaaacttggcaaagataacaatggtaatcccactgccgcctccacttccaatttgaatggtaatcatgacaaacatgtaagctcccgttctcataaaatttcacatcagcatctggttcatcgtagccaccaccatcatacaaatcatcacattaaaagaacaggcactttccatggcgtaagtgtgaatgaccccgaatctagtaatagtagtgacgttggaagtgattatcgttcattaaatgcaagtccagtttcaatcaataatgaatcaggtggtacttcgtctttaaaattttggtcaagaaagaagtaa

SEQ ID NO: 13439 - DNA, 753 bp, Candida albicans
ggcggatccggacagccccgtggtgagagcactacaaaaatagctgatcaaactttaaattcaataatacgatcatattcacaattaaaccaaaagaaaccaattaatattgaagatttcaagttgaatgaaagacagaaaatcctattaggctattatatacgtaatgactatacagtaggtaccaagtttgttggaataaatcctgtttttgataaggataccaagattaaaatagtcaaattattcaacaattcagatataaaattgccaataattgaaaataaaaccaaacctatagaaagcccttatcaattaacaaccccggtgattaataacaatttaatcaatagaatattattactggatacagtatggagcaaacttggacgatctattcaagataatcaatatgttggcggtatgaaatattctcattttatcaatttggcaattttaaaacatttatccaaacaatttcgatctcaacaagacattttgagagaaattttgacaagtgattcttttaaaatatatcttcaagattatttggaaatcgataattttaataaattttttggatgtatgtcagaaactcagaaattacaatggacgaatgaattgatgttgacattgattaaaatgattaaaccacttgatcttgtttcattagaaagttttccccaagaattcaaattacaaacacttaattattccattgctaataccacagtatctaaccacgagacttga

SEQ ID NO: 13440 - DNA, 198 bp, Candida albicans
tgcaagtgcggctccttccagcgccggtgggtgaagaaaacccttggagaattgtcaaattgggattcacaatcatattcacctggatttgatgatgatgaacttgccgaattacaatcaacattgaatttacgtaaaatcaagctctcatctaatttattctcttcaatcaatgatactttaatagcatctttataa

SEQ ID NO: 13441 - DNA, 942 bp, Candida albicans
tccttcgagccgctcgtggtgaagaatagcaataatactaatttgcgtccatcaattcattctgcgccaataagatcaagagcaccaacaagaccaactccaagagctattcctccaacaagaatagtgccacaaatcgccatacctcctcaaccccaatactattatgtttcaactccatatcaacaatattatcctgcacaaattgtcggggcaacaccaacacagccagttttccaacctttacctagaagtcaattgcgtcaagttaatccaagagtaagaatgattccattgagttccaccacaacacattttggaagaagaactttgcaacaaggaccatcacaattaccaccaggtgccatattacaacaacaacaacaacagcagagtttacctctacaacaacaacctcaacaacaaccacaatcacaacaagcgatatctttacaatcaacagcaccaaaacccaaaccaaatgcagttactgatgtatttcgcggtgatttccataaagctgctccattgcatagtcagccattatctgctcaacgagaatattttgaaaattcagtacatgacgaacctcctcaaaaatctcaagttataagcattgctgaatcacaagaaatatctggaagtattaccattaatggatcaaatgttttcaattttaaaattttcaacaagaatgaggaagaaaaaagtaatgataatgaagggacttcgaaagataacacaagcgggaagaaacaagaaggaactctagaaaaggaggaagaaccaacagatgaagaagggaaaggagagtctaatgttacagaagaaaagactcataaatctactaaactggaagatctcgaagaagataataaaaagaaattcttaaaaatatgtgaaacttgctgggatcaagtgtttaataaacgagatgattaa

SEQ ID NO: 13442 - DNA, 777 bp, Candida albicans
  unsure (737),(744): Identity of nucleotide sequences at the above locations are unknown.
tgttttacaaccatcttatcacacacttattctcacgtcatagtactcaccatgtacattaatcaatacttaaatatagataaattaatattttatctatcgtgtacaattattggatggttactgttttggtatatcattttcaaactaactggattccatcttctgaccatcactataaacaatgggatactgttcaatggaatatcatttcacacaaaacgatatctaatatcggtagggtcattgagatttagactatggggtaatagtaaaatgaccatcattgatgacttaactatcaagttattgccaaatgtgaaaaataaccaaaaacaaaatactcaagaaaagcgcaatgactatagtttcaaagatcctactgctccagtggtcaatatattccctcaaaatagaattggcaaatctgtggtctctagacttattcgacacctcccgaaaatgaatttggaactaagacaaaccgctattatcactccgtctgagaacaagactataatagagtatttaaaattcacaacaagctcaaaatacagtaaacgttctaatgaaaaaattacatttaaagctggtctttatattaacaacgtacttcatcatttgaagacaaaaggggatgtcatcaagccatttcaaattgggggtgctagttttgaggccaagtttctgattaattttgaaaccggggtattagatgatttgagaaccagagtgtnttcatcncgaagagcacggacagcgcatattctcccccat

SEQ ID NO: 13443 - DNA, 204 bp, Candida albicans
tttgaatttcattttttattgctctttctttctttcttcctttctaacaagatctttcatttccttataatcttcaacgaatacatatattatattctgagaacagttcaatatgtcatcagaagatattggaagttcaagttcatctcttcaagagtatgttggtcaacagcaacacaacaaaatacaaccttccaccgatga

SEQ ID NO: 13444 - DNA, 231 bp, Candida albicans
aaaaacatcgaaaagggcgaatggtctagtggtatgattcctcgtttgggtttgtttccgaacattaaaattcgaggaggcccggggttcaattccccgtttgccccaactttttttttcgctttctcttactatttttttttggtagagagtcttctcaaaccacaatgtcctcgtgagttgaacaatgtatattatttgatagaattaaattacaaatacttctactaa

SEQ ID NO: 13445 - DNA, 387 bp, Candida albicans
tcaccatctttgccacttaatgtattcataatatctagatcaggatcttcaggtactaatttgagtttttgcgatgttctactagttctttgtaatccaattttattagatttgactaatttagaatttgttttagcagtattagatgaaggagataatgttggttgttttagtgatactaatgatggtgttggagtaatagatgaagttgaagccgttgttgatgatgatgatgacggtttggccagcagttgtgacgacgacagttgctgcgtcgatgaaggtaatacgattggattctccgggatttcagaacttagtagtggtgttttatctgtattattgcttgtcatattaagtatatatatatatgtgagtttatattaa

SEQ ID NO: 13446 - DNA, 384 bp, Candida albicans
attatgagtattttaagaggacataaattaccaaaatcatccaagattttacttggattattaactggaatatcaatattattattagtattaaaatatcaacaatttcaatcattacaatcatcactggaggaaatcaaacttcatgatgttaaaatttcttttattcaattaattccaagatcaaccatatataacccttgggttctaattttgtcaatatttgctgaaattagtataatatcatttatattttcatttgtggtgttatatattggtagtaaatttgctgaaagattttggggtaattatttagaagtaataaaatttgtgattatagttggtagtataactaatttaatcacggtgataattgctattatt

SEQ ID NO: 13447 - DNA, 252 bp, Candida albicans
tattttaatactaataataatattgatattccagttaataatccaagtaaaatcttggatgattttggtaatttatgtcctcttaaaatactcataatctataatgtctcaaccctcttcccaaaaaacaaaaaaaaaaaaaatttgcaattaattgaaaaactagtagatttggtatgttttatagaaattgaattagtatcttctgttattgttgttgttattgtttactctttgtatgggttggtatag

SEQ ID NO: 13448 - DNA, 339 bp, Candida albicans
  unsure (311): Identity of nucleotide sequences at the above locations are unknown.
ccaaacaaacactatttttacatctttaagtattcaataactgttgtgttttataccttctattccttccccttttttccacctcaaactccatcactggatatatacttctataaattaataatgggaaacaatacttctacagggaatttccatagttctggtctgaacaagcgtcaaggaaatagttcagattcaattagaaagtcatcagcttcggtaaattacaacaatagtgtcgatagttctagtgataatagagtgagaaaatcaactgctaacaaaaatgctaattccctcgatgaagagtntagtgatttaatcttacatcaagtggtc

SEQ ID NO: 13449 - DNA, 192 bp, Candida albicans
ggattttcaattaccaaaccaaaccaaaccaaacaaagcaaaaatggagagagagaaaaagacaattgtccgatagagaaagagaaagagaaagagaaagagagagagggaaattacggtgcaaataaaaacatagaaagaaataattcagggcaacttaagtttagttatactttttgtcaaactaaataa

SEQ ID NO: 13450 - DNA, 240 bp, Candida albicans
atacttaaagatgtaaaaatagtgtttgtttggttaaaacaatttatgggtagttttacttcaattcagttttcttttttttttttttttttttttttgagtttgattttgaggattttcaattaccaaaccaaaccaaaccaaacaaagcaaaaatggagagagagaaaaagacaattgtccgatagagaaagagaaagagaaagagaaagagagagagggaaattacggtgcaaataa

SEQ ID NO: 13451 - DNA, 474 bp, Candida albicans
cccgtggtgaaaacaggagaagtgatggctataaaaagtcctttattatcaaaagccaaatataaattgccagctatatgtcctggaattgaacttgaatgcaaagatttgtttatttcacgtgactgtctatacctgattatgaagtctgctatcaacttgaagttatatgagtacgtcgatttactatatgataaaattgtattagactcgattgatccacatcgaatccaattaaattatgaagaaaaacggttagttgaaggatcaatttttacaccagagttgtttttaatcatgttggaagcttgtaagaaatccaaagatttgggtagagtattatggttaatgccctttttggatgaatatgtgggcaaaaattctgtgccagtcaccttgaagaattcaatcttggaagtactaaagacttttaatcttgaagggaaacttgtttcatatcaaaaaatcatgtaa

SEQ ID NO: 13452 - DNA, 249 bp, Candida albicans
attggttcatattttccaagatatatatatcagcgtcaatttcttcacattcttggatacttgtttgaacaggcactaactatcatgaaggccgctgttgttccaatatccattaaggataattatttaactgaaattaaagatatcccaaaaccggaaattaaagatgatcaaatcttaatcaaagctaaagcttgtgccatcaatcgaactgattggttttcatcacgagagccggcaccgcgctag

SEQ ID NO: 13453 - DNA, 186 bp, Candida albicans
ttgagaactttttatatgagacttcatataagcgcagatctcactctatcaaaaagttctccaagtgctaccacttatgttcataaaataaaattgttgttgcacaataaacaacgtcaaatatcatacctaattgagaatggtcttaatgtgtctatatatattattcaagcttattcttcttaa

SEQ ID NO: 13454 - DNA, 234 bp, Candida albicans
  unsure (8),(78): Identity of nucleotide sequences at the above locations are unknown.
caattaanaaataaaaaaaaaaagcattatcccaccatcatcatcaactttaatcaattcctatggaaatctagcatntttttttatattaaactaatttccaaatttcatcatccctccccttcatccctccctcccttcatccctccctcctcccctttccttaatttaactttaagttacaaaaaaatttggtgtgtattaatggttatttggaatgataaattgataaat

SEQ ID NO: 13455 - DNA, 354 bp, Candida albicans
tgttattcgatgggaaaacttcaaactgaatctatctcaacaagtcatgaaacttcatcttatgatttgagccatgatataacattagatcaagaaagtgaaagtagtaatagtagtaatgatgatgatgaaggtgaagatattggttttattgaaactaaagatattttacgaaatttatccttgtataatgactatcataacaacaacaacaaccacaacaacaattctgcagatagaactggtgcgagtactactactaatactggtactaattcttttaataaaccaaatggatttcatcaacgtacaacatcagtgtctaataaaacaatagatcacatcaatatataa

SEQ ID NO: 13456 - DNA, 363 bp, Candida albicans
aaatctcataagaaatcatcatctgatgtatctaatttacaaatccaatatcctcctcaaaaatacaaatttaccccaactactatcaccaccaccagcggcggtaccagcagcggcaccaccagcaatacttcaagaagagacgataattcaaaagctcaaaagaaatcaaatgtggaaaacaccagcaatggtaatgaattacaactgaatggtaatactaatagtcgtagtggtattcatagtggtataactacatttacacctacaccaacattgaagaaaaaacctgtaattagaggtagaaaagttagtgaattggctaaattatttgaagaaagaagtggaggtattgaaatttta

SEQ ID NO: 13457 - DNA, 195 bp, Candida albicans
gttgatgagattggttttggttttgattttgattttgatttagactttgaaactgacttagaagtcgtggaagtatgtagtatatttgaaaataatttatccacagtattttctgcttggtatttagatgcgttagaattgaatgacattacaatggtcagtaggtttaacagattgattgatttactcacgtaa

SEQ ID NO: 13458 - DNA, 747 bp, Candida albicans
agaggaaagaaaaaaaaaatatctaaacctcatctcggaatattttcaagatccagttacgtgagtaaatcaatcaatctgttaaacctactgaccattgtaatgtcattcaattctaacgcatctaaataccaagcagaaaatactgtggataaattattttcaaatatactacatacttccacgacttctaagtcagtttcaaagtctaaatcaaaatcaaaatcaaaaccaaaaccaatctcatcaactcaattacttgtgaatcaactacaatcaacaaatactactgccaacaataataacactaaaaggaaaaaacataataataataaacgaattaataaaacattattagaagagaaaaaattttcaaaatttattaaatataatcatattaaacaaaaatcaaataaatcagaattagatgaaaaatatttaaataaattagttcggaaaaatatcaattcattaaataaaattaataaaattgatgatttattaattgatgaagaattaaatcaaattaaacaagaattgttagaagaaaatgaatttgttggtatgggtggtggtcaacttaaaggaggtaaacgattacgtaaaaaattgttaaataatactaagcaagttattgatgaatttgatggatttggagagataagcagtagcaacaacaacaataagaagaagaatagctcatatcctggattaactcctggattggcaccagttgagtacgaagca

SEQ ID NO: 13459 - DNA, 519 bp, Candida albicans
agatgtccttcgtggtgtgatagaatattgtttttatctacgtatgaaacgataggtaacgatgatttgggattacaattattgagagcaaaaggtaaagactcaaaacagaaaaacgaagggctccccgtggtgggaaaatatgattgtattgatgaattattattatctgatcatcgtcctgtgtttgcacatatcgacataccatttgcaccccctaaactgattatatcaccaatgtcaggctgtttggaaatagtttcaacagggttaactctggatgaatcgttttcggggtttgagcagttacagggaatagacaataatactcatatagagagtggtccaactgccatttacttgaaaccaacaaaattagatcttctaattcatacactcgttacaccctttatggatacgaccatagggtatgggctttggtttggaacaacaagcgagggaagattagtattgttgatatttgcattgttatgtttttcattgtggtatcttttttag

SEQ ID NO: 13460 - DNA, 207 bp, Candida albicans
aggttagttgacggggagtgtgatatttgtattatggtatgtgcacatactcatccccccatatcaggtatttttttttttttgttaagaagagattgtacacctaaagtataccactatttgttaacaaccaactacatgaacggagaagagcaagttgacaattatgatgagtttgaaatttactgtctcttggccacggaatga

SEQ ID NO: 13461 - DNA, 672 bp, Candida albicans
gaagactcagaattcaaattaccaggccaagaaccaagtggattttcatcattacctaaaagtcctacccaatatcaaaaagtcaatgaaaccatggaaagattaaattatactgctagaccacaatctgatttatatccaggacaatataaagtattacgtcgagtcgatactaataaacgattagatataggtaatcgatatcttggaacttttataattggtagtgttattgtttatggagtttttttccatcgttggaatgatggtagagaaaatgttttcagtgatttttatcgagctcaattaaaattaaaagaaaaattaatgggtggattaaatgaacaagaatatgatgatttatatcatccaagagatagtgggattgtggttagaaatgttagagatgctcaatatattcctgaagatattaggaaaactagtgaaactaattataatttaaatagacctagtgaaagacatgttttagaagctcaaagaattcaacaagaacaagaagaaaaaatgttgaaagaattggattatcataaaaaatttgctcaatcagtattaaaagaagaagagattgatgttaaggaattgcataatcaacaagaagcaacgaacatcacagctgataaaccaaagaagaaatggtttggaattttttaa

SEQ ID NO: 13462 - DNA, 309 bp, Candida albicans
gcgcggggtcgtgcgacttacgaggtgaaaatgcttgaacttaaaagaatcttgattgaattgaacaagaaatctccttcactgtttactgctatttctaacaataacaataacaataacaataatggtcataataataatccagcattaaatttatttaaaagtttacattatgattctcgtgaatcaatattaagattattaaatcctcaaccagataaaagattaactcctaatcaattattgaatactaattggttatcacaagtttatgctgatcctaaagatttaataaaattattaaaatga

SEQ ID NO: 13463 - DNA, 459 bp, Candida albicans
gtactatgtttctttttaaacttgaactctttctcttattataatctgttgaactattcatctttaaaatcaataatgaagccacctcaaagaaaagaatataatataaagaataacaatcataatcataatcaatcaaaatcaaacaccaacggcaatggcaatggcaatggcaatggcaatggcaatgctaattccaatacaacaacaattatgaataataatcgaaaatcatcaatgaaaaaatatcgatcaatagctacacaaacattacctaatttatcaacatcatcacaattgagtaattataattcacaatataatgatatcagtgaatataaatattcaaattattcatattattataattcattagatgaattatttttacaatttgaatatgaagatcctgaacttgaatatattgatcaatttattaaagagaaattgagtaggtaa

SEQ ID NO: 13464 - DNA, 204 bp, Candida albicans
actaggaccagtcatcaacaacagcgaacacaccgtcattttgtgtctatacaagataggatatcaggtatttcagagtttgtagctactttcaatctctctctgtgtgtgtatctctatttccatctagtttttgacaacattactaaactaaggcaattcagaaatcttttgtggcttatagttttagtccaagcaacttaa

SEQ ID NO: 13465 - DNA, 258 bp, Candida albicans
atgctatatataatatttggaatacttattgttcgagtaacggaccaaactaacccacatttcctaaaagaaagaaaaacaaaagaaacaaggaataataataatatatttgagatccttatgacaagaaaggataataatattattatcattaaaacagtgtcacagattgtggtcctcttaaccagaaagctagttggatcgataacacaaaaattgcagtttggacttcttcaccaggcgctggaaggagccacg

SEQ ID NO: 13466 - DNA, 192 bp, Candida albicans
cacaactccaatattctaatgttcatttatttagcttggcacaaagtttcattaactttgtcttatcagtataatcaagcacaaggaagtgaaaataactttaaaactttatactttgttcaagcctctggttggagcatacatcaattcaaacaccccattctccttccatataataattgttttacttga

SEQ ID NO: 13467 - DNA, 246 bp, Candida albicans
aatactttgtgttacaccaaaaaaatcggtttatatttagaaacaatacaaacaaaaacaaagagaaagagaagaaaaacggaccgacaccatgtagaacaatggggcacaattgaagagaataaaattaaagagaaaccaagaaatacaaaggacaaatacaaaaagattattggtggtcacacactgtgttgtgaagtcatagaatacactcaattgtttttcttgatctccatcagcaaatga

SEQ ID NO: 13468 - DNA, 360 bp, Candida albicans
gcgcggatccggctagctccgtggtggacaatattagcagttcaatatccaatatcaaaagttcaaaaaattcatttatcaaggttagaagcattagatgtttataatgcatcacgatttgttggtaatacttcaccattttttaaattatattataattcatatgttgatacttataaacaagtattacgaatgaaacaacgagctaatataacttggtttgaagctgcttattccggatttgttagaaatgctttgactactatcccagctacttcgattgccttattagtatttgaaataatgagaactaaattaagtgataattttgaagattataatgatgttcttgaagcgtaa

SEQ ID NO: 13469 - DNA, 210 bp, Candida albicans
tgtgtgttacgcaagcgtggttccttccagcgcggtggtgaagactattttagggtaacaactttaaatagtaattctcatgattttgattgttatacaaatttgcaaaacagtattcattattttttcccccatgtagaagatcttaaatcatcatctatctattcgcaacaccaacttaaaactgtattatctaataagttcagataa

SEQ ID NO: 13470 - DNA, 201 bp, Candida albicans
gcgttcttctgctactattattgctggtcaaacacaaaacgcattgttaagattaatatcgattcgaattcccacataaatttaaaggttgatgagaccaatagacattgcgttacgcgtttaatagtcttggaccaaattagaaaagtaaacaaatcacagcaatcttgtctttcattgactttagttcaatgtttgtaa

SEQ ID NO: 13471 - DNA, 348 bp, Candida albicans
gagaatatccacattcacacacacacacacatacacactcgaatatatttatttatttttccatatttgcttgcaatgacagacacatctgaccttaaaccagaacatacagagaaggctacagggctctctacttctaaggaagtgcctgaatccacactcacacaaagaaaacaaccgtccactccagctacacagacttcaaagcgtccaactccagcaaagaaaaaacgtgcatttatcaatgtggctccgctaaataccccattgtctcatcgactcgaaacatcgggggcggtttggctttgttattgccaccgccggatggaaagacaggtgcttccccta

SEQ ID NO: 13472 - DNA, 576 bp, Candida albicans
tgtgcctatgtggattacacagaagaccaattgaatgagtttaagaaggcaaagattttacaagaacaacaagaacagcagcaagaacagcaacaggaacaagaacaacagagtgatcaagaaacaaacaatcaacaacttttaaaaacaaataaaaaggttttaaaaccaaaaaaatcacgtacagtcccttcatttagctttggacgagcaagctcaaatccttctgtcccatcagttctggctactggtacttccacatcatttacaaatcaggagttgcttcaacaacaacgccaacaccattctgttcccaatattggtacgaacttcaatacaatggcgttgtcatcttcatcgtcttcttcacaagcatcttctgtcgttgctgatgacgaagtcgttgagccactgcctgtaccaagaagcaataacgaatccagagttaatttattacctgaaggaaatgatttccaaattttgttcccagcataccctgatactgctgatttcccaccaactataacacctagtcgtcttcaccacgggcggctggaaggacccacgctcggtcta

SEQ ID NO: 13473 - DNA, 369 bp, Candida albicans
ttaaccgttgcaactcataacaaaaatgaatcttcaacatttgaaactgagagtactggatttgctattgaaaatggttatttatcctataagaattctactcactttttagcatgtccaacaagttcatcattaaccaccaccaatgataccattgttggtggtaatggtaataattttacaaacagtagtattaatggagatgctggatttgaaatttatgctaatccaaagggtaaaactacttgtccaaagggaattgaaggttatgatattaaattattgactgaattgattgtcacttattcatattcggaaaaattcaattctaatggatttttcaaaagacaactttccaaagatttataa

SEQ ID NO: 13474 - DNA, 189 bp, Candida albicans
caagatattggacatttacgtaaatttgaagtcattagatatttacacggatttgatattgaatataataatcataatgttttactggagattcatttacgaaatttattgaaagatcgattaattattgaaatgaattatttgaatggtggtgtaaaaagacaaagtgttccaaagcaaaaaaattaa

SEQ ID NO: 13475 - DNA, 195 bp, Candida albicans
caagaatcagacaccaaacactgttttggaaacatatttaagggatgggatatccttttcagtttccaacaattctacttttttttattccgtaacaatcatattataattttacattgccccaatagcaatacatatacttacatagaacttcataatgcatcttcaccacggggctggaaggacccgcgctat

SEQ ID NO: 13476 - DNA, 240 bp, Candida albicans
agttgctatttttgttacatcaattttcattttaggaaatttaccgagtttttagctcgtttagttgttcccaatcgcatcaatcttataaatcaaaatagtttactcaacagcctgtcgccatcgccgtttttccttgccgtggcatttttccgtggctactttttaaggttttgttttgtgtttttgtacaacaattatgggtgttgctaccaattaatcacaacggtaaaatcctaa

SEQ ID NO: 13477 - DNA, 234 bp, Candida albicans
tcacgaaaaaaaaaaacaattcaacccaccactcacaaactgacacgccaaaaaaaaaatagcttgatctcatacaaaacattcttcattgtaaaacaacacatcacatcacatcacactctttatatcatgtcctttgctgaaagtttttggacaccagactatgagctgggatttcagcaactatttctccaattgaatcaagggatcttggagaccaatgactttgtgttt

SEQ ID NO: 13478 - DNA, 198 bp, Candida albicans
gagaaacaaaagaaaagattgaaacttcttgatgttaagaaaaaaaaaatccaactagtcgtgctaaattacaatttgcttattggtagatcggaaaaaaaaattagttgtgttataaagtcattttttttctctgtttctgtctctgtctctagctttcaggtcaataacatctgttcagttgataatcagccgtga

SEQ ID NO: 13479 - DNA, 426 bp, Candida albicans
aatgatcaaggttcaaatcaaggtaaactctcaattacaattgctcaacataagcataatcattatttgtttgctcaatctaatagtttatatttatcaatggggaaagattctagtatttccattagtttcccaaatccggttttcactattaatcaattttcacgaagtttaaattatcaagaaacaaatatttatgtaaataatttgcccattgtatttaataatgatgattgtacatgggaatcattttggggtcaatttggaattattaaatcggccaaaattattaaacctcaattttatcatgaatatgaagatgatcataaatcaggtaaaattggatttgtgttttataaaacatttaaaatggccattagagctatattaatgacaaataataaagtggtcaatgctggtcattgt

SEQ ID NO: 13480 - DNA, 183 bp, Candida albicans
gcttttaatgtaattaatgcaattccagaattaggtatagcatacccgacaattaattcaacaagaacatttaatccaaatgaaaaccccgtgacggatgcaattgatgttaagggaattaaaaaaatgaaattaatggcaatagtgaaaaaaatcccccatattggggtttcaaccgggtaa

SEQ ID NO: 13481 - DNA, 279 bp, Candida albicans
tgtattgaaaggaggaaagcaaatcaaatcaaaaaggaaatttttctttcttgtctttttgtttacatttttttttcttttggttgtgttgtttctgtaaaagcgtacactacaactaaactaaactatactaactatgaacacacacagaagaaaaaaactcaaattagacgcgttatgacgctaccaaaagttttaagatctaggacatttgaccccatcttcccccccccttcttcaccacgggcccttggaaggaccgcaaattgcgttaccgca

SEQ ID NO: 13482 - DNA, 381 bp, Candida albicans
aacaacttagccgcatttgattcctatgtaatgtcttacccgaatagtttaggatcaccagcaaccgttacatcaacatcagttccaactgcaaaacaatcatctatctcggtagcggatagagaacgaccattcactgaagccgaatcaaacagattagttaaaatcgataaagacgaagaattaataggcgacgggtgtctcaccagtgataataacaacaataacaataacagtaatagtaatggcaatggtaatggtaatggatatagtgcagcaaacagcagtggtgctagtacctcaaggcgagccatattcaatacattaggtggggttcgtagtcttctacctagggaggcgggcggaaccgcaatggagttc

SEQ ID NO: 13483 - DNA, 696 bp, Candida albicans
  unsure (669): Identity of nucleotide sequences at the above locations are unknown.
tggacttttttttgcagtgagaagtcaaatgacgtgtttgattctacttacagaaattgccatttaatttacactgcacattcagccacagtccatcaactttttaatatcatagaatttaatttgatacatgagctacaagacactttttccataaaagaacaaccattaacttggttatttaaacaatctactgcaagaagatcgcttgcaatggatcaagttcttgaaaattcctcattattgttgctgagtcttctaaaacagtttggtcaacccaggagcaagtggtttgataggttagctgaatatgtttttaatggacttacctcaaaaacagatgtaataccggctacatgttatgaacgtgagaaagatctaatcaaaaaggatgaaggtctatcacaccaaagaaaaaagaaaaaatacactttctataatgataacatggattcaatgaaattgaggtttaaaattttaaatatagtacattattggagcttgtttttcgataaaactacccctgatggaatcaaccaaccaatgtcccagagtataaattcgattgaatcaacaaagttgattgaagaaattgcaagaaaatttatgtacatggagtatgattattgggtggaattttattattccctgttggtggattccaaaatntctttggaatatcgagaagttttttag

SEQ ID NO: 13484 - DNA, 420 bp, Candida albicans
cgatctccaaaagatatactaagtaacagacatcattgtcccataatcatgtcaatctttacgaaacaatttccaaatttgaaacaattacaaaaaaatataactcaagaattgttaaagtatgagaatagtacagccagatctctttcaaaagctgaattggaaaagacaagaacatattacaactacttgaagaaagtcaaactaagcaaaggtgaaatcctggcaataaaagatatcgataccaaattggccgatttatcaaaagacaaattccaacatcaagctgaattgcaaaataaaaatagtttaaatggtataactgaaaatatcaccaatgagaaattaccccacgagtacaagttaaacaatttgaacaacgtcttcaccatcgggaataagccggacgcgcgctataga

SEQ ID NO: 13485 - DNA, 213 bp, Candida albicans
aacgaaatacaaaacaatgagtacattactcggttaggtaaaatgcagataatggtcttattcttagaaaagtgtcaaattattagtgttgggctaatttttaaactgatgggtacaacagacccagagctttcttttaatgggaatcgagcaataaacaagctcaaaggtattcttttatttcgtactgttgtggttttaataagtaattaa

SEQ ID NO: 13486 - DNA, 633 bp, Candida albicans
  unsure (541),(553): Identity of nucleotide sequences at the above locations are unknown.
ggatctcacggcgtggcgaaaatattaactgaactatggactaggtctagcaacagttttcagtctaacttattttcaaatagatttgaagaatcgaaaagattccataaatatgaaactgtggattcagagaatttgtgggatgacgagttgttacagaacagtaaatcacaacgaaatccatcgaaagtcacatgtatgactatctcattccagtttaattcttacgagccagaaccattcaaatattttgagaataaaatatcagtaagttttgattcaatctcaaatttaaatgtcaagatccttgataaagaacttttggagaaatgtttatcaggaaagttagaaacgtcacttttcaaattgttaagacgaaaccaaactcaggggttttctgacagaccacatttgaacaaaggagatattcataatatcaattacattaatggtatcatgaaaacattttttaaaatgcgagagcattcaggggcagcggtaatcaaacctcaacaagagtcattggtttcaagcagttcanatttcctttcanaaataggggctgataaacctcgcctttattcccatagtgattttatattacgtgaactacagattttcactggagcgtga

SEQ ID NO: 13487 - DNA, 333 bp, Candida albicans
caaattcaaacacgattaatgacatcaggaagcatatcagtttctttatcttcagggaaggacttgaagtatcaccaaccacataattccataaattctactgcatcattaagatcaagctcaattgggtcttcgtttttcacccctaacaacactcacggtgctggatcaaattcatcttcaagcaatgatccatcttttcttaatggggagaacacttctgccaactgcactaattcaactgaatcatacgacaatgaattgatcgagcctactaaagatattgacattgtgggtgcaatcagtactttgcatttacatgatgatgattaa

SEQ ID NO: 13488 - DNA, 510 bp, Candida albicans
aacaggatttggaaactcaagaaaacttggaatataactcaactggctcctccaccaccaattagattaaatgtcagtgaaaacgggaaccatcccaatgatcaaaatgtctttgtgaaaccttttgaattgccagaaagccaagaagatgccagcaaaaagcaaaccactaatggtttaaacttgccgttgttaggaaaaattttagactcagaaggaagaactaacgataatgatcaaaatatatctgctagcaaacctcagttctatgacggtgctattccatttgttcccgtaaatcagaatgttactggtaatggaaactcacaaataccaccacctctcggcaacattccaccaccaatgtctaatatgccaccaccgttaccacctcactcaatgggtcttccctcttttagtccctttccacatccttctttttaccaagggtatattccttctccaccagctcatactcctactcctggtgattaccaatctttcgactag

SEQ ID NO: 13489 - DNA, 489 bp, Candida albicans
gcacatgatgagttcaaacagctttttcttaaagggtttagtatcactaccactaccaccaatgaagaatcagtggttgggtttaatttacgagaaaaatttaatagtaaacttcttgatattaatagtgagtttacctcattagaagaatcaggattaatagaatttattaattcattagcttcatcatcatcatcatcgtcttctccttcttcttcttcttcgcccacatccacaacaataatgtttcgactggctaaattacaacaagaattcactcaattggttttaaatattattgatgaattgaaatattctaaagattttgaaaaattaaatcgattaatacttgccattatgaataatattgaaattgttaatattatacttttcaatagtaatctttcattattatataaattgatagatattattgattcatcaaattttaccaccgacgataatggcaatgggaatgataataataac

SEQ ID NO: 13490 - DNA, 192 bp, Candida albicans
tttaatatagacaggttggtttctttaaagggaatagtttatccacctgtcgtattaatctataatgtagagagtaggagggagtgggggggagggaggaaggaagtgttggtagttgatggtggatggaagaacaacgaatttcaaagattgaaagggaaaaacgggaaaaaaaagaaaaaaaaaatttaa

SEQ ID NO: 13491 - DNA, 261 bp, Candida albicans
agaaaccaacctgtctatattaaattattactacaactgcaaccttcgtttcaccacatccatttccacccactttctatttcccctttttttttttgtccaacagttgcacagtttgatatatatatatatatatatacattatatcaaccttcttccattcagcataccattgtcattaaagtaatatcacctgaacctgaaattactcttcatttaacccccgcccccacctcctttaattcccataggtatgtataa

SEQ ID NO: 13492 - DNA, 690 bp, Candida albicans
aatactattggaaacaagtatattgataatgatgggttaattgatatttataattggttggaatataaccagtatcatgataatttgtcaaatttgaataatggaggtgttttaagtagtaatttatctgtggcatcatcaccgccgcaagagggtgaaaatcaagatggaaatgcttctgacggtacaacagatacacaatttggatttgatgtcagtctgggattaagagttttgaatccagtcaatttgacaaataatttggttatttccccaataaattacacagtatcaactgtaatggagggaacacaagtatctaattggttggctatgcctcagtttattaaaaaattgactgttggtgatgacaacgaaacagcagaattacctccagatcaaacagctgatatcaacgaaaatagaagtgaagaggacgaagatgacttatcaggggagtttattataggactacaatctgatgggagtatcctgagacaagttgtttatttgaaaactacagattccacttatcaagaacaccaattggtgacctatcataaagatgatatatatgttactttggtatgcgaatcaagtgatccaaagcttgatctgtctggattttataaatcattggaaacttcattgcttaattcttcaccacggagtggccggtccagtgtgaca

SEQ ID NO: 13493 - DNA, 195 bp, Candida albicans
aacgcaagtgcggatccttccaggggcgtgtgtgaagacaaagggggagagcagataattaaagcggcagtagtggtgacgacgaggcaggatataggggtaaagaataatgatgcttttttatgcaatgtaatagcccctgctactgtctattatatatcgattgtcaattggaattttcaaataactgtataa

SEQ ID NO: 13494 - DNA, 441 bp, Candida albicans
accgtatctctaccccgtggtgaagatttaaaagaaaatatcatttctacagaagtggaaacggaacagaaatattacgattatttatcgattttactaaaaaaataccaattatatcacgttgatgcaaaatcttttaccaaaagaggtaacttgggatttttcccaactaatgatattgataaatcaatacgggtgctctatactgatgctctacgagcattgattgactataaaggggaacaattaaaaattggtcatatcgaaccattgattaatgaatggagtctagataatgagatgagattggaattagaagattgggttgcaaatgatagaataaagtattataaagaaaaattggaaacaagacgtgaacaatttatgaataatttaagatctgatgataatgataatgattcgctcttagatttaatgtga

SEQ ID NO: 13495 - DNA, 183 bp, Candida albicans
agatcgtatgaaaccaaagtggaagtagcaattaattctcccgcatacgatgaagtgacagaaaagaatatcatgacgattatcattgccagtcctgtcttacccatcaaatacgtggcagcagcggctgcaggaagtccttcgccaacttcaaagtcagtcaattttggaaaatctggatag

SEQ ID NO: 13496 - DNA, 204 bp, Candida albicans
agtacagcagaccctccaagaagaatacatgagctaacgattgcattacacacaaacccacaccaaaggaaagctaagtggccaggtacaccaaatctaaagtaccccatttctgggaatgtggtgaccaaatttgcattttttttgattttgctggaaataactgaaaaaattgaaacttggagaagtcctccaatagcataa

SEQ ID NO: 13497 - DNA, 195 bp, Candida albicans
ggtctagaaaatttcattgtctttaaagataaggctgttgagtatcaattgtatttactaccacattacaaagaaaaacgttctttctgtcaattacgaacaagtactgaaacacaaattcttattcttaggaataaatggtacgtttttaatatctatttgatcaagatattgagcttctatcgatggatgtag

SEQ ID NO: 13498 - DNA, 237 bp, Candida albicans
ttcaactattcaaaacatctgtttaaaatagatttgagaacaatattgtatacatcaatagaaggtaatttcaaatcgtttcttatcactgcttggaataatgggtatataatgtataagtcgtcaggggttgaatacgtttcaaaagtagatactattttcgatactttggatgccaaaaagtcttgttcaaaagtatcaaccgttatattttcttgtgttgttgtatgtggttga

SEQ ID NO: 13499 - DNA, 603 bp, Candida albicans
cccataaagaaaacctacaatatattgggtactgctttatttaaaaggtatttaacatgtttggatataccaacagataatattttacaatacaatgaaatccatggtaaatctcaagaatttgcccaaatttgtcttgaattgttcacttcaatttctagtcaattggatttacaagcattacttgccgatttactcaaattattatataattatcccaaattgattacaccacaaatcattgaaccatttgttaatgtgattcaaatggccaaaatttctgataaagattattatttattaatccttgaattgtcgaaatattttactcaatttgatttattaagtaaagagcaaacttatcaagtgattgaatctgcttatactaaatataaactgtttggtggtaaaggtaaaggtaaaggtaaaattaatccatttattggttataaaaaagttattgtttctttagtcaataatgatttcataatggaagatagtcaattgttagacgaaatattattagattataaacaatcattacaatttaaatatagaccttgtcttcgaccacgggagctggcaggatccgcgcttaagtat

SEQ ID NO: 13500 - DNA, 327 bp, Candida albicans
  unsure (12),(25): Identity of nucleotide sequences at the above locations are unknown.
ttcctattccancggtcctgtctanattatgggcacataccggggcaggacacaattccaagaactccaatggacgtagtcattatcataataagacgctgcccacatcatcatggtttccatttgaaattgcttttgattggattcactgccaaatttttgatttctaaagctatggtagacactcaaatcaaccttgatggtatcaagaaattttcatctaaattattttcttcctttgcatataaacctttcaattattctattgcatcgttcaccagattggcaacagtgagaaagaataccacaatttccaatgaaaaatag

SEQ ID NO: 13501 - DNA, 315 bp, Candida albicans
agaacatttgcaacacttgctcaacaacaacaactagaccatgaaagacaggttgttgccgaacaacaaaaacaaccaccatctcaaccacatacaacaacacaagaaaatataacggttgatacttttgaacaagactttttggcatccaaagtatcgaaaatagtatctacttttgaaacgtattcaacccctgacgacttatacattatatacccattattccaagcagtgataagaaacgatttgaaattaccttctattgatgtatacaatattgttctcaaatctattttaaacagatgttttgaatag

SEQ ID NO: 13502 - DNA, 420 bp, Candida albicans
atactcaatatgaaattctcaactgttttcacagctatctttgcattgggcactgctgtgctggcacagcaagttgtcacaccagcatctgatcctttagccttggaattatcacaaagaaatttagataaactttacgaattacaagaaagagatttgttttctattgttgaagggttattcagtagtatcaattacacgagtattttggactccattgactatgaatcaattgctggatggacaaacaatttgttagttgaaaataataatatagaatacttggataacatcttgaactttttaggtgacactgatttggtcccatttgctgtcagttatcttttgagcaacaacgaaacaagaaatattgttggtgaagttgtaatcgaagcttggaccacttatttcttcactacg

SEQ ID NO: 13503 - DNA, 201 bp, Candida albicans
tatctattcctatatcaaatgttttccgctactgtccgttctgctttgagatcaagattatctgctcaagtcccaagagcttctaacactttaagagctgtcactatctctaaaccattgacttcacaaatcagatcttattcttcaaaccatcacgaagaaacttttgaagaattcactgctaggtatgttattgaataa

SEQ ID NO: 13504 - DNA, 222 bp, Candida albicans
ctagaatctagaaatcaactatatatatatatatatatatatattgttagttgtcaattagtattaattttaattcattatcagttcaaaaaaagtattctaataattatcacgctaccaagtgctttttttttttgtttgatctatttttccaccatattgaattattatatttccataaatagaagtatatcagatgtgaatgacattaaaagatactaa

SEQ ID NO: 13505 - DNA, 456 bp, Candida albicans
ttgtggtatcatccacggccgcccgtgaaaaacaaaaaaaatatgtacgatcgaatttcattaacaaaatcaactattggtgtaataaaaaaattagaagaagcgattaaattaattgaatcaaataacaataacaataacactgccactggtagtggtagtggtagtggtggtggagttcgtgattcaacaaatattaatggattattgaatgaggctaaatcattattatataaacctacaagacgtgcattagagcaaattaaaaatggtgataacaccaataacactgctagtaataatagtactactggtgatgatgtcaatgatggtggtagtaaaataaattcaacaacaactggtggtagcacaactattgatgttgaattacaagatgatagttttaaaccattatcattaaaaactcctcaaacttttaaaatttgggcaccataa

SEQ ID NO: 13506 - DNA, 792 bp, Candida albicans
ttcagaagtagatttttgttaattaacagccacaacaataaggaacatgcgttgaaaatagccaaagccagaagaggattgaaaagcaaaccaaagaatgaaagtaatgataatgcgattgcgtcgagttctgagtcggaatctaactctgaatcagataacgaagatgatgatgatgatgttgtcagtttaaaaaaattgaaaccaagaaagaagagttttcttaaatatggtaggagaagatctgatgcagttcttcccgatattaattttaaatttgaatttgatactggtgagaatgatgaattagaagctggtaatcaagaaacacatattaaagagccagcagaagaagatattggtgaagaagtggattactcaccggaaaatcctgtcgactcaaacaatgttccttctttggaatttgaatttgatcatcatttgattgaagtacccaaaataaatgaagaagagttgaattcagatgaagattatgaaattgatgataatgagttgctagcaacattacaagctgaaaatgatgcagaggagtttttacctccaattacaaaaggaaatagccaaccccagcgcaatgattcacttatctcttctactattgaagaagaagaaaacgacaacgacaacgaagaagcaagcaaaggaggagatggtgatgatgatgatgatgacgacgacgacgaaaatgatccatttttgaaagaagaagagaagtatcttgttaatgaatttgaaactttcttccaccaggcggctagaaggacccacgct

SEQ ID NO: 13507 - DNA, 543 bp, Candida albicans
caagtaataaaccattactattgctttcttaattcaatgcaatcgcttcatttcattttgatagtactttttttcatatcatgtatctccaatgcattaacgatacaaaaagattcacttcgatttacacgtacttcattatcttctacgtttgatccccatgatgcatttgaaactgccgttaattccacatggtcaacattttggaataatatcaatcaaggattctcccaatctgatccatcatgtcttgaatcgcaaacttttcaatattcagtagtttgggatgttgctgttgctggtttggcaattgttgaatcgagagatatttccaaaaccaatgatgttgctacttcattatataagtatcaaaactcccatggttggtttgctgctactccggggaacactcatagttatgttgatgataattgtcaagtattatgggtttttttacaagcttatgaattaactcataatgaaaaatatttaactactgctaataagttaatggaattaattcaaggacaatggtcttcacca

SEQ ID NO: 13508 - DNA, 558 bp, Candida albicans
tgcgtgaagactatgaagttaccttcaacaaattatgttccaggttatgcagttagaaaatcaccaactaatagagcaacaaatgtggtcagaatgttagaaggaaaatctcatttgttaacctacgcagatattcctaccaaattagtgtttttgaataaacaaggtggaatatatgtaactgaagttagcacaaaacagcgtattactgagagtggtctttttgatggatttgtaaagtctcattatgctgattcaagaatcccagaaaccataattcttgatccgatcaaagaatttgagtcgctattgaaactaaaagaaccacaaaagtggaatgaagtttatgattcacggaacttttcatactcaattacattgactgattacgatataccagagaaggactttaattactcagaaagtgagtttttagatgatatgacgaaatttggagatcgcctagactctctacacgatttaacgacaaatgaactaagatttgacaaacaagaaatagcgaatttgcgactaaaccgaaatgagatgaggtattat

SEQ ID NO: 13509 - DNA, 204 bp, Candida albicans
caacaattctttccaatgattggtatttgtgcgactctgcacgacatgtgttttagtgcatttgaattgtttattcaaaattcaagacatatgcagatagtacacaaattaagagtttggtataaaaggaataagaaatgtcaaatattttatatagttatatattttaattatgggaaattaaacgtttattctgttctataa

SEQ ID NO: 13510 - DNA, 306 bp, Candida albicans
acacaaatgaaagtaaaccataatcacatcagcaacaccggtgtctatgattctgaagacatattggaagcacaagatgaaatatcaattgataacaacaagaaccaggaaaatatttggaataagaagagcattttccatacatggttacttctttgctattctactggaccagtggcttcaatgagtctaacttatattccagcttcaattcaatcaattgcaaaaaatgtaggtaaaactaaaatgaaccaaccgtgtggacacacaggagaaatgattgctatgtcaagtttggatttatga

SEQ ID NO: 13511 - DNA, 225 bp, Candida albicans
gaggtgcaattttttaaatccgcgccatttttatcaagagtaactactactactactactactacttacactaatggaaatgatttcctaatggagttaagatttgcgtggagccaactagtagcaggggaaatacaaaaaaaaactaatttccaacaacaaacttcgattgcttctggaattccccccccccttcacttcatttcaaatcaattaatcatataa

SEQ ID NO: 13512 - DNA, 666 bp, Candida albicans
ggattgggttttcagcgcgtggggcagacatcgtcggtttcaggaggcacaatagcaggagctgtagttgggtcagtggcaggaacagcattagttgcaggattagtgtttttgttctgctggtatacaagaaagaagcaagatgaatacgatgacgacgttgatgatcaatttacactttctggacctaaacaagaaatggaacaacatccatattcaacgataggtggtggcggcgctggtggcggtggaggagcagcaatgttggatcctaatccatttctaattgctggtggctataataattttgatacatctcaacaacaaaccccacgacaacaaattatatcaaatggaactgtcaccggatcaggcggttatggacacaatcataaaataagttctagtggaaccagtggtgatggcaatcactcatttggatctcaaactgataccgaatttgcattctatgattatagcaactccaacaataacaataataccaccactagccccaatatcaataacaacaataacaatactaataacggagttttgcatacaaattcgccgaatccagaatttggtagacgaagattgagtaatggatcattacctgatatgattgctcgaaatcctggatctttgaaagtggtcaataattga

SEQ ID NO: 13513 - DNA, 198 bp, Candida albicans
ctatttggttgcaaaaccattttttttttctctcttccaagttacagcaccaccactaaaaacatcaaaatgagaggcaataatagacattacaagtttatcaacgtcttaattcaagagcacgattattgtcatttagtcatattggatgacaacagcatgattttagaagataatcaccaactacattttatttga

SEQ ID NO: 13514 - DNA, 423 bp, Candida albicans
ctaataaacaagtctctacttttcaattaccaatcaaacatggctgaaaatgcacactctatatcaacagcaacagactcttctgcttatagctctgggaagtcatttaccaagcatgggcacagaaacaaaaggttgaaaagtaccaattcttcacgctacatggttcaagaaacccccgtgccagttcaaaccaattcagagatctctcaaaatttaaaaacgtctacccttactacaactactactaacagcaataacgataataataatggcaatacaaacgaaattgccatactcaactcatcacctttaaaacaattatctccatctcaacctctaccagaagtattgcctactgaacctgatgaaaatcaacctgcctgtgtccacccacaggggctagaaggtcacgcgtcgccc

SEQ ID NO: 13515 - DNA, 195 bp, Candida albicans
tcgactgcctttatattcactatatactactactccatgagatttccattatctactctattggtgggcgcaaccctattaacattcacatcatgtgtgactgattttgatcagaaagttttacaacttgacaagttgttttccgaacaaggacccacaatcaatgtcttacaagcctatgaagaaataattcga

SEQ ID NO: 13516 - DNA, 564 bp, Candida albicans
gatccactacttttaagtagtaaaaaattccatgatttactccgattagtccctagtgaaatacatgtcatattatacctgtatatggtgcagctaaatatccaaccagctattagaagacatatggatggtttgataaagaaactaatcaatgagtcggccaaagccagatttgttgctcaaacaggatatttttctcctaaatggcatgaattaacaaagacacaattcaatgaaactaagagattacaaatggttaatttttttgcaataactgattttgaaaggtttgcccaatacagtatcaagcataatcagccagctatggcattgtattatttaaattgtatgcttactaaatttgaacgaaaatgcctacatggtgctaaagttgttgataatactactacagaacaagacatacagatgctactaaagacagtgttgaatttggtgatgaagtttaaaggtggatcacatggcattgatgtattgaagtatatgaacagtgtaaatttacgagtcacatttgatttatacttgtcattactacaaaatttgtga

SEQ ID NO: 13517 - DNA, 189 bp, Candida albicans
ttcaaaccaaaacaaaatttgactaattcaaagaacaaaggtaagttcataacaaaatattacttttgtatagaatcacctaactttaattctagttggtttcacaagagatattgtaacactctaattttaaccttttttttcaagatcctctgttggttctattcgattccatttctcaaaccataa

SEQ ID NO: 13518 - DNA, 231 bp, Candida albicans
ttgtctataatactacatacacatacacatacaccatacacacataacagttttgattcaaatgcaagtaatactttaaatacagaaatgcaagatttagatacaccaaaagaggtttcccaggcaatacggcaagctaatactgatgaagaagctaacattgaaaatggtaatgaactgcaacaacaacaacgagaacaacaacaacaggaacctgaaaatcacacaaac

SEQ ID NO: 13519 - DNA, 225 bp, Candida albicans
  unsure (16),(19),(104),(105),(169),(171),(172),(173),(177),(195): Identity of nucleotide sequences at the above locations are unknown.
attacccacctttccntcnttttcttctttccggggtgtttccgttttttggtaaataaaacaaaggaaataatggacaaatgtaagaaaaaaaaaaaacaaanncccccacccccccctttgggttggggggggggaggggtttcagtggggagcgcttctgggtttntnnnttcncctccccgcgccgaaaanaaagtacacaaaaaaaaacacgatttttga

SEQ ID NO: 13520 - DNA, 324 bp, Candida albicans
cacaacagcaccagtacaagtattactactactaatagtaataatgagatgtttcatttaaataaacaaattaatattagtgatacaaattgtgaagaaatatcaataccttcgaaaaaacgttatagtacagtaagtatcaaacaacaacaatacccgcaacaatcacaatttcaaacacctaaaaactattgtccatctcctttacaacttactcgatcatcatctatacgtagtaatggatcgataaatactattttacaacaacaacttcaacaacaatctccaatgatggtattgcaactgcaactgcaactgcaatag

SEQ ID NO: 13521 - DNA, 396 bp, Candida albicans
caacagctacagctacagcaacaacaactggtaccaaatactccaccttcacaatacattataaatatcaatcgtactcctaataatttaactccttcacaacgattaagtttacgtaaatccaacatcaataatagtatttctcaatataaatcagatcaaaccaatatattcaaatataaacaaaacccatcaccaccaccaccaccagcagcagtcttatcagaacaacaacaacagagaaattcacccataattgatgatgctgatgaattaattgatgataatgttatatttaatgttccattttcacaatcaatattatcattaaatcaacatgaaaaattttatttgataatcagtcttcttcaccacgagaaatggaaaacccgcgtc

SEQ ID NO: 13522 - DNA, 204 bp, Candida albicans
gttcattattccacaaatactatttttaaacaataccactttaaccaattagctcaatcaatcatatcaatcaaatcaatcaatcaatcaaagcaaatcgagtgtgatttgttgtggggtaaattttattttgattttacgcatatattcgtaatgtgttttggttttaaattaaataggaagctaactgaaagacagaattga

SEQ ID NO: 13523 - DNA, 261 bp, Candida albicans
gtattattaataaaagttgaattgaacaaagaagcaggaaccacatcagggaatgaatatcgtttaagtataagttatggtgatagtagtacaaacaatttaattattaaatatcatgaaggagattggaaaattgtttcattacaaggatataaagataataataataacaataaacttatatcaaagataaattcattagggaatcaaaaagatttttttaaagcaattgcacaatttattgtggagttaactaagtga

SEQ ID NO: 13524 - DNA, 1068 bp, Candida albicans
  unsure (7): Identity of nucleotide sequences at the above locations are unknown.
ttcttantaaaccaacaagaagaaaatggatttcaaacaccggagttagttgcattaagaaacagcaacaaatacgtgttcgttatcaactggttatacaattaccgaggctatttaaagctacaatcagagttgtttgatattgacttatttgaattggaattattgggatttttcaatgcattcgatttgtcaagtttatttattaataaattaaaattagcattgatcacgtctgttcagaactctaagcttgttgagttggaagattttgaatttgtattccgtgctcattttggggatgactctccacttggtatccaaacagacaacgaacaagattcggtaaaatttgaccttctaaacatcacagagaagtttgatatcttgtatattttaataaactacatttcaaagtattccaagttcagagactggactgaaaaacagggactaacaactagaatcgatccaatattcaaactgtcactggctgaatatttttcattatttgatgataatcgattatacaaacgaacaataacttattatcctttaaccattcccaagaaaagaaaattatcacctgagtcaccacaagattattttgattcaaaggtttttgatgttaaagatgtcaaatttgaattggtatacaagaacatttacgagttcaatgaatatttgagcaaaatcaaaaagagtctggcccataaattgttatataccaaattggcaggtaagtccagtaccatcattgatacaatttttgataacgaagtgaaaaagagaagatatttgataaacaagcgtaaggagattcaaatggttaacttattggcagtacgtaaaagaagttctcgtttagaagctaaagaaagacaacgtcaagaagagttagaaagacagagggaagaagaatcgaagcaagctgctgaaagaagatttgaacgaagaatgaaactaaaaaataccgaaaacatggatactgggaaactatcaagagatcaacgaatgcaattaagacagttgaattatgaaccaacaccagaaccagacaaagcttag

SEQ ID NO: 13525 - DNA, 222 bp, Candida albicans
  unsure (26),(46): Identity of nucleotide sequences at the above locations are unknown.
aatccattttcttcttgttggtttantaagaattatggtgtttgtntggacaaggatgctatttggtcccgattaccaatatttaagatatggaatagatggtcaccatctaatggcactggggttgaagaagtgactccaacataccaggttgtttggtatctaatgtgtaaaaaaagaagtttaaaaccaattgttgaacaaaaaaaatgggttccctgg

SEQ ID NO: 13526 - DNA, 201 bp, Candida albicans
aaaggtcgccacccacctaaaaatagcactgttgttgaacacattcaggctaactacaccaaatttgatccacctcataacattataaccacacaaatagccaaaaacacaaatatcattacaggtctaattaatagtaccacagattcactcttactaattaaacctgaaacattagaccctccaacaccggcactataa

SEQ ID NO: 13527 - DNA, 279 bp, Candida albicans
cagcagagtaattggaccaaggttgagattcaaagttcaagcgaggattcgcaaaaggtactttacaaatgggcaagatcaagtgaacacgatattaatcaaaatacagacttggatgagtatgatgattggattgataaagctattaaggatatttctatatcgtaccaagagaaccaagttatcaaggctcaatggtccaaacatgcacgcaaagttgaaaagatcaagcatatattggaagcacaagatgaagatggcgacatagaaatgatctaa

SEQ ID NO: 13528 - DNA, 201 bp, Candida albicans
caaatatccaagaaagattatagtgttaaatctagtagtgacatttttcaacttagttcaagaaaccaagagcaaatcatgagtttgtattcaaatattaggacatttctgacacgctccattgtgttgaatagaatcaagccattaaaatttgaggacttaaccaaaatcaaattgagagaaccagtagtacctagagta

SEQ ID NO: 13529 - DNA, 258 bp, Candida albicans
tggggggagggggtatggataatgtatccatgttgtatagtttcatcaactaaattcattattacgtgttctagctatcatttctcatttctagattttttttctttagccgcgcatttcttcctaatcaagtatgatctcgcgcaagcaggaagaagaattatcaaccaatctgataaacctcatacaactaagttcttatctaattggaatatctcccttcctttcttctctatccccaactcctttcgactctaa

SEQ ID NO: 13530 - DNA, 186 bp, Candida albicans
aatatcttcaattggattgaagtttttttctccttctttgattctttgttgaaagaaaaagttcggattacttttttgaacattgagacacacccaagttttttattggttgaaagagttcaagtcaacatggtagctcttgattttttttgttccctttcacacgtctttctattaagaatctaa

SEQ ID NO: 13531 - DNA, 201 bp, Candida albicans
caactagtcatgtctgcatacaaacaagctggtgtatcattaaacaaagctttagcaattgctgctcaaactttaagaaactctttaaaaccagaattcaaagctgctgctgaaaaaagaggatttgttgaagccaaagttataactttcaaagatggtaaacaaggtgaaccagttgcattgaaaccaactgataattaa

SEQ ID NO: 13532 - DNA, 489 bp, Candida albicans
tttgatttgattcctgttggtctcatcttactattgttgttcatgttttctaccagagttacattcagatggagcttatctatacggccaaatagtctattttcaagattcaattcaactactgccaaacaatatgttcgacaaaaaccgaaaatgatggatttaatacgaactccaactactaaatcattaattttaaccttaattacaagttcaatgattatagaattaatgaatagtaaaaaaaatttcgaaactttgatcaattcatataatttaaaatttgaaattttattagaaattattgataaattaaataataatgaaaaatttgatatcactaaagaattacaattagctaattcatttactgaaaataaatatagttctaaaactgatattcaaatggatgaacaattggaacaatttttaaaagacataactcaagatgaaggtgaaaataaccaattacaactgatagaagtagac

SEQ ID NO: 13533 - DNA, 183 bp, Candida albicans
actcttaagttagcaagtttgaaattttggaaaatttttgattttttttcgaaaatgcaaaatgaacctaatccccatacaaaaaaaacactgacaaattcaaaatttagatttcgacttttaggacatgaattgatagaaaatgacccgctgatttcgaatatctttaccatttcaacgtag

SEQ ID NO: 13534 - DNA, 759 bp, Candida albicans
  unsure (612): Identity of nucleotide sequences at the above locations are unknown.
gcgtggtcgaacagaaaaaattgggcattatttataaattataatcaaagattaaatcaaggatttgatagtcatgtttattttgctaatcaattgaaaaatttaaaaattttaaaatgttcaattttaaatgataatgatgatgattgtgaatgggaatttcaaatggatgattatgaagatgccggtgtattacatggtggtactgaattaattaatattaatcaacttttacatcaatatgattatccagaattaaattctattaaagatttaatccccaatggaagagaatattgggttggttttgctcgtgctagtttgaaaaattgtggttgtggatcaagaatgtatcgaccaaatttaatagtattaatgaaagatggtaaaaattataaatttgcttatgtttcatcatttgttggattaggaatcgaaatattaccttggtatttagataaaggtttatgtgaacattataatttaattatccccaatggtatttcatcttggacaattgaaaaagatcttcatcaaaaggaaaaagataaacaagtgatggattatatggcattcacaatatctcgacgtgatgctactgttgatgttgtntatgttaaaggattattaaaagcattatttactgatagttcatcgagtaaacatttattggctgtcgaacaaactggatttaaactggtgactaatgtcgattgtgctttgaaaaattcagaaaaattttgtaaaatctatggagaa

SEQ ID NO: 13535 - DNA, 204 bp, Candida albicans
cgaacgaaaaatactattgatgaagaaggatttaatggtgttattgaagcatttgagaaattcaagtctaaaacttcagcaagattaaacagttctaaaactactgatcccaatgttaatgatgtagttaatcctcgaaccgtagtagtttgtaatatattattcattgaaattgcaagcgattcaaaaacaggagaactgtag

SEQ ID NO: 13536 - DNA, 390 bp, Candida albicans
ttttttaaaaaaaaattaacatacttcaggactacaaactaccagatatatctcaattcctacagttctcctgtttttgaatcgcttgcaatttcaatgaataatatattacaaactactacggttcgaggattaactacatcattaacattgggatcagtagttttagaactgtttaatcttgctgaagttttagacttgaatttctcaaatgcttcaataacaccattaaatccttcttcatcaatagtatttttcgttcgtcaagatcgcaaagataaaaatcgtactgttaaagttttcaatggtaatggtgatcaagtttattcatttgaaagattaagtacatttaatcccatttggagaatgttaaattaccctcaaccttaa

SEQ ID NO: 13537 - DNA, 249 bp, Candida albicans
gaaatgctggcgcctcgtcaagattatctcccttcacctaatagaacttcaataaattatgaagatttagatttaaatacccgattagaatatgctcaatttgattccatatcccaagtactcccattcaccaccaaaacgattttggttctttggaaaaaatctcctaaaacaattttgattcatttatttaaaagatccacctgttaccgttttaataagaaacaatgttgtcgaaccaataattag

SEQ ID NO: 13538 - DNA, 465 bp, Candida albicans
aaaacgactgcttctgccaacaaactccaaccacgtttaactcatttaaatactgctcctcaactcactcaaattcatagtgatactgaattaataacagataaagatcgtactggtcatcacattactaacaacaacactaataatccaactttgatgaataattcatcaaccatcaatacctccattggtgatttgagtaataaatcaaaaagacaacaagctaatgaattatttaacgcattaagagataaacaatcggataattatcgatttgttgaattcactaataatcaaccaacacctgatattccttccaaacaatatactaaacaagtttcatttgatgatataaatattcaatatgatatggatgatatacctgatcctgatgatgattttggttgggaattatataaattaaagaatcgtgatcgtttatctggaacaaataatccctggtag

SEQ ID NO: 13539 - DNA, 192 bp, Candida albicans
gtgaagggagataatcttgacgaggcgccagcatttcctaaaggtgatggggttcgtaaagtgtcacgacctcgacctaaacctcgaccacgaccaatacttgaacccaccagatatcctggtaatgaattattattcgcaccaccaccaccactaccactaccactaccagggattatttgttccagataa

SEQ ID NO: 13540 - DNA, 186 bp, Candida albicans
acatgtcctctaactcttttactaatcaagaatatttcaaacttaataaatatgtcattgaatggaaagacagatttggaaaaatctggtgctagagttagtgtaacagcttccacagtttcagaaaaccggacaaccggatttgaattatatgaaaaagctcaagaactttcttttgaagaataa

SEQ ID NO: 13541 - DNA, 270 bp, Candida albicans
catgaatttttgatatatttagttttatatcgctttttattttattcaatgagcattaatattaatattaatatgtatattagttattgtgtaaagaagagactccgaaagtggcttcgtaagattaattcacgagagatatggtcttactcactatcatccatacgtttatatatttgtgttgtgaatgatccacatctaaaaattatcgttgctattgtcattaaaatctccgataagaaaaaaaaatcgttaaacgttgaccgataa

SEQ ID NO: 13542 - DNA, 546 bp, Candida albicans
  unsure (487): Identity of nucleotide sequences at the above locations are unknown.
atgtcaaaacaagatccacctccagattatacaaataggacatcagataattataacccagatacaactgataatcataatattcctccacctttcactacccatcctatagaggttcatccaccaccattctcctcttctacttcacctaatatccgtgtgccagcatattttcaaaatcaaactacttcaggatggacaatagtaataaataatcgattttggactgatggattcaggatatttgtttctgaagatgcatctaataagtttgatgcctttaaaaaaagtaaaaatcccgaaataatacaattacaagaacaaggtattggagtgccattatttaaagctgtcacgtcatatattcctttagcaactaaatttataacgtttagaagatatgtccctactaatttacatccatttgatattgataaagattattatgattattgtattgttaaacggaaattacacgttggatatngtagttatatatttgaatttattcctgatgtccaccacgcggctggagatccgcagtcc

SEQ ID NO: 13543 - DNA, 207 bp, Candida albicans
  unsure (92): Identity of nucleotide sequences at the above locations are unknown.
attaatgcaaatttgtttgaaaatacacttttgttaccagattttaaggataattttattgacaaagtatttataaatttgctcataacacnacaattatctagcaattatgtgtcggataaagatggtgagtgctatgatttgatattttcatttgatccaaatttggatgttcaaactcctagtattgaggatcttgcaacgtga

SEQ ID NO: 13544 - DNA, 720 bp, Candida albicans
tattttcatttgatccaaatttggatgttcaaactcctagtattgaggatcttgcaacgtgaaaatggtaatcagtgtccaatactagtgccaataccagtttttacacttgagcacattgctttacaattacctcaaccgcagcaggtagacttgatggaatccatcgatgcagctttaaataaatggagagtcaaatgtatcaacacattagtagtaaactttttcaatttggatgaaatgagtaacgattttttcacagagaattatggtcttaatatgaaagaattttggaatatgatgcacaataatcgccaaggtttgaataaattgttagacaattataatggccaattggtattactgttctctgaggaaaaattaattaaaaaactaaattccttttataatcgaggcgggaatggagggtttgatcaagtgagagatgcaaattgtcagttgttcaaatctaaattagctgaagcggtgtatcagaaatttatggatctagatgagggagttgatgaaattgagcttaatttaaatggaaaacgggaatatgaaactgcaagggaattgcaatatgacgatgatgaagattatattgcgaacaattacaaaaaatttagaagattgaatgacgatgctaacatgtcagaacgtaaattagcccgtgtggatactgatctactgcttcaccacggcctggaagacccactc

SEQ ID NO: 13545 - DNA, 336 bp, Candida albicans
  unsure (310),(333): Identity of nucleotide sequences at the above locations are unknown.
gttaattcgatactttccctattttcaccaaaaccaccctttatgactaatgaaataaactcagcgacggtaacccaggatgaggttataaaatggagtagagaggctcaatcaacgttagagaaaacacaaaaaatatgcacggatgcccagtccctgatgcagaagacagcacaagaattgactattttgataccagacaaactacaagcaattgagtttttattcaaatcctatagagagcaatatgacagtattttgaagcaaattgaaactaccaagatttacttacatacaaatatcgcctatnttaaccgacatgctggaaggtcncag

SEQ ID NO: 13546 - DNA, 207 bp, Candida albicans
tcaaacccacatttcacttccctcacacatcaacaacaacaatcacaactaaatttgcttctacgtgctggtggaaaaaaaaaactcactgaaaaaaaacaaatactaattcagaactctgaaaaagtgtacactgctttcaatatttctacaaacaggtatgagttcatcttctccactcaaatcttttcgttaagctgtaattaa

SEQ ID NO: 13547 - DNA, 216 bp, Candida albicans
agtatgaaagaatatagtttttcaaaaactatgagacaactgattccattaatgattctacataatgtgcaatttgggaccgacaagaataaatattctttgggacatggcccaccaatttttataattgatgaaaaaattgaccgaactcaaaaagtttgcgatctgttgtgttttgtcaatttgcatgaaaaaggattcattcacacattataa

SEQ ID NO: 13548 - DNA, 291 bp, Candida albicans
aaaatagaattaaacaaactcgaaataatcactaaaaatatcccgaggcaaaaaaaaaaaaaaaaacgtttatcaaaccaaatttcaagaataactttagcatcattatatcaaaataaagagttgttgatgatcatcatcaaaagtagtagtaatagtagtcgatcaatttctgttaaggtgaaatctcacagaaagaaagatccagaaatcccgagattaaaattcttcatcgaaacaagccatataacccatacaggggggatactaaaaaaaaatgagaacaattaa

SEQ ID NO: 13549 - DNA, 324 bp, Candida albicans
ctcaattgccgcattaactcattcaatagtttgatgtgttgtctgataatttgtgcgttgtctgcactcgaagcgatttcattcaatttcaccaaattgctatttatatgtttgacagtcgatagtatcatgcttagctccatgagcacttgttgctgttgggaaggttcatccataatagcataccatcaatcagatcgtgaatttgtttacagttcagaaaaaaaaaaagtggacagagaatgcgacaaaacctttaaacctttgtatatttataaaaactctataagaccaaacccattgctaagccaatgcttttcttga

SEQ ID NO: 13550 - DNA, 192 bp, Candida albicans
tggtatgctattatggatgaaccttcccaacagcaacaagtgctcatggagctaagcatgatactatcgactgtcaaacatataaatagcaatttggtgaaattgaatgaaatcgcttcgagtgcagacaacgcacaaattatcagacaacacatcaaactattgaatgagttaatgcggcaattgagttaa

SEQ ID NO: 13551 - DNA, 327 bp, Candida albicans
gaagataaacatgatgatgctattgtgacaccacaagaaaccgtagctccagataccaatagtcctgatgcagatcaagaacaacctgattcagtggaaccagataatgaaaccactgatgctccaataaatgtcgaagatgatgctactgctttgatttccgatgaagatactacaacttcaacaatcacaactttgatttatatcacccaatcaggagatcaaccaattaaaactcctgttccaatttttgataatgctgctaatttggctggttcaatctctctttccagtggtgtcttactattgattttaatgttgatttaa

SEQ ID NO: 13552 - DNA, 447 bp, Candida albicans
atcgaaatgagagtttccacattagttttatccacatctataatcccaattgctactgcacttaacatttcccctttccataatatcgaaaagaaagatatacttgctgacgctgcttctgcagcagggggtgcagctgctgctgtcacatctggtgctgtcggtgctgctaatactgttgcctcaggtgccgccggtgctgctgatactgccacctcgggtgctgccggtattgcaaacactgttgcttctggtgccgctggtgctgctgatactgccacttcgggtgccgccggtgctgctaaaaatggcacctcaagtgccgcccgtgctgctgaaactgccacttctggtgccgttggtggtgcaaaaactgctaattctggtgccgctggtgctgccaaaaacggcacttctggtgctgccggtgctgccccgtggtgctaa

SEQ ID NO: 13553 - DNA, 435 bp, Candida albicans
ttgatcaatatcaaaaattttttggtgcacttttttttttttttttttttcgtgaacaaaaaaactaaccacccacacccaccatgcgatgatcatcaaatactaataattaaattagacaatacaatgtcaatattacaaggatattcatcatcatcatcatcatcatcaggttcaagtgatgacgaaaaagataatgagcgaccaccatttaaaaaagtgaaaacatttgctggatcatttcaacaaattctgtcatcgatacttgaaaatgatacttttcatatcaacaacgatcggaaaatatcaaataatgctaaaaaattagctaaacaattgaaacggcaacgttataaacaaggatcaagatatgggattgatccatggaccaataattcatctgataagtattcgccacgggccgaagaccgcgta

SEQ ID NO: 13554 - DNA, 183 bp, Candida albicans
tcttcgaaatgtagtatttctaaaattaatcaagttgttccctttttttttctttctttctcatcacaattgattttctattttatttctatgtttttagttgttgctcatgttgttgttattgttgttacggtttcatttatttttgtggaactccttagtaaatttttcttgaacatttga

SEQ ID NO: 13555 - DNA, 237 bp, Candida albicans
  unsure (8),(21),(45): Identity of nucleotide sequences at the above locations are unknown.
gtatccanatacttggccatngcgcatgtgaaaaaaaggaggaanagggtacataaattgtatatacaaccacaatattactctacaaaccaagacatacaaatacaaaacaaaacaaagtggagcacacgcggtcaccacaactcggctaaatttcttaatatagtaataaactcaactataaaaactcccactacgccccctaataatttattcactagaaagaaatacgtttaa

SEQ ID NO: 13556 - DNA, 183 bp, Candida albicans
aatggaccagttagtctaattatactacagtggcttaacatgttcgatgcaaggagttattggtccgaggcaggtgatgaagaaaaaagaaaaaaaaatctaaaagatctcggaaaaagagattattattttttttctgacctgcaggtggaaggagctgccccccccaaactgacgtcataa

SEQ ID NO: 13557 - DNA, 258 bp, Candida albicans
caatgggacaagacggatattgggagtttaagtttgacgaattataacttaaaacatgtggtaaatctcaatacaaacatcaacaaagtgtggggttatgagactaaggatttgggttgctacggaaaatttacaaagttgttgtttctttttagtcaccttgttttagttattttagttttgcttgtttggttttatttctctcttggtctaaaaattattctctattgttattattcctataaggttaaagactga

SEQ ID NO: 13558 - DNA, 231 bp, Candida albicans
atcaaattcattaatgatcttcttatgttgaacactaaggaacgaaagggggagggggaggggtttaactctctcgtttttttttttcattcatcaagtttgcaaaatggaaaattactgtttttggatttgacaatgattgctgcaaaaaaaaaattagccctttgctttattcccttttggcctctcttctttgatacaaaagaaaaaatttttagatgtgatttttaa

SEQ ID NO: 13559 - DNA, 264 bp, Candida albicans
aagatgtatgaccataaaacaacagatactggcatctccatcagatcattcatcagtttaagacatgggggcaagtgtcaatttaaaaagaagtttacgaaaggatgccccaaaaaattttttcttgtcttgactggcgccttactgctaccaatttacattaacggtgtcttaaactttaaattaaaaattgaagaaagttgggtaattacattggtgggcactgggggtgaagtgttatgcacctttaaggttacaatttaa

SEQ ID NO: 13560 - DNA, 342 bp, Candida albicans
actatagcagcgaaaaatgccataacgccagaaagtgtatttgatataaccatcactaacggtatatttcgttctggttgggcaatttcatctgtcaaatgtactgctccatcaaataatgtgacacaggctaagctaggcaacatccccaagaaaaataccactccattggaggaccagcccgtttcattgatgatatttttaaacacaaactcagcagattgttttggtgatttgactaaaagtgtaataataataaagaatgttccaaaatttattaccgcaactgaaatattggtgattaacggtaataatttgactaaaaacacattgaccaaataa

SEQ ID NO: 13561 - DNA, 246 bp, Candida albicans
caaataatgagatccaaggtgatggcaacaatgaatccaaatattactactggactacctcctacttctatccacgtacttacaaatgtacttattgcaagtgctgaacatatcaaattgaatgaaaatcccatgtactttattaacttgagatttttttctaattgtgcttgggggaatactattttccgtgataacataaatccagtcttccctttctgtactttgaccagacctatttgttga

SEQ ID NO: 13562 - DNA, 195 bp, Candida albicans
gtgctaccaaacatgcggtcttattcacgtgacaaaaatgcggtcttaaatttgagtgctaccaaagatgtggtcttaaatgtgtgctctcttttctgcggtcttaaatgtgtggtcttaaatttgagtgctaccaaagatgcggtcttaaatttgaatgctctcttttctgcggtcttaaaaatgtgctcttag

SEQ ID NO: 13563 - DNA, 234 bp, Candida albicans
gggcacacaatgaagagcagaatcggggctacacaatcgacgaagaagttagacatccgtaaattgaagagcagcgagcctggtctgtttaggggtaccctgctgtgcagatctcgtaggctttttagttttacggaaattctggccgagaaaagaacaatgaccggagatcaggagacagggggggctagtagggtctgttttgattacgtttgcgttgtttcggcaatttaa

SEQ ID NO: 13564 - DNA, 213 bp, Candida albicans
ataatatcaatactgatacattatcatcattttactttaacgataaacgtcttacaagatacaagaaagatcagtttagaatgtgataccaaatttctcaaagcatcgaaccttttgactcaaataaccaatccttcaacattgattttattcttgtttaaagttcaaaatccgacaccaataatgattccaacatttatatttgaattttaa

SEQ ID NO: 13565 - DNA, 543 bp, Candida albicans
gatgaatcgggtgattttctggatgacgaatttgacattgaagctccacctcgtttcccacaacaactgcaacaatctaatatttcttcagtggccaacaaaaatcaaaatatttacgggaacaggagatttgccagatcttcaaagctttcgaattacaaagacaatttgtcagcagttaatttactagatcaagaacatggtggggtgcccaatactggcaatagttctaccagtaattttgccaatgttaatgatgacgacgatgatgacgaaatagttggcagcgatgttgatgatttcattagtggatctatatccaacagtactagcaacatcaacaacaataatgatagaggtggggtgttgggagctattttgagtgctgaagaacacgcaaaatggtttactagatttgatgaagaggtattgaaaccagtattattggatactttgccatcgacaggacaatcgagtcaaaataatagtacaagtaatctaaatagtagcggtaacggtaatggcaaaagaaaccaaagttaa

SEQ ID NO: 13566 - DNA, 189 bp, Candida albicans
ataaattttcacgttaaagattttgttggagcagaagaatatgcttcattagtgtatgatgtattatcgaaaatgttacaagttaaattatcaaaacgaccatctcctttggaattaaatgccgtaaaatttttcacgagatgttcccataatcttcaccacgcggtggaagtgcgaacttgcgatagt

SEQ ID NO: 13567 - DNA, 633 bp, Candida albicans
gagaaagggtcatttcctcaacctaacggttccaataccgatattttcaggaccaacagtggatcacgtggttcatcgaaagaaggttccaccactgatttaccaagatacatttcctcaatgcagaatcgaagtagatccagttctaatcctatgacgcatgttcatgttgcacataacgccaaagattcatatttcccatctaccatattaggcagagtcaagtctccagaatcagatgtttcgatagattctttgggcgagcctataccggaggagctcgatagtgtccttcaagcatatcaaccaactcttaatgaaccggcgggaagaaattcgcctatcgagtctttgaatagagccagatccttgaataaaagaagaacaaataatccacttttctcatcctccacccaaagaaaactgcaacagctgttgttccaaccttctttaactcaactcagcaaagtaaatcgacaaagatcgctcagttcaggtggtgaaaatagacctgggctgcaacagaagctacaacgtcattatgggaaagataacacttatgaagatgacggcgattccgaagaagaagaggaagaatccaatgaaattactgacgaagaggacgattctacc

SEQ ID NO: 13568 - DNA, 864 bp, Candida albicans
agggtcccattgggtgtatttaaagtggaaccatcaccacaacaacaaattaatattatatcacaagagatatccttgaaatctaaaaaacggagattaaataatagtcataaagacactaatgtcattgccactattattactattactactggtaccacttgttatgtatcaaatacttatacaaatggctcgagtccattggtccatggacataattttaccaccaccaccaatacagaatccaattcacgacttcatggatataatttagaaacagggataccacattctgaccaaccacaagattcacaatggatttctaatgaattaaaagatgcagctcttgtgacagcagcagctttagatactcaatttttagatttaatgtttaattttaatagtaatattccaacagatgatactagtaataatattaataataataccacaacaaatactcatactcatactgataatcaaaccaacaacaacaacaacaatactggtcattcttcaattatggatgaatttaataatcctgattttttgaatttattatttcataaaaatctgcaacttgcaataaccactccgcaaccacatatcggtacaacaacacatacaacaacaccacaattatttcattcaaatagtagtatatcattagccaatattttaaatcaaaatcaaggagcaaataataatagtaactctattcttatggatcctacatattattccaatttttccaattttttctataataatccctatcaatccaatgaaaatttagaaattgatttacatgccaaatcaattgatcatgatcatgagtattcaccacggggctggaaaatccgc

SEQ ID NO: 13569 - DNA, 294 bp, Candida albicans
cttaaccggagtataataataataataataataataactacatattgcctattagttcatttatctctaacaattgtgcaattcaaatataatttgtctgattatatcactattgggtctgttgttgttgttgttgttgttgctgttgttttcattatattgtttgattcattttattggaaatgttactgtaaaacaagaattcgtaaactgttctcccccccgcaattcaaaagtatgattattctatatgactacttgctttgtgggttgtgcgtgcgtgtgtgtgtgtga

SEQ ID NO: 13570 - DNA, 348 bp, Candida albicans
agttggcgaaatgctctttttttttcaatagacaaaacaaaaaaaggaaagctagaaagaaaaaaaaaaccaactcttaatactttgaaagtctatttaaagaccccagaaacgacgacgtggggagaaacaataaatacaatatcaagtgattatattttgttaatcaagataattaagtctgatttatatcaatcgtcccaaattttgaaaaaagaagtatccaaatatactttattttcttttttttttttgcatttcatcaacacatacatcattttttgttttgttcatccatatgtcatcattcggaagttcaacaattgcaaatggtgcttcactgggtaa

SEQ ID NO: 13571 - DNA, 255 bp, Candida albicans
gagttggttttttttttctttctagctttcctttttttgttttgtctattgaaaaaaaaagagcatttcgccaactttagagatccttcaagtttctggaatgcacctgatataaatatattaaaaggaaatattaataaccttatcaattctttaaaatacagtaaactacataaccattctttagatcatcactcaaaaaatgatcaggtactttttctaccacgggagctgaccggacccgcgcttacttat

SEQ ID NO: 13572 - DNA, 183 bp, Candida albicans
gcctcagaatttgtcttgcagcggctgttgaaaatggtggtgaagggatctattgaaaagaattcaaattcagagaatgaagataatcatcctagtactagtactagtactagtgatataataataaccgatgataatgacataaaaagtacaaggaaaagaaaagtttctgataatatttaa

SEQ ID NO: 13573 - DNA, 204 bp, Candida albicans
caacatgggaaaagtcactcactgaggtacgagaaattggacagtcaagcggtaatgcgtatcgttagcaacaggcacctgcgcccaccgtgtgcgaaggcccatattagcgaaactcccgatttgtcctcaagtgattccactgaaggtggtaaagccgtacttagggccaagtcagccagtgtaaattgtcctagtagatga

SEQ ID NO: 13574 - DNA, 276 bp, Candida albicans
ttctttttggactgccaattttatataacaatttgtttggcctttaagctatttttttttatcttggatgtgcccccattattaataatcaataaatttagcgtatcatatagtattgtattagaccaaatacaaacacatatagatttgcaactaaaaaacggaatctttaaaatctatctagtctttatcatcaacaaatgtatagagaattgtagatattatacactgtttattcattactgtcggaatttagtattttcataccagttgtag

SEQ ID NO: 13575 - DNA, 186 bp, Candida albicans
atcttgaagaatttttttttttttcgcttctccataatctctcaggcactttatttatttaacaccttctttttttttttcatttttcaaaccgtgtcaacaaacataactattgaaacaatcagtgatatcttaacccattaccataagaaaaatgtctgtacccaaagaagaaggtcctcttcc

SEQ ID NO: 13576 - DNA, 186 bp, Candida albicans
  unsure (155),(177),(178): Identity of nucleotide sequences at the above locations are unknown.
ttcatcatcataattcaacaccaacttttaaacaatttaaacaatttgtgtattattttctttgttttctttccagtattactttacaactttaattctgatgaatctcaacttcttcttttttttcttctaatattgataatagtaaaaatatnttttttatggtctcaagaacanngtagtttt

SEQ ID NO: 13577 - DNA, 234 bp, Candida albicans
ccaataatccatttcactaataagggtaaatcttgttctggcataaatgggtatttattaatgggaatcaagaaacacaccgttagtcccctaacggcaaaaaaatctatgctggtaaataagatacctagcccaatggctacccaaattaaagaggaaaaatttctttcacctgggacaaccacctgggtaaccgtatatccactaaaggcattcttttttttaataaaaatc

SEQ ID NO: 13578 - DNA, 291 bp, Candida albicans
  unsure (82): Identity of nucleotide sequences at the above locations are unknown.
ggggtttcttgtgggagggcattcaaattatttcttactttgaaccgagaattggggggcgaattaattcttttgggaaatntggctggggcgttcatggaaaatcaagggattcttcaatttcttcacattcgggaagtgggaaagttccatcaaaaggttaggaatatattattattcccttttatgtggggggaagacattattcggtatcttccaaggcaggcagtaacaaaattagaacgtcttggctattatagtattccatataattgtagtaataaacaatga

SEQ ID NO: 13579 - DNA, 279 bp, Candida albicans
  unsure (30): Identity of nucleotide sequences at the above locations are unknown.
aatacccgaacaatgagaaatcaaaacatnagtgctttgagggagcattttggaagggcacgggcatcgtctacacctaaaaagttatctcctgtccggctctcgtatactaatattccttccaatcttcggccgccactgccaccaaaattcgatgattcagatattgctactgccaagagtttgggtcgtatcagacccatggtgtttccaatagatgatcaagcaaatttttcacctatggatagaacaaaattacaatctagaaatgctatgtag

SEQ ID NO: 13580 - DNA, 204 bp, Candida albicans
acaacccccaaaaagatctggttctttcttgaatatacaatacgtatttttttgtatcctttagttatttttgttaacgacaactatatatgtatctatttaagttcattaactgttttcatgatgtctgctacttcatccataataacatccaatgatggagaattgttagtctctatcaacccgccatttcctttaatttga

SEQ ID NO: 13581 - DNA, 189 bp, Candida albicans
cgctctatcagtgttccttttttacaaaataaattacgtgagaggataactcagacaaattctaaaattttaagtattctaaattccgaatgtaggttgtatcagtttcactatattattactgatagtaaaactggagaatcagaaaagggtaaaattcagccaattgttagttcggcattaaagtga

SEQ ID NO: 13582 - DNA, 318 bp, Candida albicans
  unsure (307): Identity of nucleotide sequences at the above locations are unknown.
tggagtttatcagaaaagtatataaagggtcacttgtccaatcttgtatttgtagtttttgcatttcaacatcatcaactattttcactaatcgtaactatgtcaactatcactttaacaagagaatcccacaaaaacccagcaaagtttagaattaaacaccaagacgaattggacattttgggtccaaatcgtaaggaccgttttgccatcaatgaagacttgccaaccattactagtacttcaaaaatgccattaatggttgccgtatttgaaagtatggccggtgcccctcaaacttatgacnagtatgaataa

SEQ ID NO: 13583 - DNA, 195 bp, Candida albicans
aacccgtttgctgaatcaatcgaatcattatcagaagatgtttccgccatgttacgtgaagagaatgttgttagttccaaattcattaagttgatagaaccaccgtatgtattgcatttaacagtactatcagtgcaaaaaaaaaatgaaggaacaagtactaaatatgtcttttacgactggttggaggtttag

SEQ ID NO: 13584 - DNA, 237 bp, Candida albicans
ttaatgtctaacattggtttggttattataatttggtcatatagtatgaaacggttgcaaccttcaaattataataaaagcagaaccctgaaatcaaatgtaataataatattattatcatattatgtcacttgtggtaatttttatttaatcggtgatattgtttacttctatattgcaaaaaatgagggcaatatgtcaataaacatcaagacttcgatcaaatcccagtgttaa

SEQ ID NO: 13585 - DNA, 330 bp, Candida albicans
aagacatatttagtacttgttccttcattttttttttgcactgatagtactgttaaatgcaatacatacggtggttctatcaacttaatgaatttggaactaacaacattctcttcacgtaacatggcggaaacatcttctgataatgattcgattgattcagcaaacgggtttcaatttccaccacacaattcttggaagtcaagaataaaacactttttttacttgatgtggaatggtccctcagaaccaagagatgagccggctccacaaatagtctttttagaatttttagagaatatcccagataagttcaaagaaagattataa

SEQ ID NO: 13586 - DNA, 210 bp, Candida albicans
tttgaaggttgcaaccgtttcatactatatgaccaaattataataaccaaaccaatgttagacattaatcatttgtacaaatcacgtgacactaacaattttttgtctagacacgacatcctagttagggagattttaactgtacaaacccagatcaacctgccaaaagttttccctaaacctccaaccagtcgtaaaagacatatttag

SEQ ID NO: 13587 - DNA, 198 bp, Candida albicans
tgcaagaatcattcaaaatctttcaaagttccttttgggggggagcaagaaagaaagaaagaaagagaaaacggagtgattttttttttctcttttgcgtccgctccctccttccatctctcccttgctttcctttctccattcttgtctgtatcttccccgcgtcttcaaccacgggcgctgcaaggaaccgagctt

SEQ ID NO: 13588 - DNA, 204 bp, Candida albicans
atgaactattggttgcaaaaaaaaaaaaaagaatataaaaaaataaagaaaaatagaatcaataatatcataactatattggttggtaatgagaaggggcaaaagaaggagtacacttatgacttctactactatcatttattcattcattcgacccctatttcatgcaaaataatactgttgtcacgtgatgactactactaa

SEQ ID NO: 13589 - DNA, 195 bp, Candida albicans
aaaaaactgatgaagaatctgtttgtgatttatttaatttgtaatcttagtcaagttgataaggaattgctattgttattggaattgtttttcatttacgccttcttcttcttcttcttctttactccgatgacttttataaattttcatagtaaaatttttcttttttttttctttttttctcggaaatggtag

SEQ ID NO: 13590 - DNA, 198 bp, Candida albicans
gcggacttccagcctgttgtgaaaaacttgaatctggagcttagtgccagtaatcttaaaaagaaatcaaaaagaaaatgtgtatattcgttcagatcaattcaggcgttatcattgttgtactttacaacaaagttgcaaattgatttaattttcgcaacaagttttgacccaaaaaaaaattatacattcgactaa

SEQ ID NO: 13591 - DNA, 186 bp, Candida albicans
gggatttttcattggaccaagtttaatcaaacaaggatttccaaattatataaatcatttgatgagattgttgcagatatatattccacattagatgatattttaggtaaagtgttattcagttgtcttaatatgagtttcattagacaaagtagttgtaatggaggtagatgtagcatttgttaa

SEQ ID NO: 13592 - DNA, 315 bp, Candida albicans
tcagatttgtcgctcgatatggggaagatttataagggattaccctttttcccagataccaattatgaagtacgtaaaaattaccttgcgggtgatcaactccaaagcgaaggttataatacggaactaatatttttgaaaaacaccattgtcccccaacaagcatttgggaggttttcaaattcgttaggctcctttaaaccctcaaaaaaatttccccattggtcaattgctctgggttttaaactacccccaagcctttatgaaacaaattgggtttatctgccacaccctttcacctcgcttgggttttcc

SEQ ID NO: 13593 - DNA, 282 bp, Candida albicans
caaagcatatttacaatatacatacaaaaaaaaccatatttttattgtcatataaaagcggccaacaacttatatcataaattggtcccttggcccagtcggttaacgcgtggtgctaataagtttaatttgttacgccaagatcagcagttcgatcctgctatggaccaatttttttttgctgagcttagactgccaagctctacgtccaacactcaaagtcggatagattttaatttttttttcgagcctcatatctcagtacgtaaattgacttgctag

SEQ ID NO: 13594 - DNA, 948 bp, Candida albicans
  unsure (916),(923),(929): Identity of nucleotide sequences at the above locations are unknown.
aaaccgttcgtgataaatttagaccagggggcgggattgttttacattaattcaacttcaccattattcacccttcggattgtcaggaataattatactgtcgatccccttacatcaaacggagcacgaatttcccgatcacgttcacgttccaaatcagttgggcacggagaagcaatatcaccagcgtatttttccaagaataaaaccaaagatttagtgaaacaggaaacagcacatatcattctgaagaaattactcaacatgttacaagatttggatttacaaaaccctattgcattgaaaacaatatcacaaggttcagaatcaaagttttgtaaaatctacgtgtctaacactaataattgtatttacttaccagcagcaagttcaacaagtttcacttatgaagatgatgaaaatggcggcgttataattgctgaagatagaaatgatgaaatgccaacagcagttaataacaatactttgtcaatggatagtataaatcattcagagactgatttcctggattctccaccacctccagatttattttctaaaatgaaatcattccattcaccaaattacttgacttcaaaaatcgattctgaatgtccaattccacatacatttgctgtcattgttgagttgaccaaggactctttgattattaaagatcttcatttccaatttcagtcattaactaccattttatggccaactggggatgcatataatcggactcatgccaaggagaaatttgccattgggaatatggaatggcgtacatctttaagcgacgccgactattatatcaatagttctaattccaacgatgttaagctgaaaaacttgggtcctgaagatcttattaatcgaactagagaatacaaattaataaatattaaagaacttnacttttncatgcnccaggaccactggatgttt

SEQ ID NO: 13595 - DNA, 297 bp, Candida albicans
gtaatacaaaaggtagatgataaaattgttatacaattaggttttattattgaactagagctatcattgaatatcttagtcatttcctttcccccccttccccttccccttcccctccgcccaagttttgtctacgctgagctagaattatacgaaaacttattattagaaacaaatctatctaatcaaaagaatagttattatcaacatctatattataatatactttataattatcctcctcaagaatcaaaaaaaaaaaaaaaaaacccaatatttcttcttcttcttctttaa

SEQ ID NO: 13596 - DNA, 249 bp, Candida albicans
aaattgaattattggattaggtatataatcattattaaaggtatcgaagtaatgaaaccaagggaaagtatgatggaatttggaaaggaaggtgtaagaaagttaaagacgggggaaagaaaaaacgaaggaaggaaggaagggaggcggaggttaaaaatattaatttcacgattcctggcatataactatcaaggaagggatcaatcattcaatatcatgaaacaacaactacattgtattaggtaa

SEQ ID NO: 13597 - DNA, 183 bp, Candida albicans
  unsure (85): Identity of nucleotide sequences at the above locations are unknown.
ctaaataataatgtcgaagagttattaacgtgtgctacggaacgagaaatggaattcttcagtatattctcacaaaatgaagagngggtattcggaatacccttaagaatatggtggggggaatggcgcaattcaataatagggaaattcgtaaaacaaaagttatataggttcagagggtag

SEQ ID NO: 13598 - DNA, 645 bp, Candida albicans
agacggggaaagaaggatttccagccattgacacctcgctctgaaccaattagcggtgaaactacgaaaaagaagcgtaaatcaggtaaattgaatgacaataatgaaaatagtaatggcaattctccaaagaagcaagccaaaaccaatgcaaactccaaaaacttagatcctataataaaagaagaagagaatggagtattatctttgaagaaagaatcttcaacttcattgcaagatcaagatctagatttaaaccccccattggcaccaactcaagccactgctatgtccaatacatttaacgacgatccatttgatgttcatttattagatacacaacatcatcaccaacaaaatagcaacaacagcaatcataatcgtgggcaaaatctttcaaatggaagtaataatctcagtgtaagtggcccaggaatgggaatgaataatctggtatttggtgattcgactcatgcatttgacattaatttcaacattgatagtcttgatgatatatggacaactactggaccaggaggtgatattactggcactggttcgggttcaggaggtgctggcggtaccgatgatgataatttcatgggaatgaattgggctgcagatccaattgaaaatggcgattag

SEQ ID NO: 13599 - DNA, 216 bp, Candida albicans
attactagcaagttgtacattgatgaaagggtttggagtttatcaattcataataatgatgatagtaccagtttaataaagtgcatgcatgtgtctagtactattgaaataatatctacaattaaagttttattgcttaaactactttctaacaggtccaaattaacaagtattttcctttccttcagccattaccagttgagccacagacattga

SEQ ID NO: 13600 - DNA, 249 bp, Candida albicans
  unsure (30): Identity of nucleotide sequences at the above locations are unknown.
aatatacattattcaatacatgcacctttntaccctccaccaaacatttttcacaattggttaggaattaagattccacggaaaagagaacaggaaaaaaaaaggaaagagaaagaaagaaggaaagaaaataaaaagagaacagacagggaattcaaatcaaactttcaatataagggaatctttcatcaaacattagacaatttcagcaaccatgtctttttggccatttacaaactctatgaatag

SEQ ID NO: 13601 - DNA, 744 bp, Candida albicans
ttcgttcacacgttacatgtgggaagaacaaagttgagtgaatcaagtggtatgatgatcaatttgaaggatattctgatttcatggaataagttacgatcatttgctgaaattgggataattgcacccaatttggaatcattgaatatagtcgattgttattacttaatggattacacaacattaaagctgtcatggaaattacaatctttcacgataataaattctccttatccaattgggttgtttgatgagactagtttccctcatcttgtggatttttcgtataaggaagtgaatgctaaaaactatcataaagtatggagtgtttcatttaacagaattcacgaaagttttaacctgcaattattttttcctccaaacttgaaaaatttgactttatatggtggagagtttgctaaatctattggatttgtgttcatgttgcctcctttattggaaaagttacacattcataatttccgacttaaattcccaattactaaatttccgcaacatttacaagaaattattttaaaagttccagcagtttatattctcaatcaattaagaattcctccgcaagccaaaactgtcgttattgaagctaagaaaattgttttcagatgtatggattttttttatgatttaccagaaggccttgaaaagcttactttacatgctattaatcaaggtaaaatattaccctgtgttcaccacggggctggaaggataccgcgctta

SEQ ID NO: 13602 - DNA, 222 bp, Candida albicans
caaccaatttgtttggaattattagcatctttatctaacattaataagaatgctgcaccaacaggagcacaaattcccgaaatcaccatggggatttttacattacttgtccggcgaataaaaggtccattcaacattgaagcaacaacaaccgatacaatcatgggtaaaatggcaatagacgatttgaaagcggatttattgaaaacaacttggaaataa

SEQ ID NO: 13603 - DNA, 321 bp, Candida albicans
aattatttcaataacctacatatctctctttctttttctcttaaattacaccaacttagtagaaggatgaatatagaaatgaaggaccaaatctcaaatctcattggaaggtggtggaatctacggataaaatttgatctgcgtgtccaaaaaaaaaaaaaggaacatcctcataataataataataataatttattgtcagcaacggcggatttaaaaacaaaaatcatcatcatcatcatcatcattttatctgcgggtacagccaccattaccaccacccacccacacacacaaaaacagtcaaaaataaataaataa

SEQ ID NO: 13604 - DNA, 207 bp, Candida albicans
aaaccacaatcaggactttgtgataaaccgccgacaaaccaaaccgaaatgacaaatttaagagaacttgaagaggaaattgaaacttatgaaggtacttctggggatttacaagagcaaaatgtattacaactaccttcaagaaaaacttctttataccagaacgacccacatcacaaccaaaagttcaatcgaaaattcccttaa

SEQ ID NO: 13605 - DNA, 198 bp, Candida albicans
atcaaaacaaataaagtgtgtataatagaaagagaaattttagatgctatttttttttggatttttatacacgctattcttagtaatttaaggaatcagataattgtaacaaggaatgctaataaacaaggcaaaaaaaaaattaaaaaccacaatcaggactttgtgataaaccgccgacaaaccaaaccgaaatga

SEQ ID NO: 13606 - DNA, 222 bp, Candida albicans
  unsure (22),(23),(43): Identity of nucleotide sequences at the above locations are unknown.
gctttccgtctcgtcgcgacannatttattggttcatcttatntcactctacaggatttttgtgtagcagatttcgtacctaaggagggtgtgtcggtattggtaccattaacgggtattagcaactacaatatattgctagtcatcactagtaagttttcattcattttttttacaaatagtaggattgaaaagggaatcgagtatacttcttggtgttga

SEQ ID NO: 13607 - DNA, 198 bp, Candida albicans
tttaatggtaatgaaatatctgtggttggcgacatgatgaaactttgtttgaccgtaacatttaaaatccttaacagatgttgttttacagcaaataacggaaggcatgacaaagagtctataggtacatacaaaactggttatggtaccatgacaatgaatgagaaacaaaacttttattttacttttgattgttag

SEQ ID NO: 13608 - DNA, 549 bp, Candida albicans
ctcatgattgaaaaacttactattaagcgatcccgtcaaaaggttattgcttattcagtgataataatatggctaatgatagttaatatttggctattaaacaattatcacctaaattcatccacactcaccagacacggcaatggtgataatttgattgatgaagacgatgatctgtcatcatcatcagagtattctatttataatgaactagatacagaaaactatctaggccagcaacaccaagaagaagatgtacctaactcacaatcaaccgataactcattgataaagccaacatcacctggtaaaaactcatttaaagatgatatcacgattaaaatcttacagaagcatcttcaaaaacaacaaaataatccaaaagatattcgaactaaggatagtcatgcagaaatttataatcaaatatttgaaaatcatccacaaattgatacaatattagggaacttaaattttaatcaacgatgtcaattatttttccaaaatttatttatgtcttcaccacaggggccgaagcatccgcgctaa

SEQ ID NO: 13609 - DNA, 342 bp, Candida albicans
ttgttttcaatattgtatgctgcattatctttcatttcacaaacagtcaaagtgttatctgtcgctaatcttgtaatgagtgctactccaaccagagagttggatcagcatacgaaatcttcaccaaccaaagcatctcagccaaagtcttttcatgcaattactacaccatcccctactgattcggagtcaattaccaaagaaaaaaaaccatcaccatctaaccccgaatttgtatccaactggaaaaatttaatgttggtgacaccaaatacatcatcacggtcacctgtcactgatagcttcatcagcattgaaaagcgaaaccaaagcaaaacctga

SEQ ID NO: 13610 - DNA, 399 bp, Candida albicans
  unsure (213),(247),(284),(377): Identity of nucleotide sequences at the above locations are unknown.
ggtcaccaaaaaagcttccactggaagaatgcacatcgtcgggtcgtttcggatggaagtgacgaaatcagcaataaatcaatgtccaaaatgagctcacccccacaaccaccatcacttccattaccattaccacccacatcagtacataatcagcaaccaccaccgcaacttttaccatcactggcaattgtcactcatccaggaaatcanaatcaactgcaactgcatgtacatctgccttctntaacccaacaattggtgccaccaatggtacccatatntaataccctcaacaatataaccaacaaagtcgcaactgaccaagaaacacattcatggcaagcactattcaaaaaggtaatggaaaggtcaanaatcctcctttggacagaataa

SEQ ID NO: 13611 - DNA, 198 bp, Candida albicans
tcgtgttcaaaatctcaacagcaagaaacagaaaatccaattgttggtgtttatgaaaaattatgcgaaatttggaaaatagctgtaacaggatacacacacacacacaacccttgcccacgaaaaaaaagtgaacctgacaccaagagaaagcaaccagacaaactacactatacgacgacagacgcgaaacaataa

SEQ ID NO: 13612 - DNA, 273 bp, Candida albicans
tcctcggtttcccaatttctatatctatttccattttgtttttattttcattttttttttttcaatttttatctttcagaactaagtttgtcacaatatatgtatatttcattaactcataatctttatacaatgctgtccttaacttctgagatgttgaaaaacagtcaacaacacagacgtgttaccagacatctactcaataacatagctaaaccatctttaagagctttcttatacgcctacctttatttggttttaccaaaagccata

SEQ ID NO: 13613 - DNA, 264 bp, Candida albicans
atcgggcatttctatcatcttgagttattcttcaattttgaaacttttgatagttggttaatcttactaatgattaatcaacttttacaaaagaaaagaaatataaaagaaaaattttggaaaataaattatgggacaaaaaccagtttgaaaattgttttattcaactccttttttttcccttctggttcttacttcttacttcttacttcttttgttagtgttaagtataataataaaaatgtattgaaagtgcgacattga

SEQ ID NO: 13614 - DNA, 198 bp, Candida albicans
aaaaccggtaataaaacctgtatgtatatttattctactctctttatgttacagccaatgctatttttacgaagtattaattacagattaatgaggagcataaattcttatgctatcaacatatactcgatgtttgtattgttgtttggacaaaatactgcatatacattttcaaagtccactcataaaacagcgtga

SEQ ID NO: 13615 - DNA, 183 bp, Candida albicans
gggtgcaagactatgcaagccaataatcctaaagcaaaccaatctattaaagatatggtgagcaaatttgttgacgatagtaaagaaaaatctattaagcaagctagagaaactaataaaaaattggaagctactcaaagaagaaaagatagcgtgaatcaagggttcatcaaaagacattaa

SEQ ID NO: 13616 - DNA, 198 bp, Candida albicans
gtagctgttgtcaattacaaaaatgggatgactataaaaccaacttatttaatgccatgggccattgggcatggggccattccattccaaatcaaatccaacaaaggaaaattctctcacttaaaacaaaaaattgttggtcctaattttaccctttttaaatttatgttattggattccggatgttatgggcattaa

SEQ ID NO: 13617 - DNA, 291 bp, Candida albicans
atgttaaagacggattcacttgatttccacagttatctacctccttatcggtccttaataaaccctaatgctagatatgactatcgaactcatagccttatcccattgacccaaaatgatttgaacttattacggattgctttccaaaagaagaaggaagcaccaccatctgctttcaaaatgaagtataaatccctattgagtgatgtgagtcgaacgatttcaatgagattaagtaactcgaatttattatcgtcttcaagtgctcatactaacatcttcacaacggag

SEQ ID NO: 13618 - DNA, 252 bp, Candida albicans
  unsure (44): Identity of nucleotide sequences at the above locations are unknown.
gtagaaatcgattttccatgggatttggaagggtgtcctagagnaaataattgtggggattggatccgggcaaacttaaatggcaaacaatatcaaataccgtttgatcataatttgctggaatcagtaatccaatgttcacctttttttcatatttgtcatttgcaagtgaaacagtttaagtctattatatactacaaggcaaatttaaccacggaaaaagaattaacaccattttttaaacaagtataa

SEQ ID NO: 13619 - DNA, 219 bp, Candida albicans
atagggaattcacataattatagtgacgaaagtattcctaaagttcatgatttcatccccgtgttctggatgaattttactttaaatgtaggtaaatattccaacttaattagaggagcggtgaattcgaaacaattcctaagattatggaactaccttatttgtagggtttatggtaatgaagaaaaagttaaacattggcaattgactaagaattga

SEQ ID NO: 13620 - DNA, 513 bp, Candida albicans
  unsure (400): Identity of nucleotide sequences at the above locations are unknown.
tcaaataagattattgctaaatacaacaacaatagtaatgcctctaaggcaacaaatttgaaacaacaagtcgttttacctacttatactttggattcaaatttggttttattaccagggataatgtacaatgtaacattttccagattcaaagctgctgcattgttatatcgttataaaaatttcatttcacaagtttctatcattaacaacttgttgaatgaatacgattttaatagtggcaacaccaatgaagaagaacgttttgaagctgaacaaaaattggagcaaccagaaacatatcatgagataaaccctagtgtgatttcgccagaagctgttgaaggtattaaagaatttttccaatatgagactggtatgaaaaccggtcgaggagtanaaaaaggggtcaaatctacacaaaacgatgctattaaagaatttgattggttaacattagcaattataccaaacttggaaaaaatcaagaatccagaaaccaactctagtgct

SEQ ID NO: 13621 - DNA, 189 bp, Candida albicans
caaacaaataaacgtggtttcccagagggggttgtaccaaatgcagtcaactctaatgggatgtctttggacttttttgacgttgttgttgtcgctgctgctgctgctgcattgttgtttgttgaatttattgaattacttggcgacatggatgttccagtattggtattctgttttttgtgcttataa

SEQ ID NO: 13622 - DNA, 798 bp, Candida albicans
aaggacattcaaaagtattgcgagccagcaattatcaatgaatcattgttaacaaacttagcatcgaaattgggtatactggagaacgaattgtcacatttaaaaattcaaaaattgccgttaaaggagaaactaaaagcttttgttggtgaatttttaaatgcggtatactttggtggggactacattaaaatactagagaaattcacatttgaagaaggtgttgaattgatctatcatttggtgtcagttttgttgcaggaaatgcaagcaaattctgatttcattacttggaaagtaatttatttgttgctaaagttctttgatgaaaacttgagattgtttaagtttaaatttgttaattttcagtttaaacggtttttgaaacagcttgttgaattgccaaaagttagacaacgcagttccagtactgcagaccagtattgtagaatttgctgtttgttgtgtatcacatcgattttaagatattgcaaaattatatttgaaggttacacggatttgaatgagattgaatgttattgggtacttttcagcaacgccgttcattcatacaacgcagacaaatctaaattttcagaatatgtttactcgtcattcagaatgcaggatttactaaatgattttagattcccaaaggacccaaatccacaggacgatatcctgcaagagtccttacaggttgctcacagggtattggtttcagagattgatctaattgatactacctcgggtgaagtgccggatacatgtatactagattatgactataatttctaa

SEQ ID NO: 13623 - DNA, 228 bp, Candida albicans
ggggcacactctgtcgcgtacgtcccttccccaatggtgaagacaagcaccgagattcgtcaactgattacaaatgatgttgattctccagttagtgtcaattctgattcaacatcaaatgtacaatctattgagccagttgatacttatagttcagcggaaattgacaatttacttggaaatatccaatggtttgatcaatggacagacttcaacattgatttttag

SEQ ID NO: 13624 - DNA, 279 bp, Candida albicans
attaagagagagacggagacggagagaaaaagtgggggaaccaaatttattattcatcatcccgcggaagaagaagaagaagaagaacctatactatactatactaatcacttttcattaaaagctaactataaaacaacaattaaagatgtaggtatatacattttatacacaaataaattgtttattaaatcatatttgaaaaaaatttatatacaagttatttcattttcttctatcaacttaatggaacatccctttttttttaaagaaatttag

SEQ ID NO: 13625 - DNA, 273 bp, Candida albicans
ctggcagtacttttactgttttcaaggtttacctggtgttgtctaaaaagtgcttactttaacagacataagagttttaaaggcaatggacgggaactgacggagagaaggagttcaggactagtgaatagtttccagttgaattcaagtccggatatccctgtagcaattgaaatgaagaacaaaaaggtatcctcaacaataacaagtatcgtagatcatgaaattgccaattggaattcatgccttatcctagtaatctttgcaatataa

SEQ ID NO: 13626 - DNA, 186 bp, Candida albicans
ttgaaaaaaaaaaaaaaaccacatacacaaacacatacaccatcaaaagattttattaatcaggatattcacccaaattccctccccccttcatactataaaccatgtcaacacctgctagaagaagacttatgcgtgattttaaagtatgttactccccccttttttttttttttttggttataa

SEQ ID NO: 13627 - DNA, 186 bp, Candida albicans
gaagtgataattataattgacattaatcaactgttagttattcattggcataaatcaattcaattcaattcaattcaattcaattcatttaaattcaattcaattcaattaagcaatgcgtttggtttggtagtccacgcattttttgttgttgagagaaagaaatcaaaaaaattttttttatag

SEQ ID NO: 13628 - DNA, 627 bp, Candida albicans
acaaagatggtattaaaaaattcaaaatgggataagaaagcaaaatataaatatttgaaaaaacataacattcttccaacaaaaactgaaaaagataatgctaatactactccgtcaacaaaatggagttcaaagaagaagccaattgataatcacacaactggagtaacgcttgaagattctgatgatgaatgggattctgatattgatgatgctttaatcaatcatttttatcctcaattatcagagaatgatgaattgactattgaacaaaagaaaaagataaaactgcaaatattagcaaatctagataaagataatgaagaagaagaaaaagaaaaagaaaaagaaaaagaaggaaaagaatcaatagaaaatacgattgaggacgaacttgatggtatatatcttggatcagatgatacaaataaactaaaagaattaaaacctaatatcaatggtgcagattcaaaatttgatttggaagaattcattaataatcttgatattaaaccgaaaaagaataaacgaaaactactacataataaaatatccgataatttcttagaagaatatggactttcaagttatcaagaattgaatcgaaatgttgatgattataatatt

SEQ ID NO: 13629 - DNA, 465 bp, Candida albicans
ccacacatttgcaaaaccgagaaacaaaaaatcttcttatttctgtttaggccttatcgcaaccaccacctgcaaactataaaattcccccactctaaaaacagaacaaaaaaaaggagacaactggatacacttcttcttcttcttccttcttctaatcaaacgatgaaagttactaacgttatatcatttgctacagtggcttctacagcagtcagtttggtgattccagacatcacttcattctttagtagttttaatcaaattttaattccacaccatcaacaagcgctattaatcaatcaagatgcgcatttgccctctgatgacaaccaaccagatactaaaaccggtattctttctaatccattaaataaaataattccaaatcattacattgttgttttaaaagatgatttatcacaagctcaatttttacaacatcaaaatggggttcaaaaatga

SEQ ID NO: 13630 - DNA, 288 bp, Candida albicans
  unsure (37),(73): Identity of nucleotide sequences at the above locations are unknown.
aaacttgctgttgctgttgttgttgttgttgctgtanttgttgctgttgctgttgccattgctgtcgctgtanccgttgctgctgttctagttgtcgaagttgtcgctgttgctgttgctgtaataattgttgctgctgaaaatgatggatttgatggtcgttcggacgttgttgcgataactgttgtagttgtaattgctgttgttgctgttgttgaagaagagcatgctgctgatttaaaggtagccgctttatatataaatcccgataataaagagcttgtctaa

SEQ ID NO: 13631 - DNA, 882 bp, Candida albicans
  unsure (796),(832): Identity of nucleotide sequences at the above locations are unknown.
cctttaggagacgcaattgatacagaacagaacttacgcgaagatcaaactgcagaagctgttgatcccgcagattcccctatatcagttataaatgtgacacttgatccaccaaatgaagccaataaagaaaattcaactgagagcagtatttcattatcgaatttgtcaccaaagaacagagaatcatcgttaagctccagttcaccacaatcagtgccaccctcaatgatcacaccgatatctcctatgtcagctcaagcttcaagcgataaagcgcaagtattgcatggagattctaacacttctaatcaacctcgttacacaagctcaccagactctgctgcactgccattatcacttacaggtcccaatgacatcaatgaagaaaatcgaactcctcagtcccacaacctaaataataccgacgctttacatggtcaggactctagcaactcacaagctgtgtcaaatagtagaagcattcaatctgtaccaacagctgctgtttcttcaaaaaatcaaggtaatcaacacagtgatgatcaaattagaagtttgaatgaagaaattaaaaaacttagacaagctctttattatcgggatttatatataaagcggctacctttaaatcagcagcatgctcttcttcaacaacagcaacaacagcaattacaactacaacagttatcgcaacaacgtccgaacgaccatcaaatccatcattttcagcagcaacaattattacagcaacagcaacagcgacaacttcgacaactagaacagcagcaacggntacagcgacagcaatggcaacagcaacagcaacaantacagcaacaacaacaacaacagcaacagcaagttttcaccacgggctga

SEQ ID NO: 13632 - DNA, 669 bp, Candida albicans
tttcgaaactcctcccctatatatccaataatgaaacagaattatattttactgataattttatgttatcttctcgcgaatgttcattctgctccagcaattatcacagtttggcaaacagttacggatgcacaagtagcagctggtccaactgcagctgctcctgctgctaatgctaatgctaatgttcaacaagcagctgcagcttctgctccagctccagctcccgtggcttcacccgctgctcctgccccagcctctagtgcccctcaaagttcaactccttcatctagtggatggttgagtaatttattcaatagtttctttggaggaagtgatagtgatagttctagtggcagtgacactgcatccgctgcaccagcatcaacaagtcctcagtcatcatcatcatcttcttcttcttcaggaaacagtttcttatctttcttgagtggattatttggatcaggaagctcttcatcaaccccatcttctatttcacaacaacaacaacaacaacaagggtctccagcttctggttctaatagtccaaattcagctcaacctgatgcagcagctgcgtcaaatcccgttccacaaagtaataataatcaaggctctggattaggttctggttttggatctggatttggctctggttctggctct

SEQ ID NO: 13633 - DNA, 213 bp, Candida albicans
gtcttggtaacgaaaagagaaaaattgctttctatgtcaaaaaaaaaaaacaaaaccggaaatgaatggcaaatagagattaataataataatattaataagaaccaacagaatcaagaagaaatttacacgaataaaacgaagtttaattttttggggggaggaagggagttttattttattttatttttaaaaagaaatcaatttacataa

SEQ ID NO: 13634 - DNA, 897 bp, Candida albicans
  unsure (46),(52): Identity of nucleotide sequences at the above locations are unknown.
gttcattacgtagacacaaacaacaatctactattactactactantactantactcaacaagatcaaaacacaatctagtctccttactagaaataattcaattaataataaatcaactaaaatcataacaaatgatactgattcatcaacaattaaaccagaaaagaataatagtggtcataatagtcatagattatcaaaattatttattcgaaacaataacaacaacaatgatgaagaagaagaaggatttttagatgattcaagtacaataattactcccactataaaatatttcaataatactatttctccatcttcaaattcaaattcaaattcaagtttcttctacaataagaacaaggcccctactagtaatagtagtgatggtagtagtaataggaaattcaaaacttcatccttatctaataaatcaccattatcgaaaacatttaaacgagcatatactaaagtattcaagaaatcacaaataatcgatactaataataataataataataataataataataataataatgaaaagccaagattagtgattaggaaaaccatgttacatgatatattaccatctgattcagatgaaaacgaagataatgagaaacaagaagaggaaaaagcagaagaaggaattaataaagtgtcacccaatcataatgacaacaacaacaataaggacaacaaaaaagaagatgagggaattgaaaaccaaatttgtatacataaatcattaatatttcgtgatgtattacctactaataaatcaaatcatactgctaatataactaaagaaaatcaatattctgaacatataactatttcaccaattattattttggattatatgaatgatttgaatttgaaatatcaataa

SEQ ID NO: 13635 - DNA, 198 bp, Candida albicans
agaattgggagaaacaggaaattcagggatacgtttcagccaattctatatcagcagatccctaagaaaattcaacccccatctatgttgttaccattaccactagccataacccttacccttaccactaaccaccaacacccgaaagtatggttcaaccatctaattcccatttggtttaatacaaaaaagttttaa

SEQ ID NO: 13636 - DNA, 468 bp, Candida albicans
tttcacttaacatcaattatggcttcaaatcaaccaattatgcccaaaatcaataatccattgggtatattacgtacttctcaagcagtggcatctgatatcacgattaatattattttatatgctttaatttattcaatcatttatttatttcgtctacgaaatttatttcttcaattcaatcattatttcatcactatcatattatacatcttagaaatcttttggatcatcttatatattattattagattaatatatttggtttataatacaattaatgattctaaaattaatgattatcgttataatactcatgggattttacgtacttttataattcataatcaattttggaaatttaaaaataatttagttatgaattcgatttttaaacatggtcccaatgtttttctagacattcaagatgtcttcagcaccgggctggacaaccaaactgcggcaaca

SEQ ID NO: 13637 - DNA, 195 bp, Candida albicans
ttggtttgtagttttgactggtcaaccaaacaaatgcacacacacatttacaatatctccagtagatatggtaaaaaaaaggaaacacaaattgagaggttaagaaatgaattgaaatcgttaaacctacttatatttgagatgagggagtataaatatggaaacgcaaaactaagattcagaaactacacgtga

SEQ ID NO: 13638 - DNA, 312 bp, Candida albicans
ctcatgaattttctctataacaattcagattatagtagcacatcacatactatgaagtcaccactggcatataatcagtttcctaaactacaggcaagcaattcgacagctggtaacaataatacagccacaacagcaacggcagcagcggcagcagcatcagcatcagcatcagcatcagttacaccacaattgatatcaccaacaacgttgaccacaccacagaacaagtataaacgtggaggattggataatacgcttcccaaactagaaactactagattttcaccacgccctggaagatccgcattt

SEQ ID NO: 13639 - DNA, 321 bp, Candida albicans
gtttcatgggatatgacagataccatcacttttttaagaacctgcatagtcacaacctcaagcagtatagaacagaaggataatataaagtttgatgtcattgcgttattacttcatcatcaccctattgttattttgtgtagagtgacgattgtatttgcaccgcctgcagtgttgtttgattcgttgcttaagccattccttcctgcctctatcaggaagtgtcactggaagatttatactttagttcacatcgatagcttatttcaaaaaaggtacaccctaacacacctcattaaaagatcacatcataccatctaa

SEQ ID NO: 13640 - DNA, 711 bp, Candida albicans
aattggttcaacatagtcgctgggtatgctttatcgtttggtaagacaatgactcttttgaaaagaacatattactttttttatgccgctattgtggtggctctagctgctgttttcccatctattcgaggagtatttttggttgatccttggaatatgatatttgcaaggaccgattttgataatctgatttataaaatttccccttcggacttgccaaaagatgaacagtatcaatatttatcccaattaagcaagaaattactccgagtaattaactttttcacaactagacggaagctattgttgaattatttgggagtaaaaccacacccatttctgcacttcaaatatatggaaaaagttgaaccattaaatgattatgataatgttgttcgttttaaaaccgagaaaatggattttcaagaagttatgattacaagtttcaatgtcaacaatataattaacgtgtccaattaccctttaatgaggatgctctataataacagtgacgacaactaccaaaccttcaagagagtgatagagaaagaaaaccatgatcagaaagtaaggattaccaaatttagggccaactacgaaaggaaagaaggtaaaaacattgatacttttaatagctacgaccgtatcagaaggactcaaagtgaaggtctgcaagacctgaacgaattggatgatattagattacgatag

SEQ ID NO: 13641 - DNA, 222 bp, Candida albicans
  unsure (86): Identity of nucleotide sequences at the above locations are unknown.
tttacttccattgtcaaatatgatacatttcattgttacaaatttatcaaatttttatatgacataagtaattacacattcgttanatatgttgaaacaaacagcgactgggaaggtgcacctgaactattgaattgcattaaacagataattgtcaaggagttttcttcttttgagagttacctggaaatagtcgagtgggtacaaacattgaatatataa

SEQ ID NO: 13642 - DNA, 825 bp, Candida albicans
  unsure (144),(155),(824): Identity of nucleotide sequences at the above locations are unknown.
ttaacaattttaagccaaagttgccgaggatgtattgattggattgatagtttaaattctcgattggaacatgtgataattcatcaaaaaaatgaattgaatgaatcacccaatgatgagttaacgagaaaacaaaaacaagcnacagttgatanatatctgtcgatgcattttgatcaggactatgaaaaattggttctttttcttgaggttcaagatagtcattatccacaaaaagattcacaaaaagaggaaataatagatagtaatgacgaagatgaacaagaggaagagcaagataatgacaacgatgatgaaattattgagattttgtcactggaacctgaagaggaagtatcggaacaaccaacaacacaagaacattacggtcaattccatgaagagttacaatatcctcaaatgacccatggttataacaataatttccaaatgagtggaatagattatggtactaattataatcaaaacatcgaatatgacgaagaagaagacgtaaatgaggatgagggagacgaatttgacggatttattgatgaacaagctcatgaagttcaaggtagttccaattatgaagatgaggaagatgaagacgaaattatagatgaaggagatgaggtcgaagaagaagaagacgatgagcaatatagttatggaaccggcgcacaacaccagcaacgtggatatggtataacgaatgtacctggttacacgatagttaatggtagacctcgattgtcagataatctagaatatggccatgttgaaacttttgataataaggacggcgaagaagaagttttatna

SEQ ID NO: 13643 - DNA, 213 bp, Candida albicans
tatctttgtactacgtgcattaatacgtacaatttattgttagatatattgctattgcggatcctgcgacttcccaacactgtttcgcatacctacgcaggcgaacatagtgtacttgaggtaattatcgtagtttttaatcagcaagctacacggaagaaggaaaaagacaaacttctggtcagtataatatgtgttaacattcccgattga

SEQ ID NO: 13644 - DNA, 216 bp, Candida albicans
caccatactgaccagagagatacatggttgctttttttaaccgacaggcgatttaatgaggctccatcacacacgcccatgcattttttaaataattgcagtggggttatcttgtttacaatattaattagaattattgcttgtcatttaaaatttctgtatctgcacaaaatgttattggccaattacaatatgtatatatttgcaccaatttaa

SEQ ID NO: 13645 - DNA, 183 bp, Candida albicans
ttggtagtagactacatatctatgcatcaaataattaaattgcaacaattaaatttatactgtaaaaaaaatttattatgtatgggtgcaattcaaataagagattttggagatcatagtcacgtgattttgacatcaacatttagatatttggatcaatattgtttgattgttggtgagtga

SEQ ID NO: 13646 - DNA, 765 bp, Candida albicans
  unsure (697): Identity of nucleotide sequences at the above locations are unknown.
gcgtgcgtctttccagcgccgtggtcgaatacaaacacagccaggaaaaggaatcaatcgcaaaacaacagaccaagacaaaacagtaatcctagagatgaagcaattgcaagaacaagaacaagaagacgatcatcattatttcaggacagtcgagagagccacctagatgtttctaaaaacaataccgtacctaatacttctactactcaagaatcatcatcgaaactttggagtggattaactaaacctctagacttgatacaacaatttgacagcatgctacaaaatgagtttgaaaagtccttgatcaatgaacgtgaccaaaagcgacaactacacagtgacaatggaaagcgtttatcgcatcaatccaaatcttcagagggttctatatcaagtatcgggtctatcaattcaccattacaagcaaagtccaaggccttcgaacagaaaaagagtaatatgaatagcagaaccacaaccgatgacatgttgcagaatgtatcctcatccatatggtcatttgtcaatgatgtcaagaacaatgtattatcatcgttaaatgaagtagaaagtgagacacgatcgaagccaacagcaatgtataacctcgaaacaggctcagcagttgacattcgaaggccaccaaagctaacagctaacgaaacagaaggtgactctgataccgatttantagagcctgtggcaagtgatgacgaagataatcttgagacattggatttatcaatttatagaagatga

SEQ ID NO: 13647 - DNA, 189 bp, Candida albicans
tcagtgtttaaccatttccctcgatacccccatgttgaagttgatgtgaaccaccatgataaaaatgcatttaaaaataaaatgcctccaagtatacgtaatatatctaggaaagaaaatttcgttcttgaatctctcatgaaagttgccccggtaggtagatactattctaataattattccttgtaa

SEQ ID NO: 13648 - DNA, 225 bp, Candida albicans
atgcaatggatgtataaacacaaaaatttttcatcgaagagcagattaattatcacttataagggaaattataatcattttttaaaaaacacaatctatgagaaattaaatattaaaataaataaaagttacaaattaccaatacataactctatgcatcgttcaaattacttgtacagtaatcgatgtagttttgaaagtttcgaatccttctaccttgggtaa

SEQ ID NO: 13649 - DNA, 411 bp, Candida albicans
aaaatggcaggaagaaaaagaaaaaacgaatctaagaaaccaaatcctactgcaagatcaactgcagcaatctttcaggatataaataatttagatgaattagaatctaaaactaaaatcgacaacaacaagagtaatgaagaaaccaatgatgaacctgcaggcagtcctgaagaagatattgccaatgctggtttcccatttaactatttgtatcgagtacaagatcatttaaacgaaaatatgtcagtagtacatgatgttcaatgtttggttagtttatttttcatccaaatggtatatttagatagagttaaaatcattgattattctaaagatgaacatttaccaatgcaagtaattgcagttatttttttcaattgggtaggtgtgttcctttgtaccttttga

SEQ ID NO: 13650 - DNA, 330 bp, Candida albicans
attcaaattataacaacaacaacaacaacaatagtaacaataatcgacgcgtatcatttgcccgtgaagtcacattacataagattgattatgttgagaatcctaagcaacaaacgacgtaaaactgatattggaatcacttatcaagattatgggataatttctggagattcaaacttagagaatgattacaataatagtaataatgggaatagtatgaataatataaatgaacaagatgagcatgaagaagaacaaggtgatgaaacctatggggatcaaatgctgttgatagttctgatgaagaacaggatggatgacctgttatag

SEQ ID NO: 13651 - DNA, 351 bp, Candida albicans
gatatatattgtcataactgtttatcactattctacataagtatttttccaaccattcattcaagaaaacaatataacaaaacacaactaacaacaaacgcccacagagaacaaatggcaaaaagcatattaaaggataatcaaaaccatacagcgccaattgtatttggagataacaataataataataatactaatactaaaaatgatgaatcaggaataaccgtgaattcaaattataacaacaacaacaacaacaatagtaacaataatcgacgcgtatcatttgcccgtgaagtcacattacataagattgattatgttgagaatcctaagcaacaaacgacgtaa

SEQ ID NO: 13652 - DNA, 321 bp, Candida albicans
tattattattattattgttatctccaaatacaattggcgctgtatggttttgattatcctttaatatgctttttgccatttgttctctgtgggcgtttgttgttagttgtgttttgttatattgttttcttgaatgaatggttggaaaaatacttatgtagaatagtgataaacagttatgacaatatatatctcaagttgaaagaattagtaaagcgatataaagttgccgatagtataatgtatcaattcaaggaagtaagttgttgttgttgttgttgtttgtggttgtccgtggttgttttgttttttttgttttga

SEQ ID NO: 13653 - DNA, 444 bp, Candida albicans
aggtcaggtaccagaaatatatattcacataaacatacacatacacatagtactatcattatgagtttagactacactaaagatagaaaaactactattacatttgatgaaaaacaactacctggaacaccaccaggaagtattaccaccttaactgatcttaacaacaacaacaacaacaacaatgataaatccaaagatcatgaaattaaaccacaagaattagctgataaattaagtgatgctcatagtaatcttttgccaaaatcacaaatcattattattttactgacattagctttagctagtattgtttcatttatggatcaaactggtattaccgtaggattatcggaaattggtaaagatttaaatgctcaacaatcaatcaattgggccggttcagcagttttcacaacgccggcgaggatccatgtacccccc

SEQ ID NO: 13654 - DNA, 255 bp, Candida albicans
ttccgacgcggatctggcagccccgtgggtgaagataaaatatttacgagtcatcttgactttactggtaagaacactactcctgttgtacactacctattgtcatcgcatgataaatacgtgtacattccatttctaattacgtgtttgtttatattttctctttttatgacatacgccaaaatatttcaacaccaccaacagttattccttttgactcatgacctttcctttactaatagtttaaactactga

SEQ ID NO: 13655 - DNA, 186 bp, Candida albicans
  unsure (58),(112),(115),(154): Identity of nucleotide sequences at the above locations are unknown.
cattattaccccaggtgtgtctctaaacataatgtgggatgtttgcattgtgggctantgtttaacaccagaatagtaacgtattctactgttcacaaaagaagtgttgttnatnattgtttgtgtggaactgggttttcaggagtattgaatnatgatgtcataataattcatcttccaagatag

SEQ ID NO: 13656 - DNA, 216 bp, Candida albicans
tatctcattatgcaatatgacgtcatagaaagagcattttgtgtgtgttatggaatatttcagatcttccgttgggggaaaggtgtgggggatgcaacaaacacaaatgcacttcatgcaatgagcgacactaatttagtttacactcacgtgtctattattgttaacaagttatttttagaaactgaaaatcaattaaccctattttgtttgtga

SEQ ID NO: 13657 - DNA, 225 bp, Candida albicans
tctggtattttggaatcagtacattctttggttgttcattacagtatggttcacttcaaatatttattttttttcatttgggagaactgctactgtaaagatacatctagcttgactcagctcaaactatggattcaaactttatttcaacagtataaggatagtttccaagagaatactgatacccattatgccctgttttttttagttttattttgctcatga

SEQ ID NO: 13658 - DNA, 189 bp, Candida albicans
aaatatggtatatattttgaaatgaataaaaaatacgtagttttccaccaattaaaccaaaacccaaaaactccttatctccacatacactcacaaagaaagaaagaaaggaaggaaaaaccaacaaaggagattaagattaactccgaaacggaagaaacaaaaaaaaaaaacaacaacaacaaataa

SEQ ID NO: 13659 - DNA, 234 bp, Candida albicans
actattactattataagcgttcttatcattcacccggtattggagagtattgaaataagtggagaagatcaaaaaaaatgggccatacatacatacctacataaacaccacaagcctattattcaagaaattaaggaaacaacaacggaaaatttttgttgcttgtttatcacacacacaaaaattgcttttattttttttggattgttaaagctaacaatttcctgcatataa

SEQ ID NO: 13660 - DNA, 213 bp, Candida albicans
  unsure (205): Identity of nucleotide sequences at the above locations are unknown.
agtggtaaacagtatcagagcttacatacctacattctaatttcatttcaatccattttgttcttatactttaataagcaaaggaaaactatacattaccaaaagctatctttcgtgtacatggcagtaagtagggggcgagggaggaatggaggagaagaagaatttggaacggatactagacccggaacaaatggtatcattnacagatag

SEQ ID NO: 13661 - DNA, 315 bp, Candida albicans
cataaactaattttcatgacttatatttcccatatccacaacatccaaaccaaatcaaaatgttgtttaaattttttatccttaatttgcttagctattattactaatgctgccgtggtcaagagagatgaaccaaaggtaatcagaatggatgtccaacaaggtgtttctgagttggttaaaagaggtgatgctactggatcctcagaatggacacaggtcttttattcttatgctgatttgaagataggatccaacaaggatcctgttaatctttcgattgatacaggaaattgggttgaccccatttgttga

SEQ ID NO: 13662 - DNA, 201 bp, Candida albicans
ataacaaacaataaaatatttcagttgaaagaaggttcttcctgtctgtttgtccattcaattatcccccctcaaatcaccaacatgtatgcaaaatttacccaatcacagaagaattggaaacctttggatcgtagagaaagtggttccaattattatattcccaaaaatggtactgaatttaaaataaaaaattcctga

SEQ ID NO: 13663 - DNA, 972 bp, Candida albicans
tccagtaactctgttttgacaagctctattctcagtgaaactacaacaaatgaaagctcctcctacactgatgagccttccagtagtgaagaaattaccaatacttatgaaccaagctcggccactgaactgtctactaccgatcaattttcaagcttgttatcatcatcgttgcctgtgactacaacatcgagtacaaccatctcttctgctactccaatcacaacagttttatctacatcaataactagccaagatacaaattgtgaagcaacaatcaccaacatgtctacaaatacactaattgagacaattactgtcaatgggaatacaacaatatatactgaaactcaattatcgacatatttaacatcaaatacaaatatcaattgccccaacacaaatagtgccactactacaacaacacgggttattcctactgctacaactgaacaaattcattctactacactgaatggatcaattattgttttcactgaaactgcaacgttagaaactacagtgattattactcattgtcctgaatgtaccaatgaatcatcaactactgaatatagttcatctttaaaagctgaatctagtcaacaatcaattccaactattgaatcaaatttactggaactatcagtgtcgtctactttatcattggtggaatccactgctactggtaaatgtctgggattaacaacaacaacatttacatctgttgtttctacaaccagtgaatcaatttatactataacttctaatgaatcaacttttgaaatgacaaccacagtgactaatatacgcacaattgtgataactacatgtccaactatcactcctgttagctcatcatattcaagtaatgaaagttcatcatcaagtgttttaacatcattattgactgaatcaaattccaactatcctgataatcaactgtcccaactgaacaacttccacttttaa

SEQ ID NO: 13664 - DNA, 270 bp, Candida albicans
gcggatctttccagccgcgtggtggacaccatttacgacgaactatctttcacagttgacaaatttcaaaatgctcttgatgagttatttgcctcaataaaaaatcaattagataccagtgacaaaaatgtcaagttattagcacaaattgataaactactagaaatgaatggtttatttacacatttgtcaagattcaatactgtttttaagaaatttcttaccaaactatcaaatgaaaaggaggtatatttaaatagcaaaaggtaa

SEQ ID NO: 13665 - DNA, 189 bp, Candida albicans
ttacaagaccagggccaccagatcgagtcgttgatggactcacatgctgatgttcaaacagaagtccaaatggggaaccggacattaagtcaggctacgaaaaagaataaaagaggtgctaatatgttggtcatgctatgtatagtactaggtgtgttattagtgttggtagactatgtatcattctga

SEQ ID NO: 13666 - DNA, 600 bp, Candida albicans
cgatctcaggctgttgtgaaaatggtgctcctagatcgaccacctccaatgaaaagacagaagaacccaaatcaactggccctttcggttccaaaccagcaggatagtacaacaagtacaggcacaacaggggtatcttttggtactcaaaaccaaacaactagtgcaactagcggtggaggcttatttggggccaacaaagatcaatctccagcaccaacgggaggattattcggctctacaacaacaagtcaggatgccaaaccagcaaatgataccgccacaagtagtgaactgaaacctgctattaatatgtttggttctagtagcactacagccgataataagttgggcagcgggagctcttttggttctaacaataatccactctttggtggtaagaaggatgataacaaatcttctgcatttacgcttggatcgaaaccagaaaataatgaaggaccaaaagcacctttttttgcagctaacaatgacacaagtaaaccggctactagtggattcttgtttggggctaaaaaggatgaggataaaccagctagtggtggatttttgcttactgttaagaaggacgaccattaa

SEQ ID NO: 13667 - DNA, 246 bp, Candida albicans
cctccaatagaaggtgaatctggatacataagagcttataactttgtaattacactgccaaatatacatggtgaatccacattttgttttcatctgtatagttttttgtcaccctttgaattgggcacttttaagagtttcacatttactatgaaatatatatatatgtacagctgccaaaatcaaagaaaagaaaaaaaaaccaatgtaatcattttaagtaaactagaagaaaaggaaatttat

SEQ ID NO: 13668 - DNA, 213 bp, Candida albicans
  unsure (101),(114): Identity of nucleotide sequences at the above locations are unknown.
tcatcatctccactgccacgatgctgtggcacagaactggggtttcttgtcgatttgaaaagagctcaacaaacggcttcaaatatttctcgattagaacnaatggggtggaanaatactagtggtacatacaatatggacagtcacggtttcccattcaagtttgaacctaaaaatgtgcttattgcgggcacacttttggtttttttctcc

SEQ ID NO: 13669 - DNA, 312 bp, Candida albicans
gcaagctcgtttccttccagccgcgggcgtgaatacaaatgtaattctcatggtaaatgtactcaagttggtgataattgggcatgtcaatgtgaaccatcatttaataaaactacttcaaaaactacaacttgggttggtcatgattgttccaaaaaagatgtttctgtagaagcaaatcttttcctttggaccagtattgccttagtggtgattttagttggtggtattcaattgatgtttggaattggtaatgatccattaccaggtgtgttagatgctgctactattccaaaaaagagtaatttgtaa

SEQ ID NO: 13670 - DNA, 288 bp, Candida albicans
agacacaatggaattctgaaacgtgtgaaacgtgtgaaacgtgtgaaacttattcgttttgtacattcttctcctcctcctcttcctcctcctcctcctcctcccagcatctgtaacaataaccaggatgaatcagaatcatcaaaaccaaagctttgtcgagagattagaagtagaaaggttttaaatcaagatcaagatcgaatagtaaaaaaaaaaaaacaagtaagactaaaactaaaactaaaactaactcgtgatcatgagaataatttgtttaggaaataa

SEQ ID NO: 13671 - DNA, 552 bp, Candida albicans
attaccacgaccacccaacaggaaccagaacaacaagaaacagctacaagaagaacattccagaaaaagattttaaaattggaattaaaagacgaaccacaaccacaagaagaacatatacctcaagattatccaatgaaagaggaagaagagaatcttaaccaattatcagaaccacaaaccaatgaagaagacaatccagctgaggacatgttacaaaatgagcaatttatgagaatggtagatatattatttataagaggtatagaaaatgatcaagaagaaggagaagaacagcaacagcaacaacaacaacaagagcaagttcaacaagagcaagttcaacaagagcaagttcaacaagatcaaatggaattagaagaggatgaattaccacaacaaatgcctacatcaccagaacaaccagatgaaccagaaattccacaacttccagaaatattagatccaacattttttaattctatagtagataacaatggatctacatttaataatatttttagttttgatacagaaggatttcgtttataa

SEQ ID NO: 13672 - DNA, 246 bp, Candida albicans
aacgaaacaagacgaaaaagcaaacgtattggtgtgctgttgttgttattgtgtatgataaccattagccaaagcctcttttaccgttatatatcgaacggaattgatgctaaccaaattgtaaagacggaatctgataagttaatcctaggtgtgtggtcacatgacaaaagagaaactaaccaaacacttgttgtattactagtacgtatatgtgaagaacgccaacagacacaaaaatcatag

SEQ ID NO: 13673 - DNA, 543 bp, Candida albicans
acctgcatgtttgtgctttccaaagtttccggtcaagatgccttgagtcaatcagtggttatataccccttgaattacacagcatgtgtggtagccttaacagcttctggacaaaagttaattttatacaaggtggaatataatgagttaatatatttggagagtattgattttgatgagaaagtattagcaattacaaaaataaagattgatggccaagaagcagtggtttatttggatgatcagtctcaaattggaatactatttattgataacgaattttgcactactataaagattttagctaaactatcaagtaccgggcaaagtaaaattatcgattcacctgtttatatggtggctgatccagcagcaaacactaagttcattgcatttcatatattctgtgaagtcgttcacgtcttccatttcaatagtattctgtctgtcgatgatatattgggaaagaatcctaataacagtgtttcgccgacacgttcgaaaaatatgcgtaccgatcttggtaaaatgggggtcgcttga

SEQ ID NO: 13674 - DNA, 246 bp, Candida albicans
tatgtaccatttatatatatatctatttggtatgtccttctattgtttcttaggtcacacgtgcaatctagaaacaataattctaaagccaaaaatcaaacaaaattggaatacttatactggtttgataaaacatacaaacaaacacgaacagactttagtatcaaaaatcaaccctatatcataatattagtcgcaataagaaattactttgatcttgaatttattactaaaatattttttctt

SEQ ID NO: 13675 - DNA, 189 bp, Candida albicans
gcactaccaattaatatatatatattattattattattattattattggaattatatagagataagaaatggattacaaaaaccaaaaccccacccttttcaccttttcaccttttcaccttattttttttaactcaaaagtttattcccccttctccccctccagcatcatttttttttcaaatcttt

SEQ ID NO: 13676 - DNA, 294 bp, Candida albicans
ttaattgatagtgttgtgatcatgccaatggattatcttaccccatcaactttaccacatccaaaattgaagagaaccaacactgggttcacaccaaatcaaattattgccttggatgcagcaatcccggaatcagctaaacatatttggtacaagtattctcaattgaaaatattggattctcataaaagaaatggtccagaagacgaagataatgttaaatcagtcgttgatgatccagaccgttttgaagaagaatttgttaaacatgttgaaacatctttaggtagatcc

SEQ ID NO: 13677 - DNA, 534 bp, Candida albicans
gacatctcacaatatttgaataagcgacaaattgaattgaaactggataccattaatcgtcaaataaatatcatgattggtgagctatggaaacgtgatattgaatttgaagacattaatttgttaccgtatttccaaaaatttgttttacaaacggcaattttcattgggtatgggatcgagttggattgttataaagaacatagtcagttctgtcaagaaataattgatattgaaaataaaatcattcggttaagatcaccaatttcaaatttacaagactcaatccccttgttgcggattatgcctcggtggttcaacaactcggaaattgcccgaatgtgtggtgaaagaagaaatagctatatgaataaattgtatcaacaacttcaacaagggctagctgaagatttgccacaatataaaaatagtatattgggagatttaataactaagactacgaatacccacaataataatgatgatagtagtgacaccaattgtacttctcacaataattgtttaaacgagcaa

SEQ ID NO: 13678 - DNA, 744 bp, Candida albicans
ttatcaatcaagaaatttataaatcgaagtaatttaagtcatttatttgttggatttttaaatttaaatgacgaaaccaattctaataaaattttagaaactattcataaacaaaacaatactaccaacaacaccaataatactagtaattcatttttaaatcaatatgaacttaatggtattattaaaaaattattgaccaatcataatgatataattaaatcattacaaataattgaaaatttatcctggaatcattgtaaatggagttattttgaaatatttaaatatattttaattgaagctagaagtcatcaaaagcaagatgtggaaacatttttaaaagatttccaattaagaattattgaaaattttaaagatgaattttttttcgaagaattgacaatacttatattgaaacatatagcaattatggatcttcgagatggtattagattatataataagattttgaaattatccaacaatactaatgttattgccaccaccaccaccaccactaataaaaataggagatcaccacaatcatttaccaactccaacaccattgccactaaggggaatttaaacaccaatgatttatcattatttgaatatttaaatattgatgaaatatctgatagatatactttaaaatcaactgataaaagaatgacgatacttttaatacctaatgaaagacttaaatatctacctgaatggttaattgataaaaattattga

SEQ ID NO: 13679 - DNA, 267 bp, Candida albicans
agttggagaatatttgatgataattgtcgattaattgaattggaagaaccaaaattcattcaatcagtggctcaattggatagaattgataaatttatttcgaaaagattacgaattaatcttgatttgagattatcattagaagaacattatgaacttaatacggataattcccaacaagatgatgattcccatgacgatgatgattttgatgagaataagaatttgttttattattattttgttgatttgttacaaagtttatga

SEQ ID NO: 13680 - DNA, 354 bp, Candida albicans
ttactgacgtcagatttcatggaaccaccatttccagaaccaccggttgtccaagttgatgcaaagccaatttcgaaagtatcagttaatgatattgagtctgaacgagtagcgacagaagtagaatgtgagttgtattggctagtaatatcagactctgaagtatgtgggctatcggacttagcaccattccaggtggatgaaatctcagttatgatatcatttgatgtgaatggtaatggggttgttacaacagaagccactgacgtgctggactctagaattaaagaaccaccagaattggaagtgtcccaaacagatataaactgttcttcactagcacttgaagcatga

SEQ ID NO: 13681 - DNA, 207 bp, Candida albicans
agtggaggggggggaggggggagggaggagttcattattttccattggaatgagtacatagatgatgatgatgatgatgataattttgagatgttttatgtgtatatcgatcactttatttattattactatttttctttatttaatgtattattattattattattattattattatatttattatatttattagtttcaggataa

SEQ ID NO: 13682 - DNA, 243 bp, Candida albicans
aggaacccttctcctcctctcactgctgtggctaatattttaaacttcttggtgttagttagtagtgtgacttatttgaatttgagtttaagagctattttttttgcaactctagtccacatgggcgctctaccacaaaaactaattaaacgccatcacaaaaccggaagcaaacgcaatatcaaatattcgttgtttgtaatggtcgttaccgggagtatatcggggattcaagttgcttaa

SEQ ID NO: 13683 - DNA, 252 bp, Candida albicans
tttgtgatatatatcaccaagaataggttaaagttcaggcatcttttttttcttggtgagataaagaaacctcaggaaaaaaaaaaaaattttgtggtcacactgttgaagaagacgacgaccatgtttggttcaccatttacgaataacccgactcagaagagttcgacgcctacagtattcaaagataatgtgaggaacgcccatatatacacagttaccatggtcacaacagccatttcggaccatact

SEQ ID NO: 13684 - DNA, 324 bp, Candida albicans
gtctctaataaatggacttatatttcttttctgacaaatttgactaagtataaacttgataatatagtacctgaagtcatctctcacaatccaatatataaactcagtaaaatgaccacaaacaatacctgttggttatgggggttttgcctaaatgaatatcaaccaagtaaattattctccaacactattagttactgtattcgggaatttttcaatggcctgactattcttgaatattttttaattttcaacttttcaacaactttaaactatttagaccaccatacatatactaatactcaaaattatcggggaaagtaa

SEQ ID NO: 13685 - DNA, 438 bp, Candida albicans
  unsure (32),(299),(302),(392): Identity of nucleotide sequences at the above locations are unknown.
cttgggaaacaggatacaatcgaggaatcctntgggtgtgatgtcggatatggcttgttacatagaatccctgaagttgttggtaaatttgataacaattcaattgttgatgatattctttttgagaatagccaaaaccttgggtaccaacaacaacaaagcttgtctccacaacactcttcttacatccctgaatccgctgagaatacccaagagaacaatataattaattctccaccaccggttatgggagcaggtgctcctcctcgtgcatcaactagaaaaaagaaacacgttgntgntaaggataccttcgaggggctagatgattacatgaatgaagaattagaaaagtcgaaaaaattagatgtcgcttcacagccgcaaaatgnttcagggacaccacccccacctccacctccacaaagtagcaaatag

SEQ ID NO: 13686 - DNA, 471 bp, Candida albicans
ggtatgaccatagggtgttgggcgatggttaaaaggactgggtgtgatgtatctattggaaattgtcaaactcaattcttccatataatagacgaagagaagtgtgatcatacaataaaattacaaaaagtgaatcaaaagtcaaaacaaactacatcagtgctagacaaagttgtgactaaccttcaatcgcagtccgttttgggtagggttatgacgagcctgttgagcttatccattattccaccacaaccgtctttgactttattagaaattctggcatcaaatggctgtttaatgttgcttgaaggagaaaaacataatgtaaccgttacattagctaaccactccgctcagtctattaattacttgactttttcattctgggactcaaacatcgagtttctcaacaagaaacttacgaacccaaatctaactgcagctgaggttcacgaattggaatggaagtga

SEQ ID NO: 13687 - DNA, 477 bp, Candida albicans
  unsure (443): Identity of nucleotide sequences at the above locations are unknown.
tatagcaataacacaatggtttgggtcaatggatgtcccaaatttctgatagatctaccaataaatgaagatataattgatatagcccatatttatcatacaccgttacttactgtgcttacaaaatctggtgtatttgttttccatcaacatactttacttcccctagcttcacatgttcgaaatacccagtcaattgaaaccaatgggtataatattcaaatgaaaacgaaacatgttagtgtaaatacagctaagcttcaaaaattaagtattgtcaatttatttatccaatctgaaaataattttttgatcatttatcaaatttccattaattattcaggatcaatatatgaagtacataataaaaatgatgaattaatacaaaatgggttaccgttgagttctacatcactggggttttccgtgacggattttttcanatcagcgaacaaatcaattattcatgggaactga

SEQ ID NO: 13688 - DNA, 510 bp, Candida albicans
ttatcaataagtcatacaaaacgatcgaataattcaatcaacaacggtaacacatacataaaaacccatgttgatcatcgcttacaatatattttattgattgttctgatttttttaaatatcatcaatgtgaaatttgccaccatcaccaccaccaccaccaacaacaacaacattaactatataattagtcaaggatcactgataaatttatataaatggatgaaatggatcaatagattaatcacattacaattattatatcatggatatctgatgataattgtgtcattgacgactaatattattgatcaatatcgtgggttattatttatgatattacctggatttaatatttccatgccatggttatttttttattggtataaacatatggatgaattggttcaacaattgaatgaattgcaatccgaatatacaaactgtctaaatggggaggcggcggggagggttttcaacagccgccggaaggatctacttgctgggggg

SEQ ID NO: 13689 - DNA, 723 bp, Candida albicans
ttgtcctggctcggcgttgtgaaaacgggaagaaagaacaaagcttcaatcagtgctggcacggcacctacacctggagctttacctgccactacacctggcacattggcaaatgcaatcaaaacaccccacaatatacctacaccgcagataccacctcaaacccagagtaacaagaatacgcctagtgcccaatcaccagcttatccagtaaaggccaccccatcaagtacaaccccaggaactgcaaaccacagccacaatccaagttatgtgtatcctactcctgagattgatatatgtgccatgagctcaaatgattcgaaactggctaaacgtcgtgagctaatcaacatagatcctgaaaagtgtttctatgcatcattggccaatttgttggacttggacgattctattgtcaataatcacgatattatgaaaacatcgccaagactatctaatggtaagcctgctgccacttctccgttatcgccaaaaactggtggagaatggacaagtgaagtcaaagcattggccataacaacttcgtgtaaacaagtggatttaattagagaattggccaacgatgactttatatcgtcttcgccaatgttggctattcaagaaattgaagaaccacaactggttaaaagagagcatgatgcagatgatgatttggattctttgttcaccaataaaaatgcgaaccttgacgggttagat

SEQ ID NO: 13690 - DNA, 378 bp, Candida albicans
gtagttaatctatgttgttgttgttatagtagtagtagtagtagtgttgtttgtatgtgtgcgtgtgcgtgtgtggcttcccatttttttttacccgttttgggaaataaaatccgtagatcccctgttaaatgtccccccagggaacatcccatgataaagcatagtggaagtttgattttgtttcacatgtactgttgttggagtctcgttccaatgcaaataattaatattcaccacgggctggcaggaccgcgattgagtgagagcgcgaggacatctccacgcgaggaggatgaaggagaggcgaaacgacacaaaagaggcggagacactcaagagtctgctagaaagaagaagtcagtgagcacacgctaa

SEQ ID NO: 13691 - DNA, 297 bp, Candida albicans
tactttcattgcacaacggacatgtcaacaagttatgtcggatacatacttccattgcaaaatatacctagattatccaaaagattccggcattacgaaaatacatttactaggtctaacctacaactcaattaccaatttcaattaattcccttgatttactatattccaacattgatgatatttctcaaaaaaccaactagtatttctgaacaaaacctctcatgtcccaatacaaggaatacttacaacgcacaacgtcgttcagtaaatccagaatatccctcaaacttatga

SEQ ID NO: 13692 - DNA, 339 bp, Candida albicans
cgcaagcttaggaccttccagcccggcggtgaggaccaacaacaacaacaacagcaacagcaacaacagcaacaacagcagcagaatgcccaacagcaactgcaagtacctgttatcccaatacaaacacaaacatcacaacaaatggcttcaactaccaatcacaaatcagctaatctaataccagggtttttacaaaacccaacacaagccactggaaattcggcaaatgcttccaagctgagtgatgctggtgatggtactaatccaaccacagcaggaagttcaagttcagcagatgtcaataacaccaacaatggacctaataaaaatacataa

SEQ ID NO: 13693 - DNA, 477 bp, Candida albicans
aaatcatcatgtttgggtagtgttaacaacgttaatggattgaaaaaccttaatcgattcgaattaattaaaaaacgagattatagaataaataccaatcaagcattaaaattcttaggtgaatattatatgatttttgaaaatcaattattagccaatcaatttattaaccaaacaacaacaaaaccgtcagaaactgaaaccgaaaccgaaaccgatgttggagctggagttggaattattatgaatgggatgaaaataaattttgaaattattaaattgaatgaatcaattttgaaaactatgagtaatgaaaaaatcagtgattttaataaaattaatgaaattttatcaataattgataatcccaacacgggtacagatttcgatttcgatgttgatgttgatgtttttcaaattttaaataattggttgaatcataattctagtcgtcgtcgtaataattatgttttggtt

SEQ ID NO: 13694 - DNA, 198 bp, Candida albicans
attgattcaaaaatcattacttttttttgtgttttgtgtttttgcaccccctttgtatttcttctaactactactattactactactactactaccagccatgtgtatctaattaatcaaccacaaaacacacaacttctatttccagttcagattggttttgatatcaacacttggcatacacacaacattgattaa

SEQ ID NO: 13695 - DNA, 228 bp, Candida albicans
aacaatatcaaaaatccgggaataattgaatttcttttccgtgaaattataaacaacattgtgtttattctagttcttgtttttcaatccatattgtctatatgtctacatgacaaacaattggacgtttttgaaaacacttttgaaactatcaaaccaccagggattcattatccacttgatctatcaaaatttgtggaaatacatgagttggaatcacaaccttga

SEQ ID NO: 13696 - DNA, 309 bp, Candida albicans
agactttcgactgccgctggagatgctaaggaagttactacaattgaagggaaaactgctaaatcatgggttactgctccaggaagtgctgctgggagcgttgtttccgaaactggtagtgcaagtgaaaccggcagttccgaatcggctcaatcaacaactacaggctcgtcatctacaggctcatcatccacagactcctcctcttcttcttcctcatctccttcatcttctgctaattttgctgttttgcagacaggaggaatcggatcggtaattcttggattcatgatgtaccttcttgtataa

SEQ ID NO: 13697 - DNA, 417 bp, Candida albicans
tactatgaacccttccgagttgtcaatatattcattgacagttactatgaaccaggcacaattacaaactttttggccacccactcaagtggtgctgctactgcaggtgctactggaacatctgtcgcatctggtgcatctggtgcaagcttggaagattccactactactactgctgctgctgctgccgggggtaatggtgctgctactatcgatgataccactaaaggtcttacatttgtcacctctagaactttgaaaccaagtagtagtgcaacctcgcaaggttccgctcaagcactgggttctggttctaatgctaatcaagctaatgccgcaggtgtatattcaactaactctgttcttgtattcgtttctatttgcataggttttattggcggttctttgggtatataa

SEQ ID NO: 13698 - DNA, 225 bp, Candida albicans
gatttgttcaaactaactggtgttagatatgtttcttcgtatattattatcttggataatacgaccattgaacaagttgcagttatacatattgaatcaaaattccaatccaattggggtctacttaataactgtattagttttgaatatatttcaaatgatgattgggtgatgtatatatcattttcagtggtaattggtaacgaggtgagagtttcattgtga

SEQ ID NO: 13699 - DNA, 201 bp, Candida albicans
  unsure (84),(176): Identity of nucleotide sequences at the above locations are unknown.
cacgttgagatctataagttacatgatcccggaacaagaaaccagtcagaaaagaaaaaaattaaaggacacaaatttgaaaanaaaaaaccaccaaataaggcaaaagaattctggagagataaaaaaaatattgaatgtaaaaaatctggggaaaccacaaaaataaaaaaaanagaaggaaaaattcttgacttttga

SEQ ID NO: 13700 - DNA, 222 bp, Candida albicans
aattatattggtcgattaaagcttaagtcattaattattttatccattgtaaaacacacgaaaacaaaattaatgtttgtgtactggaacgggattaaattttttgaaacgacaaccaacaataacgacaacttcaagagacagactaactattctgtccatagagaattaaaacaattgcataatttcagcaatcaaaactccgaaatatcacaaaattga

SEQ ID NO: 13701 - DNA, 201 bp, Candida albicans
  unsure (7): Identity of nucleotide sequences at the above locations are unknown.
cccctanaattagtccggatcggctactcccgaggtgaaaaattaaagtttttctgctggccccaacacacaataaagttatctttgttgttgtcttgcctatattcttatagatcgtctatcagctctagagcatataagtatagtatttatattaaatatatctttataatcaaacagtgttggcttttatacaactga

SEQ ID NO: 13702 - DNA, 585 bp, Candida albicans
cgacgcggatgtttcacccgtggcggctacttaattcaagaattgaaggtcaatgaagatgttgcatctgcaaatgacccggaaacgtcgaatgaatcagaaagtggagattcagaagataacatatataatagattgaaatatgttggaggtcggcgctcattagcttctgccaaaaaatcaaaactgcaagataaagaagttgaagaagataaagacattaaggaaccccaaacatttatacatacgattaaattatcacctcagattcttctggatataattgaaccaacttctaaaacttttatgcacacaattgaattacctagcagaagaattgtgcatacaactaaattgcctcgtctaatcttaaagctaaagaaaacttctaccgaaaccactaaagagactatatcaactcaattaccagaaaatttagaactgaatttggaatctatgaatttaaatgaaaatggaaatgaacctacaaagagagctacaactgctaatattacatcctcaaccgaagtacctgctgcatttccggttttgtcacaaaaatcaccaacaccagcacctctgccc

SEQ ID NO: 13703 - DNA, 216 bp, Candida albicans
tctcgccccgtggtgaagactattttcttgactccatattttaaaataacacattatatatatatatatatatcattaaataatcccttttataaaggaagtgaagaggattttatcctttcagaaatcccaattttttccaaattgatgattttcgtttcgttgatttatcaacattcttcatcttgttcttattatcaccgcccagtgatataa

SEQ ID NO: 13704 - DNA, 528 bp, Candida albicans
  unsure (29): Identity of nucleotide sequences at the above locations are unknown.
aaaattaaccacataatatttcttccatntaattcatcaaataaatatcaagattggttatcaacaatttcagataattcattacaagctctgaaaaattatttatatgggataaattcaaaagatgattccattataattgatgataagattcatgccatttataaaagtcaaacttggaatgtcaattccgggagtttatcacatgatgatatattatcagatagtaattccacgtcaatgtataaagtgaaatcattgattagtatagaggatgatgaagaagttaaacggaaacaagaagaaataagattgaaaaaaagaaataataaaagaaatagtagtgttaaaagtattggaagtggtaataatggtggagttagtggatttattcatagtataaaaagtaatgataataatagtattatatcactgggcggtgataataagaacaagatgaagaatgttgataaatcaacgaaacgaaaatcatcaatttggaaaaaattgggatttctgaaaggataa

SEQ ID NO: 13705 - DNA, 255 bp, Candida albicans
  unsure (246): Identity of nucleotide sequences at the above locations are unknown.
tcgatccaattttcaattattttttctcttttaatttattcacttcatcatcaatcaatatcgatatttcacatcatgtcagttaaagaagacattcctgctgttttccttgaaaaggtttctcctcgtggtctcgaagccatccagaaaaccaaagatttcgttaacgattattgtcttccagccgatcaaatttatcctgaacaaggtccagacagtattcgtcacgaactgccgatccgcgtncaaaggggg

SEQ ID NO: 13706 - DNA, 192 bp, Candida albicans
gctgctgggattccgtgttacttatttttgtttagcttagtatccttgctagtcttgctttatcatagatatcagcacgaactatgttatattagatcggaaaatgaaggagcatattacacattcctcttattgatgataaaccttcttttgaaaaccacatactaccatcaagtcttaatatacacataa

SEQ ID NO: 13707 - DNA, 603 bp, Candida albicans
cacaaaataatgatcgggaccaaaactaatgaggattctgcatcgtcagtagttcaaactgctgaagatttattagtggaaaaactagatcttttcatttcatcgatagaatcaagattagataactttgaacgattttttaaacttgataagaaagcaagaaaggaacaacaacaacaaaaaggtaccattaatggtggtggtagtggtggaggaagaccattaggacgatcaagaagatcttcttcaacttcaagtatacaactgtttcgagatttttccataaataatttgaatatggtttatgaacgattaagattaattaaaaaatcagtattatctaattcatttaataatttagaatatttatcgaaagtacttgctgatcaatataattatctattttccagtttggcaatcgatagtgatagtgataatgaggacgacgaagacctaagtattgatcagtctaaagaaggattacagaatatggggattagatctttaaataaacgagaaatattatcacaaaaaatcatcaccacaatacaatattttgatgaaaaattaattaaaattgatgattttattaaaggaaaataa

SEQ ID NO: 13708 - DNA, 186 bp, Candida albicans
ttaatgaatcccacacataatctcatttactcgtttcttttcttttcttttctttttttttttcaacttttccatatccattttactgagtgtgtaaaatgttacgttgttcctggtagtgatactattcctgcgttagagttaaaattgaatcttagtattgtcgacgttttagatattctgtag

SEQ ID NO: 13709 - DNA, 183 bp, Candida albicans
  unsure (20),(113): Identity of nucleotide sequences at the above locations are unknown.
gtaattaaatggggtacaanatatgaacaacacacattacacaaatgcaatacagacttttttttttttcccacttccttaattgaatgcaaaatccaagctgttgatcgtantacaccaataaccacagccactggtattgttatgaaaccaagaataaatgttaacctacagaatatctaa

SEQ ID NO: 13710 - DNA, 492 bp, Candida albicans
  unsure (31),(59): Identity of nucleotide sequences at the above locations are unknown.
tctcggggacaatggatattcttggcctgtnctgaggcaaatttattgagaatgtggtnggagaaagatttaccaacagttccattggtagtaaaaacattatacaatggagtatatttaaatgaagttgagtacgtgacccaaatttcaaaatcatgggtattcacaacaaatttaattatcagagcagaagaaattttcactcgtaattttgttgaatctgaaggtgaccctatagtagcttatcatttggtgcaagtcttgtattattttgtgaatagtgcaattgcttatatgagattaacaccagaaaataaggcccatcttcaagattatcagatttggtataataatcgtaagcagtattggattggagtgttattaaaagctggccttgaaaaagaagccacagaaattgccgaaaaataccatgattttgcttctttagcaagaattttagatatacaccaagaagaaaccaattcaactgat

SEQ ID NO: 13711 - DNA, 243 bp, Candida albicans
  unsure (184),(212): Identity of nucleotide sequences at the above locations are unknown.
gctactatagggtcaccttcagattcaacaaaattacgagtgaaaatttcttctgctctgataattaaatttgttgtgaatacccatgattttgaaatttgggtcacgtactcaacttcatttaaatatactccattgtataatgtttttactaccaatggaactgttggtaaatctttctccnaccacattctcaataaatttgcctcagnacaggccaagaatatccattgtccccgagag

SEQ ID NO: 13712 - DNA, 564 bp, Candida albicans
  unsure (233),(552): Identity of nucleotide sequences at the above locations are unknown.
tctaccgtcagtggtactgacttagatcctgatgagatggcccctgcgctatctcaattaatgattaatgataagttaaattataagaagagtaattctccccaacgctcttcttccttaaatgttggtaacagtactaaatataacaagactagcaacaacaacagcaacaagactaatagagtttttgaacttgaaacttcttcaacttcagtgtccgccacagccacaantacgcctcaaagaataccttcagtacgttcaagacaatcgtcagaggcttatgattttgatttagaaattggcatgtcgatggccaaattgttgaagaatcaacaagatttcccttcgtcgtttgagtcactgaacgcgtccgtttcttctcctgtattcaccacattaggagttgatactaaagatgaagatctgcttctgtcaattaattcaagtccatgtgacaccaccaagagtaatgtcattgctaataaacaattatcgcatcctgaaaatatctcgacgtcttcaccacgggagctggccggatccgccctntacgtaagcgaa

SEQ ID NO: 13713 - DNA, 204 bp, Candida albicans
  unsure (17),(21),(25): Identity of nucleotide sequences at the above locations are unknown.
acgcgcgtcattttttncagnctcngtcgttcgctattgcacacaagagtcaccaatggcccttacgcagctcgtataaactgttcacatttggacgtagctaatgggttatacgaatcgttgagaaactctgtgactcaagtctttacgccagcgcattttcaacgatcagatgagtggaacaggaaattcgttgacgactag

SEQ ID NO: 13714 - DNA, 189 bp, Candida albicans
acctattttgcaaagggggaactattgcacaaatccattactaactcaagaattatttcttctcacgagttatatctatttgacaatggggttctgattgttcatgaacacacgacgaaaatagaaaaaaaaaacaagaaaattgtgtacctaggtacattgtcatcattttggttcgacaatgtataa

SEQ ID NO: 13715 - DNA, 498 bp, Candida albicans
aaaagattccagactttggatccaagtgttgcgacagaacttggtgtgatcaaccaatatcaaaatctagagtcgtcggaattgttgcaacaagacaatgcttcggctattacaattgaagaaattgatgactctgatgaggaacaagaacgaagcaacctagccagtcaattgcgtccccagtttagcaataaaccggaaattattgaacccacagttgctagcgaagagaatacagagaaatcaaatccagatcatgataatagcaaaatagaaagtgaagatacattactagcaccgggtgcttcatcgaacgttagttctaaatcgtcacttttttcaaacgattcacaaaagagaccaatcaaatctgcattaaagagtgcatcttcattcactgcaccaactcaacaacaacaacagctgcaacaaccagcagctataggatatgctgcccaacaagcgtacctttctttgacaactgcagaaaatacacgt

SEQ ID NO: 13716 - DNA, 261 bp, Candida albicans
cccaagcgcgtttcctgccagctccgtggcgaagacgatctgttttggtttcggttccaactttccaagttcaagaacaatcaaatactgaatggaagaattgccaaaccatttttgtctacacttgacgatgaaaaatcgactggtgatttcaatcaagccggccatttgaactcatcttttgctgaaaggtcttctgtatctgatgatgaaaaagattccagactttggatccaagtgttgcgacagaacttggtgtga

SEQ ID NO: 13717 - DNA, 432 bp, Candida albicans
gagattcctatttttttttttcatcagctccatatccacactaacatgcatttcatattctacttgattcttttagtatctgctgctgattacggtaactttggtacatacccaaaagtccctaaaactgcttccattaatgggttcgcagatccaatctacgatttattaccagactgtgcaaaggaatgtgtcaaattcagtacaagtaacaccccttgtccatattgggatacaggatgtttctgcgtgatgccacaatgggctggtttagttggtcaatgtgttgctcaaaagtgtaagggtgaagatgttgctagtgccagattcttggctacttcgttgtgttcagttgttggtgctaatacttggatgatgcctgcttctatttcctcgagctttctcttcaccacgggcgctgaagatccacgt

SEQ ID NO: 13718 - DNA, 627 bp, Candida albicans
  unsure (45),(617),(618),(619),(620): Identity of nucleotide sequences at the above locations are unknown.
cttatgtgttctgaaatggaacaattcttagaatttaaaaacganattgagaattttgacaaggctagtaggttattattgtccaagaaaaacaaatctattcaagaatttgatgacttaatcagtttgggagaaagttttggtcttgatattccatcattaaatttcatcattcgaatcagagatcggttgaaatggttgcgaacttattctttgattgaaaaaggagtagatccttatggagacaagaatgaagtgttttcaatcgtggatttgcgcaaatttttggaccaggggatttctgtattatccacagacgatttgccaatgattaaagaagtggaagccatattaaatgcaagtaatgcctttgaccatgaggtatcaaaatttttaaaatacaattatgtacaggagttggacttgaatcgattaggtgatattgcaaaaagatttagtactgaaaagttgtttatttctatgaataattaccttgagttatctaaattacatattaatattaagttgattgagcaattcaaagaattggagtcagcttcgtatcctgaactcaaacagttgcataaatcttgcccacgggtagaaatcccgctcannnngaacccc

SEQ ID NO: 13719 - DNA, 246 bp, Candida albicans
cgaatatattatgaattagtatcaacagaaagccattcgagaagcacatcgtatacgacaacacagttgcacgaaatgtccaatttcaatagttctgctaatgatagtacttcaactgccccaactgcttctacaacaacaaatggagacattggattaaactttgccagtcccaaaaagataactgctttagaagcctatacgccggaatattcagcccgccgctggaaggtaccgcacttgcgt

SEQ ID NO: 13720 - DNA, 333 bp, Candida albicans
  unsure (230),(280),(281),(299),(301): Identity of nucleotide sequences at the above locations are unknown.
gagcaaaaagtatccttttcaatttcggaagtggataaggattctttagaagtgtggatttcttttcctattttcctgaaactatcaatcttcaattacattacttatataactattctttccaaaaaactatcacaaatggctttagcaaaatctaaattacttactcctggtactgctatattaattggaggtgtgtgctatggttcatgggccatctggatggctanaaactattttcacatgtcttcgataagaaaagtttatgttgattctgacnnagaatacgacagaattcncnccattgcaaagaataagtatgaaggtgactaa

SEQ ID NO: 13721 - DNA, 219 bp, Candida albicans
tttgtagttggtgccacttcctgctctccacgacccgtttcattattgcatggggtgaggtggggtggtattttgggatataaacaaaaccggaaatccattcttttgggaagaccaagtccaaaaacaaaaacaaaaatcaccttattttcttctttcttattattcaaacctttttttttttctcaaatggtaattaaattttattcagtcgataat

SEQ ID NO: 13722 - DNA, 261 bp, Candida albicans
ttgaagattgatagtttcaggaaaataggaaaagaaatccacacttctaaagaatccttatccacttccgaaattgaaaaggatactttttgctcttatttatacatgacattatttttattattactcttgtcttgtttgattaataactatataagcagaaatatgtatgtatgtacattgttcttgattttacgggatattattcgtggcgtggttaaaaatattgtcttttgtttttttgtattcccatctgtttag

SEQ ID NO: 13723 - DNA, 219 bp, Candida albicans
  unsure (144): Identity of nucleotide sequences at the above locations are unknown.
aggtttgctgtctcaatcttggcaacggtaatgctgattgcgattgggatcttaataattcagggtgcgctggaacagctaatgtaccacccaattgatgaaagttcatcatccatgatgaatgtgaaggatgttgatgttgtngctgttgctgttgttgaagttgattctgttgatgttgttgcgggtgaattggcccaaacacctgtggagaattag

SEQ ID NO: 13724 - DNA, 933 bp, Candida albicans
  unsure (287),(916): Identity of nucleotide sequences at the above locations are unknown.
acattcaattggtattataccgagttgatattacccaattctaatttggaattaggtaatcaaccggccaatttgaatatttctccacggaaaatcatatcaattttaagaatttatttgaatttattagaattgtttgataatgggttgataataattagaagaaaaccaggatacattgctcagtgtataactcaacaatctattattcctaattctccacaggtgtttgggccaattcacccgcaacaacatcaacagaatcaacttcaacaacagcaacagcnacaacatcaacatccttcacattcatcatggatgatgaactttcatcaattgggtggtacattagctgttccagcgcaccctgaattattaagatcccaatcgcaatcagcattaccgttgccaagattgagacagcaaacctttacaccaattcaacaaaatcaacaagttcaacaccaacatcaaccaccacaacaacaacaccaacagcatgttcaaccacaatataattattataatcagcaatctattcaaagccaaccacattctgtgagaccttattctcaatcatataatatttatcaacaacaacagcaacagcagcaacaacaagctcaacaacaagctcaacaacaacaacaacaacaattacaatatcaacagggacaccagtcacaagtttcaacacctacattgaattcttctagtgctgctgcattacttagatcaagtagcagtagatcatttgttgatgtgagatccacacctcccacaagtagttttgctcaacagcaacaacaacaacaacaacaacagcaacagccgccactaacttcatcaatccatgattctccaacaccacatcctcatctaccacttcaacagctaacaagtcgtgccgcacggngaaagaaaatgggcgtg

SEQ ID NO: 13725 - DNA, 534 bp, Candida albicans
  unsure (433): Identity of nucleotide sequences at the above locations are unknown.
agaactgacgaattgggtatccatcatgtcaaattaaattgtaataataatcctatttcatttctaaataaacctaacgatttaaataagacacaagtggaacaaattttactacgtaacttgcaagcatcaaaattgggtaattttcctgtaaatttacaacgtttggcaacaattgataaattcacaaactataatcccgatttgtttatttatgttgagtcaattgccttgttgtttaatactatatttgaaattgaacagcaatcgaattccagtaattgggaaattgaaaatggattatccagtagtatagggaaagtcaatataaacaatgaggatagacttggtgttactttggatttctggcaagattacagatttataaatcacgagtatgagatagtcaagaatcagagtgggttgttggtangcgattactatacaattcaggtggatattgttgaagcatcaaaacaaacagattatttactcgataatcaagtacaggaatgggatatatctatgagtaaa

SEQ ID NO: 13726 - DNA, 435 bp, Candida albicans
ggacttggattttccagccggctggggaagagttacatggataattataatggcaagtttttcagcaacaaattgattttacgagtttctagtaaaaaaatgtgtgatagtttggtgaaatcattggaacaagagtatttcaagcttgattttgttcttcttgcaataattaagttgattagttggaatgtgcgatggtatcaatatgttcctgattatcttataatgagcattttacaaaaattgatagcaaaatatgatctggtttacattatgactacaatcaaaatcatatttgaacagaacaaaaggcagaaaactactaaatccttattcgggaaaaagaaaaaagaaggaccctatgaatttgttgaaagtgacactatatacgactatatggattatcttgtcaattggatctatagtatatcctga

SEQ ID NO: 13727 - DNA, 258 bp, Candida albicans
aacatttttggtgtaaggttagtggaaataaataattccctcaaattgaaatttattattttttttttttcaaccgataatcttcatatcaaccgactaaaaataagtaataacaatatccgccgtattatcatcaaacagttttcccttttttttttttccatttcgtcctcttcttctttatacaatccccttgttttagtcattactgtcaagactacaaccactatcaccacaataattatgaatatactgtag

SEQ ID NO: 13728 - DNA, 333 bp, Candida albicans
  unsure (286): Identity of nucleotide sequences at the above locations are unknown.
aaggaaataacagcattaatagcaatgtgtgctcttgcatatattgccattgacaattatactgaacgaataagacttgaaaaacttcataatgaaaccagtgcaatgaatctaaaggcattacagatccaacaattaaatcatccacgagaaaagaaacaaaaagatgtgactttattacaagaacggcgagagattgctaaacgagatttcaaaatgagtgtacatatagctatgttacggaaacaattaatggatttaggagtttcacccattgaattagatntggcaattaaagaatttgaaaaaagtgttaaattagataatcaataa

SEQ ID NO: 13729 - DNA, 600 bp, Candida albicans
  unsure (463),(478): Identity of nucleotide sequences at the above locations are unknown.
gatttctacccgtggggcagaccaggacaagtgacaatcaaacgagaaggaagattcaagatacagttggctactcgaaagtctgtaatagccaaggtgaagctggaaacagaacacaagccattgaagatatcactaaagcctgttattgaggctaaacagaaggctgcatcagctgtgcatgttgatccggttattcctacaaaggtcacttttaagttgcctggccatagactagctggttttgcgaaaaaagtggaactagatggaacgttggtgactattaaacttggacgtgatatgaaatcaaaagtggatgcgttggcccatcgatatgtgagaataaatacaaagatgagaaaaattgatgtatcaaacgttccatttattgaaaaagaaaaagggtctaacacttctggtgtaactgaagtaagtcggaatactggagagaaagaagacgcanaaagtccatctcctnatcttgtcaagaaagagaaaaagagacctacagtgtacattcattttggtggaaatgtgaaaaaacctgaccaacgtattattaataacagctctaaagaaggttcaacagaagttaaatga

SEQ ID NO: 13730 - DNA, 501 bp, Candida albicans
ttaatctacatccatttatcactagagaaccatttgagaactagtcaaaatatggcaaggaaatcggaaatttccattagtgataggggggcaagacgacgtctgtcgataaatataacaaataatctacccccaagttcttcttcatcatcatcttcatcatctaaggaaattaacttgggtgaagatgaattaattcaaacatatgtagatcaaaacagaatattagctaaaagaaatgcaatttactccaccaaaataacagaattagaaaataaattaaatcaatctaacttggagaatactagactacgcaatacgcttttgtctttagtaacttccattgagtcgaatgtgatgactaatgtcaacaatatcttacaactgattcaacaatcaagaataactaatggattaccaagaaacgcacagctagattgtttgggccaactggaaagaccagaaacttccacccctttaaattcaacatcgtcaacacca

SEQ ID NO: 13731 - DNA, 492 bp, Candida albicans
gtaccttatcgcggaccttgccgccccgtggtgaagacacagtcaccaccaaatagtataccacaatatcaagacgcaatgaatatgggtggttattatcaaaactatggtcaacaaaatctacccattaatcaaagccagtttccaaatcctacaggtttagttacgaatgtcccacttcctactggttcaaataatcctaatgatacaattaatcgacctgaagatgaaagttccgacatagaagagttgagtaagaatgagttcaatttacaaaaagaacagaaaccaaaagaagtttattatacgatggacgaacttaagagtaaactcaacgatccctattcacttgttcaactaaaatttgaatactatacccaattaagtgatcatatcattaagaaagctcattcacatgtggcaaagaatcgagattgtgaaaccatgaggacttatcataaattaattaaacttgctattaattgtttataa

SEQ ID NO: 13732 - DNA, 210 bp, Candida albicans
tgtcgcaaaattgaaaaattgtcaaattttattattttttgtcagaccgtctgcaataaagaacaaaccaccaaaaaaaaaaaacaattggatattaaattagacaattctacttcttctttcattccaaaaatttatggcaagaataaaagagaaaaagaatgttctgattggaaaaccatacataactatttcatttcttttagttga

SEQ ID NO: 13733 - DNA, 195 bp, Candida albicans
gtttatgtattctatcatctttatccattatcgtataccaatattactcctcaaaccatgcaagtaactactttcttggttattgctgctaatttggtaacattggtgacatcttcaccattgacatttgtttcatctacttattattgtttaccatctccaacaactactatcagtgctcatgctggtctgtga

SEQ ID NO: 13734 - DNA, 327 bp, Candida albicans
catttgtttcatctacttattattgtttaccatctccaacaactactatcagtgctcatgctggtctgtgacgttgtttttacttctgaaggatataccacgactgttccatttgaggattgtccattgacttctgttagtgctcctcctggtttcccaccaagaccatatggagggtgcaccacttataatggtgaagcttattgtgctcaaggtaattgtgatatgttttatgtttcatattatcatacatttttttgggtgactagttggccaagccccaacccaaagtcgctaaaaaggttttttttgttcatttattactga

SEQ ID NO: 13735 - DNA, 510 bp, Candida albicans
caattaaactcaatcaacgagaaggaggaaaaaaaaaaaggaggcccaaagggaaaaaagggaagaaaaagaagcagcaagagcagcaataaatattcatctaagaggaaaaaattcaaaatcatcttcaaacgaattagaaacataatatctcattctaataaaaaagaaacaaaagaaaaagtcaaaaaaaaagaaaaacaaaaaagggaaaaaacaaaagacaaaaaggaagaggaagaaaaagacaggacaaggagaagaagaagaagaagaagaagaagaagaagaaggaaaacagaaacaaccgaaaagaaaaaaagggaccaaaaaaaaaagaaacaaaaagaaacgagagaagaaagaggacaaagagggagggagaagagaaagaaagaaaaaaaggaaaacaaaagaggaaaaaaaaaacaagaaaaaaagaaaaaagaagaagaaggaagaacggagtggtcagatcttcaccaggcggaggaggcacaacgtgcggag

SEQ ID NO: 13736 - DNA, 387 bp, Candida albicans
tcatcgtcgaaaggagagaaaatcagaaggaaaaatcaaaatcagaaagagaaagaagcaagaaaagaagtcaaaaaaactcagaagaagaagaaggaggagcgggggaaagaaataaaaaaagaaaaacaaaagtcaaaaaagaaaacaaaacaaagaagagaaacagaagaagaaaaacagtccacaaatcaaaagaccaaaaagaaaaccaaaaaggacaaacctcaaaaagaaaagaggaggaagcaaagaacaacagaaagaatcaaagcacaagtccgaccaaaggaagagaaaacaaagcctatcggctctcgagaaaaaaacaaaaagggagaaaggaaagaaggaaaaagaaagaaaacaagagaagatacgatctaa

SEQ ID NO: 13737 - DNA, 480 bp, Candida albicans
caagttgcagcaggcggaactgtatataatttgccgaatgattcccataggttgcataaatctcctaaaaaattatcattactccataaagttcaatcatttgcaaacatttcaaaatacgatagtgaggaaaatgaactaatcaaagagatcgaatcgttggagtctctcaagaacacactatatgacgatttggtcaaactaatttcaaagtacaccttgcaaaatgatcagtataatgtaagtcttgaaagacttttatattgggggaacatgtctttggcaatctattgtgtttatcgtataatcaatgtgtttttagtaaagcttccattgctacttttttatggtgaagattattataatgtcagctcaacggtaattgactcaaatgaagaggcaccctcgagtaaagatgcactagcaatcacattgtccaaggttatattgtcggttttccgtaatttaccagttttttga

SEQ ID NO: 13738 - DNA, 189 bp, Candida albicans
aggcgagttagtagtagtagtattagtagtagtagtagcaatcaacaaagaaataataaacaatatgcaagaaatggtaaacaaaaacaaatgcagaagaagaagaagaagaaaaataatttaactaaattaattataaaccacacacacataatgtataacctacttacccactcccatctcatataa

SEQ ID NO: 13739 - DNA, 345 bp, Candida albicans
agattaccaaaagatgttagaaatgttgttacggcagaacaatcattatatccttctgaaattgaagatgaaggtgaagatcaagaagtattggataaagaatctttggataaagttcctcaaccatattcaggagaagaaccttccactaataataatcacgatgataatggttttagttttggtttctctgattcagatgagaaagataaccacactgaccatgatggtcataaagatcacgatggatttgattttactaatggcgcttcagaaaaacctaaaaataatttaccttatccatttaaagaaaaatcagataccgtatttgagtttcatttttaa

SEQ ID NO: 13740 - DNA, 243 bp, Candida albicans
aagccaaaacgtaataaagtaaagggatatgctttggtaacaagttcaaacataggcttgaggtctaattttaaaatatatgtcaaaaagccattatttaaaatgaactacttaccaatagaacatatcaataatcaacaaatatatgttttgaaacatattgatacattaattttagatctgctgagatgtattgaattcagtattactcataatacattgaaatcagagtcaaaaaaatga

SEQ ID NO: 13741 - DNA, 204 bp, Candida albicans
cacatgtcaataatcgtgatccgtaaatgtgcttatcaagataatctgcaagtaatcggtaaaatttgcttgttgcttaatttacaagacatagttcaatctataaacagttcctcaagaacatcaagacaccgagagctcaaaactttaacaggaatactacaaataaaagtaagaaaacaaataaatatcacctgggcatga

SEQ ID NO: 13742 - DNA, 261 bp, Candida albicans
ataagttggatgtatgattcagtgaattggtttgataaaatcttgataaatatagataaacttgaattagccaagaatcaatttataacggcattaaataaaaaagaattttattgtcgtagttctattcttgataatggtaatgtcgatgaatctaaattggcagtaattataacgataattaatcaaaacaagaataaatcaattcaaccaatagagttgagatttgaaaaattattatctgaacatttaaaccagtga

SEQ ID NO: 13743 - DNA, 195 bp, Candida albicans
ctggaagtcaatagaaggattccatgggataaggagagaaaaacccctcacgaaaccttaattttggtaccattgcattattccggacgtgcttgtctttctccaaacttggaggaacaacacaagatattagggtatcatcccaccaagtatttgtccatcccccggattaatactgatttaggtagatattaa

SEQ ID NO: 13744 - DNA, 507 bp, Candida albicans
tgcggttccttccagcgccgtgcgctgaatacagcaaccgataattatatcaacgtcttcaatacgcattttgaccatataggacaggaagcacaagttggatcagcaaaactaatcatagacacaatgaaggagttgaatctgtggccaagtttcctaagcggagacctaaacatagagcccaatctggacccttacaaagtgttgaataattacttgctgaatacagcaaacttagctacacctttcaacaagtttggacacttcaagagcacagtcacaggatttgaacgagaagtgttgttagatggtggtcaaaatatagattatatttttgcacctaagtatactctaaaaatggatagcgatgaaaacaccaaaggagccggagaactaactacagacatcagtctaaagctatatcaattgggcatgctacattcaaaatttaatggtaaatacataagtgaccatcggccattggttgctgatttcattatgaactga

SEQ ID NO: 13745 - DNA, 327 bp, Candida albicans
  unsure (247): Identity of nucleotide sequences at the above locations are unknown.
ggggaagcgccggaacaagttggtggggaccgtgggcaacgcggaacaccggctggcgataggaatcggtcagcgggttcagacgtgcaatccagatcttcccacgtcccagagagggcaggggatcattgtggacacggatgtttaacggaacgcattaagtggacgggaacgaagcctgcgccggatcggctgggcgggcgtcccgagaacggacgtttgcgagacgagatcatgggcgacgtgntgggttacgcacgggtgtcgaccggagaccaggacgtcgcggggcagacgctgcggctcgagcgggcgggcgccatatga

SEQ ID NO: 13746 - DNA, 237 bp, Candida albicans
acgcggaagagaggtaagagtagatgtgttgtattgcaggagcaatgcaggatgggcagaggagagaatgagaaacaaacccgtattgtcgtagaggatatgaagacaggtttaataagaacgcgagaaatagtggagtacagaagtgaatgtcatgaaaacgataggagagatatagaacggagaatatggacggaaaaggtagaaagatcgagaaaaccagagttggaagtgtag

SEQ ID NO: 13747 - DNA, 204 bp, Candida albicans
gtgaagaacaagaagacaaaagtgtatgttaaaggaaaagagaagattaacaagttattaggagatatggaaagaggcgagagagcaagcagcgtgacaaaaataggggaggaggatagagtatttgaagagaatataattatgcagggtattgtaggacaaggtatcacacagtcattaatatatcaagaagatacagtatag

SEQ ID NO: 13748 - DNA, 711 bp, Candida albicans
agaagtttagcagtgcccactacaagcagttttctgcaaaataatcagtctcatttaattcaaccagctgccaatacctcagtaggaccaataccggaatcaactgctcttggtcctcatgtaaatattccccaggctaaccaacttcagcaagatcaatcttctcaagcgttggttggtggacttccgccctcacaaccgcaaccacaaccgcaaccagtgatagcgcaacaaatccatactattccagagaatcaatcaattgcatttgatatgacacaacctgcagtcgcaaatgcccacctccctgaatcaaaacctgatttatcagaaacagctaacttgcaaagagatttgaaccccaccgcagacaccaccacaaataccactactgctactaagaaaaggaaaaatgacactgctggtggtactaataaaaaggctaaagttgcgaagggaaagaaaaaagaacccaaatcaaaatcaaagggtaaaaacaatcaagaagatgaccaaaatgcatcgaataaaccagacgatgagaatgtacctggaaaagacaatggcaatgaagaaaaccataaggtagaagcagaatcgaaagaagaacatttacaaatgggaatgaaaccaccacaaccaaaacaaataataccggtaattcatccaacgggcactacaaccaccaccacctcaaaatcgaagaagtag

SEQ ID NO: 13749 - DNA, 588 bp, Candida albicans
tcaactatgcttgtcgataactatatcaaggcaagttctataaaatttaatatttcaatagcaccatgtgtggaaatagcgagatatttgaaatcaaatcaacaacaacaagtacgactacaaccacatgaagatccaaaacaactactaagtcatcaacaacaacaacaaccagacactcaatatcattatcaaaatcatcaccacaacaagcagtatcgacaacgacaacgacgacaaacacaggaacataaacaacaacaaggtacaccaagaatacgtcgaccatcatcatcgttatcaccattatattcacctaaaaccaaaaaatcaacccctaataaaaccaccaaaactctactacataaatcatcaacatctccgacctcgccaccaccaccaaaaaagaaaaaatcaaagaatagaattattgttcctaatgaatttataaattgtgatcttgatattataataacattaatcaatcgaatgttaatttcattaattcaattaaatgaattatattttaataacaaccataattaccacaaccttatttatccaacaccaacaaattcgtttccataa

SEQ ID NO: 13750 - DNA, 306 bp, Candida albicans
attaatgaaattaacattcgattgattaatgttattataatatcaagatcacaatttataaattcattaggaacaataattctattctttgattttttcttttttggtggtggtggcgaggtcggagatgttgatgatttatgtagtagagttttggtggttttattaggggttgattttttggttttaggtgaatataatggtgataacgatgatgatggtcgacgtattcttggtgtaccttgttgttgtttatgttcctgtgtttgtcgtcgttgtcgttgtcgatactgcttgttgtggtga

SEQ ID NO: 13751 - DNA, 198 bp, Candida albicans
acaatagtatcatttaaaatcggtaataatgataatactatgcctaaatcaccaagaataggatatggtttaataaatgaaatccaacaaagacataaaatcactgctaaaaatgaatcaccaagtaaagatgtaattttgttgtttttgtattggaaaaatcgaattgtgaatggtaatatgaaaatccaagtgtaa

SEQ ID NO: 13752 - DNA, 375 bp, Candida albicans
agaactaacaacaacagcagcaatgacacatcatttcctactactaatagcacagtattgccatctaaacgatcgagtatttgcatatcccatagaataaagtcgaaacgaaactcctccacttcatctaccacttcctcatcatcatcatctccaccaccaactccaactacacttacatcttcaagtacacgaaaagtggttactagatcgcaaatacgacgatccaatacgatatcttctgcaagtgcattaagacattccctcaatgtatctaatagcaacacaataccaacatccatacccaagaaactgtttagtttacctattcacaagttgaatagtgattctacattaaatgaaccaattggatga

SEQ ID NO: 13753 - DNA, 390 bp, Candida albicans
atgaaccaattggatgatatccctcatttttataacaccaccatggatatcaatggtgctggcaataagtattatggtgtgattagttcgacgaataatttgatgggcagagatgggttattgactctagatttgactacgggtaatgataccaatagtttatttaccacagccactaaggagatattggataatgacctgataattatggatcccccagaaccagaagaatattttagacgtaccgagcatatggttcgttatgggtatgggtacgaacttaccaataatactgcggttgctggcgggggaagggaactaaaatatccaacccttgctcgatcaaatgttcaaaattggaaaaagaaaaattgtccggattccgtatag

SEQ ID NO: 13754 - DNA, 360 bp, Candida albicans
ataggtaaactaaacagtttcttgggtatggatgttggtattgtgttgctattagatacattgagggaatgtcttaatgcacttgcagaagatatcgtattggatcgtcgtatttgcgatctagtaaccacttttcgtgtacttgaagatgtaagtgtagttggagttggtggtggagatgatgatgatgaggaagtggtagatgaagtggaggagtttcgtttcgactttattctatgggatatgcaaatactcgatcgtttagatggcaatactgtgctattagtagtaggaaatgatgtgtcattgctgctgttgttgttagttcttcacccacgggcgctggcaggatccgcgctt

SEQ ID NO: 13755 - DNA, 363 bp, Candida albicans
  unsure (158): Identity of nucleotide sequences at the above locations are unknown.
atttcattaatccaggatttattaacagttgaaaccacaataactacacttaaagaatttggtatgagttggttagttagtgaatggagatttagaagagtgtatcaattgccgaaaaagaatttatttgatatatatcaaacagttcctgaattcanacaacgcacaacccttcctactgtgctgataacaggaccaaatccactgctgtctccagcaagtgcaagtacaaatacaagtaaatcaaaaacagacaattttactccaaatggtagtcaaccagcaaagaaaccactcgagaaactggaaacgaataatgagggaacaaatgaggtcagatttatcagtgtcaagtattactag

SEQ ID NO: 13756 - DNA, 507 bp, Candida albicans
  unsure (500): Identity of nucleotide sequences at the above locations are unknown.
caggaccaaatccactgctgtctccagcaagtgcaagtacaaatacaagtaaatcaaaaacagacaattttactccaaatggtagtcaaccagcaaagaaaccactcgagaaactggaaacgaataatgagggaacaaatgaggtcagatttatcagtgtcaagtattactagtaatggatcatcttcagggttaatgagaaggggatcaatttcttctccaatcaaaccttcacctttgtcattaccacaaaatggaagaaactcacctagaacaagtagacccaactcgatgttatttttacatccaaattcatcaacatcaaatttagaaagtgatcccgagaaaaaatcaagtgcccccttaagtccatcaacagggccaggggcaggtacaattactagaagaagatccaattctcaaccaattggcagagatgcaattattgccacatctggtgccgcaactgttttcaccacggagctggcaggatccgcgcntcacgta

SEQ ID NO: 13757 - DNA, 582 bp, Candida albicans
  unsure (558): Identity of nucleotide sequences at the above locations are unknown.
ataaatgagatcagtttgaaccaaatagatgttgcagtggcacctaacgatttttcatcaccactatcagcaagaaagccggacatatttgctgctataactgcagcaaacgggaattccaataatcaatttaaaaggccacacaagttggttagtcaatcgccttccccgtcgtcaaagaataagtttcgcatatcatcatcaactacatcttcgccacagtctaacttgcattcaccttccaagttgggactgaaaggattcaaaatgtttaaaaatgcaaatagagacgcgataatgtcgtcaagcagagttatgactccagaaaaaccgaaaatggtatctaaaatatttggcaagtcagcaaaaataaggcgagcttataccccaacccatacatctaccccaatggctgtctcatcactcaaccctccttcatcatctacactgaattcaacaacggcagcaataacatctacaagtccaccagcaaatgagcattatgatattgacaatgactttgacagtccgtcaaaaaatagaaaactgtctaatatntctgcatcttcaattattatttat

SEQ ID NO: 13758 - DNA, 225 bp, Candida albicans
gctcgccttatttttgctgacttgccaaatattttagataccattttcggtttttctggagtcataactctgcttgacgacattatcgcgtctctatttgcatttttaaacattttgaatcctttcagtcccaacttggaaggtgaatgcaagttagactgtggcgaagatgtagttgatgatgatatgcgaaacttattctttgacgacggggaaggcgattga

SEQ ID NO: 13759 - DNA, 183 bp, Candida albicans
  unsure (113),(166): Identity of nucleotide sequences at the above locations are unknown.
actacttgtgttccagccacgtatatggaattatggagagtgctcttcgaagaagcgttgactagtattgatggtaaatcgagacctgactcgactgaacactggctatcacnattggtgaacacgaatggtgaagaaattgttgaggccatttggactgaaaatnaactaatatatctttaa

SEQ ID NO: 13760 - DNA, 198 bp, Candida albicans
aggtacaagaaattgtcttggtgccctattgatgtgcgattagttgacatacagataacgagaaaccagtttccggaactcaatgggctatatgttaattgtttggggagaacccctacttgtgaattagttggtccatctgctgaagaaaccaatcctggaaaatgtaatttttcaagactccaaaagtttctataa

SEQ ID NO: 13761 - DNA, 192 bp, Candida albicans
agcgtggatcttccagcggcgcgtcgaatactagttaggttgtcaaaattacaggttgaagtgttgattcgttataagcttggccgagcaaaaatattgttgaactatagttccgatcaaccgggtgagaggaacagcttactgtgtttgaataagctgttgattgctcaattggatccctatattccgtaa

SEQ ID NO: 13762 - DNA, 621 bp, Candida albicans
ccacgcgatacttgtcggcttggggcaattttctcattcgctaaaaagagaccatctgaagttgatgtaggcccatggactccaacatctttgtcggcatcggcatcggcatctttttccatgcgtaatagagtaccatcgtcttcatcattaactggtacttcattcaccaattcaataaagaggaataattcattttccaatagaaaatcgtcacttacgagtttgatgcagagaaaaaatactcttggaacaacaccaacaactactaattcattaacatcatcgaatatcaatattttgaaccaacgtttctcacagccaacttattttgaaaattttggtaataataacagtggaccacaatctcctgcaatctcgcgtcataacagcacaaccactttgatgaattctaatcaagtcatactagagaatgtgaacaccccgggttcttataattcaaccaactcatttccttcctatgttccacacgagactcctaattcaattcctgaaactccactaaatgttaaagatttactaccttcttcattcaacataaggtcaagtcaaatgtctaccagactagatagagtcttggaagaatatcgtgctagttaa

SEQ ID NO: 13763 - DNA, 327 bp, Candida albicans
gttggctgtgagaaacgttggttcaaaatattgatattcgatgatgttaatgaattagtagttgttggtgttgttccaagagtattttttctctgcatcaaactcgtaagtgacgattttctattggaaaatgaattattcctctttattgaattggtgaatgaagtaccagttaatgatgaagacgatggtactctattacgcatggaaaaagatgccgatgccgatgccgacaaagatgttggagtccatgggcctacatcaacttcagatggtctctttttagcgaatgagaaaattgccccaagccgacaagtatcgcgtgga

SEQ ID NO: 13764 - DNA, 231 bp, Candida albicans
aagagtcatcatctaataaagctttcaaaaggaaacccttcagataacccaccatcttataatgaatcaatatctcaagtatcatctccaatatcattaacccctgtttcttcagcatcaagagtacccacactttccaattccaattccaattctaaggcaagatcgtcaaaagcgtctactaaaaaaaagaatgttccttataaaccatcagctgtaacaactacgact

SEQ ID NO: 13765 - DNA, 690 bp, Candida albicans
aaaacaaataagtttaaaaatgcccaagacttttatgaccatatacaaccaattccatttcaaaccaataccgtacctaaagatcgatctgaaatccgaggagtcgatagttctattcataggtttctatttaataaattcaaatggaaagaatatcccccaatattaaaaaatgaatttatgatgattcaattcttccctcatcatcatattatttctaattttagaaaatccaatattgcctttgcggtgaatatttatactatcccattatttaatagtatcagacttagggatgcaatgaatagatatagaggtcgatattcaaatttacagtttttcaaaaccaagactctgcccattcaatcagcttgtggaagatcacaaaccaagaaactatttagagaattgtttgtcaaggcattacaaacactgggagtgataaacaaagaaggaaatgataatacgtcagttactgacaaattgaaaggagtttatgcaattcatatttataaggtaccgattacgaccgaacaaaaagataaagtagttcaagactattcggcaatgataaataagattgtcaatgataaaaatatttggaacacattaaaccaggctgctcgcagaagcaaatccgtgaatttacagccggtattcttcaccaccgggctggacggaaacgcgctt

SEQ ID NO: 13766 - DNA, 582 bp, Candida albicans
gatgttgctatcaaatttctggtgcaacgccatagaagaatggacgcatttggttacgactacatttggtgtgattgtacaggtttcaaaataacactcaataatttgaaaattgccataaacagattgcacatatttccacacattattcattttgagtatataaacgatttaatggaccttgtgcattcttaccctgaccttgggaggagacttttgaaaatcaatggcacttttaattcttttgattttcaaaatttagaaaaccttatgacgcttatggatcagtcccaaatcagatttgacacactagcattatctaacttcaattattcatttccgctacctcctatagcaacaaacttgtcgttgttcaattgtttagtggcagattacatgattcaaggtttaagaaagctaaacttggttatagatcatcctagtattcaagatcgtatagttacttttcctgattctttggaagagttgctaattgatacaagtgttaatattagtgtgattccatcccccagtttgcgtgaattaagcttaattcttcgccacgggtcgaagaccgcgtaa

SEQ ID NO: 13767 - DNA, 339 bp, Candida albicans
ttggaaaatgagatttttgtagagagaggaaattatcaagacaaggttgcacaattgatgacttttagtcactatttatacaattatttgtcccaatacaatgaaattacattcaataattatactggttgcgaaaatcgttcaccttatgaaccacatggggtagaaagaaagggagaaaaaaacatactcctccccataaatgctgcagttattattacctcgaaagagttattgttagtttgggtttggtttggttcttttttgacaagaaatttttcagataaaatgcagtgttattgtaattggttttacttaattagatgcgaatttaattaa

SEQ ID NO: 13768 - DNA, 192 bp, Candida albicans
atgctattcctaaaaccaatgacgaatttaaatatggtcttgaaaatgtcaaggctaaagttgttggtatttatgatggttccaagtttgttgattctattgaagatccaagtattcaatatggcatattgttggataaaaccccattctatgctgaacaaggtggtcaagaatatgatactggtaaattag

SEQ ID NO: 13769 - DNA, 183 bp, Candida albicans
tgtgcgactgttcatgcgacagaaatcccggccaagcgtagcccccaaacacacaaccttaaagaaaaccttgagacagtcatatcggagatcgctgaaattccgaaactagtattcctcattcaacacgtgcgcttcatcaataaccaccatcccaagacgactgtttcgcccacagggtag

SEQ ID NO: 13770 - DNA, 192 bp, Candida albicans
tcgttagagggagaaaaatctgaactcagaaaattttcgttttcgcttgactgcaatttttccaaactttttgataacttgggtttgttcaaggaacaccaaccaccaactgccaataacccatccacactcaagttatttaacactattgattactatcaaaaaggtttctataaactgtgtgctttataa

SEQ ID NO: 13771 - DNA, 420 bp, Candida albicans
ttgcaattgtccgttcattcaccctatacttacacaatgtttgtttcaattaaatatgatcctgaaagatttaaatccctacattcatcagctaatacacctcataccggtagaacaactagacgatcgtctatgccagattataccattactaccatagccctatcgactaaatataacactaatactattacttctaattcccaatcatcatcgttcacactgttacctacaaaaatcgtcaaatttaaatataatagtcgaaggtttgtaaattctcctgcatccactaattctggaatattgaataataccccagaatttaaaccagatataaacaataaatcgatgtctacttcaccaactacaggaatccaatctttaaataatgcagataaaaattttgcgtggggtaatatg

SEQ ID NO: 13772 - DNA, 249 bp, Candida albicans
tcaatagtgttaaataacttgagtgtggatgggttattggcagttggtggttggtgttccttgaacaaacccaagttatcaaaaagtttggaaaaattgcagtcaagcgaaaacgaaaattttctgagttcagatttttctccctctaacgatcaaaacaaaaaagaaaacagacacacaatcttattaattcgtcttgaatttcaatcgataaacactgataaacaccagcagtttaaggaattatag

SEQ ID NO: 13773 - DNA, 240 bp, Candida albicans
aaaaacaacaaagaagtaatgaaaaaaaacaggcgtaaaaaacacacatatagaaaaagcaaaagaaagctgaaaaataatcaggggtcagaagtagtaaaggaagcaccaccacaggaaaaaagagtgataaatcaaagtgaggaaatgttacaagaattgtgccaccactaccaccaccaccaccaccatcaccaccgccaccatcatagaaaaaccaccaacacaccaagtcaatga

SEQ ID NO: 13774 - DNA, 372 bp, Candida albicans
atcaaagtgaggaaatgttacaagaattgtgccaccactaccaccaccaccaccaccatcaccaccgccaccatcatagaaaaaccaccaacacaccaagtcaatgataatgaaataaaagaactacctcaggtagatgaagaagatgaccctaatcaagatcaagaagaagatctgatattattggaagaatgtttagaacattatttcaacaattcaataagtgttaaacgtgaattagaaagaagagcgacattatctcacatcactgaaggagttactgccactaatttaaacgacgatggattttcttctatctgctcctcctcctccttcttctcctcgagtaatcactacaccaatgtcaaataa

SEQ ID NO: 13775 - DNA, 195 bp, Candida albicans
tgccttccccttgaaaatcaggttactgtttttttcaaaagagcttcatcttttattcagtcttctaataagagatttgttctttcctcaaataattatttcaatccaaacaatgtcgccacaagctgttactgcttccattatcaggggttctcaagtagttgtaactactattatctttgctgtttctattaa

SEQ ID NO: 13776 - DNA, 303 bp, Candida albicans
  unsure (272),(285): Identity of nucleotide sequences at the above locations are unknown.
tatttaattgatgccttccccttgaaaatcaggttactgtttttttcaaaagagcttcatcttttattcagtcttctaataagagatttgttctttcctcaaataattatttcaatccaaacaatgtcgccacaagctgttactgcttccattatcaggggttctcaagtagttgtaactactattatctttgctgtttctattaaggctttggctgtgcttggaatttattatgataaatcaaaacctacacggccatcacagttttttancggaccggtccgnaagatccattggagagag

SEQ ID NO: 13777 - DNA, 204 bp, Candida albicans
caaaacaagaaattcctacacaaaaccgtttgctttttttgcaaatttcgtaactgtgttactttttttcgcatatacaattgcgttaaaattgaggaagagcagcttataccagactgtcaagattcattaaagttgttatttaaaagccatagattgatattacaatatatgtcattattatatgacccactaaccttctaa

SEQ ID NO: 13778 - DNA, 189 bp, Candida albicans
ttttttatacaaggatcacatttcattaacacacatatatatatatataatcaagaaaccatgtctacgtatcgtaaaacatataagaatcaactgaaacgattcaataatggtaacaatagtaatagcacatctactgaattgacaaatttagttgaaatgttcccagattgggaagcagatgaataa

SEQ ID NO: 13779 - DNA, 183 bp, Candida albicans
caaggtttgttgtcggagaatgataactcattagaaattgtgatcgacttgatagttaataataaagtatccaaatgggaaccaattaagaaggaaaaacacaagaagaaagaacataaagacgacacaactgattccgtgagtcttcaccacgggatcgacggtccgccaaaagttggggag

SEQ ID NO: 13780 - DNA, 585 bp, Candida albicans
agcgtcgtccttcctccgcctggtgaagacgatgacgagttgtacgagctagatagatttgagttatttgttgaagaacagatgcctgaagatgaagacaatggggacacccatagtgattctcctggcaatgaactaaatggcggtgcacatcataatagccaagaacaaagcgacagattgattggaagcaattcaccaacaaataaacctcataacggcaacaatactgatcctaccctgagatttaggcagcttttaactaatacaaaggatgcatttttgactttaactgacaatattattgctgctggatttgcaattccaaggtcagtgagtgtatctacacagtcattaacaggaagatacagaaacaatagcacagctcgtaccgaatacactaaagaagttgttccagattttagccctgaaatgtttttacaacctgaaggtagttcccatatcacagagactttatcagagcagaacgcggcacctctgactacaaacagcaaccacagacgaagaaatgtgtatgtatactccagaaaagaagttatattagatgtatctagtgatgaataa

SEQ ID NO: 13781 - DNA, 267 bp, Candida albicans
  unsure (147),(153): Identity of nucleotide sequences at the above locations are unknown.
ttaataagtacttgtaatgaacataggtttgtaagaagaacaatgtggagaacagataagaaattttttttgttctgtgggcggtggatgaaaaatttcgttccgatcaatttgtttgaaaggtggtgggggaagtgcggggaaagnaaaatntctgccgatgctcaaactaatttcatcatctcacactcactgattaactattccttccccatcatgcataaactatttgaaacccaaacatataacttggaatttttaaactaa

SEQ ID NO: 13782 - DNA, 570 bp, Candida albicans
  unsure (4): Identity of nucleotide sequences at the above locations are unknown.
tccnaaacgttgtcctgcctacgcctggtgaagactatgccaaaaggaccagaatctgatatcaaagaaaccacaacagctccagtcccagttccagttccaattgaagaaaccaaagctgagccagttgttgaccaaactactgctgctccaattccagtccaagaaactgaaaccgaacctgaacctgttgttgcaacatcaaaggacgttgccccagccgattatgccaatgagccaattgatactactgaggaacacccaaagactttagatccaaatgctgtcgtacctgattctgaagccaaagaagttgatgcatcacctgtcgtcaaagaatctagaaatactcacgaaacagcccaagacgaagaagaaatcattattgctgctgaaggtagcgagaaggatatcactgctgctgttgaagctcgtgaaggtgctggtgtaactcttgaagaaatccaaccaacccaatcagaaaaggagagattgacaagagaagccaaacttgctgctggtgttgacgggcctgtcaccgttgaaaagattaatgttcctgaagacgaa

SEQ ID NO: 13783 - DNA, 201 bp, Candida albicans
gaaagtttacatctcaagatgaattatccccctattgtaaaaagtacatcgcctaatgatagacatcatagagtactggcgactccttacatgatggtaacgacaacaactacaacaaaaaaaatacattatcttgacggtataattagtagtgtgcgagaggcacacgataagatttatcagtttccttttctcggttga

SEQ ID NO: 13784 - DNA, 198 bp, Candida albicans
  unsure (161): Identity of nucleotide sequences at the above locations are unknown.
attccagtgggaagtgtatatttatatttagttagtttcgattttttttatttcttatttcaatatgaaattttcaaacacttgctgttgggtaaagagaaaacaacgaaaattcttatactgaaacaaaaatacttggaacactcgaatcgggttctttnttctgagtttggaaaatctgcacaatttcttgtttga

SEQ ID NO: 13785 - DNA, 474 bp, Candida albicans
actgatttaactacacgatgtaatgtttatttccaacaattattaactcaagaaaattttcaaatcaattatcacgatagtggttataaaactgaaccttttgtatataaaaggaaaaaatggcttaaagaaagaattagatcacttcgtaaacaatataaatttgataaaaataaagataaatatgattttgatcaaattgctaaacaagaattttccattgttagtaaaaaccaatcaattcatgaattaaatatttatcaacatttttgtcatacaagaatatttggtaaatgttttgatacaaataataataataataataataatggagtgattaatatggaaaatccacaatcaaatcaattatgtaaatcatttgttcaaaaattatatccttggatgagtgggaatttgcccatatttgaaagaaataaagagagatcaccaccacaattggatgattatgactga

SEQ ID NO: 13786 - DNA, 255 bp, Candida albicans
ttgtggatccgaatggaaagatttaatgttgaacaaacattgaatcatttttggtttaatgaaaaagaacaagacagtctagataatagtgaaggagctgaagaaagtcaaattgtcgaagaatcaagttgtttttcatcttcatctcaaccttcatcgatgataaatggcactaaaagactaatgataagatccaacactcaaccaattactttaaaagaacagcatgaatcacaaatcaatttcaaaacttga

SEQ ID NO: 13787 - DNA, 444 bp, Candida albicans
catagacacaagtataatgattatgccgaactgataacgaacccctttgggaatccaagctcaatatattcaggatcagtggatgatttttcaagaccgatgaaaacagattatacagatgagggtataaatccgttatacagccagattaaaccattgaaaaaatcaacaacggaacctattaattcatttgaactctcatatcagactccacctgaaaccaagttcaagcgttcgttcactgatgagtatccaataactgaagaggatagattacattcctcacaagacgaaagtaaagtgaacaatcaagaagaggaccaacaacagggtagtcctacaggaactgatattatagatgactttttagaagaattgaatgccccaccagaaaaagaacctccttatccagtaagaggagtttcgaaatactttgaaacttag

SEQ ID NO: 13788 - DNA, 222 bp, Candida albicans
  unsure (54),(114),(184),(204): Identity of nucleotide sequences at the above locations are unknown.
tgttacgagacgtctagatctgttgatcaaagtccttactgctgtgtgcactgnacacatatctgcgttctgtctgtctatcttgttactgtacgcatacgatgctcacatcgngcgattgtgcctgctgtcacgtctctcagtcatgagctcaaattatgcatgagtatgtcatactacatcnatcatcccgatcatgcattncagttacacatatgctag

SEQ ID NO: 13789 - DNA, 285 bp, Candida albicans
  unsure (52),(160): Identity of nucleotide sequences at the above locations are unknown.
gcatcgtatgcgtacagtaacaagatagacagacagaacgcagatatgtgtncagtgcacacagcagtaaggactttgatcaacagatctagacgtctcgtaacatcacggaagagatcatgtcatagactgagtatcagcacagagcagctagatcgcnccgacttgtggcttggacgtagctataatacagacacgtgtgttatgagtcgcgttcgcgaacattcagatatcagaggacaagatcaacaacccagtaggacaatccagaatgagacgcggtga

SEQ ID NO: 13790 - DNA, 183 bp, Candida albicans
actaaggagatatgtccagaaagaagaatgatcaaaatgtgtgaaaagttatcgaggaatgccaaacagacacacgtgaggttcacgaaaaacgactggccaatgattaaattaggagggagaaatagtgagaggagttataagcgcgacgagcatggatcgagaccacatggagtcaattaa

SEQ ID NO: 13791 - DNA, 306 bp, Candida albicans
  unsure (6): Identity of nucleotide sequences at the above locations are unknown.
agtganacctactccacctacaccaccaccaccaccaccacaacttcttcttctttttcttctacaggtagtattaatactatactgaattggtttctagaattaacttttcaacaattgattaaatttatatatcaattgagttgtttttcatttaaattttatttaatgtatcaattcatattatatgaattatcaattaatcaaattggatttaaaaaatttattaattatcaagaattttatccaaagctaaaagaacaagacgaagaagattttcaccacagaccggaagatccgcgaatt

SEQ ID NO: 13792 - DNA, 237 bp, Candida albicans
cttaagtcaatgagatcatttatcaaatcccatagaaagactgattcaactgtatccagcactttggaaagtccactactagaaaataatcatgccacctccactcacggtcattcaaactcggctactttgatttcacctccagatgattactatccaccagtatcatacagtaatcgttcttcaacaacaccgatccttccccgaagtcctcaccacggcctagaaggaccgcat

SEQ ID NO: 13793 - DNA, 381 bp, Candida albicans
tcccattcccaaattagtgatgttttaaattcgctaccacatatttttatgggttgtaatgtcaaagaaggaaatttattagatagatcaccttttgatactaaaagagatgttaaaattggtggtaattatgaaatctattttactgaagatacagttttttatcatttacagaattccgacaattccgacaattccggtagttcaacctcattagaaattaatattcctcatgggaaaattacatttgatagagtcaatgatataacttcacttggtttattaattggtgtattgatgattttatatgccatttcaataagagttttcatgagtaccacttcaaagacgaaaagggattcacaattaaaaaaaaaataa

SEQ ID NO: 13794 - DNA, 198 bp, Candida albicans
atcccccaacatgccgtgatccggcagtcccgaggtgaagacgaagaagaagaagaagaagataaaaatgctattactactactactactaggagattaaatattattaattttttgaaatcagatcaatttaaaaatatgttgatgattttggtatgtttaatcattattataattgatatcatacaaataaaatga

SEQ ID NO: 13795 - DNA, 204 bp, Candida albicans
tttatatttcaaatcaataaattgagaaatccattcaagataactaaacagattgtagaactaaaactacaagaaagagcctctgttgaaaaactatacatgtctctacacatgtctctatataacggcaatcattttatttgtatgatatcaattataataatgattaaacataccaaaatcatcaacatatttttaaattga

SEQ ID NO: 13796 - DNA, 405 bp, Candida albicans
  unsure (398): Identity of nucleotide sequences at the above locations are unknown.
aatattattaatcaattacatatttacccccccctccctcttttactcctccccatgtttgctcgttcaccatttatttcaacaatttttaaaagatcaattggatcagtacgtacaaccattattggtactggtactactacaattccaaaacaatatcaattattcaatttcaataatttgattaccaatttcaaatcatcatcatcaagatcttcttatggtggtagtagcaactatagcaactatagcagcagcaataatagtaataacactttaaaaatattatttgctagtactggttcatcatttttattattatctacatttgctagaaaaatccacaatgatactggcagttcaactcaatttcgttatcgacgagccgcaggatattncaatgct

SEQ ID NO: 13797 - DNA, 387 bp, Candida albicans
cagggattttttaatcaatattattttggattattatggcaattaatggaaactcaagctaaacattacaagacatctacagatataaatgatttcatatcacattttgttcaatttcttaccgtcaaagtcccggaaattttgatccatgatgaacgggccattaatgcaatcattaattataatgttaatttattacttaatagtccatttattaatcgtgctgttgaatcatttaatttacaaacagataatatttatggattgactttggtagtacgtgaattaatgaaatttgatgatgttagattctcggttcaactgtcattatataaaagaattgttgaatttgaaactttggttattgatgaatttgaatattcataa

SEQ ID NO: 13798 - DNA, 204 bp, Candida albicans
tattcttatattgaattaaccccagaaatgattcaatttttacaagatattaaaaaggatatagattatagattaatcaaattacaacaacaaagtgtggtgaatggtcaacaccacgtgttatcaatttatgataatgaatctttggcatcatcaacatccacatccacatccacagatattccatcggaattaacatgttaa

SEQ ID NO: 13799 - DNA, 195 bp, Candida albicans
gtgaacactttcacacacacacacacacacacacaattaactctgattatcaccttgtttttatctacaaatcaatatcaacaagtgttaattaataataatgttcgtatacatatatatattaaaaaattagattgtaaaccattaaaagaaaggggggttgtgccaatttctattgaattggaatcttgctaa

SEQ ID NO: 13800 - DNA, 189 bp, Candida albicans
cagaaacataatgacaatttaacaagggaacagaggcaaatgggaattaattttttccaggagaatttggatgatagttttggtgggattcggtggaaggaaaggcctgaattcaaagggagcattagcaaggtggaaataaaaaactttttttggtgggttactttattcgccattaaaaaacattaa

SEQ ID NO: 13801 - DNA, 531 bp, Candida albicans
aaaactttttttggtgggttactttattcgccattaaaaaacattaacccagaatctgagaatgtggatgatcgtacatcagacgttttgaacagatatggatctgattttgtaaatgtttctaaaagacgaactccattaatgtcaaagacgcgttcagatatcacatgttcaagcagcaatcacaaaaaacaaaccaacgaaatatcccaacttcaacgagcaaaatctggggatgtactcaaagtcaaatcaatttcagggtctattaccgactcctttcaaaacactttgaataattggataaataaatttgaaactgatccacaagacgaccaaaatccaaacctgttaccagacactgttgaaatgaataaaagtattccaaaaatcagtaccccacctaacccaaacacgtcaattcaatctgaggatccattctctgacgacgatgatttaattcaattgttgcactcaaaaaccttaccagagtgcccacaatcagtcttcacacgggctggaagatcacgc

SEQ ID NO: 13802 - DNA, 216 bp, Candida albicans
acaaatttattaaagagtagggtggggaaaaaaagggaaaggtttcatagacaaaaaagcgggtttaaggatttggaaggagagccattaaaccttttcagggaatttaaaaacccaagtattttcccagttataacacttaatattcccccaaattattcaatcaattattcaaaagtccccggatttcgacccaatagatataaatttcgataa

SEQ ID NO: 13803 - DNA, 627 bp, Candida albicans
  unsure (395),(552): Identity of nucleotide sequences at the above locations are unknown.
ataactacaaccccgaattttttttctataatgatcccattaaaacaaataacttggaataagaattcaatatttcagaacactttaatactatcgaagaaaaatttatctaaaaattctttattattatcattatcatcatcaatgtttcaaaaacctcatccaaagcaaattttacgaccaccccaaaataaatcacaaactccatcgactaatccggctgatattttgaaaaaaaatgatattttaatgtattctacaaaacctactaattatattgaatcagtaacgaaaaatggattccatttatctaataatttactcattgaatctaaattgaataaaatcccacaaatagggaccctcaatgctactaccaccactagtgctagtanaaatgatagtgctattggattaatgttattgcaatccgaagcatttgaaataaaattgaattctaataccataaatataattgatgattggtacgttgatttcaaaataaatactagtagtagtagtagtagtaatgatggtgatggtgatagtatnattaaaatatttgaattgattcatccaaaaacagaaatcttaattgttggattacgtaaaaaatcaagaatgtga

SEQ ID NO: 13804 - DNA, 186 bp, Candida albicans
aaaattattattatcaactcccacccaaaacagcaaaaaaagaaaagccaaaaaaaagaaaagcaagacaatagtcaacagagaaaaaaaacacaccagaaaaaaaatagtaattctgtatacctttatacaaataagattttaaagcctattcacacacatcaatcttctgtcagatttcaatga

SEQ ID NO: 13805 - DNA, 276 bp, Candida albicans
ctctattctcccccaccatgtgcgcatcaattaatcattttattatcattgttatcatcacatcgcatcgcatggctccatttccatatgtctattataattgtttttaattttaattttttttttaccattatttttattcctttaacttcaattgatagttctcaattcatatctgttcctaattttacaaagttgttgttgttttttggaattgaaacaaatcatctaatcttcaccacgaggctggaaggatccggccataaggtgggggaa

SEQ ID NO: 13806 - DNA, 195 bp, Candida albicans
tttgtggacggtagtgttgttcaggaaaccttaggtgtcggcccgatcaaggtcccaaagactaactataggcttaacaaaacgattacaaacttaatagaacaatttattttcttccctttgcaaataaaattgagaagaatttgtcaaaatagtaacaaccgagttctgttcatcgttagcctcttgatttga

SEQ ID NO: 13807 - DNA, 183 bp, Candida albicans
ttcccgcccccctgggattcgggaaggaacttttgggtaaacacttcgttcgccaaagggggccgaaacgttgaacacgcggtcatctcacgcaacttgccattgtggcaacaaagcggtgcaacagagaggccatggaacggacccgatagccatcgtgaggaggtgatcaacacgggctag

SEQ ID NO: 13808 - DNA, 276 bp, Candida albicans
aaatatttaataatcctatccatatcaataatccaacaacgacaacaacaacaacaaccactcagctcaattcaattcaattcaattcaattcaagtcaagtcaatttttattttacttacttaatacaatttatacacttttacaaatcatgtcatttcaaaattttgatcaaatcattaatttaaaagttaaaatcataacattattagatcaaataataattggtcaaatttatacgtcttcacccacaggggctggcagatccgcgtgcgaa

SEQ ID NO: 13809 - DNA, 474 bp, Candida albicans
  unsure (96): Identity of nucleotide sequences at the above locations are unknown.
cttgctgctgaaccagtttcaaagtatttttcatgggggaaatttgaagtgatgttcaactttgttatatttataggaagagctgatttgagattntacagaccaaacagattgccaaagaaagttcgtgctattataattggtgaacagacagcagtagtaatttcttttgaaagtgaagaagaaaatgatgacgatgacgatggtgaggaagaagattatgaagaatataccgattatgaagacggcaaccaagatgaatatgcatctgaattccctgatgatgaactttatttcaagaattctacagtgggtcgagaatcagatagtggtttgacaccagtaaataataccaattttgaaaaaaattatagtacagattcgtacggatataataccccaaacacttttcttcaatctccacatgttggaaaaccaaaaccttatcctgataatgatgaatttaaattttag

SEQ ID NO: 13810 - DNA, 207 bp, Candida albicans
ttaataattactacaagtgatataagaaatgatttgattcagtcgttttccttatctgtaggggtcgtgtggtattacacaaaacgtctcaagaggctggttctcgaaatcacctaccacgggtcttccctgaaattccaattttataaacaaaaaaataaaaaaaataaaaagaagattaacaatatacatcaaggggttccgtga

SEQ ID NO: 13811 - DNA, 294 bp, Candida albicans
aatccattaacgaaaaagaagaaagctattaataataatgaaataataatttatgccacaactaagaatcatactaataataagaatcaaaaagaatcagataaacgtaaatcctcatcagcaacaacaacaagtggagttactgccggtaccaacaataacaagaagcagaaatcatcctctacgtcaactacaaataacacaagtggtaatagtggcaccacttctaataaatccaaacaaatattatccagacttaatataaatgtcccagcagaattaaaacatatatta

SEQ ID NO: 13812 - DNA, 573 bp, Candida albicans
  unsure (559): Identity of nucleotide sequences at the above locations are unknown.
acaaaccaagtgctgtctggatctgcatatatcacgaaggacaccaagtacgctaaaattactttggatgcaaaagagccaattcaagataagaaagaaatggataaagagaaatcagaatcgtcatcattgtctacccctgaaccaccacaaagaagaactagaagtgccagagatacaacaaaatcgaaacgtaacttgcgtgatacacctaaagagaagtcacaatacaatgatgaagaaataactctgggtggtgctgaaaaatcgaaagtggaagtgagtagtacaagtgatcatacagatgatcaatcgccaacgccaggaagtacaaaaaagggtctagatgagcagacaaacgacgatatgagtgatattgaagatgtagacaaagataagggggatgagacaattgctaaaattaagaaagaaaacacttctgagcaagaagaagataaaaacaaaaagcagacagaagaagaggcagaagaagaggaagaagaaggtgatcatgttagtggagatgaaagggaaagcaaaaatatgcctgaccacgggnctgatagatccgcg

SEQ ID NO: 13813 - DNA, 570 bp, Candida albicans
gaagatgaacatgaacatgacgatgacgatgacgatgtacatcaacatcgacatggtaatatagatagatattgttttcattttaaatacttgttcccatttcattccaatttgacgtcattaactgttgatggagtcaatgttgtcaatttccataattttgataatttaattaacttaaagacattaaacatatataatcaatttaaatcatgtcataaaacttttgattataaattacctattagtttaactcgattaattttcgatcattgtcattatcaacaatatttaattgataatagtactaataataataatctttataatttgaaatatgttcaaattactaattgtggattaaataatattgatcaatcaattttaaaattaccggataatgttgaagaattgaatcttaataataattgtattggtataattgataatccatcaaaccaaaaccaaaaccaataccaaaaccaagagataacaatcgataagatttttcctaaaaatttgaaaactctacatctttgttatatcttcaccacgggtggaagatcaacg

SEQ ID NO: 13814 - DNA, 432 bp, Candida albicans
ggagataactccccggccattagttttggtatattgcattttaaactcatacattcgacatcagcatcatcagcatcttcattatatatacacttagtcatgtatggattacgatcatcagttaagaatttattaacacatcggtattattacttgggtggtggtggttcctcttatagaatcaatcaacgatcatttcatcaaaatagaattctacgaaaagatgagaaaactaaagaattacttaaaaatcttggattaaatttacaaaaaggtacaattaatagatcaaataaaaccaaagacaataacaacaataagagtggatcatctgttaaaaatgaaaagacaaatgataatggggatgaaaatgagggaaatgagggaaatgttacgagaataaatattgaccagcgggctggaagatccacg

SEQ ID NO: 13815 - DNA, 237 bp, Candida albicans
  unsure (15),(28): Identity of nucleotide sequences at the above locations are unknown.
ttggcaagacgaatngtggtctccttanatgagcatgttagaatgagcctaaataattgcagtctgaaaagtaatgataactcgtctaaagggttagatacaattacattggtgcctacttttcaaacatgttttgccagtagattgtattatattaaaatgactgtgagattgaatcatggatacagtttacttgtgaatgttcctttgaatattcatacatattataacttctag

SEQ ID NO: 13816 - DNA, 609 bp, Candida albicans
acgcggatcttccttccccgtggtcagactccagaagccattaaaatcactggtgttgataatttatccactaatgatattcaaaattatgttgattattatattaattataccaccacgataataaaccctgaaactaatgaattaaaatatgaattagttccatttgatcaactgattgaatttaaaattgaatggattgatgatagttcggtaaacattgcttttaagactattgatgattgttataaaggattacaaaagatcagtgaatcaccaatattggaaaaattgggcacacaagaatacattgaacaaagtataattgaacggaaaggaaaatcatataatccaataattgatttcaaaaaacatcaaaatttagctaatcgattgaagttggcaaatgaaagtaagaatactgacaataatgaagtcaagactgaagaactggatagtggtgatgccaatggtgttggtgctagtactggtgatatggaagaagatgaagtgtctgtggaattgattatacgtcaatcatttcaactggatagaaaagttaaaaatgcatcacaatattctcgatattacttgattcatggagaacca

SEQ ID NO: 13817 - DNA, 399 bp, Candida albicans
atcatgtttttaagatattttctggttgcaaaaattatcaccaaaaatgatggtggtgttttcaataaacttgtcacattagttaatcaacaaagatcctttgcatttaaaccaactgctgtattgtttaaatcaaaaaaaaagaaaaacaagcaactgcagattgatcaattaactaatgctcttactaaaactacaactcaattggctacacaaattgaaactattcaacataatcaacaagaaaagcaactgcaacaacaagaattgaatgataatccaaaagttgaaagttcaccacaaacctccttggattcacttatcgatcttccatttgttccttctagtctcaattatctctcgtcttcacccacgggactgagacggatccgcgcttat

SEQ ID NO: 13818 - DNA, 198 bp, Candida albicans
cttaggaactgtcgaaacaatgaattcttctatcacaaactaaacgtaagccacatacaatccgatacgaatgaaggatatctctggtttcatcctacagtaaaacatgcaacacaatggtcccacaacgtaaactccaaagaaaaatctactttcagccatcaagctctccctgtgaaaacaccgctaaccaactag

SEQ ID NO: 13819 - DNA, 273 bp, Candida albicans
  unsure (124),(226): Identity of nucleotide sequences at the above locations are unknown.
accgccaaaaccaacaacaacacgggtcgggtttaccccaagtttttagtaaggaaaaccaaatttaccatcaacgataccagtattaatataaatggcaatactgttggcaatgagaaccacnccaatataacgtttacttcttccgtgcaacatcccggtaattcagaaataccaaatttatataatgttcaagatattttaagtgattctgcatttgatgatntcatacctacacttacggataacactaaagatcagaataatatatag

SEQ ID NO: 13820 - DNA, 213 bp, Candida albicans
tacttatacgtctggatcattatattatacaatttcaatttgaggaattttatcttttacattcatctggctattccccataattcattgctattcaaagggacatcctttcacaatcaacaactaaatattcacacatattcatatcttttcaaatttaacgaacattatgagattgttgtcattcaatttatttatcatctctatcattaa

SEQ ID NO: 13821 - DNA, 474 bp, Candida albicans
tcatcacctataatagcaacaaaaagtctttcttctagatatggagaacgatctgctgctaaaaaggcgactgccaaacttcatgacaatatgtctgatttgattgcttatcaagaaatgacagagagtagtcgtaagatgaaaagttatatggatcaattagaaggatcattgacacctctgaagaaacggaagcatagcgaggaccaagaagaacaagaagacgaagacgaagatgaaaacgatgagcatggtgatgaaattgaagaattgagtcaatctgattttttgaaaacaaagaaaaagactcaatatcacatcattgccataatgtcaggttgtgaacaaatcattgaattgagtaaatcagatatacaaaaattaagaaccattggtattaaaatcgttaatgatatcgataacaatatatcgtattacaccggcgcgaatgggaggatccgaagcttggcgtaa

SEQ ID NO: 13822 - DNA, 213 bp, Candida albicans
atttctactgccttgggtactgaaaatactcagaatttgttgatttatgatttattgaaatctatggatgtcaatgaaattttgaaaagcatggaaaatgtcgtgattgaacaataccttgaacttaataattttccaggaatatactcggattccccaagaacagaattggtttattggtttgagaatttacctaaacaccctcaattctaa

SEQ ID NO: 13823 - DNA, 234 bp, Candida albicans
  unsure (59): Identity of nucleotide sequences at the above locations are unknown.
atcataaatcaacaaattctgagtattttcagtacccaaggcagtagaaatttaatggntggaaggatacgtggaccaattttttatacaatattgtgtttgtttaccaattatttgcaacaccacacatatttctggaacaacagatgctctaaatttgaacaaactggttatgattataggcaagattccatttttccacaacctatggtaatgtatgccatgactgattga

SEQ ID NO: 13824 - DNA, 228 bp, Candida albicans
  unsure (195): Identity of nucleotide sequences at the above locations are unknown.
aagcaaaaaaaaaaaacgtgtgcttgtacttggtgtgcattgtttagtgaacaagtggagtgggaaaattcaattgaaagttatacgatagagtggagggggggtaattacaaggtgaaaaaaaggaacgtttgtttgtttcacttctattttttttcttatatgttaagggtcaacaacaataaaagtaagttntcaacatctgacgccaggcctagtattcggagt

SEQ ID NO: 13825 - DNA, 288 bp, Candida albicans
acaaattgttccaccccggataatttattggcttctttcatcaattgtctagaaacttcgatttctggagcaccaccaccagcaattaaagcctgttgtttgaccaaacatctaataacacacaaggcatcgtgtaaagatctttcagtttcatcaagaaacaagttattggcccctcttataatgacagatactgttggtttaatatttctggacttcacaccagtgatttcaacaattttagaacctgaactaacaagttcttcaattaaattcaccaatacctaa

SEQ ID NO: 13826 - DNA, 219 bp, Candida albicans
aaaggggaaagggaggaggaagggggggggggggcaaatgaaaatgaaaaaatatccagatataaaaaaaaaaaaaaaactcataatgaacaaagaactcaaaattatcatcaaaaatctccaatttttttttcaaaaaaaagtttccagaatgatagttatcaatatagttcaagccaaaccaaacccataaataaattaataccttctagcaactaa

SEQ ID NO: 13827 - DNA, 231 bp, Candida albicans
tctcttttctttcttccgatccccaacctttcttcatactatatatttgctctgaattttaccactttttcttttccttttccctctttcttttccttcctcttctattccttttttatatttgctttcctttctccgaatcatattacttccattcctattcctccattctcttctgttcaccatctatctatcattttacactctcctccctattcaccttacttcttt

SEQ ID NO: 13828 - DNA, 309 bp, Candida albicans
agaaaggttggggatcggaagaaagaaaagagattaagacatatgagggataagtatctcgttataatgcaagcacaaaaattagaatatagaaagaaagtcgcctccttccctccttccatcctttcaatatatcatgacacagattcattagttaattttaattcattattattattatgtaacattgaaaattacacacacgcgcaaatccgcaaagttcaaaaccaccataatccgcgacacaggcgcagaagaaggccgcacataacgcgttcattgaagagagatttatctatgtatatctag

SEQ ID NO: 13829 - DNA, 228 bp, Candida albicans
  unsure (37): Identity of nucleotide sequences at the above locations are unknown.
cccccccatatgcgcggattgtcctcccaggctgtanacaccacgtcgtttgtgttggttgataatccattcagaaagaattatagtaaaagtaatgattatctgtttgcacaacagcaacatcaacaacaacagcaacaacaacagttacaacaacaatcatctcgtcctgagaaaagactcagtgttgcagatgtgcctaatgattgggtatggagttcattttaa

SEQ ID NO: 13830 - DNA, 348 bp, Candida albicans
attagaatgtccaaaaatccatttgcttcagctttgtcacaactggaagataaaccacgagcacaaaccccaactcattcaagtcgtgctccgccgcgtccaccaaaaccttcacagaaacagccaccgccaccaagttatgaggaggctgctggccccgaagcagcaaagaaaagttaccctagagaaaaagaaggtagaagtgaagactctagagaacgaagaagagaaaatagtagaagtggtcacagtagagaaaatggtcacagcagtcacagtcgtagttatggcagagaacatggacgtcgaagcgatcgggataaagagtgcccacaacgacgcagctga

SEQ ID NO: 13831 - DNA, 255 bp, Candida albicans
ttgagattgtcttccggggatttcctccaggcaaaagattttgccgacgaagtgaacgcccatgcgcccggcgcgacctttgatgttcccatgggtgaatttgtcaatgctgcgagttccatcgcggttgtcgtagatcacaacgttcttagcgatagtgttgactccttcaatgatcgtggaggtgcagagcaaaaagcgcagttttccagcattgaattggtcggcagtgtattgctgcagtgccctcggtag

SEQ ID NO: 13832 - DNA, 378 bp, Candida albicans
catgctacgctcgtggcaaatacaacaactagcaccacgaacaaaaatgtaaccgatggttctgtgtcaactaccaccaccacaacatcaatgggaacaccaaaatcatcaatttttgctaatccattaaccatacttagtggtagtaccaatgtcaatgtcaatgtcaatggtggtgtttctcgtaatacaattcatattccatcgatattaaatttagattcaaatgttcataaacgatcatttgatgaattatcagaatttattgattattctgaaggttgtactggtactgggagtgatagaaaaggggaacttattctggatctttctcgtactacttcatcttatagtgatcaatatttgatgaatgtatga

SEQ ID NO: 13833 - DNA, 186 bp, Candida albicans
aagatggaagaaagaaagatggaagatgaagaagatgaagaactgagagagagagagaaaatatttttttttgtcaaatcaacttcacttctattcattattttttttttcacccattcttcaattattataacccatcaccactcattcaattatagatttccatttacagaaactcaatattaa

SEQ ID NO: 13834 - DNA, 789 bp, Candida albicans
  unsure (128),(764): Identity of nucleotide sequences at the above locations are unknown.
tcagttcccgaaatcccaaggtttaacactgcacaggtacacccaggaccaacaaaaagtgaaacgtcagttcagttctccactcaagaacgtagtgacttgccaccaccagttccaccagtggcacntccaatcccgtggcaagcgccaccaccacctacgattcaaaaacgtactcccccaaaagtgccaccaacgagacctaaaaagtcctcacatataaggaattcatctcaaaatagcaatattgcacaagaacgttcatcaaaacctccaccattgccaagtggtccaccaccagtaccaacatctgcgccccctttgccaaacagcatcccaccaccaccgccaccagcaccaccagcaccaacagtgccagaagaattacaaaaccgaaacgaaggaaaggttccaactgcacccccacttccatcaggagggttgccatttttatctgaaataaatgctaaaagagatgataaaaatgtcataagctcagcacaaagttctaattccgcagctagtccatcggtgcctggatcattacctccttcaattgcaaagagttcgtcatcaaatgcgtcacgcgtaccaaacattccaccagcaccgccagcaccgccggcaccgccagcgcctccaattgcacctccgctaccagcaatggggacttcaaaagaggagaaaggtacacccaagaccaattcaagcagtattgcaccacctgcagctggaggatcattaccatttctagctcaaatgtnttcaacacgccgtggcagatccata

SEQ ID NO: 13835 - DNA, 201 bp, Candida albicans
  unsure (152),(156): Identity of nucleotide sequences at the above locations are unknown.
atgcatttaataaatcaatttcttcatctctttcttttacttgttttttcaattgagttaattcatcaagtgttaaactcatctgtaaaaattggtataattgcttatggagactacaataatgactctaataaattgggtagtgtaccttngtantggctcgaactgtatttcttgaataaagtgaatagtttatcgtga

SEQ ID NO: 13836 - DNA, 462 bp, Candida albicans
ttttttatgttcgatgttattttcattcttacaactaaatcctccaaccacttcgcctatattaatcaaatcatgtttcaaagacaaaaagtttcacctggggaatatttacaagaagccacgttggtcaaatgggttaatacaaaactcattgaggacaccttgagtccacaaacacccacttcatcatgcagagacatttccgaaacgataaacaatttaaccagtgatttacatgatagtttagtattgactaaacttgtcaatagattaatttatgaagtgactttgaacccagaccatccaatgaacaaaaaagccaatttatattatctcacgcccatatacaccaaaccaacttttaaattacaaaaactaggaaatctactggatttgcttaaatttttaaatttgattcttagtatcaatgtcagttccataagtccagaaaacatttattga

SEQ ID NO: 13837 - DNA, 216 bp, Candida albicans
accgacaagcataaacaacaacaacaacaacaactaattatacaaacaatttatctctctgtctccgtgtatgtctcccgtgtatgttgtttcatcttagatcacaataataccaacgagttacaaaagggagtcacgattcgtttcaaagtcaatttggaaccgaatacagttaagcaatatgtcgtcgtcgaccacggaaatggcaaacccgcg

SEQ ID NO: 13838 - DNA, 360 bp, Candida albicans
ttaaatactaacataattaactttttgtacaacaacaaacaatatgaaacaaaagaaacatccaacaatcactcaattaataacaaaaatagggtaggcaatagatttattttgaaaagaaagagaatgttggaaatatattatagagttggttttttagttggatggggaggacaattaaaaaaaatgtcgtgcttggaaaaaaaaaaaaaacatcaggccaaaaccaagaagtttgacggacacacgaccattaaaaaagagagaaagaggtaccaacaaacaaagcaccaccaccaagaaaaaaagaaatcaaacaatttttgtctccctttattgttgttgttgtttttgtgttaa

SEQ ID NO: 13839 - DNA, 261 bp, Candida albicans
actgaaaaaaaaaaatactctgctaaatataatttgtattattctaaaccgagtcaaacacccatcctattatatctagcccaagtgtccatgctatcgaaaactgtatcaaaagtagcatgtgctcgcccgatatggagaagattatatgcaaactcctcaaataacgtgggatcacctgaatctacaactgaatcgaagcccaaggtcaacaggtttgcgaaacagtatgccaaccaagaccaaaatcgaaatagctag

SEQ ID NO: 13840 - DNA, 192 bp, Candida albicans
aaactatacgtactaatatgggataattcgcgacagtttataaatattgttaatgaaacaaacacaaatatgattgacaattgcatgttgaactggggagacaggcaaaataaaatatttaatataaatgaaattcaaacaagtaaactcaaacaagtaaacttatatatatatatatatatatatgtataa

SEQ ID NO: 13841 - DNA, 318 bp, Candida albicans
atttttcttttaacaaatggaagacattcaaaactgaaaattgaagaaaaaaatattttatgggtgttttactttttgaggggggtgataaaaaaagcctgcactttgactttcattcaattcaattcagcttggttaggtttgcggtcattggggatttttaataataatatgtatgtcaatcttaggctagatctttatgtgttcacgtacatagacaccagctcgcttattgtttctgaatttgagaggtggagaaccaaacggttagttgaagagaaattcgtgtccgtattaaacttccccaatagctcataa

SEQ ID NO: 13842 - DNA, 219 bp, Candida albicans
aagtcaaagtgcaggctttttttatcacccccctcaaaaagtaaaacacccataaaatatttttttcttcaattttcagttttgaatgtcttccatttgttaaaagaaaaatttatgaaaggcatcattatttctttccataactcaaaaccaattacagtaattgaagataagatcaaatgggttcatctagcccaaaccccacaaaatcaccattag

SEQ ID NO: 13843 - DNA, 870 bp, Candida albicans
gagtttgaaatagagtcatttgaacaaacatcaaccccaataagaggtgaaactaggaaaagaagaaatgcttatgagtctgaatctataaaacacagaagtgatgattcagtggattctatatttgataatgcttataactcagatgttgaggacttgggttattatttgaagcaagtgtctggatctatatccagaccgggttcattttctgacaaggaaagttcaatctttttaacccaggccgatattgagatattcactaaacacgacatatcaaaccctaaacctccatccgatacatttatggaaagctttttggatgtttatgaagaccaaattaatgaacataccaccgatcaacaacaactagtcgacctagaagagcttcaatcagaagaagaagataacttgtctttaaacaaccaagctggtcttgaaataaatgatgagatttaccaattagaattaatgctaattaaagaaaaacacaattatatgatgaaaaaacaacaacgacaaattaaacatttacaaaaattattaaattatcaaagtcaaataaaccagcaattggtcaatcaaatgttagtcaacaaccaccaccataataattataataaccacagcgacaacagtgaccaattattgccaccattttcaatgaactatccacataaaaaaacaaacaccaatattgatatcgatctttacattgatgataataaatctactgtatcatcagctgattcaataatgagtaagaatcttgacattcataatcacaattatcaacatatccacaataatggtgatgatgatggtaataatactgtggaaaccagaaattgtcaagtacacccagtttaa

SEQ ID NO: 13844 - DNA, 210 bp, Candida albicans
tgcattagtagtaactttaaccgagttctagacccatgttctattaagccttcaagacaattaaaaaaagcaacttcaaaagttatcaagttgatcatcttgaatgacctcgaccccaaatattttaaccaaattacattggggagaaagaaagtaataatattatttatatcagtggttttacaaaagttgtcacgtgagaagcaatga

SEQ ID NO: 13845 - DNA, 516 bp, Candida albicans
gatccacttgacttgttatatgataacagcagaattgccatgaatgaacatttagtgactctttattgtcccaaatgtcacgacccaatgacaaagcgtataccgattacaaacgatgaaaacactggattttgtgacacagatttccagacaattaatataggttatgagaatgtgaaatgctatcatggtacaccctctcattttactcatgatgaattaagaaaactacaattgtattgtgatatgacaaacctgaaatcattacaaggaactcataagtatttctccaaagttatttgtcctcctaaattcaccaaaagaaacccatttcttattagtgatgatgtttgcaaaacattagagaaacactgggatatcaataagtcattggatgacattttgaaatctttgaatgccaagcatagacgtgaattagtgcgacaaagaatattgttgcgacattacttgttcttctaccaagggactggccgatccgcaatatattgggggaga

SEQ ID NO: 13846 - DNA, 567 bp, Candida albicans
  unsure (434): Identity of nucleotide sequences at the above locations are unknown.
atccggcggaatttgtctccctgtggtcaagattctaatactgtgatcaatagaagttctgatagtcaaatctccaaaaatggatctttgagattggctaatgatatagataaagaatcacttcaagaaggcttctcaatttattcctccaaaaaattagatgacgaatacgaaggtaaaccaccacaacaaccacaacaaagattggctgctagtgctagttttggcaattacaaaaatggacataatgggatcttgaattttcaacaagaatatctttccatcaatgaatttttaaaagaaagtataagaagatcattaatgatggctaatccagctacaaatttcaccccatccactattccatcaccagcacaacaacctcgtgtattgtcagacgtcgatagttcagatacttcagggatgtttggtantggtgatgctgctggttccatgacaccatcatcaaaatcacagaaacatagacgtaatcatagttccagtggtgggttaaatttgaaaattgtgaaaccattgaaatcagctgcttcattggggattttctaa

SEQ ID NO: 13847 - DNA, 243 bp, Candida albicans
  unsure (204),(208): Identity of nucleotide sequences at the above locations are unknown.
aagatgaagataaagacacaagatcaaaaattaaccaaatcaggtcaagatataccactacaaacaatgagttctcgagcgtcttcagtgtctaatttatctcaattagatgatttcactaggtatgtgaaagaaacatctttatacgacaggatatttcatgatttacaagagagactaccgcagcgagaccaacgaggtctntgtnttagcgaccgtcctggacaattcattcccaaagta

SEQ ID NO: 13848 - DNA, 189 bp, Candida albicans
gtatccgagcacaaagttgcatacattttactttacatcaaggtcataccacccaaccatgcgactgcttctattttgcattcagttttttgttttacatacagtcataacattccgaaaaactcaccgatacacgaccatgattttgaagttgtgtttttctccacgggcagcgaggatccgcaatta

SEQ ID NO: 13849 - DNA, 420 bp, Candida albicans
agattaatctttcaccttgaaatacaagacttcgactttttgccattctatctcttccccctcatcaatctaaacacatatatgctaagaatattttatttcaacaggttccaaaaactaaaaactcataataatagatatcaatatttcaaagtacaaactactaatgatattgataaatggattaataaaactaataatcaaagattgggtagtacagaacatgattgtgatttacctaattatgctatattaaataaaaatggattaattgagttacgatcaattctagaaccagggtttttcttatatatcaatgaatcagaattggaaaaagcaatttatcaatattatcaagttacaattaaagatttttgtgtgtcttatagttttgatcgagatctagatatgattcaaaaa

SEQ ID NO: 13850 - DNA, 531 bp, Candida albicans
tctatcgcggctcgtcgcatccccatggtgaaggacgaagatgcatgtttaatggaatgtgacgatttgcttgaaaaatacgggcaattaccagttttgttagagttaaaaacactcttacagacaagacacaatgtgtcaacgacaatcaacagactaaagaaactccaaacaattgatgcaaaattggatatgagtttaagtttaaccgaattgaagaatatttatgaggagatcaacagtttaaacgaaaaagacaatttactcgaaaagtttaacagtaaattcaacaacaagagagatgaattgatgaaacaatttcaggaaactttaaaagaaaacaaatggttaaacaactcaagtattcctaaccaagcattaacattaatttccaaacaattcaacgagctaatttgtttgcaatcaatcgtactgatacctgcttatccagaaacttggtgggggttagatttactattggagccaattattacaagattcaattaccatttcaatagtgtaaacaaagaa

SEQ ID NO: 13851 - DNA, 198 bp, Candida albicans
cgcaattgcgtgtccttccaggcccgtggtgaagatgtcaaaatagaatggcaaacacatcacaagacaggtggagttattcctgagttgaatagtagtagtagtttattatggaacgtcataaaatatcaaatttcaaactctgtcattcttgatctactacgtaaggtgctgaaattttggaattcatcatattag

SEQ ID NO: 13852 - DNA, 192 bp, Candida albicans
cgtcttgttctaatagcaattataagtttaccaatcaataatattgtcattatattaatactaatggaaaataatattgttggtaaatccatccatattgaattaatcacatacccaaccgaatcagatgataatgatgatgatgattcttcttcacttctgttagttgatatagcccgggaaaatcgatta

SEQ ID NO: 13853 - DNA, 516 bp, Candida albicans
cccccctttatcaatcggcgtgtcgtctcatccaccgatggtgaagaagaagtatcaaaatattcagccccacaaatcagaactataaataaattgttgtatttccatcaaaccacaacaactggaacatttaattttaatgatcatttattggattcctcgccattgaaaatatcatatgcttgtggcaattcaccaaataacccaggaatatattcaacaacaattataaatcataatatagataatgaatttagtcatcgagatttatgttctttagttgaagtttcaatttatgggatttactcgataaaaagtaatggtaacactaagtttgatgaaatgtcttgttttagaagagatgatggcaattcacccttttatttaaatccagatgattttgataatttattatctaatgaaacgataaccagtaaattcattggattaattatggttcatagtattaatcctaatgatcattatatgaatatctatgctccggatataataatc

SEQ ID NO: 13854 - DNA, 210 bp, Candida albicans
tttcaatttcaatttcaatttcaatttattcttaattcagcccctttcaaccctgtccatcctttcgttacatacatttatacaatcatgtcagaagaaaccgttactatttacgattatgaagaagtttccaaacatagaactcatgatgatttagggctcgttcttaatggtctagtagtgtggccgacggggctagataatccgcgt

SEQ ID NO: 13855 - DNA, 183 bp, Candida albicans
aaacatcatcgcggacccggtcgtcttgtggtgaagatcttccaggtagatcaacttccactttcagttaatcccaatcattcacgtcttttcttttttgttttttttttttggcttacattttatccttttaataagccacacacaatctatagttatcattcagataatattaggaattga

SEQ ID NO: 13856 - DNA, 603 bp, Candida albicans
  unsure (524): Identity of nucleotide sequences at the above locations are unknown.
acgcggatcttccagcccgtggcgaataataaacaatatcaaggtcctcaaccacccccacctccagcaccacaacaacaagtacctggtcagcaacaaccacaaccacaacagggaatgcctgcaggttatttggatccatatagacaatatccaccaaataccacttttgatcctatggcattgccaccaccacctaaaattaatgctcatcctcaaaaaccattacctccattacctcatcaaatgggtggtggtcaagaacaaccttctgataacgtatcacaacaaggattaaaaatacctgatcatgcatttacacctaaaagaagacccgaaccattggcattacaacattctactcattctaatgaaaatattagtaatgaagggaatattaatgccaataccaacaccaatatgaacacggtgacatcatcgattacatcagatgcagtttatccaccaccacctacatcagcaacttcagcagcttcattaacacctaatttagctagtccatnatcaccattatttcatcaatcatttagtcaaaccactttgaaaagtacacctgatccaagaggttcaacaatcactaat

SEQ ID NO: 13857 - DNA, 195 bp, Candida albicans
agatgttattatagactttcaaaacttaagagttttttgagaacaatatttagtaaagccttgtttgaaaaacacaaatacatacagaattgttttccgatcgtatatacatcaatagcagtgggtactcaggaaaaaaaaatattaacgagcactaaacgcaaaggtaagaaagagagaaataaaaaaaattaa

SEQ ID NO: 13858 - DNA, 756 bp, Candida albicans
  unsure (594),(685): Identity of nucleotide sequences at the above locations are unknown.
gacagttgttttccttcatcttttggttttaatatatatatatatatgaataacagcccaactcatattcacttcattaattatacaactcagctcaactcaatgttacaatctccatttacatacacttctagaaagagaagacactctaatgtatcttcatacccaactgtcactactacttccaccactgccaccactttcacttccacttccacttccacttccacttccacttgcacttccactacacattcttcattgaataccaacttaccaacaccaacatcagcaacagctccaataccaagtcccaaacgacaacgcaaatctaaagctgctatgtcggtattaattaataaattatcacaaatgcaatcaaaaattgatcttttacaagattgtggattaaaatgtgaattacaacaattgatagaagaaagtgtacaagaattgaatcaagaacctaaatcaatacatatgaatattcctcagaaatcatttaatgaatttatattaaatactcccaaatcatctacacctttaacattatctacacaatcaacattaataaagtcatgtcgggaggaagtnttccatactatagatgatgaagaacataacaatcttatagaaaattatcaaatatttgagactcctaaagagaaaatcataaattatgacnagataactactccaccaagagctccaagaacagaatcattattacctggttttgaatttcccaatatttga

SEQ ID NO: 13859 - DNA, 207 bp, Candida albicans
aaagtggatttgaaaaaaagagatgaggtccgctgtttattttttcagtttgttattttttttttctatggagagaggaatgcgttgcgtctcattaatgaaataagtcgcgatattaaaggaagtcgcgacaaggacaaaaaggattgtaccaattacatttggttaacatcatcatccaaagtgaatcccacaacaaggaaataa

SEQ ID NO: 13860 - DNA, 432 bp, Candida albicans
accaacatggcaccaccaaagagattctgggctagattgaagctatctccaaaatttttggggactttacctgagttcccagcgtatatctcaaaatcacgtctaaagaagttagcacaagaggaaagaagatctggtactacttcaatgactacactgcagaggtcctcacctgcacccgaaggaggagcatctgccactggtccaactatcagtaattacaaagtgaatgtgggattgaaggaaggttcaacatccggtttgacaatcaacagcataacgagcggacaatattctttagacaaatcaggtaaaccagctaaacgatgggtcaaaaaaccaaggctgtttaagactttcactggatttaaagtaacatgtgtgtcgttcaaacctgattttcaccagccggcgagatacataaaggggggg

SEQ ID NO: 13861 - DNA, 201 bp, Candida albicans
  unsure (85): Identity of nucleotide sequences at the above locations are unknown.
gtactgttaaagagatacttgaagaaatgggattttcagttattccacaggagaattcgaaatcattgccagcagacaagtcgtntatttccgaatcacaaatattcccatttccatgatggggacgaatcgtttattctctccggagctgaaatgagttattctggttccagaatggggttggtgttgttatcacaagaa

SEQ ID NO: 13862 - DNA, 303 bp, Candida albicans
  unsure (269): Identity of nucleotide sequences at the above locations are unknown.
ttaagcctgatgaattgcaaaaattacgagttgcagagtctcggaccgctcgaggacaaagctttagctgaaggtaaagtggcaatttctgaaaagttgtataatgaaattcttgaagagaacaacatgtggaaggaaaagtatgctgctgtggacttgagtacaggagacgaacacactttaagtactgttaaagagatacttgaagaaatgggattttcagttattccacaggagaattcgaaatcattgccagcagacaagtcgtntatttccgaatcacaaatattcccatttccatga

SEQ ID NO: 13863 - DNA, 282 bp, Candida albicans
aatcgcgtcctttcatactttccaatcggtccaagtgaattactggattacatgcttcctccagatatattacaaaatggtgaatttgaaaccatttacttccagacaaatccaacatatataaaatcaccgatacatatccccaaatctacaattgggaaacctgatacagttaaaattcgacactttttcgctttactacatccagatcttgttgttttaggattacaaatttttgtatatttacaaatttatccacacttggttgaaaaatacgtttaa

SEQ ID NO: 13864 - DNA, 312 bp, Candida albicans
ccaataactgtagctgaaccaaataatgcattgaaaatcaatccaacaactccggccataccgtgctctgcccatacatccaatgaatcatcaacatgtaataaatatttgattttagtcgacaagttacaaactatcccagcagtaatacctaatattactgatgcccataatggaatcattcctgaagaaggagtagcagccactaaaccagaaatacacccagaacaaactgctaccatagaccatttattttccaaacggaaatccaataaacaccaagatatggctccaaaagctccacataaatga

SEQ ID NO: 13865 - DNA, 282 bp, Candida albicans
ttattggccacttttttaaacaaccagccaacaaactcaccacaatcaatgacaaccaatgaatccattgatatcactgagttgagaactcatctctatcattcggcatgtaaattgaacaacttgagtttataccaagccagtaaatggtgtgcagaagcattgaatggattgaaagacaaacaacagccggtgacgtaccctcccctcgccttagactctgatgatttattagatcagcgatatgtcttcaccacgggacggccggaccgcattaggtta

SEQ ID NO: 13866 - DNA, 336 bp, Candida albicans
atctactactatacactaaaagaaaccaaaagcaaaaaatcaagaggcaacacacagacaacaaaaacatcagaagaaaagaaagccaacagcaccaagagaaacaaaagaacagagaacaaaagagagaacaaagaggagaaaggaagaaaagaaaagcacaaaagaacacagaacaaggagaaagacacaaagacaagaacaacagaaggaaacgaaacaagaaaagaaaaaaaatcaaacgaagggaacaaaaaagacaaaaaagaaaaacaaaaccaaaaaaaaaaaacagaaaaggaaggagaaaaagaaagaacaaaagaaaaaaaataa

SEQ ID NO: 13867 - DNA, 462 bp, Candida albicans
agacaggtggctccagtatcatcaataccatctgcttcagaaattttgaaaaaagctagagctaagaatgccgcaagtactactccagaacctaaacaagagccagtgaaatcagaagatactaaatcagaagatactaaatcaaaagaaactaaatcagaagaaactaaacgtagtgaaggaataaccaaaaatggagttatggctgctggtataccatcatggcaattacaacataaagaaaaagaagctcaaaaaaaagaagctcaaaaaaaatcaaatcaagagcaaactagtaacaataacaacaataacaataatagcagtggaatccctgtttggcaacaagcagcagcagcagcaacaacatcatcagttgatacatctaaatcagaagaagaaattaaagaaaaaatcaagagtgttggggttccagcttggcaattgaatgcttctactagt

SEQ ID NO: 13868 - DNA, 492 bp, Candida albicans
  unsure (458),(477): Identity of nucleotide sequences at the above locations are unknown.
ttactttattcttataggtataacactcctaatgatgtatcattatttttacaaaaattgaatgatccaactttgactcaaccattaccttcctcgagtcaaatccaactaattaaacggttcaaaacattatttggttccaattccataattgatcaacaaaaacttcaaaaccaaaatcaaaatcaaggattaacaaatattttcgccaataaaaaaattgatcttaataatttgtttaatagaaacaatccatcacatacagtatcagataatatttatttacaatatacacctcgattgaatgagattttagcagggttaattaatccacaaccacaatcacatcaagatggttctttgggattggcaacattggttccagataaagtgaaacaacaatatggggtacatgcaagtgatgaatcagttcaagatatcactatgtgttccacctncgggatgaggccgaaccgncctaaaagggcggga

SEQ ID NO: 13869 - DNA, 384 bp, Candida albicans
  unsure (300): Identity of nucleotide sequences at the above locations are unknown.
ttgaccggatatttgtatctgacaatagatacagacacaggatacagatacagatacagatacagatgcagatacagatgcagatacagatacagatgcagatacagatacagatgcagatacagatacagatgcagatacagatacacactatactacttttgtttagaatttcatattcccatgaaaacaaaaaaggcttataatacaattgataatacaggggggtttaaagatctttttaatgacaatactttaatctttagatctcaaatgaaaacttacaaaaacaaagctcanactataaagaagtgtcgaagagtttactatatatatatatatatattgtatggtctttcagttgaacacatcttgataagccat

SEQ ID NO: 13870 - DNA, 444 bp, Candida albicans
gtcttatattcatcaacaacaacaataacatcatatttttgttatcataagcaacaactgacaaatctgatttctaatattcctgcaaaaatagatattgatgtacccttgtcaatagaacaaacaaatgttgatattaatgttgccgttcgagaactaattgataaaaaaaatgttgaatccattggtctagagtatattattaaacgagaagacaagaaagggggtaatacagatgacaacaacaaggacgacaataacaacgatgattctaaaaagaaatcaaaacctatatatgatcaaccaggtatgagatttgtatttgctttatttgcctttgtttttttaaatatgattgccatttgtattcatcatatttatatgaaaataaccaatgcagccaatgcttataaaactgttgatgatgaaatttcaccattttaa

SEQ ID NO: 13871 - DNA, 213 bp, Candida albicans
gagattgtaatgcattcagaagaaaatcaaaggaattcctttagattggttaaaatgaaaagtggtttttttatttgtatgttacacttgagcactgattgtgaagagagtccccctattaaacgtgtaaataaatgtatgtggtttcatattttgataaaagaaaaatgtctatatatgcaaattaaacagataatatatgatattatgtga

SEQ ID NO: 13872 - DNA, 180 bp, Candida albicans
tgtgccgtcaacatctacacgacaaagctagaggctttgcgtccttatactatcaaggctttaagttatcttaatattcatttacaataccatacagatcatacgccacttttgattatacaagagctccctccaaggaattggttgccagttttttcgatcatcgatatgtcaagataa

SEQ ID NO: 13873 - DNA, 492 bp, Candida albicans
tattcatttacaataccatacagatcatacgccacttttgattatacaagagctccctccaaggaattggttgccagttttttcgatcatcgatatgtcaagataaatgattggatattcaaagatgaccaatatcgacaatccttcttgaactatatacgaaatcattcttcttttagcaaggatgagataaaggaagttgtcgagcttcatggcagattagttgaagtattagacgaacttcaaataggttttcaatttttagaaaagatgtgggatgcaattttcaatcgtgtggtaactgacgaatccgtcactgctttacaaaaagcgataattgaagaaagagatccacttacaaatgtattgatacgctctgcaagatatgatttgtacaagaaaattatcactcctagattaaatcattcccaaatgtccattaacaagagtgatgatatttcacctaggggccggaagcttccgcgaatggga

SEQ ID NO: 13874 - DNA, 294 bp, Candida albicans
tttctgttggtacgaactgagaaaagagaaccaaagaatcaaaaaggaaggaaaaaaaaaaaaaaaagaaatcagaaaactaaaacattttatacaacccccatctctggagaaaatataaccacgagtctaagtttctttattatattgacgtttcagttatttgagagaaatcctctagtaatgacaactttttggtcacaaacaatcaatcatcaaaatggtggtgttgctactgctactgccactgctactgctgctaccaccacgcctactgctggtggtactggtgct

SEQ ID NO: 13875 - DNA, 237 bp, Candida albicans
ttattattcttttataattcttatagaattaatattcaacttgttctgtgtgtgtgtgtgttgactttctttctttcttcctatctttctttcatcgattgttgttacaatttaatttgtttatatcttaatcttaatcatttaattgttatattcaatccaaaattacattcccatccaattaatattttgtatcctaatcccattgacttttgtattacaatagacagcttttga

SEQ ID NO: 13876 - DNA, 204 bp, Candida albicans
ttccccgcacatatcggccgctggatcgttcgctgccccagtgtggaagactttggccacgccttgaaattgagtattttagcggctctcgacgaaacccaattgggtgataatactacgaataaagtcgtttattttaaagataacgaaaaccaacagatgattggtcatttcttgaatcaatttttgattgtctatacttaa

SEQ ID NO: 13877 - DNA, 204 bp, Candida albicans
atgatgcatgataaaatagagcaatttatagaatgttactatgttgtaatgcttgatgcacaaataattaccaccaccattcctattcttaacaccacaattgtaattctacttttttttgttgaatttgaacaatggaaagctaatactcggatgaagggggccggtgggttggcttactgtaaaataccttttacaaaatta

SEQ ID NO: 13878 - DNA, 183 bp, Candida albicans
accaaaaaaccagtatcattcaaagcatttaatacatcagcagcagcattagaaactaatgaagatgataaaacggtgctagcagcattattaaggaaacttcctaatgaaccagaatatgaatcatcattactagtggcacgttttaaccaatcctttaactatttccccaccacccattaa

SEQ ID NO: 13879 - DNA, 687 bp, Candida albicans
ttaaaggattggttaaaacgtgccactagtaatgatgattcatattctggttcattaggaagtttccttaataatgctgctagcaccgttttatcatcttcattagtttctaatgctgctgctgatgtattaaatgctttgaatgatactggttttttggtttatgcaacgaaaagattcctttcatctgattcttatattaatatgacagtggctttagtcaatgatattgtatcatcatcaagcgttaccattgatactagtggattaaatataactgaattgatttctggtactcttggtaatccaaaagaaattgctgcattggttggatcattattatcgggtgattcatctcaaacttcacaactttctaattatttgggtagatattctggtgcccttagtcaaattcttcaagatttagaaaagaagggattatttgctgaattgaatagttatatctttggtgattcaactactaaagcatctgctactgctactgccaccgccaccgctacatatagtgctaatggtaaaaatgttgccaataataacaataaagatgctgctactagtggtagtgcaacaagtaatagtctgacttcaagtaacactaatagtgcttctaaggggtgctggtgctgttattttgtcttcaccggcgggctggaaggaccaagcttg

SEQ ID NO: 13880 - DNA, 729 bp, Candida albicans
aactccatctatggaatcaattttgatccggcaaacaatcgaaatgaaagtaatcaacttgagatgactcaacaaccacttcaaatacaacggcaagaaccagtaagtcttcaaccacaccaaatgccagaacaggaagcagtaatttatcagccaagtaatcaggatgcaagtaataatagactgattctactttcttctcctgtacagccacaacaaaaggtgagtcaaacattggaattaacaaatagaaacaacattacttctgataaaacaaatgctaatgttagttgggaagatgatattgaagatagtgatcctgagttctttaaggaaatggatattaattacgatttagttttagcttctaaggccggaaagtcgaaaactgatgaaattgccttggacaaacacaccaatgatgaaatcatttcttctgttcaaatcgagtctgtcaatgatgaatcaacacaagtaaccaatcatcatcctcatgatgttgttattcatcaatccaaaattaatcttgaaaatcatttcaatgagaaagtagagaataaaaaggaaaatgaaactatcacatatcaacatattgatccaaaaatgataagcaatggtgaagatatagatgtgttaatgtcagacatagaatctgacgtttctattacaaaccaagtaaatcaagtcacactgccaattcaagaattgaaagtttttcaccacgggtga

SEQ ID NO: 13881 - DNA, 186 bp, Candida albicans
agctcggaaaatccaggcaagcaagaaactattgaggaagaattaagaaacaaagatgagaaggttaccatctacgacagctacagcaagcaatgtctatatttaaaacacccgtcagaaaacgcctataaaaagactagtcatattaaagcagcaaagatcagaaatacaaatattaggtggtaa

SEQ ID NO: 13882 - DNA, 537 bp, Candida albicans
  unsure (522): Identity of nucleotide sequences at the above locations are unknown.
aaaggtggagatctcgagaccgttaaaaacttggcatatgaggaaggtaaaaagaaaggcaaattggacggtgataatggtgcatatggaacttcaaatcaatcgtctacgaatttcagttcaaattctaacccagtcgaagaaaaagaaatccatcaaaaaaacaaatcagcttataatccaggtggtgtttctgctgagtttgaggaaaacacgactggtccgcaagctaccaagtcaaatgctaaatcaggctcttctggtaatacagctgctggtgtcgcaagtggtgctgctgctggtgcaggaatagccggagttgccgctagtagtggcaatgctaaacaatcatcacacgacaagtcatcatcaaaaggtgtctatgacatttctgatgcacaaggaaaagatattccaagaaacgaaattgatcactcaagctataaaaacaccagttccggattgggatccgagaatcttgctgctggctgtcttcacctacgggagcgagccaggacccgnccaaaaattgacggc

SEQ ID NO: 13883 - DNA, 183 bp, Candida albicans
cttgtggaaaacaagatcatgcaaggaaaacaaaacatcgaagaaaaaaaaaaatctaccgaacatttccgagctggtagcgtggtattgcaaaccagtgtcaagcatttgaccacgaactttgctacattaaaaggccatggttcagttctggtagcccacattattgtcaacatcaaatga

SEQ ID NO: 13884 - DNA, 414 bp, Candida albicans
tattcactactatatcataaacaagaagaacaacaaacacaaacattacctgattctgtattaaagaagttttgcttgaaatgtggcaatttatttattcccggattaacagtatctatacgtgttgtttacactaaacagaagatacggaaattgagaaccagatgtttagcatgtcgacattccgtattcgatgatggcttgattcaaaagcaagaaaaagtagaaccaattgtaaaacctgcagttgttcaatctaccaatgaagaaaataatgtaaacaattcaaaatcaaaggaaagacgcaaaaagagaaaaatgaatagtttgagtaatttgctacaggataagaagaagaagaaaactgaggaatcaaagttaaattcattagatttgatggagtttttgaaataa

SEQ ID NO: 13885 - DNA, 264 bp, Candida albicans
tcatacatatacataatggcattcggagctccaagaggtacaggcggtccagcaagaggtggccgtggtggtttcggtggcggaagaggtggcacaggtggtgcccgtggtggagggagaggtggtgctcgtggaggatctaaaggtggtgctcgtggaggtgccaaaggcggtgctagaggtggtgctcgtggaggtataggtggtgccatatgcggtgctagaggtggtgccaaggtcgtcattgaaccacatatacatgct

SEQ ID NO: 13886 - DNA, 192 bp, Candida albicans
  unsure (162),(165),(182),(184): Identity of nucleotide sequences at the above locations are unknown.
aatttacaaccaaaaattttgagtactcttgaaatatataactaccctacaaaatccctaaaatttctgactaaacacaatccagcttaccacagcatacttcttttaataataaaagctacaacactagtaatattattcaatataccagtcacttcaatnttnaccatttcgccacgccntnaaaattaa

SEQ ID NO: 13887 - DNA, 621 bp, Candida albicans
  unsure (615): Identity of nucleotide sequences at the above locations are unknown.
acaacaatcacaattttaaaaattacgttaataaaacatgctgtgtcatcgtccttatcacttaatactgagagctttagcattcccaagtttcaattgaaacagttgaaattccaatcgttggtgcctttgcaaaaaaaaaatttgcgttatggcttgaatatgatctccccagcaccagcatccacctatacgtcacaaacgttacaggaaagacataaatacaaattgccgctgtttcaaactgggcaagttttagctaatttgattcatgcaaatcgtgagtcgttgaaatttatggagttggagatgatcaatctaaatgaaatatgcctaatattacaacagcaatatggattcaacaatcaatgcagtaaatactttacagcactaaatcttattaaagtggatcaatgcacagactatccaattatacaattgactcattggttaaagaattgtaaacaaatcatctatcttaaccacttcttatcaacatttgttgtcctccagcaaaattcatcaaataatggaataaaagaattcaaataccatatgtccttattcaagtataagaggatcttcgccacgagaatagcaatatcgcgctccgcngccgaa

SEQ ID NO: 13888 - DNA, 333 bp, Candida albicans
aatacctctggcagcggaaccagaagtgtgttcgtcaaaattgacatagcttttcataagagcttggatatttgcactcatctttgtaaaaataatgcaagtataaacaatagaaggagaacttcagatgaatgtgggaatagaaacaaaacagttccttcagtggcaggaaaaggtcgactatttatagatttttatttattcaatgaaggcaatttcgtgtatatcatttattctgcattctccacttcgaaattgagtccattcttctgtgaagctaattcatttacatttttcacacaccggcctgagccgatccgcatatcgcatccc

SEQ ID NO: 13889 - DNA, 645 bp, Candida albicans
aagccaaaaggcaaaactaaggaggaagagcaacaacagcaacaactaccgttatcaagtggaacagctggtggtacatcgagtaacaattcgactggtacagttgaaaaaactttgtttttcaataaaactaaaatcaagaaagaacctgcaagtgagcggtcatcgctattggataatgccagtgctggtaatgctagtgcgtcgtcatctgaggcatcactgattcaaaatgctattggttctgatgatcataatggtccaccattgacatctgcacccactagctccacattagcgaatgcttcgaaacgcatacttagttctaaattgatactgaaaaagaaatcaacgtcaaagttaaaagagtatactgctgcagaattggaagatatgtgtacggtttcttctttggagacaccagtagccacaatgatttcaaaaggaattgaggttgaagttgacttggcctcattggatctacctcctgacaccaagattttccccacgtctattatcaacaacaaaaacagaactaggggccgaaaagaaaacaaagaagctgatttaagtgacacttcaaagatccatttctgtaatttgtgtcaacagtctggcaccgccgggcaggaagatccagtgtgg

SEQ ID NO: 13890 - DNA, 246 bp, Candida albicans
  unsure (21),(36): Identity of nucleotide sequences at the above locations are unknown.
catgcgccattttacggtcgnttacggcctctaaanactaaattgttacaacaggttaatctacatatatatattatttctattaaaatgtgtcaagttttttggcttttaataaaaattaaagttaaaattataattactaaacgtgttgccaaacctaaagtcacaatgtgggttaggatttattgctgtcgttaccgtttaacacgggcttatcgttatacaatgttacccatgtgggcatag

SEQ ID NO: 13891 - DNA, 186 bp, Candida albicans
ataattacgacttggattgtattatggaatattgctcaacttcaatcgactcctaattttgtagcacttatgatttattttacaacaaaatttgatgccgtttatgtaacaggtgctatgcccacatgggtaacattgtataacgataagcccgtgttaaacggtaacgacagcaataaatcctaa

SEQ ID NO: 13892 - DNA, 186 bp, Candida albicans
ttgataaggatagtatttagtaatattaatggtaatttatattataataatttttgtttagtagttgataatcatattgatggatatatattgatttgtaaacttggtatattaagtaattattataattatttaggttcaattggtccattaaatgatgtaattaatttaataataatattataa

SEQ ID NO: 13893 - DNA, 228 bp, Candida albicans
gaagacatgtggttatcggagttaaacgaacacgggagtcaaggtggggacaatagatcaccacggattatcgttgacgttttgacaaaaaatgaaatatatttagaacaaaacaataactttaagttgttggttgataccatggatttgctacaacccttcccaattggaaatattcttcgaccccaggctcaatcgttcgtcaaatatcgatgcttggtttattaa

SEQ ID NO: 13894 - DNA, 606 bp, Candida albicans
  unsure (548): Identity of nucleotide sequences at the above locations are unknown.
caagcgcggatccttccagcccccgtggatgaagaagggttatatttccgatccccaatttttacaaatatacataaatcatttcatagtcccaacgatttgcttgcactacgtcagtgtttatcaaattatattactgcggataatgtattatataatgggcagcttgataatgggaacccgtgtccttttaatcgaatcggtaaatccactcttgagatggatattaccacaaatagtatagtcaaccgtacatggcttagtcctcgagagcttcatgatgattttatagagaaagcagagtttctcgaatacaaaagagcaattgagctgggaagtcataagtatggttacaagtatgatcaagatggtcaaccgagaatttatttgtcttccttgaaacaaatttacaacgatctaaaatatcagtgtcgatcaagagattcactgtttaatgttgctgcagatgttttagaaaccgaaaactcgtcgtattttggtactggatctacaaactggtcgaatcaagaacagttgaacgagctatntgattacttgaagaagctaaatggtgatgtcaaattggattcactgaagtattccaaa

SEQ ID NO: 13895 - DNA, 183 bp, Candida albicans
cccccaatgataagcgcgggtctgtcagttcccgtaggtgaagaccgccagcccatcatttttgactacttcttgcacagttcgaagttggcaacctgcccatacttaacaaaaggaatttatccacctattttgcccactttaaacgtatctaggtatctgcaacctgcccatattgaataa

SEQ ID NO: 13896 - DNA, 384 bp, Candida albicans
aaatcggtggggtgcaacaatactatggctgcaacggctgcagcagtagcggcagcggcaacagtggcaaatcaatcgtattatacttatcaaccaatgttgccttattattatggttatcctgcaactccttaccaatttgccaatgtattacctggtccaccaccaccaccacctccaccacatccccacccacttcctggtgctgctgctggtggtggttctgctaattccgtgactggtgataataatagaaatacggcaatgtctgctgctgctgctactgctgctactactactgcgtattcaaattatttgataccagcaagaggttatccatattattatttcaagttgggtgtggataagtcaaacaaagagtaa

SEQ ID NO: 13897 - DNA, 213 bp, Candida albicans
gaagagcgggagggaagagaagagaagggaggagcagggagtaagagagagagagaggcagggatgagcagggaaggaagagagagacgaaggagggagagaggaggaggaaagagagagggaagggaggcgaagaggagagtgagggggggaaggggaacgaagaacagggggaagaggaagaaaggagaggaagaagaggaagaggattga

SEQ ID NO: 13898 - DNA, 186 bp, Candida albicans
  unsure (10),(22),(43): Identity of nucleotide sequences at the above locations are unknown.
tccttcgggnaacttcaattgncggtggtagccgtaccaggangtgaagacgtttgtacttcaaataaaaaaaggaaagaaaagattgggtttttttcattgtttgaaggattttcattctctttgagtagaaatccacttttatccaatcaatgttgtatattgtcatctttctttcttttgtga

SEQ ID NO: 13899 - DNA, 387 bp, Candida albicans
tcaattaataaacaaatgttgggttctgggaaaaaaaaaacaataaattacgtgtcgtatttctaccgcaaatccgcacaatacattctatacacctatactgccagagaaattttaaagcaacttaaatgcatgtgtatttacgttcctaactgtctccttaattccaagacttcatttaaacattcctctatatcaggtctactgtctgggttaaatggtaaacacttttttatccaattcaatcaatttcaggttctagccattgttgccttttcggtatttcatattttcctttgtttagataaccaaattttaatttaccaccctggttctatctctattttccccaatgggagattacccaaaccaccagctaataccatt

SEQ ID NO: 13900 - DNA, 420 bp, Candida albicans
ttgattattaccatgactttaactaaataccaacgaggcgaccttatagagggttggaatgattgccctgtacccctagctcataaagaaccattacaacatgcaagccttcaacaggaaatagacacccacaaggtcatcgatatactaaacaaactattccaatgtaatatcgacttgccagaacgtgaaataaaacattatgaaacaaaattagtaaatagtgttgacaaaatgtccaagtccaatatcaacttcgtctatcatatgtgtgacaggattctacagtatcagagccagggcagtttctcagaagtgaggaatgaattgaaaaatgaagttattgaatatatgatggtccatgaaggagtcagtagttggtgctcaccattaaagaaaataataaccagcataaattag

SEQ ID NO: 13901 - DNA, 225 bp, Candida albicans
tccttaataattcaagcatttctagacacacacaaatcaatgacttcactgatcaatattttattattacttcatccaacagtagtcactgatgcccaattagtagaacaaatcaaactgaaaatttatcaatcacataataacaataacaacaacggatggtcgcactacaacgacgacaacaggaacagtgaaaatcaatctttatcaacgacgaccagatag

SEQ ID NO: 13902 - DNA, 267 bp, Candida albicans
agaacagctatatttcttgaagcattaccaagttcatatcaatggttattaacggttatgtcagcatggtgggccattggacaaattgtggttaatcttatttcatggggattaattgcaaatttttcatgtccaacaatagacaacgacgttggtagtggtagtggtagtggtaatattatatgttataaggaagataataaaggttggagatattttttatttactatgggaggattaacgttacttatgtttttcgcaagattt

SEQ ID NO: 13903 - DNA, 657 bp, Candida albicans
ttttttttattgaaaatagaaatcattattgatattataatttgtatttatgtcattacattatttcctgaatctagaaatgccaaagctagagcaaaatcaagagccaattcaataatttcatcgaggagttcaaattcaaattcaaattcaaattcaagcacaagaggtggtgttggtgtttttattggtactgctggtgatgctgttgatcaattacaagaattaaataatcaacaacaatcttcatcaaaaagtaaattgagtatgtttttcaatattttctcccccttggttatattaacttatccaactaatttaatcaatgaaaatggtaaacatcgagcatcacaatatagatttgttgttatatcattgattatatctcaatgtattaatatgatgatgataatgactcttggtcaaattttaatccaatatgggatatttgtatttgattggtcaagtgaagatgttggtaatttattaaccgtattagcatcaactagagctataatattaattgttatattaccaattttccaaaataaaattttaaagaaaaaattcaaatttagagtattgaaaaaacaattagatatgattgattattcattaatgttaattggatcttcaccacgcggctggaaggaccga

SEQ ID NO: 13904 - DNA, 411 bp, Candida albicans
ccatacacttgcacatacacatacacatctattcctattatcatagttcataccctcatgtattcaccaacgttttctactagaacggaatcttcatcaagaactacatcatctacaactaaaactccacctttggaaatgggtctcaataaattaaacagcaatcggaataacgggagccacaataatgtttttgatgcaacgaatatggaacatctgtatttgatgcctgtaactgatatacatggattaatgacagacaaagacgatatttctttggatatattcaaaatgtacaataaaaagtactttccccaagaacatcaacaacaacaccaacgaatttcaaatttagcctggagaataagctcaaagtcttccccacgtggctcgaaattgccgcgctgcagt

SEQ ID NO: 13905 - DNA, 405 bp, Candida albicans
  unsure (281),(324),(368): Identity of nucleotide sequences at the above locations are unknown.
tcttgtcctcttttttccagaaatattttaaattctattcatcccaccaattctttaattacaaaactacctccatatattatacaacagatattagaatatgtcaatcaatttgatttaattaatctactgttgacttgttcaagattatatttgttagccattgaaaaattatataaacgtatcactatagtattagaagctgaattccccaataaatataaaggtgattctcataaatatattattgataatgggatgaaatatatggatagttcatnaattttcaaattaaataatttactaaaatttatcattaccatnactaagaataaatcgatattccaattaattaaatatgtggtatntgataaaagttatgatacatttcagggtgttaagtga

SEQ ID NO: 13906 - DNA, 192 bp, Candida albicans
attttttacatatatcatttgttgaattcactaaagggaaatgataaattacacaaatttttactgtttgaaaatgttcgtcaaaaaatgtttaaattattaataactgaattaaatcaattgaataaaccatttataccgccaaaattaactaatctatttttattattgaatgatcttgatgatgaataa

SEQ ID NO: 13907 - DNA, 489 bp, Candida albicans
tgttttggtaaaattcaagaaaatcaacctagtttgagtaagatcaaaccattacgattaagtttcaccatgcatcatttatattatattactgaaagaatcagtcgatcttcattggatgttgatgttggtcctttgaatattaaatcagataatcctaatcatgaaccaacatttatatcattcatggccaataaatctagatcatcgaatcgtcactttgatagtgataatagatccataacttcaatagattcagttagatcgattgtttccaatgcatcattttattggcgttcatttagagttagtaaagatcctaaagtcattaataaagatataaaatatttatattcatcatttacaaaaattccttgtttaattttcaatcccaaaacaaaaataaatactatcagttcttatgaagaatatccttgtgatacttctgtgccaattcaaatgtttaaaaatttacaagttttagaaatt

SEQ ID NO: 13908 - DNA, 501 bp, Candida albicans
  unsure (102),(106),(450),(474),(480): Identity of nucleotide sequences at the above locations are unknown.
gatgggcgtcagccattgcaccaaagactaaaccaaaaccaaagacagttagtaaaccagtgccacaaccagaagaatcaaaaccagaagagcatattccantgcnagaaggggggagggggggggggggttctagaagataaacctgcagttgaagctgttcaacctgttcaaccacctgttgaagatgaaccagtggaagcaccagctgcgtcttctgttgctgctgttgcagatgcttcattctctgaaccaactgcttcctcaattatagatcaacaaccacaagttgtgttgccaactactcaacaacaagttgattctgtgggtatttcattcggatcattgtcagttgatgcaggtgaaccaaaggaagcagcagaagtcttacaagatgagactatttctgaacaagttcaaccagaacaacaacaacaatctcaacaacanccattaccagacgggtcactacgnactgtnggtagggcatgttctccctgc

SEQ ID NO: 13909 - DNA, 324 bp, Candida albicans
ttttttttggagttaatttttttttggacgcgactttttattttattttttcatgatttttcagataataccataattatcgtcatcttattccttacttacttaccattgccaacacaaacaacaatgagaataagattccatttgcaaagaagacaatacaatagattttctggagaggatccaatcctaatggaagaaatttctgaagatttgtcattgaattatttgactgatacatttagattacccaactttgaaacctatctcgaagcatctcattcttcaaccagacgggctggaaggacaatcgctgcggggaag

SEQ ID NO: 13910 - DNA, 183 bp, Candida albicans
tcccctactgcggcgattcggccgctccgtagtgaagactcattatgctcattattcaatatcaaacagaaagaattttcaaaatttgatactactgattttttctgtgtatactcaatccaggtgcgacaaaagaaggacgtgtacactagcacaaaaatacttgatagtgtgtgcgtctaa

SEQ ID NO: 13911 - DNA, 441 bp, Candida albicans
aatttaagcatgacaccgccaatcaagtcaccttcttcttccctggttgattatggaaagctatctgaacaacttatgatagcatatacaaaagacgtactacaacgtaatttgcaaaagtttcatggggagcaacatcgccaacaattcaaacaacttttgaaccagccagtaattaaatctatacatccattgtctggtattatcgtcagatatcgtcataacaatagtgaattagataaagctctagacaccattgatttaccaaaaatatttgaacgacttgaaattagagaaaaaaccaacgaagataaaaatctcgattatgatgatttattagttcttgaattattgaattatcttaaaaatgattttttcaaatgggtaaatacccctgattgtccatcttgtggaatctaccaaggatgtttcaagggataa

SEQ ID NO: 13912 - DNA, 459 bp, Candida albicans
ttgttggcaattcaagaccatcttatattgaatatgtcatatccaattgataatttaatggatatatcatttcctgaagaattattcccacaatccacttttagtcgctccttattagacattgtttcttatgatttgtcagaaaatgaattgaaaaaaactaatgaactggaagaaaatcatcaagtcaatacttcaataaacccatcattatcttcatcattgtctacgtcttctacttcttcttcatcatcttcatcatcatcattatcattccaaaatgaattgatacatttattgcacgaatattccgagaataccaccaccatttctccctctagtgccactgtttctccaaaaacttatatgaatggatatataaaatttgtcatggactcggcaaatacttcattagaaccaattgatacaaatgagaatagtactgaacttactcatgaa

SEQ ID NO: 13913 - DNA, 207 bp, Candida albicans
  unsure (198): Identity of nucleotide sequences at the above locations are unknown.
ttacaaattaagaatgattcaattagaaatatctgcaactatttatgtaaacaaaatcaattcttaattaccaacaaccacataagtatgttattcaaaatagacaaatacaaaaccgaagccaaagccgaagccaaagcccaaaccattactttaacaaaaactaatccttatttagtatcagctggtgaatgtatnatttgtgtc

SEQ ID NO: 13914 - DNA, 486 bp, Candida albicans
  unsure (486): Identity of nucleotide sequences at the above locations are unknown.
gccaattttatttcaatgtcttctgttttaagaaatcaagacaatcctcctactatttccgaagtttcatccactaccaaagagaatacagataattctaattccaaacaagaggagaaggataatgataaggagatatcatctacaattgaaaatcccacatttgttgacgatgaagaagataataatccattttcacaccatggtgaaggattaactagttttatgacagcaaacagtttcaatgaaggaccaaataccaaatcatataaaagaactacaaaagaaaataataacagcagcagcaacaacaaccgaggtgacaacaactatgattacgatgacgattctttactattatataatacatcaaataacaataagagcaacaatgtttctagagtcaatccaatgttaaagtcgacaggagaagttttcaagacagtgaatatgaattttgaaagtagagtaaccaaattattaaan

SEQ ID NO: 13915 - DNA, 207 bp, Candida albicans
  unsure (174),(194): Identity of nucleotide sequences at the above locations are unknown.
aaacatagatttagatccgaactaaaaaaaaactttcataaaaaagagttacagctaccctgtattatgagtaattctactgcttcctgccatagccaatggttaaaaatgagaacaaaaagggaacctctaactattaataataatgttttttctgatcctttagcgattttntatcgacccggccgctggangatgcaggtccgg

SEQ ID NO: 13916 - DNA, 648 bp, Candida albicans
  unsure (62): Identity of nucleotide sequences at the above locations are unknown.
gacgcgggttttcatgctccgtgggtgacgacaaataataaaggaattaatattagtgcatngaaagataaattgaatttgaaaattttacaactttatttaatttcaaattatgatttccgaaatgataatattttaaatcatttaataaatgaaatccatcaacaacaacaacaacaagaaaataaatatattaatgaaattgaaatattgagagaagtacaatcacaaccatttgtatcatatgaattatttaaaaccataatagatcatgattttaataatacttattatcaaatcattaatcaattaatgaaatttgataaattatatcgtaatataattgaaaataatattattaaattaactaattatttcactaacatagaaattaaaaccattcatcaattatttgagttgtcgcctccaccaacatcaaaaacaacatcaacaacaaataacttgcctactattgatatagaatcgatgatttttgatatgataattaaaaataaatttagaaatgtcactactattgatcaattgaatcaaacagtaagctttaacaatgatgataataagaataataacgaagatggtataaaatatattggtggattagttaatcaagcatatatgaagatttaa

SEQ ID NO: 13917 - DNA, 243 bp, Candida albicans
  unsure (70),(192),(214): Identity of nucleotide sequences at the above locations are unknown.
aagaatagtacagttttctatgttgaactaatttgtatagtttatactaatccccagaagaagagaattncagaatggtttcagaagagaattagttggataataatacgtactaaggattcccttttcatacttttggattttttgacacattctgaatacgtggtattttgggttattggtctgtttccnataaggacaactaagggaacantgtggaagtttccacaaaacccccccccc

SEQ ID NO: 13918 - DNA, 579 bp, Candida albicans
  unsure (56): Identity of nucleotide sequences at the above locations are unknown.
acgcggatcttctatccccgtggcgaggtttcttcttcttcttctggtggtggtanattgataaatgttcatgattttaaaatcaaatcagaatttaaaattaatccaatattacaagatataattgatggattattatcaaattcatttaatttacaattatcttcattattagaaataatatcgaaaaagaaaaaattatccatttcaacagatatgacagatatgacagatatgacagaaggtattattgatataataattcaatatgtattaccattgattgattctaataataaattgattaattggttatcttcaaaaataatatttgatatttggaaatctcaaaaatcaacaacaatcaaattaaaagaagtggaagtggaagtggaagagaaagagaaagaggaaaaaaggatattatttagagacacatttgttaattctatacaaaatagattaaatgatattgaaaagaatttaaatttggaggaggaaaatattgatgaattgaaaatcataattaatcaaatccccaaaatttatcgatcaatgatcaatgagttattagaataa

SEQ ID NO: 13919 - DNA, 234 bp, Candida albicans
attgtctatctcaaacataaagtgatatggagattagagagtttttgtataagaaaacccagtattaaaaaaaaacaagttgataataatctccaagatcttcccttgtatatacttaatacgatatggatgaagttctatatatatatagatatatctttctcgtggtctctactcttaaaaattttgaaaattttagtttattctaataactcattgatcattgatcgataa

SEQ ID NO: 13920 - DNA, 207 bp, Candida albicans
agggatctttcgttgtctgcatataattcaacaactagcgccacagaacaactcacctcaccaaaatgttaccgctgtgtctcctttgccttgatttcttcacatttttaccgacactatcctttaaataagagtactaatttgaaagtgttaacctcattggtaattaataaaacgactattgtcaattatatccaaaaaggtttc

SEQ ID NO: 13921 - DNA, 231 bp, Candida albicans
tatgtgcaacacagaaatgcgaggaatgtgttaaccacaaaaaaatatataatttcattcatacacggggataaaaaaaaaaaagcacaatacaaaaaaaaatacacccactatttgaaacaaattaacaaacgacaacaaaacaaaactactatcgatcatcaacaacaacacatatatatatctatagataaattccctagactctattttggtattgcttatttttga

SEQ ID NO: 13922 - DNA, 309 bp, Candida albicans
gtaataagtaatgccactgccaacaacgcaatagaaattagcgaaaacgccgcctgcttggaacagatggcttggcgcggcaacaacaccaccgccagaatcgttacaagcatcacgtggttcaccggcacagacgccaaaatagcacacgctatttcaaccaccaccacaaaatatagctttcgaatatcaaacccggcaaccaccaccgcactgacagagctcaacgcatacgatactgccgacaatatcgccgacggcaagtacgtcccaatagacacaaagtgttttggcgacaacatcaagtaa

SEQ ID NO: 13923 - DNA, 765 bp, Candida albicans
atttacattcatttaataaaatattctcaacataatagtattattatcttacttatgctatcattaggatcaatgtatttatacaagttaaacaccgatcaaggaactaaaattggtaatgctcaacaatggttaaataatgcaagatatttccaatatttagccttgaaaagaattcaaccaataattgaacaattaatcaatcaagaagaagaaaacattaatgggaaatttggagttgatttattgatttcattagtattattaatcttgtatgaattttcaaataattgtaataaaaattggacaatttatttaaaattaagtaaaaaattacttacttcaacaaaatttgaaattccccaaaaaaaatcaattaattcattagaatattcaatattgaaattttgtttacaatttcttgattatcaagaatcaatgggaagaacagcttgtaaagatgttaatttatttttccttgattatgcccaagatgaagaagaagaggaagaagaaaaatctatagaacaacaaaaacaaattgatggaacttcaaatattattgtagtttataaaaatgtcaatttgattagttggatgggatgtgataaacaattaatgtcaattatatctgatatcactgatttatcatttgaacgatttaaaaaatcgataaatgaaattgattataatttattatgtcaagatatgcaaaaaagattacatgacatgaaattaaatattaataagctcgccacgggctaa

SEQ ID NO: 13924 - DNA, 498 bp, Candida albicans
gctaagcgcggatcctgccagccccgtggtgaagaattggctcatggttgttttaaaagtaaaaaaatttataataataataagaataagaataataagaataagaattcattagaatttatatatgatgattttaaaactcaaatttttgaaaatcattatcttcaacaaatgcaagtatctgatgatagtgatgttgaaacgggggatatttattctgaagatgaagataaacaagaaaacctattaaaaatggatcaacttgaaaaaggcgacaaaactgatgatgatgatgatgatgatgatgcctatcgtcttatatcagcattattttatcttaatttattattacaaaaaggacaatctccaaatatgatattccgtcaattaatattattcaccatcaaatatattgaatgtgataatttcacattaaaaaaattattatcatttaaaaaagcaattggtaataagaataatgataccgaacgtgtgtta

SEQ ID NO: 13925 - DNA, 234 bp, Candida albicans
aatttgaaaaatttcacccgaaaggaaaaacggcttatataccggattcaagatgacgttatactacagccttttttgcaaagaaaaaaaaaacgttttgtattaactaagcgttcccatttttcttttctttttataaattgcaacttgtgctattttttactagacacaatgaacgtgcttaattgctggaccattcaattggcaaataaaacacacagggcggatatatag

SEQ ID NO: 13926 - DNA, 246 bp, Candida albicans
cagaatgcagcaaacaatgttcttaataatcatcaaatggcaaatccataccctggtgaaggcgtaagcaacagtgatccccctcatggtgctgttgttcctactgtgaagtataaccgctcttttacccgtttcggcaattcccccagccctaatccgccgtcaaggacccgaacatattctttagaatgggaccagtcgattgtatcaaatgcccttgtttcctttcttgggtgtaatttctaa

SEQ ID NO: 13927 - DNA, 765 bp, Candida albicans
ttagtgcggacctgccagcccgtggtgaaaaacttggatacagtcgcaggattcccaacactatacgcattcagtcctgcaaatcacgacaatcccctgatggtgttcataccgggtggcggtcataatgcccgcatctcatatggtggtcatcctggaagtcgcagtgaggacttcttagcacactggctaaataagttgggctacggcctacttgccatctcgtacccgctccagagccagccggacgagatcatggccgcaacatcaccagaatttcgtatccgtgattggggtcttcaagcagcagaggtaaccaagacggtgattgagaggcatggcctgtcgcccaaggtggtgctcgttgcttggagtatgggcggccgggtattggttccctatacgcaagcagcgaaagcacgagggttgaccgtcgagctatttgtgagtcttgcggctactcctggactggcggcttctcggcccaacccgcctggtatcaaaatgacgtccgaggggtatgctgcattggataggatgccggagcttttcctgagccaggtccgtgagcacaatattctagagtctcgtgtcattattccagacgacgtgtatctccgtgactactacggctgtacccctgtcggcttgttcggctttggcattaactattctccccaacgcgggtttgttgaaaatccaaatacctcacccggaagatgccgaaccccaaaaaatttccgttcagtggggcttttgaattcc

SEQ ID NO: 13928 - DNA, 198 bp, Candida albicans
ctaatgcggatccggcagctccgtggtgaagacgtctgctgtgaccacgcccacaacggtactggccttgggctagatcaaagttctccatatcaagcaccccgtcggtccaccccagataccccaccacttagaaacatggagttgagagctagacagcatcaagccacccaggagagacaggtcaatcgatgctga

SEQ ID NO: 13929 - DNA, 222 bp, Candida albicans
gtattgagccaatgttatcacgtacgcacgagatggatattccgcttttcctcaaaaattaaggatgatgttcccggaacggtaccagggaaccctcaaatcctatcaaattatcatgtatcaggggctggagaaacgcaagggagaatcgtgggtcaccatgtcacagggagacaagctgctgtggaggtagaccctagatatgcaatgtacgagatttag

SEQ ID NO: 13930 - DNA, 204 bp, Candida albicans
  unsure (101): Identity of nucleotide sequences at the above locations are unknown.
tatcgatggtccacgtctcaggtcgaatccaccgtcattattgtctatgctccagctaaattgctgattgacaggtccatttccggtggaggacagccacnacagagaactaacgaggaattatctgtcttggatctcgagtcgagcttccgtagaaataaagtacctatcctccggtatactccggaaaatgtgaagacctaa

SEQ ID NO: 13931 - DNA, 240 bp, Candida albicans
cgtttcttctggattgtagcgaataccggcgggcaacgaaaggaatgtgaaggtgatccagtcacaaatgtcttgtgtctaaacgaacggaaagaggaagaaaagacagaactttccaccaggcaaaagaaagaaaagaagatgaagaaagaagatgaagatctactccctactcagtttatgatatttgaaaaaaaaaaagaaagaaaatttaagaaaataagttggagaaaatattga

SEQ ID NO: 13932 - DNA, 213 bp, Candida albicans
tgctacagtatcagcgggccccgaactagtttagcccctttacagtccatcccctatgccttggctgctggacacggtcagcatcctcacagcctcacaggattagggacaactacctcacattgtcaagaattaaacactacaagaagaatcaaaggagtagtcatgaccactgaagtgatcgtcaatcgcacactatccttcggggtgtaa

SEQ ID NO: 13933 - DNA, 348 bp, Candida albicans
catgactctgtcttgggagatacattggtgaaaggtcacatacgcattgaccgtgccatcgttctcaggagtattggtgatctgcgcatatttaccccatacgacctttccgcttgtcgtgacgagacccaattcggagacgttgacttcgatgatggttcccttggtcaggactcccagttgggtgtagagagggttctgcgggttcttcttgacgcccaggatgggcagttgcacggtgacgccgagctccgggctgataaattgtcagttgggttgcaacgcaaaaagcttagagggaaggacggccgcatagtcttcactacgagctgcaagatccgaactagt

SEQ ID NO: 13934 - DNA, 399 bp, Candida albicans
acacaggggatcatggaacggctctcgggtgagatggaggtgatggggttgttacatgtagatggtgacgcggtgcggcagcgggagttactggccgaagcacctgttgttgctgtggggcggtatgttgtgagcgctgagaacagagaagggtttgaccgggtatttgaggggatgcagcatcgtctagagaacgctacgatgccgttgcctatcttcaagggttggcgagttgagaaggaggagggaaaggaggagtttgtgctattcactgggtggatggaaatgcagcagcatctcgactttgcccagtcagaggggttccaggagtattcgaagatcaaagagtatacggactcctcggaggtcaagcatattgttcgctggaaggttgagtga

SEQ ID NO: 13935 - DNA, 207 bp, Candida albicans
agtgtaggggatcgtcgatgtgtccttgaccagccagtagatgaggtagattatgtaggcaagagtgacaggttgaatcacagtactgagcaagtcaacgaacaccacgaatctcatactgaagcaacagaatccacaaagctgttgcattggaatcagctcgataagattatggacagtggagttgatccaccgacgacgttgtga

SEQ ID NO: 13936 - DNA, 183 bp, Candida albicans
tactcagttcttcagggggaataccaccgcgggcccaaatcccttatcagttcaattcccatctgtatatgcaatgactgtgcttggaccgcaggcttcagtgagcaccttatggtggtcattatagggctttctcccgggtgtctgcaatcatggtgtcaggtggccgccaccaggggctga

SEQ ID NO: 13937 - DNA, 222 bp, Candida albicans
ggctttctcccgggtgtctgcaatcatggtgtcaggtggccgccaccaggggctgaccacgaattattcaatcatttcgatattggtaggggtgatgccaagctagtcccagagccgacactccaggcgctccagcggggaagtcagggggtccttatcaggtccgcgtgccgtgtgccctctggtctacagcctaatgaccgtatggcgtgcaactcctga

SEQ ID NO: 13938 - DNA, 210 bp, Candida albicans
tttgtcttgtttgtcttgtttgtaactcccgccccacgcttctctggagtcacctcttgtcacctccattggttatgcgccactcccccagcaatcggtcaagtgagctcatctggaagacccgaaaagcatttgtcgagctctaacaagatggctacaataccaagtatgactatccgctctagtgagatgcattttgagtatctttga

SEQ ID NO: 13939 - DNA, 183 bp, Candida albicans
attaatagttgtgatggtgactacttggaaaatacacgtatctctacaactcatgcatataagatttcactcaattattgttcagtctatcgttttacaggagctatgccaaaactattttttaagtattgcttaaacacaaaaattaaggcacctaaacaaactaaagacaatggatattaa

SEQ ID NO: 13940 - DNA, 189 bp, Candida albicans
ctaagcgcggatcctgccagccccgtggtgaagacctgtgccactcaaagctgcttaggacagattgttcacgatagggggaaggactatttagatatagagatccctgaggtttgcaagcaggctgtagcccgtttgctctgcctgttccccttttttagtgcgtcggaaccaaagaataaaaattag

SEQ ID NO: 13941 - DNA, 279 bp, Candida albicans
gacatgaacaagactgaggagcagaccaggcagcgcatttcccgtctcactaatgacagtagcgaaagtgaagaggaaatccaactgcgcatgttggccaagcgttcctctcgatcgcccgtggcatcaccaagccagcgatccgtcagttactctgctacagtgactgccagctacactttgacagatgaactccacgatgaccgagagaactggggtgaaactggaactgctgcaaccaagacccccctgagcagtttgatcggggagtggcgccac

SEQ ID NO: 13942 - DNA, 270 bp, Candida albicans
gacgggaaatgcgctgcctggtctgctcctcagtcttgttcatgtcttagtccagaaggagagttccagacgtggtgcgtgcatagggatgatgacgagagtccttccgatgggacttgcgaggttggccaggagtcggagcaggaaggtactattcactttgcgttccagcaccctcattgtggtcaatctctccaagcgcggaacgcttcgagtgactattgttgggtggagtcgcaattgggccgttgttggcacgttgcatggtag

SEQ ID NO: 13943 - DNA, 240 bp, Candida albicans
  unsure (91),(133),(235): Identity of nucleotide sequences at the above locations are unknown.
tggctggaacgatcactgttgtggttgctcttggttcatcatgcgcagtactgcgagccggacttgcgaggatttgcaaaagagagaccanagcagacttggtggagaaaggatgctggctgttccaaaaatntcgcgtcatattgtcatttgatcgagtcgcaatcttttagaacttgtcagcattgctatgacaggcaaatagaaacaagatctaatagcaggataccagacntctaa

SEQ ID NO: 13944 - DNA, 189 bp, Candida albicans
cgcttgtccttccaccccgccggggaagacgattacaagctattgaatatggtgatacaaaacgtgacgggtgaagtatcttggaaacctgtatcacgaataatcgattcaatttttgataagattgattctacttttgttcaagcaaaacggaaagcaaaagggatcaccaaagatcaagaattataa

SEQ ID NO: 13945 - DNA, 258 bp, Candida albicans
tacttgtccaactgtcctatcagacttggtatcactttccccaggggtttttttgtctacgatatccccgttccaactccacattccagagaagcggatcgatatcgtgatgagagatctgatcttatcctgacagaagaaggacccttgtcaacctttgaaggtatacatttctctccgtttcaaaatgccttggctctgattgaaaagtattggttgtttgcaaaaaattggcccgaaattgaaacaagcttgtaa

SEQ ID NO: 13946 - DNA, 195 bp, Candida albicans
caagggtccttcttctgtcaggataagatcagatctctcatcacgatatcgatccgcttctctggaatgtggagttggaacggggatatcgtagacaaaaaaacccctggggaaagtgataccaagtctgataggacagttggacaagtatcaaagcaacaagagcctacatcaactcagacagtgagcatgtga

SEQ ID NO: 13947 - DNA, 249 bp, Candida albicans
tatataatttgtactacatcggaaccttattcccctttttctttcctcgtctgctttactccctccatccttttgtcccctgcgttgtcaatcccaactatattcgacacggataaatcaagcagtaaaaaaatagtgggatcaccagaccctcaattgtcgttattgcccattggtgtccttactgaaagtcggagcagcgggaccgttctaccacttactgacgagcatctgcaaccttttgcgtga

SEQ ID NO: 13948 - DNA, 231 bp, Candida albicans
caacgcaggggacaaaaggatggagggagtaaagcagacgaggaaagaaaaaggggaataaggttccgatgtagtacaaattatatactaggcagtcgtttaattgacgcaagaaacgaatacaatgcgaggagaagtttgaagagatcagaaaagaattgcaaatacgaagagagagagaaaaagaaaacagagacaaaaaaacacccaaccggtctccaagtatggtag

SEQ ID NO: 13949 - DNA, 660 bp, Candida albicans
actgtaccttatcgcggcacctgccaacctcgtggtgaaggaacatcgaacagcatgggtattctacagtggtccgagcaggacgagtgtcaggcgcgcatccaagatgccggtctctacatcgactggccaaacccctacaacctcgaaccgggcctctatattatcgtccacacggactatgccacccggcccggcgacattatggatgttattgacgacgcatatagtgccgtcacaacgcgactcaaatcgcaaaagttcagcaatccgaggcagccacttccagggcgcaagagacttttcatccattatgagctgatcaaccaggatgatgggaccaccaactccttcccgacagaggtagacctctttgaggatgttcagagacacctcatgcacatgtttgatcagctggagttcgggataaagtttgatttcccgtataaacttggtccagtgcatgtgttttggtgtgatatggtcgagtgggagcatgaccttcccactgtcactgttgaagtgtttgaggagacggagtctgattcgcaggacgctgtctcccccacaatcacagttgaaatgtatgaggaggtagactctgactcgttaggggaagcgcaagatgacgatgagcttcctgaaactgcagagcaatga

SEQ ID NO: 13950 - DNA, 192 bp, Candida albicans
agaatgtataaattgtatgttaatgtgacacacagtgtagaatttgaaaatttgcataattgtatgtcgtgtaggctgttcaataaaacgattatgagttacgggttcaattttaaagaagaaaaaaatacattcttgactccatttaacagatctcaaagtacacgctcaatctttatatcagtcatctag

SEQ ID NO: 13951 - DNA, 603 bp, Candida albicans
  unsure (492): Identity of nucleotide sequences at the above locations are unknown.
tcaatgtcttcagagtcgttaccaatatcatcttcatcttcttcatcatcatcaaatcgcaagaaagctaatgaactggtattagaagaagctattgtccgtagttctattgatactattgatctaataactcccaaaaaactcagtaatttatctatcaaaacaactgcagatgacttacaatcaaatattgaaggatatcaggaatttttatctaatgccaacactttgtttggagaaagacctttggctgattatcaatatctatggttggaaacaatttatcgattaacatttactttggtcaaattaaagaaatcatttagtcaattgtatctacatgcacaaccgtatgaaattgaatctattggtccaaaggcaattgtgttaaatgctaaattgatgcaagctacagaagaattgagtatacttatgtgtgagtttttcaataatgccctttcaatagtagttgcgtttgagaatagagtgcanagtgtgattggaacatgtttaaaattattattacttgaagaaatggaagatgatagatttgaccatatctctaaaggcggtattacaacagatccaggtgtatttgaataa

SEQ ID NO: 13952 - DNA, 207 bp, Candida albicans
tatccttcaatatttgattgtaagtcatctgcagttgttttgatagataaattactgagttttttgggagttattagatcaatagtatcaatagaactacggacaatagcttcttctaataccagttcattagctttcttgcgatttgatgatgatgaagaagatgaagatgatattggtaacgactctgaagacattgatcactag

SEQ ID NO: 13953 - DNA, 186 bp, Candida albicans
tacgctaagcgcggatcctgccagccccgtggtgaagacgatgaagagatgcgaaaaaaagtatggagaaatgacaaagacttacataaagtgcctctgcagaaggacatttctcagagcaaccctgccacaagcaggaaagttgttcatcactcggaggagttccgttggcttggggagcactaa

SEQ ID NO: 13954 - DNA, 846 bp, Candida albicans
gctttatgtctaccatcatcatcagataccactactagtggtactacgatacattcattcaaagatcaagatactgattataacaaatacaattatttattagaacaatttaaattattattcgcaaatgacgatgcagatgcagatgcagatgaaattgataatcaatacatcaagaccaaacgtgatgaaaatacggtaaattcaattgtttcccttttacaatcagttgaacaatcaggattaatacctgacattgtattagatattacttcatcacaaactaaaatggataatttagcaaattatactgtgggattactttctaccattatgaatggtaatacatcatcattattatctggaattaatattgatttaaatactacagagattttaaatgccgttttaaattcaggattacttcaatctacagctggtggattaatattaaataatgaaaataatgctaaattggcggatttagtcggagagattttaggttctcctgataatgtatggattgggtggttattagttggattaggtaatggtgaagatttgaccgttccattcattgccaatttagtggttaatacaactagtaaagccaatactaattcaactaatcaatcgaaaattaaatcaaccgttggaggtaataatcataacaacaaagtggaagatgtgataattgataaagattcaattaccgacgaggattttaatgattattctgggtccttgaatgaattccttgataatcttgccgttaaacgtgatgacagtgacaatcaatatgctggttcattgtcttcaaccacgggggctggaaggaaccgcgct

SEQ ID NO: 13955 - DNA, 285 bp, Candida albicans
  unsure (248): Identity of nucleotide sequences at the above locations are unknown.
gcactaggtatcgattatgccagggctctcctggagaatgaaaccctaagacggccggtcgaaaaagcacttctgcatcagacatctcctactctctcttatcatcgcttcgaagaatgctcgacgcagtcgccagataaggtgcccagtcctcctgatgtactgcaaattataaacgcaaaggccgaatctgccaataggaaggaaagagcttgcgcttccgatccggcaactgaaatcagagatcnaagaccgaccacttggcatttctcgaacggatgctga

SEQ ID NO: 13956 - DNA, 861 bp, Candida albicans
  unsure (2),(73),(684),(791): Identity of nucleotide sequences at the above locations are unknown.
anaacgaagggtccatcgagtcatacatctggtccatcttccactgctgctggtactggtgctggtttggtanctggaagctctgctcattctcactctgctgaatacgatgcaactcacaagtcacaattggactctgatttaaagaaagatttgtactctcaaggttacacgaaaggtaaatcaagtcattcatctgttccgtcttctgcttctgattctcataatcatcatagaactgtttctggtacttcttacaatgcaactaaaccaattaatgaaggtgaattgcctgaacctgatcttcaagatgatgttagtgggcatgatagtagaaagtcgggtgctggaattggtgctgctgctttggcaggtggagccattggtggaggtgctgctgcattagcaacatcggataaacatttggatcataatttaaaatcagaattgtatgaagctggaagatccaaagggttagctggttcatctcaaacagaacatgctgattctacgttagacccaaagttgcagacaactgcttatgatgccggtcaagccaaggggttgaacacaactggatcaactaatctgggtttgcatccaaccttgaaggaacaattatataatgaaggctatactattgctacaactgggcatccttatttaggtaaacaggatgcaaancaagatgtgggtgccaccagaaaaatttcatcacttgatcccccacaaaaaccacaactgtatgaacctagccataatcaaaggtattctgacagtgcgggttcaanggaaataattcccctggttaaccccttcaaaattctgaaagtacttggactcccaagttggaagacaaga

SEQ ID NO: 13957 - DNA, 225 bp, Candida albicans
atacttgcgtccgtgtttttgcagattgaacatggtgaggaacatggagactgcaaagaacgcggtgaaggccatcccgatcgaagcatgtcggcctatgccgtggatgggcgcgtagcaggagataccattgacaaaggtgccgttctcatccatgcgaggctgaaactcttggaacgccagatagcagtctgtgccattggagagcgtgccgttgctgtatag

SEQ ID NO: 13958 - DNA, 240 bp, Candida albicans
cgacgggtccgaacgcggatggaagccgttgacgcctcgaaggtctcgaaaaacagacatggcgacagaaacccaaggcgaaggcctctcgatcaacataccttgatattggcctcattcacatcagagggcttgagggagttagcatatccgcacattacaagctcggagcgtaagtggaaacttaccaagccgctgaccatgatcttgctctctgttgcgaccgggtgtccaccctga

SEQ ID NO: 13959 - DNA, 270 bp, Candida albicans
  unsure (232): Identity of nucleotide sequences at the above locations are unknown.
catttcccgcgcatccgagtcttagctaccatttccggcatgtctacggtggaagagagccggtttgttgggatcattgacaatggtacgggattgctcttcagttccaccgagaagtatggaggcgttgagtctgcacgtcatcgttatgcatacattcggtcaacagcaccatcagagcctcagcaattgtttccagaaactggcggcgcatgtggttccggtcaattancccttgctgggtctatcattcgctatccagagaaataa

SEQ ID NO: 13960 - DNA, 258 bp, Candida albicans
ttatttttttgcatcattatatcaccaaaaccaaacaaatcaaatcaccgtattgtcatgctgtcagaggaaaaagatttatcaccccacaaaatttccaatattctgacaaaatcaggtaaaaatggagagaccatcgttgttattcgtatgaagaatcaattggttagagaaatgtctgaagaagaatttaaactagctgctccaaagctgtatgctaaattaaaagccagacaaaacccatcaaataagaagtga

SEQ ID NO: 13961 - DNA, 210 bp, Candida albicans
ctgaatgcggtgatggctaccaagaataagaagctagaagaagtaagctcagacagatatgtgaataggaatgaaggtgctaagttggtgatgggttatatcaaagatgtttgcaaagacacgaaaaaaagagacaaaacaaagaacctaactagtgtaactaataccactaaaggtaagaataattataccagactttatggtaattga

SEQ ID NO: 13962 - DNA, 465 bp, Candida albicans
  unsure (28),(215): Identity of nucleotide sequences at the above locations are unknown.
atcattgaaaattatgtcaccacgactnatagtaccgctgccagcgatcctaatcacaaaaaaatgcttctgaagtcaatttatgaaaaaatgatgatttctgtttcagatacaaatgtaagtgatagtggatctatgagtaccactactacgacaacaacagctactagtaatatcaaaggtggtaaacgtcgtggtggtagacgagcaacaantacaacaacaagtacaaatgccaacactaccaccaccacaaatcgtaatgataaatcaaacaatggaattagtaatggtggtggtataaatggtaatgtgaaagaaaattttgatcataaatatagtgaagcaacattattagcaaaaataatgaaacaattttctggacctaaaatggctaaaccagatgaattaaatcatgatttagagttaatggggattaaaacaaaatggccaataacgaaataa

SEQ ID NO: 13963 - DNA, 543 bp, Candida albicans
actggtgttaatgtgcatttggatgatgattttataaatgagttgatctggaacacagctttatactcatttagatatagcgatattaagccactgtcgattgccaatattcaagaacttttagtgacatatcttagtctggtggaaaaattatcattcaaagcatacatgggtatcactttagtggtgtcaaaagtatctcgagaaaggggcgaaaagctttttcacattgctgaaagcaaattcattaaccagaaaactaccctgaaagagatggtggcctactatatgacccaattataccttgcaaagtccccggaagatttggttcacatattcaatatcgctatcaagaaatacaagttgtcctctaagctatggctagtttttattagaaagttgagtttatttggtttgcttgatgaaaaaagagccactaagattctcaagaaaatggttctgacaaatgtgaatatcaatagtgacatcattactgaactttcaaagtcggtatcttccccgccgggctggaaagtcatgcgc

SEQ ID NO: 13964 - DNA, 246 bp, Candida albicans
gacgtcaatttcgcggatcctggccaggtctccgtaggtgaagacacctcgggaaaaatgttagaatacgaagttacaacgtgggttagtgtaccttcacatggtagttcctggggaaaaaatacccgacatgaaagaaccaatcagaaactgttgaatatcgactcaggtcatattattatgaatatattaaaaattataaagctatcaaactatcaaactatcagaacagaattaattaattaa

SEQ ID NO: 13965 - DNA, 591 bp, Candida albicans
ttgcgcgatttgtccaatcccgtgggtcaagaatataatactaatagagttctaatgagtttacgtcaggaagaagctattgcaaaggtagtgaagaatattggaggtacagtgtttgttacacaacctgccaaatctgttgagtcaacattcacaaatttgttcctggaaaaaatcacattgttaaattcaaatgaaccatattctagtgtacaacaatatgtatcgcaatcgaacgacgttgataacgaggatgctgaaaccgaagttgttactgtcaccactgatggtgtcactcttttgaagaacttgccatccttttcatcagaagttttccaaacaaataagatagtttctcatattgagttgaataattttgattacgcaattgttaccgcattaagagacctacagtatccagttttggtttcgcaaacgtctcaagaagcttacacttatgccaacttggcctataacttggccaccaaattgaatacttctgttttccatttttttgctccaactgattatcaatcaaagaagtcaattaaattatctgagggagttttgttacacaagttggacaatttg

SEQ ID NO: 13966 - DNA, 246 bp, Candida albicans
aataaaacaacattcttactatccttattattattgtcacttcaactaatattatttgagtttcccccattcactcttttaaaaccatctcaaataagtatcactactgttagtattattatattaaataatattacaaaacaactaaaatcgatttatacaactgtgataaagaaaaagacaatatcgaaattatttttcatattctcctttattatacttcatttccatcagctagcaatataa

SEQ ID NO: 13967 - DNA, 561 bp, Candida albicans
acagggataagccctcagcatttatttgaattgatttctcaagataacgtaaaatggcaacaagccatggtgaaaaggtttgacatggatgaaaatgatgatgacgatttttctccatttcgtaatcacgataatcatatcaaagccattcttaatttaatgttaaaccaaaaacccacgaatgaaaagaattctaatccgattttcaactataatttattagaagcattagatgaggtgtcgaacgatatgattgaacaactacgagaatccacttcagctacactaaagggtcaatccaacaatgtcgacaccgccaacggtacaactgatagagatggtgttaaaggcgacgtgaaaagtaaacggaaattgtttgatactacaacaaatacattattaaatgaaaaagaaattgattttcttcgacataaaataactcaaataatacagcatagtgagcaaaccaaaatgacacaagggttttcattgtatgatactaaggatgaagaaggagtacatgctggtgcttctgacatagtgccccacagggacgaataa

SEQ ID NO: 13968 - DNA, 504 bp, Candida albicans
  unsure (500): Identity of nucleotide sequences at the above locations are unknown.
gccgcgttgatttctgccatagtgacatttccaacctaccaaacccatgttcttggctacggaagatataactctttggacttgactttgttagtagcgacgagagcgttagataccaccctttcttcgtccttgtctaaaattacaccaagcagcttatcaggttacggagacgcactcttatttattgcaagttgcacttgtattatgttttgttggttcttttatcctgaaaagttaccacctagttatcacaaatggatcacatcggctgctaacatggatatcgaattttgggagattttgaggttagttcaacagaagaaacttgtgtacggagaacatggaccgtatgaggattacttgggaccttattttgaaaagcatggcagggatcccaaacgtggtaacactgttttgactcaaccaatagaatgtgaagctgtccatgcgtttacaacaaagagttgcgaacttcacgccttgtggaggttctgganggga

SEQ ID NO: 13969 - DNA, 219 bp, Candida albicans
cgtacacgagcgatgaccttccagccgcgtggtgaagaattatgcgaattatggaaaagggtacatttttatttttacattaaagaatcaataacctatacatatgcaaacaaattgaggtattacaatttattaggtctaaatacaactcttcctgttaatttaccattagccaaatcttcaagatattgtggcaaagaattgaaatcagcaacatga

SEQ ID NO: 13970 - DNA, 357 bp, Candida albicans
tatcatacaacaggagaactaccaatgagtgaggatgaagaagacaaacatttaaaatcaccgggtggatcctcattaaatccaaggaaactgtctgaccttcaaccttcagcttcatcatccctgcaaactcttgatgatacccattctcaacctaaatcaactactccatcggaatcaaccgaatatacttcaccttcaaaatcgctaaagagttttttctttaaaaatacactatcatcatattcaatcgatagtattattgaacaacctgaattagaattccaatcacatcgtcattcaacagaacgtacccgtactaagaaatcatcttccattggaagtgcacaattaagt

SEQ ID NO: 13971 - DNA, 264 bp, Candida albicans
aaatcatcaaaaacgatgctgtcaatcactgttgaacaatatgattatcaaacattgacaaaatcatatatggatatctttaattctcaaaaatttgctcaatttcttaacaccacacaaacaggatttgcccattcatcatcaggaattgaatttagtgttcttatgaaaactttattcacatcattatgcttttgcacaattcaattgacgttgttttgtttactcagaccagttttcaattatttataccaacctcggtgc

SEQ ID NO: 13972 - DNA, 201 bp, Candida albicans
tttcttgtttcaggaacaacaaaaacaaacaacaacaacgccacttctcaaacagtttctccacaaagaatcagtagtgtatggataatttccatagatttttattcatctaacttgaaagagattacgttctgtatcacgagatataccaagtaccatacattagacgagaagtttgtcctgttgctgcacattcgctaa

SEQ ID NO: 13973 - DNA, 312 bp, Candida albicans
acgagaagtttgtcctgttgctgcacattcgctaatccatatataagattttcaatttctcattggtctttctatctttttcattttatttttggaaataaaaataccagtttaaaacataatttgttagaaaatggaaaattccaaagattgattttttcttcttttgtaatgaaaattaaccaaaccaaaccaaaaaataatagaaaaaaaataaataggaaagaatatgcagaaaggcaccctattttatggtttgtatactttggccccaaacatattcaccacgaggtgccaatcaaagctatagtc

SEQ ID NO: 13974 - DNA, 231 bp, Candida albicans
ttgtctgtgtcaaactctccaattcaagtgcaaaaaatccgagggatagtacatatcaagtcccattgttatgccagtaatttaacaattttttcagtgtttgtgattacaacgcagattaaagcgtcatcatcattattcaaggttctatattatatgctttttgttttcatgaatttttccacattacatcatcgtcatagccagtatattaatactttttcttattaa

SEQ ID NO: 13975 - DNA, 261 bp, Candida albicans
aaaagagttgttggttattattattaccttcttaaaatagaatacgccaccaatcaattaaattatctctctttagtgatcataatgattttgattgaaagctatagggtaacgctgacaacatcaacaataatactaacaattgattattgtcaggatttacatattctcatgctaatcaatgagaagttttttcttttttacaattctttgatgacctttttattgccgattgttgtcatcacatcatcaagattataa

SEQ ID NO: 13976 - DNA, 255 bp, Candida albicans
tctcgaaaagataagatactacgacgatacgattcaatgaaatttcatcttcatcacaacaaaaacaatttctcaaacgttcttcttcaagatcacaccatcataggtcaacataaaaagaattacaacaaagctttttataaaaataatgcgtttttttgtttggttgctattaccaattatcgttctataaaaccttattttttctatcttgaaaaagagttgttggttattattattaccttcttaaaatag

SEQ ID NO: 13977 - DNA, 189 bp, Candida albicans
ttaccgaatctggaattgacacaatggttttttatcattcattcattcattttttttttccaacctatgagcatatttttcttcttgaatcatactaattatgttgtgactcagttagtagttgaaccagtcatagaaatttttttttttcttttcctttctgactctttttttgctctcaatttttaa

SEQ ID NO: 13978 - DNA, 201 bp, Candida albicans
attggtgttatgcaaatacttcagtgggtggttaatgcagaaccatgtgagctgaattattgtggtagaggagataatttgacaggtatatcgttactggcagcaattggaagcaaagctaaggttgttagagactgtaagaagaaagtaactgcagatcaaataaaagatgttagaaacgagaatttagagttagtgtga

SEQ ID NO: 13979 - DNA, 210 bp, Candida albicans
agggtaatttgtactatatcattagaatcagttgtgggtttcccaggtgattttttaccattattgggttttcctgtggtggtggtagttgatgatgataatgatgatgatgttgttgttgtcgttttagcctctggtgcaactattattggggtggtttgtgcatcctttctggcggctccaacttggataattaatattagtaaagaa

SEQ ID NO: 13980 - DNA, 522 bp, Candida albicans
tttaaaactaaacatttaccattacataaattaatgaaaaacttagttacaaatgtaccatccgtacaactctataaattgacaccagaattaaaatatgtcaccactactgataatgaagttgatagttcttcattggttcatcattttaattatttcactgaaaaattggattctatttggaaacaatttaatgcaaagcatcaacaagaaattcaactgtatacacctacaaatgataaattgtttatcaatgaattatctcaattgatacatttgggtgaaaaaatcaatcatactactggtaaatctactgatgttttctttttcgaggtatcttcattattatcaatcaagagaaaaattggatcttcttcaactacatttattcatgccaaggaagctatgactgatttattgttgaaattatctcaaactttcgacattattgtggttactttcccacagattcaagaattgtctcatttgaacaagatcttaccaccgctgcagatcaacgtc

SEQ ID NO: 13981 - DNA, 504 bp, Candida albicans
gggtccttccagccccgtggtgaagactataaaacagaagccgccagtttggtttgggttgaaggtaggaaattagtccatccatttttcacgccgaaaactttacgtgtaccaccaccagcagagttcaatccactttttgaaaaaatcgaaaacatgaaacctaccattattaaatttttcttgatcccaaaagaatacgatactacctttatgcatatatacccagagcttcaagctaatcgacctattgaagatgcaattgagccaatcgaaatttctgaaaacgagtttaatagcaatgaatctgatgacaatgaagaggaagaggaagaggaagttgttgctcaggaggaacaacctacatcgaaagcaccttcatccgaggaacctgttggtcctaacttatttgttatcggacttaaaggtaaagataacaagcgtgttgaggttaaagtctctcctgaaacacaattaaggaagttactttcatattatttgagg

SEQ ID NO: 13982 - DNA, 186 bp, Candida albicans
  unsure (1): Identity of nucleotide sequences at the above locations are unknown.
nacgcggttcttccattccgtggtgaagagccaaccaaagtgaaaaacaccaattacatatttgattgtttagtaattatattctttatctctttacccccaactaaagtagtttttgttagtttttttaattttcacttagatttggtagctttttttgaaacaaaaaaaaatatagtacggtag

SEQ ID NO: 13983 - DNA, 204 bp, Candida albicans
catcatcatcattatcaattggaaaacaaaattacaaatccaatacaaacatataatcaaagttatagattgtttaataatacgaaacaacaacaaacaacaacttacataatcaggttttttaacaaacaacaagtattacataagcaatcatattcccatctttctatatcaccatccggaaagtgctcaccagccggatag

SEQ ID NO: 13984 - DNA, 510 bp, Candida albicans
ccacaacaacaacaacaaaaacaaccatcggtaccaacatcatcagtaccattacaagtatcacaaaaacaaaatcagcaacaacaagaactaccacttccacctcaacctcaacctcaacaacgaactgcaccttctgcagtaaaacagcaacaactgatgcaaatgcaaccaccaccacaacaacaacaacagcaacaacgtcatcaaccgttgcagcagtccccaccaacaatgccattgcagcagcagccagtcccaccagtgcaacaagtacaaacagtaccaccaccactgctgcaaccacaaacacaactttcacagcaacagcaacagcaacagcaagctcaattgcaaatgcaggtgccacggtgttaccaatatcagaatcgaccaccttcacaacagcgtcaatactcacaaacaccgcaatataatcaaccaccaccacaacaaaaggtttatgctctaccaccacaacaagttgtcctcaccggcggtagaggataa

SEQ ID NO: 13985 - DNA, 183 bp, Candida albicans
agggttaccgtatcatcatggggtatctcttgccatacaacacgtttaccatgtttgatggcgagtaaaatattcacaaaaacaaatagagttgagggtattcaattgttatttattggcagaataagagttacctcatctttagtgaatctgattcgtaatagaatggaacgcttacagtaa

SEQ ID NO: 13986 - DNA, 570 bp, Candida albicans
accttccggccccgtggggtgaagacaaatagtatcaaattcaattatactgttttcagcgagggtatgataatttggataattaataaaattattgaaactaaatctgacaataaattaatattattagccattatcgatattatcagctcattatcaatatatggccaagcccccaaacgatgtataccacaaatgattaagtttttggcaacgatttatggactgagtttagataatagtcttagtttatcagtatggaattgtgttaagaatctttgtcatgatcataattatcgtgacattatgaattcattatgtgacaatattcatagctccgatataaatctttacaaaattgatgttgttgaaggaataaaaccagtgtatgcatgtactgggtcaataaaattgataagaaatttccaagttcaatcaggtttatcaaggaatgaaaatatttttgaaattctgcaagttcaaatattaaattcatttaaaatggcattaaattttgggataaatattataaattcagtttttttggattgtattgatagatcattagct

SEQ ID NO: 13987 - DNA, 189 bp, Candida albicans
ctaagttatacgataatatttagatatttattgccttatattttgttaaataaatcttcagttattgtcgagtttcttcattgcaaactgtcttttgtaatgtgttgtaaaaaaacattgatcgtgtggagttgtcgtatgattctctttttttttagtttaacaccaattcaacgatctggtcgatag

SEQ ID NO: 13988 - DNA, 195 bp, Candida albicans
atccttctgcttcaaagtaactacagcagctggtcaatcttagtcactggtaaattaccactgatgtcagacacaaccaaagcttcacaaaaatgcttcaaaaaattaattaggggatgttttcatctcaactacccttggctttctatgcgacaaataaagatccaatttatgcattcaatcccatttgtgtaa

SEQ ID NO: 13989 - DNA, 267 bp, Candida albicans
  unsure (48),(92),(149): Identity of nucleotide sequences at the above locations are unknown.
attggttcattaattacttcaggaacgattaatattccattttcacanaatggacaaaatgggatttataaatcaccgaagttaccaattanaataaacccaatgggtatggaaatcttgaagaatattttatatgaaaaacctgatcntgatggaatacattctgtgaaaaatgtggacataaatactgtatttaatgttaaaattgatcaatttgatgttgaattatattataatggtaatattgatgtgaaattggccatgtaa

SEQ ID NO: 13990 - DNA, 192 bp, Candida albicans
attaaagcaagtagaggtgcggcaaggggcggggggaggaaagaagaagcagaggaggaggatggagcggcacggcggcaacggaatccaaattcaaatcacaaaaataaaagaaaatctagaagaaggaaagagaacaaattacacaaaaccctaaaagcaaaagatgcaaaaaaaagaaagaaacagtaa

SEQ ID NO: 13991 - DNA, 276 bp, Candida albicans
aaaaagatcgacacatatattgaattatatagtttcagagataattctctatatatatatatgtatataagtattacatatctttatggagtagtctcgagaaatgacaaaataggtaaattaaagcaagtagaggtgcggcaaggggcggggggaggaaagaagaagcagaggaggaggatggagcggcacggcggcaacggaatccaaattcaaatcacaaaaataaaagaaaatctagaagaaggaaagagaacaaattacacaaaaccctaa

SEQ ID NO: 13992 - DNA, 441 bp, Candida albicans
  unsure (25),(32),(78),(99),(137),(161),(162),(208): Identity of nucleotide sequences at the above locations are unknown.
attcaagttcagaaaatcccaaaanatgttgntaatattcaaagagtagctactccattagaaggaaattataaaganattggtgaagtttctggtgtnaatttaacatcaaattatatgcctggagtatttgatanattagatacacaaatttttgtaannatattacttccttatatgttagaaaagaatgaaaccatgaattatnacagcaacaacaacaacagcaacaatgttaataataatttcaataataataataatgctggcggagttaataataatagtaatggtgtggcttataataataatgctgctaattggccaataaataatgctgaagatggattaaatttagaagatttatttggaactttaggcaataatggaaatggaggaactagtagttctaatggattagaatatttagatccattttaa

SEQ ID NO: 13993 - DNA, 390 bp, Candida albicans
aaatctaaaaaatgtacttgtttgttaatcaatatctttaactcttgtatatcattttgcaatcattgcagtcttatcatgatcgatagatcgtcttgtgttaatagtgtcttttcaaaacccgatatggaatccttggaagatgctttcacaatcagtattttggcacttccttatcctattatagccagaattttatacgaatgctggaaagaaaggtacaaggtttgtctgattttacccataatatacacctgcaaacaattatactacgggtacaaatatatgctatatacgctaagaccattggtgataatcaacaagagtactaaaaccactgacaaagactgtattctgtgttctgctttcataaagttgctacaggacagc

SEQ ID NO: 13994 - DNA, 297 bp, Candida albicans
  unsure (12),(18),(166),(167): Identity of nucleotide sequences at the above locations are unknown.
gtgttgcagcanctgaantcatcaatcatatcaatatcttaccgagttaaggcgatgttaggaggattaaatgcatccagcatggttaaaggaaattggatggctaaaattaatataaaaaaggtggtggtgttttcgttgaacaaaaaggtggtcggtcaatttnntccctccaaattgaagttaatttttggggtcgccttgttgaaatgtttgaaaaaaatttggctttcaaatttgggtttgtcggaaatctttcaatatcaaatttttccaaccaagtataatattttttaa

SEQ ID NO: 13995 - DNA, 690 bp, Candida albicans
  unsure (652),(678),(683): Identity of nucleotide sequences at the above locations are unknown.
accgcacatagaacacttaaacgacagaaatcgtcagtgctgaacgtgggatattatttcacacgtgagaccaagttggagatacagcaacaccaaccacaacagcaagaaagtcgacaacaacaacaacagcagcagccacagcattcccagacacacaatatctacgataatgacaactacatgaattacaattttccacccactagcaatagacctagagcttcgacgacgacaggaacaacatctaccacacatgcaggaagcgaattatctcatgaaagccattccgtgcatacttcgcatttgaaacgaacagcatcatcagagctagatcaacctattccagccatggcaccatcttctcccctagtaagctcagccccatattattaccaacaaccatgtcaacagcaaaacctttcgtatcatgatcaccaccaccaacagcaacagcagcaatctactcctcaaggtcagcaattatctcagcagacacaactgaacctgcagagcggagtaccgccaccactatacggtactagctcaagtattcctcctggatcaacaatgcaacccagcacttcgtttgcatttcacacttcgcattcaacatataatctttcatttgactcggcccggtcctctaatntggttttcttggggagcagtgagccnccacnagtatga

SEQ ID NO: 13996 - DNA, 213 bp, Candida albicans
  unsure (183): Identity of nucleotide sequences at the above locations are unknown.
aatgtaagcttgtttcagcaggaaaaggacaaccacactttaaattctcttaacgcggtaattcaaatcattccctcctttattcgttcaatgtataggttgtgtgaaatggttagctactccgcaccttttatttttttaaggtttccctttttttgtgttaattcaattaaacattgtgtntactatataattattctaatacttcaataa

SEQ ID NO: 13997 - DNA, 288 bp, Candida albicans
aaaaaaaatattgaatctttcaattatgcattcatgtactttcgagttttaattgcaaaaaaaagatttaacgcgttttgtagccttcaagatttcacctatgtagcattctttatacgtattttagttaatacgatatatcgtatcaattctgaaacagaaccaagaaaaacttttggaaaaagaggtaaaagtaaaaggttaaaaagagtgtgtagtagtaagagcttaaaacatgtcaatcataatcaagagttggtaaaagaaatctacgggagtgccaaataa

SEQ ID NO: 13998 - DNA, 393 bp, Candida albicans
  unsure (348),(355),(358),(362),(364),(369),(370),(376),(378): Identity of nucleotide sequences at the above locations are unknown.
cccggaatttcggatccggccttgccgccctggttgaagaccacattaatcaacaaggagtctcaacagcagtcacaacaatcatcattatcttcagagaacttatttaatgataattttaaaagtttggaagatttgaaagatcaattgttaaatgaatacagggaagatacaaataataatgattgggtattagaaattcctgatcaattatatcatcaaagtttgataaatctatgtgatgtaataactgaaaatattgatgaatcattttatcgattcgatttaagcaaaattttacattggttgaatgagaaagtcttagcattgcaaaaatatatccttacngaaagtnggnaatnanaattnnaggccnanttgaaatttgtttga

SEQ ID NO: 13999 - DNA, 645 bp, Candida albicans
  unsure (596): Identity of nucleotide sequences at the above locations are unknown.
tatactaatttgtcatttgtgctaattgcatttacctttgctcaaactgtagatgtcaaccctatcactgatgaacttagcattagggacaccagtggtgccacatctgaagaaatcgaggttgctaattatcttcaacaattagttgttgctgctggtcttgattctcaaaacttgactaaaagagattatccagataattcacttttaactgctgctttcaccagtcttaacagatcaggagttggtgtacaacttgtccatacttttgctactagttctgctactcaaggtactaccattaatactgttggtcaatatgtctcagttactggattaaccaaacttttgacatctgctaataaatctggtttagcagtttctattgtcatgagatttttcattaactattctttggttcctggcttatggaatgttattgttgccttatggaataatggtgttatttctctcggtaaaagaggtcttcttgatttggtgggtggtatcattaacggtgtgcagcagtccatcattaattctcttattaccattattaattccgtcacagatttgactcaggtttgttcctcatntgaacatttcgttgtcttagaccagacgggctggacggatccgagcgtt

SEQ ID NO: 14000 - DNA, 360 bp, Candida albicans
aaaatgaccataaactacgaaagtgaaggaactatcacatttaaagaattaaggagtttattattaaaggaaagagaggagcaaagattctccatcacgaacatcctggaattcgttcccacattaacaatagaaaatcataaagaaaaagtcggtaaatactttagaaaactcacgctgctctttaaagagagacaattgccaatggttgcaaattatattaaatttccccaagatccagaggaattcccacaggacccttgggatgataaaataaacgattttgtactatcagttttagaatataccgctgatgactatgtcttcacacacggcggcaggaggcatccacgtacgcaa

SEQ ID NO: 14001 - DNA, 204 bp, Candida albicans
aatttctccaccttttcaatagaatcgattgccagtcagatcaaaaaaaaaacaggaaattcaaaacatcttcccactaaaaatttagcggtttctgatattttcaaaccaatgaacgaaaatgacgaatggaggctgttcggtccgatcagtgaaatctcttattcattgactaaaatgcatggtttctttttgggctcataa

SEQ ID NO: 14002 - DNA, 351 bp, Candida albicans
cgttgtctgcattcggctggtgaagacattcaaaaagagttccatgacgtaagtgatgaagagaaatcattcaagcataatcatgattttattgagaatataagcaatttaagacacaatgacgatgacgaggaagatattgttgaagaagaactgccaaatattgacgttaaagaaaaaaattcttcactttcacctgaaacaccatttatggccaaaccagaaaatggtgcattacgtttggatgacttgattgaagttagttgtgaaaacgaagatgatttcgaacttcaaaatatcccaaacccatctctagagttgccagtttcaccatcaaaacatggatttgct

SEQ ID NO: 14003 - DNA, 402 bp, Candida albicans
caacaaaactttttcacctgcgaacgaatcttccaagtatggccacgctttgttgaaggttgtgttgacatctgggaatccgtgaataagaatgatagctctatcccattgcaaaccagaaacctctgtttcaggaaggttactgagggtggaaaaagtccgtctaccgttgtgaagcttgatatcaaattttgtcatgtgcgtgtatgtagaaaaaaaaagaagatttcaaaaaaaatgtgggaaaaaaagagaccgctttatagtatttttcaggggaaaggggggggggaaagtgcatgtggaatttacaatgtgtatattttcatgtgctacggcattctaaaatatatcattttcatatggacaattaatactgctatgaccatctctttcacataa

SEQ ID NO: 14004 - DNA, 360 bp, Candida albicans
aatcttctttttttttctacatacacgcacatgacaaaatttgatatcaagcttcacaacggtagacggactttttccaccctcagtaaccttcctgaaacagaggtttctggtttgcaatgggatagagctatcattcttattcacggattcccagatgtcaacacaaccttcaacaaagcgtggccatacttggaagattcgttcgcaggtgaaaaagttttgttgttagcacccaaattgcggggatacgaaaaatcaagtattggccctgaaagcgaatatgcgttgccataccttgctgaagacgttaaagcgtggattgcagagatgtcttcaccacgggtggaagtccgcgtc

SEQ ID NO: 14005 - DNA, 810 bp, Candida albicans
  unsure (100),(800): Identity of nucleotide sequences at the above locations are unknown.
ggttatttacaacgtcatggtattgctcaagttgtatgtttgacattaatttcaatattggatttgatagtattatttacaatccatcctcattatgtgnaaatatcgtgtggttcactgaaattgatgtttcccgttgctagatttttgactgccgttttgtgtattgcattcattcgtgatttagaattaagtgtgacgtcaaaactttatgttgcttatgcacagttgttaattcataccattgttgggattttgttttgtatacagttgttttattggtttaccagaacaatgatttctattttccaaaatctgaaaaataatcaaacaaacaatgacgatgtaaaccaactgttgacagtttacgatagtcttgatgatttccaacaacaatttgactacaaaccattgcaacctttaccaacgtatcaaatatattctgcggctacagcaataacaacaacaccgttatcaataattgatcaaatggaaaatccattcatttttggacaaagtagtggtagttgtattatgaagcaaaacggggcacgtaataaaacgaacgcaggtaaggccaataaagataaagatgaaatggaacaacaagaagaggaagagtatttggatgctaattattattatagaagcagaagtgaacaagtttcgaaaaatattgttgatcatgaattacagactcattcatctaataatagtgatgtaactagttttgaacaactacaatatgaatcaaatatgagcaaattattctttactcacaggagccgccagcaccgctntattttaaca

SEQ ID NO: 14006 - DNA, 264 bp, Candida albicans
attggtagcattttggtatcacgtgcagataagacaatagtcaaagctggtcgtgctgattaccaatttgggacaacattctgctcacagagaaatagaaagcacataatgtgtaagccacaaagattaagaagtacatcacaacaacaacaacttccatacacattatctcgctatcaaaataaaatccattgcataaggcagtttaacttactaccacagaattatctatcatttcacttatcctacttttcttctttttga

SEQ ID NO: 14007 - DNA, 207 bp, Candida albicans
  unsure (100),(177): Identity of nucleotide sequences at the above locations are unknown.
aaaaaaagcacccagactgaatcccaaagtctaaaaccaatttatgcctttcaatatgattactcacaatctattataatcatttttgggaattggccantgttggttgcaaataccaaaatcggtatatacgtgtcggctcctgaaatactgttgatgccactatcccgggccccnaaaggggtcgcccacaattcaacaacttaa

SEQ ID NO: 14008 - DNA, 213 bp, Candida albicans
ataacacaaaatttatctaccaaaatacaaaatagaaaagtacaaaatgaagcagtgatcgggtcggaagagaacgaattgtggttttcaaccgattcatgtttttttcagcatttccagaatcaactaatagctggagttgttggtgggaaaaagataaaccatatagctaagtataaacgagctagacattgtctggatactgtatcataa

SEQ ID NO: 14009 - DNA, 186 bp, Candida albicans
gttcgtgcaaggttgatcaaaaaaggagaaattgcttttaaatctatgaatgtggatctttctgcaagtattgcgtgtgctgcacaaactttttatatccgaaaatttttggccgggaacgaaacggcaagaaaaaacagaaacaataccaccagcacggacaaaaagattataagctttgtgtaa

SEQ ID NO: 14010 - DNA, 288 bp, Candida albicans
aaaatactatatcatgacaaaatatataaatcatcatatataaatcagccattattatatcaaattatttcaacacaacatccaatgttaccagtcaagttttctaatcaaccaccggaacaaatcatttcaatttatggatttgataaaattggtgatcatttcatattacattttgaacataatgatggtacgaaaagttggggttcagttgaatttgctaaacaattgatacctgaattgacaagagaatatttgagtcatcctgcccatagtcatcttcattga

SEQ ID NO: 14011 - DNA, 198 bp, Candida albicans
  unsure (133): Identity of nucleotide sequences at the above locations are unknown.
aaacttaataacttgagaaactttcgttcctatactttaagaattggttttaacgttggtcaaattacttatcttccagagaattttaaacaggagaaaaatattttctcttcttgggttaacttcaattttnttcctcaaacttctgaatctcaaatatcccaacgtttatccaaatcaactccctttgatctctga

SEQ ID NO: 14012 - DNA, 198 bp, Candida albicans
gctagaaaaaaaaattataaaaaaacacaacacactgttttcaactttttcaaacctagacatactcaagtaaattcagaacattatgtcccaagaagaacagtccggcatctttcgcctcaagaaccaagagtagaagcgtcgacagtaagtcttcaccgcggggcggaaggtccaacttggttaggtgtagcacgc

SEQ ID NO: 14013 - DNA, 480 bp, Candida albicans
acattacggggacaaaagccagacctgctgagcaccttagtgaaaaaatcatctactactgcaacgggaataaatacaaataaaaaggcaaaacatcttcaaaaagccagcagaactactgttttgaataataagaataagattactcgacagttgcctggcccccttgttggtttatattatgacttgtatgatgataatttggttgacaaatacttcgatgctaaacatgaaaaaattgcactcggatatcccgtgactaaggcaccatatgctaacgacatagtattcataatatcgtttctttccaaatttaaagcgattataccaacggacaacatcggccctcaaaattttgaatatggtttaagtttaccattattagaagatacttctgattatgaaacggcaaactatgtgaaacgacatcaagaaaaagaaatcttcaccacggggttggaaggagccgcgcttgatggt

SEQ ID NO: 14014 - DNA, 561 bp, Candida albicans
  unsure (545),(546): Identity of nucleotide sequences at the above locations are unknown.
aattatacatcatatactagagaaagtaatttccaatcaagtggtattatgggaatggaacaacaggtttcaagtgatggatcttatacttatgatgaagtaagtgaattatctgaagatgccactactacagaaattcgaaatattgataagaatgaaaacatttctccagagactcgagcacatttatatgctgctaaaattgttcaaaatcgaatcccattatttgaacaagaaaatcaagatttacgagaaaatcttcataaaaaacaactgcaagaacaatttgcgggagttactactaatggtgatatttctatgaaatctgttgctgggaaaaatggtggattaaatgcagttaaatggaagaccagatctcaattaaaattaaacaaaggaggaagtgttgttggcgatccagaaaaaatcactagaggaacagttgaacctggagttgatttaccattagaatatgatcaaatgatatttgatcctgaaactcaacaatggcagttttcaacaggccgtaaaagagacaaatgtcnngcaaatggggggggg

SEQ ID NO: 14015 - DNA, 192 bp, Candida albicans
tttcatttgacaaaatcttacattaataattcagattttcctttcctttcctttcctttccatttttcaaacatcatcaacatcatcgccttttcaacacgtttgattgaaagaatagaccgaaccgcaaaaacaactaaatttgtgatattccaatgttacaagtatgtgattcccttattattgcggtag

SEQ ID NO: 14016 - DNA, 387 bp, Candida albicans
acagttttaaccatacgtggtttaaaaagccgaacccataggtttttcaagaaaggaataagaaacttctcatgtgttttggtcatttgcagtcattcctcaacgataaatagcaatttacacgttttacaacctagtagtattggccacaacccttacaaacctaaagcatacttggatcagtcacatataaacggagtaccctccagtaaagacgctcagtgtgttatatcaccctttccaatatgtaaaagttgtcatatcgtacattctttctctttcccgagtttagggaataagaaatcttacacaaaaataaaaaggtataatttaaacgaagagaccgaacaccacagaaaaaaaaaagaagaggtacacgccgcctag

SEQ ID NO: 14017 - DNA, 204 bp, Candida albicans
tttagatatgtggttagtacaactaaatctaaagtaaccgttgtaataatgttgtatcaaaattgtaaccatactctttatttcctattttttcttattgaaaaagaaatttctttttacctgcaccaaggggttgaagacaagacaaacagattgaatgaagaatctttaaaggacttgttggtgtcaaataacatcccttga

SEQ ID NO: 14018 - DNA, 240 bp, Candida albicans
ccccgattcaaatttcaagcgagcgagcgagtggaaagagtagttgaagcagttcgcgagcccgtgtgtgtgtgggtaattccaaaaaacgaacaaatcgaaatttcaaagggaacagcaaaaaaaaaaattaaatacactactttaattctgccaacacaaattcacaccctgttgaacttaagaatcattgttgaatcaatttataagaaagtgttgatcttatctttggatatataa

SEQ ID NO: 14019 - DNA, 186 bp, Candida albicans
  unsure (181),(182): Identity of nucleotide sequences at the above locations are unknown.
acatcagagttattttttgacaaccacctttgcaaacacaatatggaaccaacacctcttattgaattgagtgacgatgaagatgagattgatttcaatgtgaacattactagaaaaccaataagtttgacaaccaatgacgtcttcaccacgggctggaaggtcccgcgcttaggtaaanncccc

SEQ ID NO: 14020 - DNA, 261 bp, Candida albicans
gccactccaaatcaacaaccaacgcaagaagaaagaaattttttctcagcgcacgaaatcagaaatttcagacagccaacaataaaaacagtaaacaataacacaacaacgaaaaaaaaaatacacgcccagtcaaattcaactttacaacaacaacaacaacaattactgctactactactactactactaccatacttcttccacttcttcttcttcttcttctttaaacgtggacacacacacatacacatacattag

SEQ ID NO: 14021 - DNA, 189 bp, Candida albicans
taccgcctgcctctcttacgattttctacccaagttacgtctaaagtttacgccatcaccaattctattatttatttattacgcgaagaagaaaaagagaataagccactccaaatcaacaaccaacgcaagaagaaagaaattttttctcagcgcacgaaatcagaaatttcagacagccaacaataa

SEQ ID NO: 14022 - DNA, 480 bp, Candida albicans
aaacttgaagataaacgaataaaaccatacctagaagaaatcaaactgtcgcattggtttgaatcactagctgaatatcgatttcgcttctacaacttcaagtcatcacaatttctaagttctactgaatcagacatgagtacgcaagttaatgggaacaattttgtgaggttcaatctgtgtcagaaaaattcccatgaatatattcaaaagtttgaaagatcatttgaaaaatataaaaaagcacagaatgagccaatgtcacatattcaactagcgacaaatcttgtccaggatctattgtgtactcacgagtatataccaacaacagaaatatggcactatttgctaagaaatttaggtactttgaaattatacaattaccagcagattatttatttgtcacttttccaatataaacatcaaccaacaattcttgcaacaccaaaagaatcttcaccacgcgtgcagatccacgtc

SEQ ID NO: 14023 - DNA, 465 bp, Candida albicans
cgagcgtggtccttccaccgcgtggtgaagacaaagacattccgaagtatttcatacaataccaaacgggaggctattttgaatttacctgctttgtcagaacaagaacttgtgcaacgaatgatgaacactttggtgtttgtgcttaatcatacagtgactaaagaaaatctttttttggataaatcaattaggactaaagatgaatctgccaagactggaatagataacgaagaaaccaagattgttagtacaatactaaaacttgataatgaaatgcctaatgatatcaaatacgatttcaagtttagatggtttaaagaattcaccaaacagatggacagtattgatccgaaagttggacctacaaaaaatcaattagaatacttgactgaacattatgggtacagaatgtactatattacgttgatgcgattgaatgaaagtgcaaagttgtgcctatag

SEQ ID NO: 14024 - DNA, 633 bp, Candida albicans
tacgcggtatttccaggccgtggggcagatctacgaaaagaagataaatttgaggacttggtactaaaatattttattcatgaagggtacgaagacgcagcgatcaagtatagctgccgtagaaaagcaaatgcaaatgacattgatcaagaaatcgaaaacagaggcaacaatagatatgatattagtggtaataagaaggatcagatatcaccaccaactagtagtctatttatcgataatatgaaccgattgagtaacgacaaagagttttccgatatggtcattagctactttaataaccccagtggcaaacacaataataatgaaagtactgataaacataacaataataatggtggcagtgaaagtgccagttttcccgatattactgatgttggggcaataaataatcgtgataaaaaaacggagtctggttttgccacaattaagcagcgtcaagagattaagaaattgattttgaatggcgatattagtcaagcaattaaacaaattagtcaatattatccgatgattttagatttgaataatctattgcacttcaaattgttgagattaaacctcgttgaaatgatacgtaaccataaatttaacaccaagagtagcaacgat

SEQ ID NO: 14025 - DNA, 300 bp, Candida albicans
aaattttacaaccaacaacaagacaacacaattattactacaatgaatacaaacgaagataataactcaattgactttgaacagattgtcgggaaaaattttttgagaaagggagggggggaaggaaactccgtcccttcctccttgttccatctatctttccactcccttacatctctgatcacatcagtgtctcttcgactgagaccgagcacatcttttacgccgttttcctactcttctctctatatcatttcggtctttagccgatccatattcgatttgattggtcttagatga

SEQ ID NO: 14026 - DNA, 345 bp, Candida albicans
agaaagaggagaaagatgatgaaggagaaaaaagaggaggggatagaggaaagagtgggagagaagaaggtgacaaatgagagagaaagaaacaagagaagaagaggaaaggagaagaaagggtggcaaggaagagacgagagaaggaagaaagtaggaaaagagagagtaaggagaagaagaagaggagagaaaggaagagggaaagtaagagaggaaagagaagtgaagaaaatgatgaatgaagagaacgagagagaaaggagaaaaagaaggagagtgataagggagaagggaaagaataaaggagataagggggaaaaaagagggagaggggagggatag

SEQ ID NO: 14027 - DNA, 207 bp, Candida albicans
caccgggaaacaggtttgtgccccttagttaactcacaagggcggattcttttccccccccctgttgttttcgccgccaatagtaatttccgatatattataccgtggggtgtggggagcgctatagtgttgaccggtattagtttgcccgtttatacgcgaacttcgattttagccgcgccaacacttcgtttgttccacgggtga

SEQ ID NO: 14028 - DNA, 558 bp, Candida albicans
ttggcggattactgccctcgtggggcacatcctataagagttgtacctaggcctaacttggaaatggaatataattttcaacaactcaaacaagaagcggagctttattaccgagcttttgtggactctgtaatggtcaagatagaatatggaaatgagttgttgaacaacaagcctgggtatagtaatacctcgagacctaacttgagtcctatgatgagcaacgatagtgttaaattacgacagttgtacgatgttgctgacgatacgtttaaaactaatttaagaagtgggaagagtatgcgtgatgaggattattatcaatgtcttattccgtttaagaagaaatcaattacaggatcaagtaaatatcttgggatcatttccttgtcaacgattaaggaacactataagatacgttataccccaccgacaagatttgggaaagctcctcctccaaatgatactgaacttctaataccactcgagttaaattatttcactgaatcttccactccgttgaaaaatttaccagaaattaaagcaatagatgttgaa

SEQ ID NO: 14029 - DNA, 810 bp, Candida albicans
  unsure (749): Identity of nucleotide sequences at the above locations are unknown.
ataccatttaacttatctattttgaagccatccctttcaaaacgttatcttttaaatgccaccttaaagactttccaaagcaaggttattttatcaaacttgatctatacattaattgatttaaatgaatacgatgaagctttagcagtatttaccacatatatcgattatttggaaaaagacgaggaattaaaggatgggtacattgacgatatattatcgataattgatacatttagtacttgtattatccatttcaacccattgaaaagtttcaaatctggtaacaaatttaaacataatgatgattcgtcagtttgtcaacatttgaagaaatttgtcacattattgcaaaaatatttgcttgaacttcaaaaattgatagatttaacatatgatgaagaggaagatgaaagtgataaagttaccactgctgcaggtgacaaaatcccattgtcattcctttatcgtaaatacaacttgaacattttgcaatcagataacacccagtttattgaattgatttcaaaagcttggcatgcaactggttattattactattacttgtcgtcatatgaatcgtcaaaccaaattattttacaaaataatatctcattggttttgaaatcttacaagaattgtttgattgttaattcgacaggtaatgtactttatttgtctagttatgccttaacattagccaattccggctcgttgaaaacagcattaaaattgtgtaagtctatttngaaaaaaattctcataatcgttcaagacttggaaattggtggtaacattgttgtccaattt

SEQ ID NO: 14030 - DNA, 753 bp, Candida albicans
ttcattcgccaaccaatgtccagcaaagttgaaattcaaaccaacccggctactgcaacaccatctttgtcaccaccatcttcatcagcatcaacatcagtaccgccatcgtctaacaaatccactaccaccacgaagaacaacgacaacgacaacaacaaaacatcagcacagcaagatgaagtacctatgaaacgtaaaaattcagcaacttcaaatggatcctctgcatctacaacacctccaaaacgtcatagaaccatgtcattaaatcttggtgttcctgataatgctgatgtcgctcttagaattgttagtcctgggttaccacccttaattaatgaatcaatgaagacaacggttcagcttctgaaacagattcaacaacaacaaaaaaatctaatcgcagctagacatggcaaggatccagaggatgaggagcattctcaaccacaagctcaaactcaagcacaagcgcaacaaccaacatcaataacaattcctgcttctggtaatcccaatacgcaaacagttcaattgcctcctcttaatcaaagaccagctcctaaatccccagtctatgcatctgatgattctgatcttaatcgtctatcaaatgttaaaaaaatgaaaagaatgaaatgtccccccaccattgaatattgggtgacagttcacgcattggtactggtaataataccaataatactaaattggcctccatcacttcatcctgcgcccattagatcctga

SEQ ID NO: 14031 - DNA, 216 bp, Candida albicans
cgttttggaggtgttgtagatgcagaggatccatttgaagttgctgaatttttacgtttcataggtacttcatcttgctgtgctgatgttttgttgttgtcgttgtcgttgttcttcgtggtggtagtggatttgttagacgatggcggtactgatgttgatgctgatgaagatggtggtgacaaagatggtgttgcagtagccgggttggtttga

SEQ ID NO: 14032 - DNA, 204 bp, Candida albicans
attgatcattattctaatactaatcaggtgaaaatttcaagaagtcaaagtttcatgcaaagccttttacgtgtttgtgatgatcaaagaattctttacagaatagaattgtgtcacgaaagtacgatttctagattccccaagcagagaaagggaagacatggcttggaggtaataacagtttccataatttttaatatttga

SEQ ID NO: 14033 - DNA, 186 bp, Candida albicans
agggttcttggcttttcacttaatcatatggtgggagtttatctcatttctaaatatagaaccttcaaccttcaaccttcaacaaaaaaaaaaaaaactgaacaaagtaataccaagaaacttgaaaaggtttggattcatattcatgtatatttaagagctcctaactatgacaagaattgttaa

SEQ ID NO: 14034 - DNA, 183 bp, Candida albicans
ttcatagcatctcgatcctttaattttatatctgtcctggttgtttccgacaagttattgaatagatatttagctgtattctggcaactgtttctagtcgagcaaaaaattagtacagatttgccattggagtgtcgatttatcacttcaatcaacttgctattcaaaaaaatgtcaaactga

SEQ ID NO: 14035 - DNA, 519 bp, Candida albicans
atacggaagaacccgtttactcccaatacaaatacccaagcttcacaggaccaaccagtagatatattacgtgacttggacaccacaacagaaaatagccgtctaagtaaccctctaaacaatgataatataaacgctatagagatacccaccaccacaaatgaacaagacactattcctaccgccgaaataataaataggataagtgaaataatagtgacagatactaaaagagcaactcaactatacaagggagttaaagataaatcgaaaagaaaactcattgggtctgaattaatcaagttttttcgtagtgataaagttaaattatcaatttggagatatataattgatcctcgaggtagaataacaagaatgagcattttaaacgtgctcaattcaattctagacacttcagataaattaaatggaatgaagattgagatattattaaattatttgcataaactttcaccgacccataatcttcacatcgaacgtgacggaccaagtatattt

SEQ ID NO: 14036 - DNA, 186 bp, Candida albicans
gtgttaagagaaataatttttcttgccgcaaaaagaaagaaagaaagaaagatagaaaataatagagtagcccagccctgtttaaagagtaaaaaggaaagaaggaaagatgatgcgagaaaggaaagaagaaaaacagaaaatgaatgtcctgataatatcagcaaggggctggaagtaccgcgt

SEQ ID NO: 14037 - DNA, 399 bp, Candida albicans
  unsure (14): Identity of nucleotide sequences at the above locations are unknown.
tccaataggccacnatcaccaataacaccaattgccataccagtaattagaattgattccaataaactggtcccatttggtggcgtccccctatctgatttatacaccaaaaaatttcaacaacaagagtttcaacaaagaacacatcaaaagcataattgtcctattcaaggaaaacaaacaaaacattctatgctggcaacattcccattgtataacactccaattagtccagaaagtaaaggaaacgttttgaaacctgggaaggacaaagatcagaatgtaaatcctggaaatgacaagagtgagagtccattattacatttatcaaattcaaagacagcatcttcatcctcatcccagtctacatcttctagtgatgttataatacaaatataa

SEQ ID NO: 14038 - DNA, 192 bp, Candida albicans
acagtagtaagtatctgtatctgtgtatataaaccaaaatttggatttgttgatataccagacactgatagttggagagaggttcagaaaaaaattttttttgtttgttctgatttgattgttactgtggaaacgaagaaacagagagagatttatcaagcgtccaatttcgacatttgcggagccgattag

SEQ ID NO: 14039 - DNA, 183 bp, Candida albicans
aaacaaaagaggggggagataaaagaagaacgatgggagaagaagaagaagggagaggaaaggataaagagaagagaaaataagaaggtggagaacaataagggaagacagtggaaggaatataaactaaagaagaaaaggaatgagagagagaacacaatggaaatatcaggaaaattatga

SEQ ID NO: 14040 - DNA, 462 bp, Candida albicans
acaatagaacttaagggtataaacttttatgataactacttagtcattttcttcctcgacattttccctctattagaattgtccctcccaaatatactaatgacgaaaaaaggacacgaatacattcaattatcaacattttcagaacacgaaaatgaacatgaacctgaatcaagttcaactacatcatcacctccaccaccaggtatacgtcaatatgaaaaacaacatgaatggaatttcacagatttacaattacaatttgtccttttacgattaggtgtaattagtgatgaagtttatcataatcagaatttttcactcctggaccctgatattcatatttccaaagaagtagaatatatgattaataaaattgatcaattatctatatcagaagcaattgaaattattcgtgatgcattagcggatcataacggggatgttaatttcttaattgaa

SEQ ID NO: 14041 - DNA, 210 bp, Candida albicans
actcctataacgataacgtatagtgcaaattgcactacccatttaattcaagaaatttttaaagagtacaaattatttccccaacaaaaaataagacaatcaagagagaaaactaaactaaaattaaatttggcggactttaattgtatgtgtgtgtgtgcgtgtgcgtcgtgtgtgaatgacccaaacggaaaaagttttttttgttga

SEQ ID NO: 14042 - DNA, 210 bp, Candida albicans
gagatactcctaaataagcaaaccaaggattttaaactacacaattcgtatggtaaaacgtgctttgagttccaaatgatagatgcgagataccaacaaaatagaactgtcgcaaatgctgaagacaatttcactgaggttcgaaatgaaaaattacttaattcaattaaaaaatttataccaaaaggtggtctggaagtgctgatatga

SEQ ID NO: 14043 - DNA, 204 bp, Candida albicans
  unsure (172),(190),(193): Identity of nucleotide sequences at the above locations are unknown.
ggcagacaattaatgcaatgtatttgttttatagatttaattaggatggatttaatagagtcattaaaaaggtttaaattgatggaaataacgatgatgattatatatatatatatatatatatttgtaagaagtgatattgataagttgttgctcccgattcgtttctttnttcagtcggcagagggcnaantcatcccctat

SEQ ID NO: 14044 - DNA, 636 bp, Candida albicans
aaatatatgatcaaaatgaaaaccgacgaagataaattaataacaaatgacaatctaatagagagtgtgccgtccaatagcaataccaatagcaataccaataatagatctaacaatgataaaccaccccgattcaaaccaagtcgtaaatttctaggcaatacaaaatatttacaattttataatcaatttgttcaagaatttttcactaaatgtcccaaattttctgatttaacatcactgataataacaacaaatggggagatatataatttacctaaacgaaagaaacataattctagaggacgtccaagaaagaatcaaaatcaaaacccacaacaaaatgatttcttgaatgatgatgatgatggtaatgatattggtggaactttatggacatggcaagaaaaagagatttttttcaatttattaaataaatataaaactattactgccatattaaataatcaacaagattggttagcatttttaccgaagaaatccatgatacaaatcataacttattatgaattattgaaaaataattataaaactttacaacgacaacaacataaacaacaacaacaacaaagaccaagacaaaattttcaccacagcgctgccgatcaatttaaa

SEQ ID NO: 14045 - DNA, 480 bp, Candida albicans
atctccaaactcaaccacaactttctcgtcatgaaactactaccattaagtttcagtttccttcttttcacatttacatttgctaaacaactccccgtttttgatggcaaaacttatcaaagctattcacattcacgtaatgtttatgcttgtcgaatgcatattcacaaaactattaaagaatgttctaccactgatatagaggattatggctgtatgtgtaccaataaagatgccatcagtacattcattcaatgttatgcctatttccaaaaaaattctactcaagccattgatttttttgtcaaatattgtgataattatggtaacatcaccaccaacatcgaccaaatcactgatgcttatgaagatttcctcaataatggatcagacacaacaactataacaaacattaataacaataataataccactaacaacactactatcaatatcttcgccacgggtggaagatccgcg

SEQ ID NO: 14046 - DNA, 456 bp, Candida albicans
  unsure (39): Identity of nucleotide sequences at the above locations are unknown.
ccccccccactggatcttctaggcccggctgaagaacanaataagatcgagttgttcaaactgaattcgagtgtattagaactgtcggagattccttacttgatcaatttagacgaactatacagtaccaacaacttaaactatgtgatatttttacctcaaaatggattgacgattaaggactcaaccaccaacagttttaccgttgaagggtttgggacaattggtatattgaatgattggagtttacagaggaacgatttgttgcctcttctcaatattttcaaagctaacttgataaagacattgaaacagtctcaaagtgcagcaccaaagggagtttccactgagatcacatcattcacacccatggatcataaattggcagtgtttttaccaattctcgggcccattgggatatcaatattgaatggcttggcaaactttgcaaaataa

SEQ ID NO: 14047 - DNA, 216 bp, Candida albicans
ttgcttgttggagtgaaatcctatatccttatccggttgcatccattcaacacctactcatttctttatgatgagatagtaagttgcacggtggggatgaatctgtgtcacaagtcaactaatacttgttactttgtgatgaactggcaagtggtacgagtgggtgaagctccttggtggaatgatattatattaaagttattggttgagaagtaa

SEQ ID NO: 14048 - DNA, 198 bp, Candida albicans
  unsure (103): Identity of nucleotide sequences at the above locations are unknown.
ttgggagtgcaaacaatcccaaaaataaaaaaacgaggaaaaaaaaaaataagctcccccgaaaaactgaaaccaaacaaacaaaaaagtaaaacaaacctcntacaaaactcttatattatatccttgttacatttatatacgccaacaaccaaggataatacatttatgtatgataatgccagaagtcacacataa

SEQ ID NO: 14049 - DNA, 462 bp, Candida albicans
  unsure (33): Identity of nucleotide sequences at the above locations are unknown.
aaccaaacaaacaaaaaagtaaaacaaacctcntacaaaactcttatattatatccttgttacatttatatacgccaacaaccaaggataatacatttatgtatgataatgccagaagtcacacataaatcaaacaatatagaagaagatgaagacaaagcatacaatcaatatgtaaatagtactgatattccagatgatcaaattatagaatcaatattttcagaacgaaaaactgcccatgctgaagatgccatcgattatgaagatatagacgaattggcagaagaagaagatgtgatggaggatctacccagggatgaggcaataaatggattaaactcaaacaacaacaacaaccacgataaagatgatgatgacgacgatgaattcaataggttacttcaagaagggcagcctgaattgacaaattcttcaccaggcgatggaaggaaatgcgtc

SEQ ID NO: 14050 - DNA, 270 bp, Candida albicans
caaaatcaaattaaatcaatttggcaatcaattgaaaatgattataaatttggtgtagctaattattggcgatgtaaacaaatattatatgaaatttggaatcaacgagaaattaataatgataataataataataatcataacaataataaatctataataggtaatttaggaaatcaaaccaataacaagaatgatactgagggtgatgaaaatttagggtttatgagtatgattagagaatatggaattgtgttaaatttaggataa

SEQ ID NO: 14051 - DNA, 225 bp, Candida albicans
  unsure (173): Identity of nucleotide sequences at the above locations are unknown.
acgtgttactattcattaagatttggtaacgaaattgactcaaaatttttgaatactttaaaaatacaaagacaacaacaccatcaattaattttacaaactaggaattttaagaatatatttacattaatatacgtaactatacatgtatattgtccccgaacccgccctcntactcattccctaccgtttcattatcttccttttcttgattactatgcctaa

SEQ ID NO: 14052 - DNA, 264 bp, Candida albicans
tcctgtccggttttgcttaaactaaacaacttttggatgcagagcccaatcaccgaggcaataaaatggccaactagtacatttcgtggttgtgctaagggtacttgcgatgcattaaaacataaaattgccgaagcaccatatgaagcaagtatcattggagcatggtgtcggtctctaaatatattgggactcttaaataccccttccaaaagtgctacaccggcaaatgttccaataagaatttccaaccaaatgaaatag

SEQ ID NO: 14053 - DNA, 465 bp, Candida albicans
ctatcaattaagtcttccagaagaagaagaagaagaagaaatctggaatcagaattagaaagtgataaagaaaatgatattgtgggagtttcaaaaactgttaatcttaatcaatcaacaccaataaagaagcttccaccaactataccttcggctgctcctgctccaattccattgagaaataaaaaactggataatttggcttgtcatgctgataatatattaagaatggccattgattcaactattataagttctaattccttcaccataaattcatttgaagaagatgacgacgacgaagagggggagggagtggatgatcatgatcatgatcatgattttttacaggaaaattctttaattcaattattaaaatataagaattcgaaaagagagttaagatttaaacctccagttattaaatttgatattaatgcagatgatattaattctgtattataa

SEQ ID NO: 14054 - DNA, 186 bp, Candida albicans
agtaccaactatagtgcagtcccttgtagaaggattaggaaatatttttcttcattggaaaaagcaagtgtttatatgggttgccatttgacctcatcaggttcaaaaagctatgcatccaacaaagaactatataactttttaaataaattacaaaaagagccagtccatgttgtttgcctctaa

SEQ ID NO: 14055 - DNA, 192 bp, Candida albicans
ctttatttctacaatatatataactactattccctctctagtacattcttaatgattatttttagggacacccaaaaagaaaaaaatatagggggacatttaccgttatttctcaatgaggaaaaattcacacacaattattcttcacgttttttatttgatctcttagtaaagtctaacatacaagtataa

SEQ ID NO: 14056 - DNA, 198 bp, Candida albicans
tgttctcaagctaaaaaaatatttctattcattatttacatttcttctattttcataaaaatttcttatcgtctaattgttagcacatttgttctcacggttgtactttcttattttattcatttcgtctattcaaattatccaatgagatttagttatgaatcaaaaaaaaactggtttattatacttgtatgttag

SEQ ID NO: 14057 - DNA, 195 bp, Candida albicans
gaatgtactagagagggaatagtagttatatatattgtagaaataaagtcagttgtaaaaccagaaacaaattttattggaaaagaaacacttataactcaactattgtctgaatgtgtgtatcttttgattttggaaagacctctaattcgatcttcaccacgggagctgccggtccgcgataagttaaccgca

SEQ ID NO: 14058 - DNA, 321 bp, Candida albicans
agtgattttcaaaagggagaaaacaatttaatatttaaaatggaattaaaactttctcaaaggattaaagttatttgtaagtctagacacattcatgtgtgtttgtgcaaaatattaatagttggaaaaatagggatatgtagcaataatatatcctttggtatttttgttgcaaccaaaaaaaaaagggaggagtctactacctataaaagcttagctggatttctttgctattttatccttctttgtttaacttacactttcacacaaacagttacaaacaagcataacttatataatgagagaaatatcattgggtag

SEQ ID NO: 14059 - DNA, 654 bp, Candida albicans
  unsure (38): Identity of nucleotide sequences at the above locations are unknown.
gcaattgcggttccgtccaggcccgtggtgaaaaccanaacttacaggtttgttttagcagcagttttgaatctagatgcaaagtcggggtccaattttgataattctactgatatgttaaagcaggttttgagattctacggattgagtagtgatagcactaaaaatgaccgtttatccttggaagacgacattttgtacttggcaagaatggttattgattttgttgacattgttggcccagaacaaagctccctgctatatgtgaactttgtcaaacagatttatgataaattgggtaaaaatcttgacttcagacttagtctaatattgtatgaaggattggttaaaattttcaatgaagataaaatcaccatgaccaaagagtttcatcgattacgagaactcgttgatagctatattaaagattatccgtttaaggaagtcccaatattcccatatcgtgtaactaggtattacggggatatgttggtgagtcggttgaaaagccatactccaactcgcgcagatgaacttaagatactccgagtcttgcaatctggtgttaaactcgagacagaccaatacaccagtgtattaaaatactttcttgagaaatttgatgatgatgacgactacttacaccaagtcttg

SEQ ID NO: 14060 - DNA, 627 bp, Candida albicans
tctccgccggcggttaaaataaatgttcaagcacaatctactcataaacaaataagtttaagaattgaaaatttgaatgttatatctactcaattagaaggtggtaataattataattataataataataatagtgatattaatggtaatggtaatttctttattaatgggaatgatcaattggatacacctgaatttaaacgtttatcatttattgaagatattgctcgacaagttgaaaaaattgattttgaaaatgatgatgataattcaaccgaattaaaaaacaaagaccatgaccatgaccgtgaccgtgaccgtgaccatgaaaatactttaacgtttgataatgccttgttttcagatattaatcctaatatagaagataatttattgggactttattcaatgacaaattcaggaatatataataattctcaaatcactagtactacaacattagaaaatattattaatgtattagtacttaatttatcaagagttaaacaacaaaattcttcattaaatagtttatcgacatttttggaaaattattattataatttaaatcaattaaatcaagattatttggatcaacaatttcaaaaaaaattactgaaaattgaa

SEQ ID NO: 14061 - DNA, 369 bp, Candida albicans
  unsure (1),(6): Identity of nucleotide sequences at the above locations are unknown.
ntgaanagggatgggatatacactccttggtcgtcatgggtcgttgcaacatcttctgactctttgcaagctaaatcggacgtgatcaagaactttattgatgccgtcaaccaaggaatccattactataacgagcacgtcgatgaggctatagaatatatctcttcgaacttggattattccgcagaagatgccaaagagtggaccaagactgttgaattcaattcaaggatcggaaagacgccattggattgggacactatcgtcgtcaagactaaggacacattaaagttggcacgcgttttggccgaatcagacgatgtcatcttgaaaagattgaattctaatgttaaaaagacaaacttgtga

SEQ ID NO: 14062 - DNA, 183 bp, Candida albicans
tactattcttcaaaaaaagataaataccaccaacgactattattatttaacgttgcaacaaaagtggttgttaatggtacaaaacgttgtattaatggtaatggtactactaatgctggttggtgtacaattcacagcctaaaatatatgtatattataatttgtgacaaatctactttataa

SEQ ID NO: 14063 - DNA, 270 bp, Candida albicans
gtttgggaaatggcaaattacacagattcagtcggcggcggcggtggtgacgcaaatgagacaagggagttaaagaggatttcaaggggtttgacggtagtagagcatgtcataatagttcataaaaactacctaatgtttcgtaaatcttataaaaatacattaactatgcaaaaaaaaaaaactcttatcatgtcttttcgtacaccttttcattgtttctatttatatatatgtatagccatacattttaggatcacattttactaa

SEQ ID NO: 14064 - DNA, 216 bp, Candida albicans
atactaatcaaattatcacttcatgacaaaaagaatccagtcattcaactcctgtatttgaaagttttgaaatgcttgataaattatttggttgactctaaaagttctttaccatttgcgaaaccggtagttaatacattgcagtcattaaagctgagacaaagctcattgttgattgaagaagtcactacagaacttttactggtgctaaagtag

SEQ ID NO: 14065 - DNA, 228 bp, Candida albicans
gtgaagacaaatgggtatggtctgaacgatttgcctacaggcagacccaaagggtctaactactggtcgggtgtagccaacttgcacttttggattgattttgaaaatgggattggtgggttttatgcggttcaggtattgccatttatggacgagtataatattgagagctacgcgaggtttgagagtgaggtgtataaggttttaggtagtcaaagtaaattatag

SEQ ID NO: 14066 - DNA, 297 bp, Candida albicans
gtagtcaaagtaaattatagtgcgaaaataaacacagcccggaaaaaaaaaaatgtacaagtaaaccacttttccaccatccatatcatgacatctcatagtgggtaccagagactagataatgtttcttcatcatcgacagtgttgccgatgcacccaccggaatatgacgacgtgcacacacccatggaacagtttgagatagacgacccccagttgccggcatctggtcttttagtcaagtttgccaacaatttcaatacaaggatattacggcccgtgacgagaattatagac

SEQ ID NO: 14067 - DNA, 201 bp, Candida albicans
tctataattctcgtcacgggccgtaatatccttgtattgaaattgttggcaaacttgactaaaagaccagatgccggcaactgggggtcgtctatctcaaactgttccatgggtgtgtgcacgtcgtcatattccggtgggtgcatcggcaacactgtcgatgatgaagaaacattatctagtctctggtacccactatga

SEQ ID NO: 14068 - DNA, 198 bp, Candida albicans
agacatgtctatgatgatgataataataatgatgggaaaacacgtagtggagatgaacaagaaattgatgaagatgatttggatgatgaatttgaagatgaagatgatgatgattattatgctgagaaatatttcgatgatggtgatgacgatgatggaggtgatgatggaggtgatgatgaagcagcattttcatga

SEQ ID NO: 14069 - DNA, 390 bp, Candida albicans
aacaaatggaaaaaaaaaagatctccaatccaaatcactagaagtctaaaccagataatgatcaccaggaaaccgtatagaatacgaagttttatcaatcgaagctattccataacaagaaacccattgaagataaatcgaaacatttccactcatgatcgatctacaaccaacgtactaaagagaaatcaaagacgattaaaagaatttgaaaataacattcaacttgcagaacagttcaagactcatagacaaaatgtggtggaaatcttaaaggatgaaaaaaacatagatgcattatttgaaaaagaagtgccaataatagtgaatgattacgagaagttaactgaggaaatgggagcattgagttttaatgatattgagatgaga

SEQ ID NO: 14070 - DNA, 468 bp, Candida albicans
tgccgtcgcttggtgaagaccggacagaagaaatccacgaattttctatcgtttcgaactgtgagaagtagtccactacgacaaccaccaattgaaagaaaacatggtatttcattagacgaagaaagcattatacaatcaaataaatcaaattctatttcagatctacctgctatatctaatgcccccagttcaccaccagcaagtatcagatttagaaatactatgagacctacaagatctattgaagatatacctaagaaggagtcaaatacaacagcagacctcaatcagcaattttctaagcattccaaggatcacaatttcagagaatttggcttttctaggtcaagtaagttgaatactcctaagtctcgtaagcttggatttcgagaattcccagaaaagaatattgtacattccaaagtatcggatgatgttgatacatatagccatagtgttttagac

SEQ ID NO: 14071 - DNA, 528 bp, Candida albicans
aacgatcaacgtcataatccattattaaaagatatttcatcccaaggtgggaatttaagaaccgttccaagatcatcatcatcatcatcatcacaaaagaagaaatcatcaaagaaacaaagacataacgatgaagacgacgaagaaaatggtggcggtgaaggatttttagatgcttctagttcaagaaagattttacaattggcaaaagaacaacaagatgaacttgaacaagaagatgaaatacaaaataaaccttcatttgctcaatcatttaaaaatcaacaaatagatagtgaagaagaagaagaggaagatgagtattcagattttgaagaagaagaagaagttgaagagatagtatatgatgaagaagatgcagaagttgatcccaaagatgcagaattatttaataaatatttccaatccaacggtgaagctaataataatgatgatgataattcatttcaaccaacaataaatttagctgataaaatcttagccaaaattcaagaaaaagaatcccaa

SEQ ID NO: 14072 - DNA, 285 bp, Candida albicans
accagaaaacatgattggaccaaaagattaagctttgtaaactcgatagctatttatttatatacatgtatctattcattatttttttttttaaaaagaagagccataagtacgtcacgtgatatttgtgtgtatacgtgtacttgtctttttcttgattcatctttttttttttttttccaccctaagttggccttgttttcatcgaataccccacttcaaggacaattattaattacattcaaccttaagtctgggtatacccattgggatcaaaaatgggcc

SEQ ID NO: 14073 - DNA, 210 bp, Candida albicans
ttggtatttttttttttcgataacctctgtggtactaaatttctctttgtattgactccatttgaaagcgccgttcccgccctgtcaaaatccgaatttccgttcacaggaaacaacatatttaaattgattaaagttagttaccaattgattaaatcaactaaccaaccaaccaaccaaatttgtttaaattcatatcagatatgttaa

SEQ ID NO: 14074 - DNA, 576 bp, Candida albicans
atacttaagcgcggatctgccagcctcggggtgagacataaatcgtttactttattcacggaaattattgataatgttccacgaatactatctcctttgagatctacaatttttgatattctttttggaaagaacaagtttggcacacgttatacaaaactaatttgcactagtcaagagtttagagagacgtattctttggagatcgaaaattatgtgaatttagttatatcgtatctaggattaaatttggttttgataacaagaaatattaacgacatcaatgttgttaatattatacaaatgactatggccctttcaagtataccaggaattccaacggaagacgagaatgttagtgagcagtttattgtgttttgggaagatttcacagaaacttatattgatgacgccgaggagatgaaaccccaatttactgcggaccaggaccaagctaactttatagccaaaagaaatgagatcttattagaagtgagccgtatttttttcaagaaagtgctctattatcctgcagcgactaaagagtttcgactgtataggaattctgtggcagaa

SEQ ID NO: 14075 - DNA, 429 bp, Candida albicans
acatataaacaaagcttggtatactttccccccatgaacagaggaatacggccagaatttaatgaaaagctaatagaactttttgaaaatgaattacgtgaagtgagacgggaggatagtttaaagattgtgaaattacaccaagaaattgaacatttgaaactgatcattaaatccaaagacgaagagattctacgattgataagagaggaacaaccacaaccacaacaactgctgaaacgtttacttctcggtgttaagttagaaaatgaaaatactaaagaattgacattttcatttaataaatattccacacacccaagtttgacagtatcaccaatcaaaaggaacaaatcaactaaaaattcaaaatttgttaaaccacatgacagaaaaccgacacgtgatattgatccaccatttgtcaaa

SEQ ID NO: 14076 - DNA, 279 bp, Candida albicans
caattcatcaccattaatgtatcaatgtttggatccactactcaatcatcaacaactccatcttttggaggatttggatccactaataataccaacagtagttctttatttggagccaaacctaatacaacaaccgcaggaacaattggaggtggattatttgggtcttcaactaaccaacaacagcaaccagcatcaggtggattgtttggtgctaaacctgcaacaggaacaatacaggtcttcaccaggcggtggaaggagcatcgcttcggggga

SEQ ID NO: 14077 - DNA, 183 bp, Candida albicans
  unsure (153): Identity of nucleotide sequences at the above locations are unknown.
attctttttttttcctattctactttttgttcaatcaatttattaatctatcaagttttaattattgttttattatcaaattctcgcaaacaattttcaattctaattatcacaacatttgatataaatccccccgtcttctaccacggagantcgccaggatccgcgcttaatgtgaaggga

SEQ ID NO: 14078 - DNA, 570 bp, Candida albicans
agacagatacttttgatggattttgagcttgatgagctttatgctttgttccccgatttgtttgaatcttgtggttctgcagttgctaccggttcaagttcaaattcaggctctgcttctgctgctggtagttctaattctggtatatcggttaataattacttgcctccgttaattattccaggaaatgatgctaataatgttcatggcaatttaggatcaaattcattagcagaagtttcatcacctcataattcagctgcaactccaatattgtcgagtaatttcgcattgccttctcaaactagaacttttaaacttagacacaatgaagaattgtttaatgatgatcaattgtattcaaacccgggaacagcaacaacttcgtgcagtaatgtcaatccatttgaatatgctagtgcccaattgtttaaattgaataatatccctagtgatcattcaaaaatcccattatggatgaagtctactatattagatagcaatgatgctcctgtgacaacaaacatcaatcagggtcttcaccacgggctggaaggaccgcaattgcgt

SEQ ID NO: 14079 - DNA, 192 bp, Candida albicans
aaaattaacttatattatcagctcaacaacaatgaaaatagaagaatgttggaagtagtcgaaatcgtgacaaaatatcttgttgttgttgttgttgtggtggtggtggtggtggtggtggtggtgatggtactggtggcgggagggaatcatgaattcaaagaagaatcgccacacatacattgtgtctaa

SEQ ID NO: 14080 - DNA, 714 bp, Candida albicans
ttaaatatgcgcggaccgttcgctcccatggtgaagatttgttcgctcattaattatgtgggaaagttaaacactccatcaaatacaaagattttggtatcaccgaaatattcacaatatttgaaagtgaacaattacaaaccatggttgaatcaattgtatgaacagaaacattttatcatatttccagctatagttgctcaaatattaagtaactatttgactcctacaaaatacaaattaaatcaacgatacttatccagtctgttgaagaaatatattttaaacccgatttggataaattacaaattaggtataaactataataggattaattggataagcctattcagaacttattgttttcaaaatgtggtgttgatgtttggtatggggttgtattttttcaagagtaaattgttagatagactttatgagaccaagcataataaggatgaggagaaagactataatacaatcattcaagactatcttgcatatgttgctcataaatctaattcatttataaatttaatatttggagttaatttgatttccattttgttgatttcgttaacgtcgccaatatttagattgttaacccccaaaaccacgacaaatatgaattggattcagctgctttatgttaatcatttgaaattgtttttcaaaagctacaccaaaataataaggtttgcaactgggtgtgattaa

SEQ ID NO: 14081 - DNA, 219 bp, Candida albicans
agtactcttccaatatatatatgtgttcttccgaattataaaaactacgtaatctttcgttcttcgcgcttttatcttattattcttgatttgtctagcaagctattaattgaattaaaaaatgtatgtccaaataaaaatcagtttaatctcaattttgaatctccatctgcaaatcattgtccatccataatactaatttctttaattgaggaataa

SEQ ID NO: 14082 - DNA, 516 bp, Candida albicans
aaactgatcagcttggcaatctttttgttggccgtggttgtcaatggattccggttacgaggtctcaattatgctagtttgtttatgcgtgattctcgaaatgagttggatgaggaggatacaaatctgttgataaagaacttgaatatcaacctcaatgatgatttctacactgcattgttaaatgtgggaattttggcaatcacactggcggggaggtcaagctatattaccgaattaagtctagttaatctagaggatgaaacttgggtagatagaagcatttgggagagattaaagtgggcaggccactcttctcgaaatggaacatcgcggggtgttgtccagtacttgcaggaaaaccaactcgttggttatggtaatgtcatagctaaacccacacaaaggttaatttcaggaaactatttgggcgattacgagagcagcaacattggtggaaggaccagcgttttgaagaaaagaactttgtatttgaaggatatgatcgtgggtttt

SEQ ID NO: 14083 - DNA, 276 bp, Candida albicans
ggaaaaatggctcgtaataataaacaacagaaatctaaatccaagaacaacaagaagaaacaacagaatcatagaaaaaatgacgatgaaggaaatgaactctccatatatgataacaaaataagagaattcgaagatgggatattagatgctagaaaatatttacaatctgatgatattaaagttgatttagatgaagaaatcgattcagatgatgcattaggatcagatgatgattatgatgttttgaattccaaattttcacaaactatttaa

SEQ ID NO: 14084 - DNA, 306 bp, Candida albicans
gaagtggttagtattcgtatattaactctattattacaaatggagagctttttcttatcaatattatacaccgaatactacatgttattgtttagtttttggagtattgtgatggtatcatatatcaatgagctgaatccacgacaaataacgaaccatatctacttttcaacattaaaactcttgggtcacgtgatggtatttaattttaggcttagagtgaaaaatcaatccatcgcagcaataaaaagacccccaacagtcttcacctcgggaggtgccagacccggcccatataaacgcgag

SEQ ID NO: 14085 - DNA, 183 bp, Candida albicans
atggataaatggtctgttgaaacagttatccgatggtcacttttttctctcgttcccgaaacatccattggtttagaggctttagaggcaattgataaacgatattctttgagttatatagatactgaggggaaatcctatcattataaaaaaatgagtaagcaaacaagcaatcaaatataa

SEQ ID NO: 14086 - DNA, 183 bp, Candida albicans
ttattgaaaagtacgaagttgattgaaaatgaatctgaaaataaatttcttttttttttgtttagcaactcatctgaatcatatacacgacctcaatacaatacttatttggtatcgttggatttgatagaattatatgcaattgacatttattatgtagatagccacataatgtggggctaa

SEQ ID NO: 14087 - DNA, 402 bp, Candida albicans
acaaaaaaaaaagaaatttattttcagattcattttcaatcaacttcgtacttttcaataactattttacaaccattacatctgacaactttttgcaacttaggtgatatgagttcagcattattgatagctaaatatttgggagctgaaaagcaagctgaattaatagagaacttactagtagatattcaaaaagaaaataccgaaaatgatcacaatgttgaagtcttgattgaattattagatggattcaatcttgataaatatcctcaattttataatcaaatattaaatttttgtaataaaaagcttttgatggaaaatgaattagaaatcatattgaaatttgtttatacaattccttacttcaccacgagcggccaggatcccaataacgaaagt

SEQ ID NO: 14088 - DNA, 489 bp, Candida albicans
cgacgtggatatcatggatctcaccgtggaggatatagaacaggtcgttccaagtatccggaagacaggtaccttgttggcgggatgctatctcttaacaaaggatcacattatgaatcaagtgataacaggtatattcctaatgaaatcggatcgaagtcacctgaaaacaggtctcatagatcaagtaccaaggatggtagaacaccatctggactaagtacgcccttgtctagtagcgacaaagtatcaacacccatttcgatagaactgattaatggttcagaccgcaacactggggtgaataataaagattctgaatttccgaaactatctcaccattcagatttcacactgactattccattttcaagatcaataaatccccagaaaaatttcatggtcataaatgattcacatacaccgaaaactgataaaggtatacaatctagacagatacggtctttaccaacggccggaaggacagca

SEQ ID NO: 14089 - DNA, 780 bp, Candida albicans
  unsure (728): Identity of nucleotide sequences at the above locations are unknown.
cgttgttccttcgagccggctggtgaagacttattaaaactgaaaggttttgaaggatttatcaaagatgttgaacattacatttccaattcggaacgttatgaaaaattatgtgccatgatggattttgaagaagaggatgaagaagttaaatatcttattttaatgagtgctcttgaatacgccaacaatgagtttaacgaagaagaattaattgcttcatttaatcaatctactgctggtgataataaactgaaagagatgacatcatcagaatcatcatcagcagcaccaccaccaccacaagaatctgagtctgaaactgaaactggtgtacttaacattgaaggagatgttattgctagacctaaaaatttcggtggtaatgtttctcaaattgtttctttacaattgattaacaataccaatgaaacaattcaaggtggtgaattattatttgaatttttcaatcaagaacaaactatcccggtcaaagttaaaaatgctagtgacattaaaccagggagagtcaaatattatcatttaggtaaactccctgaagaattcaaaaagactgatgccgataataacgtacagttgagaattacatcacctaatgcagtattattgggtgattataaatttaatactgattcaatgttaaaattacgaataattgctgaatccaaaataaccactactttggttgttagtggttcaactttacnaaaagaagactcattaattttacaccaaatgatgaagttcaagtcactttag

SEQ ID NO: 14090 - DNA, 207 bp, Candida albicans
attgttattgataaatttttatcaatagaattcaatgggaatggtaacaaactcaaattacaaatccataataaagcaaaaaatgttataaactcattggcttttgtggttgttgttacaattgatagtattttattgattaaatataaatcactagggaaatataaaattatatttttcatttgtcgaattttggccaaattataa

SEQ ID NO: 14091 - DNA, 540 bp, Candida albicans
  unsure (517),(535): Identity of nucleotide sequences at the above locations are unknown.
gttttgtggaggctaacttgggtatctgaaaataacaatgcattggattcagccaacctcaatgaaataattaaaaggaaaggtgattttgaacctggcacaaacacaatactgtttgataatgaattaggaagaaatatccgagaattattgagacaaaataaatattcgagcaacaaggaaaccttccctctttggttaagagaacaaatgatgtatacatttggtcaagctggactctgggataggttttggagagattggcaatctattctacagtcgttaaacaaaactaatgaacggatttacttttgggttgtcacagctttatttctttccaaagttgacaacagagacgccttaagacacttgttcacaaagtattggagcaacccttctggtgcatcctttgttgctgactatactaccaataaccatcaattcaattcagataatgaaagaatggccctcaaaaatgttttggtgcagattggtggaacgtatcgtcttcacttcngtagtgaccggtccgccnagtag

SEQ ID NO: 14092 - DNA, 354 bp, Candida albicans
ctctttgcctatttggttatctggagcaaattgcatgttgtgttttccttgattataaataaattaggtttgataattaagaatgatgacccaaatgatctaaagattggttcagatgtattattttattttttttttctttcggctttgttttttaattttttcaactttttttttttgcaagcctatactagtcttgccctcatcaatacagtgtatcatacaacaaggacgtgtacacggggagaaaaagaaaacaaatatgacaatcatcatctcttaatttaccaccacatcaacaagctttataacttgtccttagagtttttagttaaaagcctacattatctatca

SEQ ID NO: 14093 - DNA, 252 bp, Candida albicans
  unsure (217),(220),(228): Identity of nucleotide sequences at the above locations are unknown.
tttatttataatcaaggaaaacacaacatgcaatttgctccagataaccaaataggcaaagagttacagcaaaacttgattcaagaaatacaaaggcgtttcaataaaccggctgatgatgccgtagatattgctgagtatatcatctacttgattgtggcaaaaaagagcgaacaagaaatagtcgcagaagtcaaagatattgccgacacatccnatnttcacttnggacgacacgcccaaaaagtagaa

SEQ ID NO: 14094 - DNA, 456 bp, Candida albicans
ccggctgtggtgaaaaatggcagatttcagatctcaagaagagaatataatgaagaatctgataatgattttgatgctaatgaatggaaaggtgtagaaagtgaaggtgaaaaccaatctagtgacgattccgaagaaagttcaagtgatgaggacgaagaaattcaagaagacgaagaagaattggctaaacaatataaaaaccaagaagttcattttgaaaaacatttccaatttgacaaagtgattaaattcaataagattcaagctagattcgttggtgaagatgaactagaattaataattccaaatgaaaacaaaactgttgatgatggtaactgtgtttcaattgatgttgaaccacttcaagatgacgatagcagcattacagatgaaattgataatacagttgcaatcccttctctcaaggaagttgaagatgtcataatggaatag

SEQ ID NO: 14095 - DNA, 282 bp, Candida albicans
ctttttgcaattcaaactaattcaaaccaaatttcagtgatcctcttatcctcatctaccaactcaaggaaaggagaaaatacaaatattgtgaagttattagaaggattgtttgaaccttttatactttttattggaaacaaagtggtcatagacttacaaaagaagaataaattatcccattacaataatttgtcttgtattcaacaagaaacgagaacaaaactgaagcataaagtgtgtaaacgattaatcgaagccattactccccatatcgtctga

SEQ ID NO: 14096 - DNA, 504 bp, Candida albicans
acaacaacaacaaccaatggatcgataaatgagtctaatgatactttgcaattatctggaacaccatcaccaaagaaaccaagcactgtatctcctgtccgtggtcatcaaaaatcagcttcaatatcgaattcatactcttcagctagtattgcattgaaagcagtcgttcatgaggaaaatagactccacaatcatcaacaactgcaacagtacataccgagatcatcgacaatatctacaattgtggaaagtcctactaaagctaacacggcaacagaaacagagacaaaagatggtcacaaaatattattaccaccaccaagtaaagatgcacaaaaattgcctcatgccgcaaagaagccaagaccaacttcatatcacccatcttcaatgtcttctgctttaatacacaacaaccaaaatcctactgatgtttttaagattcggactcccataaatttttaccacagacggacggatccatataagttaaccgaaggg

SEQ ID NO: 14097 - DNA, 243 bp, Candida albicans
gtctttagtattgttgttgtttgttatacatttgattgggaacgattatatggctctcctgcatataaacataacacgttggagaaaaatgagaaaaaagagaacaaaaaaaataaatacttgaaagaacacgttatcaagttatgttgttgttgttgttgttgttgtttgagacttattgttgtaattgacatattttatattttgattgtggtatctttactactactactactattctaa

SEQ ID NO: 14098 - DNA, 507 bp, Candida albicans
  unsure (9),(10),(11),(12),(36): Identity of nucleotide sequences at the above locations are unknown.
atcatcttnnnngggtctggctcctacgaagtgaanacgtctgcagctagtgctgtagcaccaggtttaccattgacaggaggaagcaatgcatattttgcaggaatgcaacaatcacccgtgggtggttcgtatgtcaattatccagcccaagtatatcagcagtatcaacagttccaaaatcaactacaactacaagaacaacaacagcaacagcaacagcaacagcaaaaacaacaatctcagccgcagccatcatcgcaactggttggaaatcaaaatgcacaattggaatcagtagcacgattccgttctggtttaccgacagggacacaatttaataatggtgaacaaacaccaatttcaggattgccatcacgatacgttaatgatatgttccccttcccatctccatcaaactttcttgcacctcaagattggccatcaggtataacaccaactactcatctaccacagtattttgtgaatatgccattgagtggaatt

SEQ ID NO: 14099 - DNA, 204 bp, Candida albicans
gttagtatatcagttgggtgttggtttttaatatttaaaaaaaaagaaggggggaaattaaaagaaaaaggaaaagttattattattttgaaaattgttgttattaaatgtattgtgtgtgttgtgtgtatgtttgtgtgctttttgttcaaaaaaaaaaaacagcaaaatcaagaattaatttttcgtttgttgttgcaatga

SEQ ID NO: 14100 - DNA, 189 bp, Candida albicans
agacgaaatgatcgtgataaaatttggttatcattatcatttgatgaattgaaattgtcaatacttcaaaatttggaaattaaaaaatttaatggtattgctgatttattatttaattctttgaaaagtttagctgataaaagaagtcttgataaaaacaatgaatctacaaatagtagtagtagttaa

SEQ ID NO: 14101 - DNA, 348 bp, Candida albicans
tggaagaaaattgatattgttactagagatgatccaattactggattaaagaatccagcattatcttataatgatgataatgatgatcaaggtgatgttttcagtgataatagagaaacattaaaacttaatgatgattataattatgcatcaattggtcaaaaagatgaatattatttaggagattatagtaatagtatagtttctgaagattggaataaaaaaaaagaacggaaaaccacacctcacattatattattattaaataatgatttatttatttttaaattaactactactactatttgtagattcattgtttttatcaagacttcttttatcagctaa

SEQ ID NO: 14102 - DNA, 537 bp, Candida albicans
ctctccgagcgatgtcctttcagaggcgtggtgaaaagtaatactcaagaaaaatttaaattaattattggtaattataatatatttaatgatgaaggtatattattaccatcaacacccaaaaaattacagaaatataaattaccttcaacacctttaaaatcaatgaaatataccaacaacaacaacaatagtgagataatcaagccaaattcaaattcattggtggctgaatcagagtcaggattatttcaaggaatgatattttgtataactagtattgatggagatagaaaattacaattaaaatcaatgattgaaactaatggaggtatattatgggataaagaaattcatgaattatttctgtatcatgaacgagaacgaaaacgaaaacgaaaacaagaacaaccactacgaaaagggtcagaaatttcaatttcattgtacttatcatgtgatttagaaatagttgaaacatataattttattgcattaataagtaataatttttgtcgaagtgctaaatatgtacga

SEQ ID NO: 14103 - DNA, 195 bp, Candida albicans
tcgaatacaaatagattaacaccatgtttcaatactttaaatgctaatgggttaccatctcaaggtttagctttaacccctacaagttttaatatgaatgattatgtgacgtttttcactccttcaccaggtggtgcatttaataagaatttattaaagactcctgatttccataattcattactgaaaaagtga

SEQ ID NO: 14104 - protein, 243 aa, Candida albicans
RYNTPIIYLIELTINDVSKSGFGYNPSIGPISNTITLESSLVLLNKRTISLTPTSSDSIYDRNIITKKPHEINLSSLSFLFCEIISWAHSNSKGIQDLENRLNGLGYQIGQRYLELCKIREGFKNSKREIRLLEMLQFIHGPFWKLIFGKTANELEKSQDLPNEYMIVENVPLLNRFISIPKEYGDLNCSAFVAGIIEGALDNSGFNADVTAHTVATDANPLRTVFLIKFDDSVLIRESLRFG

SEQ ID NO: 14105 - protein, 176 aa, Candida albicans
QFSHSIFLPVYSMSSTQFPTLTLEEFKTAIQDISQFELESKKNQQKHFIFKLIDTNNELWQEINNIKQLQDLSSFENKENLILYQETLWENKHSLLEQIARIESINDELIRRNLISEQDKLQEKTKLMEEINKKDIENETQQKDGTEGKEEEEKANGEGEDEGEGEGKGEGEGVYL

SEQ ID NO: 14106 - protein, 401 aa, Candida albicans
STSPIKPIALAAFDLSLYKDGAGNLPIRHKLATQIAKCLFTYGFIMVTNHGFPHDKLEFLTSLAHGILEVPLESLKPYLAGAFKSDLEDRSISLGAERGAGYKPNKYWSMRNGVEDSIIHYNFNNMQHPLFFQGSGNANNNNQYPPIVQDHLSQVAEYYRYLHNDVLRKLCNLTDIVLELPEGFIWDNYYKVTPNDYENSGGGAGRFMLYEGMDPQDREKVGDTWLRGHSDSGGFTFITSQPILSLQIRDYFTGEWNYVGHTPDGLIVNIGDAMEFITGGYFKSSIHRVVGPPDDQKEFRRLVLIYFCKPKSTCILDPEPLQSPKLNRLGIGKPKEWEKIDFAAWNNEKSRLFGKKNVNDTQSEEPKLVLLYGRLHERWHQAETDFSLEEAEKKFQVIKLT

SEQ ID NO: 14107 - protein, 129 aa, Candida albicans
CLCQPHLVDVEQPGVGETLFNTIQSADVDIRSSLYKAIVLSGGSSMYPGLPSRLEKELKQLWLTRVLQGDASRLDKFKVRIEDPPRRKHMVFIGGAVLANIMADKDHMWISKQEWEEQGPRVLEKLGPR

SEQ ID NO: 14108 - protein, 336 aa, Candida albicans
SYPIEHGIVNNWSDMEKLWYHTYTQDLKTQSEDHPLLITEAPLNPRSNRNKMCQILFENFNIPCIYISIQAVLSLYASGRTTGVVIDSGDGVTHVVPVYEGFALPPSIKRMDIAGRDITESLAFNIRRMTGVALQSSSELEIVRLIKEQNCFISKDPVRDEKKYGSHYSRNNPNNELMSTYKLPDGHEIQLGVERFRATEILFNPQLIGHESPGIHELTSLAIAKTDLDLRSTLYQNIILSGGNTLLKNFGDRMLKELKDLQQPLQEDQKMSIWNKNVQNDVYNTKMKVKIYAPPERKYSTWIGGSILAGLSTFKKMWVTSEEYHENPDIVHVKCM

SEQ ID NO: 14109 - protein, 377 aa, Candida albicans
PIFIEEVAALVIDNGSGMCKAGFAGDDAPRAVFPSLVGRPRHQGIMVGMGQKDSYVGDEAQSKRGILTLRYPIEHGIVSNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHGILRIDLAGRDLTNHLSKILSERGYSFTTSAEREIVRDIKERLCYVALDFEQEMQTSSQSSAIEKSYELPDGQVITIGNERFRAPEALFRPADLGLEAAGIDQTTFNSIMKCDMDVRKELYGNIVMSGGTTMFPGIAERMQKEITALAPSSMKVKIIAPPERKYSVWIGGSILASLSTFQQMWISKQEYDESGPSIVHHKCF

SEQ ID NO: 14110 - protein, 613 aa, Candida albicans
NMSSFNSNSNPANAQNLSSFQFQPPKEDVIFDTHQMLLSVPQLRYYASSMMQQSQQGQPQSQTSQQQQQQPFLMNIPPAFTQTQPQQMLYAMPPLQTQQPSSSSATTNNVVPPHHYNQQQLQQQQQQQQQYQQMQPQPNNMQFFDNTIPNYLIMNQTISPSQTQTTAQPNISYYNYSTQPQLQLAQPISHSQPQPQPQATQPRSNRSRLQTSFSKPRGSRQVSGSGRSTGAKKQSAITLGSTGTGPARNADTGMTSVANSTSTTTMTTTNNNNKLSVSAPVNVIYANLPERLQQVLPAPPLSRAPVRPDVTVNLTSKRAKRKSKFTPEQDDMIVNLKKKGKSWVEIAEITGVGSYLAARNRFQVIVGQQGNNNSSAWDNTDKLFLNQLLDAGEIEKWRFICCELNKLTNKNFTDYECREMIRQLFWLNPASFGVNEETIIESQKEKKLTEKTIEQREQQRKKRASANHSPPDSDSITNTNNNQQEVKYIDPQYKNYQSQLMPNQNTGSGATKISSTTPPPPSQALSNNVNTMNKNIVSSALGGTSFSQEQHSLHSNQHHHNHQQHPLIHHHQYQQQSSLPPPPTIPSTIPTSSLSIQQQQQQQQQQLYNKQFY

SEQ ID NO: 14111 - protein, 175 aa, Candida albicans
GIKHIESWYEYFNANNVKSEERLKNYKVEVWGRQLNVPICSPHYVAQFTFHELCGTPMAAGDYLALAQSFQSFIITDIPYLSIDVRDQVRRFITFLDAIYDNHGRIAVTSANSFKDLFVEPENIEKDNYYELHQKKKEQIETDPSSEEEEEEEEDEEDDALVSSPTGAARYRNSI

SEQ ID NO: 14112 - protein, 239 aa, Candida albicans
QKKKERERKKKSVPSLKTNLRSNCFFYQLYTINPPSATDIFFIEYHPINQTQLNMAKKKSKLKSSSPKPKVSSTAAKPVEIDNQQNIENVQDSPLALQQQSATAEESENTATTATPLEGTTATTESSPVTTSNETDPIELSVLDNADHAIDSNSIKSTEAVLETLDSELNTIADTKTEPPTEQELNPTLAKYMRSCQEGNLTIVKELISSGQVLVNDTFSDEITGLHWACINNRLSLVK

SEQ ID NO: 14113 - protein, 464 aa, Candida albicans
KNRNCFQKLGKKLLIETGRDPEINWALLKPWVLAKLGKIITFLTPYFLLPLLFNVLSMGGDQGGFIIPKLILAIGILGGGIYLLNKLIISQYIFDDKKLAKSPILAGVFSATAFWSVLVWLYNILPTTFIHNFFANVIMAILIAIFTWSFFKAMFINPGFVPTPADNNVILSQVAQLIELGKFDTDHFCVNSFVRKPLRSRYSKHNKRLIARFDHSCPWVYNDIGVRNHKIFITFVYSLNMAIFVFLYLSLQYFDKVKDQYDSDDEGEGEGFVCSILGDDMCYGYKNHHFHFNVFMWDLFQCVWVSFLCIVQTFQILKGLTTWEFSSLNKQLQTNRFNHSTVPRDFEAGEGISLDQTQPSDGQHRHNHNEFQTCMNLLGIDQFILTLKMSLKSLFSNTRHGNNNTNYDPLTSLHIPTDHGIKQNWLDFWIIGEEKWRNVFYLPIDGENNLNGKVVDYYTLYSYH

SEQ ID NO: 14114 - protein, 426 aa, Candida albicans
TQLSPPPSIGPNSKPTTNTVIVPPGGTDSVIIREPPNPTVTTTEYWSQSFATTTTVTAPPGGTDSVIIREPPNPTVTTTEYWSQSYATTTTVTAPPGGTDTVIIREPPNYTVTTTEYWSQSYATTTTVTGPPGGTDTVIIREPPNPTVTTTEYWSQSYATTTTVTSPPGGTDIVIIREPPNPTVTTTEYWSQSFATTTTVTAPPGGTDSVIIREPPNPTVTTTEYWSQSYATTTTVTAPPGGTDSVIIREPPNPTVTTTEYWSQSYATTTTVTAPPGGTDSVIIREPPNPTVTTTEYWSQSFVSTTTVTAPPGGTDSVIIREPPNPTVTTTEYWSQSFATTTTVTAPPGGTDSVIIREPPNPTVTTTEYWSQSYATTTTVTAPPGGTDSVIIREPPNPTVTTTEYWSQSFATTTTVTCSAPGAERN

SEQ ID NO: 14115 - protein, 100 aa, Candida albicans
  UNSURE (5),(29): Identity of amino acid sequences at the above locations are unknown.
YPRFXDTAGGGNCNGCTATTNIQGGNNEXGNQPGTNTTGDLLGITDTQSVESISQPTTLSQQTTSSLISTPLASTFDGSGSIVQHSGWLYVLLTAISIFF

SEQ ID NO: 14116 - protein, 448 aa, Candida albicans
GTTTEYWTQSYATTTTVTAPPGGTDTVIIREPPNPTVTTTEYWSQSYATTTTVTAPPGGTDTVLIREPPNHTVTTTEYWSQSYATTTTVTAPPGGTDTVIIREPPNYTVTTTEYWSQSFATTTTVTAPPRGTDTVLIREPPNHTVTTTEYWSQSYATTTTITAPPGETDTVLIREPPNHTVTTTEYWSQSYATTTTVTAPPGGTDSVIIREPPNHTVTTTEYWSQSYATTTTVTAPPGGTDTVLIREPPNHTVTTTEYWSQSYATTTTVTAPPGGTDTVIIREPPNHTVTTTEYWSQSFATTTTVTAPPGGTDTVIIREPPNHTVTTTEYWSQSFATTTTVTAPPGGTDTVLIREPPNHTVTTTEYWSQSYATTTTVTGPPGETDTVIIREPPNHTVTTTEYWSQSYATTNTVTAPPSGYDTVIIRETPNHTVTNNEYWSKQLPQPHS

SEQ ID NO: 14117 - protein, 240 aa, Candida albicans
FRRRGENPSREDITTSQPTGDNGDNTSSTNPVPTVATSTLASASEEDNKSGSHESASTSLKPSMGENSGLTTSTEIEATTTSPTEAPSPAVSSGTDVTTEPTDTREQPTTLSTTSKTNSELVATTQATNENGGKSPSTDLTSSLTTGTSASTSANSELVTSGSVTGGAVASASNDQSHSTSVTNSNSIVSNTPQTTLSQQVTSSSPSTNTFIASTYDGSGSIIQHSTWLYGLITLLSLFI

SEQ ID NO: 14118 - protein, 501 aa, Candida albicans
PYDPTVTTTEFWSESFASTTTVTNPPDGINSVIVMEPYNPTVTTTEFWSESFAITTTVTNPPDGRNSVIVMEPYNPTVTTTEFWSESFAITTTVTNPPDGTNSVIVKEPYNPTVTTTEFWSESFASTTTVTNPPDGTNSVIIKEPYNPTVTTTEFWSESFASTTTVTNPPDGTNSVIIKEPYNPTVTTTEFWSESFASTTTVTNPPDGTNSVIIKEPYNPTVTTTEFWSESFASTTTVTNPPDGTNSVIIKEPYNPTVTTTEFWSESFASTTTVTNPPDGTNSVIVKETYNPTVTTTEFWSESFASTTTITNPPDGTNSVIIKEPYNPTVTTTEFWSESFASTTTITNPPDGTNSVIIKEPYNPTVTTTEFWSESFASTTTITNPPDGTNSVIIKEPYNPTVTTTEFWSESFASTTPSVSSFESTIFHSSEPHYSSDFDSSDSFVTLISVTTASSYDESSTIVSSTFPTLHLSSYTWSSGLGSTRHFSALCQHHNLQFANI

SEQ ID NO: 14119 - protein, 154 aa, Candida albicans
RELPGSSESFSYTKTCTSTSITVEFQNVPAGYRPFVDAYISAENIDKYTLTYANEYTCENGNTVVDPFTLTWWGYKNSEADSDGDVIVVTTRTVTDSTTAVTTLPFNPSVDKTETIEILQPIPTTTITTSYIGISTSYETLTGTIGGTATVIVD

SEQ ID NO: 14120 - protein, 171 aa, Candida albicans
TDTVIIREPPNYTVTTTEYWSQSFATTTTVTAPPGGTDSVIIREPPNPTVTTTEYWSQSYATTTTVTAPPGGTATVIIREPPNYTVTTTEYWSQSYATTTTVTAPPGGTATVIIREPPNYTVTTTEYWSQSYDTTTTITAPPGDTDTVIIREPPNHTVTSFHQPDEPTCGE

SEQ ID NO: 14121 - protein, 522 aa, Candida albicans
APPGGTDTVIIREPPNHTVTTTEYWSQSYTTTTTVIAPPGGTDSVIIREPPNPTVTTTEYWSQSYATTTTITAPPGETDTVLIREPPNHTVTTTEYWSQSFATTTTVTAPPGGTDTVIIREPPNHTVTTTEYWSQSYATTTTITAPPGETDTVLIREPPNHTVTTTEYWSQSYATTTTIIAPPGETDTVLIREPPNPTVTTTEYWSQSYTTATTVTAPPGGTDTVIIYDTMSSSEISSFSRPHYTNHTTLWSTTWVIETKTITETSCEGDKGCSWVSVSTRIVTIPNNIETPMVTNTVDTTTTESTLQSPSGIFSESGVSVETESSTFTTAQTNPSVPTTESEVVFTTKGNNGNGPYESPSTNVKSSMDENSEFTTSTAASTSTDIENETIATTGSVEASSPIISSSADETTTVTTTAESTSVIEQQTNNNGGGNAPSATSTSTSSPSTTTTANNDSVITSTTSINQSQSQSNSDTQQTTLSQQMTSSLVSLHMLTTFDGSGSVIQHYTWLCGLITLLSLFI

SEQ ID NO: 14122 - protein, 232 aa, Candida albicans
KIISIRDRKVKNNDSVDIDKKKYIKGIYFHAEGRVLQSFHFCCLKTLNHQEFQMLPQFILLFISLTVSTAKTITGVFNSFDSLTWTRSVEYVYKGPETPTWNAVLGWSLNSTTADPGDTFNLILPCVFKFITTQTSVDLTADGVSYATCDFNAGEEFTTFSSLSCTVNSVSVSYARVSGTVKLPITFNVGGTGSSVDLADSKCFTAGKNTVTFMDGDTKISTTVDFDASPVS

SEQ ID NO: 14123 - protein, 1060 aa, Candida albicans
SLKRGPPSPVVKNVGGTGSSVDLEDSKCFTAGTNTVTFNDGGKKISINVDFERSNVDPKGYLTDSRVIPSLNKVSTLFVAPQCANGYTSGTMGFANTYGDVQIDCSNIHVGITKGLNDWNYPVSSESFSYTKTCSSNGIFITYKNVPAGYRPFVDAYISATDVNSYTLSYANEYTCAGGYWQRAPFTLRWTGYRNSDAGSNGIVIVATTRTVTDSTTAVTTLPFDPNRDKTKTIEILKPIPTTTITTSYVGVTTSYLTKTAPIGETATVIVDIPYHTTTTVTSKWTGTITSTTTHTNPTDSIDTVIVQVPLPNPTVTTTEYWSQSFATTTTITGPPGNTDTVLIREPPNHTVTTTEYWSESYTTTSTFTAPPGGTDSVIIKEPPNPTVTTTEYWSESYTTTTTVTAPPGGTDTVIIREPPNHTVTTTEYWSQSYTTTTTVIAPPGGTDSVIIREPPNPTVTTTEYWSQSYATTTTITAPPGETDTVLIREPPNHTVTTTEYWSQSYATTTTITAPPGETDTVLIREPPNHTVTTTEYWSQSYTTTTTVIAPPGGTDSVIIKEPPNPTVTTTEYWSQSYATTTTITAPPGGTDTVIIREPPNHTVTSTEYWSQSYATTTTVTAPAGGTDSVIIREPPNPTVTTTEYWSQSYTTTNTVTAPPGGTDSVIIREPPNPTVTTTEYWSQSYATTITVTATPGGTDTVIIREPPNYTVTTTEYWSQSYATTTTVTAPPGGTDTVIIREPPNYTVTTTEYWSQSYATTTTVTAPPGGTDTVIIREPPNYTVTTTEYWSQSYATTSTITAPPGGTDTVIIREPPNYTVTTTEYWSQSYATTTTVTAPPGGTDTVIIREPPNYTVTTTEYWSQSYATTTTVTAPPGGTDTVIIREPPNYTVTTTEYWSQSYATTTTVTAPPGGTATVIIREPPNYTVTTTEYWSQSYATTTTVTGPPGSTDTVIIREPPNPTVTTTEYWSQSYATTTTVTAPPGGTATVIIREPPNYTVTTTEYWSQSYATTTTVTGPPGGTDTVIIREPPNPTVTTTEYWSLSYTRLSSANAGRSTLG

SEQ ID NO: 14124 - protein, 109 aa, Candida albicans
RLEDSTATLSSITAANQDSLNPSSVSKYPHGSETIDNGSNGSSHSSSALAYTISASHSIKFSAHQTTLSQLLISSSTKTVIASTYDGSGSVIKLHSWFYGLVTIFFLFI

SEQ ID NO: 14125 - protein, 511 aa, Candida albicans
PSITKTFQMLLQFLLLSLCVSVATAKVITGIFDSFNSLTWTNAASYSYRGPANPTWTAVIGWSLDGATASAGDTFTLDMPCVFKFITDQTSIDLVADGRTYATCNLNSAEEFTTFSSVSCTVTTTMTADTKAIGTVTLPFSFSVGGSGSDVDLANSQCFTAGINTVTFNDGDTSISATVDFEKSTVASSDRILLSRILPSLSQAVSLFLPQECANGYTSGTMGFSTAGTGATIDCSTVHVGISNGLNDWNYPISLESFSYTKTCTSTSVLVTYQNVPAGYRPFVDAYVSATRVSSYAMRYTNIYACVGAASVDDSFTHTWLGYSNSQAGSNGITIVVTTRTVTDSTTAVTTLPFNSESDKTKTIEILQPIPTTTITTSYVGVTTSYLTKTAPIGETATVIVDVPYHTTTTVTSEWTGTITTTTTRTNPTDSIDTVVVQVPLPNPTVTTTEYWSQSYATTTTVTAPPGGTDSVIIREPPNPTVTTTEYWSQSYATTTTVTAPPGGTDSMIIR

SEQ ID NO: 14126 - protein, 386 aa, Candida albicans
PPNPTVNTTEYWSQSYATTTTVNAPPGGTDSVIIREPPNPTVTTTEYWSQSFATTTTVTAPPGGTDSVIIREPPNPTVTTTEYWSQSYATTTTVTAPPGGTDSVIIREPPNPTVTTTEYWSQSFATTTTVTAPPGGTDSVIIREPPNPTVTTTEYWSQSYATTTTVTAPPGGTDSVIIREPPNPTVTTTEYWSQSYATTTTVTAPPGGTATVIIREPPNYTVTTTGYWSQSYATTTTITAPPGGTDTVIIREPPNYTVTTTEYWSQSYTTTTTVTGPPGGTDTVIIREPPNYTVTTTEYWSQSYATTTTVTGPPGGTDTVIIREPPNYTVTTTEYWSQSYATTTTVTGPPGGTDTVIIREPPNPTVTTTEYWSQSYATTLTITAPP

SEQ ID NO: 14127 - protein, 678 aa, Candida albicans
ITLKISYLLFNYCRPHQVFFNINLSNLFNYTMERLSQLAIQTTNSSAAPAAPGHPLDPLSPAEIKSVSNIVKSKFPNKSISFNTVTLKEPIKRAYYEWKEKKGPLPSRLAYYVVVADGDSGVHEGFVDIGAQELIEIKHTEGVQPILTPHDLQVTEEIIRNDPEVQRQCELSGVPPNSMHQIYCDAWTIGYDERWGASRRLQQALMYWRSDEDDSQYSHPLDFCPIVDMNAKKVVFIDIPQRRRKVSKHKHSSFHPKHVADKYGSKENPSGYRQEDFPINITQPEGVSFKLDNHVMSWSNFNFHIGFNYREGIVLSDITYNDHGNVRPLFHRISLCEMVVPYGAPDFPHQRKHALDIGEYGAGNMTNPLALGCDCKGVIHYLDGHVVDRSGDAATIRNAICIHEEDDGVLFKHSDFRDDFQTTVTTRGKKLIISQIFTAANYEYCVYWILRQDGTIKLEIRLTGILNTYICADGEDIGPWGTVVYPNVNAHNHQHLFSLRIHPRIDGDNNSAATSDAKPSPFPTGSTQNMYGNAFYCEKTTFKTVKESITNFESATARTWDMYNPSSIHKYSGKPATYKLWSTFCSPLLAQEGSLVKKRAPWAASHTQVVPYVDDKLGYGRLYPSGDHVPQWSGDGLRRMREWIGDGTDKVDNTDILLFHTFGITHFPAPEDFPVMPT

SEQ ID NO: 14128 - protein, 81 aa, Candida albicans
YCDPAVASEDSRTFPVMPTEIFDLQLRPRNIHTENPVLDVKPSYARTTSEVKAGAKGVDTCTLNVDKSSRLAFDDGSCCKK

SEQ ID NO: 14129 - protein, 275 aa, Candida albicans
TFIIWLNLVKTWFNWGGDNYADYNMMYLSILQALSMGLSGIPFFGVDACGFNGNTDMELCSRWMQLASFFPFYRNHNVLGAIPQEPYVWEGVMNATKTSINVRYSLLPYYYTLLHESHVTGIPIMRAFNWQFPYNKELAGVETQFFVGDALLVTPVLEPGVNHTKGVFPGENVVYYDFYTHKKQKFTAGKNETLAAPLGHIPLHIKGGNIIPTQEPGYTTTESRKNPFGLLVALDAEGTASGKLYLDDGESVDVEEALYVDLVASKYKLWPLFRV

SEQ ID NO: 14130 - protein, 449 aa, Candida albicans
QNSFVLYLLNQDKPNQQNMKLLSKFIVTALGLTLIVSAAPTSSSSAENAQKTVPTELTLGVKQVPNILNDTAVDANVAAKGYSLVNVTLTGRGLTGILKLKEATNIYGYDFEYLNLSVEYQSDTRLNVHIEPTDLTDVFVLPEELVVKPKLEGDANTFNFENSDLVFEYDEEDFGFEVLRSSTREVLFSTKGNPLVFSNQFIQFNTTLPKGHSITGLGESIHGSLNEPGVVKTLFANDVGDPIDGNIYGVHPVYYDQRYNTNTTHAVYWRTSAIQEVVVGETSLTWRALSGVIDLYFFSGPDPKDVIQQYVSEIGLPAMQPYWALGYHQCRWGYDTVESLETVVENFKKFDIPLETIWSDIDYMDGYKDFTNDPHRFPLDKYRKFLDDIHNNSQHYVPIFDAAIYVPNPNNATDNDYEPFHLGNESDVFLKNPDGSLSSPRGWADRRFD

SEQ ID NO: 14131 - protein, 545 aa, Candida albicans
TFFKKKMKFLTLTTSLSIIVSINALPTSFGFWKNWFNLGEELAQEVIMDDISDQFINNDENENNNNDNNLIIDGVIDETVYNSLPEIDTESLQSLINEKGLRSRAEDLFEIAQRSIGKYDHPTRVIGSPGHWGTIGYIISEIKKLKGYYNVKTQSFKALDGKVKSFSLLIDGVEPKSLSPFSLTPPTVDGKPAHGNLVLVDDFGCKPDNFPEFTKGNIVLIKRGECAFGDKSRNAGIAGALGAIIYDDEPVRGTLGNPTGKEVATVSVAKKDVEKYIEKLSKDPKYAFETTLYVDSYVKYIKTLNVIADSVFGDHDNIVSLGAHSDSVAEGPGINDDGSGTISLLEVATHLTQFKLNNAVRFAWWAAEEEGLLGSTYYAEHLTAEENSKLRLFMDYDMMASPNYEYQVYDANNKDHPNGSGNLKDLYIDWYTSHGLNYTLTPFDGRSDYVGFIENGIPGGGIATGAEGVKDAKGQEKFGGKVGEWFDPCYHQLCDNLDNPDYEAWVINTKLIAHSVAVYAKSFEGFPKREPKEGSCQCIQFRKTK

SEQ ID NO: 14132 - protein, 282 aa, Candida albicans
IFGRTNISLGAFIHNNFYNLPEKKTLRRSSPPRKYIDTLISPFFFRFFLPIQLTSLFSLHIMDSAYWSYDNIVPSFRLDGKLVILTGGSGGLAAVVSRALLAKGADVALVDMNLERTQQAARDVLQWGEEQMKGKYESPIGQVSAWSCNIGDAEAVDLTFKAINEHHGKISSVLVNTAGYAENFPAEEYPAKNAENLMKVNGLGSFYVSQAFARPLIQNNMTGSIILIGSMSGTIVNDPQPQCMYNMSKAGVIHLARSLACEWAKYNIRVNTLSPGHILFSS

SEQ ID NO: 14133 - protein, 696 aa, Candida albicans
ITWDHVKNGGSFKDAITNFDQYVQEHIISKKKEFSIVMFDISKLRVQLVREARDKSVVLPSYLQHPRIFDLPREYLNWQSSHPETLSYPPISLTNIITALEVEVENISEYVDLPNFSSTPSPSKASATTTTTTANVTAIDVLSSETEPNGKVIANLHAKIAKQLIKKSIPVENHPNVFTRPFDSAQDITAFTSERSKVLYLSNLPNDTTQSELESWFTQYGGRPGGFWTFKSADDNNNNNNNNSNGGKGYQNARKYGISGFVAFNTHEEAVDCLALNGRVLNDRPIEVQASSSKVFDMAMDKLLLTLFPLSKNRPRPGDWTCLSCGFSNFQRRTHCFRCSFAAVAFQDVFNSNTGNANGNGNVSGNHNHNHNSGARRGMNLQPAQANEKIGTGNISIPSYNDPIKGPTGNVTNHLNNSETNLLNNTNLNNNNHHSNNYHNNYHHHNNNNNNHGNSNGNTIHGRSHYNNSVPFRAGDWKCENCMYHNFAKNLCCLKCGVAKPAINNQQNNTIHSVNSTAAAIAAATASGQPLNLNNNAFLNLQQQQSQSQPQGQHHYNQHSRNNNASGASKFNNGYNPKNQYYNNNSKNLSNNFGLNGMHQQNQNQILMYSQQLQQQQQQQQHDLNGSSSSHQLKLQLNNTEGLYRTSGQPNLGYPSINHEVSGPATLRDVSNNSPALNSSSLNSLANHMNSLNLNQ

SEQ ID NO: 14134 - protein, 395 aa, Candida albicans
KLISLDKAMEFIKETPEGKPFFGMITYTAPHWPYQAPQDKIAKYNGVYDNGPEELRQKRLQSAKNLGLIDTNIIPHPIKTIRKSWDELTLLEKLKEIKIMQTYAAMVEILDENIGRLIDHLNSIDELNNTFILFMSDNGAEGMLMEALPLTNQRINKFIDEYYDNSLSNIGNKNSFTYYGDQWAQAATAPHAMYKMWSTEGAIVCPLIIHYPNLFSSSAVSGGGSGDGDGDGDGGKILKEFTTVMDILPTILELANVSHPGETYKGRQVVKPRGKSWVNYLINKTDQVHDENTVTGWELFGQQAIRKGSFKAIYIPKPFGPEKWQLFNIIEDPGEINDLSESSSEYQTILNELLDHWAVYAAETGLIELGSDLFEKEKIEGESNEVVYRTILDNN

SEQ ID NO: 14135 - protein, 695 aa, Candida albicans
  UNSURE (695): Identity of amino acid sequences at the above locations are unknown.
LQQVRMPPSPVCENNIDAANDLNECMTCKTRLQVAKFISLTRPDLVPQIFSTWCVESGFDEIQCHMNYGYPSEDYCTMGNDFTKMVSLMNPSGLDGDYFCYYHDKNCGVLPETPLVDMSRLWPLKPRNYLPPDNSGETFHVLHISDINLQPDYKMFAEANCTQSLCCSPHCRNLQGSAPNFNENLEGGYFDSSYSRNHFEKGSYMDITKIKKPTWRPARQFGEYNCDSPALLLNSTMQGIRDLHQNHLSFEFALFTGGTVDHSDRLFMSKTKNIISQDTSYRILKHYLDTVDVIPTFGTRDIFPMNQLPQKHLTENSNSYQWQSDFLADLWLESGWIDHESSKQVRYSQIGYSLLTSRGLKIICLNSNVWNVKNLYAFWEVLSIDSFGMWKFLIEELIESERIHQRVWIVAHLPTNHQSLPLPTRVFAQIIERFSPQVIAAIFFGHIQVDTFMIQYGGDGTDTKELESAINHALVGPLISPYLGVNPAWRYYAIDLKSFSVVNSFTYYTKLDNTFINDGAEPVWEFGYSARDVYDPEQMWPMEWCLNTEWWHHVSEKIKQVPEMDLMYQRLDTRWFSQNELDGNSYCKVTSFTMEAKKQCMLTGDQDDYVEPKQPNDYVPFIHVGSKVEYIDKQVAYPPDEEEESESEEVDEDYQPGKKIGTGENNTNVGQGLNGGGNGESDATIKFFTEPPEGX

SEQ ID NO: 14136 - protein, 710 aa, Candida albicans
HSDINKKMLLSKLFTLSVIIVGATADFHLRNQVIVNHGYSDISDEIFDNLSREDGDFINFNINKVQIANGSACDKCKSRIINAKNLVEQNPDKEHLVGLLLFKNCLNTQWREACQWTDFFVTTSSRNEQRFNDDGPDAGISSISNVNFYDNDFLQIIKRFNTSSEYDLETYCYFKGNKACKLPATPNVTELFDLESWWPKKDSKYNKPPVYTNNSETFNVLHASDFHIQLDYKLGAEGNCTLVPCGTSSSYSKDAPGKAYNFTDYYKSFNSDVSGNDISFYPDSHYDENAKFSKGDYYDFPQYFGWSFNKAPATSFGAYLSDAPYLLVNNSIVEMKKLHQEKNFESIIFTGDSFSHNGELANPDELKFSEAAIFNLINHYLNGVQVFPALGNHDTMFRYAEVAPRIYVSNASYYWNEDYVTDLWVNNGWFDKKDADAIKTHYTGYSFTTKRGLKVIGLNSNFYYGDNLWSYGETTTKPDKFGIWKFLIDELVDSESHGQRVWILAHIPSNNYDVLPIQSHIFAAIVKRFSPYTIANLFFGHTHRTQYSVYYSTNDTSKIEDALTVSWVNPSVTPYTNFNPGFRYYEVENESFNIRNSFSYYFDLNGTFTNSGNEPTWKLEYSARESYDPKGTWPKDAPLNGTFWHSYVSKYLWNTTDTHFNQKFMNNKYRQSPLTPNCTTAKNALDNKCFNDNNCFLYFLSDDNINCQKG

SEQ ID NO: 14137 - protein, 319 aa, Candida albicans
RGRLLRGEEDGSNNWTFFETGLFWFKDELHQFDKELNFDTITNTDGLTSYITDKILELEIQIGEQLEKKSNGNDNYVVNENYFINLIKLIRYKELFTILEKLKDNESLSLLKQFKNIIKLSKYQYYRYLSINEFLSNNGKTGYSNLDDLSMDEFYYYLISTNTINITQTDNYYKICPKLYQISQSSIFPSNIIAKQLLEMITELKLRYGKDETIMPWQKVNKQEISLLPLPIYHITNDSINNYIFSFLVLVEFDNFEILMDDACFGDIYKFKQAFGLTLVEPSKKTMLYIILQDQKRIRELFNDPRIFESYRELLSKQN

SEQ ID NO: 14138 - protein, 110 aa, Candida albicans
GFFALFVPSGTPLPLVPILVLIEALSYSSRAISLGLRLGANILSGHLLMLILGSLIVNLMSSSILGFIGGIVPIVAVIAITILEVGIAIIQAYVFSILLSGYIKDSVSLH

SEQ ID NO: 14139 - protein, 66 aa, Candida albicans
GVAIIAIYDTILNLVYSQIGKAGGHFFPLIFTIFNLIFAANLISMIPYSFAISAQLVAIVSFSLAL

SEQ ID NO: 14140 - protein, 90 aa, Candida albicans
PTRDQRSRVGPTLPLCLAFLNPLYNLYPIRYLLFIMFYSPLDQFEIKPLLMVNNILTLALTNYTLYLIIVVSIIFGYTSIISNGRLGSTR

SEQ ID NO: 14141 - protein, 422 aa, Candida albicans
SREFDFLLKLDESLVNQQNLREFSPVDKAEIFQRIMKDQHQILVVDNQKKHIRDSKRLIKGTNNLSIRSATNSSFSNVHSGISASTSNTTTAAGNTNNNNNNNNNNFNNNNNNNALSGMHNLTRKTSNTSLKRQSLSYKSSSSSRFKISGLFTKSRPFSLTGNTSTPERVVNIEELPNPEDSIEPKQKPVVVIPLKNRKIFPVYLMPLCFKIDSETTNDHYFFQATNDTDLNEWLIKLNYANRHWFYSRILNNKTTNNNLVFGVPISFICVRELSVVPKFLEAIFQEIESEGIKDVGIYRISSSISELTSIKQTIDRTGTINFNDRGYDTHALTSIVKSYFRELPDSLITDDAISQFYELKLEQENKNQTPDRDAFDLNAYQKILHSLPVVNFNTLKILVKHLNKISEHKEIYKMTHPILLR

SEQ ID NO: 14142 - protein, 318 aa, Candida albicans
KKIVKEMSSLRKLRKDFGSIEKTQELIDQDKAKIAELKKKLSATHNKEVQAQFETIQKELDAINEYNKTIISKRDELRDKRTEIKKQKDAKYEQIRKIRSDFDEKFASFKKQLAEEKKRRDEEYKQRLLEEKQQKKKEQAEKELAEASIPAFTEEINSIHTLLSYFDPSYVKPTKKTETNGALPINNNIRKVEFPEDFVVIKKEQEEFFAGTKGKKGKQHQKKSTKHKNFTVAPEVVVALSDLTIAFPTKEEEVPETIKTLKETLTALEEKQEEQTKINIERAKARIAKLEAEEDEEEEFETTAEEKDQKVEEQSTDA

SEQ ID NO: 14143 - protein, 182 aa, Candida albicans
VYFTFFLFCLQAIMSSVKSATTSTSAAPRRREIKRPDDKAIKEEIEKLKDEIKKLDLTNNEIYAQIAKAQIDQKVMDKRNKLQTELKSLIAKQSQGKNERQLINDQIKAIDASMKKRIAEIQQLTSKNNFKNVAEIDSRINYLDGLIDAGNLKLADERRLSRKCHHYVSCVKISDQLKKLKN

SEQ ID NO: 14144 - protein, 365 aa, Candida albicans
  UNSURE (12): Identity of amino acid sequences at the above locations are unknown.
SPHMIFHPARVXDMYAYKRIDHTYACENSYLLNYLLKAELSFQGFVVSDWGAQHTGVNSALAGLDMTMPGEVFDDWLTGKSYWGPLLTRAVYNGTICQERLNDMVMRILAPFFALENVQLPLEDDVPNFSSWTHHTYGQEFPYQHYGPIVQKNWHVEARSEFSDNTALTVAREAIVLLKNSGHNLPIDKNDGVRRLFISGQGAGPDSKGFNCKDQRCVNGVLTSGWGSAAVGNPFVITPYEAVARKARERSIVVDYCRDNWDCETNADLADYADLSIVFVNSFSGEGYVYLEKNFGDRQNLSLWHNGDELIEKIADKCHKTVVVVSSTGPINMERWIEHDNVVAVLFAPPLGTICWSSNSRSLIW

SEQ ID NO: 14145 - protein, 175 aa, Candida albicans
ICFISNNTNNYFKALGGRIEGAWQKAFDKVRKLIEKMSFAEKVNLTTGTGWGSGPCVGNTGSVPRLGIPNLCLQDGPNGVRFTDFVTHFPSGLATAATFNKGLMYLRGKAMGKEHKKKGVHIALGPVIGPMGLKAAAGRNWESFGADPYLQGIGGAATVEGLQDEGSSPRVKIQS

SEQ ID NO: 14146 - protein, 312 aa, Candida albicans
FHQRGQSIWSDGLSTIMLWQYYLPHHWGQFVGQAIADLLFGDVNPSGKLPFTIARKRQHYVPIIDDLTAGDMEPQDNFDRDIYLDYRFFDKHNIKPRFDFGYGLSFTSFKVSNLKINEINPPSEYLPYPLEYLPTIKTVEDDVCDPEDALFPHDDFDPSPGYIYPYLYNENVRLIDEEDTFEYPGDFNPDQATSPPLAGGGLGGNPALWEVLYEVSVEIQNVGKIKGGYVSQLYIEFPSTLLISPPKVLRGFEKVFLESGKSTKIYFNILHRDLSIWDSESQQWIIQTGTYKIYISSSSRRVELCGEIDIGC

SEQ ID NO: 14147 - protein, 99 aa, Candida albicans
SNIYIFIYNIFNTMTDSFDIDNILSQLTLEEKIGLVSGIDFWHTYPISRLNIPKVRFTDGPNGIKRTKFFNGVPLACFPCGTGLTATFDHEIIIDHRGN

SEQ ID NO: 14148 - protein, 233 aa, Candida albicans
DSEDPYLTGQIATAIIKGIQYDNEIGATVKHYVCNDLQDERSASDSLVTPRALREIYLEPFRIAIKESNPICLMTGYNKVNGEHVSQSKFFLQNILRDEWNWQGTIISDWYGTYTSIKAIENGLDLEMPGSPIFRNKQLLTSMIKSKELHIKHLDDRVKNVLKLIKFAKQSSVVVTEDGKESSENNTQDTRDILRKLAQDSIVLLKNDNYLLPLKRDDVDFSSKFIAIIGLNA

SEQ ID NO: 14149 - protein, 514 aa, Candida albicans
IAAYSGGGSATLPAYYTTTPYNAIVEKLSSISKFDITSQLKYTIGAKAYKYLPELGPQVINPKTGKPGFSMKFYKKPKSVPNENRELFDELDTEISDILLGDYYHKDIPSNGLYYIDFECEFTPSKTQHYEFGLTVHGTAQLFIDDKLVVDNKTKQIKGVSFLNSGTIEERGSIELHQGKTYKIIVEYGSAPTFTLKDQVGEYFGGGIRLGMNEIINDDEQEIINAVNLAKSVDLVILIIGLNKDWESESYDRPDMKLPGLQDKLIESVLDVNPNTIIVNQSGTPVEFSEWLDKLKALLHCWYGGNESGNAIADILFGNVNPNGKLSLTFPLKNNDNPTFLNFKTERGRVLYGEDIFVGYRYYEKLNRQVAFPFGFGLSYTKFEFFDLKLEKKTKDKEEEEEEEESLVVSLSVKNIGKMTGSEVIQVYVSKVESDVIRPIKELKGFTKVNLQPNETKSVNLKLIIKDSVSFFDEYANQWSVQLGQYKVHVGNSSDNIPLTESFTIEKSYFWSGL

SEQ ID NO: 14150 - protein, 300 aa, Candida albicans
VANKLKLPETEQMLDYIRPDLLFLRCLAKNLIMWNEISCTDTWVASQMPSSVAHKYMSGNGHEVAFEHLDGDQLTYFNVLGGACLSMALKFASSHNLEARDTILKYLDKVMQLSAKPALNYDQKIAYKGCVNLQNILALCASVIMAASGDLEVFRRLRVLHNDTNKKMGFGCFMAINTALGFLFLGGGQYAFDSSPFAIACLVTSLYPIYPTENSEYEIHLQALRHFWALAIQPTCLIVRDISTGRPCKIPVAINMNDDSVLDSISPCLLPDIHEILTLKTNSSAHFELNLDFLLNSDVL

SEQ ID NO: 14151 - protein, 542 aa, Candida albicans
SLPPLVLVHPARPPQKLVSFQRRSVKNDTSMKFEKEEIDNQGEPNSSQSSSSNNTIVDNNNNNDNDVDGDKIVVTWDGDDDPENPQNWPTLQKAFFIFQISFLTTSVYMGSAVYTPGIEELMHDFGIGRVVATLPLTLFVIGYGVGPLVFSPMSENAIFGRTSIYIITLFLFVILQIPTALVNNIAGLCILRFLGGFFASPCLATGGASVADVVKFWNLPVGLAAWSLGAVCGPSFGPFFGSILTVKASWRWTFWFMCIISGFSFVMLCFTLPETFGKTLLYRKAKRLRAITGNDRITSEGEIENSKMTSHELIIDTLWRPLEITVMEPVVLLINIYIAMVYSILYLFFEVFPIYFVGVKHFTLVELGTTYMSIVIGIVIAAFIYIPVIRQKFTKPILRQEQVFPEVFIPIAIVGGILLTSGLFIFGWSANRTTHWVGPLFGAATTASGAFLIFQTLFNFMGASFKPHYIASVFASNDLFRSVIASVFPLFGAPLFDNLATPEYPVAWGSSVLGFITLVMIAIPVLFYLNGPKLRARSKYAN

SEQ ID NO: 14152 - protein, 78 aa, Candida albicans
FYIAPIAIHILTYNFIMHYRFLRDSFVGRVTYHLSKHKYFAHPEEAKDYIVPEKYLADYKPTLADDTSINFEEEEIDN

SEQ ID NO: 14153 - protein, 64 aa, Candida albicans
CHYSLTKQRLLNSATINPDIKPKSIDLKQDGLNIIWDQEDHESKYDFNWLRLHSYQPRLIPMDE

SEQ ID NO: 14154 - protein, 263 aa, Candida albicans
SFTRGEDNSGNSFNEHRNHHYNNNTNNNNNNNNNAATSNNYKQPQLMSKKSNDSLSSQYQYQSQSQQPKHLSGDKSRQSLTDDLDPLKANTWTPKQVSSYFALVLGFDMDVAGKFAQHKITGEILFELDLNLLKELDIDSFGTRFKLYKEIGKLKELNTEGVKDKQLRTDSLSTGSTGKNDTTSSALNSPPTASTTLHDAVPHIDDNNMLNNTGKQQTQLMPSAVLTNTSDYNNNSQQQSGSSTSSEEKVTVGGCCPTTILGF

SEQ ID NO: 14155 - protein, 96 aa, Candida albicans
LIKSSKLPSLLLLKKTNNTNMDGGDTYICIKQFNARLGDELSLKIGDKIQVLADDREYNDGWYMGKNLLTGEAGLYPKTSTQSHHGSCPNRRLLSP

SEQ ID NO: 14156 - protein, 494 aa, Candida albicans
NEEVFSVLEYLKYPKALVSIKEILRGTSSKGNTRNIDELLSQSVIDKVNEILSQYSNDIQRKNTIENSRKEIYQLIKFLTENNCQDDAIQLKKILYDASVSDTKLFALVDETYHQTLGKGIQSTEFKSLFKTVDNKSSNQDSEISLLDIIDDDDDDNTNQDKQIKNIEDYLNDLNNIKQAKFKLIEKLKKEIHNDDISDILVLNMKLKSTNEIKSIIFPEELKKFNPFTNELDKLITNEKSIIEQLKSRWNQLISNPQIKNLQTETNSKNRLIISQLEKIDQFYGNWLKYHNGLIAGEKFYNQLLDQFKNFRNNIDNQLNQGMRSLNIGQQFPTQPMLNRTQSSGLQSNYTGQSSISHSGSLSGQPSGGYNQPQPQQQQLQQQQQQQQQAQFSGAYNQQYSQPHGGYTQFQGYGQGQGQSQTGYQRQPPPPPPQLPPKQSMGSYNFATTLQQQQLPPQQQQQPQQQRTPQNESNLIYDNPSTYNPNMYNFFSSK

SEQ ID NO: 14157 - protein, 326 aa, Candida albicans
LIPFFYILPIQNMEQELLLKGRKKDSIEQFISGSQLFLENGLSQLRYMVLVEGLSTPEGYDQCPYRSYVWSILCRVPPSPTEQYLQLLETSSQTLPDELLIKIKNDTFRTLMNDKKFHLKVNEESLIRILSCIGITTEVGYVQGLNVLLAPIAYVCHKSEPQAFAILHNLITKQIPLYITPNMEGVHTGLQLVDAILKIIDPVLSDYLHSKFLKAKIYAFPSILTLCACTPPLKSVLKLWDFLFAYGTHINVLFVVAQLIICRSSILESEQPMKILRTWPNLEENEIIKLSLSFIPELPEKLYDLIATHGYDRKVPKELARFLEEK

SEQ ID NO: 14158 - protein, 1255 aa, Candida albicans
IKTICIIITYKDNLSSLIMPPAYQSAFHKIISRDKGVFEGHNFLVSVDTINWIHVNTLTITEQGQLFSSDSKDNHYLLLQSLQSCFIQIYPDSNISGSGKSSISQPPPTTSTRRNLLRKSSNLNSSDQLHLKSSEDNEHQPPAILIKTFDNDKLYIRIPSKANFGNLLSCLMVWQNLKPQGLAKKWYCENKVIEGFNPNAPIYELLVCRFKIYGPLPNKYKNLNIVPGPKAPVYQQKMDDFKANFDNSYIITPQILSDNHNSINEGWFYAMGALNSHGILNFISELDGTLLYSIDIKQILSSEIREMHNSIFNSSNILFIGQLKELRYNNVIRTLSTLTPDQLLTPFLTRDGKIIPNNQRILIEFPLHIDLEDWFVGLNYFAKREYIGSFDNESKLIHNVEHPQLYDFSKANFRVSKKMSIDIIEAKFENTETNKLGKIYAEVRMWGFPWSRTAIVNHTNNPFWKEEFLTDLPISTQMVHILIKKCSFNDSSYSTGDKLIGTVYVTPDILTKQIKTTSTIMTSSESSQAIQMNTVPLSSMASNLNAGLDIVRLTINDPNNIPIGKLLLEVHLQEYHILSPLVFKPLEKMLVNAPMKDLIKFCNENVPSSDFERVSLVLLDIFQSLEVEDDWFKSLMEVELVNVDIMTRKNYHQRNSQDQAVSNSKTQQQSSHNNVFNTLFRGSSIFSKSLEKYNLRIGQEYLEKVFGDFFAKISNEKKNCEVDPRYVRIQERALRKGKSIHEATGLENGQNEDVSDDDDDDDDNSSDDDADYNAEKERERNERIKQMVEENFQNLYGYVEEIWYKIYITSNDLPDQIKLQLKNFRTKVELVCDPEDKVTSLNCLSAFIFLRFFCPAILNPKLFYLAKNHQTGSTQRTLTLIAKILLNFANRQEFSPHKEPHLVRMNVFLRKHTPEIYDYFDKLTGRKNDFNEKILDLSHEVKRFDLGLDKTSNELPTTPYLIDKYLRLTEIVHLLDYSKYVKNIGNNNNGSMSNLGTPVNSPSRDMEREQDRSRSRSQSGTPDLDPILNLSDLKLNYENKYQIGSLEFEKLEFLELTGDNETEGFIKSLCKGNEEIFSFINSNITLKDIQKQSTKIMNKIQELEIYLENYEFPNNYKDQIIWDSFTDDIMNKCWLDTSRNCLIYSDHVPSSNNQYKKLVDHAFSGLKLKFNDHQKLNGNSTMNSLINNGGMGNRNGHDVNGHNNNNNNNNNNTGDGYNETDRNQRLSSTFSTISIGSAIKPNTSKNPFKKWLRKN

SEQ ID NO: 14159 - protein, 133 aa, Candida albicans
KVKLIIQIIVNFRFSMNTLHHNEGLKMKKPRLHEITTIPIKQLHSQFDNTENATTKSTTVDEWLDIFPQAAIFTGFDDILFDYVITIVYRKHENISTKSITKFGVSTYENMQLTHRSRFWPSCENLELKYQKS

SEQ ID NO: 14160 - protein, 230 aa, Candida albicans
IMKYALVLLLSLINALKYVPFDKTQLDPSSVFEQFDYPSLNSSPWQVSTAKKFDEGRDEIVRYSGEWKIESSTSKYPGLEGDLGLVMKSRASHYAISYKLPHEVTNTNPNNNKTQDLVLQYEVKLQQGLTCGGAYIKLLDSSPSGYKFFNSETPYQIMFGPDVCGSENKIHFIIRKKLPNGAIEEKHLKHKPMARTNELTNLYTLIIKFNSDFEIRINGTVAKAGNLYKN

SEQ ID NO: 14161 - protein, 105 aa, Candida albicans
FFHCLYFCYIIHCSLGWIPLFLLWIRERSFKMNNILVPLDECDIESGVRDINDAEFDIPPHKRMHGINSGLLLHKRFFIYNSISLDCFLKNLITHLHNNKDTIYL

SEQ ID NO: 14162 - protein, 362 aa, Candida albicans
  UNSURE (353),(355),(357): Identity of amino acid sequences at the above locations are unknown.
VDLQSKVIYHRLEQLSYISLLEGRVGMATDSYRIGARYITIALRFAVGRRQFASAKGKEETKLIDYTLHQRRLLPFLAMTYAAALGTDRLERQHEELLANLDKALATKDKLLLKNTINGTKSMFVDSGSLKSTLTWFAADLINETRQACGGHGYSSYNGFGKSYDDWVVQCTYEGDNNVLAMSAGKTIIKTVQQVLNGKPLQDSTLEFLNDAPTLSKAKKAVIRIKEHVDDVDRVLKAVAGLISKFSSDLIAVSHQSWDSIGPQRVILSKLRCHYYLLETFNERLNDNIKAKSPARPHLENIVKLYYVTNILGPFIDEFLRFGVISPKVAKYITGEYPQRLRAITRPYIVSTXRXLXKIARA

SEQ ID NO: 14163 - protein, 65 aa, Candida albicans
YLAGSGTLGEDMQILEYNIRNLLQEVYFDKLKDIMLKDLRSIGDINDKKLDDLKQNAIIKGLQGL

SEQ ID NO: 14164 - protein, 408 aa, Candida albicans
  UNSURE (4),(16),(24),(50): Identity of amino acid sequences at the above locations are unknown.
QQPXKHHHLSMFLKNXFIALAIAXLVDDTPTTTKRSAGFVALDFSVVKTXKAFPVTNGQEGKTSKRQAVPVTLHNEQVTYAADITVGSNNQKLNVIVDTGSSDLWVPDVNVDCQVTYSDQTADFCKQKGTYDPSGSSASQDLNTPFKIGYGDGSSSQGTLYKDTVGFGGVSIKNQVLADVDSTSIDQGILGVGYKTNEAGGSYDNVPVTLKKQGVIAKNAYSLYLNSPDAATGQIIFGGVDNAKYSGSLIALPVTSDRELRISLGSVEVSGKTINTDNVDVLLDSGTTITYLQQDLADQIIKAFNGKLTQDSNGNSFYEVDCNLSGDVVFNFSKNAKISVPASEFAASLQGDDGQPYDKCQLLFDVNDANILGDNFLRSAYIVYDLDDNEISLAQVKYTSASSISALT

SEQ ID NO: 14165 - protein, 178 aa, Candida albicans
YVGPSGRLVKTDNAKYSGTLIALPVTSDNELRIHLNTVKVAGQSINADVDVLLDSGTTITYLQQGVADQVISAFNGQETYDANGNLFYLVDCNLSGSVDFAFDKNAKISVPASEFTAPLYTEDGQVYDQCQLLFGTSDYNILGDNFLRSAYIVYDLDDNEISLAQVKYTTASNIAALT

SEQ ID NO: 14166 - protein, 422 aa, Candida albicans
AQPTMFLKNILSVLAFALLIDAAPVKRSPGFVTLDFNVKRSLVDPDDPTVEAKRSPLFLEFTPSEFPVDETGRDGDVDKRGPVAVTLHNEAITYTADITVGSDNQKLNVIVDTGSSDLWIPDSNVICIPKWRGDKGDFCKSAGSYSPASSRTSQNLNTRFDIKYGDGSYAKGKLYKDTVGIGGVSVRDQLFANVWSTSARKGILGIGFQSGEATEFDYDNLPISLRNQGIIGKAAYSLYLNSAEASTGQIIFGGIDKAKYSGSLVDLPITSEKKLTVGLRSVNVRGRNVDANTNVLLDSGTTISYFTRSIVRNILYAIGAQMKFDSAGNKVYVADCKTSGTIDFQFGNNLKISVPVSEFLFQTYYTSGKPFPKCEVRIRESEDNILGDNFLRSAYVVYNLDDKKISMAPVKYTSESDIVAIN

SEQ ID NO: 14167 - protein, 350 aa, Candida albicans
KGWCGTKEDMLQLNWTMKLLLILLILLLVPITKSLALLCDTGSSDLWIPDSKAICIPKWRGDRGDFCKNNGSYSPAASSTSKNLNTRFEIKYADGSYAKGNLYQDTVGIGGASVKNQLFANVWSTSAHKGILGIGFQTNEATRTPYDNLPISLKKQGIIAKNAYSLFLNSPEASSGQIIFGGIDKAKYSGSLVELPITSDRTLSVGLRSVNVMGRNVNVNAGVLLDSGTTISYFTPSIARSIIYALGGQVHFDSAGNKAYVADCKTSGTVDFQFDRNLKISVPASEFLYQLYYTNGEPYPKCEIRVRESEDNILGDNFMRSAYIVYDLDDRKISMAQVKYTSQSNIVAIN

SEQ ID NO: 14168 - protein, 215 aa, Candida albicans
QNQLKMDVNQIIQLIFGNGILSGGSIQGTHSGNGHSVKYEVSLPSSSSQKGSNGPSSTDNKDTDPSKTGFSLDDLMNSIPTDFWNLIGLNKAPTSSDNGSKDADFTPSAVSQVEQPTSKSVESTAPGPASSASSSSSLEAASSSQPSEDSQPSSSANKKTGAFFLSLDNTQTLYTATLKVGSPAQEVQVMIDTGSSDLWFISSGNSQCNSQWRIN

SEQ ID NO: 14169 - protein, 223 aa, Candida albicans
SVSCLVKTRDAVQGYILFGGIDHAKYTGDLKAFDIVQSNDKYVYSQIPLTSVASSLNNYTNAYGLPAGSNHPKVGAVIYNGTDSFNGGVDLKDTPTLLDTGTTYSYLSKDQVESIVGLYGNVTYNDAGKAYEVPCWVGNPGNYLEFNFKNEQYIKVPTSEFVISVGTYASGAELCVFGILPGTHSILGDNFMRSVYAVFDLEDHVISIAQAAYNDNHAVVPIE

SEQ ID NO: 14170 - protein, 195 aa, Candida albicans
FHICSPMSRTKSTKVLIIGAGVSGLKAAETILSKSFLTGDDVLVVEAQNRIGGRLKTTDTSQSKLGINYDLGASWFHDSLNNIVLNHMINDGLLDDEKDVYFDDKDLKTFSSTGEVPIVDKKLNRVLEDIEKYIQLYFNRNLGVPDLSLRDIVAQYFEKYNRLITEEQREYCGKDDKVLEFWFGISWDRIMGNML

SEQ ID NO: 14171 - protein, 336 aa, Candida albicans
QTMDSPIHIGDLTTQSIQQKLFETHINNNNKNKTINNNCALLSTIYSSIYSGVKTIQLTMKLDSDKNNNNNNNNNDLKFDNKSHGEIIVLRRVQDSFVNVTQLFQILIKLEVLPTSQVDNYFDNEILSNLKYFGSSSNTPQYLDLRKHQNIYLQGIWIPYDKAVNLALKFDIYEITKKLFLVDVHDFDKLPKANKRLYEEDANSDSDILDSPSKKQKLDKKSKKDLLSNGKAITKKLIASSVSQNSNYPFTLPAVIIDNSNSEIANDIQIKLGNVSKRDEEKPDGISFENVKLAFADALSRYTPEKNIDIPLGLEGSTALLLASDINSLNLRVLPY

SEQ ID NO: 14172 - protein, 416 aa, Candida albicans
TLKQSLDQFSIENQLMFNNNHSFIKTIIHTNLEKVQTFQQLYTQRVNKLEHHMGRLLIKRQQALKELEYYKSRYQEECTQLRSLRLLLQTTWGRELEKNQLKFNKINSQINLTRKHYHMALVNYKEINEIYKRDWSISLNDFYKLEVERIQVTKINCFNYCNNIATLCVDQDLAVDLARPMFAQIQPITDLEEFSGNYGTGNKIFNDPEFVDYMTGCEEPRVGYTLLNFPNPDCSNILTRTYSTYTGNGNTSKQVEQKRSDDKLNDNIFTQPHAVQYDPNRVHAPIKEMSKLPIPKLPPTNNRTKTPSPTRKPPSDYHSNYSDDIFSKDERLQSSNGSSDYSSERNWASPRKREKQLQEVQEKISRRATNDFKNIPKIPEPEKVPVIKDFSIDFIAKALEDLNAGGIFTTGWKDHA

SEQ ID NO: 14173 - protein, 376 aa, Candida albicans
PTLSTFNNLINNSLKRDILSNVPFEVTMKILSYLDYKTLLSVAQVCKKWFDIINNPDTWIKLLKRDKLITDDAVIKYELQYPDQLLREWSTLPEINSAQVLYKKRKIIVNRWMDPKFKPHRISVSGHGNKVVTCLQHDDEKVVTGVDDKCILIYSTQTGQLMKVLEGHEGGVWALKYTGNTLVTGSTDRTVRVWNMKTGQCTHIFRGHTSTIRCLDIIHPAVIGKNQDGEDIVFPEYPLLITGSRDHNIHVWKLPVVDDLQDYIETFEGEFDNPYLIAVLSGHTQSVRSISGYGNIIISGSYDSTVRVWDLLDDGHCTHVLQGHLDRVYSTAIDFHSKTCFSGSMDSNINVWNFETGELTNVLVVHYSGPAAGRYR

SEQ ID NO: 14174 - protein, 70 aa, Candida albicans
RVVSGSEKMLKLWNVEKGTFARDLLSDVTGGIWQVRFDYKRCVAAVQRIINEDEGETFIEILDFSQPLLQ

SEQ ID NO: 14175 - protein, 216 aa, Candida albicans
  UNSURE (198): Identity of amino acid sequences at the above locations are unknown.
FRFILTHYMDKKSKLFKYPLSEETAKFEYRLLNPNGKLSDIWLHEEYQKLSLSAIDKVSQQPSAVTTAPSQPHRENSRKRNAGDDDVYDQKNMPSCDDTASSDTDCQSQVSSTAHLHSYRSNGLVEPPSKRRLTTTNETSLSSAGATTFQIESPGSISAITTNNSTTSAGDSNNSNSFSDQHSRHPRTPNVMNSPTHXPISDIEEDSIQQLPFTFT
